United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 36

SEQ ID NO: 1595875 - RNA, 19 nt, Human
ucagacauagaauuaacac

SEQ ID NO: 1595876 - RNA, 22 nt, Human
ucagacauagaauuaacacaug

SEQ ID NO: 1595877 - RNA, 15 nt, Human
uauuugagaguucua

SEQ ID NO: 1595878 - RNA, 16 nt, Human
uauuugagaguucuaa

SEQ ID NO: 1595879 - RNA, 18 nt, Human
uauuugagaguucuaaau

SEQ ID NO: 1595880 - RNA, 19 nt, Human
uauuugagaguucuaaauu

SEQ ID NO: 1595881 - RNA, 21 nt, Human
uauuucuaugaaauauuaugu

SEQ ID NO: 1595882 - RNA, 22 nt, Human
uauuucuaugaaauauuauguu

SEQ ID NO: 1595883 - RNA, 13 nt, Human
uauuuauuacugu

SEQ ID NO: 1595884 - RNA, 13 nt, Human
ucaaaacugcacu

SEQ ID NO: 1595885 - RNA, 13 nt, Human
ucaaugcagcccc

SEQ ID NO: 1595886 - RNA, 19 nt, Human
ucacaggaaguagaggagg

SEQ ID NO: 1595887 - RNA, 23 nt, Human
ucacaggacagcccuucuuucca

SEQ ID NO: 1595888 - RNA, 19 nt, Human
ucaacuccaaacugacucu

SEQ ID NO: 1595889 - RNA, 13 nt, Human
ucuaaauuugaau

SEQ ID NO: 1595890 - RNA, 17 nt, Human
ucuaaauuugaauguua

SEQ ID NO: 1595891 - RNA, 19 nt, Human
ucuaacaaaaaaauauauu

SEQ ID NO: 1595892 - RNA, 22 nt, Human
ucuaaauuugaauguuaagcag

SEQ ID NO: 1595893 - RNA, 23 nt, Human
ucuaaauuugaauguuaagcaga

SEQ ID NO: 1595894 - RNA, 18 nt, Human
ucuaaauuuuauaucuug

SEQ ID NO: 1595895 - RNA, 23 nt, Human
ucuaaauuuuauaucuuguagcu

SEQ ID NO: 1595896 - RNA, 21 nt, Human
ucuacacuaagagagaaugag

SEQ ID NO: 1595897 - RNA, 17 nt, Human
ucuacacuccagugaga

SEQ ID NO: 1595898 - RNA, 21 nt, Human
ucucaaauuuggauugcuaau

SEQ ID NO: 1595899 - RNA, 15 nt, Human
ucuaguaugaaauua

SEQ ID NO: 1595900 - RNA, 17 nt, Human
ucuaguaugaaauuaua

SEQ ID NO: 1595901 - RNA, 15 nt, Human
ucucaacuccaaacu

SEQ ID NO: 1595902 - RNA, 20 nt, Human
uccuucugugaaaguacauu

SEQ ID NO: 1595903 - RNA, 15 nt, Human
uccuugcaucaauuu

SEQ ID NO: 1595904 - RNA, 18 nt, Human
ucucuucacagucacauu

SEQ ID NO: 1595905 - RNA, 19 nt, Human
ucuccugggcagcugccuc

SEQ ID NO: 1595906 - RNA, 20 nt, Human
ucuccugggcagcugccucc

SEQ ID NO: 1595907 - RNA, 21 nt, Human
ucuccugggcagcugccuccc

SEQ ID NO: 1595908 - RNA, 19 nt, Human
ucucuaggaaauauuuauu

SEQ ID NO: 1595909 - RNA, 13 nt, Human
ucucuaggaaaua

SEQ ID NO: 1595910 - RNA, 13 nt, Human
ucuccugggcagc

SEQ ID NO: 1595911 - RNA, 14 nt, Human
ucuccugggcagcu

SEQ ID NO: 1595912 - RNA, 15 nt, Human
ucuccugggcagcug

SEQ ID NO: 1595913 - RNA, 16 nt, Human
ucuccugggcagcugc

SEQ ID NO: 1595914 - RNA, 17 nt, Human
ucuccugggcagcugcc

SEQ ID NO: 1595915 - RNA, 18 nt, Human
ucuccugggcagcugccu

SEQ ID NO: 1595916 - RNA, 21 nt, Human
ucucagugucaaugcagcccc

SEQ ID NO: 1595917 - RNA, 22 nt, Human
ugaacuuguaaaggaauuuaaa

SEQ ID NO: 1595918 - RNA, 22 nt, Human
ugaaguccaagcauuuagaugu

SEQ ID NO: 1595919 - RNA, 21 nt, Human
ugaaguccaagcauuuagaug

SEQ ID NO: 1595920 - RNA, 17 nt, Human
ugaagauguagaggaga

SEQ ID NO: 1595921 - RNA, 14 nt, Human
ugaacacaucagcu

SEQ ID NO: 1595922 - RNA, 19 nt, Human
ugaaauggacuuuuguaca

SEQ ID NO: 1595923 - RNA, 22 nt, Human
ugaaaagacuccaaagaaaugu

SEQ ID NO: 1595924 - RNA, 23 nt, Human
ugaaagcagggacuugaacccau

SEQ ID NO: 1595925 - RNA, 19 nt, Human
ugaaagcagggacuugaac

SEQ ID NO: 1595926 - RNA, 18 nt, Human
ugaaagcagggacuugaa

SEQ ID NO: 1595927 - RNA, 19 nt, Human
ugaaaagacuccaaagaaa

SEQ ID NO: 1595928 - RNA, 17 nt, Human
ugaaaagacuccaaaga

SEQ ID NO: 1595929 - RNA, 16 nt, Human
ugaaaagacuccaaag

SEQ ID NO: 1595930 - RNA, 15 nt, Human
ugaaaagacuccaaa

SEQ ID NO: 1595931 - RNA, 19 nt, Human
ugaaaacuuuaugcuaagu

SEQ ID NO: 1595932 - RNA, 17 nt, Human
ucuuucacauuuaaaua

SEQ ID NO: 1595933 - RNA, 22 nt, Human
ucuguuuuauaauuuugugaag

SEQ ID NO: 1595934 - RNA, 23 nt, Human
ugcuagguuaauuccaauuauau

SEQ ID NO: 1595935 - RNA, 16 nt, Human
ugcuagguuaauucca

SEQ ID NO: 1595936 - RNA, 11 nt, Human
ugcucauggaa

SEQ ID NO: 1595937 - RNA, 21 nt, Human
ugcuagaacucccuuucaaca

SEQ ID NO: 1595938 - RNA, 20 nt, Human
ugcuagaacucccuuucaac

SEQ ID NO: 1595939 - RNA, 19 nt, Human
ugcuagaacucccuuucaa

SEQ ID NO: 1595940 - RNA, 17 nt, Human
ugcugaaacaacaaaua

SEQ ID NO: 1595941 - RNA, 18 nt, Human
ugccuccccuccucugcu

SEQ ID NO: 1595942 - RNA, 23 nt, Human
ugccuccccuccucugcuugcca

SEQ ID NO: 1595943 - RNA, 19 nt, Human
ugccuccccuccucugcuu

SEQ ID NO: 1595944 - RNA, 22 nt, Human
ugccuccccuccucugcuugcc

SEQ ID NO: 1595945 - RNA, 22 nt, Human
ugccuucucaacuccaaacuga

SEQ ID NO: 1595946 - RNA, 15 nt, Human
ugccaucccucccuc

SEQ ID NO: 1595947 - RNA, 19 nt, Human
ugccaucccucccuccacc

SEQ ID NO: 1595948 - RNA, 20 nt, Human
ugccaucccucccuccaccu

SEQ ID NO: 1595949 - RNA, 21 nt, Human
ugccaucccucccuccaccuc

SEQ ID NO: 1595950 - RNA, 22 nt, Human
ugccaucccucccuccaccucc

SEQ ID NO: 1595951 - RNA, 22 nt, Human
ugcaucagcugcugaaacaaca

SEQ ID NO: 1595952 - RNA, 21 nt, Human
ugcauuauauuuauuacugua

SEQ ID NO: 1595953 - RNA, 20 nt, Human
ugcauuauauuuauuacugu

SEQ ID NO: 1595954 - RNA, 15 nt, Human
ugcauuauauuuauu

SEQ ID NO: 1595955 - RNA, 17 nt, Human
ugcagauaaacaguagu

SEQ ID NO: 1595956 - RNA, 16 nt, Human
ugcagauaaacaguag

SEQ ID NO: 1595957 - RNA, 15 nt, Human
ugcacaucaaaauau

SEQ ID NO: 1595958 - RNA, 15 nt, Human
uggagcaaagcugau

SEQ ID NO: 1595959 - RNA, 14 nt, Human
ugcuucuguuuuau

SEQ ID NO: 1595960 - RNA, 14 nt, Human
uggaacucucgagc

SEQ ID NO: 1595961 - RNA, 16 nt, Human
uggguagacacacaug

SEQ ID NO: 1595962 - RNA, 17 nt, Human
uggguagacacacauga

SEQ ID NO: 1595963 - RNA, 18 nt, Human
uggccuucggccuccauc

SEQ ID NO: 1595964 - RNA, 17 nt, Human
uggccuucggccuccau

SEQ ID NO: 1595965 - RNA, 20 nt, Human
uggccuucggccuccauccu

SEQ ID NO: 1595966 - RNA, 21 nt, Human
ugggacagucaccucauggaa

SEQ ID NO: 1595967 - RNA, 20 nt, Human
ugggacagucaccucaugga

SEQ ID NO: 1595968 - RNA, 18 nt, Human
ugggacagucaccucaug

SEQ ID NO: 1595969 - RNA, 20 nt, Human
ugggacauuugcucauggaa

SEQ ID NO: 1595970 - RNA, 19 nt, Human
ugggacauuugcucaugga

SEQ ID NO: 1595971 - RNA, 12 nt, Human
uguuuuaaaaaa

SEQ ID NO: 1595972 - RNA, 20 nt, Human
uuaaagcuuauuaaaacuca

SEQ ID NO: 1595973 - RNA, 19 nt, Human
uuaaaagaaugauuaugaa

SEQ ID NO: 1595974 - RNA, 18 nt, Human
uuaauaauguuucaaaca

SEQ ID NO: 1595975 - RNA, 21 nt, Human
uuaccacuuguguuuugcaag

SEQ ID NO: 1595976 - RNA, 15 nt, Human
uuacauuuguauaaa

SEQ ID NO: 1595977 - RNA, 14 nt, Human
uuacauuuguauaa

SEQ ID NO: 1595978 - RNA, 13 nt, Human
uguuuaaaaucau

SEQ ID NO: 1595979 - RNA, 14 nt, Human
uguuuaaaaucauu

SEQ ID NO: 1595980 - RNA, 21 nt, Human
uguuggagaagaacugaaauc

SEQ ID NO: 1595981 - RNA, 16 nt, Human
uguucacagccagacu

SEQ ID NO: 1595982 - RNA, 12 nt, Human
uguuauaaucuu

SEQ ID NO: 1595983 - RNA, 17 nt, Human
uguagcacugacagauu

SEQ ID NO: 1595984 - RNA, 22 nt, Human
uguagcacugacagauuuccau

SEQ ID NO: 1595985 - RNA, 16 nt, Human
uguagcacugacagau

SEQ ID NO: 1595986 - RNA, 15 nt, Human
uguaaucacagcuac

SEQ ID NO: 1595987 - RNA, 15 nt, Human
uguaccgcaauguga

SEQ ID NO: 1595988 - RNA, 17 nt, Human
uguagauaauacaguuc

SEQ ID NO: 1595989 - RNA, 20 nt, Human
ugugaaguuuacauuguaaa

SEQ ID NO: 1595990 - RNA, 14 nt, Human
ugugaaguuuacau

SEQ ID NO: 1595991 - RNA, 22 nt, Human
ugucucaguccaugaagaugua

SEQ ID NO: 1595992 - RNA, 21 nt, Human
ugucucaguccaugaagaugu

SEQ ID NO: 1595993 - RNA, 22 nt, Human
ugugaccacugcagaagacagu

SEQ ID NO: 1595994 - RNA, 21 nt, Human
uugaaucucauaauuuauaca

SEQ ID NO: 1595995 - RNA, 15 nt, Human
uugaaucucauaauu

SEQ ID NO: 1595996 - RNA, 23 nt, Human
uugaaaagacuccaaagaaaugu

SEQ ID NO: 1595997 - RNA, 22 nt, Human
uugaaaagacuccaaagaaaug

SEQ ID NO: 1595998 - RNA, 18 nt, Human
uugaaaagacuccaaaga

SEQ ID NO: 1595999 - RNA, 23 nt, Human
uugaaacugagaugugaacacau

SEQ ID NO: 1596000 - RNA, 15 nt, Human
uucuuauuucauuuc

SEQ ID NO: 1596001 - RNA, 15 nt, Human
uucugagaaagacua

SEQ ID NO: 1596002 - RNA, 14 nt, Human
uucugagcauuuaa

SEQ ID NO: 1596003 - RNA, 18 nt, Human
uugcauagauucccugag

SEQ ID NO: 1596004 - RNA, 13 nt, Human
uugaugaagaagu

SEQ ID NO: 1596005 - RNA, 12 nt, Human
uugaugaagaag

SEQ ID NO: 1596006 - RNA, 15 nt, Human
uugaggacacugaua

SEQ ID NO: 1596007 - RNA, 14 nt, Human
uugaggacacugau

SEQ ID NO: 1596008 - RNA, 19 nt, Human
uuguaucacaaaucuuaac

SEQ ID NO: 1596009 - RNA, 18 nt, Human
uuguaaaugugcuuuuaa

SEQ ID NO: 1596010 - RNA, 14 nt, Human
uuguaaaugugcuu

SEQ ID NO: 1596011 - RNA, 11 nt, Human
uuguaaaugug

SEQ ID NO: 1596012 - RNA, 16 nt, Human
uuguaaaggaauuuaa

SEQ ID NO: 1596013 - RNA, 12 nt, Human
uugggaggcuga

SEQ ID NO: 1596014 - RNA, 21 nt, Human
uuccauccuagucacuaccuu

SEQ ID NO: 1596015 - RNA, 19 nt, Human
uuccacuuauaggaauuga

SEQ ID NO: 1596016 - RNA, 20 nt, Human
uucaucugacuaugacauaa

SEQ ID NO: 1596017 - RNA, 17 nt, Human
uucaucugacuaugaca

SEQ ID NO: 1596018 - RNA, 22 nt, Human
uucagagcugcccucuccuggg

SEQ ID NO: 1596019 - RNA, 23 nt, Human
uucagagcugcccucuccugggc

SEQ ID NO: 1596020 - RNA, 17 nt, Human
uuccuucugugaaagua

SEQ ID NO: 1596021 - RNA, 20 nt, Human
uuccuucugugaaaguacau

SEQ ID NO: 1596022 - RNA, 19 nt, Human
uucggccuccauccugagg

SEQ ID NO: 1596023 - RNA, 18 nt, Human
uucggccuccauccugag

SEQ ID NO: 1596024 - RNA, 22 nt, Human
uucggccuccauccugaggcuc

SEQ ID NO: 1596025 - RNA, 12 nt, Human
uuccuagugaaa

SEQ ID NO: 1596026 - RNA, 23 nt, Human
uucucuccucuccccaugauguu

SEQ ID NO: 1596027 - RNA, 13 nt, Human
uuuacauuguaaa

SEQ ID NO: 1596028 - RNA, 20 nt, Human
uuuacauuguaaauaguauu

SEQ ID NO: 1596029 - RNA, 15 nt, Human
uuuacauuguaaaua

SEQ ID NO: 1596030 - RNA, 12 nt, Human
uuuagaaacaca

SEQ ID NO: 1596031 - RNA, 20 nt, Human
uuuagaaacacaacuauauu

SEQ ID NO: 1596032 - RNA, 22 nt, Human
uuuauuguuuaaaaucauuucu

SEQ ID NO: 1596033 - RNA, 14 nt, Human
uuuccaaaauaauu

SEQ ID NO: 1596034 - RNA, 21 nt, Human
uuucagauaaucacaauacau

SEQ ID NO: 1596035 - RNA, 15 nt, Human
uuucagcagcugcag

SEQ ID NO: 1596036 - RNA, 15 nt, Human
uuucagauaaucaca

SEQ ID NO: 1596037 - RNA, 22 nt, Human
uuuccucaaaacuucagacaua

SEQ ID NO: 1596038 - RNA, 22 nt, Human
uuucugagaaagacuauucaaa

SEQ ID NO: 1596039 - RNA, 22 nt, Human
uuuucagaaaauauuauguguu

SEQ ID NO: 1596040 - RNA, 16 nt, Human
uuuucagaaaauauua

SEQ ID NO: 1596041 - RNA, 13 nt, Human
uuuuccugaaaac

SEQ ID NO: 1596042 - RNA, 15 nt, Human
uuuucagaaaauauu

SEQ ID NO: 1596043 - RNA, 16 nt, Human
uuuucacauaucuagu

SEQ ID NO: 1596044 - RNA, 13 nt, Human
uuuucacauaucu

SEQ ID NO: 1596045 - RNA, 10 nt, Human
uuuuauauuu

SEQ ID NO: 1596046 - RNA, 20 nt, Human
uuuuauaucaauuuaaaaaa

SEQ ID NO: 1596047 - RNA, 20 nt, Human
uuuuauaugcuucuguuuua

SEQ ID NO: 1596048 - RNA, 15 nt, Human
uuuuauaugcuucug

SEQ ID NO: 1596049 - RNA, 16 nt, Human
uuuguucauacauauu

SEQ ID NO: 1596050 - RNA, 13 nt, Human
uuuguucauacau

SEQ ID NO: 1596051 - RNA, 21 nt, Human
uuuguauaaaauaauuuuuau

SEQ ID NO: 1596052 - RNA, 23 nt, Human
uuuggaacaagaugguucuagca

SEQ ID NO: 1596053 - RNA, 21 nt, Human
uuugcauagauucccugagca

SEQ ID NO: 1596054 - RNA, 18 nt, Human
gccugcaauuucauaugc

SEQ ID NO: 1596055 - RNA, 20 nt, Human
gaauucauucacucaacaaa

SEQ ID NO: 1596056 - RNA, 15 nt, Human
ggaaaaaauaacaau

SEQ ID NO: 1596057 - RNA, 20 nt, Human
gcuagaacucccuuucaaca

SEQ ID NO: 1596058 - RNA, 14 nt, Human
uagcacugacagau

SEQ ID NO: 1596059 - RNA, 14 nt, Human
uauuuuugacagaa

SEQ ID NO: 1596060 - RNA, 13 nt, Human
uauuuuuuaaaaa

SEQ ID NO: 1596061 - RNA, 16 nt, Human
acuaguauuucuauga

SEQ ID NO: 1596062 - RNA, 15 nt, Human
uuuaaaaaaucucaa

SEQ ID NO: 1596063 - RNA, 18 nt, Human
uuuccaaaauaauuuuaa

SEQ ID NO: 1596064 - RNA, 16 nt, Human
ugcuuuggucauauga

SEQ ID NO: 1596065 - RNA, 16 nt, Human
cuaaauuugaauguua

SEQ ID NO: 1596066 - RNA, 22 nt, Human
uuaacaucucagaaaacucugg

SEQ ID NO: 1596067 - RNA, 21 nt, Human
uauuuuauaucaauuuaaaaa

SEQ ID NO: 1596068 - RNA, 22 nt, Human
uaaaacuuauccuccaugaaua

SEQ ID NO: 1596069 - RNA, 18 nt, Human
uaaauugacacuuaaaaa

SEQ ID NO: 1596070 - RNA, 17 nt, Human
guuauuauauuuacaaa

SEQ ID NO: 1596071 - RNA, 16 nt, Human
gaaauuguauuacaaa

SEQ ID NO: 1596072 - RNA, 13 nt, Human
aaaacucugguaa

SEQ ID NO: 1596073 - RNA, 18 nt, Human
ucuaaauuugaauguuaa

SEQ ID NO: 1596074 - RNA, 18 nt, Human
gugaaagaaaauaacaau

SEQ ID NO: 1596075 - RNA, 19 nt, Human
aaauauugacuuuuuaugg

SEQ ID NO: 1596076 - RNA, 21 nt, Human
caaagaugaucaguaugaaaa

SEQ ID NO: 1596077 - RNA, 13 nt, Human
cagugaaagaaaa

SEQ ID NO: 1596078 - RNA, 16 nt, Human
cagaaaguuauugaua

SEQ ID NO: 1596079 - RNA, 22 nt, Human
cagcaguucagagcugcccucu

SEQ ID NO: 1596080 - RNA, 21 nt, Human
cacaugaacuuguaaaggaau

SEQ ID NO: 1596081 - RNA, 21 nt, Human
cagcugccuccccuccucugc

SEQ ID NO: 1596082 - RNA, 16 nt, Human
ccugugguuaacaucu

SEQ ID NO: 1596083 - RNA, 13 nt, Human
cucaaaaugucua

SEQ ID NO: 1596084 - RNA, 14 nt, Human coronavirus 229E
gucaacagcugcua

SEQ ID NO: 1596085 - RNA, 12 nt, Human coronavirus 229E
gcaucuuuuaac

SEQ ID NO: 1596086 - RNA, 21 nt, Human coronavirus 229E
caagacgugaaagauggcacu

SEQ ID NO: 1596087 - RNA, 17 nt, Human coronavirus 229E
aauguuacauuggacaa

SEQ ID NO: 1596088 - RNA, 22 nt, Human coronavirus 229E
agaguccugcuucuucucaaac

SEQ ID NO: 1596089 - RNA, 19 nt, Human coronavirus 229E
aacuucaccugcaacugcu

SEQ ID NO: 1596090 - RNA, 14 nt, Human coronavirus 229E
acuacgucugcuuu

SEQ ID NO: 1596091 - RNA, 21 nt, Human coronavirus 229E
cuucaguuuggacacuauaaa

SEQ ID NO: 1596092 - RNA, 17 nt, Human coronavirus 229E
aucucgcauaauguuug

SEQ ID NO: 1596093 - RNA, 17 nt, Human coronavirus 229E
uacaaccucaauuuuga

SEQ ID NO: 1596094 - RNA, 19 nt, Human coronavirus 229E
uguuuuaugguuugaagau

SEQ ID NO: 1596095 - RNA, 21 nt, Human coronavirus 229E
uuacgcaacuuugauugcugu

SEQ ID NO: 1596096 - RNA, 17 nt, Human coronavirus 229E
ucucugaucuauguaug

SEQ ID NO: 1596097 - RNA, 12 nt, Human coronavirus 229E
ccuuuguugcuu

SEQ ID NO: 1596098 - RNA, 12 nt, Human coronavirus 229E
ucuauaauugcu

SEQ ID NO: 1596099 - RNA, 15 nt, Human coronavirus 229E
cagaguccugcuucu

SEQ ID NO: 1596100 - RNA, 19 nt, Human coronavirus 229E
cucucccaugagcaacaug

SEQ ID NO: 1596101 - RNA, 17 nt, Human coronavirus 229E
caauuuuaaugaaacua

SEQ ID NO: 1596102 - RNA, 19 nt, Human coronavirus 229E
gacgugaaagauggcacug

SEQ ID NO: 1596103 - RNA, 19 nt, Human coronavirus 229E
aaagcucccaaaugguguu

SEQ ID NO: 1596104 - RNA, 17 nt, Human coronavirus 229E
ugcaaugucacauuugu

SEQ ID NO: 1596105 - RNA, 18 nt, Human coronavirus 229E
uuuaaauuauguugcauu

SEQ ID NO: 1596106 - RNA, 19 nt, Human coronavirus 229E
gaacugccgaaauuuuucu

SEQ ID NO: 1596107 - RNA, 15 nt, Human coronavirus 229E
acuaaacaugccacu

SEQ ID NO: 1596108 - RNA, 12 nt, Human coronavirus 229E
acacccagcugu

SEQ ID NO: 1596109 - RNA, 19 nt, Human coronavirus 229E
aggcuggagucugcagaug

SEQ ID NO: 1596110 - RNA, 17 nt, Human coronavirus 229E
cacauuguuuccaaaga

SEQ ID NO: 1596111 - RNA, 21 nt, Human coronavirus 229E
uguuauccugcugguguuaau

SEQ ID NO: 1596112 - RNA, 15 nt, Human coronavirus 229E
cacuuugcuaugcaa

SEQ ID NO: 1596113 - RNA, 22 nt, Human coronavirus 229E
cuugcuuugucaaucuuugaca

SEQ ID NO: 1596114 - RNA, 20 nt, Human coronavirus 229E
uaguuguuuugcaucuucua

SEQ ID NO: 1596115 - RNA, 17 nt, Human coronavirus 229E
uggugcuuauagugaua

SEQ ID NO: 1596116 - RNA, 21 nt, Human coronavirus 229E
agauugcuucauuuuuucuaa

SEQ ID NO: 1596117 - RNA, 14 nt, Human coronavirus 229E
uagaugccuuuacu

SEQ ID NO: 1596118 - RNA, 21 nt, Human coronavirus 229E
guaaagguuuuuccucagaug

SEQ ID NO: 1596119 - RNA, 18 nt, Human coronavirus 229E
ggaucaauuccuuuacau

SEQ ID NO: 1596120 - RNA, 16 nt, Human coronavirus 229E
ugagacuuacaucaag

SEQ ID NO: 1596121 - RNA, 22 nt, Human coronavirus 229E
aggaugacaucaugaaggcagu

SEQ ID NO: 1596122 - RNA, 19 nt, Human coronavirus 229E
ucauaaacauacguuuauu

SEQ ID NO: 1596123 - RNA, 15 nt, Human coronavirus 229E
uucuauaauugcugu

SEQ ID NO: 1596124 - RNA, 22 nt, Human coronavirus 229E
cuagaauucaacccaucucaaa

SEQ ID NO: 1596125 - RNA, 19 nt, Human coronavirus 229E
auucuucaguuuggacacu

SEQ ID NO: 1596126 - RNA, 17 nt, Human coronavirus 229E
guuguucuacugguugc

SEQ ID NO: 1596127 - RNA, 17 nt, Human coronavirus 229E
gaaaaagauaaaaaguc

SEQ ID NO: 1596128 - RNA, 12 nt, Human coronavirus 229E
accuucuggguu

SEQ ID NO: 1596129 - RNA, 13 nt, Human coronavirus 229E
uucacauugcaac

SEQ ID NO: 1596130 - RNA, 20 nt, Human coronavirus 229E
gagccaacaauggaagagcc

SEQ ID NO: 1596131 - RNA, 19 nt, Human coronavirus 229E
uugccaaauuacacuguuc

SEQ ID NO: 1596132 - RNA, 16 nt, Human coronavirus 229E
gaccagugaaauuagc

SEQ ID NO: 1596133 - RNA, 15 nt, Human coronavirus 229E
cuguggaaauggcac

SEQ ID NO: 1596134 - RNA, 19 nt, Human coronavirus 229E
gcuuaauuacacuguucaa

SEQ ID NO: 1596135 - RNA, 23 nt, Human coronavirus 229E
uuguaacccaccagaucagcuug

SEQ ID NO: 1596136 - RNA, 21 nt, Human coronavirus 229E
cuacugcagaaaccacugauu

SEQ ID NO: 1596137 - RNA, 20 nt, Human coronavirus 229E
aguuaaaugcauucacuaga

SEQ ID NO: 1596138 - RNA, 16 nt, Human coronavirus 229E
cauuguuuccaaagag

SEQ ID NO: 1596139 - RNA, 14 nt, Human coronavirus 229E
guugagcuaccugu

SEQ ID NO: 1596140 - RNA, 19 nt, Human coronavirus 229E
gauccaggauguuguuaau

SEQ ID NO: 1596141 - RNA, 20 nt, Human coronavirus 229E
cuguuaccuucaacuugcua

SEQ ID NO: 1596142 - RNA, 15 nt, Human coronavirus 229E
cauauguuuuguaau

SEQ ID NO: 1596143 - RNA, 13 nt, Human coronavirus 229E
ucagaacuagaaa

SEQ ID NO: 1596144 - RNA, 13 nt, Human coronavirus 229E
ucacgacagguua

SEQ ID NO: 1596145 - RNA, 13 nt, Human coronavirus 229E
cuuguuuugugaa

SEQ ID NO: 1596146 - RNA, 16 nt, Human coronavirus 229E
cuaaacaugccacugu

SEQ ID NO: 1596147 - RNA, 16 nt, Human coronavirus 229E
guuuguucacauugca

SEQ ID NO: 1596148 - RNA, 13 nt, Human coronavirus 229E
ccacuuauguuug

SEQ ID NO: 1596149 - RNA, 23 nt, Human coronavirus 229E
agaguucugaaacaaaagaacaa

SEQ ID NO: 1596150 - RNA, 17 nt, Human coronavirus 229E
gcaacucuguuauuaac

SEQ ID NO: 1596151 - RNA, 18 nt, Human coronavirus 229E
auuagagguuguugugaa

SEQ ID NO: 1596152 - RNA, 15 nt, Human coronavirus 229E
gucaaucuuugacac

SEQ ID NO: 1596153 - RNA, 14 nt, Human coronavirus 229E
augauaguguuuca

SEQ ID NO: 1596154 - RNA, 14 nt, Human coronavirus 229E
caggcauuacugug

SEQ ID NO: 1596155 - RNA, 18 nt, Human coronavirus 229E
caaacuuguuacuucugg

SEQ ID NO: 1596156 - RNA, 18 nt, Human coronavirus 229E
agaauuggaauuuugguu

SEQ ID NO: 1596157 - RNA, 13 nt, Human coronavirus 229E
ugacaucaugaag

SEQ ID NO: 1596158 - RNA, 20 nt, Human coronavirus 229E
gcuaucucuagcucuauuca

SEQ ID NO: 1596159 - RNA, 17 nt, Human coronavirus 229E
uucaaaaacguuucaga

SEQ ID NO: 1596160 - RNA, 12 nt, Human coronavirus 229E
gguuugaagaug

SEQ ID NO: 1596161 - RNA, 13 nt, Human coronavirus 229E
aauaacuuuguua

SEQ ID NO: 1596162 - RNA, 14 nt, Human coronavirus 229E
cugcugguguuaau

SEQ ID NO: 1596163 - RNA, 17 nt, Human coronavirus 229E
cacugcuggcucuacaa

SEQ ID NO: 1596164 - RNA, 22 nt, Human coronavirus 229E
accuaucguaguugauugcucc

SEQ ID NO: 1596165 - RNA, 17 nt, Human coronavirus 229E
ccacguaauguuucaua

SEQ ID NO: 1596166 - RNA, 18 nt, Human coronavirus 229E
auggcacuuauaauugca

SEQ ID NO: 1596167 - RNA, 12 nt, Human coronavirus 229E
cguuucagaacu

SEQ ID NO: 1596168 - RNA, 13 nt, Human coronavirus 229E
acgcagacuacaa

SEQ ID NO: 1596169 - RNA, 21 nt, Human coronavirus 229E
uugcuccacuuauguuugcaa

SEQ ID NO: 1596170 - RNA, 16 nt, Human coronavirus 229E
cagagauaccacacuu

SEQ ID NO: 1596171 - RNA, 14 nt, Human coronavirus 229E
caguauacuucugc

SEQ ID NO: 1596172 - RNA, 20 nt, Human coronavirus 229E
ugaaacugacauaauugaug

SEQ ID NO: 1596173 - RNA, 20 nt, Human coronavirus 229E
caauguuuuggccccagaga

SEQ ID NO: 1596174 - RNA, 21 nt, Human coronavirus 229E
uucaauguaaccacacuuugc

SEQ ID NO: 1596175 - RNA, 14 nt, Human coronavirus 229E
uucauuguuauucu

SEQ ID NO: 1596176 - RNA, 19 nt, Human coronavirus 229E
auuacugugaccuugcuga

SEQ ID NO: 1596177 - RNA, 22 nt, Human coronavirus 229E
agaaauuugcuacuauguuacu

SEQ ID NO: 1596178 - RNA, 15 nt, Human coronavirus 229E
agcuuggcacugcug

SEQ ID NO: 1596179 - RNA, 19 nt, Human coronavirus 229E
auuuagagagcguguugaa

SEQ ID NO: 1596180 - RNA, 17 nt, Human coronavirus 229E
ugucgcuaccuguuuau

SEQ ID NO: 1596181 - RNA, 16 nt, Human coronavirus 229E
ugaaucaacuaaacuu

SEQ ID NO: 1596182 - RNA, 15 nt, Human coronavirus 229E
acugaacgaaaagau

SEQ ID NO: 1596183 - RNA, 19 nt, Human coronavirus 229E
uaguuuuggugacuacaac

SEQ ID NO: 1596184 - RNA, 20 nt, Human coronavirus 229E
gccacucguacuugcuuugu

SEQ ID NO: 1596185 - RNA, 17 nt, Human coronavirus 229E
aagcaugaaaugcaaaa

SEQ ID NO: 1596186 - RNA, 20 nt, Human coronavirus 229E
gagcacuacuauaauuuaua

SEQ ID NO: 1596187 - RNA, 21 nt, Human coronavirus 229E
aucaacacucguuaugugggu

SEQ ID NO: 1596188 - RNA, 22 nt, Human coronavirus 229E
ugcuucauuuuuucuaaacuga

SEQ ID NO: 1596189 - RNA, 19 nt, Human coronavirus 229E
ugucacauuuguuaacauu

SEQ ID NO: 1596190 - RNA, 16 nt, Human coronavirus 229E
aaugucaaaugacaau

SEQ ID NO: 1596191 - RNA, 13 nt, Human coronavirus 229E
acagcuuggcacu

SEQ ID NO: 1596192 - RNA, 17 nt, Human coronavirus 229E
ugcacagacgcuguuuu

SEQ ID NO: 1596193 - RNA, 14 nt, Human coronavirus 229E
uuaauuacacuguu

SEQ ID NO: 1596194 - RNA, 14 nt, Human coronavirus 229E
agcaugaaaugcaa

SEQ ID NO: 1596195 - RNA, 23 nt, Human coronavirus 229E
augcauucacuagagaaaugcaa

SEQ ID NO: 1596196 - RNA, 13 nt, Human coronavirus 229E
uucgauauggaua

SEQ ID NO: 1596197 - RNA, 16 nt, Human coronavirus 229E
aguuuguuauuucacg

SEQ ID NO: 1596198 - RNA, 14 nt, Human coronavirus 229E
acaucuaaugucac

SEQ ID NO: 1596199 - RNA, 18 nt, Human coronavirus 229E
acuugugucugcuguuaa

SEQ ID NO: 1596200 - RNA, 13 nt, Human coronavirus 229E
aaccucuauugcu

SEQ ID NO: 1596201 - RNA, 20 nt, Human coronavirus 229E
ccuaucguaguugauugcuc

SEQ ID NO: 1596202 - RNA, 13 nt, Human coronavirus 229E
cuaccuguuuauc

SEQ ID NO: 1596203 - RNA, 16 nt, Human coronavirus 229E
cacaaugguaagccag

SEQ ID NO: 1596204 - RNA, 21 nt, Human coronavirus 229E
guugagcuaccugugucuauu

SEQ ID NO: 1596205 - RNA, 23 nt, Human coronavirus 229E
uguaaccacacuuugcuaugcaa

SEQ ID NO: 1596206 - RNA, 11 nt, Human coronavirus 229E
uuacugugacc

SEQ ID NO: 1596207 - RNA, 16 nt, Human coronavirus 229E
ucuuauacacaauggu

SEQ ID NO: 1596208 - RNA, 15 nt, Human coronavirus 229E
cugcuuugaauguau

SEQ ID NO: 1596209 - RNA, 13 nt, Human coronavirus 229E
uuugcuuguugau

SEQ ID NO: 1596210 - RNA, 23 nt, Human coronavirus 229E
uacaaauugccaaauuacacugu

SEQ ID NO: 1596211 - RNA, 14 nt, Human coronavirus 229E
aagaacaaaagcau

SEQ ID NO: 1596212 - RNA, 22 nt, Human coronavirus 229E
ugcucuuuacaaagaaggcaau

SEQ ID NO: 1596213 - RNA, 14 nt, Human coronavirus 229E
ucaauuuugaagaa

SEQ ID NO: 1596214 - RNA, 18 nt, Human coronavirus 229E
agcaaugcgaaaguuagu

SEQ ID NO: 1596215 - RNA, 13 nt, Human coronavirus 229E
uugaaaagaucca

SEQ ID NO: 1596216 - RNA, 22 nt, Human coronavirus 229E
aacucauugaaccauuuaacuu

SEQ ID NO: 1596217 - RNA, 21 nt, Human coronavirus 229E
accuaucuaguuaguaacugc

SEQ ID NO: 1596218 - RNA, 15 nt, Human coronavirus 229E
aaugugucacaaacc

SEQ ID NO: 1596219 - RNA, 17 nt, Human coronavirus 229E
cugcugaaccagugcgu

SEQ ID NO: 1596220 - RNA, 20 nt, Human coronavirus 229E
cuugaaaauaaggcucugaa

SEQ ID NO: 1596221 - RNA, 17 nt, Human coronavirus 229E
uugaagaugcuuguacu

SEQ ID NO: 1596222 - RNA, 23 nt, Human coronavirus 229E
gacaucaugaaggcaguugcugc

SEQ ID NO: 1596223 - RNA, 16 nt, Human coronavirus 229E
uccacuuauguuugca

SEQ ID NO: 1596224 - RNA, 21 nt, Human coronavirus 229E
agaggugauuguaaagguuuu

SEQ ID NO: 1596225 - RNA, 16 nt, Human coronavirus 229E
guuguguauuuugcuu

SEQ ID NO: 1596226 - RNA, 22 nt, Human coronavirus 229E
acacuaaugagccucuuuguug

SEQ ID NO: 1596227 - RNA, 21 nt, Human coronavirus 229E
cagaaaauguauuugcuguug

SEQ ID NO: 1596228 - RNA, 23 nt, Human coronavirus 229E
agaacugccgaaauuuuucuaug

SEQ ID NO: 1596229 - RNA, 12 nt, Human coronavirus 229E
caguuucagacu

SEQ ID NO: 1596230 - RNA, 16 nt, Human coronavirus 229E
ugagaugcucacuuuu

SEQ ID NO: 1596231 - RNA, 16 nt, Human coronavirus 229E
ugcucguucucagagu

SEQ ID NO: 1596232 - RNA, 15 nt, Human coronavirus 229E
ucaauaccauuuuca

SEQ ID NO: 1596233 - RNA, 12 nt, Human coronavirus 229E
agguuaaugcaa

SEQ ID NO: 1596234 - RNA, 15 nt, Human coronavirus 229E
ucgugcucaucuuug

SEQ ID NO: 1596235 - RNA, 13 nt, Human coronavirus 229E
uauugaaacugac

SEQ ID NO: 1596236 - RNA, 18 nt, Human coronavirus 229E
caacuuuggaagugcagg

SEQ ID NO: 1596237 - RNA, 21 nt, Human coronavirus 229E
uuauuguaccaacaacacuuu

SEQ ID NO: 1596238 - RNA, 21 nt, Human coronavirus 229E
ugcagaugguucuauaauugc

SEQ ID NO: 1596239 - RNA, 23 nt, Human coronavirus 229E
ccaagacgugaaagauggcacug

SEQ ID NO: 1596240 - RNA, 13 nt, Human coronavirus 229E
aauugcuguucaa

SEQ ID NO: 1596241 - RNA, 12 nt, Human coronavirus 229E
uguaccagaugg

SEQ ID NO: 1596242 - RNA, 13 nt, Human coronavirus 229E
gcauuacugugac

SEQ ID NO: 1596243 - RNA, 17 nt, Human coronavirus 229E
uugaugaaguaaacuaa

SEQ ID NO: 1596244 - RNA, 17 nt, Human coronavirus 229E
ugcuguauuggucucaa

SEQ ID NO: 1596245 - RNA, 20 nt, Human coronavirus 229E
aacgaaagauugcuucauuu

SEQ ID NO: 1596246 - RNA, 11 nt, Human coronavirus 229E
ccaacaaugga

SEQ ID NO: 1596247 - RNA, 16 nt, Human coronavirus 229E
aguccugcuucuucuc

SEQ ID NO: 1596248 - RNA, 24 nt, Human coronavirus 229E
ccuaucguaguugauugcuccacu

SEQ ID NO: 1596249 - RNA, 22 nt, Human coronavirus 229E
uguauucguuucucauacauug

SEQ ID NO: 1596250 - RNA, 16 nt, Human coronavirus 229E
auaacuuuguuaaauu

SEQ ID NO: 1596251 - RNA, 19 nt, Human coronavirus 229E
gauuucuaaacuaaacgac

SEQ ID NO: 1596252 - RNA, 19 nt, Human coronavirus 229E
uugcaacuugugucugcug

SEQ ID NO: 1596253 - RNA, 12 nt, Human coronavirus 229E
agcuuggcacug

SEQ ID NO: 1596254 - RNA, 12 nt, Human coronavirus 229E
cagagcugcucu

SEQ ID NO: 1596255 - RNA, 16 nt, Human coronavirus 229E
cguauacacuaaugag

SEQ ID NO: 1596256 - RNA, 18 nt, Human coronavirus 229E
guuugauagucacauugu

SEQ ID NO: 1596257 - RNA, 20 nt, Human coronavirus 229E
uauccugcugguguuaauau

SEQ ID NO: 1596258 - RNA, 16 nt, Human coronavirus 229E
uauaguguuuaaaauu

SEQ ID NO: 1596259 - RNA, 20 nt, Human coronavirus 229E
uuauguguugcgacaaccua

SEQ ID NO: 1596260 - RNA, 13 nt, Human coronavirus 229E
ugugguugugcau

SEQ ID NO: 1596261 - RNA, 13 nt, Human coronavirus 229E
uucuuuaguuguu

SEQ ID NO: 1596262 - RNA, 15 nt, Human coronavirus 229E
ucacauaccauuugg

SEQ ID NO: 1596263 - RNA, 23 nt, Human coronavirus 229E
uugucaaacuacaaaugggcuga

SEQ ID NO: 1596264 - RNA, 23 nt, Human coronavirus 229E
aagcauauauuuacgcaacuuug

SEQ ID NO: 1596265 - RNA, 23 nt, Human coronavirus 229E
gcggagcuuaauuacacuguuca

SEQ ID NO: 1596266 - RNA, 16 nt, Human coronavirus 229E
cuauguuacugaaccu

SEQ ID NO: 1596267 - RNA, 16 nt, Human coronavirus 229E
uggcagauuuuguuca

SEQ ID NO: 1596268 - RNA, 18 nt, Human coronavirus 229E
ccugcuucuucucaaacu

SEQ ID NO: 1596269 - RNA, 13 nt, Human coronavirus 229E
uaaaacugaaccu

SEQ ID NO: 1596270 - RNA, 13 nt, Human coronavirus 229E
acugcugaaccag

SEQ ID NO: 1596271 - RNA, 17 nt, Human coronavirus 229E
aauccuuuucguuuaug

SEQ ID NO: 1596272 - RNA, 14 nt, Human coronavirus 229E
guccaauggcacuu

SEQ ID NO: 1596273 - RNA, 20 nt, Human coronavirus 229E
uacuggcgucccacaaccug

SEQ ID NO: 1596274 - RNA, 13 nt, Human coronavirus 229E
acuagagaaaugc

SEQ ID NO: 1596275 - RNA, 21 nt, Human coronavirus 229E
agaauucaacccaucucaaac

SEQ ID NO: 1596276 - RNA, 17 nt, Human coronavirus 229E
guugauagugaacaacc

SEQ ID NO: 1596277 - RNA, 19 nt, Human coronavirus 229E
auacuccagauuguuuuau

SEQ ID NO: 1596278 - RNA, 23 nt, Human coronavirus 229E
cggagcuuaauuacacuguucaa

SEQ ID NO: 1596279 - RNA, 14 nt, Human coronavirus 229E
uguugguuucuuga

SEQ ID NO: 1596280 - RNA, 22 nt, Human coronavirus 229E
uuauauacccuccgacuuugca

SEQ ID NO: 1596281 - RNA, 17 nt, Human coronavirus 229E
cuauguuacugaaccua

SEQ ID NO: 1596282 - RNA, 13 nt, Human coronavirus 229E
uguugguuucuug

SEQ ID NO: 1596283 - RNA, 23 nt, Human coronavirus 229E
cuucuauuagagguuguugugaa

SEQ ID NO: 1596284 - RNA, 23 nt, Human coronavirus 229E
ucaauauuauaauggcauuaugg

SEQ ID NO: 1596285 - RNA, 16 nt, Human coronavirus 229E
ugaugaaguaaacuaa

SEQ ID NO: 1596286 - RNA, 14 nt, Human coronavirus 229E
cuuggcacaggacc

SEQ ID NO: 1596287 - RNA, 14 nt, Human coronavirus 229E
auuggcugcuuuga

SEQ ID NO: 1596288 - RNA, 17 nt, Human coronavirus 229E
cuauuggaauguucaaa

SEQ ID NO: 1596289 - RNA, 23 nt, Human coronavirus 229E
cugcugaaccagugcgugaugaa

SEQ ID NO: 1596290 - RNA, 16 nt, Human coronavirus 229E
ucacaagcccuacaaa

SEQ ID NO: 1596291 - RNA, 16 nt, Human coronavirus 229E
uggugacuacaaccuu

SEQ ID NO: 1596292 - RNA, 12 nt, Human coronavirus 229E
uaaaacugaacc

SEQ ID NO: 1596293 - RNA, 13 nt, Human coronavirus 229E
aguauaacucauu

SEQ ID NO: 1596294 - RNA, 18 nt, Human coronavirus 229E
auugcuuuguaaauacua

SEQ ID NO: 1596295 - RNA, 20 nt, Human coronavirus 229E
gaaaacgaaagauugcuuca

SEQ ID NO: 1596296 - RNA, 23 nt, Human coronavirus 229E
agaucacaccguggcagagcugc

SEQ ID NO: 1596297 - RNA, 15 nt, Human coronavirus 229E
aauuacacuguucaa

SEQ ID NO: 1596298 - RNA, 19 nt, Human coronavirus 229E
ugcuuguaaaacuauugaa

SEQ ID NO: 1596299 - RNA, 15 nt, Human coronavirus 229E
aaugucaaaugacaa

SEQ ID NO: 1596300 - RNA, 16 nt, Human coronavirus 229E
ucagcaagcuguuguu

SEQ ID NO: 1596301 - RNA, 14 nt, Human coronavirus 229E
cuugaggaguuaaa

SEQ ID NO: 1596302 - RNA, 13 nt, Human coronavirus 229E
ggacuuggcacug

SEQ ID NO: 1596303 - RNA, 17 nt, Human coronavirus 229E
gcuaucgcuauuucacu

SEQ ID NO: 1596304 - RNA, 15 nt, Human coronavirus 229E
gcuguauuggucuca

SEQ ID NO: 1596305 - RNA, 18 nt, Human coronavirus 229E
ucgauauggauacacaaa

SEQ ID NO: 1596306 - RNA, 23 nt, Human coronavirus 229E
auaauggcauuaugguuuugccu

SEQ ID NO: 1596307 - RNA, 16 nt, Human coronavirus 229E
cucuuauaguguuuaa

SEQ ID NO: 1596308 - RNA, 17 nt, Human coronavirus 229E
ccugagguuaaugcaau

SEQ ID NO: 1596309 - RNA, 18 nt, Human coronavirus 229E
uaugcuguuugauaguca

SEQ ID NO: 1596310 - RNA, 15 nt, Human coronavirus 229E
cuagagaaaugcaac

SEQ ID NO: 1596311 - RNA, 13 nt, Human coronavirus 229E
accugcaacugcu

SEQ ID NO: 1596312 - RNA, 22 nt, Human coronavirus 229E
aucacaccguggcagagcugcu

SEQ ID NO: 1596313 - RNA, 19 nt, Human coronavirus 229E
gccacucguacuugcuuug

SEQ ID NO: 1596314 - RNA, 13 nt, Human coronavirus 229E
acauagauuggcu

SEQ ID NO: 1596315 - RNA, 23 nt, Human coronavirus 229E
cuaguuacucuguuugcaacggc

SEQ ID NO: 1596316 - RNA, 15 nt, Human coronavirus 229E
cuuguuacuucugga

SEQ ID NO: 1596317 - RNA, 22 nt, Human coronavirus 229E
acuuuuugggcauggaauccug

SEQ ID NO: 1596318 - RNA, 14 nt, Human coronavirus 229E
aauggaagagccag

SEQ ID NO: 1596319 - RNA, 15 nt, Human coronavirus 229E
cuuguugauagugaa

SEQ ID NO: 1596320 - RNA, 23 nt, Human coronavirus 229E
gcaaaguuaauaacuuuguuaaa

SEQ ID NO: 1596321 - RNA, 20 nt, Human coronavirus 229E
cugcaacugcugaaccagug

SEQ ID NO: 1596322 - RNA, 16 nt, Human coronavirus 229E
agaucagcuuguuguu

SEQ ID NO: 1596323 - RNA, 19 nt, Human coronavirus 229E
agauuggcugcuuugaaug

SEQ ID NO: 1596324 - RNA, 15 nt, Human coronavirus 229E
caguuuauggcccca

SEQ ID NO: 1596325 - RNA, 23 nt, Human coronavirus 229E
augugcgcuguguugaauugcuu

SEQ ID NO: 1596326 - RNA, 18 nt, Human coronavirus 229E
ccguggcagagcugcucu

SEQ ID NO: 1596327 - RNA, 12 nt, Human coronavirus 229E
aaucaaaagcuc

SEQ ID NO: 1596328 - RNA, 16 nt, Human coronavirus 229E
cuguaauuuugcuugg

SEQ ID NO: 1596329 - RNA, 12 nt, Human coronavirus 229E
cuugcugcaucu

SEQ ID NO: 1596330 - RNA, 23 nt, Human coronavirus 229E
guucaaccacguaauguuucaua

SEQ ID NO: 1596331 - RNA, 16 nt, Human coronavirus 229E
acgaaagauugcuuca

SEQ ID NO: 1596332 - RNA, 22 nt, Human coronavirus 229E
aaugagccucuuuguuguguau

SEQ ID NO: 1596333 - RNA, 16 nt, Human coronavirus 229E
cagucauuugucuuga

SEQ ID NO: 1596334 - RNA, 15 nt, Human coronavirus 229E
gcuccugaggggcuu

SEQ ID NO: 1596335 - RNA, 22 nt, Human coronavirus 229E
acugguagauuggcugcuuuga

SEQ ID NO: 1596336 - RNA, 16 nt, Human coronavirus 229E
agauggcacuguuacc

SEQ ID NO: 1596337 - RNA, 22 nt, Human coronavirus 229E
uaacaagauccaggauguuguu

SEQ ID NO: 1596338 - RNA, 16 nt, Human coronavirus 229E
cuggcucuacaagaca

SEQ ID NO: 1596339 - RNA, 15 nt, Human coronavirus 229E
caagcccuacaaaca

SEQ ID NO: 1596340 - RNA, 18 nt, Human coronavirus 229E
acuaguuacucuguuugc

SEQ ID NO: 1596341 - RNA, 16 nt, Human coronavirus 229E
aggugaacgcuaguau

SEQ ID NO: 1596342 - RNA, 17 nt, Human coronavirus 229E
cauuggacaaauguacu

SEQ ID NO: 1596343 - RNA, 15 nt, Human coronavirus 229E
uggucgcagugccau

SEQ ID NO: 1596344 - RNA, 18 nt, Human coronavirus 229E
auacuauaggcucauugu

SEQ ID NO: 1596345 - RNA, 22 nt, Human coronavirus 229E
ucauugaaccauuuaacuucuc

SEQ ID NO: 1596346 - RNA, 16 nt, Human coronavirus 229E
cuucaccugcaacugc

SEQ ID NO: 1596347 - RNA, 21 nt, Human coronavirus 229E
caacauccucuucuuaacccu

SEQ ID NO: 1596348 - RNA, 19 nt, Human coronavirus 229E
ugaccacaacuuuggaagu

SEQ ID NO: 1596349 - RNA, 17 nt, Human coronavirus 229E
ucauacguuacaaccuc

SEQ ID NO: 1596350 - RNA, 13 nt, Human coronavirus 229E
ccucaauuuugaa

SEQ ID NO: 1596351 - RNA, 21 nt, Human coronavirus 229E
uucaaccacguaauguuucau

SEQ ID NO: 1596352 - RNA, 14 nt, Human coronavirus 229E
cuugcuuugucaau

SEQ ID NO: 1596353 - RNA, 12 nt, Human coronavirus 229E
cacacuuugcua

SEQ ID NO: 1596354 - RNA, 12 nt, Human coronavirus 229E
uugccuguuuuu

SEQ ID NO: 1596355 - RNA, 22 nt, Human coronavirus 229E
ugaucaugcuuugguuguuaau

SEQ ID NO: 1596356 - RNA, 15 nt, Human coronavirus 229E
guuacaaccucaauu

SEQ ID NO: 1596357 - RNA, 15 nt, Human coronavirus 229E
acugcacuuaacaag

SEQ ID NO: 1596358 - RNA, 16 nt, Human coronavirus 229E
auugcaaacucugauu

SEQ ID NO: 1596359 - RNA, 14 nt, Human coronavirus 229E
caagagucuugcuc

SEQ ID NO: 1596360 - RNA, 12 nt, Human coronavirus 229E
guaaguuucuug

SEQ ID NO: 1596361 - RNA, 17 nt, Human coronavirus 229E
ugacaagccucaggaaa

SEQ ID NO: 1596362 - RNA, 16 nt, Human coronavirus 229E
aguugcuacugcacuu

SEQ ID NO: 1596363 - RNA, 11 nt, Human coronavirus 229E
cuauaauugcu

SEQ ID NO: 1596364 - RNA, 11 nt, Human coronavirus 229E
gccauugcugu

SEQ ID NO: 1596365 - RNA, 19 nt, Human coronavirus 229E
uugauugcuccacuuaugu

SEQ ID NO: 1596366 - RNA, 20 nt, Human coronavirus 229E
acuugacacuauucaggcug

SEQ ID NO: 1596367 - RNA, 17 nt, Human coronavirus 229E
cugguagauuggcugcu

SEQ ID NO: 1596368 - RNA, 22 nt, Human coronavirus 229E
aucucuagcucuauucaggcua

SEQ ID NO: 1596369 - RNA, 18 nt, Human coronavirus 229E
uuacugaaccuaggugaa

SEQ ID NO: 1596370 - RNA, 13 nt, Human coronavirus 229E
caaauacguugcu

SEQ ID NO: 1596371 - RNA, 20 nt, Human coronavirus 229E
caaacaguugcuacugcacu

SEQ ID NO: 1596372 - RNA, 19 nt, Human coronavirus 229E
cucagauguuuugucugau

SEQ ID NO: 1596373 - RNA, 13 nt, Human coronavirus 229E
uuccaaagaguca

SEQ ID NO: 1596374 - RNA, 17 nt, Human coronavirus 229E
agccguuaauuucaaug

SEQ ID NO: 1596375 - RNA, 11 nt, Human coronavirus 229E
uguauuuugcu

SEQ ID NO: 1596376 - RNA, 14 nt, Human coronavirus 229E
uugauagugaacaa

SEQ ID NO: 1596377 - RNA, 23 nt, Human coronavirus 229E
uuuuuccauacagcuuggcacug

SEQ ID NO: 1596378 - RNA, 18 nt, Human coronavirus 229E
cugacucccgugcuccuu

SEQ ID NO: 1596379 - RNA, 16 nt, Human coronavirus 229E
uagaauucaacccauc

SEQ ID NO: 1596380 - RNA, 23 nt, Human coronavirus 229E
uugaaacugacauaauugaugaa

SEQ ID NO: 1596381 - RNA, 14 nt, Human coronavirus 229E
cuguauuggucuca

SEQ ID NO: 1596382 - RNA, 15 nt, Human coronavirus 229E
auaaagaugcaaaau

SEQ ID NO: 1596383 - RNA, 20 nt, Human coronavirus 229E
uguaauuuugcuuggaagau

SEQ ID NO: 1596384 - RNA, 19 nt, Human coronavirus 229E
acuuugcauucaauaauug

SEQ ID NO: 1596385 - RNA, 16 nt, Human coronavirus 229E
ugcauucaauaauugg

SEQ ID NO: 1596386 - RNA, 20 nt, Human coronavirus 229E
ugggcugaacacuaguuacu

SEQ ID NO: 1596387 - RNA, 13 nt, Human coronavirus 229E
cuucuuuggccac

SEQ ID NO: 1596388 - RNA, 22 nt, Human coronavirus 229E
uuguugcuuaauugcuuauggu

SEQ ID NO: 1596389 - RNA, 21 nt, Human coronavirus 229E
ccuagugcacuagaauucaac

SEQ ID NO: 1596390 - RNA, 13 nt, Human coronavirus 229E
ugauugacaacau

SEQ ID NO: 1596391 - RNA, 16 nt, Human coronavirus 229E
gaaaauaaggcucuga

SEQ ID NO: 1596392 - RNA, 15 nt, Human coronavirus 229E
agaggugauuguaaa

SEQ ID NO: 1596393 - RNA, 18 nt, Human coronavirus 229E
ucaauguaaccacacuuu

SEQ ID NO: 1596394 - RNA, 18 nt, Human coronavirus 229E
acuccagauuguuuuaug

SEQ ID NO: 1596395 - RNA, 17 nt, Human coronavirus 229E
guuauugauuucuaaac

SEQ ID NO: 1596396 - RNA, 17 nt, Human coronavirus 229E
cuuuacugguguuaaug

SEQ ID NO: 1596397 - RNA, 23 nt, Human coronavirus 229E
cagauguuagugagaugcucacu

SEQ ID NO: 1596398 - RNA, 23 nt, Human coronavirus 229E
ugcaaugucacauuuguuaacau

SEQ ID NO: 1596399 - RNA, 13 nt, Human coronavirus 229E
uugauagugaaca

SEQ ID NO: 1596400 - RNA, 20 nt, Human coronavirus 229E
acacuggccaauuuuaauga

SEQ ID NO: 1596401 - RNA, 14 nt, Human coronavirus 229E
cacccaagcugcau

SEQ ID NO: 1596402 - RNA, 12 nt, Human coronavirus 229E
ugcuuaauugcu

SEQ ID NO: 1596403 - RNA, 23 nt, Human coronavirus 229E
uucaauccguugagcuaccugug

SEQ ID NO: 1596404 - RNA, 19 nt, Human coronavirus 229E
ugugucugcuguuaaucaa

SEQ ID NO: 1596405 - RNA, 14 nt, Human coronavirus 229E
acucuguuugcaac

SEQ ID NO: 1596406 - RNA, 15 nt, Human coronavirus 229E
ugcuacuauguuacu

SEQ ID NO: 1596407 - RNA, 21 nt, Human coronavirus 229E
gaaccagugcgugaugaaguu

SEQ ID NO: 1596408 - RNA, 13 nt, Human coronavirus 229E
ggcagagcugcuc

SEQ ID NO: 1596409 - RNA, 20 nt, Human coronavirus 229E
gagagauuuggcgccuuggu

SEQ ID NO: 1596410 - RNA, 14 nt, Human coronavirus 229E
gccuauaguggcua

SEQ ID NO: 1596411 - RNA, 22 nt, Human coronavirus 229E
gcaagaauucagaaccagagau

SEQ ID NO: 1596412 - RNA, 13 nt, Human coronavirus 229E
uauguugucugaa

SEQ ID NO: 1596413 - RNA, 13 nt, Human coronavirus 229E
ucuaaacugaacg

SEQ ID NO: 1596414 - RNA, 18 nt, Human coronavirus 229E
uaaucuugcucuuuacaa

SEQ ID NO: 1596415 - RNA, 18 nt, Human coronavirus 229E
cauuugaagaauuggaau

SEQ ID NO: 1596416 - RNA, 20 nt, Human coronavirus 229E
cuuguacuguggcuucuuug

SEQ ID NO: 1596417 - RNA, 14 nt, Human coronavirus 229E
cuagagaaaugcaa

SEQ ID NO: 1596418 - RNA, 20 nt, Human coronavirus 229E
cagacuacaaaaagugcacu

SEQ ID NO: 1596419 - RNA, 16 nt, Human coronavirus 229E
aucuuggcacaggacc

SEQ ID NO: 1596420 - RNA, 18 nt, Human coronavirus 229E
cuuauaggcuauuggaau

SEQ ID NO: 1596421 - RNA, 22 nt, Human coronavirus 229E
caauggcacuuauaauugcaca

SEQ ID NO: 1596422 - RNA, 13 nt, Human coronavirus 229E
uuaauuaacauga

SEQ ID NO: 1596423 - RNA, 19 nt, Human coronavirus 229E
uguaauagaacaguuuaug

SEQ ID NO: 1596424 - RNA, 21 nt, Human coronavirus 229E
acucauuacaaaugugcugga

SEQ ID NO: 1596425 - RNA, 13 nt, Human coronavirus 229E
uugcucuuuacaa

SEQ ID NO: 1596426 - RNA, 23 nt, Human coronavirus 229E
uuauacacaaugguaagccagug

SEQ ID NO: 1596427 - RNA, 19 nt, Human coronavirus 229E
ugugcguugaugguacaaa

SEQ ID NO: 1596428 - RNA, 20 nt, Human coronavirus 229E
cgucacagcuaauuugucua

SEQ ID NO: 1596429 - RNA, 16 nt, Human coronavirus 229E
gugcuuuaacuguuau

SEQ ID NO: 1596430 - RNA, 21 nt, Human coronavirus 229E
uacgcaacuuugauugcugua

SEQ ID NO: 1596431 - RNA, 23 nt, Human coronavirus 229E
aagguccguaaauucacaaaaua

SEQ ID NO: 1596432 - RNA, 13 nt, Human coronavirus 229E
ugcaaacucugau

SEQ ID NO: 1596433 - RNA, 23 nt, Human coronavirus 229E
cucauugaaccauuuaacuucuc

SEQ ID NO: 1596434 - RNA, 14 nt, Human coronavirus 229E
accuguuuaucaua

SEQ ID NO: 1596435 - RNA, 14 nt, Human coronavirus 229E
aaugcaaucacugu

SEQ ID NO: 1596436 - RNA, 14 nt, Human coronavirus 229E
cuaauuugucuaua

SEQ ID NO: 1596437 - RNA, 12 nt, Human coronavirus 229E
auauaacgguga

SEQ ID NO: 1596438 - RNA, 13 nt, Human coronavirus 229E
ucaaauugaaaau

SEQ ID NO: 1596439 - RNA, 15 nt, Human coronavirus 229E
cucagccuuucuaga

SEQ ID NO: 1596440 - RNA, 11 nt, Human coronavirus 229E
gacuuggcacu

SEQ ID NO: 1596441 - RNA, 17 nt, Human coronavirus 229E
cugcaacugcugaacca

SEQ ID NO: 1596442 - RNA, 15 nt, Human coronavirus 229E
agugacagaaaccau

SEQ ID NO: 1596443 - RNA, 15 nt, Human coronavirus 229E
caggugaugcucaca

SEQ ID NO: 1596444 - RNA, 13 nt, Human coronavirus 229E
cacauuuguuaac

SEQ ID NO: 1596445 - RNA, 11 nt, Human coronavirus 229E
gaauugcuuua

SEQ ID NO: 1596446 - RNA, 16 nt, Human coronavirus 229E
auuaagcuuuguuuca

SEQ ID NO: 1596447 - RNA, 21 nt, Human coronavirus 229E
uccacacuuggguaaguuucu

SEQ ID NO: 1596448 - RNA, 17 nt, Human coronavirus 229E
ugugcuggaguaaucaa

SEQ ID NO: 1596449 - RNA, 17 nt, Human coronavirus 229E
cucaggaaaaagauaaa

SEQ ID NO: 1596450 - RNA, 20 nt, Human coronavirus 229E
gagugacugugcccaaagac

SEQ ID NO: 1596451 - RNA, 21 nt, Human coronavirus 229E
guuacaaauugccaaauuaca

SEQ ID NO: 1596452 - RNA, 23 nt, Human coronavirus 229E
aguuccuuuaugaauguuacauu

SEQ ID NO: 1596453 - RNA, 19 nt, Human coronavirus 229E
ccacaacuuuggaagugca

SEQ ID NO: 1596454 - RNA, 14 nt, Human coronavirus 229E
aacaagaaagacaa

SEQ ID NO: 1596455 - RNA, 15 nt, Human coronavirus 229E
cucugaguugcaaac

SEQ ID NO: 1596456 - RNA, 21 nt, Human coronavirus 229E
uaauugggccuuuguugcauu

SEQ ID NO: 1596457 - RNA, 13 nt, Human coronavirus 229E
agacugauguuuu

SEQ ID NO: 1596458 - RNA, 12 nt, Human coronavirus 229E
ugaauguuacau

SEQ ID NO: 1596459 - RNA, 18 nt, Human coronavirus 229E
aaugaugaugugacaucu

SEQ ID NO: 1596460 - RNA, 21 nt, Human coronavirus 229E
auauaugcacauagacccuuu

SEQ ID NO: 1596461 - RNA, 14 nt, Human coronavirus 229E
acuuaaaguggcuc

SEQ ID NO: 1596462 - RNA, 17 nt, Human coronavirus 229E
gaugcaucugaaccaca

SEQ ID NO: 1596463 - RNA, 12 nt, Human coronavirus 229E
ccuaagccuucu

SEQ ID NO: 1596464 - RNA, 18 nt, Human coronavirus 229E
ccuuguugcauauugcug

SEQ ID NO: 1596465 - RNA, 21 nt, Human coronavirus 229E
uuagacguggaaccauuuugu

SEQ ID NO: 1596466 - RNA, 16 nt, Human coronavirus 229E
uaaauuauguugcauu

SEQ ID NO: 1596467 - RNA, 20 nt, Human coronavirus 229E
uuuaauugguggaauugcuu

SEQ ID NO: 1596468 - RNA, 17 nt, Human coronavirus 229E
auuguuuuaugguuuga

SEQ ID NO: 1596469 - RNA, 20 nt, Human coronavirus 229E
aaucaaucgcuuagcaaugc

SEQ ID NO: 1596470 - RNA, 20 nt, Human coronavirus 229E
gaugguucuauaauugcugu

SEQ ID NO: 1596471 - RNA, 17 nt, Human coronavirus 229E
uucacuagagaaaugca

SEQ ID NO: 1596472 - RNA, 19 nt, Human coronavirus 229E
cuucagguaaccuucuggg

SEQ ID NO: 1596473 - RNA, 19 nt, Human coronavirus 229E
aagacaaaaauaagcuuau

SEQ ID NO: 1596474 - RNA, 19 nt, Human coronavirus 229E
uaaaugcauucacuagaga

SEQ ID NO: 1596475 - RNA, 20 nt, Human coronavirus 229E
aaacaugccacuguguuguu

SEQ ID NO: 1596476 - RNA, 14 nt, Human coronavirus 229E
ugucgcuaccuguu

SEQ ID NO: 1596477 - RNA, 13 nt, Human coronavirus 229E
auugcuuuucucu

SEQ ID NO: 1596478 - RNA, 19 nt, Human coronavirus 229E
cuugcgguuuacuacuggu

SEQ ID NO: 1596479 - RNA, 12 nt, Human coronavirus 229E
ggugaaugugua

SEQ ID NO: 1596480 - RNA, 14 nt, Human coronavirus 229E
uucuaaacugaacg

SEQ ID NO: 1596481 - RNA, 21 nt, Human coronavirus 229E
ugauggugcuaaaacugaacc

SEQ ID NO: 1596482 - RNA, 17 nt, Human coronavirus 229E
aauugaaaauugcaaug

SEQ ID NO: 1596483 - RNA, 17 nt, Human coronavirus 229E
gaugucauacguuacaa

SEQ ID NO: 1596484 - RNA, 18 nt, Human coronavirus 229E
uguguuuuauuguaccaa

SEQ ID NO: 1596485 - RNA, 19 nt, Human coronavirus 229E
ccugcaacugcugaaccag

SEQ ID NO: 1596486 - RNA, 21 nt, Human coronavirus 229E
uauucuacaagcccuauucaa

SEQ ID NO: 1596487 - RNA, 17 nt, Human coronavirus 229E
acuuggcuugugcucaa

SEQ ID NO: 1596488 - RNA, 19 nt, Human coronavirus 229E
agguuaaugcaaucacugu

SEQ ID NO: 1596489 - RNA, 16 nt, Human coronavirus 229E
auugguggaauugcuu

SEQ ID NO: 1596490 - RNA, 15 nt, Human coronavirus 229E
ucaacuaacgacuug

SEQ ID NO: 1596491 - RNA, 19 nt, Human coronavirus 229E
acacaaugguaagccagug

SEQ ID NO: 1596492 - RNA, 22 nt, Human coronavirus 229E
aaguguugguuucuugaaaaua

SEQ ID NO: 1596493 - RNA, 18 nt, Human coronavirus 229E
gcaaacaguuucagacuu

SEQ ID NO: 1596494 - RNA, 18 nt, Human coronavirus 229E
aagaauucagaaccagag

SEQ ID NO: 1596495 - RNA, 14 nt, Human coronavirus 229E
uggccccagagacc

SEQ ID NO: 1596496 - RNA, 18 nt, Human coronavirus 229E
agucgcggucguggugaa

SEQ ID NO: 1596497 - RNA, 20 nt, Human coronavirus 229E
guuauuucacgcacaggaca

SEQ ID NO: 1596498 - RNA, 16 nt, Human coronavirus 229E
ugcaacaacauccucu

SEQ ID NO: 1596499 - RNA, 13 nt, Human coronavirus 229E
aagacagccuaau

SEQ ID NO: 1596500 - RNA, 15 nt, Human coronavirus 229E
uauacuucugcuugu

SEQ ID NO: 1596501 - RNA, 16 nt, Human coronavirus 229E
ucuugcugcaucuuuu

SEQ ID NO: 1596502 - RNA, 20 nt, Human coronavirus 229E
ucaauguaaccacacuuugc

SEQ ID NO: 1596503 - RNA, 15 nt, Human coronavirus 229E
gaaaguuagugcuga

SEQ ID NO: 1596504 - RNA, 22 nt, Human coronavirus 229E
uguugauggugcuaaaacugaa

SEQ ID NO: 1596505 - RNA, 20 nt, Human coronavirus 229E
cgcuguguugaauugcuuaa

SEQ ID NO: 1596506 - RNA, 19 nt, Human coronavirus 229E
gcugcuuugaauguauucg

SEQ ID NO: 1596507 - RNA, 15 nt, Human coronavirus 229E
ucugaaaauuuuacu

SEQ ID NO: 1596508 - RNA, 17 nt, Human coronavirus 229E
aguggcuaauugggcuu

SEQ ID NO: 1596509 - RNA, 21 nt, Human coronavirus 229E
acauaguagaugccuuuacug

SEQ ID NO: 1596510 - RNA, 20 nt, Human coronavirus 229E
gauuguuuuaugguuugaag

SEQ ID NO: 1596511 - RNA, 23 nt, Human coronavirus 229E
ugauagugaacaaccuuggaagg

SEQ ID NO: 1596512 - RNA, 12 nt, Human coronavirus 229E
uaaggcucugaa

SEQ ID NO: 1596513 - RNA, 15 nt, Human coronavirus 229E
aaccauugugccaga

SEQ ID NO: 1596514 - RNA, 21 nt, Human coronavirus 229E
uaacucauuacaaaugugcug

SEQ ID NO: 1596515 - RNA, 22 nt, Human coronavirus 229E
uauugugucgcuaccuguuuau

SEQ ID NO: 1596516 - RNA, 14 nt, Human coronavirus 229E
aagaaauuugcuac

SEQ ID NO: 1596517 - RNA, 20 nt, Human coronavirus 229E
augcgaaaguuagugcugaa

SEQ ID NO: 1596518 - RNA, 16 nt, Human coronavirus 229E
auguugucugaaaauu

SEQ ID NO: 1596519 - RNA, 18 nt, Human coronavirus 229E
uuggcaguguauguuuuu

SEQ ID NO: 1596520 - RNA, 14 nt, Human coronavirus 229E
ugagcaacaugaca

SEQ ID NO: 1596521 - RNA, 21 nt, Human coronavirus 229E
ugcaacuugugucugcuguua

SEQ ID NO: 1596522 - RNA, 18 nt, Human coronavirus 229E
uguaaaacuauugaagac

SEQ ID NO: 1596523 - RNA, 22 nt, Human coronavirus 229E
cuaauaccucaucuguuguaga

SEQ ID NO: 1596524 - RNA, 14 nt, Human coronavirus 229E
uaguauaacucauu

SEQ ID NO: 1596525 - RNA, 16 nt, Human coronavirus 229E
gagaggugauuguaaa

SEQ ID NO: 1596526 - RNA, 16 nt, Human coronavirus 229E
ugcuguaauuuugcuu

SEQ ID NO: 1596527 - RNA, 22 nt, Human coronavirus 229E
auucaggcacguuuaaauuaug

SEQ ID NO: 1596528 - RNA, 20 nt, Human coronavirus 229E
uugggcaauuuuuauugcuu

SEQ ID NO: 1596529 - RNA, 16 nt, Human coronavirus 229E
ugaacaaccuuggaag

SEQ ID NO: 1596530 - RNA, 13 nt, Human coronavirus 229E
caugaaaugcaaa

SEQ ID NO: 1596531 - RNA, 14 nt, Human coronavirus 229E
acaugggauuucau

SEQ ID NO: 1596532 - RNA, 17 nt, Human coronavirus 229E
uauguuuuguaauagaa

SEQ ID NO: 1596533 - RNA, 15 nt, Human coronavirus 229E
agcuccaacaggcau

SEQ ID NO: 1596534 - RNA, 15 nt, Human coronavirus 229E
aagcccuacaaacag

SEQ ID NO: 1596535 - RNA, 16 nt, Human coronavirus 229E
aaccacguaauguuuc

SEQ ID NO: 1596536 - RNA, 18 nt, Human coronavirus 229E
aaaaauguguaccacauu

SEQ ID NO: 1596537 - RNA, 15 nt, Human coronavirus 229E
ugcuauguugucuga

SEQ ID NO: 1596538 - RNA, 16 nt, Human coronavirus 229E
acacuggccaauuuua

SEQ ID NO: 1596539 - RNA, 14 nt, Human coronavirus 229E
uaccugugucuauu

SEQ ID NO: 1596540 - RNA, 16 nt, Human coronavirus 229E
uguuaaugaugcuauu

SEQ ID NO: 1596541 - RNA, 16 nt, Human coronavirus 229E
uccugcuucuucucaa

SEQ ID NO: 1596542 - RNA, 16 nt, Human coronavirus 229E
cuaugcguccaauggc

SEQ ID NO: 1596543 - RNA, 11 nt, Human coronavirus 229E
aauugaaaauu

SEQ ID NO: 1596544 - RNA, 23 nt, Human coronavirus 229E
caagguaaguguugguuucuuga

SEQ ID NO: 1596545 - RNA, 16 nt, Human coronavirus 229E
ugcaacugcugaacca

SEQ ID NO: 1596546 - RNA, 23 nt, Human coronavirus 229E
aaacuucaccugcaacugcugaa

SEQ ID NO: 1596547 - RNA, 22 nt, Human coronavirus 229E
gguguuauucgcguuagcaaug

SEQ ID NO: 1596548 - RNA, 22 nt, Human coronavirus 229E
acuauaauuuauaguagagucg

SEQ ID NO: 1596549 - RNA, 20 nt, Human coronavirus 229E
gaacaaaagcaugaaaugca

SEQ ID NO: 1596550 - RNA, 22 nt, Human coronavirus 229E
uucuaugcguccaauggcacuu

SEQ ID NO: 1596551 - RNA, 17 nt, Human coronavirus 229E
gacaagccucaggaaaa

SEQ ID NO: 1596552 - RNA, 15 nt, Human coronavirus 229E
agaaaccacugauuu

SEQ ID NO: 1596553 - RNA, 17 nt, Human coronavirus 229E
augcuauuacacaaacu

SEQ ID NO: 1596554 - RNA, 18 nt, Human coronavirus 229E
caaagaccauccacacuu

SEQ ID NO: 1596555 - RNA, 16 nt, Human coronavirus 229E
cuauuuuaaugguacu

SEQ ID NO: 1596556 - RNA, 15 nt, Human coronavirus 229E
uuuaaaauucuaauc

SEQ ID NO: 1596557 - RNA, 23 nt, Human coronavirus 229E
aguuucuauugaaacugacauaa

SEQ ID NO: 1596558 - RNA, 17 nt, Human coronavirus 229E
uaaugugucacaaaccu

SEQ ID NO: 1596559 - RNA, 20 nt, Human coronavirus 229E
cuuuacugguguuaaugaug

SEQ ID NO: 1596560 - RNA, 15 nt, Human coronavirus 229E
cuguuuuaacuuauu

SEQ ID NO: 1596561 - RNA, 11 nt, Human coronavirus 229E
agccuuuguug

SEQ ID NO: 1596562 - RNA, 12 nt, Human coronavirus 229E
uuuuuauugcuu

SEQ ID NO: 1596563 - RNA, 22 nt, Human coronavirus 229E
uguugguagguggagugcuagu

SEQ ID NO: 1596564 - RNA, 19 nt, Human coronavirus 229E
auuuugaagaaaaccuuag

SEQ ID NO: 1596565 - RNA, 18 nt, Human coronavirus 229E
uaaccacacuuugcuaug

SEQ ID NO: 1596566 - RNA, 23 nt, Human coronavirus 229E
uaaugagccucuuuguuguguau

SEQ ID NO: 1596567 - RNA, 17 nt, Human coronavirus 229E
uuaacuucucaguugag

SEQ ID NO: 1596568 - RNA, 17 nt, Human coronavirus 229E
caaaagcucccaaaugg

SEQ ID NO: 1596569 - RNA, 17 nt, Human coronavirus 229E
auacguugcuguuuaug

SEQ ID NO: 1596570 - RNA, 18 nt, Human coronavirus 229E
cucagauguuuugucuga

SEQ ID NO: 1596571 - RNA, 13 nt, Human coronavirus 229E
uuauaauugcaca

SEQ ID NO: 1596572 - RNA, 14 nt, Human coronavirus 229E
agcuaauuugucua

SEQ ID NO: 1596573 - RNA, 14 nt, Human coronavirus 229E
uugcuuaauugcuu

SEQ ID NO: 1596574 - RNA, 18 nt, Human coronavirus 229E
uguuauuaacagacugag

SEQ ID NO: 1596575 - RNA, 22 nt, Human coronavirus 229E
caauaauuaaacuaauuaagcu

SEQ ID NO: 1596576 - RNA, 15 nt, Human coronavirus 229E
uuugcaucuucuauu

SEQ ID NO: 1596577 - RNA, 16 nt, Human coronavirus 229E
gucuuuccauugcuga

SEQ ID NO: 1596578 - RNA, 19 nt, Human coronavirus 229E
uacaaccagacuauuuuga

SEQ ID NO: 1596579 - RNA, 12 nt, Human coronavirus 229E
acuguuguugaa

SEQ ID NO: 1596580 - RNA, 20 nt, Human coronavirus 229E
acaaaugugcuggaguaauc

SEQ ID NO: 1596581 - RNA, 21 nt, Human coronavirus 229E
uaacuaauaccucaucuguug

SEQ ID NO: 1596582 - RNA, 21 nt, Human coronavirus 229E
gauuuuguucaaauugaaaau

SEQ ID NO: 1596583 - RNA, 22 nt, Human coronavirus 229E
gcaguguauguuuuucgcuaaa

SEQ ID NO: 1596584 - RNA, 20 nt, Human coronavirus 229E
cucccaugagcaacaugaca

SEQ ID NO: 1596585 - RNA, 13 nt, Human coronavirus 229E
cuaauguuguaga

SEQ ID NO: 1596586 - RNA, 22 nt, Human coronavirus 229E
acauacuuuuuagcaaacuugu

SEQ ID NO: 1596587 - RNA, 17 nt, Human coronavirus 229E
ucacacuucacuaccaa

SEQ ID NO: 1596588 - RNA, 23 nt, Human coronavirus 229E
cagaugguucuauaauugcuguu

SEQ ID NO: 1596589 - RNA, 16 nt, Human coronavirus 229E
cuuaauuacacuguuc

SEQ ID NO: 1596590 - RNA, 13 nt, Human coronavirus 229E
gcagguguugugg

SEQ ID NO: 1596591 - RNA, 16 nt, Human coronavirus 229E
uaauugguuccuucua

SEQ ID NO: 1596592 - RNA, 21 nt, Human coronavirus 229E
uggaaaagacagccuaaugau

SEQ ID NO: 1596593 - RNA, 23 nt, Human coronavirus 229E
gaauuaaguuacaaauugccaaa

SEQ ID NO: 1596594 - RNA, 15 nt, Human coronavirus 229E
uauguuugcaauggu

SEQ ID NO: 1596595 - RNA, 23 nt, Human coronavirus 229E
uaauugcacagacgcuguuuuaa

SEQ ID NO: 1596596 - RNA, 19 nt, Human coronavirus 229E
uuaacacgggaaauugccc

SEQ ID NO: 1596597 - RNA, 12 nt, Human coronavirus 229E
caacagcugcua

SEQ ID NO: 1596598 - RNA, 19 nt, Human coronavirus 229E
cuaagauguuccuuaagcu

SEQ ID NO: 1596599 - RNA, 16 nt, Human coronavirus 229E
gucuugcucguucuca

SEQ ID NO: 1596600 - RNA, 19 nt, Human coronavirus 229E
ugcuggcucuacaagacau

SEQ ID NO: 1596601 - RNA, 15 nt, Human coronavirus 229E
cuuucccuaaacgag

SEQ ID NO: 1596602 - RNA, 16 nt, Human coronavirus 229E
caaucuuugacaccug

SEQ ID NO: 1596603 - RNA, 17 nt, Human coronavirus 229E
aaauugcccuuuuucuu

SEQ ID NO: 1596604 - RNA, 13 nt, Human coronavirus 229E
cacaggaccccau

SEQ ID NO: 1596605 - RNA, 23 nt, Human coronavirus 229E
gccacuguguuguuugaaauuca

SEQ ID NO: 1596606 - RNA, 13 nt, Human coronavirus 229E
guggucuggguug

SEQ ID NO: 1596607 - RNA, 19 nt, Human coronavirus 229E
acugaaguucgugcuucca

SEQ ID NO: 1596608 - RNA, 14 nt, Human coronavirus 229E
uaauugcuguucaa

SEQ ID NO: 1596609 - RNA, 19 nt, Human coronavirus 229E
acacuggccaauuuuaaug

SEQ ID NO: 1596610 - RNA, 23 nt, Human coronavirus 229E
auucuaauugggccuuuguugca

SEQ ID NO: 1596611 - RNA, 21 nt, Human coronavirus 229E
acuuugauugcuguaauuuug

SEQ ID NO: 1596612 - RNA, 19 nt, Human coronavirus 229E
auaagaaauuugcuacuau

SEQ ID NO: 1596613 - RNA, 17 nt, Human coronavirus 229E
uuauucagaaaauguau

SEQ ID NO: 1596614 - RNA, 19 nt, Human coronavirus 229E
uaacaugaucccuugcuuu

SEQ ID NO: 1596615 - RNA, 14 nt, Human coronavirus 229E
uaacucauuacaaa

SEQ ID NO: 1596616 - RNA, 20 nt, Human coronavirus 229E
uauuacaauaauuaaacuaa

SEQ ID NO: 1596617 - RNA, 13 nt, Human coronavirus 229E
ugacaacauaaau

SEQ ID NO: 1596618 - RNA, 20 nt, Human coronavirus 229E
caauuguuaaugcugcuccu

SEQ ID NO: 1596619 - RNA, 13 nt, Human coronavirus 229E
agauuuuguucaa

SEQ ID NO: 1596620 - RNA, 21 nt, Human coronavirus 229E
ucuaacaucagccguuucaau

SEQ ID NO: 1596621 - RNA, 21 nt, Human coronavirus 229E
cagacuacaaaaagugcacua

SEQ ID NO: 1596622 - RNA, 14 nt, Human coronavirus 229E
auuucucaacuaac

SEQ ID NO: 1596623 - RNA, 15 nt, Human coronavirus 229E
acuucaccugcaacu

SEQ ID NO: 1596624 - RNA, 18 nt, Human coronavirus 229E
ugaagaauuggaauuuug

SEQ ID NO: 1596625 - RNA, 14 nt, Human coronavirus 229E
cucaauuguuaaug

SEQ ID NO: 1596626 - RNA, 20 nt, Human coronavirus 229E
agacguggaaccauuuuguu

SEQ ID NO: 1596627 - RNA, 17 nt, Human coronavirus 229E
ugccaaauuacacuguu

SEQ ID NO: 1596628 - RNA, 18 nt, Human coronavirus 229E
cuguauuggucucaagca

SEQ ID NO: 1596629 - RNA, 18 nt, Human coronavirus 229E
acacuuggguaaguuucu

SEQ ID NO: 1596630 - RNA, 21 nt, Human coronavirus 229E
cgugaugaaguuucuauugaa

SEQ ID NO: 1596631 - RNA, 16 nt, Human coronavirus 229E
aaauguauuugcuguu

SEQ ID NO: 1596632 - RNA, 21 nt, Human coronavirus 229E
cuaacgacuuguacguugcuc

SEQ ID NO: 1596633 - RNA, 18 nt, Human coronavirus 229E
ugcugagcggcgugcuuu

SEQ ID NO: 1596634 - RNA, 18 nt, Human coronavirus 229E
uguuacuguuguugaaga

SEQ ID NO: 1596635 - RNA, 13 nt, Human coronavirus 229E
ugucgcuaccugu

SEQ ID NO: 1596636 - RNA, 13 nt, Human coronavirus 229E
acguaauguuuca

SEQ ID NO: 1596637 - RNA, 15 nt, Human coronavirus 229E
cucauuguauguuuc

SEQ ID NO: 1596638 - RNA, 21 nt, Human coronavirus 229E
ugacaagaaagcguuuacacu

SEQ ID NO: 1596639 - RNA, 20 nt, Human coronavirus 229E
cacaaaccucuauugcuaau

SEQ ID NO: 1596640 - RNA, 18 nt, Human coronavirus 229E
cugguugcuguggcuucu

SEQ ID NO: 1596641 - RNA, 23 nt, Human coronavirus 229E
gcuguguugaauugcuuaagcag

SEQ ID NO: 1596642 - RNA, 19 nt, Human coronavirus 229E
uauaagaaauuugcuacua

SEQ ID NO: 1596643 - RNA, 23 nt, Human coronavirus 229E
guaauguuucauaugauaguguu

SEQ ID NO: 1596644 - RNA, 22 nt, Human coronavirus 229E
accuaucuaguuaguaacugcu

SEQ ID NO: 1596645 - RNA, 15 nt, Human coronavirus 229E
ugaguauguugcuau

SEQ ID NO: 1596646 - RNA, 13 nt, Human coronavirus 229E
aaaugcauucacu

SEQ ID NO: 1596647 - RNA, 21 nt, Human coronavirus 229E
gaucacaccguggcagagcug

SEQ ID NO: 1596648 - RNA, 18 nt, Human coronavirus 229E
agguuaaugcaaucacug

SEQ ID NO: 1596649 - RNA, 17 nt, Human coronavirus 229E
caaauacguugcuguuu

SEQ ID NO: 1596650 - RNA, 18 nt, Human coronavirus 229E
augggauuucauugucuu

SEQ ID NO: 1596651 - RNA, 22 nt, Human coronavirus 229E
acuucugcuuguaaaacuauug

SEQ ID NO: 1596652 - RNA, 23 nt, Human coronavirus 229E
acacuguggucuugacuuucacu

SEQ ID NO: 1596653 - RNA, 22 nt, Human coronavirus 229E
ggguugugcguugaugguacaa

SEQ ID NO: 1596654 - RNA, 13 nt, Human coronavirus 229E
cuauguuacugaa

SEQ ID NO: 1596655 - RNA, 14 nt, Human coronavirus 229E
acuugugucugcug

SEQ ID NO: 1596656 - RNA, 22 nt, Human coronavirus 229E
agacagcuugcacaacaaaaag

SEQ ID NO: 1596657 - RNA, 22 nt, Human coronavirus 229E
cuucauuuuuucuaaacugaac

SEQ ID NO: 1596658 - RNA, 22 nt, Human coronavirus 229E
agaucacaccguggcagagcug

SEQ ID NO: 1596659 - RNA, 21 nt, Human coronavirus 229E
caagcccuacaaacaguugcu

SEQ ID NO: 1596660 - RNA, 19 nt, Human coronavirus 229E
agugguaguagaguggcug

SEQ ID NO: 1596661 - RNA, 14 nt, Human coronavirus 229E
aaugucacacaaug

SEQ ID NO: 1596662 - RNA, 13 nt, Human coronavirus 229E
aaugguaagccag

SEQ ID NO: 1596663 - RNA, 16 nt, Human coronavirus 229E
ucaaugucacuacugc

SEQ ID NO: 1596664 - RNA, 18 nt, Human coronavirus 229E
caaauugaaaauugcaau

SEQ ID NO: 1596665 - RNA, 20 nt, Human coronavirus 229E
uuaacauuucucgcucugag

SEQ ID NO: 1596666 - RNA, 15 nt, Human coronavirus 229E
agcguuuacacuugc

SEQ ID NO: 1596667 - RNA, 14 nt, Human coronavirus 229E
uggaauguuauucu

SEQ ID NO: 1596668 - RNA, 16 nt, Human coronavirus 229E
ucuucaguuuggacac

SEQ ID NO: 1596669 - RNA, 19 nt, Human coronavirus 229E
uauccugcugguguuaaua

SEQ ID NO: 1596670 - RNA, 22 nt, Human coronavirus 229E
ucguggugaauccaaaccucaa

SEQ ID NO: 1596671 - RNA, 13 nt, Human coronavirus 229E
agucaaaugggcu

SEQ ID NO: 1596672 - RNA, 21 nt, Human coronavirus 229E
aaauuuggcaguguauguuuu

SEQ ID NO: 1596673 - RNA, 14 nt, Human coronavirus 229E
ugguuuuuauucua

SEQ ID NO: 1596674 - RNA, 19 nt, Human coronavirus 229E
uaauugguggaauugcuuu

SEQ ID NO: 1596675 - RNA, 18 nt, Human coronavirus 229E
acgugaaagauggcacug

SEQ ID NO: 1596676 - RNA, 17 nt, Human coronavirus 229E
aauugguggaauugcuu

SEQ ID NO: 1596677 - RNA, 22 nt, Human coronavirus 229E
caagacgugaaagauggcacug

SEQ ID NO: 1596678 - RNA, 13 nt, Human coronavirus 229E
ugcuuaauugcuu

SEQ ID NO: 1596679 - RNA, 16 nt, Human coronavirus 229E
gccaauuuuaaugaaa

SEQ ID NO: 1596680 - RNA, 18 nt, Human coronavirus 229E
uacuauguuacugaaccu

SEQ ID NO: 1596681 - RNA, 14 nt, Human coronavirus 229E
acgacguugaaaag

SEQ ID NO: 1596682 - RNA, 18 nt, Human coronavirus 229E
cauuucagucgugcucau

SEQ ID NO: 1596683 - RNA, 15 nt, Human coronavirus 229E
cucuagguuuguuca

SEQ ID NO: 1596684 - RNA, 22 nt, Human coronavirus 229E
gauggugcuaaaacugaaccua

SEQ ID NO: 1596685 - RNA, 13 nt, Human coronavirus 229E
uaauuugucuaua

SEQ ID NO: 1596686 - RNA, 16 nt, Human coronavirus 229E
cugugaccuugcugag

SEQ ID NO: 1596687 - RNA, 21 nt, Human coronavirus 229E
gauugcuguaauuuugcuugg

SEQ ID NO: 1596688 - RNA, 14 nt, Human coronavirus 229E
uucagaaccagaga

SEQ ID NO: 1596689 - RNA, 15 nt, Human coronavirus 229E
ugugacaucuaaugu

SEQ ID NO: 1596690 - RNA, 18 nt, Human coronavirus 229E
acaauguuuuggccccag

SEQ ID NO: 1596691 - RNA, 12 nt, Human coronavirus 229E
caauuugcugag

SEQ ID NO: 1596692 - RNA, 16 nt, Human coronavirus 229E
ucugauugacaacaua

SEQ ID NO: 1596693 - RNA, 16 nt, Human coronavirus 229E
auuguuaaugcugcuc

SEQ ID NO: 1596694 - RNA, 18 nt, Human coronavirus 229E
accguggcagagcugcuc

SEQ ID NO: 1596695 - RNA, 22 nt, Human coronavirus 229E
ugugcgcuguguugaauugcuu

SEQ ID NO: 1596696 - RNA, 15 nt, Human coronavirus 229E
gaucuauguaugaug

SEQ ID NO: 1596697 - RNA, 16 nt, Human coronavirus 229E
aguuggaauuuugcuu

SEQ ID NO: 1596698 - RNA, 17 nt, Human coronavirus 229E
acucuguuauuaacaga

SEQ ID NO: 1596699 - RNA, 23 nt, Human coronavirus 229E
ccacugauuuuuguacuguugcg

SEQ ID NO: 1596700 - RNA, 23 nt, Human coronavirus 229E
cauacagcuuggcacugcuggcu

SEQ ID NO: 1596701 - RNA, 20 nt, Human coronavirus 229E
cauaugccuuguugcauauu

SEQ ID NO: 1596702 - RNA, 15 nt, Human coronavirus 229E
uaugaauguuacauu

SEQ ID NO: 1596703 - RNA, 23 nt, Human coronavirus 229E
ucaacaaggcaacucauugaacc

SEQ ID NO: 1596704 - RNA, 20 nt, Human coronavirus 229E
uaguuuuggcguuugugcag

SEQ ID NO: 1596705 - RNA, 17 nt, Human coronavirus 229E
uuuggcguuugugcaga

SEQ ID NO: 1596706 - RNA, 13 nt, Human coronavirus 229E
acuacaaccuuag

SEQ ID NO: 1596707 - RNA, 19 nt, Human coronavirus 229E
ugguuggaauguuauucua

SEQ ID NO: 1596708 - RNA, 12 nt, Human coronavirus 229E
auguuugcaaug

SEQ ID NO: 1596709 - RNA, 12 nt, Human coronavirus 229E
cuaagccuucuc

SEQ ID NO: 1596710 - RNA, 18 nt, Human coronavirus 229E
auaauauuuaugauguau

SEQ ID NO: 1596711 - RNA, 21 nt, Human coronavirus 229E
cauaaagaugcaaaauuuaga

SEQ ID NO: 1596712 - RNA, 16 nt, Human coronavirus 229E
aaacaguugcuacugc

SEQ ID NO: 1596713 - RNA, 18 nt, Human coronavirus 229E
cucaaucucggaauccuu

SEQ ID NO: 1596714 - RNA, 13 nt, Human coronavirus 229E
uaaugaugcuauu

SEQ ID NO: 1596715 - RNA, 16 nt, Human coronavirus 229E
aucuuuagguuuugac

SEQ ID NO: 1596716 - RNA, 15 nt, Human coronavirus 229E
gaauacauugcuuuu

SEQ ID NO: 1596717 - RNA, 21 nt, Human coronavirus 229E
agccuuuguugcuuaauugcu

SEQ ID NO: 1596718 - RNA, 21 nt, Human coronavirus 229E
auucuaauugggccuuuguug

SEQ ID NO: 1596719 - RNA, 15 nt, Human coronavirus 229E
agcguggucuggguu

SEQ ID NO: 1596720 - RNA, 13 nt, Human coronavirus 229E
acuuauaauugca

SEQ ID NO: 1596721 - RNA, 14 nt, Human coronavirus 229E
uguuguugaagaac

SEQ ID NO: 1596722 - RNA, 13 nt, Human coronavirus 229E
gaugaaguuucua

SEQ ID NO: 1596723 - RNA, 18 nt, Human coronavirus 229E
cuuggcacugcuggcucu

SEQ ID NO: 1596724 - RNA, 17 nt, Human coronavirus 229E
uucuggacuuggcacug

SEQ ID NO: 1596725 - RNA, 17 nt, Human coronavirus 229E
ucuugcucguucucaga

SEQ ID NO: 1596726 - RNA, 19 nt, Human coronavirus 229E
gaaguuucuauugaaacug

SEQ ID NO: 1596727 - RNA, 13 nt, Human coronavirus 229E
cgcagacuacaaa

SEQ ID NO: 1596728 - RNA, 16 nt, Human coronavirus 229E
guuuacacuugcuaau

SEQ ID NO: 1596729 - RNA, 19 nt, Human coronavirus 229E
ugcauaugccuuguugcau

SEQ ID NO: 1596730 - RNA, 19 nt, Human coronavirus 229E
aucucgcauaauguuugaa

SEQ ID NO: 1596731 - RNA, 14 nt, Human coronavirus 229E
aaauuauguugcau

SEQ ID NO: 1596732 - RNA, 17 nt, Human coronavirus 229E
ccuacaaacaguugcua

SEQ ID NO: 1596733 - RNA, 17 nt, Human coronavirus 229E
uacugguuuugucuauu

SEQ ID NO: 1596734 - RNA, 20 nt, Human coronavirus 229E
aguauauugauguuaauaag

SEQ ID NO: 1596735 - RNA, 13 nt, Human coronavirus 229E
cuuauuucucaac

SEQ ID NO: 1596736 - RNA, 14 nt, Human coronavirus 229E
uaauauuacacugg

SEQ ID NO: 1596737 - RNA, 22 nt, Human coronavirus 229E
ucuaacuaauaccucaucuguu

SEQ ID NO: 1596738 - RNA, 20 nt, Human coronavirus 229E
cauugcaacuugugucugcu

SEQ ID NO: 1596739 - RNA, 13 nt, Human coronavirus 229E
uuccaauuggacc

SEQ ID NO: 1596740 - RNA, 14 nt, Human coronavirus 229E
accacacuuugcua

SEQ ID NO: 1596741 - RNA, 22 nt, Human coronavirus 229E
acaucucgcauaauguuugaac

SEQ ID NO: 1596742 - RNA, 16 nt, Human coronavirus 229E
acgaucagagcugcuu

SEQ ID NO: 1596743 - RNA, 14 nt, Human coronavirus 229E
gaaaugcaaaagcc

SEQ ID NO: 1596744 - RNA, 18 nt, Human coronavirus 229E
guaauuuugcuuggaaga

SEQ ID NO: 1596745 - RNA, 13 nt, Human coronavirus 229E
ugaauacaugaca

SEQ ID NO: 1596746 - RNA, 13 nt, Human coronavirus 229E
cucaauuguuaau

SEQ ID NO: 1596747 - RNA, 15 nt, Human coronavirus 229E
ucaacacagauuuca

SEQ ID NO: 1596748 - RNA, 19 nt, Human coronavirus 229E
uagaugaauacauugcuuu

SEQ ID NO: 1596749 - RNA, 22 nt, Human coronavirus 229E
guauacuuguuuugugaacacc

SEQ ID NO: 1596750 - RNA, 16 nt, Human coronavirus 229E
acuuuagguaauguag

SEQ ID NO: 1596751 - RNA, 18 nt, Human coronavirus 229E
auguuguuguucuacugg

SEQ ID NO: 1596752 - RNA, 17 nt, Human coronavirus 229E
gugccauugcuguauug

SEQ ID NO: 1596753 - RNA, 16 nt, Human coronavirus 229E
acugguagauuggcug

SEQ ID NO: 1596754 - RNA, 19 nt, Human coronavirus 229E
gaugcaaaauuuagagagc

SEQ ID NO: 1596755 - RNA, 22 nt, Human coronavirus 229E
guuuucagccuuuguugcuuaa

SEQ ID NO: 1596756 - RNA, 22 nt, Human coronavirus 229E
uacacuggccaauuuuaaugaa

SEQ ID NO: 1596757 - RNA, 16 nt, Human coronavirus 229E
uugcaaacucugauug

SEQ ID NO: 1596758 - RNA, 23 nt, Human coronavirus 229E
gcuuauggucuguuucuggcuug

SEQ ID NO: 1596759 - RNA, 12 nt, Human coronavirus 229E
uguuuugucuga

SEQ ID NO: 1596760 - RNA, 17 nt, Human coronavirus 229E
uggcguuugugcagaug

SEQ ID NO: 1596761 - RNA, 16 nt, Human coronavirus 229E
cuauaauugcuguuca

SEQ ID NO: 1596762 - RNA, 14 nt, Human coronavirus 229E
caaggcaacucauu

SEQ ID NO: 1596763 - RNA, 13 nt, Human coronavirus 229E
uuuccauugcuga

SEQ ID NO: 1596764 - RNA, 15 nt, Human coronavirus 229E
aaaugcaaaagccac

SEQ ID NO: 1596765 - RNA, 22 nt, Human coronavirus 229E
ucguucucagaguucugaaaca

SEQ ID NO: 1596766 - RNA, 16 nt, Human coronavirus 229E
cuguuauccugcuggu

SEQ ID NO: 1596767 - RNA, 15 nt, Human coronavirus 229E
caagaauucagaacc

SEQ ID NO: 1596768 - RNA, 14 nt, Human coronavirus 229E
gguaaguuucuuga

SEQ ID NO: 1596769 - RNA, 17 nt, Human coronavirus 229E
ucgcaaacaguuucaga

SEQ ID NO: 1596770 - RNA, 16 nt, Human coronavirus 229E
gacacuauucaggcug

SEQ ID NO: 1596771 - RNA, 23 nt, Human coronavirus 229E
agcuugugccgucaacagcugcu

SEQ ID NO: 1596772 - RNA, 14 nt, Human coronavirus 229E
gcucucccaugagc

SEQ ID NO: 1596773 - RNA, 15 nt, Human coronavirus 229E
ucaccugcaacugcu

SEQ ID NO: 1596774 - RNA, 19 nt, Human coronavirus 229E
gcacagacgcuguuuuaac

SEQ ID NO: 1596775 - RNA, 15 nt, Human coronavirus 229E
ugcuguaauuuugcu

SEQ ID NO: 1596776 - RNA, 14 nt, Human coronavirus 229E
cuggcucuacaaga

SEQ ID NO: 1596777 - RNA, 14 nt, Human coronavirus 229E
uaaugaaacuaaag

SEQ ID NO: 1596778 - RNA, 18 nt, Human coronavirus 229E
gaguuauauaacggugaa

SEQ ID NO: 1596779 - RNA, 15 nt, Human coronavirus 229E
uuauugcuuuguaaa

SEQ ID NO: 1596780 - RNA, 15 nt, Human coronavirus 229E
cuggacuuggcacug

SEQ ID NO: 1596781 - RNA, 22 nt, Human coronavirus 229E
agaacugccgaaauuuuucuau

SEQ ID NO: 1596782 - RNA, 17 nt, Human coronavirus 229E
uccaggauguuguuaau

SEQ ID NO: 1596783 - RNA, 22 nt, Human coronavirus 229E
caacuugugucugcuguuaauc

SEQ ID NO: 1596784 - RNA, 15 nt, Human coronavirus 229E
agcacccuugaaaau

SEQ ID NO: 1596785 - RNA, 19 nt, Human coronavirus 229E
gcuuagcaaugcgaaaguu

SEQ ID NO: 1596786 - RNA, 17 nt, Human coronavirus 229E
cuugcuuuggcuugaca

SEQ ID NO: 1596787 - RNA, 13 nt, Human coronavirus 229E
gaauuuugcuuuu

SEQ ID NO: 1596788 - RNA, 21 nt, Human coronavirus 229E
uaguauaacucauuacaaaug

SEQ ID NO: 1596789 - RNA, 23 nt, Human coronavirus 229E
agauuggcugcuuugaauguauu

SEQ ID NO: 1596790 - RNA, 19 nt, Human coronavirus 229E
ugucuuguugccgacacaa

SEQ ID NO: 1596791 - RNA, 20 nt, Human coronavirus 229E
aacgaguuauugauuucuaa

SEQ ID NO: 1596792 - RNA, 13 nt, Human coronavirus 229E
ggcaguguauguu

SEQ ID NO: 1596793 - RNA, 20 nt, Human coronavirus 229E
cucaauuguuaaugcugcuc

SEQ ID NO: 1596794 - RNA, 22 nt, Human coronavirus 229E
ugacagaaaacgaaagauugcu

SEQ ID NO: 1596795 - RNA, 19 nt, Human coronavirus 229E
ucaguuuggacacuauaaa

SEQ ID NO: 1596796 - RNA, 22 nt, Human coronavirus 229E
caaaauuuagagagcguguuga

SEQ ID NO: 1596797 - RNA, 23 nt, Human coronavirus 229E
ugcuucauuuuuucuaaacugaa

SEQ ID NO: 1596798 - RNA, 15 nt, Human coronavirus 229E
ugaaauucaggcuuu

SEQ ID NO: 1596799 - RNA, 20 nt, Human coronavirus 229E
ugucuauuuuaaugguacug

SEQ ID NO: 1596800 - RNA, 20 nt, Human coronavirus 229E
agcaguauacuucugcuugu

SEQ ID NO: 1596801 - RNA, 14 nt, Human coronavirus 229E
gcugacuuggcuug

SEQ ID NO: 1596802 - RNA, 16 nt, Human coronavirus 229E
caacacagauuucaaa

SEQ ID NO: 1596803 - RNA, 13 nt, Human coronavirus 229E
guauuuugcuuua

SEQ ID NO: 1596804 - RNA, 16 nt, Human coronavirus 229E
caccguggcagagcug

SEQ ID NO: 1596805 - RNA, 16 nt, Human coronavirus 229E
ugaauacaugacaguu

SEQ ID NO: 1596806 - RNA, 17 nt, Human coronavirus 229E
ugauugcuguaauuuug

SEQ ID NO: 1596807 - RNA, 23 nt, Human coronavirus 229E
uaagcuaguggaugaucaugcuu

SEQ ID NO: 1596808 - RNA, 17 nt, Human coronavirus 229E
cuccacuuauguuugca

SEQ ID NO: 1596809 - RNA, 13 nt, Human coronavirus 229E
auuuugguuggaa

SEQ ID NO: 1596810 - RNA, 17 nt, Human coronavirus 229E
uaaccacacuuugcuau

SEQ ID NO: 1596811 - RNA, 13 nt, Human coronavirus 229E
agaacaguuuaug

SEQ ID NO: 1596812 - RNA, 23 nt, Human coronavirus 229E
ucucaaacuucaccugcaacugc

SEQ ID NO: 1596813 - RNA, 13 nt, Human coronavirus 229E
guugcuguugaug

SEQ ID NO: 1596814 - RNA, 16 nt, Human coronavirus 229E
gccuuucuagaaaggu

SEQ ID NO: 1596815 - RNA, 19 nt, Human coronavirus 229E
augcucacuuuugacaaga

SEQ ID NO: 1596816 - RNA, 20 nt, Human coronavirus 229E
uugauggugcuaaaacugaa

SEQ ID NO: 1596817 - RNA, 21 nt, Human coronavirus 229E
uggcucuagguuuguucacau

SEQ ID NO: 1596818 - RNA, 20 nt, Human coronavirus 229E
gccucuuuguuguguauuuu

SEQ ID NO: 1596819 - RNA, 14 nt, Human coronavirus 229E
ucagccuuucuaga

SEQ ID NO: 1596820 - RNA, 15 nt, Human coronavirus 229E
uaaacuaaacaugcc

SEQ ID NO: 1596821 - RNA, 21 nt, Human coronavirus 229E
gcugcaagaauuaaguuacaa

SEQ ID NO: 1596822 - RNA, 14 nt, Human coronavirus 229E
aaugcaaaagccac

SEQ ID NO: 1596823 - RNA, 16 nt, Human coronavirus 229E
auucuucaguuuggac

SEQ ID NO: 1596824 - RNA, 15 nt, Human coronavirus 229E
cuuauaguaaguacu

SEQ ID NO: 1596825 - RNA, 19 nt, Human coronavirus 229E
cuuaauuacacuguucaaa

SEQ ID NO: 1596826 - RNA, 12 nt, Human coronavirus 229E
uauuuaaagcaa

SEQ ID NO: 1596827 - RNA, 11 nt, Human coronavirus 229E
uacacuguuca

SEQ ID NO: 1596828 - RNA, 18 nt, Human coronavirus 229E
ccacacugucuuguugcc

SEQ ID NO: 1596829 - RNA, 16 nt, Human coronavirus 229E
uguuuugcaucuucua

SEQ ID NO: 1596830 - RNA, 19 nt, Human coronavirus 229E
ucacauuguuuccaaagag

SEQ ID NO: 1596831 - RNA, 23 nt, Human coronavirus 229E
aguaaagguauaagaaauuugcu

SEQ ID NO: 1596832 - RNA, 18 nt, Human coronavirus 229E
acuucugccaagagucuu

SEQ ID NO: 1596833 - RNA, 14 nt, Human coronavirus 229E
cuuaacaagaucca

SEQ ID NO: 1596834 - RNA, 23 nt, Human coronavirus 229E
gguacgaucagagcugcuuuuaa

SEQ ID NO: 1596835 - RNA, 16 nt, Human coronavirus 229E
uauauugauguuaaua

SEQ ID NO: 1596836 - RNA, 14 nt, Human coronavirus 229E
aacauacguuuauu

SEQ ID NO: 1596837 - RNA, 14 nt, Human coronavirus 229E
acccauuugaagaa

SEQ ID NO: 1596838 - RNA, 12 nt, Human coronavirus 229E
gcaaugaaacua

SEQ ID NO: 1596839 - RNA, 23 nt, Human coronavirus 229E
caaagaucgcauugacgagccaa

SEQ ID NO: 1596840 - RNA, 22 nt, Human coronavirus 229E
ugauggugcuaaaacugaaccu

SEQ ID NO: 1596841 - RNA, 15 nt, Human coronavirus 229E
auugcuuuaggaggu

SEQ ID NO: 1596842 - RNA, 14 nt, Human coronavirus 229E
caugaucccuugcu

SEQ ID NO: 1596843 - RNA, 20 nt, Human coronavirus 229E
ugcuauguugucugaaaauu

SEQ ID NO: 1596844 - RNA, 22 nt, Human coronavirus 229E
uuauccugcugguguuaauauu

SEQ ID NO: 1596845 - RNA, 19 nt, Human coronavirus 229E
ugcagaaaccacugauuuu

SEQ ID NO: 1596846 - RNA, 15 nt, Human coronavirus 229E
uuggccacucguacu

SEQ ID NO: 1596847 - RNA, 19 nt, Human coronavirus 229E
acgaucagagcugcuuuua

SEQ ID NO: 1596848 - RNA, 16 nt, Human coronavirus 229E
ucuugaggaguuaaau

SEQ ID NO: 1596849 - RNA, 14 nt, Human coronavirus 229E
gaaccuacagguua

SEQ ID NO: 1596850 - RNA, 22 nt, Human coronavirus 229E
aguuaaaugcauucacuagaga

SEQ ID NO: 1596851 - RNA, 17 nt, Human coronavirus 229E
auacccuccgacuuugc

SEQ ID NO: 1596852 - RNA, 14 nt, Human coronavirus 229E
acugguguuaauga

SEQ ID NO: 1596853 - RNA, 17 nt, Human coronavirus 229E
uuuuauuaucuuggcac

SEQ ID NO: 1596854 - RNA, 16 nt, Human coronavirus 229E
caguugcuacugcacu

SEQ ID NO: 1596855 - RNA, 14 nt, Human coronavirus 229E
cugugaccuugcug

SEQ ID NO: 1596856 - RNA, 20 nt, Human coronavirus 229E
gcuauuggaauguucaaaaa

SEQ ID NO: 1596857 - RNA, 21 nt, Human coronavirus 229E
ucaaaaauugcaaacucugau

SEQ ID NO: 1596858 - RNA, 20 nt, Human coronavirus 229E
uuuuccauacagcuuggcac

SEQ ID NO: 1596859 - RNA, 21 nt, Human coronavirus 229E
auuuugcuuuuguucuuucuu

SEQ ID NO: 1596860 - RNA, 22 nt, Human coronavirus 229E
cagucuaagcguuauggcuucu

SEQ ID NO: 1596861 - RNA, 18 nt, Human coronavirus 229E
caacaauggaagagccag

SEQ ID NO: 1596862 - RNA, 13 nt, Human coronavirus 229E
aaccucaauuuug

SEQ ID NO: 1596863 - RNA, 19 nt, Human coronavirus 229E
gauuggcuucagguguuca

SEQ ID NO: 1596864 - RNA, 13 nt, Human coronavirus 229E
ugcaucugaacca

SEQ ID NO: 1596865 - RNA, 22 nt, Human coronavirus 229E
cuuuguggugaguauguugcua

SEQ ID NO: 1596866 - RNA, 12 nt, Human coronavirus 229E
uggaauuuugcu

SEQ ID NO: 1596867 - RNA, 15 nt, Human coronavirus 229E
gcaacuugugucugc

SEQ ID NO: 1596868 - RNA, 17 nt, Human coronavirus 229E
uagaggacguauugaua

SEQ ID NO: 1596869 - RNA, 12 nt, Human coronavirus 229E
aaaacgaaagau

SEQ ID NO: 1596870 - RNA, 13 nt, Human coronavirus 229E
aacaaggcaacuc

SEQ ID NO: 1596871 - RNA, 19 nt, Human coronavirus 229E
ugcccaaagaccauccaca

SEQ ID NO: 1596872 - RNA, 16 nt, Human coronavirus 229E
ucaaaaacguuucaga

SEQ ID NO: 1596873 - RNA, 16 nt, Human coronavirus 229E
cagcuugcacaacaaa

SEQ ID NO: 1596874 - RNA, 22 nt, Human coronavirus 229E
uguucaaauugaaaauugcaau

SEQ ID NO: 1596875 - RNA, 13 nt, Human coronavirus 229E
acaauuugcugag

SEQ ID NO: 1596876 - RNA, 21 nt, Human coronavirus 229E
agagucgcggucguggugaau

SEQ ID NO: 1596877 - RNA, 17 nt, Human coronavirus 229E
ggaugaucaugcuuugg

SEQ ID NO: 1596878 - RNA, 14 nt, Human coronavirus 229E
ucagagcugcuuuu

SEQ ID NO: 1596879 - RNA, 13 nt, Human coronavirus 229E
gaaauucaggcuu

SEQ ID NO: 1596880 - RNA, 18 nt, Human coronavirus 229E
cuuguaaaacuauugaag

SEQ ID NO: 1596881 - RNA, 22 nt, Human coronavirus 229E
uggaacgguuucgauauggaua

SEQ ID NO: 1596882 - RNA, 14 nt, Human coronavirus 229E
uguguuguacguug

SEQ ID NO: 1596883 - RNA, 22 nt, Human coronavirus 229E
uaccauggcagauuuuguucaa

SEQ ID NO: 1596884 - RNA, 17 nt, Human coronavirus 229E
ccacuuauguuugcaau

SEQ ID NO: 1596885 - RNA, 15 nt, Human coronavirus 229E
cucguacuugcuuug

SEQ ID NO: 1596886 - RNA, 23 nt, Human coronavirus 229E
cgaaaacggguacuccuaagccu

SEQ ID NO: 1596887 - RNA, 15 nt, Human coronavirus 229E
gcacugcuggcucua

SEQ ID NO: 1596888 - RNA, 16 nt, Human coronavirus 229E
uaguuuuggcguuugu

SEQ ID NO: 1596889 - RNA, 13 nt, Human coronavirus 229E
ugaugaugugaca

SEQ ID NO: 1596890 - RNA, 15 nt, Human coronavirus 229E
cuguuguugaagaac

SEQ ID NO: 1596891 - RNA, 15 nt, Human coronavirus 229E
caugaucccuugcuu

SEQ ID NO: 1596892 - RNA, 19 nt, Human coronavirus 229E
acaguuuugggcaauuuuu

SEQ ID NO: 1596893 - RNA, 23 nt, Human coronavirus 229E
uguuuuucuccacacugucuugu

SEQ ID NO: 1596894 - RNA, 17 nt, Human coronavirus 229E
uaguuacggcuuuucua

SEQ ID NO: 1596895 - RNA, 18 nt, Human coronavirus 229E
cuaugcguccaauggcac

SEQ ID NO: 1596896 - RNA, 23 nt, Human coronavirus 229E
uaguuccuuuaugaauguuacau

SEQ ID NO: 1596897 - RNA, 18 nt, Human coronavirus 229E
guagaugaauacauugcu

SEQ ID NO: 1596898 - RNA, 12 nt, Human coronavirus 229E
cucguucucaga

SEQ ID NO: 1596899 - RNA, 13 nt, Human coronavirus 229E
cacaauuugcuga

SEQ ID NO: 1596900 - RNA, 22 nt, Human coronavirus 229E
ucaacuucagguaaccuucugg

SEQ ID NO: 1596901 - RNA, 18 nt, Human coronavirus 229E
uuuguuuaaaacaucuua

SEQ ID NO: 1596902 - RNA, 16 nt, Human coronavirus 229E
cucgcauaauguuuga

SEQ ID NO: 1596903 - RNA, 19 nt, Human coronavirus 229E
ugcacaacaaaaagugaau

SEQ ID NO: 1596904 - RNA, 21 nt, Human coronavirus 229E
agagugacugugcccaaagac

SEQ ID NO: 1596905 - RNA, 22 nt, Human coronavirus 229E
caauguaaccacacuuugcuau

SEQ ID NO: 1596906 - RNA, 18 nt, Human coronavirus 229E
cuuagacguggaaccauu

SEQ ID NO: 1596907 - RNA, 21 nt, Human coronavirus 229E
agcuuauaggcuauuggaaug

SEQ ID NO: 1596908 - RNA, 16 nt, Human coronavirus 229E
uucaaaaauugcaaac

SEQ ID NO: 1596909 - RNA, 13 nt, Human coronavirus 229E
guuuuucgcuaaa

SEQ ID NO: 1596910 - RNA, 14 nt, Human coronavirus 229E
ugcgugaugaaguu

SEQ ID NO: 1596911 - RNA, 15 nt, Human coronavirus 229E
uucacaaaauagcac

SEQ ID NO: 1596912 - RNA, 16 nt, Human coronavirus 229E
accauauucauuguua

SEQ ID NO: 1596913 - RNA, 15 nt, Human coronavirus 229E
ugguuucuugaaaau

SEQ ID NO: 1596914 - RNA, 16 nt, Human coronavirus 229E
agucaggcaacacugu

SEQ ID NO: 1596915 - RNA, 18 nt, Human coronavirus 229E
acucauuacaaaugugcu

SEQ ID NO: 1596916 - RNA, 13 nt, Human coronavirus 229E
cuuguuguuuauc

SEQ ID NO: 1596917 - RNA, 14 nt, Human coronavirus 229E
acuuguuacuucug

SEQ ID NO: 1596918 - RNA, 19 nt, Human coronavirus 229E
gcagacugauguuuuacaa

SEQ ID NO: 1596919 - RNA, 23 nt, Human coronavirus 229E
uucaauguaaccacacuuugcua

SEQ ID NO: 1596920 - RNA, 16 nt, Human coronavirus 229E
ucuaguuaguaacugc

SEQ ID NO: 1596921 - RNA, 21 nt, Human coronavirus 229E
aagccacgguggaaaagacag

SEQ ID NO: 1596922 - RNA, 17 nt, Human coronavirus 229E
ugacauaauugaugaag

SEQ ID NO: 1596923 - RNA, 20 nt, Human coronavirus 229E
ggauuucauugucuucaaug

SEQ ID NO: 1596924 - RNA, 20 nt, Human coronavirus 229E
uuuauggccguaucaacacu

SEQ ID NO: 1596925 - RNA, 11 nt, Human coronavirus 229E
cucgcucugag

SEQ ID NO: 1596926 - RNA, 16 nt, Human coronavirus 229E
aaaauucuugcugcau

SEQ ID NO: 1596927 - RNA, 14 nt, Human coronavirus 229E
ugaauguuacauug

SEQ ID NO: 1596928 - RNA, 14 nt, Human coronavirus 229E
cauaauugaugaag

SEQ ID NO: 1596929 - RNA, 21 nt, Human coronavirus 229E
aagaaauuugcuacuauguua

SEQ ID NO: 1596930 - RNA, 18 nt, Human coronavirus 229E
ucaaacuucugccaagag

SEQ ID NO: 1596931 - RNA, 14 nt, Human coronavirus 229E
cuuuauuuaaagca

SEQ ID NO: 1596932 - RNA, 12 nt, Human coronavirus 229E
cgaucagagcug

SEQ ID NO: 1596933 - RNA, 13 nt, Human coronavirus 229E
gaguaaucaaaga

SEQ ID NO: 1596934 - RNA, 16 nt, Human coronavirus 229E
aggcucauuguauguu

SEQ ID NO: 1596935 - RNA, 14 nt, Human coronavirus 229E
caguuuggacacua

SEQ ID NO: 1596936 - RNA, 19 nt, Human coronavirus 229E
cguuuaaauuauguugcau

SEQ ID NO: 1596937 - RNA, 15 nt, Human coronavirus 229E
cugcuucuucucaaa

SEQ ID NO: 1596938 - RNA, 14 nt, Human coronavirus 229E
acugguuuugucua

SEQ ID NO: 1596939 - RNA, 14 nt, Human coronavirus 229E
aagugcuuuaacug

SEQ ID NO: 1596940 - RNA, 22 nt, Human coronavirus 229E
uaauugcuuauggucuguuucu

SEQ ID NO: 1596941 - RNA, 22 nt, Human coronavirus 229E
gaaagcguuuacacuugcuaau

SEQ ID NO: 1596942 - RNA, 13 nt, Human coronavirus 229E
cagcuuggcacug

SEQ ID NO: 1596943 - RNA, 19 nt, Human coronavirus 229E
agaugcucacuuuugacaa

SEQ ID NO: 1596944 - RNA, 20 nt, Human coronavirus 229E
ggcaguugcugcggcucuua

SEQ ID NO: 1596945 - RNA, 18 nt, Human coronavirus 229E
guuaauaacuuuguuaaa

SEQ ID NO: 1596946 - RNA, 15 nt, Human coronavirus 229E
cuguuucuggcuugc

SEQ ID NO: 1596947 - RNA, 12 nt, Human coronavirus 229E
auuaucuuucuu

SEQ ID NO: 1596948 - RNA, 16 nt, Human coronavirus 229E
uuguuuugugaacacc

SEQ ID NO: 1596949 - RNA, 20 nt, Human coronavirus 229E
auuucuaaacuaaacgacaa

SEQ ID NO: 1596950 - RNA, 15 nt, Human coronavirus 229E
caauggaagagccag

SEQ ID NO: 1596951 - RNA, 18 nt, Human coronavirus 229E
agcaguauacuucugcuu

SEQ ID NO: 1596952 - RNA, 19 nt, Human coronavirus 229E
aaccacguaauguuucaua

SEQ ID NO: 1596953 - RNA, 15 nt, Human coronavirus 229E
aaccagacuauuuug

SEQ ID NO: 1596954 - RNA, 15 nt, Human coronavirus 229E
uguauguuuuucgcu

SEQ ID NO: 1596955 - RNA, 23 nt, Human coronavirus 229E
caagauccaggauguuguuaauc

SEQ ID NO: 1596956 - RNA, 17 nt, Human coronavirus 229E
cugcuuguaaaacuauu

SEQ ID NO: 1596957 - RNA, 12 nt, Human coronavirus 229E
ucaaacuacaaa

SEQ ID NO: 1596958 - RNA, 12 nt, Human coronavirus 229E
ucaacagcugcu

SEQ ID NO: 1596959 - RNA, 18 nt, Human coronavirus 229E
cuaccugaauacaugaca

SEQ ID NO: 1596960 - RNA, 19 nt, Human coronavirus 229E
acuguggucuugacuuuca

SEQ ID NO: 1596961 - RNA, 14 nt, Human coronavirus 229E
ugaagaaccugacu

SEQ ID NO: 1596962 - RNA, 14 nt, Human coronavirus 229E
gugcagguguugug

SEQ ID NO: 1596963 - RNA, 16 nt, Human coronavirus 229E
acuuugauugcuguaa

SEQ ID NO: 1596964 - RNA, 10 nt, Human coronavirus 229E
cuuguugcau

SEQ ID NO: 1596965 - RNA, 16 nt, Human coronavirus 229E
uacugguguuaaugau

SEQ ID NO: 1596966 - RNA, 17 nt, Human coronavirus 229E
uauaagaaauuugcuac

SEQ ID NO: 1596967 - RNA, 22 nt, Human coronavirus 229E
accacugauuuuuguacuguug

SEQ ID NO: 1596968 - RNA, 18 nt, Human coronavirus 229E
ucuauaauugcuguucaa

SEQ ID NO: 1596969 - RNA, 16 nt, Human coronavirus 229E
auuuaacuucucaguu

SEQ ID NO: 1596970 - RNA, 17 nt, Human coronavirus 229E
cugaguugcaaaccauu

SEQ ID NO: 1596971 - RNA, 21 nt, Human coronavirus 229E
agcacaggcuggguuuucuac

SEQ ID NO: 1596972 - RNA, 14 nt, Human coronavirus 229E
caggugaugcucac

SEQ ID NO: 1596973 - RNA, 18 nt, Human coronavirus 229E
aaauacguugcuguuuau

SEQ ID NO: 1596974 - RNA, 20 nt, Human coronavirus 229E
cuuuacauaggcgacagaau

SEQ ID NO: 1596975 - RNA, 17 nt, Human coronavirus 229E
ucuaauugggccuuugu

SEQ ID NO: 1596976 - RNA, 14 nt, Human coronavirus 229E
accaacaacacuuu

SEQ ID NO: 1596977 - RNA, 19 nt, Human coronavirus 229E
uggcuucuguggaaauggc

SEQ ID NO: 1596978 - RNA, 18 nt, Human coronavirus 229E
guugcauauugcugguug

SEQ ID NO: 1596979 - RNA, 16 nt, Human coronavirus 229E
caaauacguugcuguu

SEQ ID NO: 1596980 - RNA, 15 nt, Human coronavirus 229E
uuacucuguuugcaa

SEQ ID NO: 1596981 - RNA, 19 nt, Human coronavirus 229E
gccuucucguaaucagagu

SEQ ID NO: 1596982 - RNA, 14 nt, Human coronavirus 229E
agacauacuuuuua

SEQ ID NO: 1596983 - RNA, 15 nt, Human coronavirus 229E
aguaaaacacgguga

SEQ ID NO: 1596984 - RNA, 14 nt, Human coronavirus 229E
uauguuacugaacc

SEQ ID NO: 1596985 - RNA, 23 nt, Human coronavirus 229E
uucuggguuuuaaagauguuacu

SEQ ID NO: 1596986 - RNA, 14 nt, Human coronavirus 229E
accugcaacugcug

SEQ ID NO: 1596987 - RNA, 14 nt, Human coronavirus 229E
aagacgcugcaaga

SEQ ID NO: 1596988 - RNA, 16 nt, Human coronavirus 229E
ggccuuuguugcauuu

SEQ ID NO: 1596989 - RNA, 14 nt, Human coronavirus 229E
cucagaguucugaa

SEQ ID NO: 1596990 - RNA, 15 nt, Human coronavirus 229E
acuuggcuugugcuc

SEQ ID NO: 1596991 - RNA, 17 nt, Human coronavirus 229E
ugauuacugguagauug

SEQ ID NO: 1596992 - RNA, 18 nt, Human coronavirus 229E
agacuauuuugaauuuga

SEQ ID NO: 1596993 - RNA, 18 nt, Human coronavirus 229E
cuaaacaugccacugugu

SEQ ID NO: 1596994 - RNA, 17 nt, Human coronavirus 229E
guuuaugugccauugcu

SEQ ID NO: 1596995 - RNA, 23 nt, Human coronavirus 229E
ugcccaaagaccauccacacuug

SEQ ID NO: 1596996 - RNA, 21 nt, Human coronavirus 229E
ggccacucguacuugcuuugu

SEQ ID NO: 1596997 - RNA, 18 nt, Human coronavirus 229E
auaacggugaauguguau

SEQ ID NO: 1596998 - RNA, 19 nt, Human coronavirus 229E
gcauuacugugaccuugcu

SEQ ID NO: 1596999 - RNA, 15 nt, Human coronavirus 229E
guucagguucauaac

SEQ ID NO: 1597000 - RNA, 18 nt, Human coronavirus 229E
ugaccacaacuuuggaag

SEQ ID NO: 1597001 - RNA, 14 nt, Human coronavirus 229E
cagaaccagagaua

SEQ ID NO: 1597002 - RNA, 22 nt, Human coronavirus 229E
ugcuaauauaauuuauugcaac

SEQ ID NO: 1597003 - RNA, 16 nt, Human coronavirus 229E
gcuguugauggugcua

SEQ ID NO: 1597004 - RNA, 12 nt, Human coronavirus 229E
aguauaacucau

SEQ ID NO: 1597005 - RNA, 17 nt, Human coronavirus 229E
ucuacguacgaguaaaa

SEQ ID NO: 1597006 - RNA, 18 nt, Human coronavirus 229E
aagacaugggauuucauu

SEQ ID NO: 1597007 - RNA, 12 nt, Human coronavirus 229E
uacuucugcuug

SEQ ID NO: 1597008 - RNA, 17 nt, Human coronavirus 229E
uguuuuaacuuauucua

SEQ ID NO: 1597009 - RNA, 22 nt, Human coronavirus 229E
accagugcgugaugaaguuucu

SEQ ID NO: 1597010 - RNA, 16 nt, Human coronavirus 229E
uugcaacucuguuauu

SEQ ID NO: 1597011 - RNA, 16 nt, Human coronavirus 229E
uaauuucaaugucacu

SEQ ID NO: 1597012 - RNA, 22 nt, Human coronavirus 229E
uauauacccuccgacuuugcau

SEQ ID NO: 1597013 - RNA, 15 nt, Human coronavirus 229E
ucacauugcaacuug

SEQ ID NO: 1597014 - RNA, 22 nt, Human coronavirus 229E
auguguauacuuguuuugugaa

SEQ ID NO: 1597015 - RNA, 14 nt, Human coronavirus 229E
guuuaugugccauu

SEQ ID NO: 1597016 - RNA, 17 nt, Human coronavirus 229E
uacuauguuacugaacc

SEQ ID NO: 1597017 - RNA, 15 nt, Human coronavirus 229E
cgaucagagcugcuu

SEQ ID NO: 1597018 - RNA, 15 nt, Human coronavirus 229E
ugauuucuaaacuaa

SEQ ID NO: 1597019 - RNA, 20 nt, Human coronavirus 229E
cgugaaagauggcacuguua

SEQ ID NO: 1597020 - RNA, 19 nt, Human coronavirus 229E
cuuuuggcaaaguuaauaa

SEQ ID NO: 1597021 - RNA, 13 nt, Human coronavirus 229E
uguuguuguucua

SEQ ID NO: 1597022 - RNA, 14 nt, Human coronavirus 229E
auuacaaaugugcu

SEQ ID NO: 1597023 - RNA, 21 nt, Human coronavirus 229E
uguugauggugcuaaaacuga

SEQ ID NO: 1597024 - RNA, 14 nt, Human coronavirus 229E
ugucugcuguuaau

SEQ ID NO: 1597025 - RNA, 23 nt, Human coronavirus 229E
aagcuuuguuucacuugccauau

SEQ ID NO: 1597026 - RNA, 18 nt, Human coronavirus 229E
caaugaaacuacgucugc

SEQ ID NO: 1597027 - RNA, 15 nt, Human coronavirus 229E
gccaaauuacacugu

SEQ ID NO: 1597028 - RNA, 19 nt, Human coronavirus 229E
aauguauucguuucucaua

SEQ ID NO: 1597029 - RNA, 21 nt, Human coronavirus 229E
agcaugaaaugcaaaagccac

SEQ ID NO: 1597030 - RNA, 20 nt, Human coronavirus 229E
agauugcuucauuuuuucua

SEQ ID NO: 1597031 - RNA, 19 nt, Human coronavirus 229E
uucuguggaaauggcacuc

SEQ ID NO: 1597032 - RNA, 23 nt, Human coronavirus 229E
cuaguauaacucauuacaaaugu

SEQ ID NO: 1597033 - RNA, 21 nt, Human coronavirus 229E
ugcacagacgcuguuuuaacu

SEQ ID NO: 1597034 - RNA, 21 nt, Human coronavirus 229E
cuauugugucgcuaccuguuu

SEQ ID NO: 1597035 - RNA, 20 nt, Human coronavirus 229E
ccaaugguguuaaagcuaaa

SEQ ID NO: 1597036 - RNA, 18 nt, Human coronavirus 229E
cucuagguuuguucacau

SEQ ID NO: 1597037 - RNA, 17 nt, Human coronavirus 229E
uucuauugaaacugaca

SEQ ID NO: 1597038 - RNA, 17 nt, Human coronavirus 229E
gcucuagguuuguucac

SEQ ID NO: 1597039 - RNA, 16 nt, Human coronavirus 229E
guguugggacagacau

SEQ ID NO: 1597040 - RNA, 12 nt, Human coronavirus 229E
gaacaguuuaug

SEQ ID NO: 1597041 - RNA, 11 nt, Human coronavirus 229E
uaauguuguag

SEQ ID NO: 1597042 - RNA, 17 nt, Human coronavirus 229E
ucuacaagcccuauuca

SEQ ID NO: 1597043 - RNA, 15 nt, Human coronavirus 229E
uuguucacauugcaa

SEQ ID NO: 1597044 - RNA, 19 nt, Human coronavirus 229E
uggugaguauguugcuauu

SEQ ID NO: 1597045 - RNA, 17 nt, Human coronavirus 229E
aguuuuggugacuacaa

SEQ ID NO: 1597046 - RNA, 11 nt, Human coronavirus 229E
uacacuguucc

SEQ ID NO: 1597047 - RNA, 14 nt, Human coronavirus 229E
aacuuauucuaguu

SEQ ID NO: 1597048 - RNA, 15 nt, Human coronavirus 229E
cagucgugcucaucu

SEQ ID NO: 1597049 - RNA, 20 nt, Human coronavirus 229E
uaguuacggcuuuucuaaug

SEQ ID NO: 1597050 - RNA, 18 nt, Human coronavirus 229E
caaacaguuucagacuuu

SEQ ID NO: 1597051 - RNA, 17 nt, Human coronavirus 229E
cacuacuagagugacug

SEQ ID NO: 1597052 - RNA, 16 nt, Human coronavirus 229E
aauaauuaaacuaauu

SEQ ID NO: 1597053 - RNA, 19 nt, Human coronavirus 229E
auuuggcaguguauguuuu

SEQ ID NO: 1597054 - RNA, 13 nt, Human coronavirus 229E
ucagguguucagg

SEQ ID NO: 1597055 - RNA, 18 nt, Human coronavirus 229E
uugcuguaauuuugcuug

SEQ ID NO: 1597056 - RNA, 15 nt, Human coronavirus 229E
cagaguucugaaaca

SEQ ID NO: 1597057 - RNA, 18 nt, Human coronavirus 229E
uguaacccaccagaucag

SEQ ID NO: 1597058 - RNA, 20 nt, Human coronavirus 229E
agaugguuuuuauucuacaa

SEQ ID NO: 1597059 - RNA, 17 nt, Human coronavirus 229E
acugugaccuugcugag

SEQ ID NO: 1597060 - RNA, 12 nt, Human coronavirus 229E
cuccaacaggca

SEQ ID NO: 1597061 - RNA, 16 nt, Human coronavirus 229E
ucgugcucaucuuugu

SEQ ID NO: 1597062 - RNA, 19 nt, Human coronavirus 229E
cugaugcugaacgaauggc

SEQ ID NO: 1597063 - RNA, 18 nt, Human coronavirus 229E
acuguguuguuugaaauu

SEQ ID NO: 1597064 - RNA, 20 nt, Human coronavirus 229E
acugauuuuuguacuguugc

SEQ ID NO: 1597065 - RNA, 14 nt, Human coronavirus 229E
acuuugauugcugu

SEQ ID NO: 1597066 - RNA, 17 nt, Human coronavirus 229E
uagcucuauucaggcua

SEQ ID NO: 1597067 - RNA, 13 nt, Human coronavirus 229E
ugacacuauucag

SEQ ID NO: 1597068 - RNA, 21 nt, Human coronavirus 229E
cagagaccuugaccacaacuu

SEQ ID NO: 1597069 - RNA, 19 nt, Human coronavirus 229E
gguacgaucagagcugcuu

SEQ ID NO: 1597070 - RNA, 13 nt, Human coronavirus 229E
cacuccuuguaac

SEQ ID NO: 1597071 - RNA, 23 nt, Human coronavirus 229E
gucuugacuuucacuacuagagu

SEQ ID NO: 1597072 - RNA, 15 nt, Human coronavirus 229E
aaauuauguugcauu

SEQ ID NO: 1597073 - RNA, 14 nt, Human coronavirus 229E
uuacucuguuugca

SEQ ID NO: 1597074 - RNA, 12 nt, Human coronavirus 229E
uguuacuucugg

SEQ ID NO: 1597075 - RNA, 19 nt, Human coronavirus 229E
gauugcuguaauuuugcuu

SEQ ID NO: 1597076 - RNA, 19 nt, Human coronavirus 229E
aaacaguuucagacuuuuc

SEQ ID NO: 1597077 - RNA, 13 nt, Human coronavirus 229E
cagcuaucgucac

SEQ ID NO: 1597078 - RNA, 22 nt, Human coronavirus 229E
gucacaaaccucuauugcuaau

SEQ ID NO: 1597079 - RNA, 14 nt, Human coronavirus 229E
guguguggugcuua

SEQ ID NO: 1597080 - RNA, 14 nt, Human coronavirus 229E
gaaggcaguugcug

SEQ ID NO: 1597081 - RNA, 15 nt, Human coronavirus 229E
cuuggcacugcuggc

SEQ ID NO: 1597082 - RNA, 17 nt, Human coronavirus 229E
acuuucacuacuagagu

SEQ ID NO: 1597083 - RNA, 23 nt, Human coronavirus 229E
agauuguuuuaugguuugaagau

SEQ ID NO: 1597084 - RNA, 21 nt, Human coronavirus 229E
gguucuauaauugcuguucaa

SEQ ID NO: 1597085 - RNA, 13 nt, Human coronavirus 229E
auaauugcuguuc

SEQ ID NO: 1597086 - RNA, 18 nt, Human coronavirus 229E
auaccucaucuguuguag

SEQ ID NO: 1597087 - RNA, 22 nt, Human coronavirus 229E
aaaauaaggcucugaaaccauu

SEQ ID NO: 1597088 - RNA, 15 nt, Human coronavirus 229E
gagcaacaugacaga

SEQ ID NO: 1597089 - RNA, 20 nt, Human coronavirus 229E
ccguuaauuucaaugucacu

SEQ ID NO: 1597090 - RNA, 22 nt, Human coronavirus 229E
uguuaguuccuuuaugaauguu

SEQ ID NO: 1597091 - RNA, 12 nt, Human coronavirus 229E
gcauauugcugg

SEQ ID NO: 1597092 - RNA, 15 nt, Human coronavirus 229E
aacaggcauuacugu

SEQ ID NO: 1597093 - RNA, 18 nt, Human coronavirus 229E
ugagcaacaugacagaaa

SEQ ID NO: 1597094 - RNA, 23 nt, Human coronavirus 229E
ucuacaagacaugggauuucauu

SEQ ID NO: 1597095 - RNA, 20 nt, Human coronavirus 229E
aaucagaguccugcuucuuc

SEQ ID NO: 1597096 - RNA, 19 nt, Human coronavirus 229E
ugcucguucucagaguucu

SEQ ID NO: 1597097 - RNA, 21 nt, Human coronavirus 229E
ccauggcagauuuuguucaaa

SEQ ID NO: 1597098 - RNA, 18 nt, Human coronavirus 229E
uguugguuucuugaaaau

SEQ ID NO: 1597099 - RNA, 12 nt, Human coronavirus 229E
aggcaauuauua

SEQ ID NO: 1597100 - RNA, 21 nt, Human coronavirus 229E
ucuauuagagguuguugugaa

SEQ ID NO: 1597101 - RNA, 21 nt, Human coronavirus 229E
guuauucagaaaauguauuug

SEQ ID NO: 1597102 - RNA, 17 nt, Human coronavirus 229E
gucacacaauguuuugg

SEQ ID NO: 1597103 - RNA, 22 nt, Human coronavirus 229E
acuaguuacucuguuugcaacg

SEQ ID NO: 1597104 - RNA, 22 nt, Human coronavirus 229E
agugaacaaccuuggaagguga

SEQ ID NO: 1597105 - RNA, 16 nt, Human coronavirus 229E
uggcacuuauaauugc

SEQ ID NO: 1597106 - RNA, 19 nt, Human coronavirus 229E
uacuacugguuuugucuau

SEQ ID NO: 1597107 - RNA, 16 nt, Human coronavirus 229E
cguggcagagcugcuc

SEQ ID NO: 1597108 - RNA, 18 nt, Human coronavirus 229E
agagucaggcaacacugu

SEQ ID NO: 1597109 - RNA, 17 nt, Human coronavirus 229E
uuuuguucuuucuuuua

SEQ ID NO: 1597110 - RNA, 24 nt, Human coronavirus 229E
uuugccuggcgucgcugaugcuga

SEQ ID NO: 1597111 - RNA, 20 nt, Human coronavirus 229E
auacguuuauuguguuguac

SEQ ID NO: 1597112 - RNA, 12 nt, Human coronavirus 229E
caacuuuggaag

SEQ ID NO: 1597113 - RNA, 19 nt, Human coronavirus 229E
uaguauaacucauuacaaa

SEQ ID NO: 1597114 - RNA, 22 nt, Human coronavirus 229E
guuaggcgcaagaauucagaac

SEQ ID NO: 1597115 - RNA, 19 nt, Human coronavirus 229E
ugaugaaguaaacuaaaca

SEQ ID NO: 1597116 - RNA, 13 nt, Human coronavirus 229E
caagugacagaaa

SEQ ID NO: 1597117 - RNA, 16 nt, Human coronavirus 229E
cugauguuuuacaaga

SEQ ID NO: 1597118 - RNA, 18 nt, Human coronavirus 229E
agaguucugaaacaaaag

SEQ ID NO: 1597119 - RNA, 22 nt, Human coronavirus 229E
ugaaauuagcacccuugaaaau

SEQ ID NO: 1597120 - RNA, 13 nt, Human coronavirus 229E
ucaacagcugcua

SEQ ID NO: 1597121 - RNA, 15 nt, Human coronavirus 229E
acuguuguugaagaa

SEQ ID NO: 1597122 - RNA, 21 nt, Human coronavirus 229E
uaaugagccucuuuguugugu

SEQ ID NO: 1597123 - RNA, 19 nt, Human coronavirus 229E
agcgucauaccuagcuugc

SEQ ID NO: 1597124 - RNA, 18 nt, Human coronavirus 229E
gcaguauacuucugcuug

SEQ ID NO: 1597125 - RNA, 15 nt, Human coronavirus 229E
aaacuucugccaaga

SEQ ID NO: 1597126 - RNA, 13 nt, Human coronavirus 229E
acgaucagagcug

SEQ ID NO: 1597127 - RNA, 16 nt, Human coronavirus 229E
auauugauguuaauaa

SEQ ID NO: 1597128 - RNA, 20 nt, Human coronavirus 229E
auacuuguuuugugaacacc

SEQ ID NO: 1597129 - RNA, 22 nt, Human coronavirus 229E
uaaccuucuggguuuuaaagau

SEQ ID NO: 1597130 - RNA, 12 nt, Human coronavirus 229E
auuuuaaugaaa

SEQ ID NO: 1597131 - RNA, 17 nt, Human coronavirus 229E
cugcaucuuuuaacaaa

SEQ ID NO: 1597132 - RNA, 17 nt, Human coronavirus 229E
guuuucuacguacgagu

SEQ ID NO: 1597133 - RNA, 20 nt, Human coronavirus 229E
gcauucacuagagaaaugca

SEQ ID NO: 1597134 - RNA, 18 nt, Human coronavirus 229E
cuacaagcccuauucaau

SEQ ID NO: 1597135 - RNA, 18 nt, Human coronavirus 229E
uucacuagagaaaugcaa

SEQ ID NO: 1597136 - RNA, 18 nt, Human coronavirus 229E
uugcuuuauuuaaagcaa

SEQ ID NO: 1597137 - RNA, 20 nt, Human coronavirus 229E
aauauaauuuauugcaacuc

SEQ ID NO: 1597138 - RNA, 12 nt, Human coronavirus 229E
uucagccuuugu

SEQ ID NO: 1597139 - RNA, 22 nt, Human coronavirus 229E
aaagauggcuacagucaaaugg

SEQ ID NO: 1597140 - RNA, 21 nt, Human coronavirus 229E
uacaaauugccaaauuacacu

SEQ ID NO: 1597141 - RNA, 17 nt, Human coronavirus 229E
cuauaauugcuguucaa

SEQ ID NO: 1597142 - RNA, 18 nt, Human coronavirus 229E
uagauuggcugcuuugaa

SEQ ID NO: 1597143 - RNA, 15 nt, Human coronavirus 229E
uagugagaugcucac

SEQ ID NO: 1597144 - RNA, 14 nt, Human coronavirus 229E
guuucagaacuaga

SEQ ID NO: 1597145 - RNA, 18 nt, Human coronavirus 229E
uuugcuuuuguucuuucu

SEQ ID NO: 1597146 - RNA, 19 nt, Human coronavirus 229E
guacccaucaacaagaaag

SEQ ID NO: 1597147 - RNA, 14 nt, Human coronavirus 229E
uuauucuacaagcc

SEQ ID NO: 1597148 - RNA, 13 nt, Human coronavirus 229E
cuaaguacacuga

SEQ ID NO: 1597149 - RNA, 19 nt, Human coronavirus 229E
uaauaacuuuguuaaauuu

SEQ ID NO: 1597150 - RNA, 16 nt, Human coronavirus 229E
caauguuuuggcccca

SEQ ID NO: 1597151 - RNA, 13 nt, Human coronavirus 229E
uagguuuugacaa

SEQ ID NO: 1597152 - RNA, 19 nt, Human coronavirus 229E
uugucgaacaguacaacca

SEQ ID NO: 1597153 - RNA, 15 nt, Human coronavirus 229E
acuuucacuacuaga

SEQ ID NO: 1597154 - RNA, 19 nt, Human coronavirus 229E
ugaugcuauuacacaaacu

SEQ ID NO: 1597155 - RNA, 20 nt, Human coronavirus 229E
ggaugacaucaugaaggcag

SEQ ID NO: 1597156 - RNA, 23 nt, Human coronavirus 229E
cugccaagagucuugcucguucu

SEQ ID NO: 1597157 - RNA, 20 nt, Human coronavirus 229E
uuaacacgggaaauugcccu

SEQ ID NO: 1597158 - RNA, 17 nt, Human coronavirus 229E
gacagaauuguuucuua

SEQ ID NO: 1597159 - RNA, 14 nt, Human coronavirus 229E
agcccuuugcuugu

SEQ ID NO: 1597160 - RNA, 19 nt, Human coronavirus 229E
uguaauuuugcuuggaaga

SEQ ID NO: 1597161 - RNA, 14 nt, Human coronavirus 229E
cuuaauuacacugu

SEQ ID NO: 1597162 - RNA, 18 nt, Human coronavirus 229E
acgacagguuauccaaga

SEQ ID NO: 1597163 - RNA, 15 nt, Human coronavirus 229E
auuggcugcuuugaa

SEQ ID NO: 1597164 - RNA, 17 nt, Human coronavirus 229E
uaauggcuaucgcuauu

SEQ ID NO: 1597165 - RNA, 15 nt, Human coronavirus 229E
cagugcgugaugaag

SEQ ID NO: 1597166 - RNA, 21 nt, Human coronavirus 229E
auuuaccaaucauauaugcac

SEQ ID NO: 1597167 - RNA, 17 nt, Human coronavirus 229E
aguuucacgacagguua

SEQ ID NO: 1597168 - RNA, 16 nt, Human coronavirus 229E
agagaaaugcaacaac

SEQ ID NO: 1597169 - RNA, 20 nt, Human coronavirus 229E
uuugucuauaccuuccaauu

SEQ ID NO: 1597170 - RNA, 14 nt, Human coronavirus 229E
uuucuauugaaacu

SEQ ID NO: 1597171 - RNA, 11 nt, Human coronavirus 229E
gcuuguugaua

SEQ ID NO: 1597172 - RNA, 21 nt, Human coronavirus 229E
ggcgcaagaauucagaaccag

SEQ ID NO: 1597173 - RNA, 16 nt, Human coronavirus 229E
uaguuacucuguuugc

SEQ ID NO: 1597174 - RNA, 14 nt, Human coronavirus 229E
uguuuaaaauucua

SEQ ID NO: 1597175 - RNA, 15 nt, Human coronavirus 229E
ucuuuguuguguauu

SEQ ID NO: 1597176 - RNA, 18 nt, Human coronavirus 229E
cuauaauugcuguucaac

SEQ ID NO: 1597177 - RNA, 23 nt, Human coronavirus 229E
uguugauggugcuaaaacugaac

SEQ ID NO: 1597178 - RNA, 22 nt, Human coronavirus 229E
gaaagacaaaaauaagcuuaua

SEQ ID NO: 1597179 - RNA, 17 nt, Human coronavirus 229E
gagccaacaauggaaga

SEQ ID NO: 1597180 - RNA, 13 nt, Human coronavirus 229E
augacagacuuga

SEQ ID NO: 1597181 - RNA, 21 nt, Human coronavirus 229E
cuuaagcaguauacuucugcu

SEQ ID NO: 1597182 - RNA, 14 nt, Human coronavirus 229E
cucugaguugcaaa

SEQ ID NO: 1597183 - RNA, 15 nt, Human coronavirus 229E
accuaaucuugcucu

SEQ ID NO: 1597184 - RNA, 13 nt, Human coronavirus 229E
uguuguugaagaa

SEQ ID NO: 1597185 - RNA, 17 nt, Human coronavirus 229E
gagucaggcaacacugu

SEQ ID NO: 1597186 - RNA, 17 nt, Human coronavirus 229E
agcuuggcacugcuggc

SEQ ID NO: 1597187 - RNA, 21 nt, Human coronavirus 229E
uguuuaucauaaacauacguu

SEQ ID NO: 1597188 - RNA, 22 nt, Human coronavirus 229E
cccaucucaaacuucaccugca

SEQ ID NO: 1597189 - RNA, 13 nt, Human coronavirus 229E
ucacuagagaaau

SEQ ID NO: 1597190 - RNA, 13 nt, Human coronavirus 229E
cgagccaacaaug

SEQ ID NO: 1597191 - RNA, 19 nt, Human coronavirus 229E
accccauaaagaugcaaaa

SEQ ID NO: 1597192 - RNA, 22 nt, Human coronavirus 229E
cagucaggaugacaucaugaag

SEQ ID NO: 1597193 - RNA, 20 nt, Human coronavirus 229E
ucaacaagcuccaacaggca

SEQ ID NO: 1597194 - RNA, 15 nt, Human coronavirus 229E
acgcuguuuuaacuu

SEQ ID NO: 1597195 - RNA, 15 nt, Human coronavirus 229E
gaucccuugcuuugg

SEQ ID NO: 1597196 - RNA, 18 nt, Human coronavirus 229E
cauugacuaaguacacug

SEQ ID NO: 1597197 - RNA, 17 nt, Human coronavirus 229E
uauugcaacucuguuau

SEQ ID NO: 1597198 - RNA, 19 nt, Human coronavirus 229E
uugaagacgccuuaagaaa

SEQ ID NO: 1597199 - RNA, 20 nt, Human coronavirus 229E
aauuagcacccuugaaaaua

SEQ ID NO: 1597200 - RNA, 17 nt, Human coronavirus 229E
agguugaguauuuacaa

SEQ ID NO: 1597201 - RNA, 20 nt, Human coronavirus 229E
uaacuuuguuaaauuuggca

SEQ ID NO: 1597202 - RNA, 18 nt, Human coronavirus 229E
aacaucagccguuucaau

SEQ ID NO: 1597203 - RNA, 16 nt, Human coronavirus 229E
agcuuaauuacacugu

SEQ ID NO: 1597204 - RNA, 18 nt, Human coronavirus 229E
gccaaauuacacuguucc

SEQ ID NO: 1597205 - RNA, 23 nt, Human coronavirus 229E
agccaacaauggaagagccaguc

SEQ ID NO: 1597206 - RNA, 19 nt, Human coronavirus 229E
aacuaauuaagcuuuguuu

SEQ ID NO: 1597207 - RNA, 20 nt, Human coronavirus 229E
cugcuuuugugggugcacua

SEQ ID NO: 1597208 - RNA, 20 nt, Human coronavirus 229E
cucguucucagaguucugaa

SEQ ID NO: 1597209 - RNA, 12 nt, Human coronavirus 229E
uguauuuugcuu

SEQ ID NO: 1597210 - RNA, 17 nt, Human coronavirus 229E
acuucaaaccucagagu

SEQ ID NO: 1597211 - RNA, 16 nt, Human coronavirus 229E
uaaagaccucagccuu

SEQ ID NO: 1597212 - RNA, 13 nt, Human coronavirus 229E
auaaccuaccuga

SEQ ID NO: 1597213 - RNA, 20 nt, Human coronavirus 229E
aaacaucuuaugguguuguu

SEQ ID NO: 1597214 - RNA, 16 nt, Human coronavirus 229E
cauacguuuauugugu

SEQ ID NO: 1597215 - RNA, 14 nt, Human coronavirus 229E
ggauacacaaaaaa

SEQ ID NO: 1597216 - RNA, 19 nt, Human coronavirus 229E
aauaaggcucugaaaccau

SEQ ID NO: 1597217 - RNA, 21 nt, Human coronavirus 229E
cuaggugaacgcuaguauaac

SEQ ID NO: 1597218 - RNA, 13 nt, Human coronavirus 229E
ugaaaauaaaucu

SEQ ID NO: 1597219 - RNA, 12 nt, Human coronavirus 229E
cucuagcucuau

SEQ ID NO: 1597220 - RNA, 18 nt, Human coronavirus 229E
ugucacccauuugaagaa

SEQ ID NO: 1597221 - RNA, 20 nt, Human coronavirus 229E
gagccagucauuugucuuga

SEQ ID NO: 1597222 - RNA, 14 nt, Human coronavirus 229E
gaucccuugcuuug

SEQ ID NO: 1597223 - RNA, 20 nt, Human coronavirus 229E
uccagacagcuugcacaaca

SEQ ID NO: 1597224 - RNA, 13 nt, Human coronavirus 229E
uggccccagagac

SEQ ID NO: 1597225 - RNA, 18 nt, Human coronavirus 229E
uuuuucuccacacugucu

SEQ ID NO: 1597226 - RNA, 14 nt, Human coronavirus 229E
agcuuggcacugcu

SEQ ID NO: 1597227 - RNA, 15 nt, Human coronavirus 229E
gccgagcacuacuau

SEQ ID NO: 1597228 - RNA, 16 nt, Human coronavirus 229E
ggcacucacauuuucu

SEQ ID NO: 1597229 - RNA, 23 nt, Human coronavirus 229E
cuaaacgaguuauugauuucuaa

SEQ ID NO: 1597230 - RNA, 16 nt, Human coronavirus 229E
ugugucugcuguuaau

SEQ ID NO: 1597231 - RNA, 17 nt, Human coronavirus 229E
uugcauuuagcuuuuuu

SEQ ID NO: 1597232 - RNA, 15 nt, Human coronavirus 229E
uuuauugcuuuguaa

SEQ ID NO: 1597233 - RNA, 13 nt, Human coronavirus 229E
ugagcuaccugug

SEQ ID NO: 1597234 - RNA, 14 nt, Human coronavirus 229E
guucuuucuuuuau

SEQ ID NO: 1597235 - RNA, 22 nt, Human coronavirus 229E
ccagaguauauugauguuaaua

SEQ ID NO: 1597236 - RNA, 19 nt, Human coronavirus 229E
caaauugccaaauuacacu

SEQ ID NO: 1597237 - RNA, 14 nt, Human coronavirus 229E
aagacgugaaagau

SEQ ID NO: 1597238 - RNA, 17 nt, Human coronavirus 229E
aguuacggcuuuucuaa

SEQ ID NO: 1597239 - RNA, 17 nt, Human coronavirus 229E
cuauuacacaaacuuca

SEQ ID NO: 1597240 - RNA, 17 nt, Human coronavirus 229E
augaugcuauuacacaa

SEQ ID NO: 1597241 - RNA, 22 nt, Human coronavirus 229E
gacagguuauccaagacgugaa

SEQ ID NO: 1597242 - RNA, 16 nt, Human coronavirus 229E
cauaacagucaggaug

SEQ ID NO: 1597243 - RNA, 23 nt, Human coronavirus 229E
cgucccacaaccuguugagggug

SEQ ID NO: 1597244 - RNA, 21 nt, Human coronavirus 229E
ucaagcuaucucuagcucuau

SEQ ID NO: 1597245 - RNA, 17 nt, Human coronavirus 229E
cuaaugagccucuuugu

SEQ ID NO: 1597246 - RNA, 16 nt, Human coronavirus 229E
guccugcuucuucuca

SEQ ID NO: 1597247 - RNA, 14 nt, Human coronavirus 229E
agcuccaacaggca

SEQ ID NO: 1597248 - RNA, 14 nt, Human coronavirus 229E
auacuucugcuugu

SEQ ID NO: 1597249 - RNA, 17 nt, Human coronavirus 229E
uagucuuauacacaaug

SEQ ID NO: 1597250 - RNA, 19 nt, Human coronavirus 229E
cuucgcaaacaguuucaga

SEQ ID NO: 1597251 - RNA, 13 nt, Human coronavirus 229E
auuacguacacau

SEQ ID NO: 1597252 - RNA, 16 nt, Human coronavirus 229E
auaccucaucuguugu

SEQ ID NO: 1597253 - RNA, 21 nt, Human coronavirus 229E
gccacuguguuguuugaaauu

SEQ ID NO: 1597254 - RNA, 17 nt, Human coronavirus 229E
cugaugcaucugaacca

SEQ ID NO: 1597255 - RNA, 18 nt, Human coronavirus 229E
cugaugcaucugaaccac

SEQ ID NO: 1597256 - RNA, 16 nt, Human coronavirus 229E
gaaaauuuuacuaguu

SEQ ID NO: 1597257 - RNA, 16 nt, Human coronavirus 229E
uuaaaauucuaauccu

SEQ ID NO: 1597258 - RNA, 20 nt, Human coronavirus 229E
agcguuuacacuugcuaaug

SEQ ID NO: 1597259 - RNA, 23 nt, Human coronavirus 229E
gacagaaaacgaaagauugcuuc

SEQ ID NO: 1597260 - RNA, 15 nt, Human coronavirus 229E
acagcugcuaugcug

SEQ ID NO: 1597261 - RNA, 19 nt, Human coronavirus 229E
augguacgaucagagcugc

SEQ ID NO: 1597262 - RNA, 23 nt, Human coronavirus 229E
uuucucaacuaacgacuuguacg

SEQ ID NO: 1597263 - RNA, 12 nt, Human coronavirus 229E
ccuagugcacua

SEQ ID NO: 1597264 - RNA, 21 nt, Human coronavirus 229E
uguuuaucagcaagcuguugu

SEQ ID NO: 1597265 - RNA, 16 nt, Human coronavirus 229E
gguacgaucagagcug

SEQ ID NO: 1597266 - RNA, 17 nt, Human coronavirus 229E
auacuacuaguguguau

SEQ ID NO: 1597267 - RNA, 16 nt, Human coronavirus 229E
gaagagccagucauuu

SEQ ID NO: 1597268 - RNA, 20 nt, Human coronavirus 229E
accuaccugaauacaugaca

SEQ ID NO: 1597269 - RNA, 14 nt, Human coronavirus 229E
cagccuuuguugcu

SEQ ID NO: 1597270 - RNA, 19 nt, Human coronavirus 229E
aggcucauuguauguuucu

SEQ ID NO: 1597271 - RNA, 14 nt, Human coronavirus 229E
ugagguuaaugcaa

SEQ ID NO: 1597272 - RNA, 11 nt, Human coronavirus 229E
uauaauuuaua

SEQ ID NO: 1597273 - RNA, 12 nt, Human coronavirus 229E
uauguugcuauu

SEQ ID NO: 1597274 - RNA, 21 nt, Human coronavirus 229E
ccaaauacguugcuguuuaug

SEQ ID NO: 1597275 - RNA, 22 nt, Human coronavirus 229E
caugaaggcaguugcugcggcu

SEQ ID NO: 1597276 - RNA, 16 nt, Human coronavirus 229E
ccugugucuauugugu

SEQ ID NO: 1597277 - RNA, 17 nt, Human coronavirus 229E
uccaagacgugaaagau

SEQ ID NO: 1597278 - RNA, 15 nt, Human coronavirus 229E
auuucuaaacuaaac

SEQ ID NO: 1597279 - RNA, 15 nt, Human coronavirus 229E
cacgguggaaaagac

SEQ ID NO: 1597280 - RNA, 22 nt, Human coronavirus 229E
aucagaguccugcuucuucuca

SEQ ID NO: 1597281 - RNA, 14 nt, Human coronavirus 229E
auguuacugaaccu

SEQ ID NO: 1597282 - RNA, 13 nt, Human coronavirus 229E
aaacucugauuga

SEQ ID NO: 1597283 - RNA, 17 nt, Human coronavirus 229E
ugucacccauuugaaga

SEQ ID NO: 1597284 - RNA, 12 nt, Human coronavirus 229E
uguuggugcuau

SEQ ID NO: 1597285 - RNA, 16 nt, Human coronavirus 229E
ccagugaaauuagcac

SEQ ID NO: 1597286 - RNA, 21 nt, Human coronavirus 229E
cauugucacccauuugaagaa

SEQ ID NO: 1597287 - RNA, 20 nt, Human coronavirus 229E
ucaggcuaucuaugacagac

SEQ ID NO: 1597288 - RNA, 16 nt, Human coronavirus 229E
uuuguaaauacuacua

SEQ ID NO: 1597289 - RNA, 17 nt, Human coronavirus 229E
uuguucacauugcaacu

SEQ ID NO: 1597290 - RNA, 23 nt, Human coronavirus 229E
uuucaggugaugcucacauacca

SEQ ID NO: 1597291 - RNA, 13 nt, Human coronavirus 229E
gauuuuguucaaa

SEQ ID NO: 1597292 - RNA, 19 nt, Human coronavirus 229E
gauuuuuccauacagcuug

SEQ ID NO: 1597293 - RNA, 17 nt, Human coronavirus 229E
gcaaacaguuucagacu

SEQ ID NO: 1597294 - RNA, 18 nt, Human coronavirus 229E
cuauaauugcuguucaac

SEQ ID NO: 1597295 - RNA, 15 nt, Human coronavirus 229E
acucuguuugcaacg

SEQ ID NO: 1597296 - RNA, 16 nt, Human coronavirus 229E
cacauuuguuaacauu

SEQ ID NO: 1597297 - RNA, 17 nt, Human coronavirus 229E
cuguucaaaaauugcaa

SEQ ID NO: 1597298 - RNA, 13 nt, Human coronavirus 229E
cuuauaauugcac

SEQ ID NO: 1597299 - RNA, 14 nt, Human coronavirus 229E
cuguuguugaagaa

SEQ ID NO: 1597300 - RNA, 15 nt, Human coronavirus 229E
gcaucuuuuaacaaa

SEQ ID NO: 1597301 - RNA, 14 nt, Human coronavirus 229E
auugaaaauugcaa

SEQ ID NO: 1597302 - RNA, 23 nt, Human coronavirus 229E
agauuguuuuaugguuugaagau

SEQ ID NO: 1597303 - RNA, 24 nt, Human coronavirus 229E
aauugcaaacucugauugacaaca

SEQ ID NO: 1597304 - RNA, 14 nt, Human coronavirus 229E
aauuuauugcaacu

SEQ ID NO: 1597305 - RNA, 19 nt, Human coronavirus 229E
uaaucuugcucuuuacaaa

SEQ ID NO: 1597306 - RNA, 12 nt, Human coronavirus 229E
uacaaagaaggc

SEQ ID NO: 1597307 - RNA, 19 nt, Human coronavirus 229E
ugaccagugaaauuagcac

SEQ ID NO: 1597308 - RNA, 19 nt, Human coronavirus 229E
gcuuaauuacacuguucaa

SEQ ID NO: 1597309 - RNA, 15 nt, Human coronavirus 229E
gaauuaaguuacaaa

SEQ ID NO: 1597310 - RNA, 21 nt, Human coronavirus 229E
gaucaauuccuuuacauaggc

SEQ ID NO: 1597311 - RNA, 21 nt, Human coronavirus 229E
uuauauaacggugaaugugua

SEQ ID NO: 1597312 - RNA, 19 nt, Human coronavirus 229E
uugaaaagauccacauaca

SEQ ID NO: 1597313 - RNA, 13 nt, Human coronavirus 229E
uuaaaaaugugua

SEQ ID NO: 1597314 - RNA, 20 nt, Human coronavirus 229E
ugaucaacaaguagauaggc

SEQ ID NO: 1597315 - RNA, 19 nt, Human coronavirus 229E
ugauuacugguagauuggc

SEQ ID NO: 1597316 - RNA, 22 nt, Human coronavirus 229E
uauccaagacgugaaagauggc

SEQ ID NO: 1597317 - RNA, 16 nt, Human coronavirus 229E
uacugcacuuaacaag

SEQ ID NO: 1597318 - RNA, 14 nt, Human coronavirus 229E
uacuuuuuagcaaa

SEQ ID NO: 1597319 - RNA, 14 nt, Human coronavirus 229E
uagaagacauacuu

SEQ ID NO: 1597320 - RNA, 20 nt, Human coronavirus 229E
uacuaucaacccauucaaca

SEQ ID NO: 1597321 - RNA, 18 nt, Human coronavirus 229E
guuaauaacuuuguuaaa

SEQ ID NO: 1597322 - RNA, 20 nt, Human coronavirus 229E
guggccaaugguguuaaagc

SEQ ID NO: 1597323 - RNA, 18 nt, Human coronavirus 229E
gugcuuccagacagcuug

SEQ ID NO: 1597324 - RNA, 15 nt, Human coronavirus 229E
cccagagaccuugac

SEQ ID NO: 1597325 - RNA, 14 nt, Human coronavirus 229E
ccuuccaauuggac

SEQ ID NO: 1597326 - RNA, 22 nt, Human coronavirus 229E
caauuauuauagaaucacaucu

SEQ ID NO: 1597327 - RNA, 18 nt, Human coronavirus OC43 (HCoV-OC43)
uuguugaggcuuauaaua

SEQ ID NO: 1597328 - RNA, 22 nt, Human coronavirus OC43 (HCoV-OC43)
uuuaccauaguggccauuauua

SEQ ID NO: 1597329 - RNA, 16 nt, Human coronavirus OC43 (HCoV-OC43)
uaguaaaugaaugaag

SEQ ID NO: 1597330 - RNA, 15 nt, Human coronavirus OC43 (HCoV-OC43)
caacacuguuucaaa

SEQ ID NO: 1597331 - RNA, 16 nt, Human coronavirus OC43 (HCoV-OC43)
acucucuaucagaaug

SEQ ID NO: 1597332 - RNA, 18 nt, Human coronavirus OC43 (HCoV-OC43)
aagagccagcauguuaag

SEQ ID NO: 1597333 - RNA, 16 nt, Human coronavirus OC43 (HCoV-OC43)
aguguugcagugccca

SEQ ID NO: 1597334 - RNA, 18 nt, Human coronavirus OC43 (HCoV-OC43)
cagguuuugagaccauaa

SEQ ID NO: 1597335 - RNA, 22 nt, Human coronavirus OC43 (HCoV-OC43)
uauguuaggccgauaauugagg

SEQ ID NO: 1597336 - RNA, 19 nt, Human coronavirus OC43 (HCoV-OC43)
ucaaaagcuuauugcuaau

SEQ ID NO: 1597337 - RNA, 23 nt, Human coronavirus OC43 (HCoV-OC43)
aauaugaguccaaaaccacagcg

SEQ ID NO: 1597338 - RNA, 18 nt, Human coronavirus OC43 (HCoV-OC43)
gacugcagaggacaucag

SEQ ID NO: 1597339 - RNA, 19 nt, Human coronavirus OC43 (HCoV-OC43)
uauggagaagguuaaugaa

SEQ ID NO: 1597340 - RNA, 18 nt, Human coronavirus OC43 (HCoV-OC43)
aagccccgccagaagagg

SEQ ID NO: 1597341 - RNA, 17 nt, Human coronavirus OC43 (HCoV-OC43)
aguugaaaguuuugugu

SEQ ID NO: 1597342 - RNA, 19 nt, Human coronavirus OC43 (HCoV-OC43)
uacuaguuauauuaaugau

SEQ ID NO: 1597343 - RNA, 13 nt, Human coronavirus OC43 (HCoV-OC43)
guacugauacugu

SEQ ID NO: 1597344 - RNA, 22 nt, Human coronavirus OC43 (HCoV-OC43)
gaaugugucaaaagccaaucau

SEQ ID NO: 1597345 - RNA, 16 nt, Human coronavirus OC43 (HCoV-OC43)
uugcuguuuauguuaa

SEQ ID NO: 1597346 - RNA, 23 nt, Human coronavirus OC43 (HCoV-OC43)
gcaacuuuuaaauuguguauuca

SEQ ID NO: 1597347 - RNA, 18 nt, Human coronavirus OC43 (HCoV-OC43)
uacaaucauauugcaauu

SEQ ID NO: 1597348 - RNA, 16 nt, Human coronavirus OC43 (HCoV-OC43)
auggacauuuggagac

SEQ ID NO: 1597349 - RNA, 19 nt, Human coronavirus OC43 (HCoV-OC43)
guaaccccucgcagaaaag

SEQ ID NO: 1597350 - RNA, 19 nt, Human coronavirus OC43 (HCoV-OC43)
guuuguaugaaauucaaau

SEQ ID NO: 1597351 - RNA, 23 nt, Human coronavirus OC43 (HCoV-OC43)
uuucugugguaaugguaaucaua

SEQ ID NO: 1597352 - RNA, 17 nt, Human coronavirus OC43 (HCoV-OC43)
ucaagguauaaaacuag

SEQ ID NO: 1597353 - RNA, 11 nt, Human coronavirus OC43 (HCoV-OC43)
uuaauuucaau

SEQ ID NO: 1597354 - RNA, 11 nt, Human coronavirus OC43 (HCoV-OC43)
ccgccagaaga

SEQ ID NO: 1597355 - RNA, 22 nt, Human coronavirus OC43 (HCoV-OC43)
guuauuacccuacuucagguuc

SEQ ID NO: 1597356 - RNA, 23 nt, Human coronavirus OC43 (HCoV-OC43)
gcgcacauccagcagagccucua

SEQ ID NO: 1597357 - RNA, 18 nt, Human coronavirus OC43 (HCoV-OC43)
agcuaauaguuuaaugaa

SEQ ID NO: 1597358 - RNA, 17 nt, Human coronavirus OC43 (HCoV-OC43)
aagucgcaguauguuug

SEQ ID NO: 1597359 - RNA, 12 nt, Human coronavirus OC43 (HCoV-OC43)
uuuaaauugugu

SEQ ID NO: 1597360 - RNA, 22 nt, Human coronavirus OC43 (HCoV-OC43)
guaggcaguuuuaugaguuuua

SEQ ID NO: 1597361 - RNA, 15 nt, Human coronavirus OC43 (HCoV-OC43)
gaagagccagcaugu

SEQ ID NO: 1597362 - RNA, 22 nt, Human coronavirus OC43 (HCoV-OC43)
auuguugagaaauaauaucuaa

SEQ ID NO: 1597363 - RNA, 13 nt, Human coronavirus OC43 (HCoV-OC43)
caauucuggcaau

SEQ ID NO: 1597364 - RNA, 19 nt, Human coronavirus OC43 (HCoV-OC43)
ucacuugauuauauaaaug

SEQ ID NO: 1597365 - RNA, 22 nt, Human coronavirus OC43 (HCoV-OC43)
aaagugcagaauuuaucuggga

SEQ ID NO: 1597366 - RNA, 20 nt, Human coronavirus OC43 (HCoV-OC43)
gacugccaucaacccaaaag

SEQ ID NO: 1597367 - RNA, 16 nt, Human coronavirus OC43 (HCoV-OC43)
uauuuaaauacuacgu

SEQ ID NO: 1597368 - RNA, 19 nt, Human coronavirus OC43 (HCoV-OC43)
uacuguugauguuacuaau

SEQ ID NO: 1597369 - RNA, 17 nt, Human coronavirus OC43 (HCoV-OC43)
auguucaaaccaggggu

SEQ ID NO: 1597370 - RNA, 22 nt, Human coronavirus OC43 (HCoV-OC43)
uggaguuucaacccagaaacaa

SEQ ID NO: 1597371 - RNA, 17 nt, Human coronavirus OC43 (HCoV-OC43)
aagaaugguuuuacuuu

SEQ ID NO: 1597372 - RNA, 16 nt, Human coronavirus OC43 (HCoV-OC43)
acuacaccagcaccag

SEQ ID NO: 1597373 - RNA, 19 nt, Human coronavirus OC43 (HCoV-OC43)
ugccacuaaaccucagcaa

SEQ ID NO: 1597374 - RNA, 17 nt, Human coronavirus OC43 (HCoV-OC43)
auaagaauggacaagga

SEQ ID NO: 1597375 - RNA, 14 nt, Human coronavirus OC43 (HCoV-OC43)
cugcgcuguuaauu

SEQ ID NO: 1597376 - RNA, 17 nt, Human coronavirus OC43 (HCoV-OC43)
auguaaugcugaacacu

SEQ ID NO: 1597377 - RNA, 19 nt, Human coronavirus OC43 (HCoV-OC43)
uacuaauuauuuaacuugu

SEQ ID NO: 1597378 - RNA, 20 nt, Human coronavirus OC43 (HCoV-OC43)
gacaucagccuucuuaagaa

SEQ ID NO: 1597379 - RNA, 12 nt, Human coronavirus OC43 (HCoV-OC43)
gccuuucacgcu

SEQ ID NO: 1597380 - RNA, 23 nt, Human coronavirus OC43 (HCoV-OC43)
gaugccacuaaaccucagcaagu

SEQ ID NO: 1597381 - RNA, 14 nt, Human coronavirus OC43 (HCoV-OC43)
ccgacaagugccca

SEQ ID NO: 1597382 - RNA, 16 nt, Human coronavirus OC43 (HCoV-OC43)
uaaaggaauggaauuu

SEQ ID NO: 1597383 - RNA, 22 nt, Human coronavirus OC43 (HCoV-OC43)
caaugguuuaaaaaucaaacau

SEQ ID NO: 1597384 - RNA, 19 nt, Human coronavirus OC43 (HCoV-OC43)
cucugguguaacaccugac

SEQ ID NO: 1597385 - RNA, 16 nt, Human coronavirus OC43 (HCoV-OC43)
agcuuggcuuaaugau

SEQ ID NO: 1597386 - RNA, 22 nt, Human coronavirus OC43 (HCoV-OC43)
caaguguaauauuuuugcuaau

SEQ ID NO: 1597387 - RNA, 16 nt, Human coronavirus OC43 (HCoV-OC43)
uaugaggguguuaauu

SEQ ID NO: 1597388 - RNA, 17 nt, Human coronavirus OC43 (HCoV-OC43)
gacguucuuuuaaaaca

SEQ ID NO: 1597389 - RNA, 17 nt, Human coronavirus OC43 (HCoV-OC43)
auaagcgugguuuucuu

SEQ ID NO: 1597390 - RNA, 22 nt, Human coronavirus OC43 (HCoV-OC43)
uacacugguagugguuacuacu

SEQ ID NO: 1597391 - RNA, 20 nt, Human coronavirus OC43 (HCoV-OC43)
caaugauguaaaaccaccag

SEQ ID NO: 1597392 - RNA, 22 nt, Human coronavirus OC43 (HCoV-OC43)
uguguuaaauuauaaagguuua

SEQ ID NO: 1597393 - RNA, 23 nt, Human coronavirus OC43 (HCoV-OC43)
acaacaagaugguaugaugaaua

SEQ ID NO: 1597394 - RNA, 11 nt, Human coronavirus OC43 (HCoV-OC43)
uuaaaacuugg

SEQ ID NO: 1597395 - RNA, 21 nt, Human coronavirus OC43 (HCoV-OC43)
gggauuauuauuauaagguug

SEQ ID NO: 1597396 - RNA, 19 nt, Human coronavirus OC43 (HCoV-OC43)
gcagaacucgcacccacag

SEQ ID NO: 1597397 - RNA, 17 nt, Human coronavirus OC43 (HCoV-OC43)
acuacuacccugaaccu

SEQ ID NO: 1597398 - RNA, 15 nt, Human coronavirus OC43 (HCoV-OC43)
uuauuauaagguuga

SEQ ID NO: 1597399 - RNA, 19 nt, Human coronavirus OC43 (HCoV-OC43)
guguugcagugcccaaaag

SEQ ID NO: 1597400 - RNA, 15 nt, Human coronavirus OC43 (HCoV-OC43)
gaagagcucaaccca

SEQ ID NO: 1597401 - RNA, 17 nt, Human coronavirus OC43 (HCoV-OC43)
uuacagacacugguguu

SEQ ID NO: 1597402 - RNA, 15 nt, Human coronavirus OC43 (HCoV-OC43)
guccccuucuauuua

SEQ ID NO: 1597403 - RNA, 18 nt, Human coronavirus OC43 (HCoV-OC43)
auuuuuaggaguuuucac

SEQ ID NO: 1597404 - RNA, 17 nt, Human coronavirus OC43 (HCoV-OC43)
gcaguguuuugguaaga

SEQ ID NO: 1597405 - RNA, 23 nt, Human coronavirus OC43 (HCoV-OC43)
cagaauuuuggugguggagaaau

SEQ ID NO: 1597406 - RNA, 17 nt, Human coronavirus OC43 (HCoV-OC43)
gauucguaguugcuaua

SEQ ID NO: 1597407 - RNA, 13 nt, Human coronavirus OC43 (HCoV-OC43)
agaagauggauga

SEQ ID NO: 1597408 - RNA, 16 nt, Human coronavirus OC43 (HCoV-OC43)
auaguguuggagaaag

SEQ ID NO: 1597409 - RNA, 15 nt, Human coronavirus OC43 (HCoV-OC43)
aaaacuuggcaagga

SEQ ID NO: 1597410 - RNA, 20 nt, Human coronavirus OC43 (HCoV-OC43)
guaaauccaaacauuaugau

SEQ ID NO: 1597411 - RNA, 14 nt, Human coronavirus OC43 (HCoV-OC43)
aaugaaugaaguua

SEQ ID NO: 1597412 - RNA, 17 nt, Human coronavirus OC43 (HCoV-OC43)
aggagauuuaaagugua

SEQ ID NO: 1597413 - RNA, 23 nt, Human coronavirus OC43 (HCoV-OC43)
acccaguaauuaguaaaugaaug

SEQ ID NO: 1597414 - RNA, 19 nt, Human coronavirus OC43 (HCoV-OC43)
gugacagucguucagauug

SEQ ID NO: 1597415 - RNA, 19 nt, Human coronavirus OC43 (HCoV-OC43)
uaaauuuaacuaucaauuu

SEQ ID NO: 1597416 - RNA, 13 nt, Human coronavirus OC43 (HCoV-OC43)
caugauguuaaua

SEQ ID NO: 1597417 - RNA, 18 nt, Human coronavirus OC43 (HCoV-OC43)
gauacuaguuauauuaau

SEQ ID NO: 1597418 - RNA, 15 nt, Human coronavirus OC43 (HCoV-OC43)
gauggaugagcccua

SEQ ID NO: 1597419 - RNA, 15 nt, Human coronavirus OC43 (HCoV-OC43)
gcugcugauauuaau

SEQ ID NO: 1597420 - RNA, 22 nt, Human coronavirus OC43 (HCoV-OC43)
uauagcaccaccuacugguguu

SEQ ID NO: 1597421 - RNA, 18 nt, Human coronavirus OC43 (HCoV-OC43)
auuuuacgccuuaucaug

SEQ ID NO: 1597422 - RNA, 13 nt, Human coronavirus OC43 (HCoV-OC43)
caacaaauuauuu

SEQ ID NO: 1597423 - RNA, 17 nt, Human coronavirus OC43 (HCoV-OC43)
gcagguacuaauuauuu

SEQ ID NO: 1597424 - RNA, 17 nt, Human coronavirus OC43 (HCoV-OC43)
uaaucauauuguuaaua

SEQ ID NO: 1597425 - RNA, 22 nt, Human coronavirus OC43 (HCoV-OC43)
auuguuugggguuuuaugaauc

SEQ ID NO: 1597426 - RNA, 19 nt, Human coronavirus OC43 (HCoV-OC43)
auguauaguguuggagaaa

SEQ ID NO: 1597427 - RNA, 19 nt, Human coronavirus OC43 (HCoV-OC43)
ccugacgagccccagaagg

SEQ ID NO: 1597428 - RNA, 21 nt, Human coronavirus OC43 (HCoV-OC43)
uuauaagaauauggcugugua

SEQ ID NO: 1597429 - RNA, 18 nt, Human coronavirus OC43 (HCoV-OC43)
ggaacuagugacccacag

SEQ ID NO: 1597430 - RNA, 19 nt, Human coronavirus OC43 (HCoV-OC43)
uauguugguguuuaugaua

SEQ ID NO: 1597431 - RNA, 21 nt, Human coronavirus OC43 (HCoV-OC43)
cagccuuacuuuuguuaaugu

SEQ ID NO: 1597432 - RNA, 17 nt, Human coronavirus OC43 (HCoV-OC43)
ucuaucagaauggaugu

SEQ ID NO: 1597433 - RNA, 18 nt, Human coronavirus OC43 (HCoV-OC43)
uuuaaugcuguugauugu

SEQ ID NO: 1597434 - RNA, 13 nt, Human coronavirus OC43 (HCoV-OC43)
aggcugaugucaa

SEQ ID NO: 1597435 - RNA, 11 nt, Human coronavirus OC43 (HCoV-OC43)
uacuguuaauu

SEQ ID NO: 1597436 - RNA, 16 nt, Human coronavirus OC43 (HCoV-OC43)
gacugccaucaaccca

SEQ ID NO: 1597437 - RNA, 16 nt, Human coronavirus OC43 (HCoV-OC43)
cucuuccgaaccagca

SEQ ID NO: 1597438 - RNA, 18 nt, Human coronavirus OC43 (HCoV-OC43)
gauuuacuuuuugauaaa

SEQ ID NO: 1597439 - RNA, 14 nt, Human coronavirus OC43 (HCoV-OC43)
auugcaccaggagu

SEQ ID NO: 1597440 - RNA, 16 nt, Human coronavirus OC43 (HCoV-OC43)
uuauuuuuaaugcugu

SEQ ID NO: 1597441 - RNA, 16 nt, Human coronavirus OC43 (HCoV-OC43)
ucucagaauuagaaga

SEQ ID NO: 1597442 - RNA, 13 nt, Human coronavirus OC43 (HCoV-OC43)
uauuuuguuaaug

SEQ ID NO: 1597443 - RNA, 20 nt, Human coronavirus OC43 (HCoV-OC43)
uuucuguuagcagguuuaau

SEQ ID NO: 1597444 - RNA, 21 nt, Human coronavirus OC43 (HCoV-OC43)
aacaaugcacuguucagcagu

SEQ ID NO: 1597445 - RNA, 18 nt, Human coronavirus OC43 (HCoV-OC43)
guuaauguaccauauguu

SEQ ID NO: 1597446 - RNA, 18 nt, Human coronavirus OC43 (HCoV-OC43)
ugcagguacuaauuauuu

SEQ ID NO: 1597447 - RNA, 11 nt, Human coronavirus OC43 (HCoV-OC43)
cuaucugggaa

SEQ ID NO: 1597448 - RNA, 17 nt, Human coronavirus OC43 (HCoV-OC43)
agcuccuaagagugguu

SEQ ID NO: 1597449 - RNA, 17 nt, Human coronavirus OC43 (HCoV-OC43)
uccugacgagccccaga

SEQ ID NO: 1597450 - RNA, 21 nt, Human coronavirus OC43 (HCoV-OC43)
auuguuauuauuuaguuuuac

SEQ ID NO: 1597451 - RNA, 15 nt, Human coronavirus OC43 (HCoV-OC43)
uacuuuuuaugcaua

SEQ ID NO: 1597452 - RNA, 17 nt, Human coronavirus OC43 (HCoV-OC43)
aggcccuaaucagaauu

SEQ ID NO: 1597453 - RNA, 13 nt, Human coronavirus OC43 (HCoV-OC43)
uguuuaauguuua

SEQ ID NO: 1597454 - RNA, 14 nt, Human coronavirus OC43 (HCoV-OC43)
ucaacaaauuauuu

SEQ ID NO: 1597455 - RNA, 18 nt, Human coronavirus OC43 (HCoV-OC43)
uugcgauuguaauuauug

SEQ ID NO: 1597456 - RNA, 12 nt, Human coronavirus OC43 (HCoV-OC43)
uauugaugcugc

SEQ ID NO: 1597457 - RNA, 22 nt, Human coronavirus OC43 (HCoV-OC43)
auaagaauggacaaggagaaaa

SEQ ID NO: 1597458 - RNA, 22 nt, Human coronavirus OC43 (HCoV-OC43)
auuaccuggcgcagacaggagu

SEQ ID NO: 1597459 - RNA, 12 nt, Human coronavirus OC43 (HCoV-OC43)
uugcagugccca

SEQ ID NO: 1597460 - RNA, 23 nt, Human coronavirus OC43 (HCoV-OC43)
auugcuagucuuguucuggcaaa

SEQ ID NO: 1597461 - RNA, 13 nt, Human coronavirus OC43 (HCoV-OC43)
gaaauauaagaga

SEQ ID NO: 1597462 - RNA, 20 nt, Human coronavirus OC43 (HCoV-OC43)
acaggaguuaaauguuuaug

SEQ ID NO: 1597463 - RNA, 15 nt, Human coronavirus OC43 (HCoV-OC43)
gaagguuauagcaga

SEQ ID NO: 1597464 - RNA, 23 nt, Human coronavirus OC43 (HCoV-OC43)
auuuuuauuugucagguugugac

SEQ ID NO: 1597465 - RNA, 17 nt, Human coronavirus OC43 (HCoV-OC43)
cugacuuguaauaguaa

SEQ ID NO: 1597466 - RNA, 16 nt, Human coronavirus OC43 (HCoV-OC43)
aaaggaacaauguaug

SEQ ID NO: 1597467 - RNA, 22 nt, Human coronavirus OC43 (HCoV-OC43)
gaugucuugcugcuauaauaga

SEQ ID NO: 1597468 - RNA, 14 nt, Human coronavirus OC43 (HCoV-OC43)
cuauuacauuuaaa

SEQ ID NO: 1597469 - RNA, 13 nt, Human coronavirus OC43 (HCoV-OC43)
cagcauugcuauu

SEQ ID NO: 1597470 - RNA, 16 nt, Human coronavirus OC43 (HCoV-OC43)
cuuacuuuuguuaaug

SEQ ID NO: 1597471 - RNA, 15 nt, Human coronavirus OC43 (HCoV-OC43)
gauuauauaaauguu

SEQ ID NO: 1597472 - RNA, 21 nt, Human coronavirus OC43 (HCoV-OC43)
guugguguuuaugauauuaau

SEQ ID NO: 1597473 - RNA, 21 nt, Human coronavirus OC43 (HCoV-OC43)
aagcucagauagauagacuua

SEQ ID NO: 1597474 - RNA, 14 nt, Human coronavirus OC43 (HCoV-OC43)
gagaccauaaugaa

SEQ ID NO: 1597475 - RNA, 21 nt, Human coronavirus OC43 (HCoV-OC43)
uaugucaugccucugacuugu

SEQ ID NO: 1597476 - RNA, 21 nt, Human coronavirus OC43 (HCoV-OC43)
uuacuauucuucauaugcugu

SEQ ID NO: 1597477 - RNA, 13 nt, Human coronavirus OC43 (HCoV-OC43)
gcgcuuucacacu

SEQ ID NO: 1597478 - RNA, 16 nt, Human coronavirus OC43 (HCoV-OC43)
agcauacugccaaaga

SEQ ID NO: 1597479 - RNA, 16 nt, Human coronavirus OC43 (HCoV-OC43)
uguccugcagguacua

SEQ ID NO: 1597480 - RNA, 20 nt, Human coronavirus OC43 (HCoV-OC43)
uuacccucugguaauuauuu

SEQ ID NO: 1597481 - RNA, 19 nt, Human coronavirus OC43 (HCoV-OC43)
aacaagaugguaugaugaa

SEQ ID NO: 1597482 - RNA, 15 nt, Human coronavirus OC43 (HCoV-OC43)
caacagcuuagugau

SEQ ID NO: 1597483 - RNA, 14 nt, Human coronavirus OC43 (HCoV-OC43)
auauguuuauaaug

SEQ ID NO: 1597484 - RNA, 21 nt, Human coronavirus OC43 (HCoV-OC43)
uuggugguggagaaauguuaa

SEQ ID NO: 1597485 - RNA, 20 nt, Human coronavirus OC43 (HCoV-OC43)
uacgguuuuagagacuacau

SEQ ID NO: 1597486 - RNA, 13 nt, Human coronavirus OC43 (HCoV-OC43)
uaaguuugcuaua

SEQ ID NO: 1597487 - RNA, 16 nt, Human coronavirus OC43 (HCoV-OC43)
agugagauuaagugua

SEQ ID NO: 1597488 - RNA, 14 nt, Human coronavirus OC43 (HCoV-OC43)
uauaguguuggaga

SEQ ID NO: 1597489 - RNA, 17 nt, Human coronavirus OC43 (HCoV-OC43)
ugggucgcuagcaacca

SEQ ID NO: 1597490 - RNA, 19 nt, Human coronavirus OC43 (HCoV-OC43)
ucaacccccauaauuauuc

SEQ ID NO: 1597491 - RNA, 19 nt, Human coronavirus OC43 (HCoV-OC43)
ugauguaaaaccaccaguc

SEQ ID NO: 1597492 - RNA, 14 nt, Human coronavirus OC43 (HCoV-OC43)
acagaaguaaauga

SEQ ID NO: 1597493 - RNA, 13 nt, Human coronavirus OC43 (HCoV-OC43)
cugacgagcccca

SEQ ID NO: 1597494 - RNA, 22 nt, Human coronavirus OC43 (HCoV-OC43)
augguauuuuuacuaucuggga

SEQ ID NO: 1597495 - RNA, 16 nt, Human coronavirus OC43 (HCoV-OC43)
cuaucagaauggaugu

SEQ ID NO: 1597496 - RNA, 12 nt, Human coronavirus OC43 (HCoV-OC43)
uaauaauuguac

SEQ ID NO: 1597497 - RNA, 15 nt, Human coronavirus OC43 (HCoV-OC43)
uucuauaguuuuuac

SEQ ID NO: 1597498 - RNA, 20 nt, Human coronavirus OC43 (HCoV-OC43)
aaucaagguagauuuugugc

SEQ ID NO: 1597499 - RNA, 19 nt, Human coronavirus OC43 (HCoV-OC43)
uagcuaauaguuuaaugaa

SEQ ID NO: 1597500 - RNA, 13 nt, Human coronavirus OC43 (HCoV-OC43)
acuaugguuuaaa

SEQ ID NO: 1597501 - RNA, 21 nt, Human coronavirus OC43 (HCoV-OC43)
gcuuuaguuaaaauucaagcu

SEQ ID NO: 1597502 - RNA, 14 nt, Human coronavirus OC43 (HCoV-OC43)
aguaugucacagcg

SEQ ID NO: 1597503 - RNA, 17 nt, Human coronavirus OC43 (HCoV-OC43)
agucuuaaaucagagcu

SEQ ID NO: 1597504 - RNA, 23 nt, Human coronavirus OC43 (HCoV-OC43)
guguaccauuuuauuuaaauguu

SEQ ID NO: 1597505 - RNA, 15 nt, Human coronavirus OC43 (HCoV-OC43)
auguuuauaauggcu

SEQ ID NO: 1597506 - RNA, 18 nt, Human coronavirus OC43 (HCoV-OC43)
auacuaguuauauuaaug

SEQ ID NO: 1597507 - RNA, 16 nt, Human coronavirus OC43 (HCoV-OC43)
uguaauaguaagguua

SEQ ID NO: 1597508 - RNA, 22 nt, Human coronavirus OC43 (HCoV-OC43)
uguguugucaaugcuuauaaua

SEQ ID NO: 1597509 - RNA, 20 nt, Human coronavirus OC43 (HCoV-OC43)
caaaccagggguagaagagc

SEQ ID NO: 1597510 - RNA, 16 nt, Human coronavirus OC43 (HCoV-OC43)
uacaccagcaccaguu

SEQ ID NO: 1597511 - RNA, 21 nt, Human coronavirus OC43 (HCoV-OC43)
ugaaugcugauuauuuguauu

SEQ ID NO: 1597512 - RNA, 18 nt, Human coronavirus OC43 (HCoV-OC43)
agcacuaagcuuaaagau

SEQ ID NO: 1597513 - RNA, 19 nt, Human coronavirus OC43 (HCoV-OC43)
uguuuuauacucagguuua

SEQ ID NO: 1597514 - RNA, 21 nt, Human coronavirus OC43 (HCoV-OC43)
aaugguuuuacuuuagaauau

SEQ ID NO: 1597515 - RNA, 16 nt, Human coronavirus OC43 (HCoV-OC43)
aacucgcacccacagc

SEQ ID NO: 1597516 - RNA, 13 nt, Human coronavirus OC43 (HCoV-OC43)
uaaaguuacuauu

SEQ ID NO: 1597517 - RNA, 19 nt, Human coronavirus OC43 (HCoV-OC43)
aagauuagaguuggccaaa

SEQ ID NO: 1597518 - RNA, 12 nt, Human coronavirus OC43 (HCoV-OC43)
gcuuucaaucaa

SEQ ID NO: 1597519 - RNA, 16 nt, Human coronavirus OC43 (HCoV-OC43)
uauaaucuuaacuauu

SEQ ID NO: 1597520 - RNA, 14 nt, Human coronavirus OC43 (HCoV-OC43)
uugauguggaugac

SEQ ID NO: 1597521 - RNA, 14 nt, Human coronavirus OC43 (HCoV-OC43)
cuuguucuggcaaa

SEQ ID NO: 1597522 - RNA, 19 nt, Human coronavirus OC43 (HCoV-OC43)
gaaguuaauuauggccaau

SEQ ID NO: 1597523 - RNA, 14 nt, Human coronavirus OC43 (HCoV-OC43)
augcuugguuuaag

SEQ ID NO: 1597524 - RNA, 22 nt, Human coronavirus OC43 (HCoV-OC43)
uguuaauaguggucuuacuugu

SEQ ID NO: 1597525 - RNA, 22 nt, Human coronavirus OC43 (HCoV-OC43)
cugguuuugaucuuaauuguua

SEQ ID NO: 1597526 - RNA, 16 nt, Human coronavirus OC43 (HCoV-OC43)
uaagaagauggaugag

SEQ ID NO: 1597527 - RNA, 18 nt, Human coronavirus OC43 (HCoV-OC43)
uauuuucauuuuuaucaa

SEQ ID NO: 1597528 - RNA, 19 nt, Human coronavirus OC43 (HCoV-OC43)
aagccccgccagaagagga

SEQ ID NO: 1597529 - RNA, 18 nt, Human coronavirus OC43 (HCoV-OC43)
uaguagagccaauucugg

SEQ ID NO: 1597530 - RNA, 14 nt, Human coronavirus OC43 (HCoV-OC43)
aucaaugguuuaaa

SEQ ID NO: 1597531 - RNA, 22 nt, Human coronavirus OC43 (HCoV-OC43)
gaauccugacgagccccagaag

SEQ ID NO: 1597532 - RNA, 23 nt, Human coronavirus OC43 (HCoV-OC43)
cuauacugaagacaccucagaaa

SEQ ID NO: 1597533 - RNA, 22 nt, Human coronavirus OC43 (HCoV-OC43)
gaguccaaaaccacagcgucag

SEQ ID NO: 1597534 - RNA, 17 nt, Human coronavirus OC43 (HCoV-OC43)
auacuuggauguacacu

SEQ ID NO: 1597535 - RNA, 21 nt, Human coronavirus OC43 (HCoV-OC43)
ugauuuuuauuugucagguug

SEQ ID NO: 1597536 - RNA, 12 nt, Human coronavirus OC43 (HCoV-OC43)
auucguuuugaa

SEQ ID NO: 1597537 - RNA, 19 nt, Human coronavirus OC43 (HCoV-OC43)
guuuuauagaagauucugu

SEQ ID NO: 1597538 - RNA, 22 nt, Human coronavirus OC43 (HCoV-OC43)
agcuauggagaagguuaaugaa

SEQ ID NO: 1597539 - RNA, 16 nt, Human coronavirus OC43 (HCoV-OC43)
uucuggcaaaacuugg

SEQ ID NO: 1597540 - RNA, 21 nt, Human coronavirus OC43 (HCoV-OC43)
cagccuucuuaagaagaugga

SEQ ID NO: 1597541 - RNA, 16 nt, Human coronavirus OC43 (HCoV-OC43)
uuguaugaaauucaaa

SEQ ID NO: 1597542 - RNA, 15 nt, Human coronavirus OC43 (HCoV-OC43)
cuuacuaaucaugau

SEQ ID NO: 1597543 - RNA, 13 nt, Human coronavirus OC43 (HCoV-OC43)
uuaacuauuuuca

SEQ ID NO: 1597544 - RNA, 20 nt, Human coronavirus OC43 (HCoV-OC43)
aagauucuguuuuuaagccu

SEQ ID NO: 1597545 - RNA, 18 nt, Human coronavirus OC43 (HCoV-OC43)
cagaaccuuuuauaugau

SEQ ID NO: 1597546 - RNA, 16 nt, Human coronavirus OC43 (HCoV-OC43)
uagaauugauacuacu

SEQ ID NO: 1597547 - RNA, 13 nt, Human coronavirus OC43 (HCoV-OC43)
uucagguuuugag

SEQ ID NO: 1597548 - RNA, 20 nt, Human coronavirus OC43 (HCoV-OC43)
gcagacaagccuaaucauuu

SEQ ID NO: 1597549 - RNA, 18 nt, Human coronavirus OC43 (HCoV-OC43)
uagauaugaaaggaacaa

SEQ ID NO: 1597550 - RNA, 16 nt, Human coronavirus OC43 (HCoV-OC43)
uaccgcucuuaaugcu

SEQ ID NO: 1597551 - RNA, 23 nt, Human coronavirus OC43 (HCoV-OC43)
agagugguuauuuuguuaaugua

SEQ ID NO: 1597552 - RNA, 14 nt, Human coronavirus OC43 (HCoV-OC43)
aggagaaaaugaua

SEQ ID NO: 1597553 - RNA, 14 nt, Human coronavirus OC43 (HCoV-OC43)
gaaaaugauaauau

SEQ ID NO: 1597554 - RNA, 13 nt, Human coronavirus OC43 (HCoV-OC43)
auauuuuugcuaa

SEQ ID NO: 1597555 - RNA, 16 nt, Human coronavirus OC43 (HCoV-OC43)
augaaguuaauuaugg

SEQ ID NO: 1597556 - RNA, 15 nt, Human coronavirus OC43 (HCoV-OC43)
gauaaguuugcuaua

SEQ ID NO: 1597557 - RNA, 22 nt, Human coronavirus OC43 (HCoV-OC43)
gaccacaagcauuuuuggguug

SEQ ID NO: 1597558 - RNA, 13 nt, Human coronavirus OC43 (HCoV-OC43)
gcuuauugcuaau

SEQ ID NO: 1597559 - RNA, 20 nt, Human coronavirus OC43 (HCoV-OC43)
auuugucacuugauuauaua

SEQ ID NO: 1597560 - RNA, 20 nt, Human coronavirus OC43 (HCoV-OC43)
gaaaggaguuugaguuugua

SEQ ID NO: 1597561 - RNA, 16 nt, Human coronavirus OC43 (HCoV-OC43)
auacuagugguuuugc

SEQ ID NO: 1597562 - RNA, 22 nt, Human coronavirus OC43 (HCoV-OC43)
auguggauuguguauuuuguga

SEQ ID NO: 1597563 - RNA, 23 nt, Human coronavirus OC43 (HCoV-OC43)
gcuauaacuauagguaguacuuu

SEQ ID NO: 1597564 - RNA, 19 nt, Human coronavirus OC43 (HCoV-OC43)
ugcagaauuuaucugggaa

SEQ ID NO: 1597565 - RNA, 15 nt, Human coronavirus OC43 (HCoV-OC43)
uuuuaugaguuuuac

SEQ ID NO: 1597566 - RNA, 13 nt, Human coronavirus OC43 (HCoV-OC43)
accaucaggaggg

SEQ ID NO: 1597567 - RNA, 17 nt, Human coronavirus OC43 (HCoV-OC43)
gucaacugcugccacga

SEQ ID NO: 1597568 - RNA, 20 nt, Human coronavirus OC43 (HCoV-OC43)
cuauauugaaggcucaggaa

SEQ ID NO: 1597569 - RNA, 18 nt, Human coronavirus OC43 (HCoV-OC43)
uuauggccaauuggaaga

SEQ ID NO: 1597570 - RNA, 22 nt, Human coronavirus OC43 (HCoV-OC43)
aauggacaaggagaaaaugaua

SEQ ID NO: 1597571 - RNA, 23 nt, Human coronavirus OC43 (HCoV-OC43)
cucgaugaaggaguggauuguaa

SEQ ID NO: 1597572 - RNA, 20 nt, Human coronavirus OC43 (HCoV-OC43)
cuuaaucuucccaauugcaa

SEQ ID NO: 1597573 - RNA, 16 nt, Human coronavirus OC43 (HCoV-OC43)
acauaugaugugaaug

SEQ ID NO: 1597574 - RNA, 17 nt, Human coronavirus OC43 (HCoV-OC43)
acaaggagaaaaugaua

SEQ ID NO: 1597575 - RNA, 16 nt, Human coronavirus OC43 (HCoV-OC43)
caagcuguuguuaaug

SEQ ID NO: 1597576 - RNA, 18 nt, Human coronavirus OC43 (HCoV-OC43)
auuaccacugguuuugau

SEQ ID NO: 1597577 - RNA, 21 nt, Human coronavirus OC43 (HCoV-OC43)
gcagguguucuuacuaaucau

SEQ ID NO: 1597578 - RNA, 14 nt, Human coronavirus OC43 (HCoV-OC43)
acuguuucaaagcu

SEQ ID NO: 1597579 - RNA, 18 nt, Human coronavirus OC43 (HCoV-OC43)
gacauuuucaaauuguaa

SEQ ID NO: 1597580 - RNA, 15 nt, Human coronavirus OC43 (HCoV-OC43)
auuauuuuuaaugcu

SEQ ID NO: 1597581 - RNA, 23 nt, Human coronavirus OC43 (HCoV-OC43)
cuuauauggaccuuaauccuguu

SEQ ID NO: 1597582 - RNA, 13 nt, Human coronavirus OC43 (HCoV-OC43)
acuacuugacacu

SEQ ID NO: 1597583 - RNA, 20 nt, Human coronavirus OC43 (HCoV-OC43)
aggaugguuauaauaaauua

SEQ ID NO: 1597584 - RNA, 17 nt, Human coronavirus OC43 (HCoV-OC43)
uaaagcuacagguacuu

SEQ ID NO: 1597585 - RNA, 14 nt, Human coronavirus OC43 (HCoV-OC43)
agcauacugccaaa

SEQ ID NO: 1597586 - RNA, 19 nt, Human coronavirus OC43 (HCoV-OC43)
uaucuagacuugaugcucu

SEQ ID NO: 1597587 - RNA, 15 nt, Human coronavirus OC43 (HCoV-OC43)
ugagauuaaguguaa

SEQ ID NO: 1597588 - RNA, 23 nt, Human coronavirus OC43 (HCoV-OC43)
auacuaaagcgccguauguaaug

SEQ ID NO: 1597589 - RNA, 14 nt, Human coronavirus OC43 (HCoV-OC43)
gagaaaaugauaau

SEQ ID NO: 1597590 - RNA, 23 nt, Human coronavirus OC43 (HCoV-OC43)
uuuaguuggcauaggugagcacu

SEQ ID NO: 1597591 - RNA, 15 nt, Human coronavirus OC43 (HCoV-OC43)
cugugguaaugguaa

SEQ ID NO: 1597592 - RNA, 19 nt, Human coronavirus OC43 (HCoV-OC43)
aguuuuacaaugauguaaa

SEQ ID NO: 1597593 - RNA, 17 nt, Human coronavirus OC43 (HCoV-OC43)
aauucuaucuagacuug

SEQ ID NO: 1597594 - RNA, 14 nt, Human coronavirus OC43 (HCoV-OC43)
ucguaguugcuaua

SEQ ID NO: 1597595 - RNA, 21 nt, Human coronavirus OC43 (HCoV-OC43)
agcaaccaggcugaugucaau

SEQ ID NO: 1597596 - RNA, 13 nt, Human coronavirus OC43 (HCoV-OC43)
aacauuaaugcca

SEQ ID NO: 1597597 - RNA, 23 nt, Human coronavirus OC43 (HCoV-OC43)
cucagaaauauaagagaaugaac

SEQ ID NO: 1597598 - RNA, 15 nt, Human coronavirus OC43 (HCoV-OC43)
cuacugauuuacaaa

SEQ ID NO: 1597599 - RNA, 13 nt, Human coronavirus OC43 (HCoV-OC43)
gcacucucuauca

SEQ ID NO: 1597600 - RNA, 18 nt, Human coronavirus OC43 (HCoV-OC43)
aguuuagaaauguucaaa

SEQ ID NO: 1597601 - RNA, 19 nt, Human coronavirus OC43 (HCoV-OC43)
gcuauuucuguucaaacau

SEQ ID NO: 1597602 - RNA, 19 nt, Human coronavirus OC43 (HCoV-OC43)
uaauaaagacacugguguu

SEQ ID NO: 1597603 - RNA, 12 nt, Human coronavirus OC43 (HCoV-OC43)
guuuauucaaac

SEQ ID NO: 1597604 - RNA, 17 nt, Human coronavirus OC43 (HCoV-OC43)
acuauuaugucaugccu

SEQ ID NO: 1597605 - RNA, 19 nt, Human coronavirus OC43 (HCoV-OC43)
acauugguacauaugaaua

SEQ ID NO: 1597606 - RNA, 14 nt, Human coronavirus OC43 (HCoV-OC43)
ugguuuguuauaua

SEQ ID NO: 1597607 - RNA, 13 nt, Human coronavirus OC43 (HCoV-OC43)
guauuuuugcuaa

SEQ ID NO: 1597608 - RNA, 22 nt, Human coronavirus OC43 (HCoV-OC43)
gcguauacgcauugaauaaugu

SEQ ID NO: 1597609 - RNA, 14 nt, Human coronavirus OC43 (HCoV-OC43)
agcaccaguuuaua

SEQ ID NO: 1597610 - RNA, 23 nt, Human coronavirus OC43 (HCoV-OC43)
aauucuugguguuuguguuaauu

SEQ ID NO: 1597611 - RNA, 24 nt, Human coronavirus OC43 (HCoV-OC43)
uuaaaugcaaccguucugguagua

SEQ ID NO: 1597612 - RNA, 13 nt, Human coronavirus OC43 (HCoV-OC43)
gaguuucaaccca

SEQ ID NO: 1597613 - RNA, 16 nt, Human coronavirus OC43 (HCoV-OC43)
ugcuaccucucagcaa

SEQ ID NO: 1597614 - RNA, 21 nt, Human coronavirus OC43 (HCoV-OC43)
gaucaguccgaccaguuuaga

SEQ ID NO: 1597615 - RNA, 14 nt, Human coronavirus OC43 (HCoV-OC43)
guaaugguaaucau

SEQ ID NO: 1597616 - RNA, 15 nt, Human coronavirus OC43 (HCoV-OC43)
cuacaccagcaccag

SEQ ID NO: 1597617 - RNA, 22 nt, Human coronavirus OC43 (HCoV-OC43)
aauuuuacgccuuaucaugccu

SEQ ID NO: 1597618 - RNA, 14 nt, Human coronavirus OC43 (HCoV-OC43)
aauuaguaaaugaa

SEQ ID NO: 1597619 - RNA, 23 nt, Human coronavirus OC43 (HCoV-OC43)
uaguuuuagauguuaaaggugua

SEQ ID NO: 1597620 - RNA, 16 nt, Human coronavirus OC43 (HCoV-OC43)
cucuaucagaauggau

SEQ ID NO: 1597621 - RNA, 19 nt, Human coronavirus OC43 (HCoV-OC43)
aagacaccucagaaauaua

SEQ ID NO: 1597622 - RNA, 15 nt, Human coronavirus OC43 (HCoV-OC43)
uccagcagagccucu

SEQ ID NO: 1597623 - RNA, 20 nt, Human coronavirus OC43 (HCoV-OC43)
cgguuuuaaugucucagaau

SEQ ID NO: 1597624 - RNA, 22 nt, Human coronavirus OC43 (HCoV-OC43)
gcuaccucucagcaaccaucag

SEQ ID NO: 1597625 - RNA, 14 nt, Human coronavirus OC43 (HCoV-OC43)
uauaguugccauuu

SEQ ID NO: 1597626 - RNA, 23 nt, Human coronavirus OC43 (HCoV-OC43)
uaauauggaggaguuuauucaaa

SEQ ID NO: 1597627 - RNA, 18 nt, Human coronavirus OC43 (HCoV-OC43)
aauagauagagaagguua

SEQ ID NO: 1597628 - RNA, 23 nt, Human coronavirus OC43 (HCoV-OC43)
uaucaacaacaagaugguaugau

SEQ ID NO: 1597629 - RNA, 17 nt, Human coronavirus OC43 (HCoV-OC43)
guuuuauacucagguuu

SEQ ID NO: 1597630 - RNA, 20 nt, Human coronavirus OC43 (HCoV-OC43)
uauauaagcguaauuucaca

SEQ ID NO: 1597631 - RNA, 21 nt, Human coronavirus OC43 (HCoV-OC43)
agaauuuuggugguggagaaa

SEQ ID NO: 1597632 - RNA, 19 nt, Human coronavirus OC43 (HCoV-OC43)
aauugccgacaagugccca

SEQ ID NO: 1597633 - RNA, 23 nt, Human coronavirus OC43 (HCoV-OC43)
aagauggcguuaauuucaaugua

SEQ ID NO: 1597634 - RNA, 18 nt, Human coronavirus OC43 (HCoV-OC43)
agaguugacugcagagga

SEQ ID NO: 1597635 - RNA, 15 nt, Human coronavirus OC43 (HCoV-OC43)
acaggaguuaaaugu

SEQ ID NO: 1597636 - RNA, 16 nt, Human coronavirus OC43 (HCoV-OC43)
caagaugguauuauuu

SEQ ID NO: 1597637 - RNA, 17 nt, Human coronavirus OC43 (HCoV-OC43)
agaugauuauuuugugg

SEQ ID NO: 1597638 - RNA, 20 nt, Human coronavirus OC43 (HCoV-OC43)
uguuucuguuagcagguuua

SEQ ID NO: 1597639 - RNA, 15 nt, Human coronavirus OC43 (HCoV-OC43)
ugcacuguucagcag

SEQ ID NO: 1597640 - RNA, 23 nt, Human coronavirus OC43 (HCoV-OC43)
cagauacuaguuauauuaaugau

SEQ ID NO: 1597641 - RNA, 23 nt, Human coronavirus OC43 (HCoV-OC43)
auuucuuucugauuuuauuaaug

SEQ ID NO: 1597642 - RNA, 23 nt, Human coronavirus OC43 (HCoV-OC43)
guaacuaagcauacugccaaaga

SEQ ID NO: 1597643 - RNA, 13 nt, Human coronavirus OC43 (HCoV-OC43)
cgcucuuaaugcu

SEQ ID NO: 1597644 - RNA, 18 nt, Human coronavirus OC43 (HCoV-OC43)
uacugguguuuaugaauu

SEQ ID NO: 1597645 - RNA, 15 nt, Human coronavirus OC43 (HCoV-OC43)
guuucaacccagaaa

SEQ ID NO: 1597646 - RNA, 20 nt, Human coronavirus OC43 (HCoV-OC43)
guucagauuguaaucauauu

SEQ ID NO: 1597647 - RNA, 15 nt, Human coronavirus OC43 (HCoV-OC43)
cagaacuuuuaugau

SEQ ID NO: 1597648 - RNA, 17 nt, Human coronavirus OC43 (HCoV-OC43)
uauuuagccauuucaaa

SEQ ID NO: 1597649 - RNA, 17 nt, Human
cugcacuccagccugag

SEQ ID NO: 1597650 - RNA, 20 nt, Human
cugcacuccagccugagcga

SEQ ID NO: 1597651 - RNA, 16 nt, Human
cugcacuccagccuga

SEQ ID NO: 1597652 - RNA, 21 nt, Human
cuggugccucaccccuugcca

SEQ ID NO: 1597653 - RNA, 15 nt, Human
cugggcagcugccuc

SEQ ID NO: 1597654 - RNA, 14 nt, Human
cugggcagcugccu

SEQ ID NO: 1597655 - RNA, 16 nt, Human
cugggcagcugccucc

SEQ ID NO: 1597656 - RNA, 13 nt, Human
cugggcagcugcc

SEQ ID NO: 1597657 - RNA, 15 nt, Human
cuucuguuuuauaau

SEQ ID NO: 1597658 - RNA, 20 nt, Human
cuucuguuuuauaauuuugu

SEQ ID NO: 1597659 - RNA, 21 nt, Human
cuuugagugucuuaauuaaaa

SEQ ID NO: 1597660 - RNA, 11 nt, Human
cuucagacaua

SEQ ID NO: 1597661 - RNA, 12 nt, Human
cuucaucugacu

SEQ ID NO: 1597662 - RNA, 23 nt, Human
cuucaugcugucuacacuaagag

SEQ ID NO: 1597663 - RNA, 18 nt, Human
cuucaucugacuaugaca

SEQ ID NO: 1597664 - RNA, 21 nt, Human
gacagaaagcagaacagugau

SEQ ID NO: 1597665 - RNA, 15 nt, Human
gacacacugaagaag

SEQ ID NO: 1597666 - RNA, 16 nt, Human
gacacacugaagaagc

SEQ ID NO: 1597667 - RNA, 16 nt, Human
gacauuugcucaugga

SEQ ID NO: 1597668 - RNA, 17 nt, Human
gacauuugcucauggaa

SEQ ID NO: 1597669 - RNA, 21 nt, Human
gacagugagacucugucucag

SEQ ID NO: 1597670 - RNA, 14 nt, Human
gacucuuaagaaga

SEQ ID NO: 1597671 - RNA, 15 nt, Human
gacucuuaagaagac

SEQ ID NO: 1597672 - RNA, 21 nt, Human
gacucuuaagaagacugcauu

SEQ ID NO: 1597673 - RNA, 16 nt, Human
gacgcucucuggccuu

SEQ ID NO: 1597674 - RNA, 17 nt, Human
gacgcucucuggccuuc

SEQ ID NO: 1597675 - RNA, 15 nt, Human
gacgcucucuggccu

SEQ ID NO: 1597676 - RNA, 23 nt, Human
gaagcaacccaaauguucaucaa

SEQ ID NO: 1597677 - RNA, 14 nt, Human
gaagcaaaauuuuu

SEQ ID NO: 1597678 - RNA, 14 nt, Human
gaacugaaaucaua

SEQ ID NO: 1597679 - RNA, 20 nt, Human
gaauauguuucaaacuuugg

SEQ ID NO: 1597680 - RNA, 15 nt, Human
gaauauguuucaaac

SEQ ID NO: 1597681 - RNA, 14 nt, Human
gaauauguuucaaa

SEQ ID NO: 1597682 - RNA, 16 nt, Human
gaguuuaaauuguaau

SEQ ID NO: 1597683 - RNA, 19 nt, Human
gaggcuccacuuggucugu

SEQ ID NO: 1597684 - RNA, 12 nt, Human
gaggcuccacuu

SEQ ID NO: 1597685 - RNA, 23 nt, Human
gaggcuccacuuggucugugaga

SEQ ID NO: 1597686 - RNA, 20 nt, Human
gaggacgcucucuggccuuc

SEQ ID NO: 1597687 - RNA, 15 nt, Human
gaggacgcucucugg

SEQ ID NO: 1597688 - RNA, 23 nt, Human
gcacaguuuucugagaaagacua

SEQ ID NO: 1597689 - RNA, 22 nt, Human
gcacaguuuucugagaaagacu

SEQ ID NO: 1597690 - RNA, 22 nt, Human
gcaauagucaaauugugugaaa

SEQ ID NO: 1597691 - RNA, 20 nt, Human
gcaaguauuagaauaccaca

SEQ ID NO: 1597692 - RNA, 16 nt, Human
gauuuaccacuugugu

SEQ ID NO: 1597693 - RNA, 15 nt, Human
gauuuaccacuugug

SEQ ID NO: 1597694 - RNA, 16 nt, Human
gaugaucuuuaaaaua

SEQ ID NO: 1597695 - RNA, 18 nt, Human
gauguagaggagaaacug

SEQ ID NO: 1597696 - RNA, 14 nt, Human
gaugguucuagcau

SEQ ID NO: 1597697 - RNA, 21 nt, Human
gcuaguaauuggaaaggcagc

SEQ ID NO: 1597698 - RNA, 16 nt, Human
gcuaguaucaaaagaa

SEQ ID NO: 1597699 - RNA, 18 nt, Human
gcuccccucggagaagag

SEQ ID NO: 1597700 - RNA, 15 nt, Human
gcuccccucggagaa

SEQ ID NO: 1597701 - RNA, 22 nt, Human
gcugccuccccuccucugcuug

SEQ ID NO: 1597702 - RNA, 21 nt, Human
gcugccuccccuccucugcuu

SEQ ID NO: 1597703 - RNA, 20 nt, Human
gcugccuccccuccucugcu

SEQ ID NO: 1597704 - RNA, 17 nt, Human
gcugccuccccuccucu

SEQ ID NO: 1597705 - RNA, 16 nt, Human
gcugccuccccuccuc

SEQ ID NO: 1597706 - RNA, 17 nt, Human
gcuggagcucugcccau

SEQ ID NO: 1597707 - RNA, 22 nt, Human
gcuuccuucugugaaaguacau

SEQ ID NO: 1597708 - RNA, 14 nt, Human
gcccuguuaaaaga

SEQ ID NO: 1597709 - RNA, 17 nt, Human
gcccuguuaaaagauga

SEQ ID NO: 1597710 - RNA, 13 nt, Human
gcccuguuaaaag

SEQ ID NO: 1597711 - RNA, 16 nt, Human
gcccccaggugccagu

SEQ ID NO: 1597712 - RNA, 22 nt, Human
gccagacaucaacagauaaaua

SEQ ID NO: 1597713 - RNA, 23 nt, Human
gccagcaguucagagcugcccuc

SEQ ID NO: 1597714 - RNA, 22 nt, Human
gccagcaguucagagcugcccu

SEQ ID NO: 1597715 - RNA, 21 nt, Human
gccacuguuuugaaucucaua

SEQ ID NO: 1597716 - RNA, 15 nt, Human
ggaggcugagauggg

SEQ ID NO: 1597717 - RNA, 19 nt, Human
ggaggcugagaugggagaa

SEQ ID NO: 1597718 - RNA, 22 nt, Human
ggaugguucccuugaugaagaa

SEQ ID NO: 1597719 - RNA, 23 nt, Human
ggaugguucccuugaugaagaag

SEQ ID NO: 1597720 - RNA, 20 nt, Human
gggaggcagagguugcagug

SEQ ID NO: 1597721 - RNA, 22 nt, Human
aaaagcuccauuuuuagugaaa

SEQ ID NO: 1597722 - RNA, 21 nt, Human
aaaacuuuaugcuaagugaaa

SEQ ID NO: 1597723 - RNA, 19 nt, Human
aaaagccugcaauuucaua

SEQ ID NO: 1597724 - RNA, 19 nt, Human
gggcagcugccuccccucc

SEQ ID NO: 1597725 - RNA, 14 nt, Human
gggcagcugccucc

SEQ ID NO: 1597726 - RNA, 13 nt, Human
gggcagcugccuc

SEQ ID NO: 1597727 - RNA, 23 nt, Human
gggcagcugccuccccuccucug

SEQ ID NO: 1597728 - RNA, 20 nt, Human
gggcagcugccuccccuccu

SEQ ID NO: 1597729 - RNA, 21 nt, Human
aaaauaauuuuuauauuugaa

SEQ ID NO: 1597730 - RNA, 23 nt, Human
aaaauaauuuuuauauuugaaau

SEQ ID NO: 1597731 - RNA, 14 nt, Human
aaaauauauuuaau

SEQ ID NO: 1597732 - RNA, 13 nt, Human
aaaggaauuuaaa

SEQ ID NO: 1597733 - RNA, 14 nt, Human
ggucugugagaugc

SEQ ID NO: 1597734 - RNA, 24 nt, Human
ggucugugagaugcuagaacuccc

SEQ ID NO: 1597735 - RNA, 21 nt, Human
aaagauuuucagaaaauauua

SEQ ID NO: 1597736 - RNA, 16 nt, Human
aaagaaugauuaugaa

SEQ ID NO: 1597737 - RNA, 21 nt, Human
ggucauauuaauauauuucca

SEQ ID NO: 1597738 - RNA, 18 nt, Human
aaagagaacuuccagauc

SEQ ID NO: 1597739 - RNA, 22 nt, Human
aaagacuauucaaacagucuca

SEQ ID NO: 1597740 - RNA, 14 nt, Human
aaagacuccaaaga

SEQ ID NO: 1597741 - RNA, 13 nt, Human
aaagacuccaaag

SEQ ID NO: 1597742 - RNA, 23 nt, Human
aaagacuauucaaacagucucag

SEQ ID NO: 1597743 - RNA, 20 nt, Human
aaagaggcagcuugaaacug

SEQ ID NO: 1597744 - RNA, 15 nt, Human
aaagauuuucagaaa

SEQ ID NO: 1597745 - RNA, 14 nt, Human
aaagauuuucagaa

SEQ ID NO: 1597746 - RNA, 16 nt, Human
aaaccacagcaguuga

SEQ ID NO: 1597747 - RNA, 15 nt, Human
aaaccacagcaguug

SEQ ID NO: 1597748 - RNA, 14 nt, Human
aaacacaacuauau

SEQ ID NO: 1597749 - RNA, 13 nt, Human
aaacauauauaac

SEQ ID NO: 1597750 - RNA, 16 nt, Human
aaacauauauaacaau

SEQ ID NO: 1597751 - RNA, 19 nt, Human
aaacauauauaacaaugcu

SEQ ID NO: 1597752 - RNA, 21 nt, Human
aaacauauauaacaaugcugu

SEQ ID NO: 1597753 - RNA, 15 nt, Human
aaaauauuauguguu

SEQ ID NO: 1597754 - RNA, 14 nt, Human
aaaauauuaugugu

SEQ ID NO: 1597755 - RNA, 21 nt, Human
aaaauauuauguguuuccaua

SEQ ID NO: 1597756 - RNA, 19 nt, Human
aaaauuuuuucucuaggaa

SEQ ID NO: 1597757 - RNA, 17 nt, Human
aaacaaggaugaauuaa

SEQ ID NO: 1597758 - RNA, 19 nt, Human
aaacaacuucaauauccaa

SEQ ID NO: 1597759 - RNA, 16 nt, Human
cucuccccaugauguu

SEQ ID NO: 1597760 - RNA, 15 nt, Human
cucuccccaugaugu

SEQ ID NO: 1597761 - RNA, 19 nt, Human
cucuauguucuaagaagug

SEQ ID NO: 1597762 - RNA, 14 nt, Human
cucucuggccuucg

SEQ ID NO: 1597763 - RNA, 16 nt, Human
cucucuggccuucggc

SEQ ID NO: 1597764 - RNA, 13 nt, Human
cucucuggccuuc

SEQ ID NO: 1597765 - RNA, 19 nt, Human
cucccuccaccucccugca

SEQ ID NO: 1597766 - RNA, 22 nt, Human
cucccuccaccucccugcaaua

SEQ ID NO: 1597767 - RNA, 21 nt, Human
cucccuccaccucccugcaau

SEQ ID NO: 1597768 - RNA, 20 nt, Human
cucccuccaccucccugcaa

SEQ ID NO: 1597769 - RNA, 16 nt, Human
cucaguccaugaagau

SEQ ID NO: 1597770 - RNA, 18 nt, Human
cuaucucauuuccaagca

SEQ ID NO: 1597771 - RNA, 18 nt, Human
cuauguucuaagaaguga

SEQ ID NO: 1597772 - RNA, 17 nt, Human
ccuucucuucacaguca

SEQ ID NO: 1597773 - RNA, 20 nt, Human
cuacaaaaacacagcaaggg

SEQ ID NO: 1597774 - RNA, 12 nt, Human
ccuuuucccaac

SEQ ID NO: 1597775 - RNA, 20 nt, Human
ccuaacgaaguauccuucag

SEQ ID NO: 1597776 - RNA, 13 nt, Human
cccucggagaaga

SEQ ID NO: 1597777 - RNA, 14 nt, Human
cccugagcaggauu

SEQ ID NO: 1597778 - RNA, 20 nt, Human
ccucuccugggcagcugccu

SEQ ID NO: 1597779 - RNA, 19 nt, Human
ccucuccugggcagcugcc

SEQ ID NO: 1597780 - RNA, 18 nt, Human
ccucuccugggcagcugc

SEQ ID NO: 1597781 - RNA, 17 nt, Human
ccucuccugggcagcug

SEQ ID NO: 1597782 - RNA, 16 nt, Human
ccucuccugggcagcu

SEQ ID NO: 1597783 - RNA, 15 nt, Human
ccucuccugggcagc

SEQ ID NO: 1597784 - RNA, 22 nt, Human
ccucuccugggcagcugccucc

SEQ ID NO: 1597785 - RNA, 21 nt, Human
ccucuccugggcagcugccuc

SEQ ID NO: 1597786 - RNA, 22 nt, Human
ccauuguggucacaggaaguag

SEQ ID NO: 1597787 - RNA, 13 nt, Human
ccauuuaaagcuu

SEQ ID NO: 1597788 - RNA, 18 nt, Human
ccaugggcacugugggua

SEQ ID NO: 1597789 - RNA, 15 nt, Human
ccccauuguggucac

SEQ ID NO: 1597790 - RNA, 15 nt, Human
ccaggggccaugaau

SEQ ID NO: 1597791 - RNA, 12 nt, Human
ccacuuggucug

SEQ ID NO: 1597792 - RNA, 20 nt, Human
ccacuuggucugugagaugc

SEQ ID NO: 1597793 - RNA, 22 nt, Human
ccacuuggucugugagaugcua

SEQ ID NO: 1597794 - RNA, 15 nt, Human
ccacuuggucuguga

SEQ ID NO: 1597795 - RNA, 16 nt, Human
ccacuuggucugugag

SEQ ID NO: 1597796 - RNA, 17 nt, Human
ccacuuggucugugaga

SEQ ID NO: 1597797 - RNA, 19 nt, Human
ccacuuggucugugagaug

SEQ ID NO: 1597798 - RNA, 14 nt, Human
cagccagacuggca

SEQ ID NO: 1597799 - RNA, 23 nt, Human
cagccagcaguucagagcugccc

SEQ ID NO: 1597800 - RNA, 20 nt, Human
cagccagacuggcacaguuu

SEQ ID NO: 1597801 - RNA, 15 nt, Human
cagccagacuggcac

SEQ ID NO: 1597802 - RNA, 18 nt, Human
cagccagacuggcacagu

SEQ ID NO: 1597803 - RNA, 21 nt, Human
cagagcugcccucuccugggc

SEQ ID NO: 1597804 - RNA, 20 nt, Human
cagagcugcccucuccuggg

SEQ ID NO: 1597805 - RNA, 19 nt, Human
cagagcugcccucuccugg

SEQ ID NO: 1597806 - RNA, 18 nt, Human
cagagcugcccucuccug

SEQ ID NO: 1597807 - RNA, 23 nt, Human
cagagcugcccucuccugggcag

SEQ ID NO: 1597808 - RNA, 22 nt, Human
cagacuggcacaguuuucugag

SEQ ID NO: 1597809 - RNA, 23 nt, Human
cagacuggcacaguuuucugaga

SEQ ID NO: 1597810 - RNA, 17 nt, Human
cagacuggcacaguuuu

SEQ ID NO: 1597811 - RNA, 18 nt, Human
cagacuggcacaguuuuc

SEQ ID NO: 1597812 - RNA, 20 nt, Human
cagcuguaugauucccagcc

SEQ ID NO: 1597813 - RNA, 14 nt, Human
cagcuuauugucua

SEQ ID NO: 1597814 - RNA, 20 nt, Human
cagcuuauugucuagugaaa

SEQ ID NO: 1597815 - RNA, 16 nt, Human
caggaaagagaacuuc

SEQ ID NO: 1597816 - RNA, 20 nt, Human
caggaaagagaacuuccaga

SEQ ID NO: 1597817 - RNA, 20 nt, Human
cagcugccuccccuccucug

SEQ ID NO: 1597818 - RNA, 19 nt, Human
cagcugccuccccuccucu

SEQ ID NO: 1597819 - RNA, 18 nt, Human
cagcugccuccccuccuc

SEQ ID NO: 1597820 - RNA, 17 nt, Human
cagcugccuccccuccu

SEQ ID NO: 1597821 - RNA, 16 nt, Human
cagcugccuccccucc

SEQ ID NO: 1597822 - RNA, 15 nt, Human
cagcugccuccccuc

SEQ ID NO: 1597823 - RNA, 14 nt, Human
cagcugccuccccu

SEQ ID NO: 1597824 - RNA, 9 nt, Human
cagcugccu

SEQ ID NO: 1597825 - RNA, 11 nt, Human
cagcugccucc

SEQ ID NO: 1597826 - RNA, 10 nt, Human
cagcugccuc

SEQ ID NO: 1597827 - RNA, 11 nt, Human
caggcuacugu

SEQ ID NO: 1597828 - RNA, 14 nt, Human
ccaaaaggcagaag

SEQ ID NO: 1597829 - RNA, 17 nt, Human
cauuuguauaaaauaau

SEQ ID NO: 1597830 - RNA, 14 nt, Human
cauuuguauaaaau

SEQ ID NO: 1597831 - RNA, 16 nt, Human
cauuuguauaaaauaa

SEQ ID NO: 1597832 - RNA, 21 nt, Human
ccaacuccagaaagugacaag

SEQ ID NO: 1597833 - RNA, 19 nt, Human
ccaauucgaacuuuuucca

SEQ ID NO: 1597834 - RNA, 22 nt, Human
caguucagagcugcccucuccu

SEQ ID NO: 1597835 - RNA, 21 nt, Human
caguucagagcugcccucucc

SEQ ID NO: 1597836 - RNA, 19 nt, Human
caguucagagcugcccucu

SEQ ID NO: 1597837 - RNA, 18 nt, Human
caguucagagcugcccuc

SEQ ID NO: 1597838 - RNA, 24 nt, Human
caguucagagcugcccucuccugg

SEQ ID NO: 1597839 - RNA, 23 nt, Human
caguucagagcugcccucuccug

SEQ ID NO: 1597840 - RNA, 17 nt, Human
caguucagagcugcccu

SEQ ID NO: 1597841 - RNA, 16 nt, Human
caguucagagcugccc

SEQ ID NO: 1597842 - RNA, 15 nt, Human
caguucagagcugcc

SEQ ID NO: 1597843 - RNA, 22 nt, Human
caguuauuauauuuacaaaugg

SEQ ID NO: 1597844 - RNA, 21 nt, Human
caguuauuauauuuacaaaug

SEQ ID NO: 1597845 - RNA, 17 nt, Human
caguuauuauauuuaca

SEQ ID NO: 1597846 - RNA, 13 nt, Human
caguuauggcuau

SEQ ID NO: 1597847 - RNA, 19 nt, Human
caguuauggcuauaggugc

SEQ ID NO: 1597848 - RNA, 20 nt, Human
caguuauggcuauaggugcu

SEQ ID NO: 1597849 - RNA, 22 nt, Human
cagugauuaccagggacugagg

SEQ ID NO: 1597850 - RNA, 18 nt, Human
cauccugaggcuccacuu

SEQ ID NO: 1597851 - RNA, 19 nt, Human
cauccugaggcuccacuug

SEQ ID NO: 1597852 - RNA, 13 nt, Human
caucagcugcuga

SEQ ID NO: 1597853 - RNA, 23 nt, Human
caguuguucaauaauaaauauuu

SEQ ID NO: 1597854 - RNA, 16 nt, Human
cauagguuuaauaauu

SEQ ID NO: 1597855 - RNA, 20 nt, Human
cauagcagcuuauucacaag

SEQ ID NO: 1597856 - RNA, 19 nt, Human
cauagcagcuuauucacaa

SEQ ID NO: 1597857 - RNA, 22 nt, Human
auugaggacacugauauggguc

SEQ ID NO: 1597858 - RNA, 19 nt, Human
auuuuuauauuugaaauau

SEQ ID NO: 1597859 - RNA, 21 nt, Human
caaaagguauuuuaaucacca

SEQ ID NO: 1597860 - RNA, 19 nt, Human
auuuucuauaauuuaaaua

SEQ ID NO: 1597861 - RNA, 18 nt, Human
auuuucuauaauuuaaau

SEQ ID NO: 1597862 - RNA, 17 nt, Human
auuuucuauaauuuaaa

SEQ ID NO: 1597863 - RNA, 21 nt, Human
auugauaaguucauacauugu

SEQ ID NO: 1597864 - RNA, 19 nt, Human
auugauaaguucauacauu

SEQ ID NO: 1597865 - RNA, 18 nt, Human
auugauaaguucauacau

SEQ ID NO: 1597866 - RNA, 17 nt, Human
auugauaaguucauaca

SEQ ID NO: 1597867 - RNA, 16 nt, Human
auugauaaguucauac

SEQ ID NO: 1597868 - RNA, 15 nt, Human
auugauaaguucaua

SEQ ID NO: 1597869 - RNA, 12 nt, Human
auugauaaguuc

SEQ ID NO: 1597870 - RNA, 23 nt, Human
cacugaagaagcaccaaucauga

SEQ ID NO: 1597871 - RNA, 21 nt, Human
cacuccagugagacagcucug

SEQ ID NO: 1597872 - RNA, 23 nt, Human
cacaucagcuugcccuguuaaaa

SEQ ID NO: 1597873 - RNA, 13 nt, Human
cacaucagcuugc

SEQ ID NO: 1597874 - RNA, 17 nt, Human
caaucagccuaguugau

SEQ ID NO: 1597875 - RNA, 14 nt, Human
caagcaaguauuag

SEQ ID NO: 1597876 - RNA, 19 nt, Human
caacuauauuguuugcuaa

SEQ ID NO: 1597877 - RNA, 19 nt, Human
caacuaucucauuuccaag

SEQ ID NO: 1597878 - RNA, 20 nt, Human
caacuauuuuuccaaaauaa

SEQ ID NO: 1597879 - RNA, 12 nt, Human
caacuccagaaa

SEQ ID NO: 1597880 - RNA, 15 nt, Human
caacuauuuuuccaa

SEQ ID NO: 1597881 - RNA, 16 nt, Human
uuuucuauaauuuaaa

SEQ ID NO: 1597882 - RNA, 20 nt, Human
uuuucaggcuagauguaugu

SEQ ID NO: 1597883 - RNA, 13 nt, Human
auguuaagcagau

SEQ ID NO: 1597884 - RNA, 12 nt, Human
auguuaagcaga

SEQ ID NO: 1597885 - RNA, 21 nt, Human
augugcuaguaauuggaaagg

SEQ ID NO: 1597886 - RNA, 12 nt, Human
auguguuuccau

SEQ ID NO: 1597887 - RNA, 17 nt, Human
uuuguaguguuggagaa

SEQ ID NO: 1597888 - RNA, 23 nt, Human
augucgucaaagcugaaauggac

SEQ ID NO: 1597889 - RNA, 19 nt, Human
auguauauuuuauaucaau

SEQ ID NO: 1597890 - RNA, 19 nt, Human
uuugcuaagcauuccaacu

SEQ ID NO: 1597891 - RNA, 20 nt, Human
uuugcuggagcucugcccau

SEQ ID NO: 1597892 - RNA, 13 nt, Human
uuugagaguucua

SEQ ID NO: 1597893 - RNA, 14 nt, Human
uuugagaguucuaa

SEQ ID NO: 1597894 - RNA, 21 nt, Human
uuugacagaauauguuucaaa

SEQ ID NO: 1597895 - RNA, 20 nt, Human
uuugacagaauauguuucaa

SEQ ID NO: 1597896 - RNA, 19 nt, Human
uuugacagaauauguuuca

SEQ ID NO: 1597897 - RNA, 18 nt, Human
uuugacagaauauguuuc

SEQ ID NO: 1597898 - RNA, 22 nt, Human
auucaaacagucucaggaaauc

SEQ ID NO: 1597899 - RNA, 20 nt, Human
auuauauggcuugaguuuaa

SEQ ID NO: 1597900 - RNA, 17 nt, Human
auuccaagugauugaaa

SEQ ID NO: 1597901 - RNA, 22 nt, Human
auucaggagaguagaacagaua

SEQ ID NO: 1597902 - RNA, 21 nt, Human
auucaggagaguagaacagau

SEQ ID NO: 1597903 - RNA, 15 nt, Human
auuacuguaagaaaa

SEQ ID NO: 1597904 - RNA, 16 nt, Human
auuacuguaagaaaau

SEQ ID NO: 1597905 - RNA, 15 nt, Human
uuuuguuuucauuau

SEQ ID NO: 1597906 - RNA, 14 nt, Human
uuuugugaagcaaa

SEQ ID NO: 1597907 - RNA, 17 nt, Human
uuuuuauauuugaaaua

SEQ ID NO: 1597908 - RNA, 15 nt, Human
uuuuugaagcuguau

SEQ ID NO: 1597909 - RNA, 13 nt, Human
uuuuugacagaau

SEQ ID NO: 1597910 - RNA, 12 nt, Human
uuuuugacagaa

SEQ ID NO: 1597911 - RNA, 19 nt, Human
uuuuuguagcacugacaga

SEQ ID NO: 1597912 - RNA, 21 nt, Human
uuuuuguagcacugacagauu

SEQ ID NO: 1597913 - RNA, 20 nt, Human
uuuuuguagcacugacagau

SEQ ID NO: 1597914 - RNA, 16 nt, Human
auuggagcucguggaa

SEQ ID NO: 1597915 - RNA, 17 nt, Human
auuggagcucgugggac

SEQ ID NO: 1597916 - RNA, 17 nt, Human
auuguacgaagaguauu

SEQ ID NO: 1597917 - RNA, 19 nt, Human
auugauguguuuauuuaua

SEQ ID NO: 1597918 - RNA, 12 nt, Human
auugauguguuu

SEQ ID NO: 1597919 - RNA, 15 nt, Human
auuuaccacuugugu

SEQ ID NO: 1597920 - RNA, 22 nt, Human
auuuaccacuuguguuuugcaa

SEQ ID NO: 1597921 - RNA, 16 nt, Human
auuguaguccuguaau

SEQ ID NO: 1597922 - RNA, 17 nt, Human
auuuaaaaaaaaaccug

SEQ ID NO: 1597923 - RNA, 19 nt, Human
auuuauuacuguaagaaaa

SEQ ID NO: 1597924 - RNA, 20 nt, Human
auuuauuacuguaagaaaau

SEQ ID NO: 1597925 - RNA, 21 nt, Human
auuuauuuuaauaauguuuca

SEQ ID NO: 1597926 - RNA, 18 nt, Human
auuugaauguuaagcaga

SEQ ID NO: 1597927 - RNA, 13 nt, Human
auuugaauguuaa

SEQ ID NO: 1597928 - RNA, 19 nt, Human
auuugaauguuaagcagau

SEQ ID NO: 1597929 - RNA, 20 nt, Human
augccuuuucccaacuccag

SEQ ID NO: 1597930 - RNA, 22 nt, Human
augccuuuucccaacuccagaa

SEQ ID NO: 1597931 - RNA, 18 nt, Human
augcuacaggauuugaaa

SEQ ID NO: 1597932 - RNA, 21 nt, Human
uuuauaugcuucuguuuuaua

SEQ ID NO: 1597933 - RNA, 23 nt, Human
augcuguauuuuaaaagaaugau

SEQ ID NO: 1597934 - RNA, 22 nt, Human
augcuguauuuuaaaagaauga

SEQ ID NO: 1597935 - RNA, 21 nt, Human
augcuucuguuuuauaauuuu

SEQ ID NO: 1597936 - RNA, 17 nt, Human
auggaaugcuguguuaa

SEQ ID NO: 1597937 - RNA, 21 nt, Human
auggaaugcuguguuaaauaa

SEQ ID NO: 1597938 - RNA, 19 nt, Human
uuucaaacauauauaacaa

SEQ ID NO: 1597939 - RNA, 22 nt, Human
uuucacauaucuaguaugaaau

SEQ ID NO: 1597940 - RNA, 20 nt, Human
uuuaaaaaagaaacauuugg

SEQ ID NO: 1597941 - RNA, 21 nt, Human
uuuaaauauaugcuaagucuu

SEQ ID NO: 1597942 - RNA, 18 nt, Human
uuuaaaaaaauuccaagu

SEQ ID NO: 1597943 - RNA, 12 nt, Human
augcaaagcacu

SEQ ID NO: 1597944 - RNA, 13 nt, Human
augcaaagcacug

SEQ ID NO: 1597945 - RNA, 14 nt, Human
augcaaagcacuga

SEQ ID NO: 1597946 - RNA, 15 nt, Human
augcaaagcacugac

SEQ ID NO: 1597947 - RNA, 13 nt, Human
augauuucauuca

SEQ ID NO: 1597948 - RNA, 18 nt, Human
uuguucauacauauuuuu

SEQ ID NO: 1597949 - RNA, 16 nt, Human
uuguucauacauauuu

SEQ ID NO: 1597950 - RNA, 22 nt, Human
uuguucaauaauaaauauuuuu

SEQ ID NO: 1597951 - RNA, 13 nt, Human
uuguucauacaua

SEQ ID NO: 1597952 - RNA, 20 nt, Human
uuguucaauaauaaauauuu

SEQ ID NO: 1597953 - RNA, 20 nt, Human
uugucaauaaaauccauaca

SEQ ID NO: 1597954 - RNA, 17 nt, Human
augagguacugagagug

SEQ ID NO: 1597955 - RNA, 18 nt, Human
augagguacugagaguga

SEQ ID NO: 1597956 - RNA, 15 nt, Human
augagguacugagag

SEQ ID NO: 1597957 - RNA, 17 nt, Human
uuguagcuuuaucaaag

SEQ ID NO: 1597958 - RNA, 16 nt, Human
uuguagcuuuaucaaa

SEQ ID NO: 1597959 - RNA, 13 nt, Human
uugacaugggaca

SEQ ID NO: 1597960 - RNA, 12 nt, Human
uugacuuuuuau

SEQ ID NO: 1597961 - RNA, 15 nt, Human
aucucaaaacugcac

SEQ ID NO: 1597962 - RNA, 19 nt, Human
aucucaaaacugcacuguc

SEQ ID NO: 1597963 - RNA, 20 nt, Human
aucucaaaacugcacuguca

SEQ ID NO: 1597964 - RNA, 22 nt, Human
uugcaagccagauuuuccugaa

SEQ ID NO: 1597965 - RNA, 14 nt, Human
aucugacuaugaca

SEQ ID NO: 1597966 - RNA, 17 nt, Human
aucugacuaugacauaa

SEQ ID NO: 1597967 - RNA, 15 nt, Human
aucuuauaauuuaaa

SEQ ID NO: 1597968 - RNA, 16 nt, Human
aucuuauaauuuaaaa

SEQ ID NO: 1597969 - RNA, 12 nt, Human
aucuuuaaaaua

SEQ ID NO: 1597970 - RNA, 15 nt, Human
aucuuuaaaauacac

SEQ ID NO: 1597971 - RNA, 17 nt, Human
uuggagaagaacugaaa

SEQ ID NO: 1597972 - RNA, 22 nt, Human
uuggagaagaacugaaaucaua

SEQ ID NO: 1597973 - RNA, 15 nt, Human
uuggagaagaacuga

SEQ ID NO: 1597974 - RNA, 18 nt, Human
uuggagacacaacuauuu

SEQ ID NO: 1597975 - RNA, 23 nt, Human
auaugcaaagcacugacuucuaa

SEQ ID NO: 1597976 - RNA, 16 nt, Human
auaugcaaagcacuga

SEQ ID NO: 1597977 - RNA, 21 nt, Human
uucagaaaauauuauguguuu

SEQ ID NO: 1597978 - RNA, 20 nt, Human
uucagaaaauauuauguguu

SEQ ID NO: 1597979 - RNA, 14 nt, Human
uucagaaaauauua

SEQ ID NO: 1597980 - RNA, 13 nt, Human
uucagaaaauauu

SEQ ID NO: 1597981 - RNA, 17 nt, Human
auagucaaauuguguga

SEQ ID NO: 1597982 - RNA, 18 nt, Human
auagucaaauugugugaa

SEQ ID NO: 1597983 - RNA, 17 nt, Human
auauauaacaaugcugu

SEQ ID NO: 1597984 - RNA, 18 nt, Human
auauauaacaaugcugua

SEQ ID NO: 1597985 - RNA, 19 nt, Human
auauauaacaaugcuguau

SEQ ID NO: 1597986 - RNA, 19 nt, Human
auauaaguauucuaaauuu

SEQ ID NO: 1597987 - RNA, 12 nt, Human
auauaacaaugc

SEQ ID NO: 1597988 - RNA, 15 nt, Human
auauaacaaugcugu

SEQ ID NO: 1597989 - RNA, 17 nt, Human
auauaacaaugcuguau

SEQ ID NO: 1597990 - RNA, 19 nt, Human
auauaagcuuguauuccuu

SEQ ID NO: 1597991 - RNA, 17 nt, Human
auauaaguauucuaaau

SEQ ID NO: 1597992 - RNA, 17 nt, Human
auagcuacuaauuuuaa

SEQ ID NO: 1597993 - RNA, 14 nt, Human
auagcuacuaauuu

SEQ ID NO: 1597994 - RNA, 18 nt, Human
auagcuacuaauuuuaaa

SEQ ID NO: 1597995 - RNA, 17 nt, Human
uuauuguuuaaaaucau

SEQ ID NO: 1597996 - RNA, 22 nt, Human
auaggaauugacccacaagaaa

SEQ ID NO: 1597997 - RNA, 21 nt, Human
auaggaauugacccacaagaa

SEQ ID NO: 1597998 - RNA, 21 nt, Human
uucacauaucuaguaugaaau

SEQ ID NO: 1597999 - RNA, 20 nt, Human
uucacauaucuaguaugaaa

SEQ ID NO: 1598000 - RNA, 22 nt, Human
uucaagaaaacaacuucaauau

SEQ ID NO: 1598001 - RNA, 15 nt, Human
uucaaacauauauaa

SEQ ID NO: 1598002 - RNA, 16 nt, Human
uucaaacuuuggaaca

SEQ ID NO: 1598003 - RNA, 14 nt, Human
uucugaagaagaug

SEQ ID NO: 1598004 - RNA, 23 nt, Human
uucugcaucagcugcugaaacaa

SEQ ID NO: 1598005 - RNA, 12 nt, Human
uucugaagaaga

SEQ ID NO: 1598006 - RNA, 13 nt, Human
uucugaagaagau

SEQ ID NO: 1598007 - RNA, 13 nt, Human
aucccucccucca

SEQ ID NO: 1598008 - RNA, 11 nt, Human
aucccucccuc

SEQ ID NO: 1598009 - RNA, 23 nt, Human
aucccucccuccaccucccugca

SEQ ID NO: 1598010 - RNA, 14 nt, Human
aucccucccuccac

SEQ ID NO: 1598011 - RNA, 14 nt, Human
uucucaacuccaaa

SEQ ID NO: 1598012 - RNA, 18 nt, Human
uucucaacuccaaacuga

SEQ ID NO: 1598013 - RNA, 19 nt, Human
aucagugugucuaaauuug

SEQ ID NO: 1598014 - RNA, 20 nt, Human
aucagugugucuaaauuuga

SEQ ID NO: 1598015 - RNA, 14 nt, Human
auauuugaaauauu

SEQ ID NO: 1598016 - RNA, 19 nt, Human
auauuugaaauauugacuu

SEQ ID NO: 1598017 - RNA, 23 nt, Human
auauuugaaauauugacuuuuua

SEQ ID NO: 1598018 - RNA, 12 nt, Human
auauuuuaacuu

SEQ ID NO: 1598019 - RNA, 22 nt, Human
auauuuguaucacaaaucuuaa

SEQ ID NO: 1598020 - RNA, 13 nt, Human
auauuugaaauau

SEQ ID NO: 1598021 - RNA, 18 nt, Human
auauuguguugugaaugu

SEQ ID NO: 1598022 - RNA, 17 nt, Human
auauuguguugugaaug

SEQ ID NO: 1598023 - RNA, 17 nt, Human
auauguuucaaacuuug

SEQ ID NO: 1598024 - RNA, 17 nt, Human
agugaaagaaaauaaca

SEQ ID NO: 1598025 - RNA, 15 nt, Human
agugaaagaaaauaa

SEQ ID NO: 1598026 - RNA, 16 nt, Human
agugaacaaauuuaca

SEQ ID NO: 1598027 - RNA, 20 nt, Human
agugaacaaauuuacagaga

SEQ ID NO: 1598028 - RNA, 14 nt, Human
ugugauguauucua

SEQ ID NO: 1598029 - RNA, 16 nt, Human
ugugauguauucuagc

SEQ ID NO: 1598030 - RNA, 15 nt, Human
ugugagaugcuagaa

SEQ ID NO: 1598031 - RNA, 19 nt, Human
ugugagaugcuagaacucc

SEQ ID NO: 1598032 - RNA, 22 nt, Human
ugugagaugcuagaacucccuu

SEQ ID NO: 1598033 - RNA, 22 nt, Human
agucucaggaaaucaaauaugc

SEQ ID NO: 1598034 - RNA, 18 nt, Human
agucacuaccuucaugca

SEQ ID NO: 1598035 - RNA, 17 nt, Human
aguguacuuaacuauuc

SEQ ID NO: 1598036 - RNA, 14 nt, Human
uguuccuagugaaa

SEQ ID NO: 1598037 - RNA, 18 nt, Human
uguuccuagugaaagagg

SEQ ID NO: 1598038 - RNA, 15 nt, Human
uguuauaaucuuuca

SEQ ID NO: 1598039 - RNA, 14 nt, Human
agugugucuaaauu

SEQ ID NO: 1598040 - RNA, 20 nt, Human
ugugugaaagguacuucaaa

SEQ ID NO: 1598041 - RNA, 13 nt, Human
uguguaaguagau

SEQ ID NO: 1598042 - RNA, 16 nt, Human
uguuaaguauguguaa

SEQ ID NO: 1598043 - RNA, 15 nt, Human
uguuaaguaugugua

SEQ ID NO: 1598044 - RNA, 19 nt, Human
uguguuaaguauguguaaa

SEQ ID NO: 1598045 - RNA, 20 nt, Human
uguggucacaggaaguagag

SEQ ID NO: 1598046 - RNA, 22 nt, Human
aguugcauagguuuaauaauuu

SEQ ID NO: 1598047 - RNA, 14 nt, Human
uguuuugcaagcca

SEQ ID NO: 1598048 - RNA, 21 nt, Human
aguucugcagauaaacaguag

SEQ ID NO: 1598049 - RNA, 16 nt, Human
aguucugcagauaaac

SEQ ID NO: 1598050 - RNA, 19 nt, Human
uguuuucauuaucucaaaa

SEQ ID NO: 1598051 - RNA, 19 nt, Human
uguuuugaaucucauaauu

SEQ ID NO: 1598052 - RNA, 24 nt, Human
uguuuauuuauagaguguacuuaa

SEQ ID NO: 1598053 - RNA, 14 nt, Human
uguuuauuuauaga

SEQ ID NO: 1598054 - RNA, 15 nt, Human
uuacuguaagaaaau

SEQ ID NO: 1598055 - RNA, 14 nt, Human
uuaccuuacagaag

SEQ ID NO: 1598056 - RNA, 16 nt, Human
auaaaauaauuuuuau

SEQ ID NO: 1598057 - RNA, 21 nt, Human
auaaaauaauuuuuauauuug

SEQ ID NO: 1598058 - RNA, 22 nt, Human
auaaaauaauuuuuauauuuga

SEQ ID NO: 1598059 - RNA, 18 nt, Human
auaaaauccauacauuug

SEQ ID NO: 1598060 - RNA, 19 nt, Human
auaaaauccauacauuugu

SEQ ID NO: 1598061 - RNA, 18 nt, Human
uuaaguaaugauaacugg

SEQ ID NO: 1598062 - RNA, 22 nt, Human
uuaagaagacugcauuauauuu

SEQ ID NO: 1598063 - RNA, 17 nt, Human
uuaauuccaauuauaug

SEQ ID NO: 1598064 - RNA, 23 nt, Human
agggaggacgcucucuggccuuc

SEQ ID NO: 1598065 - RNA, 21 nt, Human
agggaggacgcucucuggccu

SEQ ID NO: 1598066 - RNA, 22 nt, Human
agggaggacgcucucuggccuu

SEQ ID NO: 1598067 - RNA, 16 nt, Human
aggggaauugaggaca

SEQ ID NO: 1598068 - RNA, 18 nt, Human
aggggagcaugggaagug

SEQ ID NO: 1598069 - RNA, 16 nt, Human
aguacauuuggagaca

SEQ ID NO: 1598070 - RNA, 15 nt, Human
aguaauucaagaaaa

SEQ ID NO: 1598071 - RNA, 16 nt, Human
uguagaggagaaacug

SEQ ID NO: 1598072 - RNA, 13 nt, Human
aguaaaauccaca

SEQ ID NO: 1598073 - RNA, 18 nt, Human
aguaaugauaacuggaaa

SEQ ID NO: 1598074 - RNA, 20 nt, Human
aguaaugauaacuggaaacu

SEQ ID NO: 1598075 - RNA, 17 nt, Human
aguaaugauaacuggaa

SEQ ID NO: 1598076 - RNA, 14 nt, Human
aguaauagagcaaa

SEQ ID NO: 1598077 - RNA, 17 nt, Human
aguauuucuaugaaaua

SEQ ID NO: 1598078 - RNA, 16 nt, Human
aguauuucuaugaaau

SEQ ID NO: 1598079 - RNA, 18 nt, Human
aguauuucuaugaaauau

SEQ ID NO: 1598080 - RNA, 21 nt, Human
aguauuagaauaccacaggaa

SEQ ID NO: 1598081 - RNA, 14 nt, Human
agucaccucaugga

SEQ ID NO: 1598082 - RNA, 15 nt, Human
agucaccucauggaa

SEQ ID NO: 1598083 - RNA, 17 nt, Human
agucaccucauggaauu

SEQ ID NO: 1598084 - RNA, 18 nt, Human
aguauuagaauaccacag

SEQ ID NO: 1598085 - RNA, 16 nt, Human
aguaguaauagagcaa

SEQ ID NO: 1598086 - RNA, 14 nt, Human
uguaguguuggaga

SEQ ID NO: 1598087 - RNA, 15 nt, Human
uguaguguuggagaa

SEQ ID NO: 1598088 - RNA, 15 nt, Human
uguaucacaaaucuu

SEQ ID NO: 1598089 - RNA, 18 nt, Human
uguaucacaaaucuuaac

SEQ ID NO: 1598090 - RNA, 22 nt, Human
uguauucuagcuaauguaauaa

SEQ ID NO: 1598091 - RNA, 13 nt, Human
uguauuacaaauc

SEQ ID NO: 1598092 - RNA, 22 nt, Human
uguauuacaaauccaaugaaau

SEQ ID NO: 1598093 - RNA, 20 nt, Human
uguauucuagcuaauguaau

SEQ ID NO: 1598094 - RNA, 23 nt, Human
uggugugaccacugcagaagaca

SEQ ID NO: 1598095 - RNA, 16 nt, Human
uguaaauaguauuuga

SEQ ID NO: 1598096 - RNA, 23 nt, Human
aggaaaucaaauaugcaaagcac

SEQ ID NO: 1598097 - RNA, 21 nt, Human
aggaaaucaaauaugcaaagc

SEQ ID NO: 1598098 - RNA, 22 nt, Human
aggaaaucaaauaugcaaagca

SEQ ID NO: 1598099 - RNA, 20 nt, Human
aggaaaucaaauaugcaaag

SEQ ID NO: 1598100 - RNA, 14 nt, Human
ugcuacaaaaacac

SEQ ID NO: 1598101 - RNA, 15 nt, Human
ugcuacaaaaacaca

SEQ ID NO: 1598102 - RNA, 17 nt, Human
ugccuuuucccaacucc

SEQ ID NO: 1598103 - RNA, 19 nt, Human
ugccuuuucccaacuccag

SEQ ID NO: 1598104 - RNA, 16 nt, Human
agcuugcccuguuaaa

SEQ ID NO: 1598105 - RNA, 18 nt, Human
agcuugcccuguuaaaag

SEQ ID NO: 1598106 - RNA, 19 nt, Human
agcuugcccuguuaaaaga

SEQ ID NO: 1598107 - RNA, 20 nt, Human
agcuugcccuggugccucac

SEQ ID NO: 1598108 - RNA, 14 nt, Human
agcuguucacagcc

SEQ ID NO: 1598109 - RNA, 16 nt, Human
agcugcccucuccugg

SEQ ID NO: 1598110 - RNA, 15 nt, Human
agcugcccucuccug

SEQ ID NO: 1598111 - RNA, 14 nt, Human
agcugcccucuccu

SEQ ID NO: 1598112 - RNA, 13 nt, Human
agcugcccucucc

SEQ ID NO: 1598113 - RNA, 20 nt, Human
ugcccuguuaaaagaugaaa

SEQ ID NO: 1598114 - RNA, 17 nt, Human
uggagcucguggaacag

SEQ ID NO: 1598115 - RNA, 21 nt, Human
uggagcucguggaacaguuac

SEQ ID NO: 1598116 - RNA, 21 nt, Human
uggagcucgugggacagucac

SEQ ID NO: 1598117 - RNA, 15 nt, Human
aggcagcuugaaacu

SEQ ID NO: 1598118 - RNA, 20 nt, Human
aggcauuuaggccaugggac

SEQ ID NO: 1598119 - RNA, 15 nt, Human
aggcccccaggugcc

SEQ ID NO: 1598120 - RNA, 14 nt, Human
uggaguugaaaauc

SEQ ID NO: 1598121 - RNA, 13 nt, Human
aggacgcucucug

SEQ ID NO: 1598122 - RNA, 14 nt, Human
aggacgcucucugg

SEQ ID NO: 1598123 - RNA, 16 nt, Human
aggacgcucucuggcc

SEQ ID NO: 1598124 - RNA, 17 nt, Human
aggacgcucucuggccu

SEQ ID NO: 1598125 - RNA, 19 nt, Human
aggacgcucucuggccuuc

SEQ ID NO: 1598126 - RNA, 20 nt, Human
aggacgcucucuggccuucg

SEQ ID NO: 1598127 - RNA, 18 nt, Human
aggagaaacuggaacucu

SEQ ID NO: 1598128 - RNA, 19 nt, Human
aggagaaacuggaacucuc

SEQ ID NO: 1598129 - RNA, 17 nt, Human
aggagaguagaacagau

SEQ ID NO: 1598130 - RNA, 17 nt, Human
ugcuuuuaaaaaaaaau

SEQ ID NO: 1598131 - RNA, 20 nt, Human
ugcauagauucccugagcag

SEQ ID NO: 1598132 - RNA, 19 nt, Human
ugcauacucauuaggaugg

SEQ ID NO: 1598133 - RNA, 13 nt, Human
ugccauaauuacu

SEQ ID NO: 1598134 - RNA, 17 nt, Human
ugccaguuauggcuaua

SEQ ID NO: 1598135 - RNA, 22 nt, Human
ugcagaagacaguauggcagcu

SEQ ID NO: 1598136 - RNA, 17 nt, Human
ugcacuccagccugagc

SEQ ID NO: 1598137 - RNA, 15 nt, Human
ugcacuccagccuga

SEQ ID NO: 1598138 - RNA, 18 nt, Human
agccccgugggguuccuc

SEQ ID NO: 1598139 - RNA, 21 nt, Human
ugcaauaaaauggguuuuacu

SEQ ID NO: 1598140 - RNA, 17 nt, Human
ugcaauaaaauggguuu

SEQ ID NO: 1598141 - RNA, 15 nt, Human
ugcaagccagauuuu

SEQ ID NO: 1598142 - RNA, 21 nt, Human
ugcaagccagauuuuccugaa

SEQ ID NO: 1598143 - RNA, 13 nt, Human
ugauuucauucaa

SEQ ID NO: 1598144 - RNA, 18 nt, Human
ugcaaagcacugacuucu

SEQ ID NO: 1598145 - RNA, 20 nt, Human
ugcaaagcacugacuucuaa

SEQ ID NO: 1598146 - RNA, 22 nt, Human
ugcaaagcacugacuucuaagu

SEQ ID NO: 1598147 - RNA, 15 nt, Human
ugauuaaguaaugau

SEQ ID NO: 1598148 - RNA, 16 nt, Human
ugauuaaguaaugaua

SEQ ID NO: 1598149 - RNA, 14 nt, Human
ugaugggaaagcau

SEQ ID NO: 1598150 - RNA, 22 nt, Human
agcauuuagauguauagguuga

SEQ ID NO: 1598151 - RNA, 19 nt, Human
agcagggcauggcugggaa

SEQ ID NO: 1598152 - RNA, 14 nt, Human
agcaggcuacuguc

SEQ ID NO: 1598153 - RNA, 16 nt, Human
agcaggcuacugucag

SEQ ID NO: 1598154 - RNA, 17 nt, Human
agcaggcuacugucagc

SEQ ID NO: 1598155 - RNA, 19 nt, Human
agcaggcuacugucagcuc

SEQ ID NO: 1598156 - RNA, 20 nt, Human
agcaggcuacugucagcucc

SEQ ID NO: 1598157 - RNA, 17 nt, Human
agcagucaggaaagaga

SEQ ID NO: 1598158 - RNA, 18 nt, Human
agcagucaggaaagagaa

SEQ ID NO: 1598159 - RNA, 19 nt, Human
agcagucaggaaagagaac

SEQ ID NO: 1598160 - RNA, 19 nt, Human
agcauaccaacacgagcag

SEQ ID NO: 1598161 - RNA, 22 nt, Human
agcauaccaacacgagcaggcu

SEQ ID NO: 1598162 - RNA, 13 nt, Human
agcauaccaacac

SEQ ID NO: 1598163 - RNA, 19 nt, Human
ugauaaguucauacauugu

SEQ ID NO: 1598164 - RNA, 17 nt, Human
ugauaaguucauacauu

SEQ ID NO: 1598165 - RNA, 15 nt, Human
ugauaaguucauaca

SEQ ID NO: 1598166 - RNA, 13 nt, Human
ugauaaguucaua

SEQ ID NO: 1598167 - RNA, 16 nt, Human
ugauaaguaaaugcua

SEQ ID NO: 1598168 - RNA, 22 nt, Human
ugaguucuacauaaguaauuca

SEQ ID NO: 1598169 - RNA, 20 nt, Human
ugaguucuacauaaguaauu

SEQ ID NO: 1598170 - RNA, 15 nt, Human
ugaguucuacauaag

SEQ ID NO: 1598171 - RNA, 16 nt, Human
agaguuuagcuggaaa

SEQ ID NO: 1598172 - RNA, 17 nt, Human
agaguuuagcuggaaaa

SEQ ID NO: 1598173 - RNA, 14 nt, Human
agagugaacaaauu

SEQ ID NO: 1598174 - RNA, 18 nt, Human
agaugcaguucugaagaa

SEQ ID NO: 1598175 - RNA, 19 nt, Human
agaugcaguucugaagaag

SEQ ID NO: 1598176 - RNA, 20 nt, Human
agaugcaguucugaagaaga

SEQ ID NO: 1598177 - RNA, 14 nt, Human
agaugcuagaacuc

SEQ ID NO: 1598178 - RNA, 15 nt, Human
agaugcuagaacucc

SEQ ID NO: 1598179 - RNA, 17 nt, Human
ugacccacaagaaauga

SEQ ID NO: 1598180 - RNA, 17 nt, Human
ugacauaaaaacaacuu

SEQ ID NO: 1598181 - RNA, 20 nt, Human
ugacauaaaaacaacuuuau

SEQ ID NO: 1598182 - RNA, 18 nt, Human
ugacauaaaaacaacuuu

SEQ ID NO: 1598183 - RNA, 15 nt, Human
agagguugcagugag

SEQ ID NO: 1598184 - RNA, 21 nt, Human
agagcuguucacagccagacu

SEQ ID NO: 1598185 - RNA, 22 nt, Human
agagcugcccucuccugggcag

SEQ ID NO: 1598186 - RNA, 19 nt, Human
ugaacaaauuuacagagac

SEQ ID NO: 1598187 - RNA, 20 nt, Human
ugaacaaauuuacagagaca

SEQ ID NO: 1598188 - RNA, 15 nt, Human
ugaaauuguauuaca

SEQ ID NO: 1598189 - RNA, 18 nt, Human
ugaaauauuauguuaaaa

SEQ ID NO: 1598190 - RNA, 14 nt, Human
agagcugcccucuc

SEQ ID NO: 1598191 - RNA, 13 nt, Human
agagcugcccucu

SEQ ID NO: 1598192 - RNA, 15 nt, Human
agagcugcccucucc

SEQ ID NO: 1598193 - RNA, 17 nt, Human
ugaaauaagccagacau

SEQ ID NO: 1598194 - RNA, 18 nt, Human
ugaaauaagccagacauc

SEQ ID NO: 1598195 - RNA, 20 nt, Human
ugaaauaagccagacaucaa

SEQ ID NO: 1598196 - RNA, 23 nt, Human
ugaaauaagccagacaucaacag

SEQ ID NO: 1598197 - RNA, 20 nt, Human
agagcaaaauugauguguuu

SEQ ID NO: 1598198 - RNA, 14 nt, Human
agagcaaaauugau

SEQ ID NO: 1598199 - RNA, 14 nt, Human
agacauagaauuaa

SEQ ID NO: 1598200 - RNA, 16 nt, Human
ucuuauuucauuucuu

SEQ ID NO: 1598201 - RNA, 15 nt, Human
ucuuauuucauuucu

SEQ ID NO: 1598202 - RNA, 24 nt, Human
agagacagaaagcagaacagugau

SEQ ID NO: 1598203 - RNA, 23 nt, Human
ucuuagaugcaguucugaagaag

SEQ ID NO: 1598204 - RNA, 14 nt, Human
ucuuaauuaaaaga

SEQ ID NO: 1598205 - RNA, 16 nt, Human
agacacacugaagaag

SEQ ID NO: 1598206 - RNA, 17 nt, Human
agacacacugaagaagc

SEQ ID NO: 1598207 - RNA, 20 nt, Human
agacacaacuauuuuuccaa

SEQ ID NO: 1598208 - RNA, 19 nt, Human
agacacaacuauuuuucca

SEQ ID NO: 1598209 - RNA, 12 nt, Human
ucucaggaaauc

SEQ ID NO: 1598210 - RNA, 16 nt, Human
acuuguguuuugcaag

SEQ ID NO: 1598211 - RNA, 23 nt, Human
acuucuaaguaaaaccacagcag

SEQ ID NO: 1598212 - RNA, 16 nt, Human
acuugucaauaaaauc

SEQ ID NO: 1598213 - RNA, 21 nt, Human
acuugaacccauauuuguaca

SEQ ID NO: 1598214 - RNA, 19 nt, Human
acuugaacccgggaggcag

SEQ ID NO: 1598215 - RNA, 20 nt, Human
acuugaacccgggaggcaga

SEQ ID NO: 1598216 - RNA, 21 nt, Human
acuugaacccgggaggcagag

SEQ ID NO: 1598217 - RNA, 12 nt, Human
ucucuggccuuc

SEQ ID NO: 1598218 - RNA, 21 nt, Human
ucucuggccuucggccuccau

SEQ ID NO: 1598219 - RNA, 22 nt, Human
ucucuggccuucggccuccauc

SEQ ID NO: 1598220 - RNA, 23 nt, Human
ucucuggccuucggccuccaucc

SEQ ID NO: 1598221 - RNA, 13 nt, Human
ucucuggccuucg

SEQ ID NO: 1598222 - RNA, 14 nt, Human
agaaaugaaagcag

SEQ ID NO: 1598223 - RNA, 12 nt, Human
ucugaagaagau

SEQ ID NO: 1598224 - RNA, 14 nt, Human
agaaagaaaaucag

SEQ ID NO: 1598225 - RNA, 17 nt, Human
agaaaucaaagagagaa

SEQ ID NO: 1598226 - RNA, 16 nt, Human
ucugacuaugacauaa

SEQ ID NO: 1598227 - RNA, 14 nt, Human
ucugacuaugacau

SEQ ID NO: 1598228 - RNA, 13 nt, Human
acugccuucucaa

SEQ ID NO: 1598229 - RNA, 19 nt, Human
acugccuucucaacuccaa

SEQ ID NO: 1598230 - RNA, 20 nt, Human
acugccuucucaacuccaaa

SEQ ID NO: 1598231 - RNA, 21 nt, Human
acuggcacaguuuucugagaa

SEQ ID NO: 1598232 - RNA, 19 nt, Human
acuggcacaguuuucugag

SEQ ID NO: 1598233 - RNA, 20 nt, Human
acuggcacaguuuucugaga

SEQ ID NO: 1598234 - RNA, 13 nt, Human
acuggcacaguuu

SEQ ID NO: 1598235 - RNA, 15 nt, Human
acugcauuauauuua

SEQ ID NO: 1598236 - RNA, 14 nt, Human
acugcauuauauuu

SEQ ID NO: 1598237 - RNA, 18 nt, Human
acuguggguagacacaca

SEQ ID NO: 1598238 - RNA, 21 nt, Human
acugucagcuccccucggaga

SEQ ID NO: 1598239 - RNA, 18 nt, Human
acugggacaggggagaac

SEQ ID NO: 1598240 - RNA, 22 nt, Human
acugucagcuccccucggagaa

SEQ ID NO: 1598241 - RNA, 22 nt, Human
ucggguuuuauuguuuaaaauc

SEQ ID NO: 1598242 - RNA, 22 nt, Human
ucuacauaaguaauucaagaaa

SEQ ID NO: 1598243 - RNA, 20 nt, Human
ucuaaagccauuguaguccu

SEQ ID NO: 1598244 - RNA, 21 nt, Human
ucuaaguaaaaccacagcagu

SEQ ID NO: 1598245 - RNA, 22 nt, Human
ucuaaguaaaaccacagcaguu

SEQ ID NO: 1598246 - RNA, 23 nt, Human
ucuaaguaaaaccacagcaguug

SEQ ID NO: 1598247 - RNA, 16 nt, Human
ucuacauacuauggaa

SEQ ID NO: 1598248 - RNA, 20 nt, Human
ucuacauaaguaauucaaga

SEQ ID NO: 1598249 - RNA, 17 nt, Human
ucuacauaaguaauuca

SEQ ID NO: 1598250 - RNA, 18 nt, Human
ucccagccagcaguucag

SEQ ID NO: 1598251 - RNA, 17 nt, Human
ucccagccagcaguuca

SEQ ID NO: 1598252 - RNA, 14 nt, Human
ucccagucauuuaa

SEQ ID NO: 1598253 - RNA, 22 nt, Human
ucccagucauuuaauaaaugug

SEQ ID NO: 1598254 - RNA, 13 nt, Human
uccaugaagaugu

SEQ ID NO: 1598255 - RNA, 21 nt, Human
uccaugaagauguagaggaga

SEQ ID NO: 1598256 - RNA, 20 nt, Human
uccauccugaggcuccacuu

SEQ ID NO: 1598257 - RNA, 21 nt, Human
uccauccugaggcuccacuug

SEQ ID NO: 1598258 - RNA, 16 nt, Human
uccccucggagaagag

SEQ ID NO: 1598259 - RNA, 17 nt, Human
uccccucggagaagagc

SEQ ID NO: 1598260 - RNA, 14 nt, Human
ucccucccuccacc

SEQ ID NO: 1598261 - RNA, 13 nt, Human
ucccucccuccac

SEQ ID NO: 1598262 - RNA, 23 nt, Human
ucccuccaccucccugcaauaaa

SEQ ID NO: 1598263 - RNA, 21 nt, Human
ucccuccaccucccugcaaua

SEQ ID NO: 1598264 - RNA, 17 nt, Human
ucccucccuccaccucc

SEQ ID NO: 1598265 - RNA, 16 nt, Human
ucccucccuccaccuc

SEQ ID NO: 1598266 - RNA, 15 nt, Human
ucccucccuccaccu

SEQ ID NO: 1598267 - RNA, 16 nt, Human
ucccugcaauaaaaug

SEQ ID NO: 1598268 - RNA, 11 nt, Human
ucccugagcag

SEQ ID NO: 1598269 - RNA, 14 nt, Human
acuccaaagaaaug

SEQ ID NO: 1598270 - RNA, 15 nt, Human
acuccaaagaaaugu

SEQ ID NO: 1598271 - RNA, 18 nt, Human
acuccaaagaaauguaag

SEQ ID NO: 1598272 - RNA, 21 nt, Human
acuccaaagaaauguaaggga

SEQ ID NO: 1598273 - RNA, 19 nt, Human
ucccuuucugcuuguguua

SEQ ID NO: 1598274 - RNA, 14 nt, Human
acgagaaaacaaua

SEQ ID NO: 1598275 - RNA, 19 nt, Human
acgagcaggcuacugucag

SEQ ID NO: 1598276 - RNA, 20 nt, Human
acgagcaggcuacugucagc

SEQ ID NO: 1598277 - RNA, 21 nt, Human
ucaugaauuaguuuuauaugc

SEQ ID NO: 1598278 - RNA, 16 nt, Human
ucaugaauuaguuuua

SEQ ID NO: 1598279 - RNA, 13 nt, Human
accucccugcaau

SEQ ID NO: 1598280 - RNA, 12 nt, Human
accucccugcaa

SEQ ID NO: 1598281 - RNA, 22 nt, Human
ucaggaaaucaaauaugcaaag

SEQ ID NO: 1598282 - RNA, 23 nt, Human
ucaggaaaucaaauaugcaaagc

SEQ ID NO: 1598283 - RNA, 21 nt, Human
accuagggugauauuaaccag

SEQ ID NO: 1598284 - RNA, 19 nt, Human
accucaaaaugucuaagau

SEQ ID NO: 1598285 - RNA, 21 nt, Human
uaugaaauauuauguuaaaac

SEQ ID NO: 1598286 - RNA, 21 nt, Human
uauuuccauuaaaaaaucagu

SEQ ID NO: 1598287 - RNA, 13 nt, Human
uauuucauuucuu

SEQ ID NO: 1598288 - RNA, 15 nt, Human
acaguuuucugagaa

SEQ ID NO: 1598289 - RNA, 16 nt, Human
acaguuuucugagaaa

SEQ ID NO: 1598290 - RNA, 17 nt, Human
acaguuuucugagaaag

SEQ ID NO: 1598291 - RNA, 18 nt, Human
acaguuuucugagaaaga

SEQ ID NO: 1598292 - RNA, 19 nt, Human
acaguuuucugagaaagac

SEQ ID NO: 1598293 - RNA, 20 nt, Human
acaguuuucugagaaagacu

SEQ ID NO: 1598294 - RNA, 21 nt, Human
acaguuuucugagaaagacua

SEQ ID NO: 1598295 - RNA, 21 nt, Human
acauaaaaacaacuuuauacc

SEQ ID NO: 1598296 - RNA, 19 nt, Human
acauaaaaacaacuuuaua

SEQ ID NO: 1598297 - RNA, 16 nt, Human
acauaaaaacaacuuu

SEQ ID NO: 1598298 - RNA, 13 nt, Human
acaucaacagaua

SEQ ID NO: 1598299 - RNA, 19 nt, Human
acauauauaacaaugcugu

SEQ ID NO: 1598300 - RNA, 14 nt, Human
acauagaauuaaca

SEQ ID NO: 1598301 - RNA, 18 nt, Human
acauagaauuaacacaug

SEQ ID NO: 1598302 - RNA, 17 nt, Human
acauaucuaguaugaaa

SEQ ID NO: 1598303 - RNA, 22 nt, Human
acauaucuaguaugaaauuaua

SEQ ID NO: 1598304 - RNA, 20 nt, Human
acauaucuaguaugaaauua

SEQ ID NO: 1598305 - RNA, 23 nt, Human
acauaucuaguaugaaauuauau

SEQ ID NO: 1598306 - RNA, 22 nt, Human
ucaagaugaugaugaucuuuaa

SEQ ID NO: 1598307 - RNA, 16 nt, Human
acaugaaguccaagca

SEQ ID NO: 1598308 - RNA, 19 nt, Human
acaugauccugcaauucca

SEQ ID NO: 1598309 - RNA, 14 nt, Human
ucaaagcugaaaug

SEQ ID NO: 1598310 - RNA, 17 nt, Human
ucaaagggugaaaauua

SEQ ID NO: 1598311 - RNA, 18 nt, Human
ucaaaagaaagaaaauca

SEQ ID NO: 1598312 - RNA, 23 nt, Human
uauuuuugacagaauauguuuca

SEQ ID NO: 1598313 - RNA, 19 nt, Human
uauuuuugacagaauaugu

SEQ ID NO: 1598314 - RNA, 15 nt, Human
uauuuuugacagaau

SEQ ID NO: 1598315 - RNA, 14 nt, Human
uauuuuugacagaa

SEQ ID NO: 1598316 - RNA, 13 nt, Human
uauuuuugacaga

SEQ ID NO: 1598317 - RNA, 21 nt, Human
ucaaaauaugccccauucaac

SEQ ID NO: 1598318 - RNA, 23 nt, Human
ucaaaauaccaugccauuuaaag

SEQ ID NO: 1598319 - RNA, 21 nt, Human
ucaaaauaccaugccauuuaa

SEQ ID NO: 1598320 - RNA, 14 nt, Human
ucaaaaugucuaag

SEQ ID NO: 1598321 - RNA, 12 nt, Human
ucagagcugccc

SEQ ID NO: 1598322 - RNA, 13 nt, Human
ucaggaaagagaa

SEQ ID NO: 1598323 - RNA, 19 nt, Human
ucaggaaagagaacuucca

SEQ ID NO: 1598324 - RNA, 20 nt, Human
ucaggaaaucaaauaugcaa

SEQ ID NO: 1598325 - RNA, 21 nt, Human
ucaggaaaucaaauaugcaaa

SEQ ID NO: 1598326 - RNA, 23 nt, Human
accauuucuugagguaaaagcau

SEQ ID NO: 1598327 - RNA, 18 nt, Human
accacuuguguuuugcaa

SEQ ID NO: 1598328 - RNA, 13 nt, Human
accacugcagaag

SEQ ID NO: 1598329 - RNA, 14 nt, Human
accagggacugagg

SEQ ID NO: 1598330 - RNA, 17 nt, Human
ucacuaccuucaugcau

SEQ ID NO: 1598331 - RNA, 15 nt, Human
ucaauucuugccaaa

SEQ ID NO: 1598332 - RNA, 20 nt, Human
ucaauuuuucuuauuucauu

SEQ ID NO: 1598333 - RNA, 23 nt, Human
ucaauuuuucuuauuucauuucu

SEQ ID NO: 1598334 - RNA, 13 nt, Human
accaaucaugaau

SEQ ID NO: 1598335 - RNA, 15 nt, Human
accaaucaugaauua

SEQ ID NO: 1598336 - RNA, 21 nt, Human
ucacaacagauuauuaccuua

SEQ ID NO: 1598337 - RNA, 22 nt, Human
ucacauaucuaguaugaaauua

SEQ ID NO: 1598338 - RNA, 21 nt, Human
ucacauaucuaguaugaaauu

SEQ ID NO: 1598339 - RNA, 17 nt, Human
ucacauaucuaguauga

SEQ ID NO: 1598340 - RNA, 18 nt, Human
acacuaagagagaaugag

SEQ ID NO: 1598341 - RNA, 19 nt, Human
acacuaagagagaaugaga

SEQ ID NO: 1598342 - RNA, 17 nt, Human
acacuaagagagaauga

SEQ ID NO: 1598343 - RNA, 13 nt, Human
acacacugaagaa

SEQ ID NO: 1598344 - RNA, 14 nt, Human
acaaugcuguauuu

SEQ ID NO: 1598345 - RNA, 17 nt, Human
acaaugcuguauuuuaa

SEQ ID NO: 1598346 - RNA, 18 nt, Human
acaaugcuguauuuuaaa

SEQ ID NO: 1598347 - RNA, 14 nt, Human
acacaacuauauug

SEQ ID NO: 1598348 - RNA, 17 nt, Human
acacaacuauauuguuu

SEQ ID NO: 1598349 - RNA, 18 nt, Human
acacaacuauuuuuccaa

SEQ ID NO: 1598350 - RNA, 12 nt, Human
uaguguuggaga

SEQ ID NO: 1598351 - RNA, 16 nt, Human
uaguguuggagaagaa

SEQ ID NO: 1598352 - RNA, 17 nt, Human
uaguguuggagaagaac

SEQ ID NO: 1598353 - RNA, 20 nt, Human
uaguaauagagcaaaauuga

SEQ ID NO: 1598354 - RNA, 14 nt, Human
acacacugaagaag

SEQ ID NO: 1598355 - RNA, 14 nt, Human
uaguaauagagcaa

SEQ ID NO: 1598356 - RNA, 15 nt, Human
uauauuuauuacugu

SEQ ID NO: 1598357 - RNA, 19 nt, Human
uauauuuauuacuguaaga

SEQ ID NO: 1598358 - RNA, 14 nt, Human
acagauaaucagug

SEQ ID NO: 1598359 - RNA, 20 nt, Human
acagcccuucuuuccacaga

SEQ ID NO: 1598360 - RNA, 21 nt, Human
acagcccuucuuuccacagaa

SEQ ID NO: 1598361 - RNA, 16 nt, Human
uaucuuguagcuuuau

SEQ ID NO: 1598362 - RNA, 13 nt, Human
acacuuaaaaaug

SEQ ID NO: 1598363 - RNA, 15 nt, Human
acacuuaaaaauggu

SEQ ID NO: 1598364 - RNA, 19 nt, Human
acagaaagcagaacaguga

SEQ ID NO: 1598365 - RNA, 12 nt, Human
uauauuuacaaa

SEQ ID NO: 1598366 - RNA, 15 nt, Human
uauauuuaaugauaa

SEQ ID NO: 1598367 - RNA, 12 nt, Human
acacugaagaag

SEQ ID NO: 1598368 - RNA, 14 nt, Human
acacugaagaagca

SEQ ID NO: 1598369 - RNA, 14 nt, Human
acacuccagugaga

SEQ ID NO: 1598370 - RNA, 16 nt, Human
uauaaguauucuaaau

SEQ ID NO: 1598371 - RNA, 21 nt, Human
aauuuuucuuauuucauuucu

SEQ ID NO: 1598372 - RNA, 22 nt, Human
aauuuuuucucuaggaaauauu

SEQ ID NO: 1598373 - RNA, 22 nt, Human
uagauaggucagugcaaauacu

SEQ ID NO: 1598374 - RNA, 17 nt, Human
uagauaggccaugggca

SEQ ID NO: 1598375 - RNA, 21 nt, Human
uagaugcaguucugaagaaga

SEQ ID NO: 1598376 - RNA, 20 nt, Human
uagaugcaguucugaagaag

SEQ ID NO: 1598377 - RNA, 17 nt, Human
acaaauuuacagagaca

SEQ ID NO: 1598378 - RNA, 22 nt, Human
acaagcucacagaccuuugaac

SEQ ID NO: 1598379 - RNA, 17 nt, Human
acaagaugguucuagca

SEQ ID NO: 1598380 - RNA, 16 nt, Human
uagcuacuaauuuuaa

SEQ ID NO: 1598381 - RNA, 18 nt, Human
acaaugaagauaaaaaga

SEQ ID NO: 1598382 - RNA, 17 nt, Human
uacugagagugaacaaa

SEQ ID NO: 1598383 - RNA, 19 nt, Human
uacugagagugaacaaauu

SEQ ID NO: 1598384 - RNA, 18 nt, Human
aauugaggacacugauau

SEQ ID NO: 1598385 - RNA, 18 nt, Human
uacuaaaaauacaaaaaa

SEQ ID NO: 1598386 - RNA, 14 nt, Human
uacuaaaaauacaa

SEQ ID NO: 1598387 - RNA, 13 nt, Human
aauugacccacaa

SEQ ID NO: 1598388 - RNA, 19 nt, Human
uacuucuuaggguuaugau

SEQ ID NO: 1598389 - RNA, 15 nt, Human
aauuggagcucgugg

SEQ ID NO: 1598390 - RNA, 17 nt, Human
aauuuacagagacagaa

SEQ ID NO: 1598391 - RNA, 18 nt, Human
aauuuacagagacagaaa

SEQ ID NO: 1598392 - RNA, 19 nt, Human
aauuucucccagucauuua

SEQ ID NO: 1598393 - RNA, 17 nt, Human
aauuuauacaggucaua

SEQ ID NO: 1598394 - RNA, 16 nt, Human
aauuuauacaggucau

SEQ ID NO: 1598395 - RNA, 21 nt, Human
aauaacaaugaaaguugauaa

SEQ ID NO: 1598396 - RNA, 15 nt, Human
aauaacgauaaaaga

SEQ ID NO: 1598397 - RNA, 13 nt, Human
aauaacugugaag

SEQ ID NO: 1598398 - RNA, 15 nt, Human
uaaauguugacaugg

SEQ ID NO: 1598399 - RNA, 17 nt, Human
uaaauuuugaguucuac

SEQ ID NO: 1598400 - RNA, 20 nt, Human
aauaauuuuuauauuugaaa

SEQ ID NO: 1598401 - RNA, 16 nt, Human
aauaacugugaaguuu

SEQ ID NO: 1598402 - RNA, 14 nt, Human
aauaacugugaagu

SEQ ID NO: 1598403 - RNA, 20 nt, Human
aauaacugugaaguuuacau

SEQ ID NO: 1598404 - RNA, 16 nt, Human
aauaauuuuuauauuu

SEQ ID NO: 1598405 - RNA, 17 nt, Human
aauaauuuuuauauuug

SEQ ID NO: 1598406 - RNA, 19 nt, Human
aauaauuuuuauauuugaa

SEQ ID NO: 1598407 - RNA, 21 nt, Human
aauaauuuuaagaaaucaaag

SEQ ID NO: 1598408 - RNA, 19 nt, Human
aauaucuuuuuuuuaauaa

SEQ ID NO: 1598409 - RNA, 15 nt, Human
aauaugcaaagcacu

SEQ ID NO: 1598410 - RNA, 17 nt, Human
aauaugcaaagcacuga

SEQ ID NO: 1598411 - RNA, 24 nt, Human
aauaugcaaagcacugacuucuaa

SEQ ID NO: 1598412 - RNA, 15 nt, Human
aauauuucagauaau

SEQ ID NO: 1598413 - RNA, 18 nt, Human
aauauuguguugugaaug

SEQ ID NO: 1598414 - RNA, 20 nt, Human
aauauugcuuuggucauaug

SEQ ID NO: 1598415 - RNA, 15 nt, Human
aauaucacuugucaa

SEQ ID NO: 1598416 - RNA, 12 nt, Human
aauaucacuugu

SEQ ID NO: 1598417 - RNA, 15 nt, Human
aauaguauuugagag

SEQ ID NO: 1598418 - RNA, 18 nt, Human
aauaggcguaacuaauuu

SEQ ID NO: 1598419 - RNA, 20 nt, Human
uaaauuuugucuuuaacuca

SEQ ID NO: 1598420 - RNA, 19 nt, Human
uaaauuuugaguucuacau

SEQ ID NO: 1598421 - RNA, 18 nt, Human
uaaauuuugaguucuaca

SEQ ID NO: 1598422 - RNA, 20 nt, Human
aauccucaguuuuugugaaa

SEQ ID NO: 1598423 - RNA, 22 nt, Human
aaucauuucugcaucagcugcu

SEQ ID NO: 1598424 - RNA, 13 nt, Human
aauccuugaagau

SEQ ID NO: 1598425 - RNA, 16 nt, Human
aaucuuauaauuuaaa

SEQ ID NO: 1598426 - RNA, 14 nt, Human
aaucuuauaauuua

SEQ ID NO: 1598427 - RNA, 15 nt, Human
aaucaucaagucuuu

SEQ ID NO: 1598428 - RNA, 19 nt, Human
aaucaugaauuaguuuuau

SEQ ID NO: 1598429 - RNA, 17 nt, Human
aaucaugaauuaguuuu

SEQ ID NO: 1598430 - RNA, 23 nt, Human
aaucaugaauuaguuuuauaugc

SEQ ID NO: 1598431 - RNA, 12 nt, Human
uaaguucauaca

SEQ ID NO: 1598432 - RNA, 18 nt, Human
uaaguuuuuuuuuaaaaa

SEQ ID NO: 1598433 - RNA, 14 nt, Human
uaaguucauacauu

SEQ ID NO: 1598434 - RNA, 13 nt, Human
uaaguucauacau

SEQ ID NO: 1598435 - RNA, 20 nt, Human
uaaguauguguaaaauguga

SEQ ID NO: 1598436 - RNA, 23 nt, Human
uaaucagugugucuaaauuugaa

SEQ ID NO: 1598437 - RNA, 21 nt, Human
aaugagagacacacugaagaa

SEQ ID NO: 1598438 - RNA, 16 nt, Human
uaaugauaacuggaaa

SEQ ID NO: 1598439 - RNA, 14 nt, Human
uaaugguguuuuaa

SEQ ID NO: 1598440 - RNA, 19 nt, Human
uacacuaagagagaaugag

SEQ ID NO: 1598441 - RNA, 14 nt, Human
uacacuccagugag

SEQ ID NO: 1598442 - RNA, 19 nt, Human
aauggacuuuuguacauag

SEQ ID NO: 1598443 - RNA, 11 nt, Human
aaugugauaug

SEQ ID NO: 1598444 - RNA, 18 nt, Human
uacauauuuuuguagcac

SEQ ID NO: 1598445 - RNA, 17 nt, Human
uacauauuuuuguagca

SEQ ID NO: 1598446 - RNA, 13 nt, Human
uacaaaaacacag

SEQ ID NO: 1598447 - RNA, 14 nt, Human
uacaaaaacacagc

SEQ ID NO: 1598448 - RNA, 15 nt, Human
uacaaaaacacagca

SEQ ID NO: 1598449 - RNA, 16 nt, Human
uacaaaaacacagcaa

SEQ ID NO: 1598450 - RNA, 17 nt, Human
uaauuuauacaggucau

SEQ ID NO: 1598451 - RNA, 13 nt, Human
uaauucaagaaaa

SEQ ID NO: 1598452 - RNA, 12 nt, Human
aaugcuguguua

SEQ ID NO: 1598453 - RNA, 16 nt, Human
aagaaugauuaugaau

SEQ ID NO: 1598454 - RNA, 18 nt, Human
aagaaugauuaugaauua

SEQ ID NO: 1598455 - RNA, 18 nt, Human
gugcuaguaauuggaaag

SEQ ID NO: 1598456 - RNA, 16 nt, Human
aagaagugaaaaucua

SEQ ID NO: 1598457 - RNA, 22 nt, Human
aagaagugaaaaucuacacucc

SEQ ID NO: 1598458 - RNA, 13 nt, Human
aagaaagaaaauc

SEQ ID NO: 1598459 - RNA, 21 nt, Human
gugggacagucaccucaugga

SEQ ID NO: 1598460 - RNA, 14 nt, Human
guggguagacacac

SEQ ID NO: 1598461 - RNA, 13 nt, Human
aagacuauucaaa

SEQ ID NO: 1598462 - RNA, 18 nt, Human
guguuuccauauuuuaua

SEQ ID NO: 1598463 - RNA, 23 nt, Human
guuuucugagaaagacuauucaa

SEQ ID NO: 1598464 - RNA, 21 nt, Human
guuucaaacauauauaacaau

SEQ ID NO: 1598465 - RNA, 13 nt, Human
aagguacuucaaa

SEQ ID NO: 1598466 - RNA, 10 nt, Human
guuuaaaauc

SEQ ID NO: 1598467 - RNA, 16 nt, Human
guuuaaaaucauuucu

SEQ ID NO: 1598468 - RNA, 18 nt, Human
guuguaccgcaaugugac

SEQ ID NO: 1598469 - RNA, 14 nt, Human
guugacaugggaca

SEQ ID NO: 1598470 - RNA, 18 nt, Human
guugacaugggacauuug

SEQ ID NO: 1598471 - RNA, 18 nt, Human
guucuagcauggcauauu

SEQ ID NO: 1598472 - RNA, 14 nt, Human
guuaaguaugugua

SEQ ID NO: 1598473 - RNA, 23 nt, Human
guucauacauauuuuuguagcac

SEQ ID NO: 1598474 - RNA, 14 nt, Human
guucauacauauuu

SEQ ID NO: 1598475 - RNA, 13 nt, Human
guucauacauauu

SEQ ID NO: 1598476 - RNA, 10 nt, Human
guucauacau

SEQ ID NO: 1598477 - RNA, 9 nt, Human
guucauaca

SEQ ID NO: 1598478 - RNA, 14 nt, Human
guucauacauugua

SEQ ID NO: 1598479 - RNA, 11 nt, Human
guucauacauu

SEQ ID NO: 1598480 - RNA, 22 nt, Human
aacaguagugauaguuguaccg

SEQ ID NO: 1598481 - RNA, 18 nt, Human
aacauuugguaaggggaa

SEQ ID NO: 1598482 - RNA, 21 nt, Human
guccaagcauuuagauguaua

SEQ ID NO: 1598483 - RNA, 24 nt, Human
guccaagcauaccaacacgagcag

SEQ ID NO: 1598484 - RNA, 15 nt, Human
aacaaggaugaauua

SEQ ID NO: 1598485 - RNA, 21 nt, Human
aacaagccuccuuuuaaagua

SEQ ID NO: 1598486 - RNA, 18 nt, Human
aacaaugaagauaaaaag

SEQ ID NO: 1598487 - RNA, 14 nt, Human
aacaaugaagauaa

SEQ ID NO: 1598488 - RNA, 14 nt, Human
aacuccagaaagug

SEQ ID NO: 1598489 - RNA, 21 nt, Human
aacuccagaaagugacaagcu

SEQ ID NO: 1598490 - RNA, 18 nt, Human
aacucguuaauuuguagu

SEQ ID NO: 1598491 - RNA, 13 nt, Human
aacucccuuucaa

SEQ ID NO: 1598492 - RNA, 14 nt, Human
aacucccuuucaac

SEQ ID NO: 1598493 - RNA, 19 nt, Human
gucuuauauauuguagaua

SEQ ID NO: 1598494 - RNA, 22 nt, Human
gucuuaauuaaaagaauauuuu

SEQ ID NO: 1598495 - RNA, 19 nt, Human
gucuuaauuaaaagaauau

SEQ ID NO: 1598496 - RNA, 21 nt, Human
gucuuaauuaaaagaauauuu

SEQ ID NO: 1598497 - RNA, 12 nt, Human
aaccacagcagu

SEQ ID NO: 1598498 - RNA, 20 nt, Human
aacccauauuuguacaccaa

SEQ ID NO: 1598499 - RNA, 13 nt, Human
aacccaaauguuc

SEQ ID NO: 1598500 - RNA, 18 nt, Human
aacccaaauguucaucaa

SEQ ID NO: 1598501 - RNA, 20 nt, Human
aaccuagggugauauuaacc

SEQ ID NO: 1598502 - RNA, 17 nt, Human
aaccucaaaaugucuaa

SEQ ID NO: 1598503 - RNA, 14 nt, Human
aaauccuugaagau

SEQ ID NO: 1598504 - RNA, 19 nt, Human
aaaucuacacuccagugag

SEQ ID NO: 1598505 - RNA, 21 nt, Human
aaaugaaagcagggacuugaa

SEQ ID NO: 1598506 - RNA, 22 nt, Human
aaaugaaagcagggacuugaac

SEQ ID NO: 1598507 - RNA, 19 nt, Human
aaauggcuuccuggcaaua

SEQ ID NO: 1598508 - RNA, 14 nt, Human
aaaugcauuucuaa

SEQ ID NO: 1598509 - RNA, 14 nt, Human
guaugauucccagc

SEQ ID NO: 1598510 - RNA, 22 nt, Human
aaauguaagggaaacugccagc

SEQ ID NO: 1598511 - RNA, 16 nt, Human
gucaaauugugugaaa

SEQ ID NO: 1598512 - RNA, 18 nt, Human
aaauuucagcagcugcag

SEQ ID NO: 1598513 - RNA, 17 nt, Human
aaauuucagcagcugca

SEQ ID NO: 1598514 - RNA, 20 nt, Human
guauuuuugacagaauaugu

SEQ ID NO: 1598515 - RNA, 18 nt, Human
aaauuauauaaguauucu

SEQ ID NO: 1598516 - RNA, 16 nt, Human
aaauuauauaaguauu

SEQ ID NO: 1598517 - RNA, 19 nt, Human
aaauuauuuuguucauaca

SEQ ID NO: 1598518 - RNA, 17 nt, Human
aaauuauuuuguucaua

SEQ ID NO: 1598519 - RNA, 22 nt, Human
aaauuauauaaguauucuaaau

SEQ ID NO: 1598520 - RNA, 21 nt, Human
aaauuauuuuguucauacaua

SEQ ID NO: 1598521 - RNA, 20 nt, Human
aaauuauuuuguucauacau

SEQ ID NO: 1598522 - RNA, 22 nt, Human
aaauuauuuuguucauacauau

SEQ ID NO: 1598523 - RNA, 10 nt, Human
aaaaucauuu

SEQ ID NO: 1598524 - RNA, 11 nt, Human
aaaaucauuuc

SEQ ID NO: 1598525 - RNA, 12 nt, Human
aaaaucauuucu

SEQ ID NO: 1598526 - RNA, 17 nt, Human
aaaagaaagaaaaucag

SEQ ID NO: 1598527 - RNA, 12 nt, Human
aaaagaauauuu

SEQ ID NO: 1598528 - RNA, 20 nt, Human
aaaagacaaggaaaaaauaa

SEQ ID NO: 1598529 - RNA, 13 nt, Human
aaaagaauauuuu

SEQ ID NO: 1598530 - RNA, 11 nt, Human
aaaagaaugau

SEQ ID NO: 1598531 - RNA, 13 nt, Human
aaaagacuccaaa

SEQ ID NO: 1598532 - RNA, 15 nt, Human
aaacugcacugucaa

SEQ ID NO: 1598533 - RNA, 21 nt, Human
aaaaucauuucugcaucagcu

SEQ ID NO: 1598534 - RNA, 15 nt, Human
aaagcauuguaaaug

SEQ ID NO: 1598535 - RNA, 17 nt, Human
aaagcauuguaaaugug

SEQ ID NO: 1598536 - RNA, 19 nt, Human
aaagcauuguaaaugugcu

SEQ ID NO: 1598537 - RNA, 18 nt, Human
aaagccugcaauuucaua

SEQ ID NO: 1598538 - RNA, 13 nt, Human
aaagccugcaauu

SEQ ID NO: 1598539 - RNA, 22 nt, Human
aaauguugacaugggacauuug

SEQ ID NO: 1598540 - RNA, 17 nt, Human
aaauguucaucaaugaa

SEQ ID NO: 1598541 - RNA, 13 nt, Human
aaauguucaucaa

SEQ ID NO: 1598542 - RNA, 23 nt, Human
aaauguugacaugggacauuugc

SEQ ID NO: 1598543 - RNA, 21 nt, Human
aaauauuuauuuuaauaaugu

SEQ ID NO: 1598544 - RNA, 18 nt, Human
aaaucucaauauuucaga

SEQ ID NO: 1598545 - RNA, 23 nt, Human
aaaucucaaauuuggauugcuaa

SEQ ID NO: 1598546 - RNA, 19 nt, Human
aagaguauuuuugacagaa

SEQ ID NO: 1598547 - RNA, 16 nt, Human
aagaguaguaauagag

SEQ ID NO: 1598548 - RNA, 20 nt, Human
aacgcaggcccccaggugcc

SEQ ID NO: 1598549 - RNA, 11 nt, Human
aagaacugaaa

SEQ ID NO: 1598550 - RNA, 12 nt, Human
aagaacugaaau

SEQ ID NO: 1598551 - RNA, 13 nt, Human
aagaacugaaauc

SEQ ID NO: 1598552 - RNA, 15 nt, Human
aagaacugaaaucau

SEQ ID NO: 1598553 - RNA, 21 nt, Human
aagacaaggaaaaaauaacaa

SEQ ID NO: 1598554 - RNA, 20 nt, Human
aagaagacugcauuauauuu

SEQ ID NO: 1598555 - RNA, 15 nt, Human
aagaagacugcauua

SEQ ID NO: 1598556 - RNA, 14 nt, Human
aagagagaaaauaa

SEQ ID NO: 1598557 - RNA, 20 nt, Human
aaugaauacuuuauaaagga

SEQ ID NO: 1598558 - RNA, 16 nt, Human
aaucucaauauuucag

SEQ ID NO: 1598559 - RNA, 16 nt, Human
aaucucauaauuuaua

SEQ ID NO: 1598560 - RNA, 19 nt, Human
acagugauuaccagggacu

SEQ ID NO: 1598561 - RNA, 20 nt, Human
acagugauuaccagggacug

SEQ ID NO: 1598562 - RNA, 24 nt, Human
acaggaugguucccuugaugaaga

SEQ ID NO: 1598563 - RNA, 22 nt, Human
acaggaugguucccuugaugaa

SEQ ID NO: 1598564 - RNA, 15 nt, Human
acauuugcucaugga

SEQ ID NO: 1598565 - RNA, 16 nt, Human
acauuugcucauggaa

SEQ ID NO: 1598566 - RNA, 16 nt, Human
acauuuguauaaaaua

SEQ ID NO: 1598567 - RNA, 19 nt, Human
acauuuguauaaaauaauu

SEQ ID NO: 1598568 - RNA, 21 nt, Human
acauuuguauaaaauaauuuu

SEQ ID NO: 1598569 - RNA, 20 nt, Human
acaucccuuaccugggaaag

SEQ ID NO: 1598570 - RNA, 21 nt, Human
acauaaguaauucaagaaaac

SEQ ID NO: 1598571 - RNA, 20 nt, Human
acauaaguaauucaagaaaa

SEQ ID NO: 1598572 - RNA, 15 nt, Human
acaccaauauucaua

SEQ ID NO: 1598573 - RNA, 11 nt, Human
aauuguaauag

SEQ ID NO: 1598574 - RNA, 18 nt, Human
aauuucauaugcuguaua

SEQ ID NO: 1598575 - RNA, 16 nt, Human
aauuucauaugcugua

SEQ ID NO: 1598576 - RNA, 17 nt, Human
aauuauauaaguauucu

SEQ ID NO: 1598577 - RNA, 16 nt, Human
aauuauauaaguauuc

SEQ ID NO: 1598578 - RNA, 15 nt, Human
aauuauauaaguauu

SEQ ID NO: 1598579 - RNA, 21 nt, Human
acccugucucuacuaaaaaua

SEQ ID NO: 1598580 - RNA, 19 nt, Human
acgcaggcccccaggugcc

SEQ ID NO: 1598581 - RNA, 17 nt, Human
acuucagcgguuuauau

SEQ ID NO: 1598582 - RNA, 21 nt, Human
acuucagacauagaauuaaca

SEQ ID NO: 1598583 - RNA, 13 nt, Human
acuuggucuguga

SEQ ID NO: 1598584 - RNA, 17 nt, Human
acuucaaauccuugaag

SEQ ID NO: 1598585 - RNA, 18 nt, Human
acuucaaauccuugaaga

SEQ ID NO: 1598586 - RNA, 19 nt, Human
acuucaaauccuugaagau

SEQ ID NO: 1598587 - RNA, 22 nt, Human
acuuaaaaaugguuuaaauggu

SEQ ID NO: 1598588 - RNA, 17 nt, Human
acuguaaaauaauaacu

SEQ ID NO: 1598589 - RNA, 12 nt, Human
acuggaacucuc

SEQ ID NO: 1598590 - RNA, 14 nt, Human
acucguuaauuugu

SEQ ID NO: 1598591 - RNA, 19 nt, Human
acucguuaauuuguagugu

SEQ ID NO: 1598592 - RNA, 14 nt, Human
acucccuuucaaca

SEQ ID NO: 1598593 - RNA, 19 nt, Human
acugauaugggucuugaua

SEQ ID NO: 1598594 - RNA, 16 nt, Human
acugacagauuuccau

SEQ ID NO: 1598595 - RNA, 17 nt, Human
agcuguaugauucccag

SEQ ID NO: 1598596 - RNA, 18 nt, Human
agcuguaugauucccagc

SEQ ID NO: 1598597 - RNA, 18 nt, Human
aggaaaaaauaacaauga

SEQ ID NO: 1598598 - RNA, 14 nt, Human
agcugcugaaacaa

SEQ ID NO: 1598599 - RNA, 15 nt, Human
agcugcugaaacaac

SEQ ID NO: 1598600 - RNA, 16 nt, Human
agcugcugaaacaaca

SEQ ID NO: 1598601 - RNA, 20 nt, Human
agcugcugaaacaacaaaua

SEQ ID NO: 1598602 - RNA, 13 nt, Human
agcgacagugaga

SEQ ID NO: 1598603 - RNA, 15 nt, Human
agcgacagugagacu

SEQ ID NO: 1598604 - RNA, 17 nt, Human
agcgacagugagacucu

SEQ ID NO: 1598605 - RNA, 13 nt, Human
agcuacaaaugca

SEQ ID NO: 1598606 - RNA, 13 nt, Human
aggaaguagagga

SEQ ID NO: 1598607 - RNA, 20 nt, Human
aggcagagguugcagugagc

SEQ ID NO: 1598608 - RNA, 17 nt, Human
agggacaggauaagagg

SEQ ID NO: 1598609 - RNA, 19 nt, Human
agcacugacuucuaaguaa

SEQ ID NO: 1598610 - RNA, 17 nt, Human
agcacugacuucuaagu

SEQ ID NO: 1598611 - RNA, 15 nt, Human
agccagcaguucaga

SEQ ID NO: 1598612 - RNA, 14 nt, Human
agccagcaguucag

SEQ ID NO: 1598613 - RNA, 20 nt, Human
agauagauaggucagugcaa

SEQ ID NO: 1598614 - RNA, 23 nt, Human
agcaaaauuuuuucucuaggaaa

SEQ ID NO: 1598615 - RNA, 23 nt, Human
agcaaaauugauguguuuauuua

SEQ ID NO: 1598616 - RNA, 19 nt, Human
agcaaaauugauguguuua

SEQ ID NO: 1598617 - RNA, 13 nt, Human
agcaaaauugaug

SEQ ID NO: 1598618 - RNA, 17 nt, Human
agacccaaaaggcagaa

SEQ ID NO: 1598619 - RNA, 19 nt, Human
agacaaggaaaaaauaaca

SEQ ID NO: 1598620 - RNA, 21 nt, Human
agaagacugcauuauauuuau

SEQ ID NO: 1598621 - RNA, 20 nt, Human
agaagagcuguucacagcca

SEQ ID NO: 1598622 - RNA, 21 nt, Human
agaagagcuguucacagccag

SEQ ID NO: 1598623 - RNA, 13 nt, Human
agaagagcuguuc

SEQ ID NO: 1598624 - RNA, 22 nt, Human
agaacagugauuaccagggacu

SEQ ID NO: 1598625 - RNA, 19 nt, Human
agaacagauaaucagugug

SEQ ID NO: 1598626 - RNA, 17 nt, Human
auaaguaauucaagaaa

SEQ ID NO: 1598627 - RNA, 15 nt, Human
auaaguaaaugcuag

SEQ ID NO: 1598628 - RNA, 14 nt, Human
aguugaaaagacuc

SEQ ID NO: 1598629 - RNA, 20 nt, Human
aguuguucaauaauaaauau

SEQ ID NO: 1598630 - RNA, 15 nt, Human
auaaaagacagugaa

SEQ ID NO: 1598631 - RNA, 16 nt, Human
auaaaagacagugaaa

SEQ ID NO: 1598632 - RNA, 23 nt, Human
auaaaaauauuguguugugaaug

SEQ ID NO: 1598633 - RNA, 14 nt, Human
auaaaaacaacuuu

SEQ ID NO: 1598634 - RNA, 20 nt, Human
auaaaaagacauucuuccaa

SEQ ID NO: 1598635 - RNA, 13 nt, Human
agucauuuaauaa

SEQ ID NO: 1598636 - RNA, 15 nt, Human
agugauuaccaggga

SEQ ID NO: 1598637 - RNA, 13 nt, Human
agugauuaccagg

SEQ ID NO: 1598638 - RNA, 19 nt, Human
agugaugucacuagggcag

SEQ ID NO: 1598639 - RNA, 13 nt, Human
agugaaugaaaca

SEQ ID NO: 1598640 - RNA, 13 nt, Human
augaaguacucau

SEQ ID NO: 1598641 - RNA, 20 nt, Human
augggacauuugcucaugga

SEQ ID NO: 1598642 - RNA, 15 nt, Human
augggacagggagga

SEQ ID NO: 1598643 - RNA, 14 nt, Human
augggaaagcauug

SEQ ID NO: 1598644 - RNA, 20 nt, Human
augggaaagcauuguaaaug

SEQ ID NO: 1598645 - RNA, 23 nt, Human
auggcuuccuggcaauagucaaa

SEQ ID NO: 1598646 - RNA, 12 nt, Human
auccuugaagau

SEQ ID NO: 1598647 - RNA, 21 nt, Human
aucaugaauuaguuuuauaug

SEQ ID NO: 1598648 - RNA, 14 nt, Human
aucaaaagaaagaa

SEQ ID NO: 1598649 - RNA, 20 nt, Human
aucaaagggugaaaauuauu

SEQ ID NO: 1598650 - RNA, 18 nt, Human
aucaaagagagaaaauaa

SEQ ID NO: 1598651 - RNA, 15 nt, Human
caagaaaugaaagca

SEQ ID NO: 1598652 - RNA, 13 nt, Human
caagaaaugaaag

SEQ ID NO: 1598653 - RNA, 16 nt, Human
caagcauuuagaugua

SEQ ID NO: 1598654 - RNA, 19 nt, Human
caagcauuuagauguauag

SEQ ID NO: 1598655 - RNA, 21 nt, Human
caagcauaccaacacgagcag

SEQ ID NO: 1598656 - RNA, 16 nt, Human
caagcauaccaacacg

SEQ ID NO: 1598657 - RNA, 17 nt, Human
caaauuuacagagacag

SEQ ID NO: 1598658 - RNA, 23 nt, Human
caaauuuacagagacagaaagca

SEQ ID NO: 1598659 - RNA, 18 nt, Human
auuuuaauaauguuucaa

SEQ ID NO: 1598660 - RNA, 19 nt, Human
auuuuaauaauguuucaaa

SEQ ID NO: 1598661 - RNA, 14 nt, Human
caaagaaauguaag

SEQ ID NO: 1598662 - RNA, 13 nt, Human
cacaagaaaugaa

SEQ ID NO: 1598663 - RNA, 15 nt, Human
cacaagaaaugaaag

SEQ ID NO: 1598664 - RNA, 23 nt, Human
cacaagaaaugaaagcagggacu

SEQ ID NO: 1598665 - RNA, 23 nt, Human
cacaagacccaaaaggcagaagc

SEQ ID NO: 1598666 - RNA, 16 nt, Human
cacaugaaguccaagc

SEQ ID NO: 1598667 - RNA, 17 nt, Human
cacaugaaguccaagca

SEQ ID NO: 1598668 - RNA, 20 nt, Human
cacaugaaguccaagcauuu

SEQ ID NO: 1598669 - RNA, 21 nt, Human
cacaguuuucugagaaagacu

SEQ ID NO: 1598670 - RNA, 22 nt, Human
cacaguuuucugagaaagacua

SEQ ID NO: 1598671 - RNA, 21 nt, Human
uuugcauagauucccugagca

SEQ ID NO: 1598672 - RNA, 23 nt, Human
uuuggaacaagaugguucuagca

SEQ ID NO: 1598673 - RNA, 21 nt, Human
uuuguauaaaauaauuuuuau

SEQ ID NO: 1598674 - RNA, 13 nt, Human
uuuguucauacau

SEQ ID NO: 1598675 - RNA, 16 nt, Human
uuuguucauacauauu

SEQ ID NO: 1598676 - RNA, 15 nt, Human
uuuuauaugcuucug

SEQ ID NO: 1598677 - RNA, 20 nt, Human
uuuuauaugcuucuguuuua

SEQ ID NO: 1598678 - RNA, 20 nt, Human
uuuuauaucaauuuaaaaaa

SEQ ID NO: 1598679 - RNA, 10 nt, Human
uuuuauauuu

SEQ ID NO: 1598680 - RNA, 13 nt, Human
uuuucacauaucu

SEQ ID NO: 1598681 - RNA, 16 nt, Human
uuuucacauaucuagu

SEQ ID NO: 1598682 - RNA, 15 nt, Human
uuuucagaaaauauu

SEQ ID NO: 1598683 - RNA, 13 nt, Human
uuuuccugaaaac

SEQ ID NO: 1598684 - RNA, 16 nt, Human
uuuucagaaaauauua

SEQ ID NO: 1598685 - RNA, 22 nt, Human
uuucugagaaagacuauucaaa

SEQ ID NO: 1598686 - RNA, 22 nt, Human
uuuccucaaaacuucagacaua

SEQ ID NO: 1598687 - RNA, 15 nt, Human
uuucagauaaucaca

SEQ ID NO: 1598688 - RNA, 15 nt, Human
uuucagcagcugcag

SEQ ID NO: 1598689 - RNA, 21 nt, Human
uuucagauaaucacaauacau

SEQ ID NO: 1598690 - RNA, 14 nt, Human
uuuccaaaauaauu

SEQ ID NO: 1598691 - RNA, 22 nt, Human
uuuauuguuuaaaaucauuucu

SEQ ID NO: 1598692 - RNA, 20 nt, Human
uuuagaaacacaacuauauu

SEQ ID NO: 1598693 - RNA, 12 nt, Human
uuuagaaacaca

SEQ ID NO: 1598694 - RNA, 15 nt, Human
uuuacauuguaaaua

SEQ ID NO: 1598695 - RNA, 20 nt, Human
uuuacauuguaaauaguauu

SEQ ID NO: 1598696 - RNA, 13 nt, Human
uuuacauuguaaa

SEQ ID NO: 1598697 - RNA, 23 nt, Human
uucucuccucuccccaugauguu

SEQ ID NO: 1598698 - RNA, 12 nt, Human
uuccuagugaaa

SEQ ID NO: 1598699 - RNA, 22 nt, Human
uucggccuccauccugaggcuc

SEQ ID NO: 1598700 - RNA, 18 nt, Human
uucggccuccauccugag

SEQ ID NO: 1598701 - RNA, 19 nt, Human
uucggccuccauccugagg

SEQ ID NO: 1598702 - RNA, 20 nt, Human
uuccuucugugaaaguacau

SEQ ID NO: 1598703 - RNA, 17 nt, Human
uuccuucugugaaagua

SEQ ID NO: 1598704 - RNA, 23 nt, Human
uucagagcugcccucuccugggc

SEQ ID NO: 1598705 - RNA, 22 nt, Human
uucagagcugcccucuccuggg

SEQ ID NO: 1598706 - RNA, 21 nt, Human
uucagagcugcccucuccugg

SEQ ID NO: 1598707 - RNA, 17 nt, Human
uucaucugacuaugaca

SEQ ID NO: 1598708 - RNA, 20 nt, Human
uucaucugacuaugacauaa

SEQ ID NO: 1598709 - RNA, 19 nt, Human
uuccacuuauaggaauuga

SEQ ID NO: 1598710 - RNA, 21 nt, Human
uuccauccuagucacuaccuu

SEQ ID NO: 1598711 - RNA, 12 nt, Human
uugggaggcuga

SEQ ID NO: 1598712 - RNA, 16 nt, Human
uuguaaaggaauuuaa

SEQ ID NO: 1598713 - RNA, 11 nt, Human
uuguaaaugug

SEQ ID NO: 1598714 - RNA, 14 nt, Human
uuguaaaugugcuu

SEQ ID NO: 1598715 - RNA, 18 nt, Human
uuguaaaugugcuuuuaa

SEQ ID NO: 1598716 - RNA, 19 nt, Human
uuguaucacaaaucuuaac

SEQ ID NO: 1598717 - RNA, 14 nt, Human
uugaggacacugau

SEQ ID NO: 1598718 - RNA, 15 nt, Human
uugaggacacugaua

SEQ ID NO: 1598719 - RNA, 12 nt, Human
uugaugaagaag

SEQ ID NO: 1598720 - RNA, 13 nt, Human
uugaugaagaagu

SEQ ID NO: 1598721 - RNA, 18 nt, Human
uugcauagauucccugag

SEQ ID NO: 1598722 - RNA, 14 nt, Human
uucugagcauuuaa

SEQ ID NO: 1598723 - RNA, 15 nt, Human
uucugagaaagacua

SEQ ID NO: 1598724 - RNA, 15 nt, Human
uucuuauuucauuuc

SEQ ID NO: 1598725 - RNA, 23 nt, Human
uugaaacugagaugugaacacau

SEQ ID NO: 1598726 - RNA, 18 nt, Human
uugaaaagacuccaaaga

SEQ ID NO: 1598727 - RNA, 22 nt, Human
uugaaaagacuccaaagaaaug

SEQ ID NO: 1598728 - RNA, 23 nt, Human
uugaaaagacuccaaagaaaugu

SEQ ID NO: 1598729 - RNA, 15 nt, Human
uugaaucucauaauu

SEQ ID NO: 1598730 - RNA, 21 nt, Human
uugaaucucauaauuuauaca

SEQ ID NO: 1598731 - RNA, 22 nt, Human
ugugaccacugcagaagacagu

SEQ ID NO: 1598732 - RNA, 21 nt, Human
ugucucaguccaugaagaugu

SEQ ID NO: 1598733 - RNA, 22 nt, Human
ugucucaguccaugaagaugua

SEQ ID NO: 1598734 - RNA, 14 nt, Human
ugugaaguuuacau

SEQ ID NO: 1598735 - RNA, 20 nt, Human
ugugaaguuuacauuguaaa

SEQ ID NO: 1598736 - RNA, 17 nt, Human
uguagauaauacaguuc

SEQ ID NO: 1598737 - RNA, 15 nt, Human
uguaccgcaauguga

SEQ ID NO: 1598738 - RNA, 15 nt, Human
uguaaucacagcuac

SEQ ID NO: 1598739 - RNA, 20 nt, Human
uguaaaaugugaagugaaug

SEQ ID NO: 1598740 - RNA, 16 nt, Human
uguagcacugacagau

SEQ ID NO: 1598741 - RNA, 22 nt, Human
uguagcacugacagauuuccau

SEQ ID NO: 1598742 - RNA, 17 nt, Human
uguagcacugacagauu

SEQ ID NO: 1598743 - RNA, 12 nt, Human
uguuauaaucuu

SEQ ID NO: 1598744 - RNA, 16 nt, Human
uguucacagccagacu

SEQ ID NO: 1598745 - RNA, 21 nt, Human
uguuggagaagaacugaaauc

SEQ ID NO: 1598746 - RNA, 14 nt, Human
uguuuaaaaucauu

SEQ ID NO: 1598747 - RNA, 13 nt, Human
uguuuaaaaucau

SEQ ID NO: 1598748 - RNA, 14 nt, Human
uuacauuuguauaa

SEQ ID NO: 1598749 - RNA, 15 nt, Human
uuacauuuguauaaa

SEQ ID NO: 1598750 - RNA, 21 nt, Human
uuaccacuuguguuuugcaag

SEQ ID NO: 1598751 - RNA, 18 nt, Human
uuaauaauguuucaaaca

SEQ ID NO: 1598752 - RNA, 19 nt, Human
uuaaaagaaugauuaugaa

SEQ ID NO: 1598753 - RNA, 20 nt, Human
uuaaagcuuauuaaaacuca

SEQ ID NO: 1598754 - RNA, 12 nt, Human
uguuuuaaaaaa

SEQ ID NO: 1598755 - RNA, 19 nt, Human
ugggacauuugcucaugga

SEQ ID NO: 1598756 - RNA, 20 nt, Human
ugggacauuugcucauggaa

SEQ ID NO: 1598757 - RNA, 18 nt, Human
ugggacagucaccucaug

SEQ ID NO: 1598758 - RNA, 20 nt, Human
ugggacagucaccucaugga

SEQ ID NO: 1598759 - RNA, 21 nt, Human
ugggacagucaccucauggaa

SEQ ID NO: 1598760 - RNA, 20 nt, Human
uggccuucggccuccauccu

SEQ ID NO: 1598761 - RNA, 17 nt, Human
uggccuucggccuccau

SEQ ID NO: 1598762 - RNA, 18 nt, Human
uggccuucggccuccauc

SEQ ID NO: 1598763 - RNA, 17 nt, Human
uggguagacacacauga

SEQ ID NO: 1598764 - RNA, 16 nt, Human
uggguagacacacaug

SEQ ID NO: 1598765 - RNA, 14 nt, Human
uggaacucucgagc

SEQ ID NO: 1598766 - RNA, 14 nt, Human
ugcuucuguuuuau

SEQ ID NO: 1598767 - RNA, 15 nt, Human
uggagcaaagcugau

SEQ ID NO: 1598768 - RNA, 15 nt, Human
ugcacaucaaaauau

SEQ ID NO: 1598769 - RNA, 16 nt, Human
ugcagauaaacaguag

SEQ ID NO: 1598770 - RNA, 17 nt, Human
ugcagauaaacaguagu

SEQ ID NO: 1598771 - RNA, 15 nt, Human
ugcauuauauuuauu

SEQ ID NO: 1598772 - RNA, 20 nt, Human
ugcauuauauuuauuacugu

SEQ ID NO: 1598773 - RNA, 21 nt, Human
ugcauuauauuuauuacugua

SEQ ID NO: 1598774 - RNA, 22 nt, Human
ugcaucagcugcugaaacaaca

SEQ ID NO: 1598775 - RNA, 22 nt, Human
ugccaucccucccuccaccucc

SEQ ID NO: 1598776 - RNA, 21 nt, Human
ugccaucccucccuccaccuc

SEQ ID NO: 1598777 - RNA, 20 nt, Human
ugccaucccucccuccaccu

SEQ ID NO: 1598778 - RNA, 19 nt, Human
ugccaucccucccuccacc

SEQ ID NO: 1598779 - RNA, 15 nt, Human
ugccaucccucccuc

SEQ ID NO: 1598780 - RNA, 22 nt, Human
ugccuucucaacuccaaacuga

SEQ ID NO: 1598781 - RNA, 22 nt, Human
ugccuccccuccucugcuugcc

SEQ ID NO: 1598782 - RNA, 19 nt, Human
ugccuccccuccucugcuu

SEQ ID NO: 1598783 - RNA, 23 nt, Human
ugccuccccuccucugcuugcca

SEQ ID NO: 1598784 - RNA, 18 nt, Human
ugccuccccuccucugcu

SEQ ID NO: 1598785 - RNA, 17 nt, Human
ugcugaaacaacaaaua

SEQ ID NO: 1598786 - RNA, 19 nt, Human
ugcuagaacucccuuucaa

SEQ ID NO: 1598787 - RNA, 20 nt, Human
ugcuagaacucccuuucaac

SEQ ID NO: 1598788 - RNA, 21 nt, Human
ugcuagaacucccuuucaaca

SEQ ID NO: 1598789 - RNA, 11 nt, Human
ugcucauggaa

SEQ ID NO: 1598790 - RNA, 16 nt, Human
ugcuagguuaauucca

SEQ ID NO: 1598791 - RNA, 23 nt, Human
ugcuagguuaauuccaauuauau

SEQ ID NO: 1598792 - RNA, 22 nt, Human
ucuguuuuauaauuuugugaag

SEQ ID NO: 1598793 - RNA, 17 nt, Human
ucuuucacauuuaaaua

SEQ ID NO: 1598794 - RNA, 19 nt, Human
ugaaaacuuuaugcuaagu

SEQ ID NO: 1598795 - RNA, 15 nt, Human
ugaaaagacuccaaa

SEQ ID NO: 1598796 - RNA, 16 nt, Human
ugaaaagacuccaaag

SEQ ID NO: 1598797 - RNA, 17 nt, Human
ugaaaagacuccaaaga

SEQ ID NO: 1598798 - RNA, 19 nt, Human
ugaaaagacuccaaagaaa

SEQ ID NO: 1598799 - RNA, 18 nt, Human
ugaaagcagggacuugaa

SEQ ID NO: 1598800 - RNA, 19 nt, Human
ugaaagcagggacuugaac

SEQ ID NO: 1598801 - RNA, 23 nt, Human
ugaaagcagggacuugaacccau

SEQ ID NO: 1598802 - RNA, 22 nt, Human
ugaaaagacuccaaagaaaugu

SEQ ID NO: 1598803 - RNA, 19 nt, Human
ugaaauggacuuuuguaca

SEQ ID NO: 1598804 - RNA, 14 nt, Human
ugaacacaucagcu

SEQ ID NO: 1598805 - RNA, 17 nt, Human
ugaagauguagaggaga

SEQ ID NO: 1598806 - RNA, 21 nt, Human
ugaaguccaagcauuuagaug

SEQ ID NO: 1598807 - RNA, 22 nt, Human
ugaaguccaagcauuuagaugu

SEQ ID NO: 1598808 - RNA, 22 nt, Human
ugaacuuguaaaggaauuuaaa

SEQ ID NO: 1598809 - RNA, 21 nt, Human
ucucagugucaaugcagcccc

SEQ ID NO: 1598810 - RNA, 18 nt, Human
ucuccugggcagcugccu

SEQ ID NO: 1598811 - RNA, 17 nt, Human
ucuccugggcagcugcc

SEQ ID NO: 1598812 - RNA, 16 nt, Human
ucuccugggcagcugc

SEQ ID NO: 1598813 - RNA, 15 nt, Human
ucuccugggcagcug

SEQ ID NO: 1598814 - RNA, 14 nt, Human
ucuccugggcagcu

SEQ ID NO: 1598815 - RNA, 13 nt, Human
ucuccugggcagc

SEQ ID NO: 1598816 - RNA, 13 nt, Human
ucucuaggaaaua

SEQ ID NO: 1598817 - RNA, 19 nt, Human
ucucuaggaaauauuuauu

SEQ ID NO: 1598818 - RNA, 21 nt, Human
ucuccugggcagcugccuccc

SEQ ID NO: 1598819 - RNA, 20 nt, Human
ucuccugggcagcugccucc

SEQ ID NO: 1598820 - RNA, 19 nt, Human
ucuccugggcagcugccuc

SEQ ID NO: 1598821 - RNA, 18 nt, Human
ucucuucacagucacauu

SEQ ID NO: 1598822 - RNA, 15 nt, Human
uccuugcaucaauuu

SEQ ID NO: 1598823 - RNA, 20 nt, Human
uccuucugugaaaguacauu

SEQ ID NO: 1598824 - RNA, 15 nt, Human
ucucaacuccaaacu

SEQ ID NO: 1598825 - RNA, 17 nt, Human
ucuaguaugaaauuaua

SEQ ID NO: 1598826 - RNA, 15 nt, Human
ucuaguaugaaauua

SEQ ID NO: 1598827 - RNA, 21 nt, Human
ucucaaauuuggauugcuaau

SEQ ID NO: 1598828 - RNA, 17 nt, Human
ucuacacuccagugaga

SEQ ID NO: 1598829 - RNA, 21 nt, Human
ucuacacuaagagagaaugag

SEQ ID NO: 1598830 - RNA, 23 nt, Human
ucuaaauuuuauaucuuguagcu

SEQ ID NO: 1598831 - RNA, 18 nt, Human
ucuaaauuuuauaucuug

SEQ ID NO: 1598832 - RNA, 23 nt, Human
ucuaaauuugaauguuaagcaga

SEQ ID NO: 1598833 - RNA, 22 nt, Human
ucuaaauuugaauguuaagcag

SEQ ID NO: 1598834 - RNA, 19 nt, Human
ucuaacaaaaaaauauauu

SEQ ID NO: 1598835 - RNA, 17 nt, Human
ucuaaauuugaauguua

SEQ ID NO: 1598836 - RNA, 13 nt, Human
ucuaaauuugaau

SEQ ID NO: 1598837 - RNA, 19 nt, Human
ucaacuccaaacugacucu

SEQ ID NO: 1598838 - RNA, 23 nt, Human
ucacaggacagcccuucuuucca

SEQ ID NO: 1598839 - RNA, 19 nt, Human
ucacaggaaguagaggagg

SEQ ID NO: 1598840 - RNA, 13 nt, Human
ucaaugcagcccc

SEQ ID NO: 1598841 - RNA, 13 nt, Human
ucaaaacugcacu

SEQ ID NO: 1598842 - RNA, 13 nt, Human
uauuuauuacugu

SEQ ID NO: 1598843 - RNA, 22 nt, Human
uauuucuaugaaauauuauguu

SEQ ID NO: 1598844 - RNA, 21 nt, Human
uauuucuaugaaauauuaugu

SEQ ID NO: 1598845 - RNA, 19 nt, Human
uauuugagaguucuaaauu

SEQ ID NO: 1598846 - RNA, 18 nt, Human
uauuugagaguucuaaau

SEQ ID NO: 1598847 - RNA, 16 nt, Human
uauuugagaguucuaa

SEQ ID NO: 1598848 - RNA, 15 nt, Human
uauuugagaguucua

SEQ ID NO: 1598849 - RNA, 22 nt, Human
ucagacauagaauuaacacaug

SEQ ID NO: 1598850 - RNA, 19 nt, Human
ucagacauagaauuaacac

SEQ ID NO: 1598851 - RNA, 17 nt, Human
ucacuugucaauaaaau

SEQ ID NO: 1598852 - RNA, 20 nt, Human
ucagaaaauauuauguguuu

SEQ ID NO: 1598853 - RNA, 19 nt, Human
ucagaaaauauuauguguu

SEQ ID NO: 1598854 - RNA, 17 nt, Human
ucagaaaauauuaugug

SEQ ID NO: 1598855 - RNA, 16 nt, Human
ucccaaauuucauacc

SEQ ID NO: 1598856 - RNA, 14 nt, Human
ucauuucuuugagu

SEQ ID NO: 1598857 - RNA, 16 nt, Human
ucauuucugcaucagc

SEQ ID NO: 1598858 - RNA, 22 nt, Human
ucauuucugcaucagcugcuga

SEQ ID NO: 1598859 - RNA, 23 nt, Human
uccaaacugacucuuaagaagac

SEQ ID NO: 1598860 - RNA, 12 nt, Human
uccaaagaaaug

SEQ ID NO: 1598861 - RNA, 17 nt, Human
uccaagcauuuagaugu

SEQ ID NO: 1598862 - RNA, 23 nt, Human
uccaagcauaccaacacgagcag

SEQ ID NO: 1598863 - RNA, 16 nt, Human
uccagauccuggaaau

SEQ ID NO: 1598864 - RNA, 17 nt, Human
uccagauccuggaaauc

SEQ ID NO: 1598865 - RNA, 14 nt, Human
uccagauccuggaa

SEQ ID NO: 1598866 - RNA, 14 nt, Human
uccacuuggucugu

SEQ ID NO: 1598867 - RNA, 12 nt, Human
uccacuuggucu

SEQ ID NO: 1598868 - RNA, 13 nt, Human
uccacuuggucug

SEQ ID NO: 1598869 - RNA, 14 nt, Human
uccaccuacaugag

SEQ ID NO: 1598870 - RNA, 12 nt, Human
uccaccucccug

SEQ ID NO: 1598871 - RNA, 23 nt, Human
uccaccucccugcaauaaaaugg

SEQ ID NO: 1598872 - RNA, 20 nt, Human
uccaagcauuuagauguaua

SEQ ID NO: 1598873 - RNA, 16 nt, Human
ucauacauuguacgaa

SEQ ID NO: 1598874 - RNA, 15 nt, Human
ucauacauuguacga

SEQ ID NO: 1598875 - RNA, 13 nt, Human
ucauacauuguac

SEQ ID NO: 1598876 - RNA, 15 nt, Human
ucauaauuuauacag

SEQ ID NO: 1598877 - RNA, 13 nt, Human
ucaguuguacagu

SEQ ID NO: 1598878 - RNA, 16 nt, Human
uaaaaaagaaacauuu

SEQ ID NO: 1598879 - RNA, 15 nt, Human
guuuucugagaaaga

SEQ ID NO: 1598880 - RNA, 18 nt, Human
guuuucaggcuagaugua

SEQ ID NO: 1598881 - RNA, 16 nt, Human
guuuucauuaucucaa

SEQ ID NO: 1598882 - RNA, 13 nt, Human
guuuagaaagcuu

SEQ ID NO: 1598883 - RNA, 17 nt, Human
guuuagaaagcuugccc

SEQ ID NO: 1598884 - RNA, 13 nt, Human
guuuagcaguaua

SEQ ID NO: 1598885 - RNA, 19 nt, Human
uaaaauccauacauuugug

SEQ ID NO: 1598886 - RNA, 18 nt, Human
uaaaauccauacauuugu

SEQ ID NO: 1598887 - RNA, 15 nt, Human
uaaaaaugguuuaaa

SEQ ID NO: 1598888 - RNA, 14 nt, Human
uaaaagaugaaaau

SEQ ID NO: 1598889 - RNA, 17 nt, Human
uaaaauggguuuuacug

SEQ ID NO: 1598890 - RNA, 17 nt, Human
uaaauaaaaauaauccu

SEQ ID NO: 1598891 - RNA, 18 nt, Human
uaaauauaugcuaagucu

SEQ ID NO: 1598892 - RNA, 22 nt, Human
uaaauaaaccucaaaaugucua

SEQ ID NO: 1598893 - RNA, 16 nt, Human
uaagcauuccaacuau

SEQ ID NO: 1598894 - RNA, 18 nt, Human
uaagcauuccaacuaucu

SEQ ID NO: 1598895 - RNA, 20 nt, Human
uaagcauuccaacuaucuca

SEQ ID NO: 1598896 - RNA, 13 nt, Human
uaagccagacauc

SEQ ID NO: 1598897 - RNA, 20 nt, Human
uaagccagacaucaacagau

SEQ ID NO: 1598898 - RNA, 21 nt, Human
uaagccagacaucaacagaua

SEQ ID NO: 1598899 - RNA, 23 nt, Human
uaagagggauuagggagagaaga

SEQ ID NO: 1598900 - RNA, 19 nt, Human
uaagaaaucaaagagagaa

SEQ ID NO: 1598901 - RNA, 13 nt, Human
uaacugugaaguu

SEQ ID NO: 1598902 - RNA, 19 nt, Human
uaaugccacuaaauugaca

SEQ ID NO: 1598903 - RNA, 19 nt, Human
uaaugauaaguaaaugcua

SEQ ID NO: 1598904 - RNA, 14 nt, Human
uaauauauuuccau

SEQ ID NO: 1598905 - RNA, 15 nt, Human
uaauaauguuucaaa

SEQ ID NO: 1598906 - RNA, 15 nt, Human
uaauaacugugaagu

SEQ ID NO: 1598907 - RNA, 22 nt, Human
uaauuggaaaggcagcucuaaa

SEQ ID NO: 1598908 - RNA, 20 nt, Human
uaauuuguaguguuggagaa

SEQ ID NO: 1598909 - RNA, 23 nt, Human
uaauuuguaguguuggagaagaa

SEQ ID NO: 1598910 - RNA, 13 nt, Human
uaauuuuaagaaa

SEQ ID NO: 1598911 - RNA, 14 nt, Human
uaauguuucaaaca

SEQ ID NO: 1598912 - RNA, 15 nt, Human
uaauguuucaaacau

SEQ ID NO: 1598913 - RNA, 20 nt, Human
uaauuaaaagaauauuuuaa

SEQ ID NO: 1598914 - RNA, 23 nt, Human
uaauuaaauuuugaguucuacau

SEQ ID NO: 1598915 - RNA, 13 nt, Human
uacagaauuuuau

SEQ ID NO: 1598916 - RNA, 23 nt, Human
uaccacaggaaccacaagacugc

SEQ ID NO: 1598917 - RNA, 18 nt, Human
uaccaccagucugacugu

SEQ ID NO: 1598918 - RNA, 15 nt, Human
uacauaaguaauuca

SEQ ID NO: 1598919 - RNA, 16 nt, Human
uaccaacacgagcagg

SEQ ID NO: 1598920 - RNA, 21 nt, Human
uacaugagguacugagaguga

SEQ ID NO: 1598921 - RNA, 22 nt, Human
uacaugagguacugagagugaa

SEQ ID NO: 1598922 - RNA, 17 nt, Human
uacauuuguauaaaaua

SEQ ID NO: 1598923 - RNA, 11 nt, Human
uacauuugugu

SEQ ID NO: 1598924 - RNA, 16 nt, Human
uacauuuguauaaaau

SEQ ID NO: 1598925 - RNA, 23 nt, Human
uacauuuggagacacaacuauuu

SEQ ID NO: 1598926 - RNA, 17 nt, Human
uagaacagauaaucagu

SEQ ID NO: 1598927 - RNA, 23 nt, Human
uacugauguuccuagugaaagag

SEQ ID NO: 1598928 - RNA, 23 nt, Human
uacgaagaguauuuuugacagaa

SEQ ID NO: 1598929 - RNA, 23 nt, Human
uaccuuuguucccaaauuucaua

SEQ ID NO: 1598930 - RNA, 22 nt, Human
uacgaagaguauuuuugacaga

SEQ ID NO: 1598931 - RNA, 20 nt, Human
uacgaagaguauuuuugaca

SEQ ID NO: 1598932 - RNA, 16 nt, Human
uagauguauguacuuc

SEQ ID NO: 1598933 - RNA, 20 nt, Human
uagauguauguacuucaugc

SEQ ID NO: 1598934 - RNA, 20 nt, Human
uagcagggcauggcugggaa

SEQ ID NO: 1598935 - RNA, 17 nt, Human
uagaguuuagcuggaaa

SEQ ID NO: 1598936 - RNA, 18 nt, Human
uagaguuuagcuggaaaa

SEQ ID NO: 1598937 - RNA, 23 nt, Human
uaggaauugacccacaagaaaug

SEQ ID NO: 1598938 - RNA, 20 nt, Human
uaggaauugacccacaagaa

SEQ ID NO: 1598939 - RNA, 13 nt, Human
uaggccaugggac

SEQ ID NO: 1598940 - RNA, 16 nt, Human
uaggccaugggacagg

SEQ ID NO: 1598941 - RNA, 13 nt, Human
uauauuugaaaua

SEQ ID NO: 1598942 - RNA, 14 nt, Human
uauauuugaaauau

SEQ ID NO: 1598943 - RNA, 20 nt, Human
uauauuuauuacuguaagaa

SEQ ID NO: 1598944 - RNA, 23 nt, Human
uauauuuauuacuguaagaaaau

SEQ ID NO: 1598945 - RNA, 19 nt, Human
uauauuuuuuguuaaauga

SEQ ID NO: 1598946 - RNA, 18 nt, Human
uagucaaauugugugaaa

SEQ ID NO: 1598947 - RNA, 21 nt, Human
uaguuguaccgcaaugugacu

SEQ ID NO: 1598948 - RNA, 15 nt, Human
uaguuuuauaugcuu

SEQ ID NO: 1598949 - RNA, 18 nt, Human
uauaacaaugcuguauuu

SEQ ID NO: 1598950 - RNA, 21 nt, Human
uauaauucagaaggaucuuca

SEQ ID NO: 1598951 - RNA, 16 nt, Human
uauacccagaaaguua

SEQ ID NO: 1598952 - RNA, 12 nt, Human
ggaaauauuuau

SEQ ID NO: 1598953 - RNA, 13 nt, Human
ggaaauauuuauu

SEQ ID NO: 1598954 - RNA, 15 nt, Human
ggaaauauuuauuuu

SEQ ID NO: 1598955 - RNA, 17 nt, Human
ggaaauauuuauuuuaa

SEQ ID NO: 1598956 - RNA, 18 nt, Human
ggaaauauuuauuuuaau

SEQ ID NO: 1598957 - RNA, 16 nt, Human
ggaaaucaaauaugca

SEQ ID NO: 1598958 - RNA, 17 nt, Human
gcuuuuaaaaaaaaaua

SEQ ID NO: 1598959 - RNA, 20 nt, Human
ggaaaaaauaacaaugaaag

SEQ ID NO: 1598960 - RNA, 23 nt, Human
gcuguucacagccagacuggcac

SEQ ID NO: 1598961 - RNA, 15 nt, Human
gcuguucacagccag

SEQ ID NO: 1598962 - RNA, 16 nt, Human
gcuguucacagccaga

SEQ ID NO: 1598963 - RNA, 16 nt, Human
gcuugccaucccuccc

SEQ ID NO: 1598964 - RNA, 18 nt, Human
gcuugcccuguuaaaaga

SEQ ID NO: 1598965 - RNA, 21 nt, Human
gcuugccaucccucccuccac

SEQ ID NO: 1598966 - RNA, 18 nt, Human
gcuugccaucccucccuc

SEQ ID NO: 1598967 - RNA, 17 nt, Human
gcuugcccuggugccuc

SEQ ID NO: 1598968 - RNA, 19 nt, Human
gcuugcccuggugccucac

SEQ ID NO: 1598969 - RNA, 22 nt, Human
gcuguauuuuaaaagaaugauu

SEQ ID NO: 1598970 - RNA, 18 nt, Human
gcuagauguauguacuuc

SEQ ID NO: 1598971 - RNA, 22 nt, Human
ggccaugggacagggaggacgc

SEQ ID NO: 1598972 - RNA, 22 nt, Human
ggcagcugccuccccuccucug

SEQ ID NO: 1598973 - RNA, 21 nt, Human
ggcagcugccuccccuccucu

SEQ ID NO: 1598974 - RNA, 18 nt, Human
ggcagcugccuccccucc

SEQ ID NO: 1598975 - RNA, 20 nt, Human
ggaggacgcucucuggccuu

SEQ ID NO: 1598976 - RNA, 21 nt, Human
ggaggacgcucucuggccuuc

SEQ ID NO: 1598977 - RNA, 19 nt, Human
ggaggacgcucucuggccu

SEQ ID NO: 1598978 - RNA, 22 nt, Human
ggcuugaguuuaaauuguaaua

SEQ ID NO: 1598979 - RNA, 23 nt, Human
ggugcuacaaaaacacagcaagg

SEQ ID NO: 1598980 - RNA, 17 nt, Human
gccccgugggguuccuc

SEQ ID NO: 1598981 - RNA, 19 nt, Human
gccccugcacuccagccug

SEQ ID NO: 1598982 - RNA, 16 nt, Human
gcccucuccugggcag

SEQ ID NO: 1598983 - RNA, 15 nt, Human
gcccucuccugggca

SEQ ID NO: 1598984 - RNA, 21 nt, Human
gcccucuccugggcagcugcc

SEQ ID NO: 1598985 - RNA, 19 nt, Human
gcccucuccugggcagcug

SEQ ID NO: 1598986 - RNA, 18 nt, Human
gcccucuccugggcagcu

SEQ ID NO: 1598987 - RNA, 16 nt, Human
gcccacagcuguauga

SEQ ID NO: 1598988 - RNA, 22 nt, Human
gccaugggacagggaggacgcu

SEQ ID NO: 1598989 - RNA, 22 nt, Human
gccauuuaaagcuuauuaaaac

SEQ ID NO: 1598990 - RNA, 16 nt, Human
gccaucccucccucca

SEQ ID NO: 1598991 - RNA, 15 nt, Human
gccaucccucccucc

SEQ ID NO: 1598992 - RNA, 14 nt, Human
gccaugggacaggg

SEQ ID NO: 1598993 - RNA, 19 nt, Human
gccaugggacagggaggac

SEQ ID NO: 1598994 - RNA, 14 nt, Human
gccaucccucccuc

SEQ ID NO: 1598995 - RNA, 13 nt, Human
gccaucccucccu

SEQ ID NO: 1598996 - RNA, 11 nt, Human
gccaucccucc

SEQ ID NO: 1598997 - RNA, 22 nt, Human
gccacguucuuacuaguuuccc

SEQ ID NO: 1598998 - RNA, 18 nt, Human
gccuuggggcugaugcag

SEQ ID NO: 1598999 - RNA, 19 nt, Human
gccuucggccuccauccug

SEQ ID NO: 1599000 - RNA, 18 nt, Human
gccuucggccuccauccu

SEQ ID NO: 1599001 - RNA, 18 nt, Human
gccuguaaucacagcuac

SEQ ID NO: 1599002 - RNA, 14 nt, Human
gccuccccuccucu

SEQ ID NO: 1599003 - RNA, 13 nt, Human
gccuccccuccuc

SEQ ID NO: 1599004 - RNA, 12 nt, Human
gccuccccuccu

SEQ ID NO: 1599005 - RNA, 11 nt, Human
gccuccccucc

SEQ ID NO: 1599006 - RNA, 16 nt, Human
gccuccccuccucugc

SEQ ID NO: 1599007 - RNA, 19 nt, Human
gcccuucuuuccacagaag

SEQ ID NO: 1599008 - RNA, 15 nt, Human
gcaggcuacugucag

SEQ ID NO: 1599009 - RNA, 18 nt, Human
gcauagauucccugagca

SEQ ID NO: 1599010 - RNA, 13 nt, Human
gcaguucugaaga

SEQ ID NO: 1599011 - RNA, 14 nt, Human
gcaguucugaagaa

SEQ ID NO: 1599012 - RNA, 15 nt, Human
gcacugucaagauga

SEQ ID NO: 1599013 - RNA, 14 nt, Human
gcagaagacaguau

SEQ ID NO: 1599014 - RNA, 20 nt, Human
gcacagccucuuagaugcag

SEQ ID NO: 1599015 - RNA, 18 nt, Human
gcagauggaaugcugugu

SEQ ID NO: 1599016 - RNA, 22 nt, Human
gcagauggaaugcuguguuaaa

SEQ ID NO: 1599017 - RNA, 22 nt, Human
gauuaaguaaugauaacuggaa

SEQ ID NO: 1599018 - RNA, 14 nt, Human
gauuaaguaaugau

SEQ ID NO: 1599019 - RNA, 16 nt, Human
gaugcuagaacucccu

SEQ ID NO: 1599020 - RNA, 12 nt, Human
gcaagauguggg

SEQ ID NO: 1599021 - RNA, 16 nt, Human
gcaagaugugggcagu

SEQ ID NO: 1599022 - RNA, 14 nt, Human
gauccuggaaauca

SEQ ID NO: 1599023 - RNA, 13 nt, Human
gaucuuuaaaaua

SEQ ID NO: 1599024 - RNA, 23 nt, Human
gaucagcuuauugucuagugaaa

SEQ ID NO: 1599025 - RNA, 17 nt, Human
gauaggucagugcaaau

SEQ ID NO: 1599026 - RNA, 13 nt, Human
gauaaacaguagu

SEQ ID NO: 1599027 - RNA, 11 nt, Human
gaguucuacau

SEQ ID NO: 1599028 - RNA, 23 nt, Human
gaauucuugaaggaaaaugauac

SEQ ID NO: 1599029 - RNA, 12 nt, Human
gaaguccaagca

SEQ ID NO: 1599030 - RNA, 22 nt, Human
gaaguccaagcauuuagaugua

SEQ ID NO: 1599031 - RNA, 16 nt, Human
gaaguauccuucagcc

SEQ ID NO: 1599032 - RNA, 14 nt, Human
gaaguauccuucag

SEQ ID NO: 1599033 - RNA, 16 nt, Human
gaauauuuuaacuucc

SEQ ID NO: 1599034 - RNA, 15 nt, Human
gaacauaaaauacaa

SEQ ID NO: 1599035 - RNA, 16 nt, Human
gaacagugauuaccag

SEQ ID NO: 1599036 - RNA, 20 nt, Human
gaacagugauuaccagggac

SEQ ID NO: 1599037 - RNA, 16 nt, Human
gaaauuguauuacaaa

SEQ ID NO: 1599038 - RNA, 18 nt, Human
gaaauuguauuacaaauc

SEQ ID NO: 1599039 - RNA, 21 nt, Human
gaacuagaguuuagcuggaaa

SEQ ID NO: 1599040 - RNA, 12 nt, Human
gaagaacugaaa

SEQ ID NO: 1599041 - RNA, 19 nt, Human
gaagacugcauuauauuua

SEQ ID NO: 1599042 - RNA, 18 nt, Human
gaagauguagaggagaaa

SEQ ID NO: 1599043 - RNA, 14 nt, Human
gacuggcacaguuu

SEQ ID NO: 1599044 - RNA, 18 nt, Human
gacuggcacaguuuucug

SEQ ID NO: 1599045 - RNA, 22 nt, Human
gacuggcacaguuuucugagaa

SEQ ID NO: 1599046 - RNA, 16 nt, Human
gacugaggggagggga

SEQ ID NO: 1599047 - RNA, 20 nt, Human
gacccaaaaggcagaagcaa

SEQ ID NO: 1599048 - RNA, 18 nt, Human
gacccaaaaggcagaagc

SEQ ID NO: 1599049 - RNA, 19 nt, Human
gacccaaaaggcagaagca

SEQ ID NO: 1599050 - RNA, 16 nt, Human
gaccacugcagaagac

SEQ ID NO: 1599051 - RNA, 18 nt, Human
gaccacugcagaagacag

SEQ ID NO: 1599052 - RNA, 23 nt, Human
gacaggaugguucccuugaugaa

SEQ ID NO: 1599053 - RNA, 17 nt, Human
gacauaaaaacaacuuu

SEQ ID NO: 1599054 - RNA, 20 nt, Human
cuugcuugauuguauggugg

SEQ ID NO: 1599055 - RNA, 22 nt, Human
cuugcccuguuaaaagaugaaa

SEQ ID NO: 1599056 - RNA, 14 nt, Human
cuugccaucccucc

SEQ ID NO: 1599057 - RNA, 17 nt, Human
cuugccaucccucccuc

SEQ ID NO: 1599058 - RNA, 19 nt, Human
cuugccaucccucccucca

SEQ ID NO: 1599059 - RNA, 16 nt, Human
cuugccaucccucccu

SEQ ID NO: 1599060 - RNA, 15 nt, Human
cuugccaucccuccc

SEQ ID NO: 1599061 - RNA, 14 nt, Human
cuugcccuguuaaa

SEQ ID NO: 1599062 - RNA, 18 nt, Human
cuugcccuggugccucac

SEQ ID NO: 1599063 - RNA, 16 nt, Human
cuuggggcugaugcag

SEQ ID NO: 1599064 - RNA, 18 nt, Human
cuuggggcugaugcaguu

SEQ ID NO: 1599065 - RNA, 16 nt, Human
cuuggacucauuuuaa

SEQ ID NO: 1599066 - RNA, 14 nt, Human
gaaaacaaggauga

SEQ ID NO: 1599067 - RNA, 19 nt, Human
gaaaauaacaauaaaagac

SEQ ID NO: 1599068 - RNA, 14 nt, Human
gaaaaguauguuag

SEQ ID NO: 1599069 - RNA, 20 nt, Human
gaaaaguauguuagugcaaa

SEQ ID NO: 1599070 - RNA, 20 nt, Human
cuuccuuggacucauuuuaa

SEQ ID NO: 1599071 - RNA, 19 nt, Human
cuuccuuggacucauuuua

SEQ ID NO: 1599072 - RNA, 18 nt, Human
cuucggccuccauccuga

SEQ ID NO: 1599073 - RNA, 19 nt, Human
cuucggccuccauccugag

SEQ ID NO: 1599074 - RNA, 17 nt, Human
cuucggccuccauccug

SEQ ID NO: 1599075 - RNA, 18 nt, Human
cuucagcgguuuauauaa

SEQ ID NO: 1599076 - RNA, 19 nt, Human
cuuccagauccuggaaauc

SEQ ID NO: 1599077 - RNA, 19 nt, Human
cuuagaugcaguucugaag

SEQ ID NO: 1599078 - RNA, 20 nt, Human
cuuagaugcaguucugaaga

SEQ ID NO: 1599079 - RNA, 19 nt, Human
cuuacuaguuucccuugca

SEQ ID NO: 1599080 - RNA, 14 nt, Human
cuuauaauuuaaaa

SEQ ID NO: 1599081 - RNA, 13 nt, Human
cuuauaauuuaaa

SEQ ID NO: 1599082 - RNA, 21 nt, Human
cuuaggguuaugauuaaguaa

SEQ ID NO: 1599083 - RNA, 15 nt, Human
cuuaugauugcagau

SEQ ID NO: 1599084 - RNA, 21 nt, Human
cuuaagaagacugcauuauau

SEQ ID NO: 1599085 - RNA, 18 nt, Human
cuuaaugccacuaaauug

SEQ ID NO: 1599086 - RNA, 11 nt, Human
cuuaacuauuc

SEQ ID NO: 1599087 - RNA, 19 nt, Human
cuguuuuauaauuuuguga

SEQ ID NO: 1599088 - RNA, 18 nt, Human
cuguuuugaaucucauaa

SEQ ID NO: 1599089 - RNA, 13 nt, Human
cucuuaagaagac

SEQ ID NO: 1599090 - RNA, 21 nt, Human
cucuccugggcagcugccucc

SEQ ID NO: 1599091 - RNA, 23 nt, Human
cucugcauacucauuaggauggc

SEQ ID NO: 1599092 - RNA, 12 nt, Human
cucggagaagag

SEQ ID NO: 1599093 - RNA, 13 nt, Human
cucggagaagagc

SEQ ID NO: 1599094 - RNA, 20 nt, Human
cucggagaagagcuguucac

SEQ ID NO: 1599095 - RNA, 13 nt, Human
cucccuuucaaca

SEQ ID NO: 1599096 - RNA, 16 nt, Human
cucccuucucuucaca

SEQ ID NO: 1599097 - RNA, 17 nt, Human
cuccaccucccugcaau

SEQ ID NO: 1599098 - RNA, 16 nt, Human
cuccaccucccugcaa

SEQ ID NO: 1599099 - RNA, 15 nt, Human
cuccaccucccugca

SEQ ID NO: 1599100 - RNA, 14 nt, Human
cuccaccucccugc

SEQ ID NO: 1599101 - RNA, 23 nt, Human
cuccaccucccugcaauaaaaug

SEQ ID NO: 1599102 - RNA, 23 nt, Human
cuccauccugaggcuccacuugg

SEQ ID NO: 1599103 - RNA, 21 nt, Human
cuccauccugaggcuccacuu

SEQ ID NO: 1599104 - RNA, 17 nt, Human
cucccagucauuuaaua

SEQ ID NO: 1599105 - RNA, 17 nt, Human
cucauuaggauggcuag

SEQ ID NO: 1599106 - RNA, 18 nt, Human
cucauuaggauggcuagu

SEQ ID NO: 1599107 - RNA, 15 nt, Human
cucauaauuuauaca

SEQ ID NO: 1599108 - RNA, 13 nt, Human
cucauaauuuaua

SEQ ID NO: 1599109 - RNA, 22 nt, Human
cucauaauuuauacaggucaua

SEQ ID NO: 1599110 - RNA, 18 nt, Human
cuggcacaguuuucugag

SEQ ID NO: 1599111 - RNA, 19 nt, Human
cuggcacaguuuucugaga

SEQ ID NO: 1599112 - RNA, 20 nt, Human
cuggcacaguuuucugagaa

SEQ ID NO: 1599113 - RNA, 16 nt, Human
cuggccaacgggguga

SEQ ID NO: 1599114 - RNA, 12 nt, Human
cuggagcucugc

SEQ ID NO: 1599115 - RNA, 23 nt, Human
cuggaauaauccuaaacauauga

SEQ ID NO: 1599116 - RNA, 18 nt, Human
cugcugaaacaacaaaua

SEQ ID NO: 1599117 - RNA, 13 nt, Human
cugcugaaacaac

SEQ ID NO: 1599118 - RNA, 22 nt, Human
cugggaacccaaguccaagcau

SEQ ID NO: 1599119 - RNA, 21 nt, Human
cuggucccagccagcaguuca

SEQ ID NO: 1599120 - RNA, 15 nt, Human
cugccuaagugcagc

SEQ ID NO: 1599121 - RNA, 13 nt, Human
cugauguuccuag

SEQ ID NO: 1599122 - RNA, 18 nt, Human
cugauguuccuagugaaa

SEQ ID NO: 1599123 - RNA, 20 nt, Human
cugauguuccuagugaaaga

SEQ ID NO: 1599124 - RNA, 21 nt, Human
cugauguuccuagugaaagag

SEQ ID NO: 1599125 - RNA, 23 nt, Human
cugcagaagacaguauggcagcu

SEQ ID NO: 1599126 - RNA, 13 nt, Human
cugcagaagacag

SEQ ID NO: 1599127 - RNA, 20 nt, Human
cugcaauuucauaugcugua

SEQ ID NO: 1599128 - RNA, 18 nt, Human
cugcaauuucauaugcug

SEQ ID NO: 1599129 - RNA, 16 nt, Human
cccuugaugaagaagu

SEQ ID NO: 1599130 - RNA, 21 nt, Human
ccucugcuugccaucccuccc

SEQ ID NO: 1599131 - RNA, 20 nt, Human
ccucugcuugccaucccucc

SEQ ID NO: 1599132 - RNA, 13 nt, Human
ccucuccugggca

SEQ ID NO: 1599133 - RNA, 12 nt, Human
ccucuccugggc

SEQ ID NO: 1599134 - RNA, 11 nt, Human
ccucuccuggg

SEQ ID NO: 1599135 - RNA, 14 nt, Human
ccucuccugggcag

SEQ ID NO: 1599136 - RNA, 13 nt, Human
ccuccucugcuug

SEQ ID NO: 1599137 - RNA, 11 nt, Human
ccuccucugcu

SEQ ID NO: 1599138 - RNA, 18 nt, Human
ccuccccuccucugcuug

SEQ ID NO: 1599139 - RNA, 17 nt, Human
ccuccccuccucugcuu

SEQ ID NO: 1599140 - RNA, 16 nt, Human
ccucccugcaauaaaa

SEQ ID NO: 1599141 - RNA, 12 nt, Human
ccucccugcaau

SEQ ID NO: 1599142 - RNA, 20 nt, Human
ccucagaaaacaaggaugaa

SEQ ID NO: 1599143 - RNA, 15 nt, Human
ccuccccuccucugc

SEQ ID NO: 1599144 - RNA, 18 nt, Human
ccugaggcuccacuuggu

SEQ ID NO: 1599145 - RNA, 20 nt, Human
ccugaggcuccacuuggucu

SEQ ID NO: 1599146 - RNA, 23 nt, Human
ccucuuagaugcaguucugaaga

SEQ ID NO: 1599147 - RNA, 18 nt, Human
ccugaaagaggaaugaag

SEQ ID NO: 1599148 - RNA, 23 nt, Human
ccugaaagaggaaugaaguacuc

SEQ ID NO: 1599149 - RNA, 18 nt, Human
ccugggcagcugccuccc

SEQ ID NO: 1599150 - RNA, 17 nt, Human
ccugggcagcugccucc

SEQ ID NO: 1599151 - RNA, 16 nt, Human
ccugggcagcugccuc

SEQ ID NO: 1599152 - RNA, 15 nt, Human
ccugggcagcugccu

SEQ ID NO: 1599153 - RNA, 22 nt, Human
ccugggcagcugccuccccucc

SEQ ID NO: 1599154 - RNA, 20 nt, Human
ccugggcagcugccuccccu

SEQ ID NO: 1599155 - RNA, 14 nt, Human
ccuugaugaagaag

SEQ ID NO: 1599156 - RNA, 20 nt, Human
ccuugaaaacuuuaugcuaa

SEQ ID NO: 1599157 - RNA, 11 nt, Human
cgcaaugugac

SEQ ID NO: 1599158 - RNA, 16 nt, Human
cggccuccauccugag

SEQ ID NO: 1599159 - RNA, 17 nt, Human
cggccuccauccugagg

SEQ ID NO: 1599160 - RNA, 13 nt, Human
cccaggugccagu

SEQ ID NO: 1599161 - RNA, 18 nt, Human
cccaaaaggcagaagcaa

SEQ ID NO: 1599162 - RNA, 13 nt, Human
cccaaaaggcaga

SEQ ID NO: 1599163 - RNA, 18 nt, Human
ccaucaaggguacacugc

SEQ ID NO: 1599164 - RNA, 16 nt, Human
ccaugauguuuagaaa

SEQ ID NO: 1599165 - RNA, 14 nt, Human
ccaugaagauguag

SEQ ID NO: 1599166 - RNA, 17 nt, Human
ccaggugccaguuaugg

SEQ ID NO: 1599167 - RNA, 20 nt, Human
ccagugaauucuugaaggaa

SEQ ID NO: 1599168 - RNA, 16 nt, Human
ccagugaauucuugaa

SEQ ID NO: 1599169 - RNA, 13 nt, Human
ccacugcagaaga

SEQ ID NO: 1599170 - RNA, 18 nt, Human
ccacugcagaagacagua

SEQ ID NO: 1599171 - RNA, 16 nt, Human
ccaauauucauagcag

SEQ ID NO: 1599172 - RNA, 20 nt, Human
ccacaggaaccacaagacug

SEQ ID NO: 1599173 - RNA, 17 nt, Human
cauuuaggccaugggac

SEQ ID NO: 1599174 - RNA, 13 nt, Human
cauuugcucaugg

SEQ ID NO: 1599175 - RNA, 18 nt, Human
cauuugcucauggaauug

SEQ ID NO: 1599176 - RNA, 14 nt, Human
ccaagcaaguauua

SEQ ID NO: 1599177 - RNA, 17 nt, Human
ccaagcauuuagaugua

SEQ ID NO: 1599178 - RNA, 22 nt, Human
ccaagcauaccaacacgagcag

SEQ ID NO: 1599179 - RNA, 22 nt, Human
ccaaacugacucuuaagaagac

SEQ ID NO: 1599180 - RNA, 16 nt, Human
ccaaaggcucucuccu

SEQ ID NO: 1599181 - RNA, 23 nt, Human
ccaaauuucauaccuaucaucuu

SEQ ID NO: 1599182 - RNA, 19 nt, Human
acuaguauuucuaugaaau

SEQ ID NO: 1599183 - RNA, 18 nt, Human
acuaguauuucuaugaaa

SEQ ID NO: 1599184 - RNA, 19 nt, Human
acggacgaaccuugaaaac

SEQ ID NO: 1599185 - RNA, 17 nt, Human
accucugccucagaaaa

SEQ ID NO: 1599186 - RNA, 18 nt, Human
accucugccucagaaaac

SEQ ID NO: 1599187 - RNA, 20 nt, Human
accucugccucagaaaacaa

SEQ ID NO: 1599188 - RNA, 20 nt, Human
acuucaaauccuugaagauu

SEQ ID NO: 1599189 - RNA, 18 nt, Human
acuucagcgguuuauaua

SEQ ID NO: 1599190 - RNA, 19 nt, Human
acuucagcgguuuauauaa

SEQ ID NO: 1599191 - RNA, 21 nt, Human
acuuaaaaaugguuuaaaugg

SEQ ID NO: 1599192 - RNA, 13 nt, Human
acuuaaaaauggu

SEQ ID NO: 1599193 - RNA, 14 nt, Human
acuuaaaaaugguu

SEQ ID NO: 1599194 - RNA, 12 nt, Human
acuuuaugcuaa

SEQ ID NO: 1599195 - RNA, 17 nt, Human
acuuuaugcuaagugaa

SEQ ID NO: 1599196 - RNA, 22 nt, Human
acuugggaggcugagaugggag

SEQ ID NO: 1599197 - RNA, 14 nt, Human
acucuuaagaagac

SEQ ID NO: 1599198 - RNA, 15 nt, Human
acucuuaagaagacu

SEQ ID NO: 1599199 - RNA, 20 nt, Human
acucuuaagaagacugcauu

SEQ ID NO: 1599200 - RNA, 15 nt, Human
acucugucucagucc

SEQ ID NO: 1599201 - RNA, 17 nt, Human
acucugucucaguccau

SEQ ID NO: 1599202 - RNA, 22 nt, Human
aauuucauaccuaucaucuuaa

SEQ ID NO: 1599203 - RNA, 21 nt, Human
acaaggaugaauuaaguuuuu

SEQ ID NO: 1599204 - RNA, 22 nt, Human
acaagaaaugaaagcagggacu

SEQ ID NO: 1599205 - RNA, 15 nt, Human
acaagaaaugaaagc

SEQ ID NO: 1599206 - RNA, 16 nt, Human
acaagaaaugaaagca

SEQ ID NO: 1599207 - RNA, 17 nt, Human
aauuuugugaagcaaaa

SEQ ID NO: 1599208 - RNA, 18 nt, Human
aauuuugugaagcaaaau

SEQ ID NO: 1599209 - RNA, 16 nt, Human
acagaagcuccaggua

SEQ ID NO: 1599210 - RNA, 19 nt, Human
accaaggcugauuaaacca

SEQ ID NO: 1599211 - RNA, 20 nt, Human
accaaggcugauuaaaccaa

SEQ ID NO: 1599212 - RNA, 21 nt, Human
acagugauuaccagggacuga

SEQ ID NO: 1599213 - RNA, 19 nt, Human
acauaauuaaauuuugagu

SEQ ID NO: 1599214 - RNA, 15 nt, Human
acauaaguaauucaa

SEQ ID NO: 1599215 - RNA, 12 nt, Human
aaguagaggagg

SEQ ID NO: 1599216 - RNA, 14 nt, Human
aagggauggcaaga

SEQ ID NO: 1599217 - RNA, 17 nt, Human
aagggauggcaagaugu

SEQ ID NO: 1599218 - RNA, 19 nt, Human
aagccagauuuuccugaaa

SEQ ID NO: 1599219 - RNA, 15 nt, Human
aagagaacuuccaga

SEQ ID NO: 1599220 - RNA, 23 nt, Human
aagacagugaaagaaaauaacaa

SEQ ID NO: 1599221 - RNA, 21 nt, Human
aagacauucuuccaaaaagau

SEQ ID NO: 1599222 - RNA, 14 nt, Human
aagauagcagggca

SEQ ID NO: 1599223 - RNA, 15 nt, Human
aagcagggacuugaa

SEQ ID NO: 1599224 - RNA, 13 nt, Human
aagauuuucagaa

SEQ ID NO: 1599225 - RNA, 16 nt, Human
aauccauacauuugug

SEQ ID NO: 1599226 - RNA, 17 nt, Human
aauccauacauuugugu

SEQ ID NO: 1599227 - RNA, 14 nt, Human
aaugauaacuggaa

SEQ ID NO: 1599228 - RNA, 15 nt, Human
aaugauaacuggaaa

SEQ ID NO: 1599229 - RNA, 16 nt, Human
aaugauaacuggaaac

SEQ ID NO: 1599230 - RNA, 22 nt, Human
aaucaaauaugcaaagcacuga

SEQ ID NO: 1599231 - RNA, 15 nt, Human
aaucaaauaugcaaa

SEQ ID NO: 1599232 - RNA, 16 nt, Human
aaucaaauaugcaaag

SEQ ID NO: 1599233 - RNA, 14 nt, Human
aauaauguuucaaa

SEQ ID NO: 1599234 - RNA, 19 nt, Human
aauaauguuucaaacauau

SEQ ID NO: 1599235 - RNA, 12 nt, Human
aauaauguuuca

SEQ ID NO: 1599236 - RNA, 22 nt, Human
aaguugauaugccuuuucccaa

SEQ ID NO: 1599237 - RNA, 20 nt, Human
aauaaaccucaaaaugucua

SEQ ID NO: 1599238 - RNA, 14 nt, Human
aauaauaaauauuu

SEQ ID NO: 1599239 - RNA, 10 nt, Human
aauaaaccau

SEQ ID NO: 1599240 - RNA, 17 nt, Human
aauaaaccucaaaaugu

SEQ ID NO: 1599241 - RNA, 14 nt, Human
aaaucuuaacuuga

SEQ ID NO: 1599242 - RNA, 20 nt, Human
aaaugcuagguuaauuccaa

SEQ ID NO: 1599243 - RNA, 20 nt, Human
aaauguucaucaaugaauga

SEQ ID NO: 1599244 - RNA, 12 nt, Human
aacacaucagcu

SEQ ID NO: 1599245 - RNA, 21 nt, Human
aaauugauguguuuauuuaua

SEQ ID NO: 1599246 - RNA, 14 nt, Human
aaauugauguguuu

SEQ ID NO: 1599247 - RNA, 23 nt, Human
aacugagaugugaacacaucagc

SEQ ID NO: 1599248 - RNA, 19 nt, Human
aaaauccauacauuugugu

SEQ ID NO: 1599249 - RNA, 18 nt, Human
aaaauuauuuuguucaua

SEQ ID NO: 1599250 - RNA, 16 nt, Human
aaaauuauuuuguuca

SEQ ID NO: 1599251 - RNA, 20 nt, Human
aaaauuauuuuguucauaca

SEQ ID NO: 1599252 - RNA, 13 nt, Human
aaagaaacauuug

SEQ ID NO: 1599253 - RNA, 21 nt, Human
aaacccugucucuacuaaaaa

SEQ ID NO: 1599254 - RNA, 19 nt, Human
aaacccuugccaugugcua

SEQ ID NO: 1599255 - RNA, 22 nt, Human
aaaccucaaaaugucuaagaua

SEQ ID NO: 1599256 - RNA, 17 nt, Human
aaaccucaaaaugucua

SEQ ID NO: 1599257 - RNA, 20 nt, Human
aaagcauuguaaaugugcuu

SEQ ID NO: 1599258 - RNA, 20 nt, Human
aaauaaaaauauuguguugu

SEQ ID NO: 1599259 - RNA, 19 nt, Human
aaauaaaccucaaaauguc

SEQ ID NO: 1599260 - RNA, 20 nt, Human
agggauuagggagagaagau

SEQ ID NO: 1599261 - RNA, 15 nt, Human
agggauuagggagag

SEQ ID NO: 1599262 - RNA, 21 nt, Human
aggccaugggcacugugggua

SEQ ID NO: 1599263 - RNA, 23 nt, Human
aggccaugggcacuguggguaga

SEQ ID NO: 1599264 - RNA, 15 nt, Human
agggacugaggggag

SEQ ID NO: 1599265 - RNA, 18 nt, Human
agcuucacuguaaaauaa

SEQ ID NO: 1599266 - RNA, 20 nt, Human
agcuccccucggagaagagc

SEQ ID NO: 1599267 - RNA, 17 nt, Human
agcuccccucggagaag

SEQ ID NO: 1599268 - RNA, 19 nt, Human
agcuccccucggagaagag

SEQ ID NO: 1599269 - RNA, 12 nt, Human
agcuacaaaugc

SEQ ID NO: 1599270 - RNA, 23 nt, Human
agcuaauguaauaacugugaagu

SEQ ID NO: 1599271 - RNA, 13 nt, Human
agaggaaugaagu

SEQ ID NO: 1599272 - RNA, 18 nt, Human
agacucugucucagucca

SEQ ID NO: 1599273 - RNA, 13 nt, Human
agaagauagcagg

SEQ ID NO: 1599274 - RNA, 18 nt, Human
agaagacugcauuauauu

SEQ ID NO: 1599275 - RNA, 22 nt, Human
agaagagcuguucacagccaga

SEQ ID NO: 1599276 - RNA, 21 nt, Human
agaagugaaaaucuacacucc

SEQ ID NO: 1599277 - RNA, 17 nt, Human
agaaugagagacacacu

SEQ ID NO: 1599278 - RNA, 22 nt, Human
agaaugagagacacacugaaga

SEQ ID NO: 1599279 - RNA, 17 nt, Human
agaaugauuaugaauua

SEQ ID NO: 1599280 - RNA, 19 nt, Human
agacccaaaaggcagaagc

SEQ ID NO: 1599281 - RNA, 24 nt, Human
agcaaaauuuuuucucuaggaaau

SEQ ID NO: 1599282 - RNA, 21 nt, Human
agcaaagcugaugacaacuuc

SEQ ID NO: 1599283 - RNA, 23 nt, Human
agcaaagcugaugacaacuuccc

SEQ ID NO: 1599284 - RNA, 19 nt, Human
agauguagaggagaaacug

SEQ ID NO: 1599285 - RNA, 19 nt, Human
agaugaugaugaucuuuaa

SEQ ID NO: 1599286 - RNA, 14 nt, Human
agaugguucuagca

SEQ ID NO: 1599287 - RNA, 20 nt, Human
aguucagagcugcccucucc

SEQ ID NO: 1599288 - RNA, 22 nt, Human
aguucagagcugcccucuccug

SEQ ID NO: 1599289 - RNA, 21 nt, Human
aguucagagcugcccucuccu

SEQ ID NO: 1599290 - RNA, 23 nt, Human
aguucagagcugcccucuccugg

SEQ ID NO: 1599291 - RNA, 21 nt, Human
aguugaaaagacuccaaagaa

SEQ ID NO: 1599292 - RNA, 18 nt, Human
aguugaaaagacuccaaa

SEQ ID NO: 1599293 - RNA, 19 nt, Human
aguugaaaagacuccaaag

SEQ ID NO: 1599294 - RNA, 20 nt, Human
aguugaaaagacuccaaaga

SEQ ID NO: 1599295 - RNA, 19 nt, Human
agugucaaugcagccccca

SEQ ID NO: 1599296 - RNA, 13 nt, Human
aguacucauacau

SEQ ID NO: 1599297 - RNA, 22 nt, Human
aguaaaugcuagguuaauucca

SEQ ID NO: 1599298 - RNA, 11 nt, Human
aguaaaugcua

SEQ ID NO: 1599299 - RNA, 23 nt, Human
aguaaaugcuagguuaauuccaa

SEQ ID NO: 1599300 - RNA, 19 nt, Human
aguaacaaugaagauaaaa

SEQ ID NO: 1599301 - RNA, 17 nt, Human
aguauuuuugacagaau

SEQ ID NO: 1599302 - RNA, 16 nt, Human
aguauuuuugacagaa

SEQ ID NO: 1599303 - RNA, 18 nt, Human
aguauuuuugacagaaua

SEQ ID NO: 1599304 - RNA, 13 nt, Human
aguauuuuugaca

SEQ ID NO: 1599305 - RNA, 11 nt, Human
aguccaagcau

SEQ ID NO: 1599306 - RNA, 20 nt, Human
agugaauucuugaaggaaaa

SEQ ID NO: 1599307 - RNA, 14 nt, Human
auaacaaugaaagu

SEQ ID NO: 1599308 - RNA, 15 nt, Human
auaacaaugcuguau

SEQ ID NO: 1599309 - RNA, 17 nt, Human
auaacaaugcuguauuu

SEQ ID NO: 1599310 - RNA, 19 nt, Human
auaacaaugcuguauuuua

SEQ ID NO: 1599311 - RNA, 20 nt, Human
auaacaaugcuguauuuuaa

SEQ ID NO: 1599312 - RNA, 21 nt, Human
auaacaaugcuguauuuuaaa

SEQ ID NO: 1599313 - RNA, 20 nt, Human
auaaaaagccugcaauuuca

SEQ ID NO: 1599314 - RNA, 22 nt, Human
auaaaaagccugcaauuucaua

SEQ ID NO: 1599315 - RNA, 13 nt, Human
auaauguuucaaa

SEQ ID NO: 1599316 - RNA, 21 nt, Human
auaagccagacaucaacagau

SEQ ID NO: 1599317 - RNA, 22 nt, Human
auaagccagacaucaacagaua

SEQ ID NO: 1599318 - RNA, 18 nt, Human
auaauguuucaaacauau

SEQ ID NO: 1599319 - RNA, 17 nt, Human
auacccagaaaguuauu

SEQ ID NO: 1599320 - RNA, 18 nt, Human
auagcagcuuauucacaa

SEQ ID NO: 1599321 - RNA, 15 nt, Human
auagcagcuuauuca

SEQ ID NO: 1599322 - RNA, 14 nt, Human
auauuauguuaaaa

SEQ ID NO: 1599323 - RNA, 16 nt, Human
auauuauguuaaaacu

SEQ ID NO: 1599324 - RNA, 13 nt, Human
auauuauguuaaa

SEQ ID NO: 1599325 - RNA, 17 nt, Human
auauuauguguuuccau

SEQ ID NO: 1599326 - RNA, 19 nt, Human
auccucaguuuuugugaaa

SEQ ID NO: 1599327 - RNA, 14 nt, Human
aucaaauaugcaaa

SEQ ID NO: 1599328 - RNA, 15 nt, Human
aucaaauaugcaaag

SEQ ID NO: 1599329 - RNA, 13 nt, Human
aucagcuuauugu

SEQ ID NO: 1599330 - RNA, 22 nt, Human
aucagcuugcccuguuaaaaga

SEQ ID NO: 1599331 - RNA, 17 nt, Human
aucaugaauuaguuuua

SEQ ID NO: 1599332 - RNA, 20 nt, Human
augaaguccaagcauuuaga

SEQ ID NO: 1599333 - RNA, 23 nt, Human
augaaguccaagcauuuagaugu

SEQ ID NO: 1599334 - RNA, 21 nt, Human
augaaguacucauacauguua

SEQ ID NO: 1599335 - RNA, 14 nt, Human
aucuaguaugaaau

SEQ ID NO: 1599336 - RNA, 18 nt, Human
aucuaguaugaaauuaua

SEQ ID NO: 1599337 - RNA, 17 nt, Human
aucuaguaugaaauuau

SEQ ID NO: 1599338 - RNA, 16 nt, Human
aucuaguaugaaauua

SEQ ID NO: 1599339 - RNA, 15 nt, Human
aucuaguaugaaauu

SEQ ID NO: 1599340 - RNA, 19 nt, Human
aucuaguaugaaauuauau

SEQ ID NO: 1599341 - RNA, 18 nt, Human
augaugaucuuuaaaaua

SEQ ID NO: 1599342 - RNA, 21 nt, Human
augaugaucuuuaaaauacac

SEQ ID NO: 1599343 - RNA, 16 nt, Human
augaucuuuaaaauac

SEQ ID NO: 1599344 - RNA, 15 nt, Human
augugaacacaucag

SEQ ID NO: 1599345 - RNA, 21 nt, Human
augucaaucagccuaguugau

SEQ ID NO: 1599346 - RNA, 17 nt, Human
auguuccuagugaaaga

SEQ ID NO: 1599347 - RNA, 15 nt, Human
auguuccuagugaaa

SEQ ID NO: 1599348 - RNA, 16 nt, Human
auguuccuagugaaag

SEQ ID NO: 1599349 - RNA, 15 nt, Human
auguguaaaauguga

SEQ ID NO: 1599350 - RNA, 21 nt, Human
cuggaaaucaggguuaguauu

SEQ ID NO: 1599351 - RNA, 10 nt, Human
cugggacagg

SEQ ID NO: 1599352 - RNA, 19 nt, Human
cugggcagcugccuccccu

SEQ ID NO: 1599353 - RNA, 21 nt, Human
cugggcagcugccuccccucc

SEQ ID NO: 1599354 - RNA, 20 nt, Human
cugggcagcugccuccccuc

SEQ ID NO: 1599355 - RNA, 22 nt, Human
cugggcagcugccuccccuccu

SEQ ID NO: 1599356 - RNA, 23 nt, Human
cugucagcuccccucggagaaga

SEQ ID NO: 1599357 - RNA, 21 nt, Human
cugucagcuccccucggagaa

SEQ ID NO: 1599358 - RNA, 16 nt, Human
cugugagaugcuagaa

SEQ ID NO: 1599359 - RNA, 21 nt, Human
cugugagaugcuagaacuccc

SEQ ID NO: 1599360 - RNA, 18 nt, Human
cugugaaguuuacauugu

SEQ ID NO: 1599361 - RNA, 14 nt, Human
gaaagacuauucaa

SEQ ID NO: 1599362 - RNA, 15 nt, Human
gaaagacuauucaaa

SEQ ID NO: 1599363 - RNA, 17 nt, Human
gaaagacuauucaaaca

SEQ ID NO: 1599364 - RNA, 18 nt, Human
gaaauauuuauuuuaaua

SEQ ID NO: 1599365 - RNA, 22 nt, Human
gaaauauuuauuuuaauaaugu

SEQ ID NO: 1599366 - RNA, 18 nt, Human
gaaaucaaauaugcaaag

SEQ ID NO: 1599367 - RNA, 21 nt, Human
gaaaucaaauaugcaaagcac

SEQ ID NO: 1599368 - RNA, 19 nt, Human
gaaaucaaauaugcaaagc

SEQ ID NO: 1599369 - RNA, 20 nt, Human
gaaaucaaauaugcaaagca

SEQ ID NO: 1599370 - RNA, 17 nt, Human
gaaauauuuauuuuaau

SEQ ID NO: 1599371 - RNA, 22 nt, Human
cuucuaaguaaaaccacagcag

SEQ ID NO: 1599372 - RNA, 23 nt, Human
cuucuaaguaaaaccacagcagu

SEQ ID NO: 1599373 - RNA, 13 nt, Human
cuugaugaagaag

SEQ ID NO: 1599374 - RNA, 12 nt, Human
cuugaugaagaa

SEQ ID NO: 1599375 - RNA, 15 nt, Human
cuucacuguaaaaua

SEQ ID NO: 1599376 - RNA, 20 nt, Human
cuucaugcauagguuuagca

SEQ ID NO: 1599377 - RNA, 21 nt, Human
cuucaucugacuaugacauaa

SEQ ID NO: 1599378 - RNA, 19 nt, Human
cuucaucugacuaugacau

SEQ ID NO: 1599379 - RNA, 20 nt, Human
gauauguaccuaacgaagua

SEQ ID NO: 1599380 - RNA, 16 nt, Human
gaguuuagcuggaaaa

SEQ ID NO: 1599381 - RNA, 14 nt, Human
gaugugaacacauc

SEQ ID NO: 1599382 - RNA, 16 nt, Human
gaugugaacacaucag

SEQ ID NO: 1599383 - RNA, 14 nt, Human
gauuaccagggacu

SEQ ID NO: 1599384 - RNA, 17 nt, Human
gauuagggagagaagau

SEQ ID NO: 1599385 - RNA, 19 nt, Human
gcagggacuugaacccaua

SEQ ID NO: 1599386 - RNA, 22 nt, Human
gcagcugccuccccuccucugc

SEQ ID NO: 1599387 - RNA, 18 nt, Human
gcagcugccuccccuccu

SEQ ID NO: 1599388 - RNA, 17 nt, Human
gcagcugccuccccucc

SEQ ID NO: 1599389 - RNA, 16 nt, Human
gcagcugccuccccuc

SEQ ID NO: 1599390 - RNA, 15 nt, Human
gcagcugccuccccu

SEQ ID NO: 1599391 - RNA, 13 nt, Human
gcagcugccuccc

SEQ ID NO: 1599392 - RNA, 12 nt, Human
gcagcugccucc

SEQ ID NO: 1599393 - RNA, 20 nt, Human
gcacaguuuucugagaaaga

SEQ ID NO: 1599394 - RNA, 18 nt, Human
gcacaguuuucugagaaa

SEQ ID NO: 1599395 - RNA, 14 nt, Human
gcacaguuuucuga

SEQ ID NO: 1599396 - RNA, 17 nt, Human
gcacaguuuucugagaa

SEQ ID NO: 1599397 - RNA, 12 nt, Human
gcacugacagau

SEQ ID NO: 1599398 - RNA, 17 nt, Human
gcacugacagauuucca

SEQ ID NO: 1599399 - RNA, 22 nt, Human
gaaugagagacacacugaagaa

SEQ ID NO: 1599400 - RNA, 23 nt, Human
gaaugagagacacacugaagaag

SEQ ID NO: 1599401 - RNA, 20 nt, Human
gaaugagagacacacugaag

SEQ ID NO: 1599402 - RNA, 16 nt, Human
gacacuuaaaaauggu

SEQ ID NO: 1599403 - RNA, 16 nt, Human
gacagaauauguuuca

SEQ ID NO: 1599404 - RNA, 14 nt, Human
gacagugaaagaaa

SEQ ID NO: 1599405 - RNA, 17 nt, Human
gacagucaccucaugga

SEQ ID NO: 1599406 - RNA, 13 nt, Human
gacacacugaaga

SEQ ID NO: 1599407 - RNA, 12 nt, Human
gacacacaugaa

SEQ ID NO: 1599408 - RNA, 14 nt, Human
gacacacugaagaa

SEQ ID NO: 1599409 - RNA, 11 nt, Human
gaauuaguuuu

SEQ ID NO: 1599410 - RNA, 13 nt, Human
gagcgacagugag

SEQ ID NO: 1599411 - RNA, 13 nt, Human
gacuaugacauaa

SEQ ID NO: 1599412 - RNA, 17 nt, Human
gacucuuaagaagacug

SEQ ID NO: 1599413 - RNA, 18 nt, Human
gacucuuaagaagacugc

SEQ ID NO: 1599414 - RNA, 16 nt, Human
gacucuuaagaagacu

SEQ ID NO: 1599415 - RNA, 15 nt, Human
gagaaucacuugaac

SEQ ID NO: 1599416 - RNA, 14 nt, Human
gagaaucacuugaa

SEQ ID NO: 1599417 - RNA, 22 nt, Human
gagacguuuuuggaagaguagu

SEQ ID NO: 1599418 - RNA, 22 nt, Human
gccaguuauggcuauaggugcu

SEQ ID NO: 1599419 - RNA, 16 nt, Human
gccauaugaaaaggcu

SEQ ID NO: 1599420 - RNA, 21 nt, Human
gccagcaguucagagcugccc

SEQ ID NO: 1599421 - RNA, 20 nt, Human
gccagcaguucagagcugcc

SEQ ID NO: 1599422 - RNA, 19 nt, Human
gccagcaguucagagcugc

SEQ ID NO: 1599423 - RNA, 14 nt, Human
gccagcaguucaga

SEQ ID NO: 1599424 - RNA, 13 nt, Human
gccagcaguucag

SEQ ID NO: 1599425 - RNA, 22 nt, Human
gccaugugcuaguaauuggaaa

SEQ ID NO: 1599426 - RNA, 17 nt, Human
gcuacaaaaacacagca

SEQ ID NO: 1599427 - RNA, 18 nt, Human
gcuacaaaaacacagcaa

SEQ ID NO: 1599428 - RNA, 19 nt, Human
gcuacaaaaacacagcaag

SEQ ID NO: 1599429 - RNA, 15 nt, Human
gcuacugucagcucc

SEQ ID NO: 1599430 - RNA, 17 nt, Human
gcuacuugggaggcuga

SEQ ID NO: 1599431 - RNA, 16 nt, Human
gccuccauccugaggc

SEQ ID NO: 1599432 - RNA, 20 nt, Human
gccuccauccugaggcucca

SEQ ID NO: 1599433 - RNA, 12 nt, Human
gcuguauuuuaa

SEQ ID NO: 1599434 - RNA, 13 nt, Human
gcuguauuuuaaa

SEQ ID NO: 1599435 - RNA, 14 nt, Human
gcuggagcucugcc

SEQ ID NO: 1599436 - RNA, 19 nt, Human
gcuuccuggcaauagucaa

SEQ ID NO: 1599437 - RNA, 20 nt, Human
gcuccacuuggucugugaga

SEQ ID NO: 1599438 - RNA, 21 nt, Human
gcucugcccauccugccccug

SEQ ID NO: 1599439 - RNA, 15 nt, Human
gcucugcccauccug

SEQ ID NO: 1599440 - RNA, 16 nt, Human
gcugaaacaacaaaua

SEQ ID NO: 1599441 - RNA, 22 nt, Human
ggauguugaaaaaguucugcag

SEQ ID NO: 1599442 - RNA, 12 nt, Human
ggauggcaagau

SEQ ID NO: 1599443 - RNA, 22 nt, Human
ggaucuucaucugacuaugaca

SEQ ID NO: 1599444 - RNA, 17 nt, Human
ggcauauuuuucacaua

SEQ ID NO: 1599445 - RNA, 15 nt, Human
ggcauauuuuucaca

SEQ ID NO: 1599446 - RNA, 23 nt, Human
ggccuucggccuccauccugagg

SEQ ID NO: 1599447 - RNA, 13 nt, Human
ggccuccauccug

SEQ ID NO: 1599448 - RNA, 12 nt, Human
gggcagcugccu

SEQ ID NO: 1599449 - RNA, 16 nt, Human
gggauuguaaaauggu

SEQ ID NO: 1599450 - RNA, 17 nt, Human
gggauuguaaaauggug

SEQ ID NO: 1599451 - RNA, 14 nt, Human
aaaaccacagcagu

SEQ ID NO: 1599452 - RNA, 13 nt, Human
aaaaccacagcag

SEQ ID NO: 1599453 - RNA, 13 nt, Human
aaaacucauuuuu

SEQ ID NO: 1599454 - RNA, 17 nt, Human
aaaagaugaaaauauuu

SEQ ID NO: 1599455 - RNA, 12 nt, Human
aaaaccacagca

SEQ ID NO: 1599456 - RNA, 22 nt, Human
aaaaauggaacauaaaauacaa

SEQ ID NO: 1599457 - RNA, 20 nt, Human
gggacauuugcucauggaau

SEQ ID NO: 1599458 - RNA, 21 nt, Human
gggacauuugcucauggaauu

SEQ ID NO: 1599459 - RNA, 19 nt, Human
aaaaauauauuuaaugaua

SEQ ID NO: 1599460 - RNA, 15 nt, Human
aaaaauauauuuaau

SEQ ID NO: 1599461 - RNA, 13 nt, Human
aaaaauauauuua

SEQ ID NO: 1599462 - RNA, 19 nt, Human
aaaaguauguuagugcaaa

SEQ ID NO: 1599463 - RNA, 20 nt, Human
aaacaagcacuaaacaaaga

SEQ ID NO: 1599464 - RNA, 20 nt, Human
aaacagucucaggaaaucaa

SEQ ID NO: 1599465 - RNA, 22 nt, Human
aaaauuuuuucucuaggaaaua

SEQ ID NO: 1599466 - RNA, 15 nt, Human
aaaaugugauaugua

SEQ ID NO: 1599467 - RNA, 12 nt, Human
aaaaugugaagu

SEQ ID NO: 1599468 - RNA, 14 nt, Human
aaagacuauucaaa

SEQ ID NO: 1599469 - RNA, 20 nt, Human
ggguuuuauuguuuaaaauc

SEQ ID NO: 1599470 - RNA, 15 nt, Human
ggugccaguuauggc

SEQ ID NO: 1599471 - RNA, 17 nt, Human
aaagcagggacuugaac

SEQ ID NO: 1599472 - RNA, 17 nt, Human
aaagacuauucaaacag

SEQ ID NO: 1599473 - RNA, 15 nt, Human
aaagacuauucaaac

SEQ ID NO: 1599474 - RNA, 13 nt, Human
aaagauuuucaga

SEQ ID NO: 1599475 - RNA, 16 nt, Human
gguuuagaaagcuugc

SEQ ID NO: 1599476 - RNA, 16 nt, Human
ggugugaccacugcag

SEQ ID NO: 1599477 - RNA, 23 nt, Human
aaaguuauugauaaguucauaca

SEQ ID NO: 1599478 - RNA, 15 nt, Human
aaauaauuuuuauau

SEQ ID NO: 1599479 - RNA, 18 nt, Human
aaauaauuuuuauauuug

SEQ ID NO: 1599480 - RNA, 20 nt, Human
aaauaauuuuuauauuugaa

SEQ ID NO: 1599481 - RNA, 22 nt, Human
guaaaaugugaagugaaugaaa

SEQ ID NO: 1599482 - RNA, 20 nt, Human
guaaaaugugaagugaauga

SEQ ID NO: 1599483 - RNA, 19 nt, Human
guaaaaugugaagugaaug

SEQ ID NO: 1599484 - RNA, 12 nt, Human
guaaaaugugaa

SEQ ID NO: 1599485 - RNA, 17 nt, Human
guaacaaugaagauaaa

SEQ ID NO: 1599486 - RNA, 20 nt, Human
cucuuagaugcaguucugaa

SEQ ID NO: 1599487 - RNA, 21 nt, Human
cucuuagaugcaguucugaag

SEQ ID NO: 1599488 - RNA, 15 nt, Human
cucuuagaugcaguu

SEQ ID NO: 1599489 - RNA, 12 nt, Human
cucucuggccuu

SEQ ID NO: 1599490 - RNA, 11 nt, Human
cucucuggccu

SEQ ID NO: 1599491 - RNA, 14 nt, Human
cucccugcaauaaa

SEQ ID NO: 1599492 - RNA, 16 nt, Human
cucccugcaauaaaau

SEQ ID NO: 1599493 - RNA, 21 nt, Human
cuccagugagacagcucugca

SEQ ID NO: 1599494 - RNA, 15 nt, Human
cgacagugagacucu

SEQ ID NO: 1599495 - RNA, 16 nt, Human
cgacagugagacucug

SEQ ID NO: 1599496 - RNA, 23 nt, Human
cuaguugaucagcuuauugucua

SEQ ID NO: 1599497 - RNA, 16 nt, Human
cuagaacucccuuuca

SEQ ID NO: 1599498 - RNA, 17 nt, Human
cuagaacucccuuucaa

SEQ ID NO: 1599499 - RNA, 18 nt, Human
cuagaacucccuuucaac

SEQ ID NO: 1599500 - RNA, 19 nt, Human
cuagaacucccuuucaaca

SEQ ID NO: 1599501 - RNA, 20 nt, Human
cuaacgaaguauccuucagc

SEQ ID NO: 1599502 - RNA, 20 nt, Human
cuaagugaaauaagccagac

SEQ ID NO: 1599503 - RNA, 23 nt, Human
cuaagugaaauaagccagacauc

SEQ ID NO: 1599504 - RNA, 15 nt, Human
cuacaaaaacacagc

SEQ ID NO: 1599505 - RNA, 18 nt, Human
cuacaugagguacugaga

SEQ ID NO: 1599506 - RNA, 15 nt, Human
cuacaugagguacug

SEQ ID NO: 1599507 - RNA, 22 nt, Human
cuacauaaguaauucaagaaaa

SEQ ID NO: 1599508 - RNA, 23 nt, Human
cuacauaaguaauucaagaaaac

SEQ ID NO: 1599509 - RNA, 17 nt, Human
cccuucuuuccacagaa

SEQ ID NO: 1599510 - RNA, 16 nt, Human
ccguagguuauuuuca

SEQ ID NO: 1599511 - RNA, 15 nt, Human
ccucauguccacugg

SEQ ID NO: 1599512 - RNA, 20 nt, Human
ccucauguccacugguucuu

SEQ ID NO: 1599513 - RNA, 13 nt, Human
ccucugcuugcca

SEQ ID NO: 1599514 - RNA, 17 nt, Human
ccucugcuugccauccc

SEQ ID NO: 1599515 - RNA, 20 nt, Human
cccauauuuguacaccaaua

SEQ ID NO: 1599516 - RNA, 24 nt, Human
cccagccagcaguucagagcugcc

SEQ ID NO: 1599517 - RNA, 16 nt, Human
cccagccagcaguuca

SEQ ID NO: 1599518 - RNA, 20 nt, Human
cccagccagcaguucagagc

SEQ ID NO: 1599519 - RNA, 17 nt, Human
cccagccagcaguucag

SEQ ID NO: 1599520 - RNA, 22 nt, Human
cccauuguggucacaggaagua

SEQ ID NO: 1599521 - RNA, 23 nt, Human
cccauuguggucacaggaaguag

SEQ ID NO: 1599522 - RNA, 23 nt, Human
cccgggaggcagagguugcagug

SEQ ID NO: 1599523 - RNA, 15 nt, Human
ccagauccuggaaau

SEQ ID NO: 1599524 - RNA, 22 nt, Human
cagggaggacgcucucuggccu

SEQ ID NO: 1599525 - RNA, 23 nt, Human
caggacagcccuucuuuccacag

SEQ ID NO: 1599526 - RNA, 24 nt, Human
caggacagcccuucuuuccacaga

SEQ ID NO: 1599527 - RNA, 16 nt, Human
cagcuuauucacaaga

SEQ ID NO: 1599528 - RNA, 17 nt, Human
cagcuuauucacaagac

SEQ ID NO: 1599529 - RNA, 22 nt, Human
caggaaaucaaauaugcaaagc

SEQ ID NO: 1599530 - RNA, 21 nt, Human
caggaaaucaaauaugcaaag

SEQ ID NO: 1599531 - RNA, 19 nt, Human
caggaaaucaaauaugcaa

SEQ ID NO: 1599532 - RNA, 16 nt, Human
cagagguugcagugag

SEQ ID NO: 1599533 - RNA, 22 nt, Human
cagcaguucagagcugcccucu

SEQ ID NO: 1599534 - RNA, 21 nt, Human
cagcaguucagagcugcccuc

SEQ ID NO: 1599535 - RNA, 20 nt, Human
cagcaguucagagcugcccu

SEQ ID NO: 1599536 - RNA, 19 nt, Human
cagcaguucagagcugccc

SEQ ID NO: 1599537 - RNA, 19 nt, Human
cagccccgugggguuccuc

SEQ ID NO: 1599538 - RNA, 23 nt, Human
cagccugagcgacagugagacuc

SEQ ID NO: 1599539 - RNA, 20 nt, Human
caucagcuugcccuguuaaa

SEQ ID NO: 1599540 - RNA, 15 nt, Human
caucagcugcugaaa

SEQ ID NO: 1599541 - RNA, 17 nt, Human
caucagcugcugaaaca

SEQ ID NO: 1599542 - RNA, 18 nt, Human
caucagcugcugaaacaa

SEQ ID NO: 1599543 - RNA, 16 nt, Human
caugaauuaguuuuau

SEQ ID NO: 1599544 - RNA, 17 nt, Human
cauagauucccugagca

SEQ ID NO: 1599545 - RNA, 18 nt, Human
cauagauucccugagcag

SEQ ID NO: 1599546 - RNA, 22 nt, Human
ccaauuauaugagacguuuuug

SEQ ID NO: 1599547 - RNA, 15 nt, Human
cauuaggauggcuag

SEQ ID NO: 1599548 - RNA, 12 nt, Human
cauuuccaagca

SEQ ID NO: 1599549 - RNA, 19 nt, Human
ccaaaaagauuuucagaaa

SEQ ID NO: 1599550 - RNA, 17 nt, Human
cacacaugaaguccaag

SEQ ID NO: 1599551 - RNA, 22 nt, Human
cacacaugaaguccaagcauuu

SEQ ID NO: 1599552 - RNA, 17 nt, Human
cacagccucuuagaugc

SEQ ID NO: 1599553 - RNA, 21 nt, Human
cacagccucuuagaugcaguu

SEQ ID NO: 1599554 - RNA, 15 nt, Human
caaugcuguauuuua

SEQ ID NO: 1599555 - RNA, 16 nt, Human
caaugcuguauuuuaa

SEQ ID NO: 1599556 - RNA, 17 nt, Human
caaugcuguauuuuaaa

SEQ ID NO: 1599557 - RNA, 15 nt, Human
caauucuugccaaau

SEQ ID NO: 1599558 - RNA, 18 nt, Human
cacaagacugcacaucaa

SEQ ID NO: 1599559 - RNA, 14 nt, Human
caaguccaagcaua

SEQ ID NO: 1599560 - RNA, 21 nt, Human
cacugcagaagacaguauggc

SEQ ID NO: 1599561 - RNA, 22 nt, Human
cacuuguguuuugcaagccaga

SEQ ID NO: 1599562 - RNA, 16 nt, Human
cacuugucaauaaaau

SEQ ID NO: 1599563 - RNA, 19 nt, Human
cacuuguguuuugcaagcc

SEQ ID NO: 1599564 - RNA, 22 nt, Human
cacugguucuucuuggucucag

SEQ ID NO: 1599565 - RNA, 16 nt, Human
cacuccagugagacag

SEQ ID NO: 1599566 - RNA, 20 nt, Human
cacuagggcagggacaggau

SEQ ID NO: 1599567 - RNA, 21 nt, Human
cacuagggcagggacaggaua

SEQ ID NO: 1599568 - RNA, 11 nt, Human
cacugacagau

SEQ ID NO: 1599569 - RNA, 19 nt, Human
auuuuauagcuacuaauuu

SEQ ID NO: 1599570 - RNA, 14 nt, Human
auuugcucauggaa

SEQ ID NO: 1599571 - RNA, 17 nt, Human
auuugcucauggaauug

SEQ ID NO: 1599572 - RNA, 15 nt, Human
caaacagucucagga

SEQ ID NO: 1599573 - RNA, 15 nt, Human
caaaaggcagaagca

SEQ ID NO: 1599574 - RNA, 20 nt, Human
caaaaaaaaaaaaaaauuag

SEQ ID NO: 1599575 - RNA, 23 nt, Human
caacacgagcaggcuacugucag

SEQ ID NO: 1599576 - RNA, 15 nt, Human
caaauccuugaagau

SEQ ID NO: 1599577 - RNA, 20 nt, Human
caaagcacugacuucuaagu

SEQ ID NO: 1599578 - RNA, 22 nt, Human
caaagcacugacuucuaaguaa

SEQ ID NO: 1599579 - RNA, 19 nt, Human
auucacaagacccaaaagg

SEQ ID NO: 1599580 - RNA, 18 nt, Human
auuaugaauuacauuugu

SEQ ID NO: 1599581 - RNA, 14 nt, Human
auuaugaauuacau

SEQ ID NO: 1599582 - RNA, 17 nt, Human
auuaugaauuacauuug

SEQ ID NO: 1599583 - RNA, 16 nt, Human
auuagggagagaagau

SEQ ID NO: 1599584 - RNA, 19 nt, Human
auucauagcagcuuauuca

SEQ ID NO: 1599585 - RNA, 22 nt, Human
auucauagcagcuuauucacaa

SEQ ID NO: 1599586 - RNA, 14 nt, Human
auuguaaaauggug

SEQ ID NO: 1599587 - RNA, 14 nt, Human
auuguaaauaguau

SEQ ID NO: 1599588 - RNA, 22 nt, Human
auugauaaguucauacauugua

SEQ ID NO: 1599589 - RNA, 18 nt, Human
auucuugaaggaaaauga

SEQ ID NO: 1599590 - RNA, 15 nt, Human
auucuugaaggaaaa

SEQ ID NO: 1599591 - RNA, 16 nt, Human
uuguauaaaauaauuu

SEQ ID NO: 1599592 - RNA, 15 nt, Human
uuguauaaaauaauu

SEQ ID NO: 1599593 - RNA, 17 nt, Human
uuguauaaaauaauuuu

SEQ ID NO: 1599594 - RNA, 23 nt, Human
uuguaguguuggagaagaacuga

SEQ ID NO: 1599595 - RNA, 19 nt, Human
uuguauaaaauaauuuuua

SEQ ID NO: 1599596 - RNA, 16 nt, Human
uuguaucacaaaucuu

SEQ ID NO: 1599597 - RNA, 13 nt, Human
augagagacacac

SEQ ID NO: 1599598 - RNA, 14 nt, Human
augagagacacacu

SEQ ID NO: 1599599 - RNA, 17 nt, Human
augagagacacacugaa

SEQ ID NO: 1599600 - RNA, 19 nt, Human
augagagacacacugaaga

SEQ ID NO: 1599601 - RNA, 18 nt, Human
augaagauguagaggaga

SEQ ID NO: 1599602 - RNA, 13 nt, Human
augaaugaauggc

SEQ ID NO: 1599603 - RNA, 13 nt, Human
augaaauauuaug

SEQ ID NO: 1599604 - RNA, 17 nt, Human
augaaauauuauguuaa

SEQ ID NO: 1599605 - RNA, 18 nt, Human
augaaauauuauguuaaa

SEQ ID NO: 1599606 - RNA, 15 nt, Human
augaauuaaguuuuu

SEQ ID NO: 1599607 - RNA, 13 nt, Human
aucuuuuucuaac

SEQ ID NO: 1599608 - RNA, 15 nt, Human
augaaagcagggacu

SEQ ID NO: 1599609 - RNA, 13 nt, Human
uugcccuguuaaa

SEQ ID NO: 1599610 - RNA, 18 nt, Human
uugauggugguauguuuu

SEQ ID NO: 1599611 - RNA, 19 nt, Human
uugauggugguauguuuuc

SEQ ID NO: 1599612 - RNA, 20 nt, Human
uugauguguuuauuuauaga

SEQ ID NO: 1599613 - RNA, 11 nt, Human
uugauguguuu

SEQ ID NO: 1599614 - RNA, 13 nt, Human
aucucaauauuuc

SEQ ID NO: 1599615 - RNA, 23 nt, Human
aucucauuuccaagcaaguauua

SEQ ID NO: 1599616 - RNA, 17 nt, Human
aucucauaauuuauaca

SEQ ID NO: 1599617 - RNA, 21 nt, Human
aucucauuuccaagcaaguau

SEQ ID NO: 1599618 - RNA, 18 nt, Human
aucucauaauuuauacag

SEQ ID NO: 1599619 - RNA, 22 nt, Human
uuuagcuggaaaaguauguuag

SEQ ID NO: 1599620 - RNA, 20 nt, Human
uuuagcuggaaaaguauguu

SEQ ID NO: 1599621 - RNA, 13 nt, Human
uuuauauaagcuu

SEQ ID NO: 1599622 - RNA, 22 nt, Human
augcugucuacacuaagagaga

SEQ ID NO: 1599623 - RNA, 16 nt, Human
uuuauuacuguaagaa

SEQ ID NO: 1599624 - RNA, 16 nt, Human
augcuagaacucccuu

SEQ ID NO: 1599625 - RNA, 19 nt, Human
augcuagaacucccuuuca

SEQ ID NO: 1599626 - RNA, 15 nt, Human
augcuagaacucccu

SEQ ID NO: 1599627 - RNA, 20 nt, Human
auggcuaguaucaaaagaaa

SEQ ID NO: 1599628 - RNA, 16 nt, Human
auggaaugcuguguua

SEQ ID NO: 1599629 - RNA, 18 nt, Human
augcaguucugaagaaga

SEQ ID NO: 1599630 - RNA, 19 nt, Human
augcaguucugaagaagau

SEQ ID NO: 1599631 - RNA, 15 nt, Human
augccacuaaauuga

SEQ ID NO: 1599632 - RNA, 17 nt, Human
augccacuaaauugaca

SEQ ID NO: 1599633 - RNA, 15 nt, Human
augcaguucugaaga

SEQ ID NO: 1599634 - RNA, 17 nt, Human
augcaguucugaagaag

SEQ ID NO: 1599635 - RNA, 14 nt, Human
uuguuuucauuauc

SEQ ID NO: 1599636 - RNA, 12 nt, Human
augauucccagc

SEQ ID NO: 1599637 - RNA, 22 nt, Human
augauuaugaauuacauuugua

SEQ ID NO: 1599638 - RNA, 20 nt, Human
augagagacacacugaagaa

SEQ ID NO: 1599639 - RNA, 21 nt, Human
augagagacacacugaagaag

SEQ ID NO: 1599640 - RNA, 23 nt, Human
augagagacacacugaagaagca

SEQ ID NO: 1599641 - RNA, 23 nt, Human
uugugugaaagguacuucaaauc

SEQ ID NO: 1599642 - RNA, 20 nt, Human
uuguguuaaguauguguaaa

SEQ ID NO: 1599643 - RNA, 20 nt, Human
aucaaauaugcaaagcacug

SEQ ID NO: 1599644 - RNA, 21 nt, Human
uucuaaguaaaaccacagcag

SEQ ID NO: 1599645 - RNA, 14 nt, Human
uucuauaauuuaaa

SEQ ID NO: 1599646 - RNA, 13 nt, Human
uucuauaauuuaa

SEQ ID NO: 1599647 - RNA, 13 nt, Human
uucuaagaaguga

SEQ ID NO: 1599648 - RNA, 19 nt, Human
uucuaaguaaaaccacagc

SEQ ID NO: 1599649 - RNA, 20 nt, Human
uucuaaguaaaaccacagca

SEQ ID NO: 1599650 - RNA, 20 nt, Human
uucuaacaaaaaaauauauu

SEQ ID NO: 1599651 - RNA, 19 nt, Human
uucuaacaaaaaaauauau

SEQ ID NO: 1599652 - RNA, 14 nt, Human
auccauacauuugu

SEQ ID NO: 1599653 - RNA, 20 nt, Human
aucauuucugcaucagcugc

SEQ ID NO: 1599654 - RNA, 19 nt, Human
uugaaauauugacuuuuua

SEQ ID NO: 1599655 - RNA, 18 nt, Human
uugaacccgggaggcaga

SEQ ID NO: 1599656 - RNA, 20 nt, Human
auccuagucacuaccuucau

SEQ ID NO: 1599657 - RNA, 17 nt, Human
auaggcguaacuaauuu

SEQ ID NO: 1599658 - RNA, 23 nt, Human
uucacaagacccaaaaggcagaa

SEQ ID NO: 1599659 - RNA, 14 nt, Human
uucaaacauauaua

SEQ ID NO: 1599660 - RNA, 18 nt, Human
uucaaacagucucaggaa

SEQ ID NO: 1599661 - RNA, 17 nt, Human
uuauuuuguucauacau

SEQ ID NO: 1599662 - RNA, 21 nt, Human
uuauuuuguucauacauauuu

SEQ ID NO: 1599663 - RNA, 14 nt, Human
auauauaacaaugc

SEQ ID NO: 1599664 - RNA, 20 nt, Human
auaguuguaccgcaauguga

SEQ ID NO: 1599665 - RNA, 13 nt, Human
auagucuuucagu

SEQ ID NO: 1599666 - RNA, 18 nt, Human
uucccaacuccagaaagu

SEQ ID NO: 1599667 - RNA, 12 nt, Human
uucccaaauuuc

SEQ ID NO: 1599668 - RNA, 15 nt, Human
auauauuuaaugaua

SEQ ID NO: 1599669 - RNA, 13 nt, Human
auauauuuaauga

SEQ ID NO: 1599670 - RNA, 19 nt, Human
uucauacauuguacgaaga

SEQ ID NO: 1599671 - RNA, 13 nt, Human
uucauacauugua

SEQ ID NO: 1599672 - RNA, 13 nt, Human
uucauaugcugua

SEQ ID NO: 1599673 - RNA, 23 nt, Human
uucauacauauuuuuguagcacu

SEQ ID NO: 1599674 - RNA, 12 nt, Human
uucauacauauu

SEQ ID NO: 1599675 - RNA, 13 nt, Human
auaucuuguagcu

SEQ ID NO: 1599676 - RNA, 17 nt, Human
auaucuaguaugaaauu

SEQ ID NO: 1599677 - RNA, 15 nt, Human
auaucuaguaugaaa

SEQ ID NO: 1599678 - RNA, 14 nt, Human
auaucuaguaugaa

SEQ ID NO: 1599679 - RNA, 19 nt, Human
auuuguaguguuggagaag

SEQ ID NO: 1599680 - RNA, 15 nt, Human
auuuguaucacaaau

SEQ ID NO: 1599681 - RNA, 14 nt, Human
auuuuaauaauguu

SEQ ID NO: 1599682 - RNA, 15 nt, Human
auuuuaauaauguuu

SEQ ID NO: 1599683 - RNA, 16 nt, Human
auuuuaauaauguuuc

SEQ ID NO: 1599684 - RNA, 22 nt, Human
auuuauuacuguaagaaaauau

SEQ ID NO: 1599685 - RNA, 18 nt, Human
auuuguaguguuggagaa

SEQ ID NO: 1599686 - RNA, 23 nt, Human
auuugguaaggggaauugaggac

SEQ ID NO: 1599687 - RNA, 21 nt, Human
auuuggagacacaacuauuuu

SEQ ID NO: 1599688 - RNA, 20 nt, Human
auuuggagacacaacuauuu

SEQ ID NO: 1599689 - RNA, 20 nt, Human
auugacacuuaaaaaugguu

SEQ ID NO: 1599690 - RNA, 16 nt, Human
auuuacaaaugggaaa

SEQ ID NO: 1599691 - RNA, 19 nt, Human
auuuaaagcuuauuaaaac

SEQ ID NO: 1599692 - RNA, 15 nt, Human
auuguauuacaaauc

SEQ ID NO: 1599693 - RNA, 14 nt, Human
auuguauuacaaau

SEQ ID NO: 1599694 - RNA, 13 nt, Human
auugugccccugc

SEQ ID NO: 1599695 - RNA, 21 nt, Human
auugcuaaucaccaaaggcuc

SEQ ID NO: 1599696 - RNA, 20 nt, Human
auuccacuuauaggaauuga

SEQ ID NO: 1599697 - RNA, 14 nt, Human
auucaaacagucuc

SEQ ID NO: 1599698 - RNA, 15 nt, Human
auucaaacagucuca

SEQ ID NO: 1599699 - RNA, 16 nt, Human
auucaaacagucucag

SEQ ID NO: 1599700 - RNA, 16 nt, Human
auuauauuuacaaaug

SEQ ID NO: 1599701 - RNA, 18 nt, Human
auuaucucaaaacugcac

SEQ ID NO: 1599702 - RNA, 23 nt, Human
auuaucucaaaacugcacuguca

SEQ ID NO: 1599703 - RNA, 17 nt, Human
auuauauuuacaaaugg

SEQ ID NO: 1599704 - RNA, 20 nt, Human
auuauuaccuuacagaaguu

SEQ ID NO: 1599705 - RNA, 13 nt, Human
auuacauuuguau

SEQ ID NO: 1599706 - RNA, 15 nt, Human
auuacauuuguauaa

SEQ ID NO: 1599707 - RNA, 16 nt, Human
auuacauuuguauaaa

SEQ ID NO: 1599708 - RNA, 12 nt, Human
auuaccagggac

SEQ ID NO: 1599709 - RNA, 23 nt, Human
uuuuuuaaaaaagaaacauuugg

SEQ ID NO: 1599710 - RNA, 13 nt, Human
auuaaguaaugau

SEQ ID NO: 1599711 - RNA, 15 nt, Human
auuaaguaaugauaa

SEQ ID NO: 1599712 - RNA, 21 nt, Human
auuaaguaaugauaacuggaa

SEQ ID NO: 1599713 - RNA, 15 nt, Human
auuaauauauuucca

SEQ ID NO: 1599714 - RNA, 22 nt, Human
uuuuauggcacuaguauuucua

SEQ ID NO: 1599715 - RNA, 19 nt, Human
uuuuauggcacuaguauuu

SEQ ID NO: 1599716 - RNA, 23 nt, Human
uuuuauggaggcuuugcauagau

SEQ ID NO: 1599717 - RNA, 14 nt, Human
uuuuauaauuuugu

SEQ ID NO: 1599718 - RNA, 15 nt, Human
auguugacaugggac

SEQ ID NO: 1599719 - RNA, 19 nt, Human
auguucaucaaugaaugaa

SEQ ID NO: 1599720 - RNA, 16 nt, Human
auuaaaagaauauuuu

SEQ ID NO: 1599721 - RNA, 20 nt, Human
auuaaaaaaucaguuguaca

SEQ ID NO: 1599722 - RNA, 18 nt, Human
auguuucaaacauauaua

SEQ ID NO: 1599723 - RNA, 21 nt, Human
auguuucaaacauauauaaca

SEQ ID NO: 1599724 - RNA, 15 nt, Human
auguugugauguauu

SEQ ID NO: 1599725 - RNA, 16 nt, Human
auguccacugguucuu

SEQ ID NO: 1599726 - RNA, 11 nt, Human
uuugcucaugg

SEQ ID NO: 1599727 - RNA, 12 nt, Human
uuugcucaugga

SEQ ID NO: 1599728 - RNA, 15 nt, Human
auggcuauaggugcu

SEQ ID NO: 1599729 - RNA, 13 nt, Human
uuugcucauggaa

SEQ ID NO: 1599730 - RNA, 14 nt, Human
uuuuaaaagaauga

SEQ ID NO: 1599731 - RNA, 15 nt, Human
uuuuaaaagaaugau

SEQ ID NO: 1599732 - RNA, 13 nt, Human
uuuuaaaaaagaa

SEQ ID NO: 1599733 - RNA, 11 nt, Human
uuuuaagaaau

SEQ ID NO: 1599734 - RNA, 19 nt, Human
uuuguagcacugacagauu

SEQ ID NO: 1599735 - RNA, 17 nt, Human
uuuguagcacugacaga

SEQ ID NO: 1599736 - RNA, 18 nt, Human
auaauccuaaacauauga

SEQ ID NO: 1599737 - RNA, 14 nt, Human
uuagggagagaaga

SEQ ID NO: 1599738 - RNA, 22 nt, Human
auaacgauaaaagacagugaaa

SEQ ID NO: 1599739 - RNA, 13 nt, Human
auaacugugaagu

SEQ ID NO: 1599740 - RNA, 13 nt, Human
auaaauaaaaaua

SEQ ID NO: 1599741 - RNA, 14 nt, Human
auaaauaaaaauaa

SEQ ID NO: 1599742 - RNA, 15 nt, Human
auaaauaguuuauga

SEQ ID NO: 1599743 - RNA, 18 nt, Human
auaaauauuuuugccaua

SEQ ID NO: 1599744 - RNA, 12 nt, Human
auaaaauaauuu

SEQ ID NO: 1599745 - RNA, 15 nt, Human
auaaaauaauuuuua

SEQ ID NO: 1599746 - RNA, 19 nt, Human
aguuuucugagaaagacua

SEQ ID NO: 1599747 - RNA, 23 nt, Human
aguuuucugagaaagacuauuca

SEQ ID NO: 1599748 - RNA, 20 nt, Human
uuaagaagacugcauuauau

SEQ ID NO: 1599749 - RNA, 14 nt, Human
uuaaguauguguaa

SEQ ID NO: 1599750 - RNA, 13 nt, Human
uguuucaaacaua

SEQ ID NO: 1599751 - RNA, 14 nt, Human
aguuuaaauuguaa

SEQ ID NO: 1599752 - RNA, 23 nt, Human
aguguuggagaagaacugaaauc

SEQ ID NO: 1599753 - RNA, 17 nt, Human
aguguuggagaagaacu

SEQ ID NO: 1599754 - RNA, 18 nt, Human
aguguuggagaagaacug

SEQ ID NO: 1599755 - RNA, 14 nt, Human
aguguuggagaaga

SEQ ID NO: 1599756 - RNA, 16 nt, Human
aguguuggagaagaac

SEQ ID NO: 1599757 - RNA, 14 nt, Human
aguucagagcugcc

SEQ ID NO: 1599758 - RNA, 19 nt, Human
aguucggugagcuacaaau

SEQ ID NO: 1599759 - RNA, 20 nt, Human
aguucggugagcuacaaaug

SEQ ID NO: 1599760 - RNA, 15 nt, Human
aguucuacauaagua

SEQ ID NO: 1599761 - RNA, 20 nt, Human
uguugugauguauucuagcu

SEQ ID NO: 1599762 - RNA, 14 nt, Human
uguugugauguauu

SEQ ID NO: 1599763 - RNA, 13 nt, Human
uguugugaauguu

SEQ ID NO: 1599764 - RNA, 12 nt, Human
uguugugaaugu

SEQ ID NO: 1599765 - RNA, 22 nt, Human
agugcaaauugucacaggacag

SEQ ID NO: 1599766 - RNA, 18 nt, Human
agugcaaauugucacagg

SEQ ID NO: 1599767 - RNA, 21 nt, Human
agugcaaauugucacaggaca

SEQ ID NO: 1599768 - RNA, 21 nt, Human
agugccuguaaucacagcuac

SEQ ID NO: 1599769 - RNA, 13 nt, Human
uguguugugaaug

SEQ ID NO: 1599770 - RNA, 16 nt, Human
agucaggaaagagaac

SEQ ID NO: 1599771 - RNA, 15 nt, Human
agucaggaaagagaa

SEQ ID NO: 1599772 - RNA, 20 nt, Human
ugucaaucagccuaguugau

SEQ ID NO: 1599773 - RNA, 21 nt, Human
ugucaauaaaauccauacauu

SEQ ID NO: 1599774 - RNA, 23 nt, Human
ugucauuugcuggagcucugccc

SEQ ID NO: 1599775 - RNA, 22 nt, Human
aguauuucuaugaaauauuaug

SEQ ID NO: 1599776 - RNA, 16 nt, Human
aguauuugagaguucu

SEQ ID NO: 1599777 - RNA, 13 nt, Human
aguauuucuauga

SEQ ID NO: 1599778 - RNA, 15 nt, Human
aguauuucuaugaaa

SEQ ID NO: 1599779 - RNA, 14 nt, Human
aguauguguaaaau

SEQ ID NO: 1599780 - RNA, 17 nt, Human
uguaagaaaauaucacu

SEQ ID NO: 1599781 - RNA, 14 nt, Human
agguugcagugagc

SEQ ID NO: 1599782 - RNA, 15 nt, Human
aguaaaaccacagca

SEQ ID NO: 1599783 - RNA, 18 nt, Human
uguagaggagaaacugga

SEQ ID NO: 1599784 - RNA, 19 nt, Human
aguagauaggccaugggca

SEQ ID NO: 1599785 - RNA, 19 nt, Human
aguagaacagauaaucagu

SEQ ID NO: 1599786 - RNA, 13 nt, Human
aguagaacagaua

SEQ ID NO: 1599787 - RNA, 14 nt, Human
ugggaguacaaaag

SEQ ID NO: 1599788 - RNA, 17 nt, Human
agggcagggacaggaua

SEQ ID NO: 1599789 - RNA, 20 nt, Human
ugguaaggggaauugaggac

SEQ ID NO: 1599790 - RNA, 17 nt, Human
aggguuaugauuaagua

SEQ ID NO: 1599791 - RNA, 23 nt, Human
agguacuucaaauccuugaagau

SEQ ID NO: 1599792 - RNA, 19 nt, Human
aggucauauuaauauauuu

SEQ ID NO: 1599793 - RNA, 18 nt, Human
aggucauauuaauauauu

SEQ ID NO: 1599794 - RNA, 23 nt, Human
aggacagcccuucuuuccacaga

SEQ ID NO: 1599795 - RNA, 14 nt, Human
uggagcucguggaa

SEQ ID NO: 1599796 - RNA, 14 nt, Human
uggagaagaacuga

SEQ ID NO: 1599797 - RNA, 13 nt, Human
uggagaagaacug

SEQ ID NO: 1599798 - RNA, 18 nt, Human
uggcacaguuuucugaga

SEQ ID NO: 1599799 - RNA, 19 nt, Human
uggcacaguuuucugagaa

SEQ ID NO: 1599800 - RNA, 20 nt, Human
uggcacaguuuucugagaaa

SEQ ID NO: 1599801 - RNA, 14 nt, Human
uggccuucggccuc

SEQ ID NO: 1599802 - RNA, 17 nt, Human
uggcauauuuuucacau

SEQ ID NO: 1599803 - RNA, 16 nt, Human
uggcauauuuuucaca

SEQ ID NO: 1599804 - RNA, 16 nt, Human
agcuguucacagccag

SEQ ID NO: 1599805 - RNA, 19 nt, Human
agcuguucacagccagacu

SEQ ID NO: 1599806 - RNA, 22 nt, Human
agcugcccucuccugggcagcu

SEQ ID NO: 1599807 - RNA, 15 nt, Human
agcugccuccccucc

SEQ ID NO: 1599808 - RNA, 17 nt, Human
agcugccuccccuccuc

SEQ ID NO: 1599809 - RNA, 16 nt, Human
agcugccuccccuccu

SEQ ID NO: 1599810 - RNA, 20 nt, Human
ugcuacaaaaacacagcaag

SEQ ID NO: 1599811 - RNA, 16 nt, Human
ugcuacaaaaacacag

SEQ ID NO: 1599812 - RNA, 17 nt, Human
ugcuacaaaaacacagc

SEQ ID NO: 1599813 - RNA, 18 nt, Human
ugcuacaaaaacacagca

SEQ ID NO: 1599814 - RNA, 19 nt, Human
ugcuacaaaaacacagcaa

SEQ ID NO: 1599815 - RNA, 17 nt, Human
agcuugaaacugagaug

SEQ ID NO: 1599816 - RNA, 21 nt, Human
ugcuguauuuuaaaagaauga

SEQ ID NO: 1599817 - RNA, 22 nt, Human
ugcuguauuuuaaaagaaugau

SEQ ID NO: 1599818 - RNA, 13 nt, Human
ugcuguauuuuaa

SEQ ID NO: 1599819 - RNA, 23 nt, Human
ugcuguauuuuaaaagaaugauu

SEQ ID NO: 1599820 - RNA, 13 nt, Human
aggaaauauuuau

SEQ ID NO: 1599821 - RNA, 12 nt, Human
aggaaauauuua

SEQ ID NO: 1599822 - RNA, 14 nt, Human
ugcucauggaauug

SEQ ID NO: 1599823 - RNA, 23 nt, Human
agcuuuaucaaagggugaaaauu

SEQ ID NO: 1599824 - RNA, 18 nt, Human
agcccauggcacucuaug

SEQ ID NO: 1599825 - RNA, 17 nt, Human
agcccuucuuuccacag

SEQ ID NO: 1599826 - RNA, 20 nt, Human
agccucauguccacugguuc

SEQ ID NO: 1599827 - RNA, 15 nt, Human
agccucauguccacu

SEQ ID NO: 1599828 - RNA, 22 nt, Human
agccugaaagaggaaugaagua

SEQ ID NO: 1599829 - RNA, 19 nt, Human
agcuacuaauuuuaaaaug

SEQ ID NO: 1599830 - RNA, 17 nt, Human
agcuacuugggaggcug

SEQ ID NO: 1599831 - RNA, 18 nt, Human
agcuacuugggaggcuga

SEQ ID NO: 1599832 - RNA, 20 nt, Human
agccuuggggcugaugcagu

SEQ ID NO: 1599833 - RNA, 19 nt, Human
agccagacuggcacaguuu

SEQ ID NO: 1599834 - RNA, 14 nt, Human
agccagacuggcac

SEQ ID NO: 1599835 - RNA, 15 nt, Human
ugauggugguauguu

SEQ ID NO: 1599836 - RNA, 14 nt, Human
ugaugaucuuuaaa

SEQ ID NO: 1599837 - RNA, 17 nt, Human
ugaugaucuuuaaaaua

SEQ ID NO: 1599838 - RNA, 12 nt, Human
ugauuaaaccaa

SEQ ID NO: 1599839 - RNA, 16 nt, Human
ugauuaccagggacug

SEQ ID NO: 1599840 - RNA, 14 nt, Human
ugauuaccagggac

SEQ ID NO: 1599841 - RNA, 17 nt, Human
ugaugaagaaguugaua

SEQ ID NO: 1599842 - RNA, 23 nt, Human
agcauaaauguugacaugggaca

SEQ ID NO: 1599843 - RNA, 22 nt, Human
ugaguaacugauuuguaacaag

SEQ ID NO: 1599844 - RNA, 18 nt, Human
ugagugucuuaauuaaaa

SEQ ID NO: 1599845 - RNA, 12 nt, Human
ugauaaguaaau

SEQ ID NO: 1599846 - RNA, 19 nt, Human
ugauacgcaacauaauuaa

SEQ ID NO: 1599847 - RNA, 12 nt, Human
ugauaugggucu

SEQ ID NO: 1599848 - RNA, 20 nt, Human
agcaucacaugaacuuguaa

SEQ ID NO: 1599849 - RNA, 17 nt, Human
agcauuguaaaugugcu

SEQ ID NO: 1599850 - RNA, 18 nt, Human
agcauuguaaaugugcuu

SEQ ID NO: 1599851 - RNA, 20 nt, Human
agcaugucgucaaagcugaa

SEQ ID NO: 1599852 - RNA, 17 nt, Human
agcaugucgucaaagcu

SEQ ID NO: 1599853 - RNA, 22 nt, Human
agcauggcauauuuuucacaua

SEQ ID NO: 1599854 - RNA, 21 nt, Human
agcauggcauauuuuucacau

SEQ ID NO: 1599855 - RNA, 19 nt, Human
agcauggcauauuuuucac

SEQ ID NO: 1599856 - RNA, 18 nt, Human
agcauggcauauuuuuca

SEQ ID NO: 1599857 - RNA, 23 nt, Human
agcaacgcaggcccccaggugcc

SEQ ID NO: 1599858 - RNA, 15 nt, Human
agauucccugagcag

SEQ ID NO: 1599859 - RNA, 15 nt, Human
ugacuucuaaguaaa

SEQ ID NO: 1599860 - RNA, 22 nt, Human
ugacuucuaaguaaaaccacag

SEQ ID NO: 1599861 - RNA, 23 nt, Human
ugacuucuaaguaaaaccacagc

SEQ ID NO: 1599862 - RNA, 24 nt, Human
ugacuucuaaguaaaaccacagca

SEQ ID NO: 1599863 - RNA, 16 nt, Human
agaugcaguucugaag

SEQ ID NO: 1599864 - RNA, 17 nt, Human
agaugcaguucugaaga

SEQ ID NO: 1599865 - RNA, 17 nt, Human
ugacacuuaaaaauggu

SEQ ID NO: 1599866 - RNA, 15 nt, Human
agauggaaugcugug

SEQ ID NO: 1599867 - RNA, 13 nt, Human
agauggaaugcug

SEQ ID NO: 1599868 - RNA, 18 nt, Human
agauggaaugcuguguua

SEQ ID NO: 1599869 - RNA, 20 nt, Human
agaguauuuuugacagaaua

SEQ ID NO: 1599870 - RNA, 15 nt, Human
ugaauacuuuauaaa

SEQ ID NO: 1599871 - RNA, 18 nt, Human
agaguauuuuugacagaa

SEQ ID NO: 1599872 - RNA, 17 nt, Human
agaguauuuuugacaga

SEQ ID NO: 1599873 - RNA, 23 nt, Human
ugaaaguacauuuggagacacaa

SEQ ID NO: 1599874 - RNA, 14 nt, Human
ugaaaguacauuug

SEQ ID NO: 1599875 - RNA, 15 nt, Human
agaguauuuuugaca

SEQ ID NO: 1599876 - RNA, 14 nt, Human
agaguauuuuugac

SEQ ID NO: 1599877 - RNA, 19 nt, Human
ugaaacucguuaauuugua

SEQ ID NO: 1599878 - RNA, 22 nt, Human
ugaaacugagaugugaacacau

SEQ ID NO: 1599879 - RNA, 20 nt, Human
ugaaaaucuuauaauuuaaa

SEQ ID NO: 1599880 - RNA, 22 nt, Human
ugaaaaaguucugcagauaaac

SEQ ID NO: 1599881 - RNA, 22 nt, Human
ugaaaaagaccuuuggagcaaa

SEQ ID NO: 1599882 - RNA, 14 nt, Human
agagagaaaauaaa

SEQ ID NO: 1599883 - RNA, 14 nt, Human
agaaucacuugaac

SEQ ID NO: 1599884 - RNA, 15 nt, Human
ucuucacaacagauu

SEQ ID NO: 1599885 - RNA, 21 nt, Human
agacauagaauuaacacauga

SEQ ID NO: 1599886 - RNA, 17 nt, Human
agacaucaacagauaaa

SEQ ID NO: 1599887 - RNA, 18 nt, Human
agacaucaacagauaaau

SEQ ID NO: 1599888 - RNA, 19 nt, Human
agacauucuuccaaaaaga

SEQ ID NO: 1599889 - RNA, 16 nt, Human
agacuauucaaacagu

SEQ ID NO: 1599890 - RNA, 15 nt, Human
agacuauucaaacag

SEQ ID NO: 1599891 - RNA, 12 nt, Human
agacuauucaaa

SEQ ID NO: 1599892 - RNA, 14 nt, Human
agacuauucaaaca

SEQ ID NO: 1599893 - RNA, 15 nt, Human
ucuuuaacucauaaa

SEQ ID NO: 1599894 - RNA, 19 nt, Human
agaagcaccaaucaugaau

SEQ ID NO: 1599895 - RNA, 20 nt, Human
ucugcccauccugccccuga

SEQ ID NO: 1599896 - RNA, 17 nt, Human
agaacucccuuucaaca

SEQ ID NO: 1599897 - RNA, 16 nt, Human
agaacucccuuucaac

SEQ ID NO: 1599898 - RNA, 10 nt, Human
ucuggccuuc

SEQ ID NO: 1599899 - RNA, 13 nt, Human
agaaguugauaug

SEQ ID NO: 1599900 - RNA, 16 nt, Human
agaaggaucuucaucu

SEQ ID NO: 1599901 - RNA, 20 nt, Human
agaaagcagaacagugauua

SEQ ID NO: 1599902 - RNA, 17 nt, Human
agaaagcagaacaguga

SEQ ID NO: 1599903 - RNA, 18 nt, Human
agaaagcagaacagugau

SEQ ID NO: 1599904 - RNA, 18 nt, Human
agaaagacuauucaaaca

SEQ ID NO: 1599905 - RNA, 16 nt, Human
agaaagacuauucaaa

SEQ ID NO: 1599906 - RNA, 16 nt, Human
agaaaacaaggaugaa

SEQ ID NO: 1599907 - RNA, 16 nt, Human
agaaacacaacuauau

SEQ ID NO: 1599908 - RNA, 23 nt, Human
agaaacuuaagguuaccuuuguu

SEQ ID NO: 1599909 - RNA, 15 nt, Human
agaaacauuugguaa

SEQ ID NO: 1599910 - RNA, 23 nt, Human
acugucagcuccccucggagaag

SEQ ID NO: 1599911 - RNA, 22 nt, Human
acugaagaagcaccaaucauga

SEQ ID NO: 1599912 - RNA, 13 nt, Human
acuguggguagac

SEQ ID NO: 1599913 - RNA, 17 nt, Human
ucuaccaaaaaucucaa

SEQ ID NO: 1599914 - RNA, 21 nt, Human
ucuaagauaguaacaaugaag

SEQ ID NO: 1599915 - RNA, 23 nt, Human
acuugaacccgggaggcagaggu

SEQ ID NO: 1599916 - RNA, 17 nt, Human
ucucaaaacugcacugu

SEQ ID NO: 1599917 - RNA, 13 nt, Human
acuucuaaguaaa

SEQ ID NO: 1599918 - RNA, 18 nt, Human
acuucuaaguaaaaccac

SEQ ID NO: 1599919 - RNA, 19 nt, Human
acuucuaaguaaaaccaca

SEQ ID NO: 1599920 - RNA, 21 nt, Human
acuucuaaguaaaaccacagc

SEQ ID NO: 1599921 - RNA, 22 nt, Human
acuucccuuucugcuuguguua

SEQ ID NO: 1599922 - RNA, 14 nt, Human
acuucccuuucugc

SEQ ID NO: 1599923 - RNA, 20 nt, Human
acuuccagauccuggaaauc

SEQ ID NO: 1599924 - RNA, 13 nt, Human
ucuauaauuuaaa

SEQ ID NO: 1599925 - RNA, 17 nt, Human
acuucccagugaauucu

SEQ ID NO: 1599926 - RNA, 18 nt, Human
ucuagcauggcauauuuu

SEQ ID NO: 1599927 - RNA, 17 nt, Human
ucuagcauggcauauuu

SEQ ID NO: 1599928 - RNA, 15 nt, Human
acccgggaggcagag

SEQ ID NO: 1599929 - RNA, 16 nt, Human
acccaaauguucauca

SEQ ID NO: 1599930 - RNA, 20 nt, Human
acccaaauguucaucaauga

SEQ ID NO: 1599931 - RNA, 14 nt, Human
ucagagcugcccuc

SEQ ID NO: 1599932 - RNA, 13 nt, Human
ucagagcugcccu

SEQ ID NO: 1599933 - RNA, 16 nt, Human
ucagagcugcccucuc

SEQ ID NO: 1599934 - RNA, 15 nt, Human
ucagagcugcccucu

SEQ ID NO: 1599935 - RNA, 17 nt, Human
ucagagcugcccucucc

SEQ ID NO: 1599936 - RNA, 18 nt, Human
ucagagcugcccucuccu

SEQ ID NO: 1599937 - RNA, 16 nt, Human
ucacagaccuuugaac

SEQ ID NO: 1599938 - RNA, 12 nt, Human
ucaauuuaaaaa

SEQ ID NO: 1599939 - RNA, 13 nt, Human
ucaauuuaaaaaa

SEQ ID NO: 1599940 - RNA, 17 nt, Human
ucacagccagacuggca

SEQ ID NO: 1599941 - RNA, 23 nt, Human
ucacagccagacuggcacaguuu

SEQ ID NO: 1599942 - RNA, 14 nt, Human
ucacaggaaguaga

SEQ ID NO: 1599943 - RNA, 16 nt, Human
accacaagacugcaca

SEQ ID NO: 1599944 - RNA, 14 nt, Human
accaacacgagcag

SEQ ID NO: 1599945 - RNA, 19 nt, Human
accaacacgagcaggcuac

SEQ ID NO: 1599946 - RNA, 23 nt, Human
accaaaaaucucaauauuucaga

SEQ ID NO: 1599947 - RNA, 18 nt, Human
accaaauaaaaauauugu

SEQ ID NO: 1599948 - RNA, 16 nt, Human
accaaauaaaaauauu

SEQ ID NO: 1599949 - RNA, 23 nt, Human
ucaauauuucagauaaucacaau

SEQ ID NO: 1599950 - RNA, 21 nt, Human
acauuguaaauaguauuugag

SEQ ID NO: 1599951 - RNA, 19 nt, Human
acauuguaaauaguauuug

SEQ ID NO: 1599952 - RNA, 17 nt, Human
acauuguaaauaguauu

SEQ ID NO: 1599953 - RNA, 19 nt, Human
acauuguacgaagaguauu

SEQ ID NO: 1599954 - RNA, 16 nt, Human
acaugagguacugaga

SEQ ID NO: 1599955 - RNA, 13 nt, Human
ucaaacagucuca

SEQ ID NO: 1599956 - RNA, 20 nt, Human
ucaaacagucucaggaaauc

SEQ ID NO: 1599957 - RNA, 21 nt, Human
ucaaacagucucaggaaauca

SEQ ID NO: 1599958 - RNA, 19 nt, Human
uauuuuuguagcacugaca

SEQ ID NO: 1599959 - RNA, 15 nt, Human
uauuuuuguagcacu

SEQ ID NO: 1599960 - RNA, 19 nt, Human
uauuuuaauaauguuucaa

SEQ ID NO: 1599961 - RNA, 22 nt, Human
uauuuuaauaauguuucaaaca

SEQ ID NO: 1599962 - RNA, 13 nt, Human
uauuuuuguagca

SEQ ID NO: 1599963 - RNA, 13 nt, Human
uauuuuucacaua

SEQ ID NO: 1599964 - RNA, 12 nt, Human
uauuuuucacau

SEQ ID NO: 1599965 - RNA, 16 nt, Human
uauuuuguucauacau

SEQ ID NO: 1599966 - RNA, 15 nt, Human
uauuuuguucauaca

SEQ ID NO: 1599967 - RNA, 14 nt, Human
uauuuuaaaagaau

SEQ ID NO: 1599968 - RNA, 18 nt, Human
uauuuuaaaagaaugauu

SEQ ID NO: 1599969 - RNA, 17 nt, Human
uauguguaaaaugugaa

SEQ ID NO: 1599970 - RNA, 14 nt, Human
uauguguaaaaugu

SEQ ID NO: 1599971 - RNA, 20 nt, Human
acuagaguuuagcuggaaaa

SEQ ID NO: 1599972 - RNA, 13 nt, Human
acuauucaaacag

SEQ ID NO: 1599973 - RNA, 14 nt, Human
acuauucaaacagu

SEQ ID NO: 1599974 - RNA, 16 nt, Human
acuauucaaacagucu

SEQ ID NO: 1599975 - RNA, 18 nt, Human
acuauucaaacagucuca

SEQ ID NO: 1599976 - RNA, 22 nt, Human
acuaugacauaaaaacaacuuu

SEQ ID NO: 1599977 - RNA, 24 nt, Human
uccccuccucugcuugccaucccu

SEQ ID NO: 1599978 - RNA, 18 nt, Human
uccccuccucugcuugcc

SEQ ID NO: 1599979 - RNA, 15 nt, Human
uccccuccucugcuu

SEQ ID NO: 1599980 - RNA, 19 nt, Human
ucccuccaccucccugcaa

SEQ ID NO: 1599981 - RNA, 17 nt, Human
ucccuccaccucccugc

SEQ ID NO: 1599982 - RNA, 15 nt, Human
ucccuccaccucccu

SEQ ID NO: 1599983 - RNA, 14 nt, Human
ucccuccaccuccc

SEQ ID NO: 1599984 - RNA, 21 nt, Human
acuccaaacugacucuuaaga

SEQ ID NO: 1599985 - RNA, 14 nt, Human
acucagaauauugc

SEQ ID NO: 1599986 - RNA, 14 nt, Human
acuccagaaaguga

SEQ ID NO: 1599987 - RNA, 18 nt, Human
acuccagaaagugacaag

SEQ ID NO: 1599988 - RNA, 17 nt, Human
uccucuccccaugaugu

SEQ ID NO: 1599989 - RNA, 21 nt, Human
uccugaaaacccuugccaugu

SEQ ID NO: 1599990 - RNA, 22 nt, Human
uccugaaaacccuugccaugug

SEQ ID NO: 1599991 - RNA, 13 nt, Human
acugaaacuuccc

SEQ ID NO: 1599992 - RNA, 14 nt, Human
uccagugagacagc

SEQ ID NO: 1599993 - RNA, 11 nt, Human
uccauccugag

SEQ ID NO: 1599994 - RNA, 22 nt, Human
uccaugaagauguagaggagaa

SEQ ID NO: 1599995 - RNA, 17 nt, Human
acgcucucuggccuucg

SEQ ID NO: 1599996 - RNA, 15 nt, Human
acgcucucuggccuu

SEQ ID NO: 1599997 - RNA, 16 nt, Human
acgcucucuggccuuc

SEQ ID NO: 1599998 - RNA, 20 nt, Human
acgaagaguauuuuugacag

SEQ ID NO: 1599999 - RNA, 22 nt, Human
acgaagaguauuuuugacagaa

SEQ ID NO: 1600000 - RNA, 16 nt, Human
ucauaauaaguugcau

SEQ ID NO: 1600001 - RNA, 12 nt, Human
accugagcccca

SEQ ID NO: 1600002 - RNA, 17 nt, Human
accugagccccaaaagg

SEQ ID NO: 1600003 - RNA, 19 nt, Human
uccaaaaagauuuucagaa

SEQ ID NO: 1600004 - RNA, 20 nt, Human
uccaaaaagauuuucagaaa

SEQ ID NO: 1600005 - RNA, 15 nt, Human
uagaaacacaacuau

SEQ ID NO: 1600006 - RNA, 17 nt, Human
uagaacucccuuucaac

SEQ ID NO: 1600007 - RNA, 18 nt, Human
uagaacucccuuucaaca

SEQ ID NO: 1600008 - RNA, 16 nt, Human
uagaacucccuuucaa

SEQ ID NO: 1600009 - RNA, 17 nt, Human
aauuccaauuauaugag

SEQ ID NO: 1600010 - RNA, 13 nt, Human
uagacacacauga

SEQ ID NO: 1600011 - RNA, 16 nt, Human
aauuuggauugcuaau

SEQ ID NO: 1600012 - RNA, 13 nt, Human
acaaaaacacagc

SEQ ID NO: 1600013 - RNA, 16 nt, Human
acaaaaacacagcaag

SEQ ID NO: 1600014 - RNA, 14 nt, Human
acaaaaacacagca

SEQ ID NO: 1600015 - RNA, 15 nt, Human
acaaaaacacagcaa

SEQ ID NO: 1600016 - RNA, 14 nt, Human
uagaggguguguaa

SEQ ID NO: 1600017 - RNA, 19 nt, Human
uagcacugacagauuucca

SEQ ID NO: 1600018 - RNA, 14 nt, Human
uagcacugacagau

SEQ ID NO: 1600019 - RNA, 13 nt, Human
acacaacuauauu

SEQ ID NO: 1600020 - RNA, 13 nt, Human
uaggauguugaaa

SEQ ID NO: 1600021 - RNA, 15 nt, Human
uaugccccauucaac

SEQ ID NO: 1600022 - RNA, 19 nt, Human
acagcccuucuuuccacag

SEQ ID NO: 1600023 - RNA, 14 nt, Human
acagcuguaugauu

SEQ ID NO: 1600024 - RNA, 19 nt, Human
acagcuguaugauucccag

SEQ ID NO: 1600025 - RNA, 20 nt, Human
acagcuguaugauucccagc

SEQ ID NO: 1600026 - RNA, 23 nt, Human
acagcuguaugauucccagccag

SEQ ID NO: 1600027 - RNA, 22 nt, Human
acaggaaccacaagacugcaca

SEQ ID NO: 1600028 - RNA, 13 nt, Human
acacucaaaucaa

SEQ ID NO: 1600029 - RNA, 18 nt, Human
acacucaaaucaagaaac

SEQ ID NO: 1600030 - RNA, 17 nt, Human
acacucaaaucaagaaa

SEQ ID NO: 1600031 - RNA, 21 nt, Human
uauacaggucauauuaauaua

SEQ ID NO: 1600032 - RNA, 16 nt, Human
uauacaggucauauua

SEQ ID NO: 1600033 - RNA, 15 nt, Human
uauacaggucauauu

SEQ ID NO: 1600034 - RNA, 16 nt, Human
uauaggugcuacaaaa

SEQ ID NO: 1600035 - RNA, 12 nt, Human
uauaggaauuga

SEQ ID NO: 1600036 - RNA, 16 nt, Human
acacucaguuguucaa

SEQ ID NO: 1600037 - RNA, 20 nt, Human
uauauccuuucuaacaaaaa

SEQ ID NO: 1600038 - RNA, 14 nt, Human
uaucacaaaucuua

SEQ ID NO: 1600039 - RNA, 16 nt, Human
uaucacaaaucuuaac

SEQ ID NO: 1600040 - RNA, 20 nt, Human
uaucacaaaucuuaacuuga

SEQ ID NO: 1600041 - RNA, 14 nt, Human
acagaccuuugaac

SEQ ID NO: 1600042 - RNA, 19 nt, Human
uaucaaagggugaaaauua

SEQ ID NO: 1600043 - RNA, 18 nt, Human
uaucaaagggugaaaauu

SEQ ID NO: 1600044 - RNA, 22 nt, Human
uaucaaagggugaaaauuauuu

SEQ ID NO: 1600045 - RNA, 13 nt, Human
aauguucaucaau

SEQ ID NO: 1600046 - RNA, 16 nt, Human
aauguucaucaaugaa

SEQ ID NO: 1600047 - RNA, 20 nt, Human
aauguucaucaaugaaugaa

SEQ ID NO: 1600048 - RNA, 19 nt, Human
uaccagggacugaggggag

SEQ ID NO: 1600049 - RNA, 13 nt, Human
aauuacauuugua

SEQ ID NO: 1600050 - RNA, 14 nt, Human
aauuacauuuguau

SEQ ID NO: 1600051 - RNA, 21 nt, Human
aauucagaaggaucuucaucu

SEQ ID NO: 1600052 - RNA, 20 nt, Human
aauucaagaaaacaacuuca

SEQ ID NO: 1600053 - RNA, 12 nt, Human
aauucaagaaaa

SEQ ID NO: 1600054 - RNA, 17 nt, Human
uacagagacagaaagca

SEQ ID NO: 1600055 - RNA, 20 nt, Human
aauguaagggaaacugccag

SEQ ID NO: 1600056 - RNA, 22 nt, Human
aaugcuguauuuuaaaagaaug

SEQ ID NO: 1600057 - RNA, 20 nt, Human
aaugcuguauuuuaaaagaa

SEQ ID NO: 1600058 - RNA, 21 nt, Human
aaugcuguauuuuaaaagaau

SEQ ID NO: 1600059 - RNA, 21 nt, Human
uacaaaaaaaaaaaaaaauua

SEQ ID NO: 1600060 - RNA, 22 nt, Human
aaugagagacacacugaagaag

SEQ ID NO: 1600061 - RNA, 20 nt, Human
aaugacucagaauauugcuu

SEQ ID NO: 1600062 - RNA, 16 nt, Human
aaugauuucauucaau

SEQ ID NO: 1600063 - RNA, 22 nt, Human
uaauuccguagguuauuuucag

SEQ ID NO: 1600064 - RNA, 19 nt, Human
uaauuuuuauauuugaaau

SEQ ID NO: 1600065 - RNA, 21 nt, Human
uaauuuuuauauuugaaauau

SEQ ID NO: 1600066 - RNA, 18 nt, Human
uaauuuuuauauuugaaa

SEQ ID NO: 1600067 - RNA, 16 nt, Human
uaauuuauacagguca

SEQ ID NO: 1600068 - RNA, 15 nt, Human
aauauuuauuuuaau

SEQ ID NO: 1600069 - RNA, 16 nt, Human
aaucagccuaguugau

SEQ ID NO: 1600070 - RNA, 15 nt, Human
uaagcaaaaugugau

SEQ ID NO: 1600071 - RNA, 21 nt, Human
uaagcaaaaugugauauguac

SEQ ID NO: 1600072 - RNA, 14 nt, Human
uaagcaaaauguga

SEQ ID NO: 1600073 - RNA, 14 nt, Human
aaucagugugucua

SEQ ID NO: 1600074 - RNA, 13 nt, Human
uaaguaaaaccac

SEQ ID NO: 1600075 - RNA, 15 nt, Human
uaaguaaaaccacag

SEQ ID NO: 1600076 - RNA, 16 nt, Human
uaaguaaaaccacagc

SEQ ID NO: 1600077 - RNA, 17 nt, Human
uaaguaaaaccacagca

SEQ ID NO: 1600078 - RNA, 18 nt, Human
uaaguaaaaccacagcag

SEQ ID NO: 1600079 - RNA, 19 nt, Human
uaaguaaaaccacagcagu

SEQ ID NO: 1600080 - RNA, 20 nt, Human
uaaguaaugauaacuggaaa

SEQ ID NO: 1600081 - RNA, 16 nt, Human
uaaguaauucaagaaa

SEQ ID NO: 1600082 - RNA, 22 nt, Human
aaucagugugucuaaauuugaa

SEQ ID NO: 1600083 - RNA, 18 nt, Human
aaucagugugucuaaauu

SEQ ID NO: 1600084 - RNA, 17 nt, Human
aaucagugugucuaaau

SEQ ID NO: 1600085 - RNA, 13 nt, Human
uaacaaugcugua

SEQ ID NO: 1600086 - RNA, 17 nt, Human
uaacaaugaagauaaaa

SEQ ID NO: 1600087 - RNA, 23 nt, Human
aauaccacaggaaccacaagacu

SEQ ID NO: 1600088 - RNA, 18 nt, Human
aauaccaugccauuuaaa

SEQ ID NO: 1600089 - RNA, 23 nt, Human
aauacaucccuuaccugggaaag

SEQ ID NO: 1600090 - RNA, 22 nt, Human
aauagagcaaaauugauguguu

SEQ ID NO: 1600091 - RNA, 20 nt, Human
aauagagcaaaauugaugug

SEQ ID NO: 1600092 - RNA, 13 nt, Human
uaagaagugaaaa

SEQ ID NO: 1600093 - RNA, 21 nt, Human
uaacuuccuuggacucauuuu

SEQ ID NO: 1600094 - RNA, 14 nt, Human
aauauauuuaauga

SEQ ID NO: 1600095 - RNA, 19 nt, Human
aauagucaaauugugugaa

SEQ ID NO: 1600096 - RNA, 16 nt, Human
aagcauuuagauguau

SEQ ID NO: 1600097 - RNA, 18 nt, Human
aagcauuguaaaugugcu

SEQ ID NO: 1600098 - RNA, 13 nt, Human
aagcauuguaaau

SEQ ID NO: 1600099 - RNA, 13 nt, Human
aagcuccagguag

SEQ ID NO: 1600100 - RNA, 14 nt, Human
aagcuccagguaga

SEQ ID NO: 1600101 - RNA, 20 nt, Human
aagcucacagaccuuugaac

SEQ ID NO: 1600102 - RNA, 22 nt, Human
aagccugcaauuucauaugcug

SEQ ID NO: 1600103 - RNA, 17 nt, Human
aagccugcaauuucaua

SEQ ID NO: 1600104 - RNA, 18 nt, Human
guuauugauaaguucaua

SEQ ID NO: 1600105 - RNA, 13 nt, Human
aagaugaaaauau

SEQ ID NO: 1600106 - RNA, 14 nt, Human
aagaugaaaauauu

SEQ ID NO: 1600107 - RNA, 21 nt, Human
gugugaccacugcagaagaca

SEQ ID NO: 1600108 - RNA, 13 nt, Human
aagauguagagga

SEQ ID NO: 1600109 - RNA, 19 nt, Human
aagauguagaggagaaacu

SEQ ID NO: 1600110 - RNA, 23 nt, Human
aagaggaaugaaguacucauaca

SEQ ID NO: 1600111 - RNA, 16 nt, Human
aagacugcacaucaaa

SEQ ID NO: 1600112 - RNA, 17 nt, Human
aagacugcauuauauuu

SEQ ID NO: 1600113 - RNA, 21 nt, Human
aagaccuuuggagcaaagcug

SEQ ID NO: 1600114 - RNA, 23 nt, Human
aagaccuugcuuaugauugcaga

SEQ ID NO: 1600115 - RNA, 12 nt, Human
uaaaagaaugau

SEQ ID NO: 1600116 - RNA, 23 nt, Human
uaaaagaauauuuuaacuuccuu

SEQ ID NO: 1600117 - RNA, 20 nt, Human
uaaaagacagugaaagaaaa

SEQ ID NO: 1600118 - RNA, 20 nt, Human
uaaaauaauuuuuauauuug

SEQ ID NO: 1600119 - RNA, 13 nt, Human
aaguauuagaaua

SEQ ID NO: 1600120 - RNA, 14 nt, Human
aaguaaugauaacu

SEQ ID NO: 1600121 - RNA, 19 nt, Human
aaguaaugauaacuggaaa

SEQ ID NO: 1600122 - RNA, 16 nt, Human
aagucuuucacauuua

SEQ ID NO: 1600123 - RNA, 12 nt, Human
guuucaaacuuu

SEQ ID NO: 1600124 - RNA, 14 nt, Human
aagguacuucaaau

SEQ ID NO: 1600125 - RNA, 19 nt, Human
aagggugaugggaaagcau

SEQ ID NO: 1600126 - RNA, 16 nt, Human
aagggugaaaauuauu

SEQ ID NO: 1600127 - RNA, 15 nt, Human
aagggugaaaauuau

SEQ ID NO: 1600128 - RNA, 15 nt, Human
guauaaaauaauuuu

SEQ ID NO: 1600129 - RNA, 21 nt, Human
guauaaaauaauuuuuauauu

SEQ ID NO: 1600130 - RNA, 16 nt, Human
guauauuuuauaucaa

SEQ ID NO: 1600131 - RNA, 20 nt, Human
guaguguuggagaagaacug

SEQ ID NO: 1600132 - RNA, 16 nt, Human
aaauguaagggaaacu

SEQ ID NO: 1600133 - RNA, 14 nt, Human
aaauggguuuuacu

SEQ ID NO: 1600134 - RNA, 15 nt, Human
aaauggguuuuacug

SEQ ID NO: 1600135 - RNA, 18 nt, Human
guauguacuucaugcugu

SEQ ID NO: 1600136 - RNA, 15 nt, Human
guauuuuugacagaa

SEQ ID NO: 1600137 - RNA, 12 nt, Human
guauuuuugaca

SEQ ID NO: 1600138 - RNA, 16 nt, Human
guauuuuugacagaau

SEQ ID NO: 1600139 - RNA, 17 nt, Human
aacacaacuauauuguu

SEQ ID NO: 1600140 - RNA, 15 nt, Human
aacacagcaagggug

SEQ ID NO: 1600141 - RNA, 18 nt, Human
aacacagcaagggugaug

SEQ ID NO: 1600142 - RNA, 15 nt, Human
aacagugauuaccag

SEQ ID NO: 1600143 - RNA, 22 nt, Human
aacagugauuaccagggacuga

SEQ ID NO: 1600144 - RNA, 13 nt, Human
aacagauaaucag

SEQ ID NO: 1600145 - RNA, 17 nt, Human
aacaaugcuguauuuua

SEQ ID NO: 1600146 - RNA, 22 nt, Human
aacaaugcuguauuuuaaaaga

SEQ ID NO: 1600147 - RNA, 15 nt, Human
aacacaacuauauug

SEQ ID NO: 1600148 - RNA, 16 nt, Human
aacacaacuauauugu

SEQ ID NO: 1600149 - RNA, 12 nt, Human
aacaauaaaaga

SEQ ID NO: 1600150 - RNA, 14 nt, Human
aacaaugcuguauu

SEQ ID NO: 1600151 - RNA, 15 nt, Human
aacaaugcuguauuu

SEQ ID NO: 1600152 - RNA, 20 nt, Human
aaauuuuuucucuaggaaau

SEQ ID NO: 1600153 - RNA, 19 nt, Human
aacaagaugguucuagcau

SEQ ID NO: 1600154 - RNA, 20 nt, Human
aaccugagccccaaaaggua

SEQ ID NO: 1600155 - RNA, 16 nt, Human
gucuuucacauuuaaa

SEQ ID NO: 1600156 - RNA, 21 nt, Human
aacuagaguuuagcuggaaaa

SEQ ID NO: 1600157 - RNA, 18 nt, Human
aaccuugaaaacuuuaug

SEQ ID NO: 1600158 - RNA, 18 nt, Human
aacccaaguccaagcaua

SEQ ID NO: 1600159 - RNA, 23 nt, Human
aacccaaauguucaucaaugaau

SEQ ID NO: 1600160 - RNA, 16 nt, Human
aacccgggaggcagag

SEQ ID NO: 1600161 - RNA, 18 nt, Human
aaccugagccccaaaagg

SEQ ID NO: 1600162 - RNA, 17 nt, Human
aacugggacaggggaga

SEQ ID NO: 1600163 - RNA, 19 nt, Human
aacuggacugguucaaaug

SEQ ID NO: 1600164 - RNA, 19 nt, Human
aacugcacugucaagauga

SEQ ID NO: 1600165 - RNA, 21 nt, Human
gugagaugcuagaacucccuu

SEQ ID NO: 1600166 - RNA, 12 nt, Human
aacugaaaucau

SEQ ID NO: 1600167 - RNA, 13 nt, Human
aacugaaaucaua

SEQ ID NO: 1600168 - RNA, 17 nt, Human
gugaugggaaagcauug

SEQ ID NO: 1600169 - RNA, 18 nt, Human
aacuuccagauccuggaa

SEQ ID NO: 1600170 - RNA, 18 nt, Human
aacuucccagugaauucu

SEQ ID NO: 1600171 - RNA, 20 nt, Human
cacaagaaaugaaagcaggg

SEQ ID NO: 1600172 - RNA, 21 nt, Human
cacaagaaaugaaagcaggga

SEQ ID NO: 1600173 - RNA, 18 nt, Human
cacaagaaaugaaagcag

SEQ ID NO: 1600174 - RNA, 22 nt, Human
caaugugacuuaaugccacuaa

SEQ ID NO: 1600175 - RNA, 21 nt, Human
caauaucuuuuuuuuaauaaa

SEQ ID NO: 1600176 - RNA, 22 nt, Human
caauuuuucuuauuucauuucu

SEQ ID NO: 1600177 - RNA, 17 nt, Human
cacagccagacuggcac

SEQ ID NO: 1600178 - RNA, 18 nt, Human
cacagccagacuggcaca

SEQ ID NO: 1600179 - RNA, 21 nt, Human
cacagcaguugaaaagacucc

SEQ ID NO: 1600180 - RNA, 19 nt, Human
cacagcaguugaaaagacu

SEQ ID NO: 1600181 - RNA, 13 nt, Human
cacacugaagaag

SEQ ID NO: 1600182 - RNA, 14 nt, Human
cacacugaagaagc

SEQ ID NO: 1600183 - RNA, 20 nt, Human
caaggaaaaaauaacaauga

SEQ ID NO: 1600184 - RNA, 18 nt, Human
caaggaaaaaauaacaau

SEQ ID NO: 1600185 - RNA, 23 nt, Human
caagggugaugggaaagcauugu

SEQ ID NO: 1600186 - RNA, 21 nt, Human
caagggugaugggaaagcauu

SEQ ID NO: 1600187 - RNA, 17 nt, Human
caauagucaaauugugu

SEQ ID NO: 1600188 - RNA, 19 nt, Human
caauagucaaauuguguga

SEQ ID NO: 1600189 - RNA, 19 nt, Human
caauaauaaauauuuuugc

SEQ ID NO: 1600190 - RNA, 17 nt, Human
caaacugacucuuaaga

SEQ ID NO: 1600191 - RNA, 21 nt, Human
caaacugacucuuaagaagac

SEQ ID NO: 1600192 - RNA, 16 nt, Human
caaacugacucuuaag

SEQ ID NO: 1600193 - RNA, 14 nt, Human
caaaacugcacugu

SEQ ID NO: 1600194 - RNA, 17 nt, Human
caaaacugcacugucaa

SEQ ID NO: 1600195 - RNA, 18 nt, Human
caaaacugcacugucaag

SEQ ID NO: 1600196 - RNA, 22 nt, Human
caaaauaauuuuaagaaaucaa

SEQ ID NO: 1600197 - RNA, 18 nt, Human
caaaauaauuuuaagaaa

SEQ ID NO: 1600198 - RNA, 17 nt, Human
caagaaaugaaagcagg

SEQ ID NO: 1600199 - RNA, 19 nt, Human
caagaaaugaaagcaggga

SEQ ID NO: 1600200 - RNA, 14 nt, Human
caaauaugcaaagc

SEQ ID NO: 1600201 - RNA, 13 nt, Human
caaauaugcaaag

SEQ ID NO: 1600202 - RNA, 12 nt, Human
caaauaugcaaa

SEQ ID NO: 1600203 - RNA, 20 nt, Human
caaauguucaucaaugaaug

SEQ ID NO: 1600204 - RNA, 18 nt, Human
caaauguucaucaaugaa

SEQ ID NO: 1600205 - RNA, 14 nt, Human
caaauguucaucaa

SEQ ID NO: 1600206 - RNA, 18 nt, Human
caaauaaaaauauugugu

SEQ ID NO: 1600207 - RNA, 16 nt, Human
caaauaaaaauauugu

SEQ ID NO: 1600208 - RNA, 15 nt, Human
caaauaaaaauauug

SEQ ID NO: 1600209 - RNA, 19 nt, Human
caaagagagaaaauaaaga

SEQ ID NO: 1600210 - RNA, 16 nt, Human
caaagagagaaaauaa

SEQ ID NO: 1600211 - RNA, 16 nt, Human
uuaauaauguuucaaa

SEQ ID NO: 1600212 - RNA, 20 nt, Human
uuacauuuguauaaaauaau

SEQ ID NO: 1600213 - RNA, 20 nt, Human
uuacagagacagaaagcaga

SEQ ID NO: 1600214 - RNA, 13 nt, Human
uuacauuguaaau

SEQ ID NO: 1600215 - RNA, 12 nt, Human
uuacauuguaaa

SEQ ID NO: 1600216 - RNA, 16 nt, Human
uuaaugauaaguaaau

SEQ ID NO: 1600217 - RNA, 17 nt, Human
uuaaugauaaguaaaug

SEQ ID NO: 1600218 - RNA, 18 nt, Human
uuaaaauacacacucaaa

SEQ ID NO: 1600219 - RNA, 19 nt, Human
uuaaaauacacacucaaau

SEQ ID NO: 1600220 - RNA, 22 nt, Human
uuaaaaaaaaaccugagcccca

SEQ ID NO: 1600221 - RNA, 19 nt, Human
uguuuccauauuuuauagg

SEQ ID NO: 1600222 - RNA, 20 nt, Human
uguugacaugggacauuugc

SEQ ID NO: 1600223 - RNA, 17 nt, Human
uguuuaaaaucauuucu

SEQ ID NO: 1600224 - RNA, 18 nt, Human
uguuuaaaaucauuucug

SEQ ID NO: 1600225 - RNA, 14 nt, Human
uguuggagaagaac

SEQ ID NO: 1600226 - RNA, 16 nt, Human
uguuggagaagaacug

SEQ ID NO: 1600227 - RNA, 17 nt, Human
uguuggagaagaacuga

SEQ ID NO: 1600228 - RNA, 19 nt, Human
uguuggagaagaacugaaa

SEQ ID NO: 1600229 - RNA, 20 nt, Human
uguuggagaagaacugaaau

SEQ ID NO: 1600230 - RNA, 21 nt, Human
ugugugaaagguacuucaaau

SEQ ID NO: 1600231 - RNA, 22 nt, Human
ugugugaaagguacuucaaauc

SEQ ID NO: 1600232 - RNA, 13 nt, Human
uguguuuugcaag

SEQ ID NO: 1600233 - RNA, 19 nt, Human
uguguuuugcaagccagau

SEQ ID NO: 1600234 - RNA, 21 nt, Human
uguuaaaagaugaaaauauuu

SEQ ID NO: 1600235 - RNA, 14 nt, Human
uguuagugcaaauu

SEQ ID NO: 1600236 - RNA, 23 nt, Human
uguucauacauauuuuuguagca

SEQ ID NO: 1600237 - RNA, 14 nt, Human
uguucauacauauu

SEQ ID NO: 1600238 - RNA, 12 nt, Human
uguucauacaua

SEQ ID NO: 1600239 - RNA, 19 nt, Human
ugugcuaguaauuggaaag

SEQ ID NO: 1600240 - RNA, 21 nt, Human
ugugaauguugugauguauuc

SEQ ID NO: 1600241 - RNA, 18 nt, Human
ugugaagugaaugaaaca

SEQ ID NO: 1600242 - RNA, 15 nt, Human
uguaugauucccagc

SEQ ID NO: 1600243 - RNA, 16 nt, Human
uguaugauucccagcc

SEQ ID NO: 1600244 - RNA, 14 nt, Human
uguaaucacagcua

SEQ ID NO: 1600245 - RNA, 17 nt, Human
uggucacaggaaguaga

SEQ ID NO: 1600246 - RNA, 16 nt, Human
uguaccgcaaugugac

SEQ ID NO: 1600247 - RNA, 22 nt, Human
uguaguguuggagaagaacuga

SEQ ID NO: 1600248 - RNA, 14 nt, Human
uguacgaagaguau

SEQ ID NO: 1600249 - RNA, 22 nt, Human
uguacgaagaguauuuuugaca

SEQ ID NO: 1600250 - RNA, 20 nt, Human
ugccacuaaauugacacuua

SEQ ID NO: 1600251 - RNA, 18 nt, Human
ugccaaauauaaauaaaa

SEQ ID NO: 1600252 - RNA, 17 nt, Human
ugccaaauauaaauaaa

SEQ ID NO: 1600253 - RNA, 22 nt, Human
ugccaaauauaaauaaaaauaa

SEQ ID NO: 1600254 - RNA, 19 nt, Human
ugccaaauauaaauaaaaa

SEQ ID NO: 1600255 - RNA, 12 nt, Human
ugccaucccucc

SEQ ID NO: 1600256 - RNA, 11 nt, Human
ugccaucccuc

SEQ ID NO: 1600257 - RNA, 14 nt, Human
ugccaucccucccu

SEQ ID NO: 1600258 - RNA, 16 nt, Human
ugcacugucaagauga

SEQ ID NO: 1600259 - RNA, 15 nt, Human
ugcaguucugaagaa

SEQ ID NO: 1600260 - RNA, 16 nt, Human
ugcaguucugaagaag

SEQ ID NO: 1600261 - RNA, 17 nt, Human
ugcaguucugaagaaga

SEQ ID NO: 1600262 - RNA, 18 nt, Human
ugcaguucugaagaagau

SEQ ID NO: 1600263 - RNA, 19 nt, Human
ugcaguucugaagaagaug

SEQ ID NO: 1600264 - RNA, 22 nt, Human
ugcaguucugaagaagauggua

SEQ ID NO: 1600265 - RNA, 15 nt, Human
ugcuaagcauuccaa

SEQ ID NO: 1600266 - RNA, 19 nt, Human
ugcuaagcauuccaacuau

SEQ ID NO: 1600267 - RNA, 18 nt, Human
ugccuguaaucacagcua

SEQ ID NO: 1600268 - RNA, 15 nt, Human
ugccuucucaacucc

SEQ ID NO: 1600269 - RNA, 17 nt, Human
ugccuucucaacuccaa

SEQ ID NO: 1600270 - RNA, 16 nt, Human
uggcuuccuggcaaua

SEQ ID NO: 1600271 - RNA, 21 nt, Human
uggcuugaguuuaaauuguaa

SEQ ID NO: 1600272 - RNA, 11 nt, Human
uggagggaagc

SEQ ID NO: 1600273 - RNA, 23 nt, Human
uggaaacuucagcgguuuauaua

SEQ ID NO: 1600274 - RNA, 20 nt, Human
uggaacauaaaauacaaugu

SEQ ID NO: 1600275 - RNA, 21 nt, Human
uggaacauaaaauacaauguu

SEQ ID NO: 1600276 - RNA, 22 nt, Human
uggaauaauccuaaacauauga

SEQ ID NO: 1600277 - RNA, 16 nt, Human
uggaaugcuguguuaa

SEQ ID NO: 1600278 - RNA, 17 nt, Human
uccucugcuugccaucc

SEQ ID NO: 1600279 - RNA, 16 nt, Human
uccucugcuugccauc

SEQ ID NO: 1600280 - RNA, 15 nt, Human
uccucugcuugccau

SEQ ID NO: 1600281 - RNA, 14 nt, Human
uccucugcuugcca

SEQ ID NO: 1600282 - RNA, 19 nt, Human
uccucugcuugccaucccu

SEQ ID NO: 1600283 - RNA, 15 nt, Human
uccugaggcuccacu

SEQ ID NO: 1600284 - RNA, 16 nt, Human
uccugaggcuccacuu

SEQ ID NO: 1600285 - RNA, 17 nt, Human
uccugaggcuccacuug

SEQ ID NO: 1600286 - RNA, 20 nt, Human
uccucaaaacuucagacaua

SEQ ID NO: 1600287 - RNA, 15 nt, Human
ucggccuccauccug

SEQ ID NO: 1600288 - RNA, 16 nt, Human
ucggccuccauccuga

SEQ ID NO: 1600289 - RNA, 17 nt, Human
ucggccuccauccugag

SEQ ID NO: 1600290 - RNA, 17 nt, Human
uccuugcaucaauuuuu

SEQ ID NO: 1600291 - RNA, 12 nt, Human
ucuacuaaaaau

SEQ ID NO: 1600292 - RNA, 15 nt, Human
ucuacuaaaaauaca

SEQ ID NO: 1600293 - RNA, 19 nt, Human
ucuacuaaaaauacaaaaa

SEQ ID NO: 1600294 - RNA, 22 nt, Human
ucucauaauuuauacaggucau

SEQ ID NO: 1600295 - RNA, 16 nt, Human
ucucauaauuuauaca

SEQ ID NO: 1600296 - RNA, 12 nt, Human
uccauacauuug

SEQ ID NO: 1600297 - RNA, 21 nt, Human
ucauggaauuggagcucgugg

SEQ ID NO: 1600298 - RNA, 19 nt, Human
ucauggaauuggagcucgu

SEQ ID NO: 1600299 - RNA, 18 nt, Human
ucaguccaugaagaugua

SEQ ID NO: 1600300 - RNA, 19 nt, Human
ucagugugucuaaauuuga

SEQ ID NO: 1600301 - RNA, 22 nt, Human
ucagcuccccucggagaagagc

SEQ ID NO: 1600302 - RNA, 16 nt, Human
ucagcugcugaaacaa

SEQ ID NO: 1600303 - RNA, 22 nt, Human
ucaggagaguagaacagauaau

SEQ ID NO: 1600304 - RNA, 14 nt, Human
ucugucucagucca

SEQ ID NO: 1600305 - RNA, 23 nt, Human
ucucauaauuuauacaggucaua

SEQ ID NO: 1600306 - RNA, 17 nt, Human
ucuuuccacagaagcuc

SEQ ID NO: 1600307 - RNA, 19 nt, Human
ugaaaauuauuuuguucau

SEQ ID NO: 1600308 - RNA, 23 nt, Human
ugaaaauuauuuuguucauacau

SEQ ID NO: 1600309 - RNA, 22 nt, Human
ugaaaauuauuuuguucauaca

SEQ ID NO: 1600310 - RNA, 23 nt, Human
ugaaacacucaguuguucaauaa

SEQ ID NO: 1600311 - RNA, 14 nt, Human
ucuuauaauuuaaa

SEQ ID NO: 1600312 - RNA, 13 nt, Human
ucuuauaauuuaa

SEQ ID NO: 1600313 - RNA, 16 nt, Human
ucuucuuggucucagu

SEQ ID NO: 1600314 - RNA, 18 nt, Human
ucuuguagcuuuaucaaa

SEQ ID NO: 1600315 - RNA, 19 nt, Human
ucuugccaaauauaaauaa

SEQ ID NO: 1600316 - RNA, 19 nt, Human
ucuugaaggaaaaugauac

SEQ ID NO: 1600317 - RNA, 14 nt, Human
ugacucuuaagaag

SEQ ID NO: 1600318 - RNA, 15 nt, Human
ugacucuuaagaaga

SEQ ID NO: 1600319 - RNA, 16 nt, Human
ugacucuuaagaagac

SEQ ID NO: 1600320 - RNA, 15 nt, Human
ugagaaagacuauuc

SEQ ID NO: 1600321 - RNA, 20 nt, Human
ugagcaggauuuuaaucuuu

SEQ ID NO: 1600322 - RNA, 15 nt, Human
ugagcaggauuuuaa

SEQ ID NO: 1600323 - RNA, 16 nt, Human
ugaccacugcagaaga

SEQ ID NO: 1600324 - RNA, 17 nt, Human
ugaccacugcagaagac

SEQ ID NO: 1600325 - RNA, 18 nt, Human
ugaccacugcagaagaca

SEQ ID NO: 1600326 - RNA, 23 nt, Human
ugacagaauauguuucaaacuuu

SEQ ID NO: 1600327 - RNA, 14 nt, Human
ugaauuaaguuuuu

SEQ ID NO: 1600328 - RNA, 13 nt, Human
ugaauuacauuug

SEQ ID NO: 1600329 - RNA, 14 nt, Human
ugaauuacauuugu

SEQ ID NO: 1600330 - RNA, 18 nt, Human
ugacagaauauguuucaa

SEQ ID NO: 1600331 - RNA, 22 nt, Human
ugacagaauauguuucaaacuu

SEQ ID NO: 1600332 - RNA, 21 nt, Human
ugacagaauauguuucaaacu

SEQ ID NO: 1600333 - RNA, 22 nt, Human
ugacaacuucccagugaauucu

SEQ ID NO: 1600334 - RNA, 20 nt, Human
ugaaguuuacauuguaaaua

SEQ ID NO: 1600335 - RNA, 16 nt, Human
ugaaguuuacauugua

SEQ ID NO: 1600336 - RNA, 14 nt, Human
ugaaguuuacauug

SEQ ID NO: 1600337 - RNA, 15 nt, Human
ugaaugaauggcuaa

SEQ ID NO: 1600338 - RNA, 20 nt, Human
ugaaugaauggcuaagcaaa

SEQ ID NO: 1600339 - RNA, 20 nt, Human
ugaaucucauaauuuauaca

SEQ ID NO: 1600340 - RNA, 13 nt, Human
ugaaucucauaau

SEQ ID NO: 1600341 - RNA, 15 nt, Human
ugaaggaaaaugaua

SEQ ID NO: 1600342 - RNA, 17 nt, Human
uacacacucaaaucaag

SEQ ID NO: 1600343 - RNA, 16 nt, Human
uacacacucaaaucaa

SEQ ID NO: 1600344 - RNA, 18 nt, Human
uaauuuugugaagcaaaa

SEQ ID NO: 1600345 - RNA, 12 nt, Human
uaauuuuuauau

SEQ ID NO: 1600346 - RNA, 16 nt, Human
uaauuuuuauauuuga

SEQ ID NO: 1600347 - RNA, 17 nt, Human
uaauuuuuauauuugaa

SEQ ID NO: 1600348 - RNA, 13 nt, Human
uaauuuugugaag

SEQ ID NO: 1600349 - RNA, 23 nt, Human
uacaguucggugagcuacaaaug

SEQ ID NO: 1600350 - RNA, 14 nt, Human
uacaggauuugaaa

SEQ ID NO: 1600351 - RNA, 23 nt, Human
uacugucagcuccccucggagaa

SEQ ID NO: 1600352 - RNA, 13 nt, Human
uacuuaacuauuc

SEQ ID NO: 1600353 - RNA, 16 nt, Human
uaccuaucaucuuaag

SEQ ID NO: 1600354 - RNA, 22 nt, Human
uaccuaacgaaguauccuucag

SEQ ID NO: 1600355 - RNA, 22 nt, Human
uaccaaaaaucucaauauuuca

SEQ ID NO: 1600356 - RNA, 14 nt, Human
uacccagaaaguua

SEQ ID NO: 1600357 - RNA, 23 nt, Human
uagaauaccacaggaaccacaag

SEQ ID NO: 1600358 - RNA, 15 nt, Human
uagaauuaacacaug

SEQ ID NO: 1600359 - RNA, 16 nt, Human
uagaauuaacacauga

SEQ ID NO: 1600360 - RNA, 18 nt, Human
uagaauuaacacaugauc

SEQ ID NO: 1600361 - RNA, 14 nt, Human
uagauaggccaugg

SEQ ID NO: 1600362 - RNA, 18 nt, Human
uagcauggcauauuuuuc

SEQ ID NO: 1600363 - RNA, 17 nt, Human
uagcauggcauauuuuu

SEQ ID NO: 1600364 - RNA, 15 nt, Human
uagcauggcauauuu

SEQ ID NO: 1600365 - RNA, 17 nt, Human
uaguauuguccaggucu

SEQ ID NO: 1600366 - RNA, 23 nt, Human
uaggugcuacaaaaacacagcaa

SEQ ID NO: 1600367 - RNA, 20 nt, Human
uaggugcuacaaaaacacag

SEQ ID NO: 1600368 - RNA, 22 nt, Human
uaggugcuacaaaaacacagca

SEQ ID NO: 1600369 - RNA, 22 nt, Human
uagguuaauuccaauuauauga

SEQ ID NO: 1600370 - RNA, 21 nt, Human
uauauuuuuuguuaaaugauu

SEQ ID NO: 1600371 - RNA, 20 nt, Human
uauauuugaaauauugacuu

SEQ ID NO: 1600372 - RNA, 14 nt, Human
uauaugcuucuguu

SEQ ID NO: 1600373 - RNA, 16 nt, Human
uauaugcuucuguuuu

SEQ ID NO: 1600374 - RNA, 14 nt, Human
uaucaaaagaaaga

SEQ ID NO: 1600375 - RNA, 17 nt, Human
uauauaacaaugcugua

SEQ ID NO: 1600376 - RNA, 19 nt, Human
uauauaacaaugcuguauu

SEQ ID NO: 1600377 - RNA, 18 nt, Human
uauauaaguauucuaaau

SEQ ID NO: 1600378 - RNA, 14 nt, Human
uauaucuuguagcu

SEQ ID NO: 1600379 - RNA, 14 nt, Human
uaauaauguuucaa

SEQ ID NO: 1600380 - RNA, 17 nt, Human
uaaugauaacuggaaac

SEQ ID NO: 1600381 - RNA, 22 nt, Human
uaaugauaacuggaaacuucag

SEQ ID NO: 1600382 - RNA, 23 nt, Human
uaaugauaacuggaaacuucagc

SEQ ID NO: 1600383 - RNA, 22 nt, Human
uaauguuucaaacauauauaac

SEQ ID NO: 1600384 - RNA, 18 nt, Human
uaagguuaccuuuguucc

SEQ ID NO: 1600385 - RNA, 13 nt, Human
uaagugaaauaag

SEQ ID NO: 1600386 - RNA, 21 nt, Human
uaauaacugugaaguuuacau

SEQ ID NO: 1600387 - RNA, 19 nt, Human
uaauaaauauuuuugccau

SEQ ID NO: 1600388 - RNA, 17 nt, Human
uaaccaggggccaugaa

SEQ ID NO: 1600389 - RNA, 14 nt, Human
uaagagagaaugag

SEQ ID NO: 1600390 - RNA, 23 nt, Human
uaagagagaaugagagacacacu

SEQ ID NO: 1600391 - RNA, 13 nt, Human
uaagagagaauga

SEQ ID NO: 1600392 - RNA, 21 nt, Human
uaagaaaauaucacuugucaa

SEQ ID NO: 1600393 - RNA, 18 nt, Human
uaacugugaaguuuacau

SEQ ID NO: 1600394 - RNA, 15 nt, Human
uaacuggaaacuuca

SEQ ID NO: 1600395 - RNA, 17 nt, Human
uaacugugaaguuuaca

SEQ ID NO: 1600396 - RNA, 20 nt, Human
uaaauggcuuccuggcaaua

SEQ ID NO: 1600397 - RNA, 16 nt, Human
uaaaugugccuucauu

SEQ ID NO: 1600398 - RNA, 16 nt, Human
uaaaugugcuuuuaaa

SEQ ID NO: 1600399 - RNA, 20 nt, Human
uaaauugacacuuaaaaaug

SEQ ID NO: 1600400 - RNA, 23 nt, Human
uaaauugacacuuaaaaaugguu

SEQ ID NO: 1600401 - RNA, 14 nt, Human
uaaauuugaauguu

SEQ ID NO: 1600402 - RNA, 22 nt, Human
uaaauuugaauguuaagcagau

SEQ ID NO: 1600403 - RNA, 19 nt, Human
uaaaccaaggcuagaacca

SEQ ID NO: 1600404 - RNA, 14 nt, Human
uaaaggaauuuaaa

SEQ ID NO: 1600405 - RNA, 14 nt, Human
uaaaguguuugaaa

SEQ ID NO: 1600406 - RNA, 15 nt, Human
uaaaauccauacauu

SEQ ID NO: 1600407 - RNA, 17 nt, Human
uaaaauccauacauuug

SEQ ID NO: 1600408 - RNA, 18 nt, Human
uaaaaucauuucugcauc

SEQ ID NO: 1600409 - RNA, 22 nt, Human
uaaaaucauuucugcaucagcu

SEQ ID NO: 1600410 - RNA, 10 nt, Human
uaaaaucauu

SEQ ID NO: 1600411 - RNA, 13 nt, Human
uaaaaucauuucu

SEQ ID NO: 1600412 - RNA, 13 nt, Human
uaaaaccacagca

SEQ ID NO: 1600413 - RNA, 22 nt, Human
uaaaacaagcacuaaacaaaga

SEQ ID NO: 1600414 - RNA, 19 nt, Human
uaaaaaugguuuaaauggu

SEQ ID NO: 1600415 - RNA, 18 nt, Human
uaaaaaugguuuaaaugg

SEQ ID NO: 1600416 - RNA, 21 nt, Human
uaaaaagacauucuuccaaaa

SEQ ID NO: 1600417 - RNA, 19 nt, Human
uaaaaacaacuuuauaccc

SEQ ID NO: 1600418 - RNA, 18 nt, Human
uaaaaacaacuuuauacc

SEQ ID NO: 1600419 - RNA, 13 nt, Human
uaaaaacaacuuu

SEQ ID NO: 1600420 - RNA, 20 nt, Human
guuuagcuggaaaaguaugu

SEQ ID NO: 1600421 - RNA, 21 nt, Human
guuuagcuggaaaaguauguu

SEQ ID NO: 1600422 - RNA, 20 nt, Human
guuuaggauguugaaaaagu

SEQ ID NO: 1600423 - RNA, 20 nt, Human
guuuauauaagcuuguauuc

SEQ ID NO: 1600424 - RNA, 14 nt, Human
guugugaauguugu

SEQ ID NO: 1600425 - RNA, 12 nt, Human
guucugaagaag

SEQ ID NO: 1600426 - RNA, 13 nt, Human
guucugaagaaga

SEQ ID NO: 1600427 - RNA, 14 nt, Human
guucugaagaagau

SEQ ID NO: 1600428 - RNA, 15 nt, Human
guucugaagaagaug

SEQ ID NO: 1600429 - RNA, 23 nt, Human
guugaaaagacuccaaagaaaug

SEQ ID NO: 1600430 - RNA, 17 nt, Human
guugaaaagacuccaaa

SEQ ID NO: 1600431 - RNA, 22 nt, Human
guugaaaagacuccaaagaaau

SEQ ID NO: 1600432 - RNA, 20 nt, Human
guugauggugguauguuuuc

SEQ ID NO: 1600433 - RNA, 21 nt, Human
guugauggugguauguuuuca

SEQ ID NO: 1600434 - RNA, 16 nt, Human
guucaucaaugaauga

SEQ ID NO: 1600435 - RNA, 19 nt, Human
guucagagcugcccucucc

SEQ ID NO: 1600436 - RNA, 17 nt, Human
guucagagcugcccucu

SEQ ID NO: 1600437 - RNA, 16 nt, Human
guucagagcugcccuc

SEQ ID NO: 1600438 - RNA, 15 nt, Human
guucagagcugcccu

SEQ ID NO: 1600439 - RNA, 22 nt, Human
guucagagcugcccucuccugg

SEQ ID NO: 1600440 - RNA, 20 nt, Human
guucagagcugcccucuccu

SEQ ID NO: 1600441 - RNA, 23 nt, Human
guucagagcugcccucuccuggg

SEQ ID NO: 1600442 - RNA, 14 nt, Human
guucagagcugccc

SEQ ID NO: 1600443 - RNA, 13 nt, Human
guucagagcugcc

SEQ ID NO: 1600444 - RNA, 23 nt, Human
guuaccucugccucagaaaacaa

SEQ ID NO: 1600445 - RNA, 17 nt, Human
guuauuauauuuacaaa

SEQ ID NO: 1600446 - RNA, 18 nt, Human
guucaauaauaaauauuu

SEQ ID NO: 1600447 - RNA, 20 nt, Human
guuaaaagaugaaaauauuu

SEQ ID NO: 1600448 - RNA, 14 nt, Human
guuaaaagaugaaa

SEQ ID NO: 1600449 - RNA, 16 nt, Human
guuaaaagaugaaaau

SEQ ID NO: 1600450 - RNA, 15 nt, Human
gugcuacaaaaacac

SEQ ID NO: 1600451 - RNA, 20 nt, Human
gugcuacaaaaacacagcaa

SEQ ID NO: 1600452 - RNA, 21 nt, Human
gugcuacaaaaacacagcaag

SEQ ID NO: 1600453 - RNA, 21 nt, Human
guguaaguagauaggccaugg

SEQ ID NO: 1600454 - RNA, 15 nt, Human
guguacuuaacuauu

SEQ ID NO: 1600455 - RNA, 14 nt, Human
gugagcuacaaaug

SEQ ID NO: 1600456 - RNA, 21 nt, Human
gugaacaaauuuacagagaca

SEQ ID NO: 1600457 - RNA, 15 nt, Human
gugaacacaucagcu

SEQ ID NO: 1600458 - RNA, 13 nt, Human
gugaacacaucag

SEQ ID NO: 1600459 - RNA, 18 nt, Human
gugaauucuugaaggaaa

SEQ ID NO: 1600460 - RNA, 22 nt, Human
gugaauucuugaaggaaaauga

SEQ ID NO: 1600461 - RNA, 22 nt, Human
gucugugagaugcuagaacucc

SEQ ID NO: 1600462 - RNA, 23 nt, Human
gucugugagaugcuagaacuccc

SEQ ID NO: 1600463 - RNA, 15 nt, Human
gucugugagaugcua

SEQ ID NO: 1600464 - RNA, 16 nt, Human
gucugugagaugcuag

SEQ ID NO: 1600465 - RNA, 17 nt, Human
gucugugagaugcuaga

SEQ ID NO: 1600466 - RNA, 21 nt, Human
gucugugagaugcuagaacuc

SEQ ID NO: 1600467 - RNA, 23 nt, Human
gucggguuuuauuguuuaaaauc

SEQ ID NO: 1600468 - RNA, 18 nt, Human
gucgucaaagcugaaaug

SEQ ID NO: 1600469 - RNA, 13 nt, Human
gucuaaauuugaa

SEQ ID NO: 1600470 - RNA, 21 nt, Human
gucuaagauaguaacaaugaa

SEQ ID NO: 1600471 - RNA, 13 nt, Human
gucaggaaagaga

SEQ ID NO: 1600472 - RNA, 21 nt, Human
gucagcuccccucggagaaga

SEQ ID NO: 1600473 - RNA, 22 nt, Human
gucagcuccccucggagaagag

SEQ ID NO: 1600474 - RNA, 23 nt, Human
gucagcuccccucggagaagagc

SEQ ID NO: 1600475 - RNA, 19 nt, Human
gucagcuccccucggagaa

SEQ ID NO: 1600476 - RNA, 20 nt, Human
guauuuuaaaagaaugauua

SEQ ID NO: 1600477 - RNA, 13 nt, Human
guauuuuaaucac

SEQ ID NO: 1600478 - RNA, 23 nt, Human
gucaauaaaauccauacauuugu

SEQ ID NO: 1600479 - RNA, 22 nt, Human
gucaauaaaauccauacauuug

SEQ ID NO: 1600480 - RNA, 15 nt, Human
gucaaugcagccccc

SEQ ID NO: 1600481 - RNA, 17 nt, Human
guauguuagugcaaauu

SEQ ID NO: 1600482 - RNA, 23 nt, Human
guaugaaauuauauaaguauucu

SEQ ID NO: 1600483 - RNA, 13 nt, Human
guaugaaauuaua

SEQ ID NO: 1600484 - RNA, 14 nt, Human
guaguguuggagaa

SEQ ID NO: 1600485 - RNA, 15 nt, Human
guaguguuggagaag

SEQ ID NO: 1600486 - RNA, 17 nt, Human
guaguguuggagaagaa

SEQ ID NO: 1600487 - RNA, 19 nt, Human
gcuauaggugcuacaaaaa

SEQ ID NO: 1600488 - RNA, 18 nt, Human
gcuauaggugcuacaaaa

SEQ ID NO: 1600489 - RNA, 15 nt, Human
guagcacugacagau

SEQ ID NO: 1600490 - RNA, 14 nt, Human
guagcacugacaga

SEQ ID NO: 1600491 - RNA, 13 nt, Human
uuuguauaaaaua

SEQ ID NO: 1600492 - RNA, 14 nt, Human
uuuguauaaaauaa

SEQ ID NO: 1600493 - RNA, 16 nt, Human
uuuguauaaaauaauu

SEQ ID NO: 1600494 - RNA, 21 nt, Human
uuuuaaaagaaugauuaugaa

SEQ ID NO: 1600495 - RNA, 20 nt, Human
uuuuaauaauguuucaaaca

SEQ ID NO: 1600496 - RNA, 15 nt, Human
uuucugagaaagacu

SEQ ID NO: 1600497 - RNA, 13 nt, Human
uuucugagaaaga

SEQ ID NO: 1600498 - RNA, 17 nt, Human
uuucuuauuucauuucu

SEQ ID NO: 1600499 - RNA, 18 nt, Human
uuugaaucaucaagucuu

SEQ ID NO: 1600500 - RNA, 20 nt, Human
uuugaaucucauaauuuaua

SEQ ID NO: 1600501 - RNA, 19 nt, Human
uuugaaucucauaauuuau

SEQ ID NO: 1600502 - RNA, 16 nt, Human
uuugaaucucauaauu

SEQ ID NO: 1600503 - RNA, 22 nt, Human
uuugaaucucauaauuuauaca

SEQ ID NO: 1600504 - RNA, 21 nt, Human
uuugaaucucauaauuuauac

SEQ ID NO: 1600505 - RNA, 19 nt, Human
uuuuucucuaggaaauauu

SEQ ID NO: 1600506 - RNA, 14 nt, Human
uuuuccugaaaacc

SEQ ID NO: 1600507 - RNA, 18 nt, Human
uuuuggucuggagggaag

SEQ ID NO: 1600508 - RNA, 11 nt, Human
uuuugacagaa

SEQ ID NO: 1600509 - RNA, 20 nt, Human
uuuugaaucucauaauuuau

SEQ ID NO: 1600510 - RNA, 18 nt, Human
uuuuuaaaaaagaaacau

SEQ ID NO: 1600511 - RNA, 18 nt, Human
uuuuguagcacugacaga

SEQ ID NO: 1600512 - RNA, 19 nt, Human
uuuuguagcacugacagau

SEQ ID NO: 1600513 - RNA, 23 nt, Human
gccaucccucccuccaccucccu

SEQ ID NO: 1600514 - RNA, 18 nt, Human
gccaucccucccuccacc

SEQ ID NO: 1600515 - RNA, 20 nt, Human
gccgggcgugguggugagug

SEQ ID NO: 1600516 - RNA, 23 nt, Human
gccuccccuccucugcuugccau

SEQ ID NO: 1600517 - RNA, 22 nt, Human
gccuccccuccucugcuugcca

SEQ ID NO: 1600518 - RNA, 20 nt, Human
gccuccccuccucugcuugc

SEQ ID NO: 1600519 - RNA, 19 nt, Human
gccuccccuccucugcuug

SEQ ID NO: 1600520 - RNA, 17 nt, Human
gccuccccuccucugcu

SEQ ID NO: 1600521 - RNA, 19 nt, Human
gcuagaacucccuuucaac

SEQ ID NO: 1600522 - RNA, 13 nt, Human
gcuauaggugcua

SEQ ID NO: 1600523 - RNA, 22 nt, Human
gcgacagugagacucugucuca

SEQ ID NO: 1600524 - RNA, 12 nt, Human
gcgacagugaga

SEQ ID NO: 1600525 - RNA, 15 nt, Human
gccugcaauuucaua

SEQ ID NO: 1600526 - RNA, 15 nt, Human
gauuuuccugaaaac

SEQ ID NO: 1600527 - RNA, 14 nt, Human
gcaagggugauggg

SEQ ID NO: 1600528 - RNA, 10 nt, Human
gcaagccaga

SEQ ID NO: 1600529 - RNA, 17 nt, Human
gcaaaauugauguguuu

SEQ ID NO: 1600530 - RNA, 14 nt, Human
gauagucuuucagu

SEQ ID NO: 1600531 - RNA, 15 nt, Human
gauaguaacaaugaa

SEQ ID NO: 1600532 - RNA, 22 nt, Human
gauagucuuucaguuaaggaga

SEQ ID NO: 1600533 - RNA, 23 nt, Human
gauagauaggucagugcaaauac

SEQ ID NO: 1600534 - RNA, 13 nt, Human
gauagcagggcau

SEQ ID NO: 1600535 - RNA, 22 nt, Human
gauaaauaguuuaugauuccac

SEQ ID NO: 1600536 - RNA, 16 nt, Human
gauaaguucauacauu

SEQ ID NO: 1600537 - RNA, 14 nt, Human
gauaaguucauaca

SEQ ID NO: 1600538 - RNA, 12 nt, Human
gauaaguucaua

SEQ ID NO: 1600539 - RNA, 13 nt, Human
gauccuggaaauc

SEQ ID NO: 1600540 - RNA, 14 nt, Human
gaugaaaauauuug

SEQ ID NO: 1600541 - RNA, 21 nt, Human
gauggcuaguaucaaaagaaa

SEQ ID NO: 1600542 - RNA, 17 nt, Human
gaugacaacuucccagu

SEQ ID NO: 1600543 - RNA, 18 nt, Human
gcagauaaacaguaguga

SEQ ID NO: 1600544 - RNA, 20 nt, Human
gcagccccgugggguuccuc

SEQ ID NO: 1600545 - RNA, 12 nt, Human
gcaucagcugcu

SEQ ID NO: 1600546 - RNA, 13 nt, Human
gcauuauauuuau

SEQ ID NO: 1600547 - RNA, 13 nt, Human
gcauagaaguaaa

SEQ ID NO: 1600548 - RNA, 17 nt, Human
gcaguucugaagaagau

SEQ ID NO: 1600549 - RNA, 18 nt, Human
gcaguucagagcugcccu

SEQ ID NO: 1600550 - RNA, 17 nt, Human
gcaguucagagcugccc

SEQ ID NO: 1600551 - RNA, 15 nt, Human
gcaguucugaagaag

SEQ ID NO: 1600552 - RNA, 16 nt, Human
gcaguucagagcugcc

SEQ ID NO: 1600553 - RNA, 17 nt, Human
gcauagguuuaauaauu

SEQ ID NO: 1600554 - RNA, 15 nt, Human
gcaguugaaaagacu

SEQ ID NO: 1600555 - RNA, 19 nt, Human
gcauauuuuucacauaucu

SEQ ID NO: 1600556 - RNA, 16 nt, Human
gcauauuuuucacaua

SEQ ID NO: 1600557 - RNA, 15 nt, Human
gcauauuuuucacau

SEQ ID NO: 1600558 - RNA, 14 nt, Human
gcauauuuuucaca

SEQ ID NO: 1600559 - RNA, 20 nt, Human
gcauauuuuucacauaucua

SEQ ID NO: 1600560 - RNA, 15 nt, Human
gacaagcucacagac

SEQ ID NO: 1600561 - RNA, 14 nt, Human
gacaucaacagaua

SEQ ID NO: 1600562 - RNA, 22 nt, Human
gacaugggacauuugcucaugg

SEQ ID NO: 1600563 - RNA, 23 nt, Human
gaccugauuucugagcauuuaau

SEQ ID NO: 1600564 - RNA, 13 nt, Human
gagaagaacugaa

SEQ ID NO: 1600565 - RNA, 14 nt, Human
gagaagaacugaaa

SEQ ID NO: 1600566 - RNA, 16 nt, Human
gagaagaacugaaauc

SEQ ID NO: 1600567 - RNA, 15 nt, Human
gagaagagcuguuca

SEQ ID NO: 1600568 - RNA, 22 nt, Human
gagaagagcuguucacagccag

SEQ ID NO: 1600569 - RNA, 18 nt, Human
gagacacacugaagaagc

SEQ ID NO: 1600570 - RNA, 13 nt, Human
gagaaagacuauu

SEQ ID NO: 1600571 - RNA, 15 nt, Human
gagaaagacuauuca

SEQ ID NO: 1600572 - RNA, 17 nt, Human
gagaaagacuauucaaa

SEQ ID NO: 1600573 - RNA, 18 nt, Human
gagaaagacuauucaaac

SEQ ID NO: 1600574 - RNA, 19 nt, Human
gagagacacacugaagaag

SEQ ID NO: 1600575 - RNA, 17 nt, Human
gagauacagaauuuuau

SEQ ID NO: 1600576 - RNA, 19 nt, Human
gagagugaacaaauuuaca

SEQ ID NO: 1600577 - RNA, 15 nt, Human
gagagugaacaaauu

SEQ ID NO: 1600578 - RNA, 15 nt, Human
gagacagcucugcau

SEQ ID NO: 1600579 - RNA, 18 nt, Human
gagacagcucugcauacu

SEQ ID NO: 1600580 - RNA, 13 nt, Human
gagacagcucugc

SEQ ID NO: 1600581 - RNA, 16 nt, Human
gagcucgugggacagu

SEQ ID NO: 1600582 - RNA, 23 nt, Human
gagcugcccucuccugggcagcu

SEQ ID NO: 1600583 - RNA, 21 nt, Human
gagcugcccucuccugggcag

SEQ ID NO: 1600584 - RNA, 19 nt, Human
gagcugcccucuccugggc

SEQ ID NO: 1600585 - RNA, 18 nt, Human
gagcugcccucuccuggg

SEQ ID NO: 1600586 - RNA, 15 nt, Human
gaaauauuuauuuua

SEQ ID NO: 1600587 - RNA, 16 nt, Human
gaaauauuuauuuuaa

SEQ ID NO: 1600588 - RNA, 13 nt, Human
gaaauauuuauuu

SEQ ID NO: 1600589 - RNA, 23 nt, Human
gaaauuauauaaguauucuaaau

SEQ ID NO: 1600590 - RNA, 17 nt, Human
gaaauuauauaaguauu

SEQ ID NO: 1600591 - RNA, 24 nt, Human
gaacaguuaccucugccucagaaa

SEQ ID NO: 1600592 - RNA, 18 nt, Human
gaacagauaaucagugug

SEQ ID NO: 1600593 - RNA, 13 nt, Human
gaaacugccagca

SEQ ID NO: 1600594 - RNA, 15 nt, Human
gaaacugccagcaac

SEQ ID NO: 1600595 - RNA, 19 nt, Human
gaaagacuauucaaacagu

SEQ ID NO: 1600596 - RNA, 22 nt, Human
gaaagacuauucaaacagucuc

SEQ ID NO: 1600597 - RNA, 23 nt, Human
gaaagacuauucaaacagucuca

SEQ ID NO: 1600598 - RNA, 13 nt, Human
gaaagcagaacag

SEQ ID NO: 1600599 - RNA, 14 nt, Human
gaaagcagaacagu

SEQ ID NO: 1600600 - RNA, 23 nt, Human
gaaaguuauugauaaguucauac

SEQ ID NO: 1600601 - RNA, 23 nt, Human
gaaguccaagcauuuagauguau

SEQ ID NO: 1600602 - RNA, 14 nt, Human
gaaccacaagacug

SEQ ID NO: 1600603 - RNA, 15 nt, Human
gaaccacaagacugc

SEQ ID NO: 1600604 - RNA, 16 nt, Human
gaacucccuuucaaca

SEQ ID NO: 1600605 - RNA, 22 nt, Human
gaacuuguaaaggaauuuaaaa

SEQ ID NO: 1600606 - RNA, 17 nt, Human
gaagauguagaggagaa

SEQ ID NO: 1600607 - RNA, 13 nt, Human
gaagagcuguuca

SEQ ID NO: 1600608 - RNA, 15 nt, Human
gaagagcuguucaca

SEQ ID NO: 1600609 - RNA, 20 nt, Human
gaagagcuguucacagccag

SEQ ID NO: 1600610 - RNA, 23 nt, Human
gaagagcuguucacagccagacu

SEQ ID NO: 1600611 - RNA, 20 nt, Human
gaagaguauuuuugacagaa

SEQ ID NO: 1600612 - RNA, 18 nt, Human
cuuguaaaggaauuuaaa

SEQ ID NO: 1600613 - RNA, 17 nt, Human
cuugccaaauauaaaua

SEQ ID NO: 1600614 - RNA, 13 nt, Human
cuucuuuccacag

SEQ ID NO: 1600615 - RNA, 19 nt, Human
cuucuuuccacagaagcuc

SEQ ID NO: 1600616 - RNA, 19 nt, Human
cuugaacccgggaggcaga

SEQ ID NO: 1600617 - RNA, 20 nt, Human
cuugaacccgggaggcagag

SEQ ID NO: 1600618 - RNA, 21 nt, Human
cuugcaugguuuagaaagcuu

SEQ ID NO: 1600619 - RNA, 23 nt, Human
cuugcaucaauuuuucuuauuuc

SEQ ID NO: 1600620 - RNA, 19 nt, Human
cuuuccucaaaacuucaga

SEQ ID NO: 1600621 - RNA, 16 nt, Human
cuuuggaacaagaugg

SEQ ID NO: 1600622 - RNA, 12 nt, Human
cugcacugucaa

SEQ ID NO: 1600623 - RNA, 15 nt, Human
cugccagcaacgcag

SEQ ID NO: 1600624 - RNA, 20 nt, Human
cugcaucagcugcugaaaca

SEQ ID NO: 1600625 - RNA, 15 nt, Human
cugcccucuccuggg

SEQ ID NO: 1600626 - RNA, 14 nt, Human
cugcccucuccugg

SEQ ID NO: 1600627 - RNA, 13 nt, Human
cugcccucuccug

SEQ ID NO: 1600628 - RNA, 12 nt, Human
cugcccucuccu

SEQ ID NO: 1600629 - RNA, 15 nt, Human
cugcuugccaucccu

SEQ ID NO: 1600630 - RNA, 16 nt, Human
cugcuugccaucccuc

SEQ ID NO: 1600631 - RNA, 22 nt, Human
cugcuugccaucccucccucca

SEQ ID NO: 1600632 - RNA, 20 nt, Human
cugcuugccaucccucccuc

SEQ ID NO: 1600633 - RNA, 19 nt, Human
cugcuugccaucccucccu

SEQ ID NO: 1600634 - RNA, 18 nt, Human
cugcuugccaucccuccc

SEQ ID NO: 1600635 - RNA, 16 nt, Human
cuggccuucggccucc

SEQ ID NO: 1600636 - RNA, 17 nt, Human
cuggccuucggccucca

SEQ ID NO: 1600637 - RNA, 18 nt, Human
cuggccuucggccuccau

SEQ ID NO: 1600638 - RNA, 21 nt, Human
cuggccuucggccuccauccu

SEQ ID NO: 1600639 - RNA, 15 nt, Human
cuggccuucggccuc

SEQ ID NO: 1600640 - RNA, 15 nt, Human
cuguaugauucccag

SEQ ID NO: 1600641 - RNA, 13 nt, Human
cuguauuuuaaaa

SEQ ID NO: 1600642 - RNA, 16 nt, Human
cuguauuuuaaaagaa

SEQ ID NO: 1600643 - RNA, 19 nt, Human
cuguauuuuaaaagaauga

SEQ ID NO: 1600644 - RNA, 18 nt, Human
cugucucuacuaaaaaua

SEQ ID NO: 1600645 - RNA, 22 nt, Human
cucuucuuuaaagggauggcaa

SEQ ID NO: 1600646 - RNA, 23 nt, Human
cugaagaagcaccaaucaugaau

SEQ ID NO: 1600647 - RNA, 12 nt, Human
cucuggccuucg

SEQ ID NO: 1600648 - RNA, 19 nt, Human
cucuggccuucggccucca

SEQ ID NO: 1600649 - RNA, 20 nt, Human
cucugcuugccaucccuccc

SEQ ID NO: 1600650 - RNA, 17 nt, Human
cucugcuugccaucccu

SEQ ID NO: 1600651 - RNA, 14 nt, Human
cucugcuugccauc

SEQ ID NO: 1600652 - RNA, 12 nt, Human
cucugcuugcca

SEQ ID NO: 1600653 - RNA, 16 nt, Human
cugagcgacagugaga

SEQ ID NO: 1600654 - RNA, 20 nt, Human
cugagcgacagugagacucu

SEQ ID NO: 1600655 - RNA, 15 nt, Human
cugacagauuuccau

SEQ ID NO: 1600656 - RNA, 11 nt, Human
cugacagauuu

SEQ ID NO: 1600657 - RNA, 23 nt, Human
cugagaaagacuauucaaacagu

SEQ ID NO: 1600658 - RNA, 16 nt, Human
cugacuucuaaguaaa

SEQ ID NO: 1600659 - RNA, 13 nt, Human
cugacuucuaagu

SEQ ID NO: 1600660 - RNA, 15 nt, Human
cugacuucuaaguaa

SEQ ID NO: 1600661 - RNA, 17 nt, Human
cugacucuuaagaagac

SEQ ID NO: 1600662 - RNA, 15 nt, Human
cugacuaugacauaa

SEQ ID NO: 1600663 - RNA, 17 nt, Human
cucccuccaccucccug

SEQ ID NO: 1600664 - RNA, 15 nt, Human
cucccuccaccuccc

SEQ ID NO: 1600665 - RNA, 11 nt, Human
cuccauccuga

SEQ ID NO: 1600666 - RNA, 16 nt, Human
cuccauccugaggcuc

SEQ ID NO: 1600667 - RNA, 18 nt, Human
cuccauccugaggcucca

SEQ ID NO: 1600668 - RNA, 20 nt, Human
cuccauccugaggcuccacu

SEQ ID NO: 1600669 - RNA, 15 nt, Human
cucuaggaaauauuu

SEQ ID NO: 1600670 - RNA, 17 nt, Human
cucuaggaaauauuuau

SEQ ID NO: 1600671 - RNA, 19 nt, Human
cucuccugggcagcugccu

SEQ ID NO: 1600672 - RNA, 18 nt, Human
cucuccugggcagcugcc

SEQ ID NO: 1600673 - RNA, 16 nt, Human
cucuccugggcagcug

SEQ ID NO: 1600674 - RNA, 15 nt, Human
cucuccugggcagcu

SEQ ID NO: 1600675 - RNA, 12 nt, Human
cucuccugggca

SEQ ID NO: 1600676 - RNA, 20 nt, Human
cucuccugggcagcugccuc

SEQ ID NO: 1600677 - RNA, 21 nt, Human
cucuccugauagucuuucagu

SEQ ID NO: 1600678 - RNA, 14 nt, Human
cgcucucuggccuu

SEQ ID NO: 1600679 - RNA, 15 nt, Human
cgcucucuggccuuc

SEQ ID NO: 1600680 - RNA, 18 nt, Human
cgcucucuggccuucggc

SEQ ID NO: 1600681 - RNA, 12 nt, Human
cggccuccaucc

SEQ ID NO: 1600682 - RNA, 14 nt, Human
cggccuccauccug

SEQ ID NO: 1600683 - RNA, 21 nt, Human
cggguuuuauuguuuaaaauc

SEQ ID NO: 1600684 - RNA, 17 nt, Human
cggugagcuacaaaugc

SEQ ID NO: 1600685 - RNA, 22 nt, Human
cggucggguuuuauuguuuaaa

SEQ ID NO: 1600686 - RNA, 23 nt, Human
cuaaauugacacuuaaaaauggu

SEQ ID NO: 1600687 - RNA, 23 nt, Human
cuaaauuugaauguuaagcagau

SEQ ID NO: 1600688 - RNA, 13 nt, Human
cucacauuuauau

SEQ ID NO: 1600689 - RNA, 17 nt, Human
cucaccccuugccauaa

SEQ ID NO: 1600690 - RNA, 21 nt, Human
cuaugacauaaaaacaacuuu

SEQ ID NO: 1600691 - RNA, 19 nt, Human
cuauauuguuugcuaagca

SEQ ID NO: 1600692 - RNA, 20 nt, Human
cuauauuuuuuguuaaauga

SEQ ID NO: 1600693 - RNA, 22 nt, Human
cuauauuuuuuguuaaaugauu

SEQ ID NO: 1600694 - RNA, 13 nt, Human
cuaugaaauauua

SEQ ID NO: 1600695 - RNA, 18 nt, Human
cuaugaaauauuauguua

SEQ ID NO: 1600696 - RNA, 18 nt, Human
cuaugacauaaaaacaac

SEQ ID NO: 1600697 - RNA, 22 nt, Human
cuaguauuucuaugaaauauua

SEQ ID NO: 1600698 - RNA, 19 nt, Human
cuaguauuucuaugaaaua

SEQ ID NO: 1600699 - RNA, 20 nt, Human
cuaguauuucuaugaaauau

SEQ ID NO: 1600700 - RNA, 15 nt, Human
cuaguaucaaaagaa

SEQ ID NO: 1600701 - RNA, 17 nt, Human
cuaguaucaaaagaaag

SEQ ID NO: 1600702 - RNA, 23 nt, Human
cuaguaucaaaagaaagaaaauc

SEQ ID NO: 1600703 - RNA, 16 nt, Human
cuaguaugaaauuaua

SEQ ID NO: 1600704 - RNA, 15 nt, Human
cuacuugggaggcug

SEQ ID NO: 1600705 - RNA, 18 nt, Human
cuacuugggaggcugaga

SEQ ID NO: 1600706 - RNA, 19 nt, Human
cuacuugggaggcugagau

SEQ ID NO: 1600707 - RNA, 15 nt, Human
cuaagcaaaauguga

SEQ ID NO: 1600708 - RNA, 18 nt, Human
cuaagcaaaaugugauau

SEQ ID NO: 1600709 - RNA, 14 nt, Human
cuaagcaaaaugug

SEQ ID NO: 1600710 - RNA, 16 nt, Human
cuacacuccagugaga

SEQ ID NO: 1600711 - RNA, 17 nt, Human
cuacacuccagugagac

SEQ ID NO: 1600712 - RNA, 19 nt, Human
cuaauguaauaacugugaa

SEQ ID NO: 1600713 - RNA, 14 nt, Human
ccuccauccugagg

SEQ ID NO: 1600714 - RNA, 12 nt, Human
ccuccauccuga

SEQ ID NO: 1600715 - RNA, 13 nt, Human
ccuccauccugag

SEQ ID NO: 1600716 - RNA, 14 nt, Human
ccuccccuccucug

SEQ ID NO: 1600717 - RNA, 13 nt, Human
ccuccccuccucu

SEQ ID NO: 1600718 - RNA, 12 nt, Human
ccuccccuccuc

SEQ ID NO: 1600719 - RNA, 22 nt, Human
ccgggaggcagagguugcagug

SEQ ID NO: 1600720 - RNA, 13 nt, Human
ccuaaacauauga

SEQ ID NO: 1600721 - RNA, 15 nt, Human
cccugcaauaaaaug

SEQ ID NO: 1600722 - RNA, 14 nt, Human
cccugcaauaaaau

SEQ ID NO: 1600723 - RNA, 13 nt, Human
cccucccuccacc

SEQ ID NO: 1600724 - RNA, 20 nt, Human
cccucccuccaccucccugc

SEQ ID NO: 1600725 - RNA, 14 nt, Human
ccccaggugccagu

SEQ ID NO: 1600726 - RNA, 23 nt, Human
ccauggcacucuauguucuaaga

SEQ ID NO: 1600727 - RNA, 19 nt, Human
ccagccugagcgacaguga

SEQ ID NO: 1600728 - RNA, 16 nt, Human
ccauccugaggcucca

SEQ ID NO: 1600729 - RNA, 15 nt, Human
ccauccugaggcucc

SEQ ID NO: 1600730 - RNA, 23 nt, Human
cauuucugcaucagcugcugaaa

SEQ ID NO: 1600731 - RNA, 19 nt, Human
cauuuaaagcuuauuaaaa

SEQ ID NO: 1600732 - RNA, 15 nt, Human
cauuugcucauggaa

SEQ ID NO: 1600733 - RNA, 14 nt, Human
cauuugcucaugga

SEQ ID NO: 1600734 - RNA, 16 nt, Human
cauuugcucauggaau

SEQ ID NO: 1600735 - RNA, 17 nt, Human
ccaaagaaauguaaggg

SEQ ID NO: 1600736 - RNA, 21 nt, Human
ccaacacgagcaggcuacugu

SEQ ID NO: 1600737 - RNA, 14 nt, Human
ccaacacgagcagg

SEQ ID NO: 1600738 - RNA, 18 nt, Human
ccaaggcuagaaccaccu

SEQ ID NO: 1600739 - RNA, 16 nt, Human
ccacaagaaaugaaag

SEQ ID NO: 1600740 - RNA, 22 nt, Human
ccacaagaaaugaaagcaggga

SEQ ID NO: 1600741 - RNA, 19 nt, Human
ccaaggcugauuaaaccaa

SEQ ID NO: 1600742 - RNA, 20 nt, Human
ccaauauucauagcagcuua

SEQ ID NO: 1600743 - RNA, 23 nt, Human
caugcugucuacacuaagagaga

SEQ ID NO: 1600744 - RNA, 23 nt, Human
caugggacagggaggacgcucuc

SEQ ID NO: 1600745 - RNA, 17 nt, Human
caugggacagggaggac

SEQ ID NO: 1600746 - RNA, 21 nt, Human
caguuaccucugccucagaaa

SEQ ID NO: 1600747 - RNA, 15 nt, Human
caguucugaagaaga

SEQ ID NO: 1600748 - RNA, 16 nt, Human
caguucugaagaagau

SEQ ID NO: 1600749 - RNA, 22 nt, Human
caguucugaagaagaugguacc

SEQ ID NO: 1600750 - RNA, 13 nt, Human
caguucugaagaa

SEQ ID NO: 1600751 - RNA, 14 nt, Human
caguucugaagaag

SEQ ID NO: 1600752 - RNA, 12 nt, Human
caguucugaaga

SEQ ID NO: 1600753 - RNA, 22 nt, Human
caguucggugagcuacaaaugc

SEQ ID NO: 1600754 - RNA, 14 nt, Human
cagugucaaugcag

SEQ ID NO: 1600755 - RNA, 14 nt, Human
cagugugucuaaau

SEQ ID NO: 1600756 - RNA, 23 nt, Human
cagugugucuaaauuugaauguu

SEQ ID NO: 1600757 - RNA, 23 nt, Human
caguugaaaagacuccaaagaaa

SEQ ID NO: 1600758 - RNA, 21 nt, Human
caguugaaaagacuccaaaga

SEQ ID NO: 1600759 - RNA, 22 nt, Human
caguugaaaagacuccaaagaa

SEQ ID NO: 1600760 - RNA, 18 nt, Human
caguugaaaagacuccaa

SEQ ID NO: 1600761 - RNA, 14 nt, Human
caguugaaaagacu

SEQ ID NO: 1600762 - RNA, 14 nt, Human
caguuuucugagaa

SEQ ID NO: 1600763 - RNA, 15 nt, Human
caguuuucugagaaa

SEQ ID NO: 1600764 - RNA, 19 nt, Human
caguuuucugagaaagacu

SEQ ID NO: 1600765 - RNA, 20 nt, Human
caguuuucugagaaagacua

SEQ ID NO: 1600766 - RNA, 15 nt, Human
cauaaaaacaacuuu

SEQ ID NO: 1600767 - RNA, 23 nt, Human
cauaaaaacaacuuuauacccag

SEQ ID NO: 1600768 - RNA, 21 nt, Human
cauaaaaacaacuuuauaccc

SEQ ID NO: 1600769 - RNA, 20 nt, Human
cauaaaaacaacuuuauacc

SEQ ID NO: 1600770 - RNA, 17 nt, Human
cauaaaaacaacuuuau

SEQ ID NO: 1600771 - RNA, 23 nt, Human
cauaaaaagccugcaauuucaua

SEQ ID NO: 1600772 - RNA, 22 nt, Human
cauaaguaauucaagaaaacaa

SEQ ID NO: 1600773 - RNA, 18 nt, Human
cauaaguaauucaagaaa

SEQ ID NO: 1600774 - RNA, 17 nt, Human
cauaaguaauucaagaa

SEQ ID NO: 1600775 - RNA, 16 nt, Human
cauaaguaauucaaga

SEQ ID NO: 1600776 - RNA, 11 nt, Human
cauacauauuu

SEQ ID NO: 1600777 - RNA, 17 nt, Human
cauaccaacacgagcag

SEQ ID NO: 1600778 - RNA, 19 nt, Human
cauacauauuuuuguagca

SEQ ID NO: 1600779 - RNA, 12 nt, Human
cauacauauuuu

SEQ ID NO: 1600780 - RNA, 15 nt, Human
cauacauuguacgaa

SEQ ID NO: 1600781 - RNA, 14 nt, Human
caucuagugagcag

SEQ ID NO: 1600782 - RNA, 22 nt, Human
caucuagugagcagucaggaaa

SEQ ID NO: 1600783 - RNA, 13 nt, Human
caucccucccucc

SEQ ID NO: 1600784 - RNA, 12 nt, Human
caucccucccuc

SEQ ID NO: 1600785 - RNA, 14 nt, Human
caucccucccucca

SEQ ID NO: 1600786 - RNA, 20 nt, Human
caucccucccuccaccuccc

SEQ ID NO: 1600787 - RNA, 18 nt, Human
cauauuuuucacauaucu

SEQ ID NO: 1600788 - RNA, 22 nt, Human
caucaagucuuucacauuuaaa

SEQ ID NO: 1600789 - RNA, 18 nt, Human
caucaaugaaugaaugaa

SEQ ID NO: 1600790 - RNA, 21 nt, Human
cauauuuuucacauaucuagu

SEQ ID NO: 1600791 - RNA, 14 nt, Human
cauauuuuucacau

SEQ ID NO: 1600792 - RNA, 12 nt, Human
aaaaacacagca

SEQ ID NO: 1600793 - RNA, 12 nt, Human
aaaaacaacuuu

SEQ ID NO: 1600794 - RNA, 17 nt, Human
aaaacaaggaugaauua

SEQ ID NO: 1600795 - RNA, 18 nt, Human
aaaacacagcaaggguga

SEQ ID NO: 1600796 - RNA, 12 nt, Human
aaaacacagcaa

SEQ ID NO: 1600797 - RNA, 13 nt, Human
aaaacacagcaag

SEQ ID NO: 1600798 - RNA, 14 nt, Human
aaaacaaggaugaa

SEQ ID NO: 1600799 - RNA, 12 nt, Human
aaaacaacuuua

SEQ ID NO: 1600800 - RNA, 17 nt, Human
aggauguugaaaaaguu

SEQ ID NO: 1600801 - RNA, 14 nt, Human
aggauguugaaaaa

SEQ ID NO: 1600802 - RNA, 14 nt, Human
agcuguaugauucc

SEQ ID NO: 1600803 - RNA, 19 nt, Human
agcuuccuucugugaaagu

SEQ ID NO: 1600804 - RNA, 22 nt, Human
agguuaauuccaauuauaugag

SEQ ID NO: 1600805 - RNA, 15 nt, Human
agguuaauuccaauu

SEQ ID NO: 1600806 - RNA, 18 nt, Human
agcaguucagagcugccc

SEQ ID NO: 1600807 - RNA, 17 nt, Human
agcaguucagagcugcc

SEQ ID NO: 1600808 - RNA, 16 nt, Human
agcaguucagagcugc

SEQ ID NO: 1600809 - RNA, 23 nt, Human
agcaguugaaaagacuccaaaga

SEQ ID NO: 1600810 - RNA, 21 nt, Human
agcaguugaaaagacuccaaa

SEQ ID NO: 1600811 - RNA, 14 nt, Human
agauguagaggaga

SEQ ID NO: 1600812 - RNA, 21 nt, Human
agaugggagaaucacuugaac

SEQ ID NO: 1600813 - RNA, 16 nt, Human
agauguagaggagaaa

SEQ ID NO: 1600814 - RNA, 19 nt, Human
agcaguucagagcugcccu

SEQ ID NO: 1600815 - RNA, 20 nt, Human
agcaguucagagcugcccuc

SEQ ID NO: 1600816 - RNA, 15 nt, Human
agccagauuuuccug

SEQ ID NO: 1600817 - RNA, 19 nt, Human
agccagauuuuccugaaaa

SEQ ID NO: 1600818 - RNA, 21 nt, Human
agauaggucagugcaaauacu

SEQ ID NO: 1600819 - RNA, 17 nt, Human
agacugcauuauauuua

SEQ ID NO: 1600820 - RNA, 14 nt, Human
agacacaacuauuu

SEQ ID NO: 1600821 - RNA, 17 nt, Human
aucagcugcugaaacaa

SEQ ID NO: 1600822 - RNA, 13 nt, Human
auccuuucuaaca

SEQ ID NO: 1600823 - RNA, 22 nt, Human
aucuuauaauuuaaaauaugcu

SEQ ID NO: 1600824 - RNA, 14 nt, Human
augacucagaauau

SEQ ID NO: 1600825 - RNA, 20 nt, Human
augaaacacucaguuguuca

SEQ ID NO: 1600826 - RNA, 14 nt, Human
augccuuuucccaa

SEQ ID NO: 1600827 - RNA, 16 nt, Human
augucaaucagccuag

SEQ ID NO: 1600828 - RNA, 21 nt, Human
auguaagggaaacugccagca

SEQ ID NO: 1600829 - RNA, 22 nt, Human
auguaagggaaacugccagcaa

SEQ ID NO: 1600830 - RNA, 20 nt, Human
auguaagggaaacugccagc

SEQ ID NO: 1600831 - RNA, 17 nt, Human
auguaauaacugugaag

SEQ ID NO: 1600832 - RNA, 19 nt, Human
aguuguaccgcaaugugac

SEQ ID NO: 1600833 - RNA, 18 nt, Human
aguuguaccgcaauguga

SEQ ID NO: 1600834 - RNA, 18 nt, Human
agugauuaccagggacug

SEQ ID NO: 1600835 - RNA, 16 nt, Human
aguccaagcauuuaga

SEQ ID NO: 1600836 - RNA, 21 nt, Human
aguccaagcauuuagauguau

SEQ ID NO: 1600837 - RNA, 15 nt, Human
agucaaauuguguga

SEQ ID NO: 1600838 - RNA, 17 nt, Human
agucaaauugugugaaa

SEQ ID NO: 1600839 - RNA, 13 nt, Human
agucaaauugugu

SEQ ID NO: 1600840 - RNA, 14 nt, Human
auaauuacuauguc

SEQ ID NO: 1600841 - RNA, 22 nt, Human
auauaaguauucuaaauuuuau

SEQ ID NO: 1600842 - RNA, 23 nt, Human
auauuucagauaaucacaauaca

SEQ ID NO: 1600843 - RNA, 14 nt, Human
auauuuauuacugu

SEQ ID NO: 1600844 - RNA, 19 nt, Human
auauuuauuacuguaagaa

SEQ ID NO: 1600845 - RNA, 18 nt, Human
auauuuauuuuaauaaug

SEQ ID NO: 1600846 - RNA, 22 nt, Human
auauuuauuacuguaagaaaau

SEQ ID NO: 1600847 - RNA, 18 nt, Human
auaucacuugucaauaaa

SEQ ID NO: 1600848 - RNA, 16 nt, Human
auauccuuucuaacaa

SEQ ID NO: 1600849 - RNA, 15 nt, Human
auauccuuucuaaca

SEQ ID NO: 1600850 - RNA, 13 nt, Human
acauguuacaaca

SEQ ID NO: 1600851 - RNA, 18 nt, Human
acauuugcucauggaauu

SEQ ID NO: 1600852 - RNA, 14 nt, Human
acauuuguauaaaa

SEQ ID NO: 1600853 - RNA, 16 nt, Human
acccaaguccaagcau

SEQ ID NO: 1600854 - RNA, 15 nt, Human
acccacaagaaauga

SEQ ID NO: 1600855 - RNA, 20 nt, Human
acagcucugcauacucauua

SEQ ID NO: 1600856 - RNA, 19 nt, Human
acaggucauauuaauauau

SEQ ID NO: 1600857 - RNA, 16 nt, Human
acagccagacuggcac

SEQ ID NO: 1600858 - RNA, 13 nt, Human
acagccagacugg

SEQ ID NO: 1600859 - RNA, 15 nt, Human
acagccagacuggca

SEQ ID NO: 1600860 - RNA, 15 nt, Human
acagcaguugaaaag

SEQ ID NO: 1600861 - RNA, 18 nt, Human
acagcaguugaaaagacu

SEQ ID NO: 1600862 - RNA, 21 nt, Human
acagaauauguuucaaacuuu

SEQ ID NO: 1600863 - RNA, 19 nt, Human
acagaauauguuucaaacu

SEQ ID NO: 1600864 - RNA, 17 nt, Human
acagaauauguuucaaa

SEQ ID NO: 1600865 - RNA, 16 nt, Human
acagaauauguuucaa

SEQ ID NO: 1600866 - RNA, 13 nt, Human
acaacuauauugu

SEQ ID NO: 1600867 - RNA, 20 nt, Human
aauuuugaguucuacauaag

SEQ ID NO: 1600868 - RNA, 15 nt, Human
aauuuuauaucuugu

SEQ ID NO: 1600869 - RNA, 16 nt, Human
acaacuauuuuuccaa

SEQ ID NO: 1600870 - RNA, 18 nt, Human
acaacuucccagugaauu

SEQ ID NO: 1600871 - RNA, 17 nt, Human
acaacuucaauauccaa

SEQ ID NO: 1600872 - RNA, 14 nt, Human
acaacuuuauaccc

SEQ ID NO: 1600873 - RNA, 13 nt, Human
acaacuuuauacc

SEQ ID NO: 1600874 - RNA, 19 nt, Human
acuuuauacccagaaaguu

SEQ ID NO: 1600875 - RNA, 14 nt, Human
agaaaauaacaaua

SEQ ID NO: 1600876 - RNA, 23 nt, Human
agaaaauauuauguguuuccaua

SEQ ID NO: 1600877 - RNA, 20 nt, Human
acuuguaaaggaauuuaaaa

SEQ ID NO: 1600878 - RNA, 19 nt, Human
acuuguaaaggaauuuaaa

SEQ ID NO: 1600879 - RNA, 14 nt, Human
acuuggucugugag

SEQ ID NO: 1600880 - RNA, 15 nt, Human
acuuggucugugaga

SEQ ID NO: 1600881 - RNA, 21 nt, Human
acuuggucugugagaugcuag

SEQ ID NO: 1600882 - RNA, 12 nt, Human
acuguuuugaau

SEQ ID NO: 1600883 - RNA, 16 nt, Human
acuaagagagaaugag

SEQ ID NO: 1600884 - RNA, 12 nt, Human
acucccuuucaa

SEQ ID NO: 1600885 - RNA, 13 nt, Human
acucccuuucaac

SEQ ID NO: 1600886 - RNA, 14 nt, Human
acuagcuauggugu

SEQ ID NO: 1600887 - RNA, 14 nt, Human
acucaaaucaagaa

SEQ ID NO: 1600888 - RNA, 21 nt, Human
acucauaaaaagccugcaauu

SEQ ID NO: 1600889 - RNA, 22 nt, Human
aaccacuggaaaguuuaugguu

SEQ ID NO: 1600890 - RNA, 15 nt, Human
aacacgagcaggcua

SEQ ID NO: 1600891 - RNA, 13 nt, Human
aagaaauguaagg

SEQ ID NO: 1600892 - RNA, 14 nt, Human
aagaaauguaaggg

SEQ ID NO: 1600893 - RNA, 16 nt, Human
aacuuuggaacaagau

SEQ ID NO: 1600894 - RNA, 19 nt, Human
aaacugccagcaacgcagg

SEQ ID NO: 1600895 - RNA, 16 nt, Human
aaacugacucuuaaga

SEQ ID NO: 1600896 - RNA, 17 nt, Human
aaacugacucuuaagaa

SEQ ID NO: 1600897 - RNA, 14 nt, Human
aaacugccagcaac

SEQ ID NO: 1600898 - RNA, 15 nt, Human
aaacugccagcaacg

SEQ ID NO: 1600899 - RNA, 17 nt, Human
aaagaugaaaauauuug

SEQ ID NO: 1600900 - RNA, 13 nt, Human
aaagaugaaaaua

SEQ ID NO: 1600901 - RNA, 16 nt, Human
aaagaugaaaauauuu

SEQ ID NO: 1600902 - RNA, 21 nt, Human
aaaauuauuuuguucauacau

SEQ ID NO: 1600903 - RNA, 12 nt, Human
aaauaacaauga

SEQ ID NO: 1600904 - RNA, 18 nt, Human
aaauggcuuccuggcaau

SEQ ID NO: 1600905 - RNA, 18 nt, Human
aaaucaaauaugcaaagc

SEQ ID NO: 1600906 - RNA, 19 nt, Human
aaaucaaauaugcaaagca

SEQ ID NO: 1600907 - RNA, 14 nt, Human
aaauaguauuugag

SEQ ID NO: 1600908 - RNA, 16 nt, Human
aagauuuaccacuugu

SEQ ID NO: 1600909 - RNA, 13 nt, Human
aagccagauuuuc

SEQ ID NO: 1600910 - RNA, 14 nt, Human
aauaaaauggguuu

SEQ ID NO: 1600911 - RNA, 19 nt, Human
aauaaaauggguuuuacug

SEQ ID NO: 1600912 - RNA, 21 nt, Human
aauaauccuaaacauaugaau

SEQ ID NO: 1600913 - RNA, 18 nt, Human
aaguauguguaaaaugug

SEQ ID NO: 1600914 - RNA, 13 nt, Human
aaucacaauacau

SEQ ID NO: 1600915 - RNA, 15 nt, Human
aaucaagaaacuuaa

SEQ ID NO: 1600916 - RNA, 16 nt, Human
aauauuauguuaaaac

SEQ ID NO: 1600917 - RNA, 14 nt, Human
aauauuauguguuu

SEQ ID NO: 1600918 - RNA, 13 nt, Human
aauccauacauuu

SEQ ID NO: 1600919 - RNA, 14 nt, Human
aauccauacauuug

SEQ ID NO: 1600920 - RNA, 18 nt, Human
aaucucauaauuuauaca

SEQ ID NO: 1600921 - RNA, 17 nt, Human
aaugauaacuggaaacu

SEQ ID NO: 1600922 - RNA, 21 nt, Human
aaugauaaguaaaugcuaggu

SEQ ID NO: 1600923 - RNA, 20 nt, Human
aaugauaacuggaaacuuca

SEQ ID NO: 1600924 - RNA, 18 nt, Human
aaugauaaguaaaugcua

SEQ ID NO: 1600925 - RNA, 14 nt, Human
aauuaguuuuauau

SEQ ID NO: 1600926 - RNA, 17 nt, Human
aauuaguuuuauaugcu

SEQ ID NO: 1600927 - RNA, 20 nt, Human
aauuaguuuuauaugcuucu

SEQ ID NO: 1600928 - RNA, 22 nt, Human
aauuaaauuuugaguucuacau

SEQ ID NO: 1600929 - RNA, 14 nt, Human
aauuaaauuuugag

SEQ ID NO: 1600930 - RNA, 23 nt, Human
cuuggucucagugucaaugcagc

SEQ ID NO: 1600931 - RNA, 20 nt, Human
gaaaagacuccaaagaaaug

SEQ ID NO: 1600932 - RNA, 21 nt, Human
gaaaagacuccaaagaaaugu

SEQ ID NO: 1600933 - RNA, 23 nt, Human
gaaacuucagcgguuuauauaag

SEQ ID NO: 1600934 - RNA, 17 nt, Human
gaaaucaaauaugcaaa

SEQ ID NO: 1600935 - RNA, 16 nt, Human
gaaaucaaauaugcaa

SEQ ID NO: 1600936 - RNA, 19 nt, Human
gaaaucaaagagagaaaau

SEQ ID NO: 1600937 - RNA, 23 nt, Human
gaaaucaaauaugcaaagcacug

SEQ ID NO: 1600938 - RNA, 18 nt, Human
gaaaugaaagcagggacu

SEQ ID NO: 1600939 - RNA, 17 nt, Human
gaacaaauuuacagaga

SEQ ID NO: 1600940 - RNA, 18 nt, Human
gaacaaauuuacagagac

SEQ ID NO: 1600941 - RNA, 23 nt, Human
gaacaaauuuacagagacagaaa

SEQ ID NO: 1600942 - RNA, 16 nt, Human
gaacaagaugguucua

SEQ ID NO: 1600943 - RNA, 23 nt, Human
cuggaaaaguauguuagugcaaa

SEQ ID NO: 1600944 - RNA, 18 nt, Human
cugccuccccuccucugc

SEQ ID NO: 1600945 - RNA, 17 nt, Human
cugccuccccuccucug

SEQ ID NO: 1600946 - RNA, 20 nt, Human
cugccuccccuccucugcuu

SEQ ID NO: 1600947 - RNA, 19 nt, Human
cugccuccccuccucugcu

SEQ ID NO: 1600948 - RNA, 21 nt, Human
cugccuccccuccucugcuug

SEQ ID NO: 1600949 - RNA, 20 nt, Human
cuguaagaaaauaucacuug

SEQ ID NO: 1600950 - RNA, 20 nt, Human
cugucuacacuaagagagaa

SEQ ID NO: 1600951 - RNA, 12 nt, Human
cuggugccucac

SEQ ID NO: 1600952 - RNA, 21 nt, Human
cuuaaaaaugguuuaaauggu

SEQ ID NO: 1600953 - RNA, 13 nt, Human
cuuaaaaaugguu

SEQ ID NO: 1600954 - RNA, 20 nt, Human
cuuaaaaaugguuuaaaugg

SEQ ID NO: 1600955 - RNA, 23 nt, Human
cugugaaguuuacauuguaaaua

SEQ ID NO: 1600956 - RNA, 23 nt, Human
cugugagaugcuagaacucccuu

SEQ ID NO: 1600957 - RNA, 19 nt, Human
cuguucacagccagacugg

SEQ ID NO: 1600958 - RNA, 22 nt, Human
cuguucacagccagacuggcac

SEQ ID NO: 1600959 - RNA, 22 nt, Human
gagcuguucacagccagacugg

SEQ ID NO: 1600960 - RNA, 20 nt, Human
gagcuguucacagccagacu

SEQ ID NO: 1600961 - RNA, 14 nt, Human
gagcagucaggaaa

SEQ ID NO: 1600962 - RNA, 18 nt, Human
gaggcugagaugggagaa

SEQ ID NO: 1600963 - RNA, 17 nt, Human
gaggcuccacuuggucu

SEQ ID NO: 1600964 - RNA, 18 nt, Human
gaggcuccacuuggucug

SEQ ID NO: 1600965 - RNA, 15 nt, Human
gaggcuccacuuggu

SEQ ID NO: 1600966 - RNA, 21 nt, Human
gaggacgcucucuggccuucg

SEQ ID NO: 1600967 - RNA, 12 nt, Human
gaggagaaacug

SEQ ID NO: 1600968 - RNA, 14 nt, Human
gaggagaaacugga

SEQ ID NO: 1600969 - RNA, 22 nt, Human
gacuuuuuauggcacuaguauu

SEQ ID NO: 1600970 - RNA, 21 nt, Human
gagauugugccccugcacucc

SEQ ID NO: 1600971 - RNA, 20 nt, Human
gagaugcuagaacucccuuu

SEQ ID NO: 1600972 - RNA, 16 nt, Human
gagaugcuagaacucc

SEQ ID NO: 1600973 - RNA, 18 nt, Human
gacagucaccucauggaa

SEQ ID NO: 1600974 - RNA, 12 nt, Human
gacagcucugca

SEQ ID NO: 1600975 - RNA, 14 nt, Human
gacgcucucuggcc

SEQ ID NO: 1600976 - RNA, 14 nt, Human
gaaugaauggcuaa

SEQ ID NO: 1600977 - RNA, 22 nt, Human
gaauauugcuuuggucauauga

SEQ ID NO: 1600978 - RNA, 13 nt, Human
gaauuacauuugu

SEQ ID NO: 1600979 - RNA, 15 nt, Human
gaauuacauuuguau

SEQ ID NO: 1600980 - RNA, 18 nt, Human
gaauuacauuuguauaaa

SEQ ID NO: 1600981 - RNA, 20 nt, Human
gaauuacauuuguauaaaau

SEQ ID NO: 1600982 - RNA, 14 nt, Human
gaauuaacacauga

SEQ ID NO: 1600983 - RNA, 15 nt, Human
gaauuaacacaugau

SEQ ID NO: 1600984 - RNA, 22 nt, Human
gaaugauuaugaauuacauuug

SEQ ID NO: 1600985 - RNA, 14 nt, Human
gaaugauuaugaau

SEQ ID NO: 1600986 - RNA, 15 nt, Human
gaaugaauggcuaag

SEQ ID NO: 1600987 - RNA, 20 nt, Human
gaaugaauggcuaagcaaaa

SEQ ID NO: 1600988 - RNA, 12 nt, Human
gcagaacaguga

SEQ ID NO: 1600989 - RNA, 13 nt, Human
gcagaacagugau

SEQ ID NO: 1600990 - RNA, 18 nt, Human
gcagaacagugauuacca

SEQ ID NO: 1600991 - RNA, 22 nt, Human
gcagaacagugauuaccaggga

SEQ ID NO: 1600992 - RNA, 11 nt, Human
gcagcugccuc

SEQ ID NO: 1600993 - RNA, 22 nt, Human
gcaguuguugcccacagcugua

SEQ ID NO: 1600994 - RNA, 13 nt, Human
gcagugaugucac

SEQ ID NO: 1600995 - RNA, 20 nt, Human
gcaucuagcaugucgucaaa

SEQ ID NO: 1600996 - RNA, 22 nt, Human
gccucauguccacugguucuuc

SEQ ID NO: 1600997 - RNA, 13 nt, Human
gccuccauccuga

SEQ ID NO: 1600998 - RNA, 14 nt, Human
gccuccauccugag

SEQ ID NO: 1600999 - RNA, 15 nt, Human
gccuccauccugagg

SEQ ID NO: 1601000 - RNA, 11 nt, Human
gccccaaaagg

SEQ ID NO: 1601001 - RNA, 13 nt, Human
gcauuuagaugua

SEQ ID NO: 1601002 - RNA, 19 nt, Human
gcauuuaggccaugggaca

SEQ ID NO: 1601003 - RNA, 12 nt, Human
gcauuuagaugu

SEQ ID NO: 1601004 - RNA, 16 nt, Human
ggaaaaaauaacaaug

SEQ ID NO: 1601005 - RNA, 13 nt, Human
ggaaacugccagc

SEQ ID NO: 1601006 - RNA, 19 nt, Human
ggaaaucaggguuaguauu

SEQ ID NO: 1601007 - RNA, 17 nt, Human
ggacagucaccucaugg

SEQ ID NO: 1601008 - RNA, 18 nt, Human
ggacagucaccucaugga

SEQ ID NO: 1601009 - RNA, 21 nt, Human
ggacagucaccucauggaauu

SEQ ID NO: 1601010 - RNA, 13 nt, Human
gcugcugaaacaa

SEQ ID NO: 1601011 - RNA, 20 nt, Human
gcuguauuuuaaaagaauga

SEQ ID NO: 1601012 - RNA, 18 nt, Human
gcuguauuuuaaaagaau

SEQ ID NO: 1601013 - RNA, 21 nt, Human
gcuguauuuuaaaagaaugau

SEQ ID NO: 1601014 - RNA, 14 nt, Human
gcugccuccccucc

SEQ ID NO: 1601015 - RNA, 23 nt, Human
ggaucuucaucugacuaugacau

SEQ ID NO: 1601016 - RNA, 20 nt, Human
ggcuaagcuucacuguaaaa

SEQ ID NO: 1601017 - RNA, 18 nt, Human
ggccuucggccuccaucc

SEQ ID NO: 1601018 - RNA, 22 nt, Human
ggccuucggccuccauccugag

SEQ ID NO: 1601019 - RNA, 16 nt, Human
ggccuucggccuccau

SEQ ID NO: 1601020 - RNA, 23 nt, Human
aaaaagauuuucagaaaauauua

SEQ ID NO: 1601021 - RNA, 13 nt, Human
aaaaauacaaaaa

SEQ ID NO: 1601022 - RNA, 20 nt, Human
aaaaagccugcaauuucaua

SEQ ID NO: 1601023 - RNA, 20 nt, Human
aaagggcuguuauaaucuuu

SEQ ID NO: 1601024 - RNA, 22 nt, Human
aaagggcuguuauaaucuuuca

SEQ ID NO: 1601025 - RNA, 13 nt, Human
aaagcuuauuaaa

SEQ ID NO: 1601026 - RNA, 16 nt, Human
aaagcagaacagugau

SEQ ID NO: 1601027 - RNA, 12 nt, Human
aaacuuuaugcu

SEQ ID NO: 1601028 - RNA, 19 nt, Human
aaacuuuaugcuaagugaa

SEQ ID NO: 1601029 - RNA, 19 nt, Human
gguuuuauuguuuaaaauc

SEQ ID NO: 1601030 - RNA, 17 nt, Human
aaaguauguuagugcaa

SEQ ID NO: 1601031 - RNA, 20 nt, Human
gguucuagcauggcauauuu

SEQ ID NO: 1601032 - RNA, 17 nt, Human
gguguuuuaaaaaaucu

SEQ ID NO: 1601033 - RNA, 15 nt, Human
guaauagagcaaaau

SEQ ID NO: 1601034 - RNA, 19 nt, Human
guaauagagcaaaauugau

SEQ ID NO: 1601035 - RNA, 13 nt, Human
aaauaugcaaagc

SEQ ID NO: 1601036 - RNA, 15 nt, Human
aaauaugcaaagcac

SEQ ID NO: 1601037 - RNA, 16 nt, Human
aaauaugcaaagcacu

SEQ ID NO: 1601038 - RNA, 17 nt, Human
aaauaugcaaagcacug

SEQ ID NO: 1601039 - RNA, 20 nt, Human
aaauauuguguugugaaugu

SEQ ID NO: 1601040 - RNA, 21 nt, Human
aaauaccaugccauuuaaagc

SEQ ID NO: 1601041 - RNA, 22 nt, Human
aaauaucacuugucaauaaaau

SEQ ID NO: 1601042 - RNA, 15 nt, Human
aaauauauuuaauga

SEQ ID NO: 1601043 - RNA, 18 nt, Human
aaauauaugcuaagucuu

SEQ ID NO: 1601044 - RNA, 14 nt, Human
aaauauauuuaaug

SEQ ID NO: 1601045 - RNA, 19 nt, Human
aaacuucagacauagaauu

SEQ ID NO: 1601046 - RNA, 21 nt, Human
aaacuucccuuucugcuugug

SEQ ID NO: 1601047 - RNA, 14 nt, Human
ggucagugcaaaua

SEQ ID NO: 1601048 - RNA, 18 nt, Human
ggucauauuaauauauuu

SEQ ID NO: 1601049 - RNA, 16 nt, Human
aaaaugguuuaaaugg

SEQ ID NO: 1601050 - RNA, 18 nt, Human
aaaaugguuuaaaugguc

SEQ ID NO: 1601051 - RNA, 16 nt, Human
aaaauggguuuuacug

SEQ ID NO: 1601052 - RNA, 15 nt, Human
gggcgugguggugag

SEQ ID NO: 1601053 - RNA, 11 nt, Human
aaaauaauuuu

SEQ ID NO: 1601054 - RNA, 16 nt, Human
aaaauaauuuuuauau

SEQ ID NO: 1601055 - RNA, 17 nt, Human
aaaauaauuuuuauauu

SEQ ID NO: 1601056 - RNA, 20 nt, Human
aaaauaauuuuuauauuuga

SEQ ID NO: 1601057 - RNA, 14 nt, Human
aaaauacacacuca

SEQ ID NO: 1601058 - RNA, 15 nt, Human
aaaauauauuuaaug

SEQ ID NO: 1601059 - RNA, 16 nt, Human
aaaauauauuuaauga

SEQ ID NO: 1601060 - RNA, 15 nt, Human
cugaaacaacaaaua

SEQ ID NO: 1601061 - RNA, 13 nt, Human
cugaaacuucccu

SEQ ID NO: 1601062 - RNA, 22 nt, Human
cucuuagaugcaguucugaaga

SEQ ID NO: 1601063 - RNA, 16 nt, Human
cugagaugugaacaca

SEQ ID NO: 1601064 - RNA, 14 nt, Human
cucguuaauuugua

SEQ ID NO: 1601065 - RNA, 20 nt, Human
cuccucugcuugccaucccu

SEQ ID NO: 1601066 - RNA, 17 nt, Human
cuccucugcuugccauc

SEQ ID NO: 1601067 - RNA, 16 nt, Human
cuccucugcuugccau

SEQ ID NO: 1601068 - RNA, 15 nt, Human
cuccucugcuugcca

SEQ ID NO: 1601069 - RNA, 22 nt, Human
cuccucugcuugccaucccucc

SEQ ID NO: 1601070 - RNA, 21 nt, Human
cuccucugcuugccaucccuc

SEQ ID NO: 1601071 - RNA, 22 nt, Human
cuccugggcagcugccuccccu

SEQ ID NO: 1601072 - RNA, 19 nt, Human
cuccugggcagcugccucc

SEQ ID NO: 1601073 - RNA, 18 nt, Human
cuccugggcagcugccuc

SEQ ID NO: 1601074 - RNA, 17 nt, Human
cuccugggcagcugccu

SEQ ID NO: 1601075 - RNA, 16 nt, Human
cuccugggcagcugcc

SEQ ID NO: 1601076 - RNA, 15 nt, Human
cuccugggcagcugc

SEQ ID NO: 1601077 - RNA, 14 nt, Human
cuccugggcagcug

SEQ ID NO: 1601078 - RNA, 12 nt, Human
cuccugggcagc

SEQ ID NO: 1601079 - RNA, 14 nt, Human
cuccucugcuugcc

SEQ ID NO: 1601080 - RNA, 12 nt, Human
cuccucugcuug

SEQ ID NO: 1601081 - RNA, 13 nt, Human
cuccacuuggucu

SEQ ID NO: 1601082 - RNA, 15 nt, Human
cuccacuuggucugu

SEQ ID NO: 1601083 - RNA, 16 nt, Human
cuccacuuggucugug

SEQ ID NO: 1601084 - RNA, 17 nt, Human
cuccacuuggucuguga

SEQ ID NO: 1601085 - RNA, 21 nt, Human
cuccacuuggucugugagaug

SEQ ID NO: 1601086 - RNA, 22 nt, Human
cuccacuuggucugugagaugc

SEQ ID NO: 1601087 - RNA, 23 nt, Human
cuccacuuggucugugagaugcu

SEQ ID NO: 1601088 - RNA, 23 nt, Human
cucaaaauaccaugccauuuaaa

SEQ ID NO: 1601089 - RNA, 12 nt, Human
cuagaacucccu

SEQ ID NO: 1601090 - RNA, 13 nt, Human
cuagaacucccuu

SEQ ID NO: 1601091 - RNA, 22 nt, Human
cuaaguaaaaccacagcaguug

SEQ ID NO: 1601092 - RNA, 23 nt, Human
cuaaguaaaaccacagcaguuga

SEQ ID NO: 1601093 - RNA, 20 nt, Human
cuaaguaaaaccacagcagu

SEQ ID NO: 1601094 - RNA, 20 nt, Human
cuacaugagguacugagagu

SEQ ID NO: 1601095 - RNA, 18 nt, Human
cuacauacuauggaauuu

SEQ ID NO: 1601096 - RNA, 18 nt, Human
cuacaaaaacacagcaag

SEQ ID NO: 1601097 - RNA, 16 nt, Human
cuacaaaaacacagca

SEQ ID NO: 1601098 - RNA, 17 nt, Human
cuacaaaaacacagcaa

SEQ ID NO: 1601099 - RNA, 18 nt, Human
cgcaggcccccaggugcc

SEQ ID NO: 1601100 - RNA, 23 nt, Human
cgccacuguuuugaaucucauaa

SEQ ID NO: 1601101 - RNA, 15 nt, Human
ccuguaaucacagcu

SEQ ID NO: 1601102 - RNA, 23 nt, Human
ccucauggaauuggagcucgugg

SEQ ID NO: 1601103 - RNA, 18 nt, Human
ccccugcacuccagccug

SEQ ID NO: 1601104 - RNA, 13 nt, Human
ccauacauuugug

SEQ ID NO: 1601105 - RNA, 14 nt, Human
ccauacauuugugu

SEQ ID NO: 1601106 - RNA, 22 nt, Human
ccauuuaaagcuuauuaaaacu

SEQ ID NO: 1601107 - RNA, 13 nt, Human
cagauccuggaaa

SEQ ID NO: 1601108 - RNA, 12 nt, Human
cagauccuggaa

SEQ ID NO: 1601109 - RNA, 17 nt, Human
cagagguugcagugagc

SEQ ID NO: 1601110 - RNA, 18 nt, Human
cagcaguucagagcugcc

SEQ ID NO: 1601111 - RNA, 13 nt, Human
cagcaguucagag

SEQ ID NO: 1601112 - RNA, 21 nt, Human
cagcuccccucggagaagagc

SEQ ID NO: 1601113 - RNA, 22 nt, Human
cagcuccccucggagaagagcu

SEQ ID NO: 1601114 - RNA, 16 nt, Human
cagucaccucauggaa

SEQ ID NO: 1601115 - RNA, 15 nt, Human
cagucacauuccaag

SEQ ID NO: 1601116 - RNA, 19 nt, Human
cagucaccucauggaauug

SEQ ID NO: 1601117 - RNA, 19 nt, Human
caggugccaguuauggcua

SEQ ID NO: 1601118 - RNA, 20 nt, Human
cagucugacuguuuccauca

SEQ ID NO: 1601119 - RNA, 23 nt, Human
ccacagcaguugaaaagacucca

SEQ ID NO: 1601120 - RNA, 17 nt, Human
ccacagcaguugaaaag

SEQ ID NO: 1601121 - RNA, 18 nt, Human
ccacagcaguugaaaaga

SEQ ID NO: 1601122 - RNA, 12 nt, Human
ccacagcaguug

SEQ ID NO: 1601123 - RNA, 19 nt, Human
cauuuguauaaaauaauuu

SEQ ID NO: 1601124 - RNA, 20 nt, Human
cauuuguauaaaauaauuuu

SEQ ID NO: 1601125 - RNA, 18 nt, Human
ccaaauguucaucaauga

SEQ ID NO: 1601126 - RNA, 17 nt, Human
ccaaauguucaucaaug

SEQ ID NO: 1601127 - RNA, 14 nt, Human
caugauguuuagaa

SEQ ID NO: 1601128 - RNA, 19 nt, Human
cauuauauuuauuacugua

SEQ ID NO: 1601129 - RNA, 23 nt, Human
cauaugcuguauauccuuucuaa

SEQ ID NO: 1601130 - RNA, 19 nt, Human
cauauuaauauauuuccau

SEQ ID NO: 1601131 - RNA, 15 nt, Human
cauauuaauauauuu

SEQ ID NO: 1601132 - RNA, 14 nt, Human
cauauuaauauauu

SEQ ID NO: 1601133 - RNA, 14 nt, Human
caaguauuagaaua

SEQ ID NO: 1601134 - RNA, 20 nt, Human
caaguauuagaauaccacag

SEQ ID NO: 1601135 - RNA, 16 nt, Human
cacaagacugcacauc

SEQ ID NO: 1601136 - RNA, 12 nt, Human
caauuuaaaaaa

SEQ ID NO: 1601137 - RNA, 12 nt, Human
caauauuucaga

SEQ ID NO: 1601138 - RNA, 20 nt, Human
caauauuucagauaaucaca

SEQ ID NO: 1601139 - RNA, 21 nt, Human
caauauuucagauaaucacaa

SEQ ID NO: 1601140 - RNA, 14 nt, Human
caaugcuguauuuu

SEQ ID NO: 1601141 - RNA, 23 nt, Human
caaugcuguauuuuaaaagaaug

SEQ ID NO: 1601142 - RNA, 11 nt, Human
cacugaagaag

SEQ ID NO: 1601143 - RNA, 21 nt, Human
caccuacaugagguacugaga

SEQ ID NO: 1601144 - RNA, 23 nt, Human
caccucaaaauaccaugccauuu

SEQ ID NO: 1601145 - RNA, 20 nt, Human
cacuuggucugugagaugcu

SEQ ID NO: 1601146 - RNA, 12 nt, Human
cagaauauguuu

SEQ ID NO: 1601147 - RNA, 17 nt, Human
cagaauauguuucaaac

SEQ ID NO: 1601148 - RNA, 15 nt, Human
cagaauauguuucaa

SEQ ID NO: 1601149 - RNA, 14 nt, Human
cagaauauguuuca

SEQ ID NO: 1601150 - RNA, 13 nt, Human
cagaauauguuuc

SEQ ID NO: 1601151 - RNA, 20 nt, Human
cagaauauguuucaaacuuu

SEQ ID NO: 1601152 - RNA, 18 nt, Human
cagaauauguuucaaacu

SEQ ID NO: 1601153 - RNA, 13 nt, Human
cagaauauugcuu

SEQ ID NO: 1601154 - RNA, 15 nt, Human
caacacgagcaggcu

SEQ ID NO: 1601155 - RNA, 21 nt, Human
caacuaucucauuuccaagca

SEQ ID NO: 1601156 - RNA, 19 nt, Human
caacccaaauguucaucaa

SEQ ID NO: 1601157 - RNA, 17 nt, Human
auuuuauagcuacuaau

SEQ ID NO: 1601158 - RNA, 18 nt, Human
caaaaaaauauauuuaau

SEQ ID NO: 1601159 - RNA, 13 nt, Human
auuguaaaauggu

SEQ ID NO: 1601160 - RNA, 23 nt, Human
auuguaauaggcguaacuaauuu

SEQ ID NO: 1601161 - RNA, 14 nt, Human
auuguaaaugugcu

SEQ ID NO: 1601162 - RNA, 15 nt, Human
auuguaaaugugcuu

SEQ ID NO: 1601163 - RNA, 17 nt, Human
auuguaaaugugcuuuu

SEQ ID NO: 1601164 - RNA, 19 nt, Human
auuguuuaaaaucauuucu

SEQ ID NO: 1601165 - RNA, 15 nt, Human
auuucuaugaaauau

SEQ ID NO: 1601166 - RNA, 18 nt, Human
auuucuaugaaauauuau

SEQ ID NO: 1601167 - RNA, 20 nt, Human
auuucuaugaaauauuaugu

SEQ ID NO: 1601168 - RNA, 22 nt, Human
auuuaaugauaaguaaaugcua

SEQ ID NO: 1601169 - RNA, 16 nt, Human
auuucagcagcugcag

SEQ ID NO: 1601170 - RNA, 19 nt, Human
auuuauacaggucauauua

SEQ ID NO: 1601171 - RNA, 17 nt, Human
auucuugccaaauauaa

SEQ ID NO: 1601172 - RNA, 18 nt, Human
auucacaagacccaaaag

SEQ ID NO: 1601173 - RNA, 22 nt, Human
auucaagaaaacaacuucaaua

SEQ ID NO: 1601174 - RNA, 18 nt, Human
auuaaauuuugaguucua

SEQ ID NO: 1601175 - RNA, 20 nt, Human
auuaaauuuugaguucuaca

SEQ ID NO: 1601176 - RNA, 19 nt, Human
uuuuuauauuugaaauauu

SEQ ID NO: 1601177 - RNA, 17 nt, Human
uuuuguucauacauauu

SEQ ID NO: 1601178 - RNA, 14 nt, Human
uuuuguucauacau

SEQ ID NO: 1601179 - RNA, 14 nt, Human
uuuugaguucuaca

SEQ ID NO: 1601180 - RNA, 17 nt, Human
auuauauaaguauucua

SEQ ID NO: 1601181 - RNA, 14 nt, Human
auuauauaaguauu

SEQ ID NO: 1601182 - RNA, 20 nt, Human
auuauauaaguauucuaaau

SEQ ID NO: 1601183 - RNA, 17 nt, Human
auuacauuuguauaaaa

SEQ ID NO: 1601184 - RNA, 18 nt, Human
auuacauuuguauaaaau

SEQ ID NO: 1601185 - RNA, 20 nt, Human
auuacauuuguauaaaauaa

SEQ ID NO: 1601186 - RNA, 19 nt, Human
uuuuugugaaaagcuccau

SEQ ID NO: 1601187 - RNA, 23 nt, Human
auuaaguaaugauaacuggaaac

SEQ ID NO: 1601188 - RNA, 17 nt, Human
uuuuuguagcacugaca

SEQ ID NO: 1601189 - RNA, 20 nt, Human
augugcuaguaauuggaaag

SEQ ID NO: 1601190 - RNA, 19 nt, Human
augugcuaguaauuggaaa

SEQ ID NO: 1601191 - RNA, 16 nt, Human
uuuuaauaauguuuca

SEQ ID NO: 1601192 - RNA, 12 nt, Human
uuuuaauaaugu

SEQ ID NO: 1601193 - RNA, 13 nt, Human
uuuuaauaauguu

SEQ ID NO: 1601194 - RNA, 14 nt, Human
uuuuaauaauguuu

SEQ ID NO: 1601195 - RNA, 18 nt, Human
auguucaucaaugaauga

SEQ ID NO: 1601196 - RNA, 15 nt, Human
auguuuucaggcuag

SEQ ID NO: 1601197 - RNA, 17 nt, Human
auguuuucaggcuagau

SEQ ID NO: 1601198 - RNA, 21 nt, Human
auguuuucaggcuagauguau

SEQ ID NO: 1601199 - RNA, 15 nt, Human
auuaaaagaauauuu

SEQ ID NO: 1601200 - RNA, 14 nt, Human
uuuucucuaggaaa

SEQ ID NO: 1601201 - RNA, 16 nt, Human
uuuucucuaggaaaua

SEQ ID NO: 1601202 - RNA, 15 nt, Human
uuuucugagaaagac

SEQ ID NO: 1601203 - RNA, 18 nt, Human
uuuucugagaaagacuau

SEQ ID NO: 1601204 - RNA, 15 nt, Human
uuuuccaaaauaauu

SEQ ID NO: 1601205 - RNA, 14 nt, Human
auucuaaauuuuau

SEQ ID NO: 1601206 - RNA, 18 nt, Human
auugacccacaagaaaug

SEQ ID NO: 1601207 - RNA, 21 nt, Human
auugacccacaagaaaugaaa

SEQ ID NO: 1601208 - RNA, 14 nt, Human
auuugaaauauuga

SEQ ID NO: 1601209 - RNA, 19 nt, Human
auuuauuuuaauaauguuu

SEQ ID NO: 1601210 - RNA, 20 nt, Human
auuuauuuuaauaauguuuc

SEQ ID NO: 1601211 - RNA, 12 nt, Human
auuucauuucuu

SEQ ID NO: 1601212 - RNA, 17 nt, Human
auuuauuuuaauaaugu

SEQ ID NO: 1601213 - RNA, 13 nt, Human
auuuagauguaua

SEQ ID NO: 1601214 - RNA, 18 nt, Human
auuuuaaaagaaugauua

SEQ ID NO: 1601215 - RNA, 22 nt, Human
auuuuaaaagaaugauuaugaa

SEQ ID NO: 1601216 - RNA, 18 nt, Human
auuuguauaaaauaauuu

SEQ ID NO: 1601217 - RNA, 19 nt, Human
auuuguauaaaauaauuuu

SEQ ID NO: 1601218 - RNA, 21 nt, Human
auuuguauaaaauaauuuuua

SEQ ID NO: 1601219 - RNA, 17 nt, Human
auuuuaaaagaaugauu

SEQ ID NO: 1601220 - RNA, 22 nt, Human
auuuucaguuauuauauuuaca

SEQ ID NO: 1601221 - RNA, 17 nt, Human
auuuucagaaaauauua

SEQ ID NO: 1601222 - RNA, 14 nt, Human
auuuucagaaaaua

SEQ ID NO: 1601223 - RNA, 11 nt, Human
uugcucaugga

SEQ ID NO: 1601224 - RNA, 12 nt, Human
uugcucauggaa

SEQ ID NO: 1601225 - RNA, 21 nt, Human
augaaauauuauguuaaaacu

SEQ ID NO: 1601226 - RNA, 20 nt, Human
augaaauauuauguuaaaac

SEQ ID NO: 1601227 - RNA, 13 nt, Human
uuguauaaaauaa

SEQ ID NO: 1601228 - RNA, 21 nt, Human
augaauuaguuuuauaugcuu

SEQ ID NO: 1601229 - RNA, 23 nt, Human
augaauuaguuuuauaugcuucu

SEQ ID NO: 1601230 - RNA, 18 nt, Human
augaauuacauuuguaua

SEQ ID NO: 1601231 - RNA, 19 nt, Human
augaauuacauuuguauaa

SEQ ID NO: 1601232 - RNA, 22 nt, Human
augaauuacauuuguauaaaau

SEQ ID NO: 1601233 - RNA, 18 nt, Human
uugugaagcaaaauuuuu

SEQ ID NO: 1601234 - RNA, 14 nt, Human
augauaacuggaaa

SEQ ID NO: 1601235 - RNA, 19 nt, Human
augacauaaaaacaacuuu

SEQ ID NO: 1601236 - RNA, 22 nt, Human
augggacauuugcucauggaau

SEQ ID NO: 1601237 - RNA, 21 nt, Human
augggacauuugcucauggaa

SEQ ID NO: 1601238 - RNA, 21 nt, Human
auggcuauaggugcuacaaaa

SEQ ID NO: 1601239 - RNA, 23 nt, Human
auggcuauaggugcuacaaaaac

SEQ ID NO: 1601240 - RNA, 16 nt, Human
auggcuauaggugcua

SEQ ID NO: 1601241 - RNA, 19 nt, Human
auggcuauaggugcuacaa

SEQ ID NO: 1601242 - RNA, 17 nt, Human
auggaauuucucccagu

SEQ ID NO: 1601243 - RNA, 13 nt, Human
uuucuaugaaaua

SEQ ID NO: 1601244 - RNA, 14 nt, Human
uuucuaugaaauau

SEQ ID NO: 1601245 - RNA, 20 nt, Human
uuucuaugaaauauuauguu

SEQ ID NO: 1601246 - RNA, 14 nt, Human
uuucugcaucagcu

SEQ ID NO: 1601247 - RNA, 14 nt, Human
uuugaaauauugac

SEQ ID NO: 1601248 - RNA, 15 nt, Human
uuugaaauauugacu

SEQ ID NO: 1601249 - RNA, 24 nt, Human
uuuaaagcuuauuaaaacucauuu

SEQ ID NO: 1601250 - RNA, 17 nt, Human
uuuauaugcuucuguuu

SEQ ID NO: 1601251 - RNA, 19 nt, Human
uuuauaugcuucuguuuua

SEQ ID NO: 1601252 - RNA, 16 nt, Human
uuuauuuuaauaaugu

SEQ ID NO: 1601253 - RNA, 16 nt, Human
auggaacauaaaauac

SEQ ID NO: 1601254 - RNA, 14 nt, Human
augcuguauuuuaa

SEQ ID NO: 1601255 - RNA, 19 nt, Human
augcuguauuuuaaaagaa

SEQ ID NO: 1601256 - RNA, 23 nt, Human
augcugucuacacuaagagagaa

SEQ ID NO: 1601257 - RNA, 19 nt, Human
uuuauuacuguaagaaaau

SEQ ID NO: 1601258 - RNA, 19 nt, Human
augcuguauauccuuucua

SEQ ID NO: 1601259 - RNA, 22 nt, Human
uuucagaaaauauuauguguuu

SEQ ID NO: 1601260 - RNA, 23 nt, Human
auggaauuggagcucgugggaca

SEQ ID NO: 1601261 - RNA, 15 nt, Human
uuucauaugcuguau

SEQ ID NO: 1601262 - RNA, 17 nt, Human
uucagcgguuuauauaa

SEQ ID NO: 1601263 - RNA, 13 nt, Human
auauaugcuaagu

SEQ ID NO: 1601264 - RNA, 15 nt, Human
uucaucaaugaauga

SEQ ID NO: 1601265 - RNA, 16 nt, Human
auauauuuaaugauaa

SEQ ID NO: 1601266 - RNA, 14 nt, Human
uucauuaucucaaa

SEQ ID NO: 1601267 - RNA, 23 nt, Human
auauguaccuaacgaaguauccu

SEQ ID NO: 1601268 - RNA, 15 nt, Human
auaugcaaagcacug

SEQ ID NO: 1601269 - RNA, 13 nt, Human
auaugcaaagcac

SEQ ID NO: 1601270 - RNA, 14 nt, Human
auaugcaaagcacu

SEQ ID NO: 1601271 - RNA, 21 nt, Human
auaugagcuuccuucugugaa

SEQ ID NO: 1601272 - RNA, 22 nt, Human
auaugagcuuccuucugugaaa

SEQ ID NO: 1601273 - RNA, 14 nt, Human
aucaauuuuucuua

SEQ ID NO: 1601274 - RNA, 19 nt, Human
aucaauuuuucuuauuuca

SEQ ID NO: 1601275 - RNA, 21 nt, Human
aucaaggguacacugccuucu

SEQ ID NO: 1601276 - RNA, 13 nt, Human
aucaauuuaaaaa

SEQ ID NO: 1601277 - RNA, 16 nt, Human
aucaaggguacacugc

SEQ ID NO: 1601278 - RNA, 16 nt, Human
aucaaauaugcaaagc

SEQ ID NO: 1601279 - RNA, 17 nt, Human
aucaaauaugcaaagca

SEQ ID NO: 1601280 - RNA, 18 nt, Human
aucaaauaugcaaagcac

SEQ ID NO: 1601281 - RNA, 23 nt, Human
auauuuuuguagcacugacagau

SEQ ID NO: 1601282 - RNA, 16 nt, Human
auauuuuuguagcacu

SEQ ID NO: 1601283 - RNA, 15 nt, Human
auauuuuuguagcac

SEQ ID NO: 1601284 - RNA, 18 nt, Human
auauuuuucacauaucua

SEQ ID NO: 1601285 - RNA, 17 nt, Human
uucccagugaauucuug

SEQ ID NO: 1601286 - RNA, 16 nt, Human
auauguuucaaacuuu

SEQ ID NO: 1601287 - RNA, 14 nt, Human
auauguuucaaacu

SEQ ID NO: 1601288 - RNA, 13 nt, Human
auauguuucaaac

SEQ ID NO: 1601289 - RNA, 14 nt, Human
auauuguuugcuaa

SEQ ID NO: 1601290 - RNA, 13 nt, Human
auauuuacaaaug

SEQ ID NO: 1601291 - RNA, 23 nt, Human
auauuuaaugauaaguaaaugcu

SEQ ID NO: 1601292 - RNA, 13 nt, Human
auauuuaaugaua

SEQ ID NO: 1601293 - RNA, 12 nt, Human
auauuuaaugau

SEQ ID NO: 1601294 - RNA, 16 nt, Human
auccugcaauuccacu

SEQ ID NO: 1601295 - RNA, 22 nt, Human
auccugaggcuccacuuggucu

SEQ ID NO: 1601296 - RNA, 13 nt, Human
auccugccccuga

SEQ ID NO: 1601297 - RNA, 11 nt, Human
auccugaggcu

SEQ ID NO: 1601298 - RNA, 13 nt, Human
auccugaggcucc

SEQ ID NO: 1601299 - RNA, 16 nt, Human
auccugaggcuccacu

SEQ ID NO: 1601300 - RNA, 18 nt, Human
auccugaggcuccacuug

SEQ ID NO: 1601301 - RNA, 19 nt, Human
uugacacuuaaaaaugguu

SEQ ID NO: 1601302 - RNA, 14 nt, Human
uugacccacaagaa

SEQ ID NO: 1601303 - RNA, 14 nt, Human
uugagaguucuaaa

SEQ ID NO: 1601304 - RNA, 16 nt, Human
uugauaaguucauaca

SEQ ID NO: 1601305 - RNA, 17 nt, Human
uugauaaguucauacau

SEQ ID NO: 1601306 - RNA, 17 nt, Human
uugacacuuaaaaaugg

SEQ ID NO: 1601307 - RNA, 17 nt, Human
uugaaggaaaaugauac

SEQ ID NO: 1601308 - RNA, 21 nt, Human
aucccucccuccaccucccug

SEQ ID NO: 1601309 - RNA, 20 nt, Human
aucccucccuccaccucccu

SEQ ID NO: 1601310 - RNA, 18 nt, Human
aucccucccuccaccucc

SEQ ID NO: 1601311 - RNA, 17 nt, Human
aucccucccuccaccuc

SEQ ID NO: 1601312 - RNA, 16 nt, Human
aucccucccuccaccu

SEQ ID NO: 1601313 - RNA, 16 nt, Human
uucuguuuuauaauuu

SEQ ID NO: 1601314 - RNA, 17 nt, Human
uucuguuuuauaauuuu

SEQ ID NO: 1601315 - RNA, 16 nt, Human
uucugcaucagcugcu

SEQ ID NO: 1601316 - RNA, 23 nt, Human
aucacuugaacccgggaggcaga

SEQ ID NO: 1601317 - RNA, 23 nt, Human
aucagugugucuaaauuugaaug

SEQ ID NO: 1601318 - RNA, 13 nt, Human
ugcuggagcucug

SEQ ID NO: 1601319 - RNA, 14 nt, Human
ugcuggagcucugc

SEQ ID NO: 1601320 - RNA, 14 nt, Human
aggacacugauaug

SEQ ID NO: 1601321 - RNA, 17 nt, Human
aggacacugauaugggu

SEQ ID NO: 1601322 - RNA, 11 nt, Human
aggaauuuaaa

SEQ ID NO: 1601323 - RNA, 11 nt, Human
aggagaaacug

SEQ ID NO: 1601324 - RNA, 17 nt, Human
aggagaaacuggaacuc

SEQ ID NO: 1601325 - RNA, 16 nt, Human
ugcuugccaucccucc

SEQ ID NO: 1601326 - RNA, 15 nt, Human
ugcuugccaucccuc

SEQ ID NO: 1601327 - RNA, 13 nt, Human
uggaaaggcagcu

SEQ ID NO: 1601328 - RNA, 18 nt, Human
uggaauuggagcucgugg

SEQ ID NO: 1601329 - RNA, 22 nt, Human
uggaauuucucccagucauuua

SEQ ID NO: 1601330 - RNA, 18 nt, Human
uggacgagaaaacaauaa

SEQ ID NO: 1601331 - RNA, 22 nt, Human
uggcacaguuuucugagaaaga

SEQ ID NO: 1601332 - RNA, 21 nt, Human
agcugcccucuccugggcagc

SEQ ID NO: 1601333 - RNA, 20 nt, Human
agcugcccucuccugggcag

SEQ ID NO: 1601334 - RNA, 19 nt, Human
agcugcccucuccugggca

SEQ ID NO: 1601335 - RNA, 18 nt, Human
agcugcccucuccugggc

SEQ ID NO: 1601336 - RNA, 17 nt, Human
agcugcccucuccuggg

SEQ ID NO: 1601337 - RNA, 15 nt, Human
ugccuccccuccucu

SEQ ID NO: 1601338 - RNA, 14 nt, Human
ugccuccccuccuc

SEQ ID NO: 1601339 - RNA, 13 nt, Human
ugccuccccuccu

SEQ ID NO: 1601340 - RNA, 12 nt, Human
ugccuccccucc

SEQ ID NO: 1601341 - RNA, 11 nt, Human
ugccuccccuc

SEQ ID NO: 1601342 - RNA, 16 nt, Human
ugccuccccuccucug

SEQ ID NO: 1601343 - RNA, 18 nt, Human
ugccucagaaaacaagga

SEQ ID NO: 1601344 - RNA, 15 nt, Human
ugccucaccccuugc

SEQ ID NO: 1601345 - RNA, 19 nt, Human
ugcccuguuaaaagaugaa

SEQ ID NO: 1601346 - RNA, 20 nt, Human
ugcccucuccugggcagcug

SEQ ID NO: 1601347 - RNA, 18 nt, Human
ugcccucuccugggcagc

SEQ ID NO: 1601348 - RNA, 17 nt, Human
ugcccucuccugggcag

SEQ ID NO: 1601349 - RNA, 16 nt, Human
ugcccucuccugggca

SEQ ID NO: 1601350 - RNA, 23 nt, Human
ugcccucuccugggcagcugccu

SEQ ID NO: 1601351 - RNA, 22 nt, Human
ugcccucuccugggcagcugcc

SEQ ID NO: 1601352 - RNA, 15 nt, Human
ugcccucuccugggc

SEQ ID NO: 1601353 - RNA, 14 nt, Human
ugcccucuccuggg

SEQ ID NO: 1601354 - RNA, 13 nt, Human
ugcccucuccugg

SEQ ID NO: 1601355 - RNA, 12 nt, Human
ugcccucuccug

SEQ ID NO: 1601356 - RNA, 23 nt, Human
agcucugcccauccugccccuga

SEQ ID NO: 1601357 - RNA, 22 nt, Human
ugccauuuaaagcuuauuaaaa

SEQ ID NO: 1601358 - RNA, 16 nt, Human
ugccccauucaacauc

SEQ ID NO: 1601359 - RNA, 19 nt, Human
ugaugggaaagcauuguaa

SEQ ID NO: 1601360 - RNA, 11 nt, Human
ugaugaagaag

SEQ ID NO: 1601361 - RNA, 12 nt, Human
ugaugaagaagu

SEQ ID NO: 1601362 - RNA, 23 nt, Human
ugauuaaguaaugauaacuggaa

SEQ ID NO: 1601363 - RNA, 18 nt, Human
ugauuaaguaaugauaac

SEQ ID NO: 1601364 - RNA, 21 nt, Human
agccagcaguucagagcugcc

SEQ ID NO: 1601365 - RNA, 20 nt, Human
agccagcaguucagagcugc

SEQ ID NO: 1601366 - RNA, 22 nt, Human
agccagcaguucagagcugccc

SEQ ID NO: 1601367 - RNA, 19 nt, Human
agccagcaguucagagcug

SEQ ID NO: 1601368 - RNA, 17 nt, Human
agccagcaguucagagc

SEQ ID NO: 1601369 - RNA, 14 nt, Human
ugcagaagacagua

SEQ ID NO: 1601370 - RNA, 15 nt, Human
ugcagaagacaguau

SEQ ID NO: 1601371 - RNA, 13 nt, Human
uguuuuauaauuu

SEQ ID NO: 1601372 - RNA, 20 nt, Human
uguuuuauaauuuugugaag

SEQ ID NO: 1601373 - RNA, 19 nt, Human
uguuugcuaagcauuccaa

SEQ ID NO: 1601374 - RNA, 15 nt, Human
uguuugcuaagcauu

SEQ ID NO: 1601375 - RNA, 21 nt, Human
aguugauaugccuuuucccaa

SEQ ID NO: 1601376 - RNA, 13 nt, Human
aguucugaagaag

SEQ ID NO: 1601377 - RNA, 14 nt, Human
aguucugaagaaga

SEQ ID NO: 1601378 - RNA, 15 nt, Human
aguucugaagaagau

SEQ ID NO: 1601379 - RNA, 16 nt, Human
aguucugaagaagaug

SEQ ID NO: 1601380 - RNA, 19 nt, Human
uuaaaaaagaaacauuugg

SEQ ID NO: 1601381 - RNA, 15 nt, Human
uuaaaaaagaaacau

SEQ ID NO: 1601382 - RNA, 18 nt, Human
uuaaaaaagaaacauuug

SEQ ID NO: 1601383 - RNA, 14 nt, Human
uuaaaaucauuucu

SEQ ID NO: 1601384 - RNA, 19 nt, Human
aguucagagcugcccucuc

SEQ ID NO: 1601385 - RNA, 18 nt, Human
aguucagagcugcccucu

SEQ ID NO: 1601386 - RNA, 17 nt, Human
aguucagagcugcccuc

SEQ ID NO: 1601387 - RNA, 16 nt, Human
aguucagagcugcccu

SEQ ID NO: 1601388 - RNA, 15 nt, Human
aguucagagcugccc

SEQ ID NO: 1601389 - RNA, 15 nt, Human
aguucuaaauuuugu

SEQ ID NO: 1601390 - RNA, 20 nt, Human
aguuauuauauuuacaaaug

SEQ ID NO: 1601391 - RNA, 19 nt, Human
aguuauggcuauaggugcu

SEQ ID NO: 1601392 - RNA, 22 nt, Human
aguuauugauaaguucauacau

SEQ ID NO: 1601393 - RNA, 21 nt, Human
aguuauugauaaguucauaca

SEQ ID NO: 1601394 - RNA, 19 nt, Human
aguuauugauaaguucaua

SEQ ID NO: 1601395 - RNA, 17 nt, Human
aguuauugauaaguuca

SEQ ID NO: 1601396 - RNA, 23 nt, Human
aguuauugauaaguucauacauu

SEQ ID NO: 1601397 - RNA, 22 nt, Human
auacauuguacgaagaguauuu

SEQ ID NO: 1601398 - RNA, 21 nt, Human
auacauuguacgaagaguauu

SEQ ID NO: 1601399 - RNA, 14 nt, Human
auacauuguacgaa

SEQ ID NO: 1601400 - RNA, 20 nt, Human
auacaucccuuaccugggaa

SEQ ID NO: 1601401 - RNA, 19 nt, Human
auacauauuuuuguagcac

SEQ ID NO: 1601402 - RNA, 21 nt, Human
auacaguucggugagcuacaa

SEQ ID NO: 1601403 - RNA, 21 nt, Human
auacaggucauauuaauauau

SEQ ID NO: 1601404 - RNA, 15 nt, Human
auacaggucauauua

SEQ ID NO: 1601405 - RNA, 22 nt, Human
auaccacaggaaccacaagacu

SEQ ID NO: 1601406 - RNA, 22 nt, Human
uuaucaaagggugaaaauuauu

SEQ ID NO: 1601407 - RNA, 13 nt, Human
auaauuuugugaa

SEQ ID NO: 1601408 - RNA, 14 nt, Human
auaauuuugugaag

SEQ ID NO: 1601409 - RNA, 15 nt, Human
auaauuuugugaagc

SEQ ID NO: 1601410 - RNA, 20 nt, Human
auaauuuugugaagcaaaau

SEQ ID NO: 1601411 - RNA, 14 nt, Human
auaauuuuuauauu

SEQ ID NO: 1601412 - RNA, 16 nt, Human
auaauuuuuauauuug

SEQ ID NO: 1601413 - RNA, 19 nt, Human
auaauuuuuauauuugaaa

SEQ ID NO: 1601414 - RNA, 21 nt, Human
auaauuuuuauauuugaaaua

SEQ ID NO: 1601415 - RNA, 22 nt, Human
auaauuuuuauauuugaaauau

SEQ ID NO: 1601416 - RNA, 22 nt, Human
auacaaaaaaaaaaaaaaauua

SEQ ID NO: 1601417 - RNA, 21 nt, Human
auaauuuuaagaaaucaaaga

SEQ ID NO: 1601418 - RNA, 15 nt, Human
auaauuuuaagaaau

SEQ ID NO: 1601419 - RNA, 18 nt, Human
uuauauaagcuuguauuc

SEQ ID NO: 1601420 - RNA, 16 nt, Human
uuauauaaguauucua

SEQ ID NO: 1601421 - RNA, 14 nt, Human
uuauauaaguauuc

SEQ ID NO: 1601422 - RNA, 13 nt, Human
uuauauaaguauu

SEQ ID NO: 1601423 - RNA, 19 nt, Human
uuauacccagaaaguuauu

SEQ ID NO: 1601424 - RNA, 18 nt, Human
uuauacccagaaaguuau

SEQ ID NO: 1601425 - RNA, 23 nt, Human
uuauacccagaaaguuauugaua

SEQ ID NO: 1601426 - RNA, 23 nt, Human
uuauagaguguacuuaacuauuc

SEQ ID NO: 1601427 - RNA, 18 nt, Human
aguuuucugagaaagacu

SEQ ID NO: 1601428 - RNA, 14 nt, Human
aguuuucugagaaa

SEQ ID NO: 1601429 - RNA, 17 nt, Human
aguuuucugagaaagac

SEQ ID NO: 1601430 - RNA, 12 nt, Human
aguuuucugaga

SEQ ID NO: 1601431 - RNA, 13 nt, Human
aguuuucugagaa

SEQ ID NO: 1601432 - RNA, 16 nt, Human
auaaaccucaaaaugu

SEQ ID NO: 1601433 - RNA, 19 nt, Human
auaaaugugccuucauuuu

SEQ ID NO: 1601434 - RNA, 12 nt, Human
auaacuggaaac

SEQ ID NO: 1601435 - RNA, 12 nt, Human
auaacugugaag

SEQ ID NO: 1601436 - RNA, 23 nt, Human
uuagaugcaguucugaagaagau

SEQ ID NO: 1601437 - RNA, 22 nt, Human
uuagaugcaguucugaagaaga

SEQ ID NO: 1601438 - RNA, 14 nt, Human
auaaugaauacuuu

SEQ ID NO: 1601439 - RNA, 21 nt, Human
auaaucuuucacaggggacag

SEQ ID NO: 1601440 - RNA, 20 nt, Human
auaaucagugugucuaaauu

SEQ ID NO: 1601441 - RNA, 12 nt, Human
uuaccugggaaa

SEQ ID NO: 1601442 - RNA, 15 nt, Human
auaaguucauacauu

SEQ ID NO: 1601443 - RNA, 14 nt, Human
auaaguucauacau

SEQ ID NO: 1601444 - RNA, 13 nt, Human
auaaguucauaca

SEQ ID NO: 1601445 - RNA, 11 nt, Human
auaaguucaua

SEQ ID NO: 1601446 - RNA, 21 nt, Human
auaaguucauacauuguacga

SEQ ID NO: 1601447 - RNA, 21 nt, Human
agggugaugggaaagcauugu

SEQ ID NO: 1601448 - RNA, 22 nt, Human
agggugaugggaaagcauugua

SEQ ID NO: 1601449 - RNA, 15 nt, Human
agggugaaaauuauu

SEQ ID NO: 1601450 - RNA, 22 nt, Human
ugguccaugggccauaugaaaa

SEQ ID NO: 1601451 - RNA, 22 nt, Human
uggucugugagaugcuagaacu

SEQ ID NO: 1601452 - RNA, 20 nt, Human
aggguuuauguuuaggaugu

SEQ ID NO: 1601453 - RNA, 15 nt, Human
aggucagugcaaaua

SEQ ID NO: 1601454 - RNA, 16 nt, Human
aggucauauuaauaua

SEQ ID NO: 1601455 - RNA, 16 nt, Human
uguaaaggaauuuaaa

SEQ ID NO: 1601456 - RNA, 18 nt, Human
uguaagaaaauaucacuu

SEQ ID NO: 1601457 - RNA, 15 nt, Human
uguacuuaacuauuc

SEQ ID NO: 1601458 - RNA, 17 nt, Human
ugucucuacuaaaaaua

SEQ ID NO: 1601459 - RNA, 14 nt, Human
ugucuuaauuaaaa

SEQ ID NO: 1601460 - RNA, 14 nt, Human
ugucuucacaacag

SEQ ID NO: 1601461 - RNA, 21 nt, Human
agugagcagucaggaaagaga

SEQ ID NO: 1601462 - RNA, 16 nt, Human
agugagccgagauugu

SEQ ID NO: 1601463 - RNA, 20 nt, Human
agugaaacucguuaauuugu

SEQ ID NO: 1601464 - RNA, 14 nt, Human
agugagacagcucu

SEQ ID NO: 1601465 - RNA, 22 nt, Human
agugaaagaggcagcuugaaac

SEQ ID NO: 1601466 - RNA, 16 nt, Human
agugaaagaggcagcu

SEQ ID NO: 1601467 - RNA, 14 nt, Human
ugugaagcaaaauu

SEQ ID NO: 1601468 - RNA, 15 nt, Human
aguauuguccagguc

SEQ ID NO: 1601469 - RNA, 16 nt, Human
aguauuguccaggucu

SEQ ID NO: 1601470 - RNA, 20 nt, Human
agucacauuccaagccucau

SEQ ID NO: 1601471 - RNA, 18 nt, Human
aguauguuagugcaaauu

SEQ ID NO: 1601472 - RNA, 21 nt, Human
aguauguuagugcaaauuguc

SEQ ID NO: 1601473 - RNA, 23 nt, Human
ugucagcuccccucggagaagag

SEQ ID NO: 1601474 - RNA, 20 nt, Human
ugucagcuccccucggagaa

SEQ ID NO: 1601475 - RNA, 21 nt, Human
ugucagcuccccucggagaag

SEQ ID NO: 1601476 - RNA, 18 nt, Human
ugucuaaauuugaauguu

SEQ ID NO: 1601477 - RNA, 15 nt, Human
ugucuaagauaguaa

SEQ ID NO: 1601478 - RNA, 14 nt, Human
ugucuaagauagua

SEQ ID NO: 1601479 - RNA, 16 nt, Human
agagacacacugaaga

SEQ ID NO: 1601480 - RNA, 14 nt, Human
agagacagaaagca

SEQ ID NO: 1601481 - RNA, 15 nt, Human
agagacagaaagcag

SEQ ID NO: 1601482 - RNA, 23 nt, Human
agacuggcacaguuuucugagaa

SEQ ID NO: 1601483 - RNA, 20 nt, Human
agacuggcacaguuuucuga

SEQ ID NO: 1601484 - RNA, 21 nt, Human
agacuggcacaguuuucugag

SEQ ID NO: 1601485 - RNA, 13 nt, Human
ugaaagaaaauaa

SEQ ID NO: 1601486 - RNA, 21 nt, Human
ugaaaauauuuguaucacaaa

SEQ ID NO: 1601487 - RNA, 22 nt, Human
ugaaaauauuuguaucacaaau

SEQ ID NO: 1601488 - RNA, 17 nt, Human
ugaaaauauuuguauca

SEQ ID NO: 1601489 - RNA, 18 nt, Human
ugaaagaggaaugaagua

SEQ ID NO: 1601490 - RNA, 17 nt, Human
ugaaagaggaaugaagu

SEQ ID NO: 1601491 - RNA, 18 nt, Human
agagcuguucacagccag

SEQ ID NO: 1601492 - RNA, 19 nt, Human
agagcuguucacagccaga

SEQ ID NO: 1601493 - RNA, 17 nt, Human
ugaaguacucauacaug

SEQ ID NO: 1601494 - RNA, 17 nt, Human
ugaagauuuaccacuug

SEQ ID NO: 1601495 - RNA, 20 nt, Human
ugaagauuuaccacuugugu

SEQ ID NO: 1601496 - RNA, 23 nt, Human
ugaacuagaguuuagcuggaaaa

SEQ ID NO: 1601497 - RNA, 22 nt, Human
ugaacccauauuuguacaccaa

SEQ ID NO: 1601498 - RNA, 18 nt, Human
ugaacccgggaggcagag

SEQ ID NO: 1601499 - RNA, 18 nt, Human
ugaacaaauuuacagaga

SEQ ID NO: 1601500 - RNA, 13 nt, Human
ugaacaaauuuac

SEQ ID NO: 1601501 - RNA, 14 nt, Human
ugaaauaagccaga

SEQ ID NO: 1601502 - RNA, 18 nt, Human
agagcugcccucuccugg

SEQ ID NO: 1601503 - RNA, 17 nt, Human
agagcugcccucuccug

SEQ ID NO: 1601504 - RNA, 16 nt, Human
agagcugcccucuccu

SEQ ID NO: 1601505 - RNA, 20 nt, Human
agagcugcccucuccugggc

SEQ ID NO: 1601506 - RNA, 19 nt, Human
agagcugcccucuccuggg

SEQ ID NO: 1601507 - RNA, 21 nt, Human
ugagagacacacugaagaagc

SEQ ID NO: 1601508 - RNA, 22 nt, Human
ugagagacacacugaagaagca

SEQ ID NO: 1601509 - RNA, 24 nt, Human
ugagaugugaacacaucagcuugc

SEQ ID NO: 1601510 - RNA, 18 nt, Human
ugagaugugaacacauca

SEQ ID NO: 1601511 - RNA, 19 nt, Human
ugagaugugaacacaucag

SEQ ID NO: 1601512 - RNA, 13 nt, Human
ugagaugugaaca

SEQ ID NO: 1601513 - RNA, 16 nt, Human
ugagagacacacugaa

SEQ ID NO: 1601514 - RNA, 17 nt, Human
ugagagacacacugaag

SEQ ID NO: 1601515 - RNA, 19 nt, Human
ugagagacacacugaagaa

SEQ ID NO: 1601516 - RNA, 20 nt, Human
ugagagacacacugaagaag

SEQ ID NO: 1601517 - RNA, 20 nt, Human
ugagacucugucucagucca

SEQ ID NO: 1601518 - RNA, 12 nt, Human
ugagacagcucu

SEQ ID NO: 1601519 - RNA, 15 nt, Human
agauuuuccugaaaa

SEQ ID NO: 1601520 - RNA, 16 nt, Human
agauuuuccugaaaac

SEQ ID NO: 1601521 - RNA, 20 nt, Human
agcaagggugaugggaaagc

SEQ ID NO: 1601522 - RNA, 22 nt, Human
agcaagggugaugggaaagcau

SEQ ID NO: 1601523 - RNA, 16 nt, Human
agcaagggugauggga

SEQ ID NO: 1601524 - RNA, 21 nt, Human
agaugcaguucugaagaagau

SEQ ID NO: 1601525 - RNA, 19 nt, Human
agaugcuagaacucccuuu

SEQ ID NO: 1601526 - RNA, 21 nt, Human
agaugcuagaacucccuuuca

SEQ ID NO: 1601527 - RNA, 22 nt, Human
agaugcuagaacucccuuucaa

SEQ ID NO: 1601528 - RNA, 13 nt, Human
agauccuggaaau

SEQ ID NO: 1601529 - RNA, 14 nt, Human
agauccuggaaauc

SEQ ID NO: 1601530 - RNA, 15 nt, Human
ugacacuuaaaaaug

SEQ ID NO: 1601531 - RNA, 16 nt, Human
ugacacuuaaaaaugg

SEQ ID NO: 1601532 - RNA, 22 nt, Human
agaugugaacacaucagcuugc

SEQ ID NO: 1601533 - RNA, 22 nt, Human
agauguauguacuucaugcugu

SEQ ID NO: 1601534 - RNA, 17 nt, Human
agaugugaacacaucag

SEQ ID NO: 1601535 - RNA, 14 nt, Human
ugacuaugacauaa

SEQ ID NO: 1601536 - RNA, 22 nt, Human
acuuuuuauggcacuaguauuu

SEQ ID NO: 1601537 - RNA, 15 nt, Human
acuuuggaacaagau

SEQ ID NO: 1601538 - RNA, 15 nt, Human
ucucauuuccaagca

SEQ ID NO: 1601539 - RNA, 23 nt, Human
ucucaggaaaucaaauaugcaaa

SEQ ID NO: 1601540 - RNA, 14 nt, Human
ucucaggaaaucaa

SEQ ID NO: 1601541 - RNA, 21 nt, Human
ucucaggaaaucaaauaugca

SEQ ID NO: 1601542 - RNA, 15 nt, Human
acuugucaauaaaau

SEQ ID NO: 1601543 - RNA, 14 nt, Human
uccugggcagcugc

SEQ ID NO: 1601544 - RNA, 13 nt, Human
uccugggcagcug

SEQ ID NO: 1601545 - RNA, 12 nt, Human
uccugggcagcu

SEQ ID NO: 1601546 - RNA, 20 nt, Human
ucuaaguaaaaccacagcag

SEQ ID NO: 1601547 - RNA, 19 nt, Human
ucuaaguaaaaccacagca

SEQ ID NO: 1601548 - RNA, 14 nt, Human
ucuaaguaaaacca

SEQ ID NO: 1601549 - RNA, 15 nt, Human
ucuaaguaaaaccac

SEQ ID NO: 1601550 - RNA, 23 nt, Human
acuuaacuauucaggagaguaga

SEQ ID NO: 1601551 - RNA, 17 nt, Human
ucuaggaaauauuuauu

SEQ ID NO: 1601552 - RNA, 16 nt, Human
ucuaggaaauauuuau

SEQ ID NO: 1601553 - RNA, 23 nt, Human
ucuagcauggcauauuuuucaca

SEQ ID NO: 1601554 - RNA, 22 nt, Human
ucuagcauggcauauuuuucac

SEQ ID NO: 1601555 - RNA, 21 nt, Human
ucuagcauggcauauuuuuca

SEQ ID NO: 1601556 - RNA, 18 nt, Human
ucugcagauaaacaguag

SEQ ID NO: 1601557 - RNA, 18 nt, Human
agaagaugguaccaccag

SEQ ID NO: 1601558 - RNA, 13 nt, Human
agaagaacugaaa

SEQ ID NO: 1601559 - RNA, 14 nt, Human
agaagaacugaaau

SEQ ID NO: 1601560 - RNA, 19 nt, Human
agaagcaacccaaauguuc

SEQ ID NO: 1601561 - RNA, 23 nt, Human
ucugcuugccaucccucccucca

SEQ ID NO: 1601562 - RNA, 20 nt, Human
ucugcuugccaucccucccu

SEQ ID NO: 1601563 - RNA, 17 nt, Human
ucugcuugccaucccuc

SEQ ID NO: 1601564 - RNA, 16 nt, Human
ucugcuugccaucccu

SEQ ID NO: 1601565 - RNA, 12 nt, Human
agacacacauga

SEQ ID NO: 1601566 - RNA, 15 nt, Human
agacacacaugaagu

SEQ ID NO: 1601567 - RNA, 23 nt, Human
ucugugagaugcuagaacucccu

SEQ ID NO: 1601568 - RNA, 17 nt, Human
ucugugagaugcuagaa

SEQ ID NO: 1601569 - RNA, 22 nt, Human
ucugugagaugcuagaacuccc

SEQ ID NO: 1601570 - RNA, 14 nt, Human
ucugugagaugcua

SEQ ID NO: 1601571 - RNA, 16 nt, Human
ucugugaaaguacauu

SEQ ID NO: 1601572 - RNA, 23 nt, Human
agaauuaacacaugauccugcaa

SEQ ID NO: 1601573 - RNA, 15 nt, Human
agaauuaacacauga

SEQ ID NO: 1601574 - RNA, 14 nt, Human
ucugcuuguguuaa

SEQ ID NO: 1601575 - RNA, 21 nt, Human
agaauauguuucaaacuuugg

SEQ ID NO: 1601576 - RNA, 19 nt, Human
agaauauguuucaaacuuu

SEQ ID NO: 1601577 - RNA, 18 nt, Human
agaauauguuucaaacuu

SEQ ID NO: 1601578 - RNA, 17 nt, Human
agaauauguuucaaacu

SEQ ID NO: 1601579 - RNA, 13 nt, Human
agaauauguuuca

SEQ ID NO: 1601580 - RNA, 21 nt, Human
acucuuaagaagacugcauua

SEQ ID NO: 1601581 - RNA, 12 nt, Human
acugaagaagca

SEQ ID NO: 1601582 - RNA, 13 nt, Human
acugacucuuaag

SEQ ID NO: 1601583 - RNA, 14 nt, Human
acugacucuuaaga

SEQ ID NO: 1601584 - RNA, 15 nt, Human
acugacucuuaagaa

SEQ ID NO: 1601585 - RNA, 16 nt, Human
acugacucuuaagaag

SEQ ID NO: 1601586 - RNA, 17 nt, Human
acugacucuuaagaaga

SEQ ID NO: 1601587 - RNA, 18 nt, Human
acugacucuuaagaagac

SEQ ID NO: 1601588 - RNA, 20 nt, Human
acugacucuuaagaagacug

SEQ ID NO: 1601589 - RNA, 13 nt, Human
acugacuucuaag

SEQ ID NO: 1601590 - RNA, 15 nt, Human
acugacuucuaagua

SEQ ID NO: 1601591 - RNA, 16 nt, Human
acugacuucuaaguaa

SEQ ID NO: 1601592 - RNA, 22 nt, Human
acugacuucuaaguaaaaccac

SEQ ID NO: 1601593 - RNA, 18 nt, Human
acugagagugaacaaauu

SEQ ID NO: 1601594 - RNA, 22 nt, Human
acugagaugugaacacaucagc

SEQ ID NO: 1601595 - RNA, 17 nt, Human
acugagaugugaacaca

SEQ ID NO: 1601596 - RNA, 16 nt, Human
uccuggaaaucagggu

SEQ ID NO: 1601597 - RNA, 16 nt, Human
acuaucucauuuccaa

SEQ ID NO: 1601598 - RNA, 17 nt, Human
acuaucucauuuccaag

SEQ ID NO: 1601599 - RNA, 15 nt, Human
acuaucucauuucca

SEQ ID NO: 1601600 - RNA, 17 nt, Human
acuauauuguuugcuaa

SEQ ID NO: 1601601 - RNA, 22 nt, Human
acuauauuguuugcuaagcauu

SEQ ID NO: 1601602 - RNA, 19 nt, Human
uccauccugaggcuccacu

SEQ ID NO: 1601603 - RNA, 12 nt, Human
uccauccugagg

SEQ ID NO: 1601604 - RNA, 15 nt, Human
uccauccugaggcuc

SEQ ID NO: 1601605 - RNA, 15 nt, Human
acuaauuuuaaaaug

SEQ ID NO: 1601606 - RNA, 18 nt, Human
uccagugagacagcucug

SEQ ID NO: 1601607 - RNA, 11 nt, Human
acgcucucugg

SEQ ID NO: 1601608 - RNA, 14 nt, Human
acgcucucuggccu

SEQ ID NO: 1601609 - RNA, 20 nt, Human
accuuuuggucuggagggaa

SEQ ID NO: 1601610 - RNA, 22 nt, Human
uccacugguucuucuuggucuc

SEQ ID NO: 1601611 - RNA, 19 nt, Human
accuugaaaacuuuaugcu

SEQ ID NO: 1601612 - RNA, 18 nt, Human
accuuuggagcaaagcug

SEQ ID NO: 1601613 - RNA, 15 nt, Human
ucaguuuuugugaaa

SEQ ID NO: 1601614 - RNA, 17 nt, Human
ucaguuuuugugaaaag

SEQ ID NO: 1601615 - RNA, 22 nt, Human
ucauaaaaagccugcaauuuca

SEQ ID NO: 1601616 - RNA, 16 nt, Human
accuagggugauauua

SEQ ID NO: 1601617 - RNA, 16 nt, Human
accucaaaaugucuaa

SEQ ID NO: 1601618 - RNA, 17 nt, Human
acccgggaggcagaggu

SEQ ID NO: 1601619 - RNA, 14 nt, Human
accccugcuucuga

SEQ ID NO: 1601620 - RNA, 18 nt, Human
ucaaauugugugaaaggu

SEQ ID NO: 1601621 - RNA, 15 nt, Human
acaugggacauuugc

SEQ ID NO: 1601622 - RNA, 20 nt, Human
acaugggacauuugcucaug

SEQ ID NO: 1601623 - RNA, 21 nt, Human
acaugggacauuugcucaugg

SEQ ID NO: 1601624 - RNA, 11 nt, Human
acaugggacau

SEQ ID NO: 1601625 - RNA, 14 nt, Human
acaugggacauuug

SEQ ID NO: 1601626 - RNA, 23 nt, Human
acaugagguacugagagugaaca

SEQ ID NO: 1601627 - RNA, 20 nt, Human
acaugagguacugagaguga

SEQ ID NO: 1601628 - RNA, 17 nt, Human
ucaagaaaacaacuuca

SEQ ID NO: 1601629 - RNA, 22 nt, Human
ucaauaucuuuuuuuuaauaaa

SEQ ID NO: 1601630 - RNA, 18 nt, Human
ucaauauccaaaccaaau

SEQ ID NO: 1601631 - RNA, 15 nt, Human
ucaauauuucagaua

SEQ ID NO: 1601632 - RNA, 19 nt, Human
ucaauauuucagauaauca

SEQ ID NO: 1601633 - RNA, 23 nt, Human
ucaaugaaugaaugaauggcuaa

SEQ ID NO: 1601634 - RNA, 19 nt, Human
acauucuuccaaaaagauu

SEQ ID NO: 1601635 - RNA, 12 nt, Human
ucaccucaugga

SEQ ID NO: 1601636 - RNA, 13 nt, Human
ucaccucauggaa

SEQ ID NO: 1601637 - RNA, 14 nt, Human
ucaccucauggaau

SEQ ID NO: 1601638 - RNA, 14 nt, Human
accagucugacugu

SEQ ID NO: 1601639 - RNA, 23 nt, Human
ucacuugaacccgggaggcagag

SEQ ID NO: 1601640 - RNA, 16 nt, Human
ucaauucuugccaaau

SEQ ID NO: 1601641 - RNA, 14 nt, Human
ucacauaucuagua

SEQ ID NO: 1601642 - RNA, 22 nt, Human
aaucaggguuaguauuguccag

SEQ ID NO: 1601643 - RNA, 16 nt, Human
aaucaggguuaguauu

SEQ ID NO: 1601644 - RNA, 21 nt, Human
aaucaggguuaguauugucca

SEQ ID NO: 1601645 - RNA, 22 nt, Human
uaagcagauggaaugcuguguu

SEQ ID NO: 1601646 - RNA, 21 nt, Human
aauaugccccauucaacaucu

SEQ ID NO: 1601647 - RNA, 24 nt, Human
aauaugccccauucaacaucuagu

SEQ ID NO: 1601648 - RNA, 18 nt, Human
aauauuuauuuuaauaau

SEQ ID NO: 1601649 - RNA, 19 nt, Human
aauauuuauuuuaauaaug

SEQ ID NO: 1601650 - RNA, 14 nt, Human
aauauuucagauaa

SEQ ID NO: 1601651 - RNA, 17 nt, Human
aauauuguguugugaau

SEQ ID NO: 1601652 - RNA, 20 nt, Human
uaacgauaaaagacagugaa

SEQ ID NO: 1601653 - RNA, 18 nt, Human
uaagaagugaaaaucuac

SEQ ID NO: 1601654 - RNA, 22 nt, Human
aauaucacuugucaauaaaauc

SEQ ID NO: 1601655 - RNA, 20 nt, Human
aauaucacuugucaauaaaa

SEQ ID NO: 1601656 - RNA, 23 nt, Human
aauaguauuugagaguucuaaau

SEQ ID NO: 1601657 - RNA, 16 nt, Human
aauagucaaauugugu

SEQ ID NO: 1601658 - RNA, 22 nt, Human
aauaguauuugagaguucuaaa

SEQ ID NO: 1601659 - RNA, 20 nt, Human
aauaguauuugagaguucua

SEQ ID NO: 1601660 - RNA, 19 nt, Human
aaucuuauaauuuaaaaua

SEQ ID NO: 1601661 - RNA, 19 nt, Human
aaucuacacuccagugaga

SEQ ID NO: 1601662 - RNA, 12 nt, Human
aaucaugaauua

SEQ ID NO: 1601663 - RNA, 15 nt, Human
aaucaugaauuaguu

SEQ ID NO: 1601664 - RNA, 16 nt, Human
uaaguauucuaaauuu

SEQ ID NO: 1601665 - RNA, 16 nt, Human
uaagcuuguauuccuu

SEQ ID NO: 1601666 - RNA, 19 nt, Human
uaaguaaugauaacuggaa

SEQ ID NO: 1601667 - RNA, 13 nt, Human
uaaguaaaugcua

SEQ ID NO: 1601668 - RNA, 21 nt, Human
uaauagagcaaaauugaugug

SEQ ID NO: 1601669 - RNA, 12 nt, Human
uaauagagcaaa

SEQ ID NO: 1601670 - RNA, 22 nt, Human
aaugaauggcuaagcaaaaugu

SEQ ID NO: 1601671 - RNA, 19 nt, Human
aaugaaacacucaguuguu

SEQ ID NO: 1601672 - RNA, 20 nt, Human
aauuauuuuguucauacaua

SEQ ID NO: 1601673 - RNA, 19 nt, Human
aauuauuuuguucauacau

SEQ ID NO: 1601674 - RNA, 18 nt, Human
aauuauuuuguucauaca

SEQ ID NO: 1601675 - RNA, 16 nt, Human
aauuauuuuguucaua

SEQ ID NO: 1601676 - RNA, 22 nt, Human
aauuauuuuguucauacauauu

SEQ ID NO: 1601677 - RNA, 21 nt, Human
aauuauuuuguucauacauau

SEQ ID NO: 1601678 - RNA, 22 nt, Human
aauuccacuuauaggaauugac

SEQ ID NO: 1601679 - RNA, 18 nt, Human
aauuccaagugauugaaa

SEQ ID NO: 1601680 - RNA, 15 nt, Human
aauucagaaggaucu

SEQ ID NO: 1601681 - RNA, 19 nt, Human
uacauuguacgaagaguau

SEQ ID NO: 1601682 - RNA, 14 nt, Human
uacuguaagaaaau

SEQ ID NO: 1601683 - RNA, 22 nt, Human
aauugacccacaagaaaugaaa

SEQ ID NO: 1601684 - RNA, 21 nt, Human
aauugacccacaagaaaugaa

SEQ ID NO: 1601685 - RNA, 14 nt, Human
aauugauguguuua

SEQ ID NO: 1601686 - RNA, 13 nt, Human
aauugauguguuu

SEQ ID NO: 1601687 - RNA, 14 nt, Human
uacacuaagagaga

SEQ ID NO: 1601688 - RNA, 18 nt, Human
uacacuaagagagaauga

SEQ ID NO: 1601689 - RNA, 16 nt, Human
aaugcuguauuuuaaa

SEQ ID NO: 1601690 - RNA, 13 nt, Human
aaugcuguguuaa

SEQ ID NO: 1601691 - RNA, 13 nt, Human
aauguuaagcaga

SEQ ID NO: 1601692 - RNA, 17 nt, Human
uacauuguaaauaguau

SEQ ID NO: 1601693 - RNA, 20 nt, Human
uacaucccuuaccugggaaa

SEQ ID NO: 1601694 - RNA, 23 nt, Human
uacaggucauauuaauauauuuc

SEQ ID NO: 1601695 - RNA, 23 nt, Human
uauucaaacagucucaggaaauc

SEQ ID NO: 1601696 - RNA, 15 nt, Human
uauucaaacagucuc

SEQ ID NO: 1601697 - RNA, 15 nt, Human
uauuagaauaccaca

SEQ ID NO: 1601698 - RNA, 14 nt, Human
uauuacuguaagaa

SEQ ID NO: 1601699 - RNA, 16 nt, Human
acagucaccucaugga

SEQ ID NO: 1601700 - RNA, 17 nt, Human
acagucaccucauggaa

SEQ ID NO: 1601701 - RNA, 18 nt, Human
acagucaccucauggaau

SEQ ID NO: 1601702 - RNA, 20 nt, Human
acagggaggacgcucucugg

SEQ ID NO: 1601703 - RNA, 21 nt, Human
acagggaggacgcucucuggc

SEQ ID NO: 1601704 - RNA, 17 nt, Human
acaggaaguagaggagg

SEQ ID NO: 1601705 - RNA, 15 nt, Human
uauauuguuugcuaa

SEQ ID NO: 1601706 - RNA, 17 nt, Human
uaucucaaaacugcacu

SEQ ID NO: 1601707 - RNA, 19 nt, Human
uauccaaaccaaauaaaaa

SEQ ID NO: 1601708 - RNA, 16 nt, Human
acagccucuuagaugc

SEQ ID NO: 1601709 - RNA, 19 nt, Human
uaugccccauucaacaucu

SEQ ID NO: 1601710 - RNA, 16 nt, Human
uaugauuaaguaauga

SEQ ID NO: 1601711 - RNA, 20 nt, Human
uaugauuaaguaaugauaac

SEQ ID NO: 1601712 - RNA, 21 nt, Human
uaugauuaaguaaugauaacu

SEQ ID NO: 1601713 - RNA, 20 nt, Human
acagauuuccauccuaguca

SEQ ID NO: 1601714 - RNA, 18 nt, Human
acagcaagggugauggga

SEQ ID NO: 1601715 - RNA, 19 nt, Human
uaugaaauuauauaaguau

SEQ ID NO: 1601716 - RNA, 20 nt, Human
acacacucaaaucaagaaac

SEQ ID NO: 1601717 - RNA, 15 nt, Human
acacacucaaaucaa

SEQ ID NO: 1601718 - RNA, 22 nt, Human
acaaugcuguauuuuaaaagaa

SEQ ID NO: 1601719 - RNA, 22 nt, Human
uagugaaacucguuaauuugua

SEQ ID NO: 1601720 - RNA, 23 nt, Human
uaguguuggagaagaacugaaau

SEQ ID NO: 1601721 - RNA, 13 nt, Human
acacuaagagaga

SEQ ID NO: 1601722 - RNA, 14 nt, Human
acacuaagagagaa

SEQ ID NO: 1601723 - RNA, 19 nt, Human
acacucaaaucaagaaacu

SEQ ID NO: 1601724 - RNA, 15 nt, Human
acacaugaaguccaa

SEQ ID NO: 1601725 - RNA, 15 nt, Human
acacaucagcuugcc

SEQ ID NO: 1601726 - RNA, 18 nt, Human
acacaugauccugcaauu

SEQ ID NO: 1601727 - RNA, 19 nt, Human
uaggaaauauuuauuuuaa

SEQ ID NO: 1601728 - RNA, 18 nt, Human
uaggaaauauuuauuuua

SEQ ID NO: 1601729 - RNA, 18 nt, Human
uaggcaaccuuuauuuuu

SEQ ID NO: 1601730 - RNA, 14 nt, Human
uagggagagaagau

SEQ ID NO: 1601731 - RNA, 15 nt, Human
uagggagagaagaua

SEQ ID NO: 1601732 - RNA, 13 nt, Human
acaagacugcaca

SEQ ID NO: 1601733 - RNA, 14 nt, Human
acaagacugcacau

SEQ ID NO: 1601734 - RNA, 23 nt, Human
acaauacaucccuuaccugggaa

SEQ ID NO: 1601735 - RNA, 19 nt, Human
uagcuaauguaauaacugu

SEQ ID NO: 1601736 - RNA, 12 nt, Human
uagcuaauguaa

SEQ ID NO: 1601737 - RNA, 19 nt, Human
acaaauuuacagagacaga

SEQ ID NO: 1601738 - RNA, 18 nt, Human
acaaauuuacagagacag

SEQ ID NO: 1601739 - RNA, 20 nt, Human
acaagacccaaaaggcagaa

SEQ ID NO: 1601740 - RNA, 18 nt, Human
uagcaugucgucaaagcu

SEQ ID NO: 1601741 - RNA, 15 nt, Human
uagaugcaguucuga

SEQ ID NO: 1601742 - RNA, 21 nt, Human
uagcauggcauauuuuucaca

SEQ ID NO: 1601743 - RNA, 22 nt, Human
uagcauggcauauuuuucacau

SEQ ID NO: 1601744 - RNA, 18 nt, Human
acaaaaggauaaugaaua

SEQ ID NO: 1601745 - RNA, 22 nt, Human
uagaggagaaacuggaacucuc

SEQ ID NO: 1601746 - RNA, 21 nt, Human
uagagcaaaauugauguguuu

SEQ ID NO: 1601747 - RNA, 14 nt, Human
uagagcaaaauuga

SEQ ID NO: 1601748 - RNA, 22 nt, Human
uagagcaaaauugauguguuua

SEQ ID NO: 1601749 - RNA, 22 nt, Human
gugcuacaaaaacacagcaagg

SEQ ID NO: 1601750 - RNA, 14 nt, Human
aagaaagaaaauca

SEQ ID NO: 1601751 - RNA, 16 nt, Human
aagaaagaaaaucagg

SEQ ID NO: 1601752 - RNA, 11 nt, Human
aagaaacauuu

SEQ ID NO: 1601753 - RNA, 14 nt, Human
aagaaaacaacuuc

SEQ ID NO: 1601754 - RNA, 11 nt, Human
gugauuaccag

SEQ ID NO: 1601755 - RNA, 16 nt, Human
gugauuaccagggacu

SEQ ID NO: 1601756 - RNA, 17 nt, Human
gugauuaccagggacug

SEQ ID NO: 1601757 - RNA, 22 nt, Human
aacuuccuuggacucauuuuaa

SEQ ID NO: 1601758 - RNA, 18 nt, Human
aacuucagcgguuuauau

SEQ ID NO: 1601759 - RNA, 13 nt, Human
aacuucagacaua

SEQ ID NO: 1601760 - RNA, 21 nt, Human
aacuucagcgguuuauauaag

SEQ ID NO: 1601761 - RNA, 23 nt, Human
aacuuccuuggacucauuuuaaa

SEQ ID NO: 1601762 - RNA, 19 nt, Human
aacugugaaguuuacauug

SEQ ID NO: 1601763 - RNA, 17 nt, Human
aacugugaaguuuacau

SEQ ID NO: 1601764 - RNA, 14 nt, Human
gugaaguuuacauu

SEQ ID NO: 1601765 - RNA, 13 nt, Human
gucuucacaacag

SEQ ID NO: 1601766 - RNA, 14 nt, Human
gucuuaauuaaaag

SEQ ID NO: 1601767 - RNA, 21 nt, Human
aacucauuuuuguuuucauua

SEQ ID NO: 1601768 - RNA, 24 nt, Human
aacucauuuuuguuuucauuaucu

SEQ ID NO: 1601769 - RNA, 23 nt, Human
aacuauucaggagaguagaacag

SEQ ID NO: 1601770 - RNA, 14 nt, Human
aacauaaaauacaa

SEQ ID NO: 1601771 - RNA, 14 nt, Human
aacagucucaggaa

SEQ ID NO: 1601772 - RNA, 12 nt, Human
aacauauauaac

SEQ ID NO: 1601773 - RNA, 13 nt, Human
aacagucucagga

SEQ ID NO: 1601774 - RNA, 20 nt, Human
aacacagcaagggugauggg

SEQ ID NO: 1601775 - RNA, 22 nt, Human
guccaugaagauguagaggaga

SEQ ID NO: 1601776 - RNA, 23 nt, Human
guccaugaagauguagaggagaa

SEQ ID NO: 1601777 - RNA, 20 nt, Human
gucacaggaaguagaggagg

SEQ ID NO: 1601778 - RNA, 21 nt, Human
gucaauuuuguuauguauauu

SEQ ID NO: 1601779 - RNA, 13 nt, Human
gucacaggaagua

SEQ ID NO: 1601780 - RNA, 15 nt, Human
gucacaggaaguaga

SEQ ID NO: 1601781 - RNA, 14 nt, Human
gucaggaaagagaa

SEQ ID NO: 1601782 - RNA, 18 nt, Human
aaaugugccuucauuuuu

SEQ ID NO: 1601783 - RNA, 15 nt, Human
aaaugugcuuuuaaa

SEQ ID NO: 1601784 - RNA, 17 nt, Human
aaauuguauuacaaauc

SEQ ID NO: 1601785 - RNA, 17 nt, Human
aaauuccaagugauuga

SEQ ID NO: 1601786 - RNA, 11 nt, Human
aaaucauuucu

SEQ ID NO: 1601787 - RNA, 19 nt, Human
guauucuagcuaauguaau

SEQ ID NO: 1601788 - RNA, 24 nt, Human
guauucuaaauuuuauaucuugua

SEQ ID NO: 1601789 - RNA, 21 nt, Human
guauucuaaauuuuauaucuu

SEQ ID NO: 1601790 - RNA, 22 nt, Human
uaaaauaauuuuuauauuugaa

SEQ ID NO: 1601791 - RNA, 21 nt, Human
uaaaauacacacucaaaucaa

SEQ ID NO: 1601792 - RNA, 13 nt, Human
uaaaagaauauuu

SEQ ID NO: 1601793 - RNA, 16 nt, Human
uaaaagaauauuuuaa

SEQ ID NO: 1601794 - RNA, 15 nt, Human
uaaaaccacagcagu

SEQ ID NO: 1601795 - RNA, 14 nt, Human
uaaaaccacagcag

SEQ ID NO: 1601796 - RNA, 22 nt, Human
uaaaaauauuguguugugaaug

SEQ ID NO: 1601797 - RNA, 21 nt, Human
uaaaaauauuguguugugaau

SEQ ID NO: 1601798 - RNA, 21 nt, Human
uaaaaaaaaaccugagcccca

SEQ ID NO: 1601799 - RNA, 22 nt, Human
uaaaaagccugcaauuucauau

SEQ ID NO: 1601800 - RNA, 19 nt, Human
uaaaaagccugcaauuuca

SEQ ID NO: 1601801 - RNA, 14 nt, Human
uaaaaauauugugu

SEQ ID NO: 1601802 - RNA, 9 nt, Human
uaaaauggu

SEQ ID NO: 1601803 - RNA, 11 nt, Human
uaaaaugugaa

SEQ ID NO: 1601804 - RNA, 13 nt, Human
uaaaaugugaagu

SEQ ID NO: 1601805 - RNA, 15 nt, Human
aagggcuguuauaau

SEQ ID NO: 1601806 - RNA, 17 nt, Human
aagggcuguuauaaucu

SEQ ID NO: 1601807 - RNA, 17 nt, Human
aaggggaauugaggaca

SEQ ID NO: 1601808 - RNA, 12 nt, Human
aaguaaaugcua

SEQ ID NO: 1601809 - RNA, 14 nt, Human
guuuaugauuccac

SEQ ID NO: 1601810 - RNA, 18 nt, Human
aaguauguuagugcaaau

SEQ ID NO: 1601811 - RNA, 19 nt, Human
aaguauguuagugcaaauu

SEQ ID NO: 1601812 - RNA, 19 nt, Human
aaguauguguaaaauguga

SEQ ID NO: 1601813 - RNA, 23 nt, Human
aagcuuguauuccuuuuucucuc

SEQ ID NO: 1601814 - RNA, 18 nt, Human
aagcuuauuaaaacucau

SEQ ID NO: 1601815 - RNA, 18 nt, Human
guucccuugaugaagaag

SEQ ID NO: 1601816 - RNA, 22 nt, Human
guucuagcauggcauauuuuuc

SEQ ID NO: 1601817 - RNA, 19 nt, Human
guucuagcauggcauauuu

SEQ ID NO: 1601818 - RNA, 21 nt, Human
aagccuuggggcugaugcagu

SEQ ID NO: 1601819 - RNA, 19 nt, Human
guuaauuccaauuauauga

SEQ ID NO: 1601820 - RNA, 19 nt, Human
guuauuauauuuacaaaug

SEQ ID NO: 1601821 - RNA, 20 nt, Human
guuauuauauuuacaaaugg

SEQ ID NO: 1601822 - RNA, 22 nt, Human
guuauugauaaguucauacauu

SEQ ID NO: 1601823 - RNA, 21 nt, Human
guuauugauaaguucauacau

SEQ ID NO: 1601824 - RNA, 16 nt, Human
aagcacuaaacaaaga

SEQ ID NO: 1601825 - RNA, 16 nt, Human
aagcacugacuucuaa

SEQ ID NO: 1601826 - RNA, 17 nt, Human
aagcacugacuucuaag

SEQ ID NO: 1601827 - RNA, 19 nt, Human
aagcacugacuucuaagua

SEQ ID NO: 1601828 - RNA, 20 nt, Human
aagcacugacuucuaaguaa

SEQ ID NO: 1601829 - RNA, 19 nt, Human
aagcauuguaaaugugcuu

SEQ ID NO: 1601830 - RNA, 13 nt, Human
aagcaaaauguga

SEQ ID NO: 1601831 - RNA, 17 nt, Human
aagcaacccaaauguuc

SEQ ID NO: 1601832 - RNA, 22 nt, Human
gugucuuaauuaaaagaauauu

SEQ ID NO: 1601833 - RNA, 15 nt, Human
aagauagcagggcau

SEQ ID NO: 1601834 - RNA, 15 nt, Human
guguaaaaugugaag

SEQ ID NO: 1601835 - RNA, 16 nt, Human
cacaguuuucugagaa

SEQ ID NO: 1601836 - RNA, 17 nt, Human
cacaguuuucugagaaa

SEQ ID NO: 1601837 - RNA, 19 nt, Human
cacaguuuucugagaaaga

SEQ ID NO: 1601838 - RNA, 20 nt, Human
cacaguuuucugagaaagac

SEQ ID NO: 1601839 - RNA, 19 nt, Human
caaaaaucucaauauuuca

SEQ ID NO: 1601840 - RNA, 23 nt, Human
caaaacuucagacauagaauuaa

SEQ ID NO: 1601841 - RNA, 15 nt, Human
caaaaacacagcaag

SEQ ID NO: 1601842 - RNA, 17 nt, Human
caaaaacacagcaaggg

SEQ ID NO: 1601843 - RNA, 13 nt, Human
caaaaacacagca

SEQ ID NO: 1601844 - RNA, 14 nt, Human
caaaaacacagcaa

SEQ ID NO: 1601845 - RNA, 13 nt, Human
auuuuccugaaaa

SEQ ID NO: 1601846 - RNA, 21 nt, Human
caaauaugcaaagcacugacu

SEQ ID NO: 1601847 - RNA, 15 nt, Human
caaauugugugaaag

SEQ ID NO: 1601848 - RNA, 16 nt, Human
caaaauuuuuucucua

SEQ ID NO: 1601849 - RNA, 21 nt, Human
caaaauuuuuucucuaggaaa

SEQ ID NO: 1601850 - RNA, 22 nt, Human
caaaauuuuuucucuaggaaau

SEQ ID NO: 1601851 - RNA, 16 nt, Human
caaaauugauguguuu

SEQ ID NO: 1601852 - RNA, 15 nt, Human
caaaauugauguguu

SEQ ID NO: 1601853 - RNA, 22 nt, Human
caaaauugauguguuuauuuau

SEQ ID NO: 1601854 - RNA, 19 nt, Human
caaagcugaugacaacuuc

SEQ ID NO: 1601855 - RNA, 23 nt, Human
caauacaucccuuaccugggaaa

SEQ ID NO: 1601856 - RNA, 21 nt, Human
caagccagauuuuccugaaaa

SEQ ID NO: 1601857 - RNA, 17 nt, Human
caaggcugauuaaacca

SEQ ID NO: 1601858 - RNA, 19 nt, Human
caagacugcacaucaaaau

SEQ ID NO: 1601859 - RNA, 15 nt, Human
caagaaaacaacuuc

SEQ ID NO: 1601860 - RNA, 18 nt, Human
caagaaaacaacuucaau

SEQ ID NO: 1601861 - RNA, 16 nt, Human
uuauauuuacaaaugg

SEQ ID NO: 1601862 - RNA, 20 nt, Human
uuauauuuauuacuguaaga

SEQ ID NO: 1601863 - RNA, 12 nt, Human
uuauauuugaaa

SEQ ID NO: 1601864 - RNA, 13 nt, Human
uuauauuugaaau

SEQ ID NO: 1601865 - RNA, 15 nt, Human
uuauauuugaaauau

SEQ ID NO: 1601866 - RNA, 11 nt, Human
uuaucucaaaa

SEQ ID NO: 1601867 - RNA, 18 nt, Human
uuauggcuauaggugcua

SEQ ID NO: 1601868 - RNA, 12 nt, Human
uuauaauuuaaa

SEQ ID NO: 1601869 - RNA, 14 nt, Human
uuauaauuuuguga

SEQ ID NO: 1601870 - RNA, 15 nt, Human
uuauaauuuugugaa

SEQ ID NO: 1601871 - RNA, 11 nt, Human
uuauaaucuuu

SEQ ID NO: 1601872 - RNA, 15 nt, Human
uuauaucuuguagcu

SEQ ID NO: 1601873 - RNA, 22 nt, Human
uuauaucuuguagcuuuaucaa

SEQ ID NO: 1601874 - RNA, 22 nt, Human
uuauacaggucauauuaauaua

SEQ ID NO: 1601875 - RNA, 16 nt, Human
uuauaauuuugugaag

SEQ ID NO: 1601876 - RNA, 17 nt, Human
uuauaauuuugugaagc

SEQ ID NO: 1601877 - RNA, 18 nt, Human
uuauaauuuugugaagca

SEQ ID NO: 1601878 - RNA, 14 nt, Human
uuauacaggucaua

SEQ ID NO: 1601879 - RNA, 23 nt, Human
uucaguuauuauauuuacaaaug

SEQ ID NO: 1601880 - RNA, 18 nt, Human
uuccagauccuggaaauc

SEQ ID NO: 1601881 - RNA, 21 nt, Human
uuccaaaaagauuuucagaaa

SEQ ID NO: 1601882 - RNA, 22 nt, Human
uucacaagacccaaaaggcaga

SEQ ID NO: 1601883 - RNA, 20 nt, Human
uucagagcugcccucuccug

SEQ ID NO: 1601884 - RNA, 19 nt, Human
uucagagcugcccucuccu

SEQ ID NO: 1601885 - RNA, 18 nt, Human
uucagagcugcccucucc

SEQ ID NO: 1601886 - RNA, 17 nt, Human
uucagagcugcccucuc

SEQ ID NO: 1601887 - RNA, 15 nt, Human
uucagagcugcccuc

SEQ ID NO: 1601888 - RNA, 19 nt, Human
uuauuuuaauaauguuuca

SEQ ID NO: 1601889 - RNA, 20 nt, Human
uuauuuuaauaauguuucaa

SEQ ID NO: 1601890 - RNA, 16 nt, Human
uuauuuuguucauaca

SEQ ID NO: 1601891 - RNA, 14 nt, Human
uuauuuuguucaua

SEQ ID NO: 1601892 - RNA, 16 nt, Human
uucaauaauaaauauu

SEQ ID NO: 1601893 - RNA, 17 nt, Human
uugacccacaagaaaug

SEQ ID NO: 1601894 - RNA, 14 nt, Human
uugaugaagaaguu

SEQ ID NO: 1601895 - RNA, 23 nt, Human
uugaugaagaaguugauaugccu

SEQ ID NO: 1601896 - RNA, 17 nt, Human
uucugucuucacaacag

SEQ ID NO: 1601897 - RNA, 18 nt, Human
uucugcuuguguuaagua

SEQ ID NO: 1601898 - RNA, 16 nt, Human
uugaaaagacuccaaa

SEQ ID NO: 1601899 - RNA, 17 nt, Human
uucuuccaaaaagauuu

SEQ ID NO: 1601900 - RNA, 14 nt, Human
uucuaugaaauauu

SEQ ID NO: 1601901 - RNA, 21 nt, Human
uucuaugaaauauuauguuaa

SEQ ID NO: 1601902 - RNA, 16 nt, Human
uucugagaaagacuau

SEQ ID NO: 1601903 - RNA, 21 nt, Human
uucugagaaagacuauucaaa

SEQ ID NO: 1601904 - RNA, 18 nt, Human
uucggugagcuacaaaug

SEQ ID NO: 1601905 - RNA, 17 nt, Human
uuccuuggacucauuuu

SEQ ID NO: 1601906 - RNA, 15 nt, Human
uucuacauacuaugg

SEQ ID NO: 1601907 - RNA, 22 nt, Human
uucuacauaaguaauucaagaa

SEQ ID NO: 1601908 - RNA, 22 nt, Human
uuuauaauuuugugaagcaaaa

SEQ ID NO: 1601909 - RNA, 13 nt, Human
uuuaccacuugug

SEQ ID NO: 1601910 - RNA, 14 nt, Human
uuuaauaauguuuc

SEQ ID NO: 1601911 - RNA, 19 nt, Human
uuuaacucuauaauguguu

SEQ ID NO: 1601912 - RNA, 13 nt, Human
uuuaauaauguuu

SEQ ID NO: 1601913 - RNA, 16 nt, Human
uuggucugugagaugc

SEQ ID NO: 1601914 - RNA, 17 nt, Human
uuguaaauaguauuuga

SEQ ID NO: 1601915 - RNA, 15 nt, Human
uugucuagugaaacu

SEQ ID NO: 1601916 - RNA, 14 nt, Human
uuguauuacaaauc

SEQ ID NO: 1601917 - RNA, 23 nt, Human
uuguacgaagaguauuuuugaca

SEQ ID NO: 1601918 - RNA, 21 nt, Human
uuguacgaagaguauuuuuga

SEQ ID NO: 1601919 - RNA, 18 nt, Human
uuguguuuugcaagccag

SEQ ID NO: 1601920 - RNA, 14 nt, Human
uuguuuaaaaucau

SEQ ID NO: 1601921 - RNA, 12 nt, Human
uugugccccugc

SEQ ID NO: 1601922 - RNA, 13 nt, Human
uuguguugugaau

SEQ ID NO: 1601923 - RNA, 22 nt, Human
uuuugacagaauauguuucaaa

SEQ ID NO: 1601924 - RNA, 23 nt, Human
uuuugacagaauauguuucaaac

SEQ ID NO: 1601925 - RNA, 18 nt, Human
uuuguauaaaauaauuuu

SEQ ID NO: 1601926 - RNA, 19 nt, Human
uuuguauaaaauaauuuuu

SEQ ID NO: 1601927 - RNA, 17 nt, Human
uuuguauaaaauaauuu

SEQ ID NO: 1601928 - RNA, 15 nt, Human
uuuccacagaagcuc

SEQ ID NO: 1601929 - RNA, 12 nt, Human
uuugaguucuac

SEQ ID NO: 1601930 - RNA, 13 nt, Human
uuuuauauuugaa

SEQ ID NO: 1601931 - RNA, 18 nt, Human
uuuuauauuugaaauauu

SEQ ID NO: 1601932 - RNA, 21 nt, Human
uuuuaaaguaacccuacaaaa

SEQ ID NO: 1601933 - RNA, 23 nt, Human
uuuuauaauuuugugaagcaaaa

SEQ ID NO: 1601934 - RNA, 21 nt, Human
uuuuauaauuuugugaagcaa

SEQ ID NO: 1601935 - RNA, 13 nt, Human
uuuucuuauuuca

SEQ ID NO: 1601936 - RNA, 23 nt, Human
uuuucagaaaauauuauguguuu

SEQ ID NO: 1601937 - RNA, 22 nt, Human
uuuucagaaaauauuauguguu

SEQ ID NO: 1601938 - RNA, 19 nt, Human
ugcagauaaacaguaguga

SEQ ID NO: 1601939 - RNA, 14 nt, Human
ugcauuauauuuau

SEQ ID NO: 1601940 - RNA, 20 nt, Human
ugcaauuucauaugcuguau

SEQ ID NO: 1601941 - RNA, 14 nt, Human
ugcaauuucauaug

SEQ ID NO: 1601942 - RNA, 17 nt, Human
ugagcagucaggaaaga

SEQ ID NO: 1601943 - RNA, 15 nt, Human
ugagcagucaggaaa

SEQ ID NO: 1601944 - RNA, 20 nt, Human
ugagcagucaggaaagagaa

SEQ ID NO: 1601945 - RNA, 14 nt, Human
ugagaugcuagaac

SEQ ID NO: 1601946 - RNA, 16 nt, Human
ugagaugcuagaacuc

SEQ ID NO: 1601947 - RNA, 20 nt, Human
ugagaugcuagaacucccuu

SEQ ID NO: 1601948 - RNA, 13 nt, Human
ugagccccaaaag

SEQ ID NO: 1601949 - RNA, 20 nt, Human
ugagaaagacuauucaaaca

SEQ ID NO: 1601950 - RNA, 18 nt, Human
ugagaaagacuauucaaa

SEQ ID NO: 1601951 - RNA, 16 nt, Human
ugagaaagacuauuca

SEQ ID NO: 1601952 - RNA, 17 nt, Human
ugagaaagacuauucaa

SEQ ID NO: 1601953 - RNA, 14 nt, Human
ugagacagcucugc

SEQ ID NO: 1601954 - RNA, 16 nt, Human
ugagacagcucugcau

SEQ ID NO: 1601955 - RNA, 13 nt, Human
ugacucuuaagaa

SEQ ID NO: 1601956 - RNA, 12 nt, Human
ugacucuuaaga

SEQ ID NO: 1601957 - RNA, 24 nt, Human
ugauaguuguaccgcaaugugacu

SEQ ID NO: 1601958 - RNA, 21 nt, Human
ugauguauucuagcuaaugua

SEQ ID NO: 1601959 - RNA, 20 nt, Human
ugauguauucuagcuaaugu

SEQ ID NO: 1601960 - RNA, 14 nt, Human
ugauguauucuagc

SEQ ID NO: 1601961 - RNA, 13 nt, Human
ugauguauucuag

SEQ ID NO: 1601962 - RNA, 23 nt, Human
ugggcagcugccuccccuccucu

SEQ ID NO: 1601963 - RNA, 22 nt, Human
ugggcagcugccuccccuccuc

SEQ ID NO: 1601964 - RNA, 20 nt, Human
ugggcagcugccuccccucc

SEQ ID NO: 1601965 - RNA, 12 nt, Human
ugggcagcugcc

SEQ ID NO: 1601966 - RNA, 14 nt, Human
ugggacagggagga

SEQ ID NO: 1601967 - RNA, 23 nt, Human
uggccuucggccuccauccugag

SEQ ID NO: 1601968 - RNA, 22 nt, Human
uggccuucggccuccauccuga

SEQ ID NO: 1601969 - RNA, 17 nt, Human
uggagacacaacuauuu

SEQ ID NO: 1601970 - RNA, 17 nt, Human
ugcuucuguuuuauaau

SEQ ID NO: 1601971 - RNA, 22 nt, Human
uggaaaaguauguuagugcaaa

SEQ ID NO: 1601972 - RNA, 15 nt, Human
ugcuuguguuaagua

SEQ ID NO: 1601973 - RNA, 22 nt, Human
ugcuucuguuuuauaauuuugu

SEQ ID NO: 1601974 - RNA, 12 nt, Human
ugcuuguguuaa

SEQ ID NO: 1601975 - RNA, 17 nt, Human
ugucuacacuaagagag

SEQ ID NO: 1601976 - RNA, 22 nt, Human
ugucuacacuaagagagaauga

SEQ ID NO: 1601977 - RNA, 12 nt, Human
ugucuuaauuaa

SEQ ID NO: 1601978 - RNA, 18 nt, Human
uguauuuuaaaagaauga

SEQ ID NO: 1601979 - RNA, 19 nt, Human
uguauuuuaaaagaaugau

SEQ ID NO: 1601980 - RNA, 20 nt, Human
uguaguguuggagaagaacu

SEQ ID NO: 1601981 - RNA, 21 nt, Human
uguaguguuggagaagaacug

SEQ ID NO: 1601982 - RNA, 19 nt, Human
uguaguguuggagaagaac

SEQ ID NO: 1601983 - RNA, 14 nt, Human
uguauaaaauaauu

SEQ ID NO: 1601984 - RNA, 13 nt, Human
uguauaaaauaau

SEQ ID NO: 1601985 - RNA, 15 nt, Human
uguagcuuuaucaaa

SEQ ID NO: 1601986 - RNA, 14 nt, Human
uguagcuuuaucaa

SEQ ID NO: 1601987 - RNA, 16 nt, Human
ugguucccuugaugaa

SEQ ID NO: 1601988 - RNA, 17 nt, Human
ugguucccuugaugaag

SEQ ID NO: 1601989 - RNA, 20 nt, Human
ugguucccuugaugaagaag

SEQ ID NO: 1601990 - RNA, 14 nt, Human
uggguagacacaca

SEQ ID NO: 1601991 - RNA, 11 nt, Human
uguaaaauggu

SEQ ID NO: 1601992 - RNA, 12 nt, Human
uguaaaauggug

SEQ ID NO: 1601993 - RNA, 22 nt, Human
uguaauaacugugaaguuuaca

SEQ ID NO: 1601994 - RNA, 14 nt, Human
uguaauaacuguga

SEQ ID NO: 1601995 - RNA, 15 nt, Human
ucccuugaugaagaa

SEQ ID NO: 1601996 - RNA, 16 nt, Human
ucccuugaugaagaag

SEQ ID NO: 1601997 - RNA, 22 nt, Human
uccucugcuugccaucccuccc

SEQ ID NO: 1601998 - RNA, 21 nt, Human
uccucugcuugccaucccucc

SEQ ID NO: 1601999 - RNA, 20 nt, Human
uccucugcuugccaucccuc

SEQ ID NO: 1602000 - RNA, 16 nt, Human
uccuuggacucauuuu

SEQ ID NO: 1602001 - RNA, 20 nt, Human
uccugccuaagugcagcccc

SEQ ID NO: 1602002 - RNA, 22 nt, Human
ucuagugagcagucaggaaaga

SEQ ID NO: 1602003 - RNA, 19 nt, Human
ucuagugagcagucaggaa

SEQ ID NO: 1602004 - RNA, 13 nt, Human
ucuaugaaauauu

SEQ ID NO: 1602005 - RNA, 14 nt, Human
ucuaugaaauauua

SEQ ID NO: 1602006 - RNA, 17 nt, Human
ucuaugaaauauuaugu

SEQ ID NO: 1602007 - RNA, 18 nt, Human
ucuaugaaauauuauguu

SEQ ID NO: 1602008 - RNA, 13 nt, Human
ucguuaauuugua

SEQ ID NO: 1602009 - RNA, 18 nt, Human
ucggccuccauccugagg

SEQ ID NO: 1602010 - RNA, 21 nt, Human
ucguggaacaguuaccucugc

SEQ ID NO: 1602011 - RNA, 22 nt, Human
ucgugggacagucaccucaugg

SEQ ID NO: 1602012 - RNA, 14 nt, Human
ucugcaucagcugc

SEQ ID NO: 1602013 - RNA, 19 nt, Human
ucugcaucagcugcugaaa

SEQ ID NO: 1602014 - RNA, 21 nt, Human
ucugcaucagcugcugaaaca

SEQ ID NO: 1602015 - RNA, 17 nt, Human
ucuggccuucggccucc

SEQ ID NO: 1602016 - RNA, 18 nt, Human
ucuggccuucggccucca

SEQ ID NO: 1602017 - RNA, 23 nt, Human
ucuggccuucggccuccauccug

SEQ ID NO: 1602018 - RNA, 12 nt, Human
ucuuaagaagac

SEQ ID NO: 1602019 - RNA, 18 nt, Human
ucuuaagaagacugcauu

SEQ ID NO: 1602020 - RNA, 15 nt, Human
ucugucuucacaaca

SEQ ID NO: 1602021 - RNA, 22 nt, Human
ucuuaggguuaugauuaaguaa

SEQ ID NO: 1602022 - RNA, 19 nt, Human
ucuucaucugacuaugaca

SEQ ID NO: 1602023 - RNA, 16 nt, Human
ucaaauaugcaaagca

SEQ ID NO: 1602024 - RNA, 14 nt, Human
ucaaauaugcaaag

SEQ ID NO: 1602025 - RNA, 20 nt, Human
ucaaaucaagaaacuuaagg

SEQ ID NO: 1602026 - RNA, 15 nt, Human
ucaaauccuugaaga

SEQ ID NO: 1602027 - RNA, 14 nt, Human
ucaaauugugugaa

SEQ ID NO: 1602028 - RNA, 15 nt, Human
ucaaauugugugaaa

SEQ ID NO: 1602029 - RNA, 21 nt, Human
ucaauaaaauccauacauuug

SEQ ID NO: 1602030 - RNA, 14 nt, Human
ucaccaaggcugau

SEQ ID NO: 1602031 - RNA, 13 nt, Human
ucacaagacccaa

SEQ ID NO: 1602032 - RNA, 17 nt, Human
ucacaagacccaaaagg

SEQ ID NO: 1602033 - RNA, 18 nt, Human
ucacaagacccaaaaggc

SEQ ID NO: 1602034 - RNA, 16 nt, Human
ucacagucacauucca

SEQ ID NO: 1602035 - RNA, 16 nt, Human
uauuauucccauucua

SEQ ID NO: 1602036 - RNA, 14 nt, Human
uauucuaaauuuua

SEQ ID NO: 1602037 - RNA, 19 nt, Human
uauucuagcuaauguaaua

SEQ ID NO: 1602038 - RNA, 19 nt, Human
uauucuaaauuuuauaucu

SEQ ID NO: 1602039 - RNA, 15 nt, Human
uauucuaaauuuuau

SEQ ID NO: 1602040 - RNA, 20 nt, Human
uauucuaaauuuuauaucuu

SEQ ID NO: 1602041 - RNA, 13 nt, Human
uauguacuucaug

SEQ ID NO: 1602042 - RNA, 17 nt, Human
uauguacuucaugcugu

SEQ ID NO: 1602043 - RNA, 12 nt, Human
uauuaauauauu

SEQ ID NO: 1602044 - RNA, 16 nt, Human
uauguuucaaacuuug

SEQ ID NO: 1602045 - RNA, 15 nt, Human
uauguuucaaacuuu

SEQ ID NO: 1602046 - RNA, 13 nt, Human
uauguuucaaacu

SEQ ID NO: 1602047 - RNA, 21 nt, Human
ucagagcugcccucuccuggg

SEQ ID NO: 1602048 - RNA, 20 nt, Human
ucagagcugcccucuccugg

SEQ ID NO: 1602049 - RNA, 19 nt, Human
ucagagcugcccucuccug

SEQ ID NO: 1602050 - RNA, 23 nt, Human
ucagagcugcccucuccugggca

SEQ ID NO: 1602051 - RNA, 22 nt, Human
ucagagcugcccucuccugggc

SEQ ID NO: 1602052 - RNA, 17 nt, Human
ucagcuccccucggaga

SEQ ID NO: 1602053 - RNA, 18 nt, Human
ucagcuccccucggagaa

SEQ ID NO: 1602054 - RNA, 21 nt, Human
ucagcuccccucggagaagag

SEQ ID NO: 1602055 - RNA, 13 nt, Human
ucaggcuagaugu

SEQ ID NO: 1602056 - RNA, 17 nt, Human
ucaggcuagauguaugu

SEQ ID NO: 1602057 - RNA, 17 nt, Human
uccacuuggucugugag

SEQ ID NO: 1602058 - RNA, 15 nt, Human
uccacuuggucugug

SEQ ID NO: 1602059 - RNA, 16 nt, Human
uccacuuggucuguga

SEQ ID NO: 1602060 - RNA, 19 nt, Human
uccacagaagcuccaggua

SEQ ID NO: 1602061 - RNA, 14 nt, Human
uccaccucccugca

SEQ ID NO: 1602062 - RNA, 13 nt, Human
uccaccucccugc

SEQ ID NO: 1602063 - RNA, 17 nt, Human
uccaccucccugcaaua

SEQ ID NO: 1602064 - RNA, 16 nt, Human
uccaccucccugcaau

SEQ ID NO: 1602065 - RNA, 15 nt, Human
uccaccucccugcaa

SEQ ID NO: 1602066 - RNA, 15 nt, Human
uccaaaauaauuuua

SEQ ID NO: 1602067 - RNA, 19 nt, Human
uccaaaauaauuuuaagaa

SEQ ID NO: 1602068 - RNA, 19 nt, Human
ucauuaucucaaaacugca

SEQ ID NO: 1602069 - RNA, 20 nt, Human
ucauuaucucaaaacugcac

SEQ ID NO: 1602070 - RNA, 13 nt, Human
ucauuaucucaaa

SEQ ID NO: 1602071 - RNA, 13 nt, Human
ucauuuccaagca

SEQ ID NO: 1602072 - RNA, 16 nt, Human
ucauuuccaagcaagu

SEQ ID NO: 1602073 - RNA, 18 nt, Human
ucauaccuaucaucuuaa

SEQ ID NO: 1602074 - RNA, 18 nt, Human
ucaucugacuaugacaua

SEQ ID NO: 1602075 - RNA, 17 nt, Human
ucaucugacuaugacau

SEQ ID NO: 1602076 - RNA, 16 nt, Human
ggaggacgcucucugg

SEQ ID NO: 1602077 - RNA, 19 nt, Human
ggaggggagcaugggaagu

SEQ ID NO: 1602078 - RNA, 11 nt, Human
ggagaagaacu

SEQ ID NO: 1602079 - RNA, 14 nt, Human
ggagaagaacugaa

SEQ ID NO: 1602080 - RNA, 15 nt, Human
ggagaagagcuguuc

SEQ ID NO: 1602081 - RNA, 23 nt, Human
ggagaagagcuguucacagccag

SEQ ID NO: 1602082 - RNA, 16 nt, Human
ggacgcucucuggccu

SEQ ID NO: 1602083 - RNA, 19 nt, Human
ggacgcucucuggccuucg

SEQ ID NO: 1602084 - RNA, 17 nt, Human
ggacauuugcucaugga

SEQ ID NO: 1602085 - RNA, 20 nt, Human
ggacauuugcucauggaauu

SEQ ID NO: 1602086 - RNA, 21 nt, Human
ggcagagguugcagugagccg

SEQ ID NO: 1602087 - RNA, 16 nt, Human
ggcagcugccuccccu

SEQ ID NO: 1602088 - RNA, 13 nt, Human
ggcagcugccucc

SEQ ID NO: 1602089 - RNA, 12 nt, Human
ggcagcugccuc

SEQ ID NO: 1602090 - RNA, 11 nt, Human
ggcagcugccu

SEQ ID NO: 1602091 - RNA, 16 nt, Human
ggcuccacuuggucug

SEQ ID NO: 1602092 - RNA, 20 nt, Human
ggcuaguaucaaaagaaaga

SEQ ID NO: 1602093 - RNA, 23 nt, Human
ggcuauaggugcuacaaaaacac

SEQ ID NO: 1602094 - RNA, 17 nt, Human
gggaggacgcucucugg

SEQ ID NO: 1602095 - RNA, 20 nt, Human
gggaggacgcucucuggccu

SEQ ID NO: 1602096 - RNA, 11 nt, Human
gggaggcagag

SEQ ID NO: 1602097 - RNA, 14 nt, Human
gggaauugaggaca

SEQ ID NO: 1602098 - RNA, 21 nt, Human
gggacugaggggaggggagca

SEQ ID NO: 1602099 - RNA, 21 nt, Human
gcuauaggugcuacaaaaaca

SEQ ID NO: 1602100 - RNA, 14 nt, Human
gcuagauguaugua

SEQ ID NO: 1602101 - RNA, 16 nt, Human
gcuagauguauguacu

SEQ ID NO: 1602102 - RNA, 13 nt, Human
gcuagauguaugu

SEQ ID NO: 1602103 - RNA, 17 nt, Human
gccugagcgacagugag

SEQ ID NO: 1602104 - RNA, 20 nt, Human
gccugagcgacagugagacu

SEQ ID NO: 1602105 - RNA, 21 nt, Human
gcugauuaaaccaaggcuaga

SEQ ID NO: 1602106 - RNA, 12 nt, Human
gcugcccucucc

SEQ ID NO: 1602107 - RNA, 21 nt, Human
gcuggaaaaguauguuagugc

SEQ ID NO: 1602108 - RNA, 23 nt, Human
gcuggaaaaguauguuagugcaa

SEQ ID NO: 1602109 - RNA, 22 nt, Human
gcugcccucuccugggcagcug

SEQ ID NO: 1602110 - RNA, 20 nt, Human
gcugcccucuccugggcagc

SEQ ID NO: 1602111 - RNA, 18 nt, Human
gcugcccucuccugggca

SEQ ID NO: 1602112 - RNA, 17 nt, Human
gcugcccucuccugggc

SEQ ID NO: 1602113 - RNA, 16 nt, Human
gcugcccucuccuggg

SEQ ID NO: 1602114 - RNA, 15 nt, Human
gcugcccucuccugg

SEQ ID NO: 1602115 - RNA, 14 nt, Human
gcugcccucuccug

SEQ ID NO: 1602116 - RNA, 13 nt, Human
gcugcccucuccu

SEQ ID NO: 1602117 - RNA, 23 nt, Human
gcugcccucuccugggcagcugc

SEQ ID NO: 1602118 - RNA, 19 nt, Human
gcuucuguuuuauaauuuu

SEQ ID NO: 1602119 - RNA, 12 nt, Human
gcuuguguuaag

SEQ ID NO: 1602120 - RNA, 23 nt, Human
gcuggucccagccagcaguucag

SEQ ID NO: 1602121 - RNA, 18 nt, Human
gcuguguuaaauaaaccu

SEQ ID NO: 1602122 - RNA, 19 nt, Human
gccagacuggcacaguuuu

SEQ ID NO: 1602123 - RNA, 15 nt, Human
gccagacuggcacag

SEQ ID NO: 1602124 - RNA, 18 nt, Human
gccagacuggcacaguuu

SEQ ID NO: 1602125 - RNA, 19 nt, Human
gccaugggcacugugggua

SEQ ID NO: 1602126 - RNA, 23 nt, Human
gccaugggacagggaggacgcuc

SEQ ID NO: 1602127 - RNA, 19 nt, Human
gccagauuuuccugaaaac

SEQ ID NO: 1602128 - RNA, 23 nt, Human
gcagagguugcagugagccgaga

SEQ ID NO: 1602129 - RNA, 18 nt, Human
gcagagguugcagugagc

SEQ ID NO: 1602130 - RNA, 15 nt, Human
gcacagccucuuaga

SEQ ID NO: 1602131 - RNA, 18 nt, Human
gcacagccucuuagaugc

SEQ ID NO: 1602132 - RNA, 23 nt, Human
gcaucagcugcugaaacaacaaa

SEQ ID NO: 1602133 - RNA, 22 nt, Human
gcaucagcugcugaaacaacaa

SEQ ID NO: 1602134 - RNA, 23 nt, Human
gcaguucagagcugcccucuccu

SEQ ID NO: 1602135 - RNA, 22 nt, Human
gcaguucagagcugcccucucc

SEQ ID NO: 1602136 - RNA, 20 nt, Human
gcaguucagagcugcccucu

SEQ ID NO: 1602137 - RNA, 19 nt, Human
gcaguucagagcugcccuc

SEQ ID NO: 1602138 - RNA, 16 nt, Human
gcaguugaaaagacuc

SEQ ID NO: 1602139 - RNA, 19 nt, Human
gcaguugaaaagacuccaa

SEQ ID NO: 1602140 - RNA, 21 nt, Human
gcaguugaaaagacuccaaag

SEQ ID NO: 1602141 - RNA, 22 nt, Human
gcaguugaaaagacuccaaaga

SEQ ID NO: 1602142 - RNA, 17 nt, Human
gaguauuuuugacagaa

SEQ ID NO: 1602143 - RNA, 16 nt, Human
gaguauuuuugacaga

SEQ ID NO: 1602144 - RNA, 14 nt, Human
gaguauuuuugaca

SEQ ID NO: 1602145 - RNA, 18 nt, Human
gaguauuuuugacagaau

SEQ ID NO: 1602146 - RNA, 21 nt, Human
gaguugaaaaucuuauaauuu

SEQ ID NO: 1602147 - RNA, 22 nt, Human
gagugaacaaauuuacagagac

SEQ ID NO: 1602148 - RNA, 23 nt, Human
gagugaacaaauuuacagagaca

SEQ ID NO: 1602149 - RNA, 19 nt, Human
gagugaacaaauuuacaga

SEQ ID NO: 1602150 - RNA, 21 nt, Human
gauaaucagugugucuaaauu

SEQ ID NO: 1602151 - RNA, 19 nt, Human
gauguugaaaaaguucugc

SEQ ID NO: 1602152 - RNA, 13 nt, Human
gauugugccccug

SEQ ID NO: 1602153 - RNA, 18 nt, Human
gaugcaguucugaagaag

SEQ ID NO: 1602154 - RNA, 16 nt, Human
gaugggaaagcauugu

SEQ ID NO: 1602155 - RNA, 16 nt, Human
gaucuucaucugacua

SEQ ID NO: 1602156 - RNA, 14 nt, Human
gaucuuuaaaauac

SEQ ID NO: 1602157 - RNA, 23 nt, Human
gaucuucaucugacuaugacaua

SEQ ID NO: 1602158 - RNA, 14 nt, Human
gagcuacaaaugca

SEQ ID NO: 1602159 - RNA, 17 nt, Human
gagcugcccucuccugg

SEQ ID NO: 1602160 - RNA, 16 nt, Human
gagcugcccucuccug

SEQ ID NO: 1602161 - RNA, 15 nt, Human
gagcugcccucuccu

SEQ ID NO: 1602162 - RNA, 14 nt, Human
gagcugcccucucc

SEQ ID NO: 1602163 - RNA, 13 nt, Human
gagcuacaaaugc

SEQ ID NO: 1602164 - RNA, 12 nt, Human
gagcuacaaaug

SEQ ID NO: 1602165 - RNA, 21 nt, Human
gagcaggcuacugucagcucc

SEQ ID NO: 1602166 - RNA, 13 nt, Human
gagcaaagcugau

SEQ ID NO: 1602167 - RNA, 23 nt, Human
cuauucaaacagucucaggaaau

SEQ ID NO: 1602168 - RNA, 18 nt, Human
cuauucaaacagucucag

SEQ ID NO: 1602169 - RNA, 16 nt, Human
cuauucaaacagucuc

SEQ ID NO: 1602170 - RNA, 18 nt, Human
cuauauuguuugcuaagc

SEQ ID NO: 1602171 - RNA, 20 nt, Human
cuauaggugcuacaaaaaca

SEQ ID NO: 1602172 - RNA, 21 nt, Human
cuauaggugcuacaaaaacac

SEQ ID NO: 1602173 - RNA, 22 nt, Human
cuauaggugcuacaaaaacaca

SEQ ID NO: 1602174 - RNA, 16 nt, Human
cuaguaauuggaaagg

SEQ ID NO: 1602175 - RNA, 20 nt, Human
cuagugaaacucguuaauuu

SEQ ID NO: 1602176 - RNA, 18 nt, Human
cuagugaaagaggcagcu

SEQ ID NO: 1602177 - RNA, 19 nt, Human
cuagugaaagaggcagcuu

SEQ ID NO: 1602178 - RNA, 21 nt, Human
cuagugagcagucaggaaaga

SEQ ID NO: 1602179 - RNA, 21 nt, Human
cuccaaacugacucuuaagaa

SEQ ID NO: 1602180 - RNA, 12 nt, Human
cuccaaagaaau

SEQ ID NO: 1602181 - RNA, 13 nt, Human
cuccaaagaaaug

SEQ ID NO: 1602182 - RNA, 21 nt, Human
cucauuuccaagcaaguauua

SEQ ID NO: 1602183 - RNA, 12 nt, Human
cuccauccugag

SEQ ID NO: 1602184 - RNA, 13 nt, Human
cuccccuccucug

SEQ ID NO: 1602185 - RNA, 11 nt, Human
cuccccuccuc

SEQ ID NO: 1602186 - RNA, 14 nt, Human
cuccauccugaggc

SEQ ID NO: 1602187 - RNA, 13 nt, Human
cuccauccugagg

SEQ ID NO: 1602188 - RNA, 20 nt, Human
cuccccuccucugcuugcca

SEQ ID NO: 1602189 - RNA, 12 nt, Human
cucccuuucaac

SEQ ID NO: 1602190 - RNA, 19 nt, Human
cucuuaagaagacugcauu

SEQ ID NO: 1602191 - RNA, 21 nt, Human
cucuggccuucggccuccauc

SEQ ID NO: 1602192 - RNA, 22 nt, Human
cucuggccuucggccuccaucc

SEQ ID NO: 1602193 - RNA, 12 nt, Human
cugagaaagacu

SEQ ID NO: 1602194 - RNA, 13 nt, Human
cugagaaagacua

SEQ ID NO: 1602195 - RNA, 15 nt, Human
cugagaaagacuauu

SEQ ID NO: 1602196 - RNA, 18 nt, Human
cugagaaagacuauucaa

SEQ ID NO: 1602197 - RNA, 16 nt, Human
cugagcaggauuuuaa

SEQ ID NO: 1602198 - RNA, 21 nt, Human
cugagaugugaacacaucagc

SEQ ID NO: 1602199 - RNA, 22 nt, Human
cugagaaagacuauucaaacag

SEQ ID NO: 1602200 - RNA, 19 nt, Human
cugagaaagacuauucaaa

SEQ ID NO: 1602201 - RNA, 20 nt, Human
cugagaaagacuauucaaac

SEQ ID NO: 1602202 - RNA, 20 nt, Human
cugagaugugaacacaucag

SEQ ID NO: 1602203 - RNA, 14 nt, Human
cugaagaagauggu

SEQ ID NO: 1602204 - RNA, 15 nt, Human
cugaggcuccacuug

SEQ ID NO: 1602205 - RNA, 21 nt, Human
cugaggcuccacuuggucugu

SEQ ID NO: 1602206 - RNA, 15 nt, Human
cugcaauaaaauggg

SEQ ID NO: 1602207 - RNA, 22 nt, Human
cugcaauaaaauggguuuuacu

SEQ ID NO: 1602208 - RNA, 13 nt, Human
gaaauauuauguu

SEQ ID NO: 1602209 - RNA, 16 nt, Human
gaaauauuauguuaaa

SEQ ID NO: 1602210 - RNA, 22 nt, Human
gaaauguaagggaaacugccag

SEQ ID NO: 1602211 - RNA, 11 nt, Human
gaaacauuugg

SEQ ID NO: 1602212 - RNA, 21 nt, Human
gaagaagcaccaaucaugaau

SEQ ID NO: 1602213 - RNA, 21 nt, Human
gaacuuguaaaggaauuuaaa

SEQ ID NO: 1602214 - RNA, 15 nt, Human
gaacucccuuucaac

SEQ ID NO: 1602215 - RNA, 14 nt, Human
gaacucccuuucaa

SEQ ID NO: 1602216 - RNA, 22 nt, Human
gaacuuccagauccuggaaauc

SEQ ID NO: 1602217 - RNA, 22 nt, Human
gaacuagaguuuagcuggaaaa

SEQ ID NO: 1602218 - RNA, 14 nt, Human
gaauacuuuauaaa

SEQ ID NO: 1602219 - RNA, 20 nt, Human
gaauaauccuaaacauauga

SEQ ID NO: 1602220 - RNA, 17 nt, Human
gaaguuuacauuguaaa

SEQ ID NO: 1602221 - RNA, 16 nt, Human
gaaguuuacauuguaa

SEQ ID NO: 1602222 - RNA, 17 nt, Human
gaagacugcauuauauu

SEQ ID NO: 1602223 - RNA, 21 nt, Human
gaagccuuggggcugaugcag

SEQ ID NO: 1602224 - RNA, 14 nt, Human
gaaggaaaaugaua

SEQ ID NO: 1602225 - RNA, 22 nt, Human
gaaaacaauaacgauaaaagac

SEQ ID NO: 1602226 - RNA, 20 nt, Human
gaaaaucuuauaauuuaaaa

SEQ ID NO: 1602227 - RNA, 19 nt, Human
gaaaauaacgauaaaagac

SEQ ID NO: 1602228 - RNA, 19 nt, Human
gaaaaucuuauaauuuaaa

SEQ ID NO: 1602229 - RNA, 12 nt, Human
gaaaauaucacu

SEQ ID NO: 1602230 - RNA, 17 nt, Human
gaaaauauuauguguuu

SEQ ID NO: 1602231 - RNA, 19 nt, Human
cuuguaaaggaauuuaaaa

SEQ ID NO: 1602232 - RNA, 22 nt, Human
cuugccaucccucccuccaccu

SEQ ID NO: 1602233 - RNA, 21 nt, Human
cuugccaucccucccuccacc

SEQ ID NO: 1602234 - RNA, 13 nt, Human
cuuuccacagaag

SEQ ID NO: 1602235 - RNA, 21 nt, Human
cuuuauuuucuauaauuuaaa

SEQ ID NO: 1602236 - RNA, 20 nt, Human
cuuuaaagggauggcaagau

SEQ ID NO: 1602237 - RNA, 18 nt, Human
cuuuaaagggauggcaag

SEQ ID NO: 1602238 - RNA, 19 nt, Human
cuuguguuaaguaugugua

SEQ ID NO: 1602239 - RNA, 16 nt, Human
cuucagcgguuuauau

SEQ ID NO: 1602240 - RNA, 15 nt, Human
cuucagccugaaaga

SEQ ID NO: 1602241 - RNA, 17 nt, Human
cuucaaauccuugaaga

SEQ ID NO: 1602242 - RNA, 12 nt, Human
cuucacaacaga

SEQ ID NO: 1602243 - RNA, 14 nt, Human
cuucacaacagauu

SEQ ID NO: 1602244 - RNA, 20 nt, Human
cuucggccuccauccugagg

SEQ ID NO: 1602245 - RNA, 23 nt, Human
cuuaagaagacugcauuauauuu

SEQ ID NO: 1602246 - RNA, 12 nt, Human
cuuaaaaauggu

SEQ ID NO: 1602247 - RNA, 19 nt, Human
cuuaauuaaaagaauauuu

SEQ ID NO: 1602248 - RNA, 20 nt, Human
cuuaauuaaaagaauauuuu

SEQ ID NO: 1602249 - RNA, 16 nt, Human
cuuaauuaaaagaaua

SEQ ID NO: 1602250 - RNA, 17 nt, Human
cuuaauuaaaagaauau

SEQ ID NO: 1602251 - RNA, 14 nt, Human
cuguuuuauaauuu

SEQ ID NO: 1602252 - RNA, 15 nt, Human
cuguuuuauaauuuu

SEQ ID NO: 1602253 - RNA, 19 nt, Human
cuguuaaaagaugaaaaua

SEQ ID NO: 1602254 - RNA, 15 nt, Human
cuguuaaaagaugaa

SEQ ID NO: 1602255 - RNA, 16 nt, Human
cuguuaaaagaugaaa

SEQ ID NO: 1602256 - RNA, 18 nt, Human
cugucuucacaacagauu

SEQ ID NO: 1602257 - RNA, 18 nt, Human
cugugaaaguacauuugg

SEQ ID NO: 1602258 - RNA, 20 nt, Human
cccacaagaaaugaaagcag

SEQ ID NO: 1602259 - RNA, 13 nt, Human
cccacaagaaaug

SEQ ID NO: 1602260 - RNA, 17 nt, Human
cccuccaccucccugca

SEQ ID NO: 1602261 - RNA, 15 nt, Human
cccuccaccucccug

SEQ ID NO: 1602262 - RNA, 19 nt, Human
cccuccaccucccugcaau

SEQ ID NO: 1602263 - RNA, 12 nt, Human
cccuccaccucc

SEQ ID NO: 1602264 - RNA, 14 nt, Human
cccuccaccucccu

SEQ ID NO: 1602265 - RNA, 13 nt, Human
cccucuccugggc

SEQ ID NO: 1602266 - RNA, 12 nt, Human
cccucuccuggg

SEQ ID NO: 1602267 - RNA, 11 nt, Human
cccucuccugg

SEQ ID NO: 1602268 - RNA, 15 nt, Human
cccucuccugggcag

SEQ ID NO: 1602269 - RNA, 14 nt, Human
cccucuccugggca

SEQ ID NO: 1602270 - RNA, 15 nt, Human
cccgugggguuccuc

SEQ ID NO: 1602271 - RNA, 18 nt, Human
ccuccucugcuugccauc

SEQ ID NO: 1602272 - RNA, 16 nt, Human
ccuccucugcuugcca

SEQ ID NO: 1602273 - RNA, 20 nt, Human
ccucccuccaccucccugca

SEQ ID NO: 1602274 - RNA, 17 nt, Human
ccucccuccaccucccu

SEQ ID NO: 1602275 - RNA, 22 nt, Human
ccuccaccucccugcaauaaaa

SEQ ID NO: 1602276 - RNA, 17 nt, Human
ccuccaccucccugcaa

SEQ ID NO: 1602277 - RNA, 15 nt, Human
ccuccaccucccugc

SEQ ID NO: 1602278 - RNA, 14 nt, Human
ccuccaccucccug

SEQ ID NO: 1602279 - RNA, 13 nt, Human
ccuccaccucccu

SEQ ID NO: 1602280 - RNA, 16 nt, Human
ccgggcguggugguga

SEQ ID NO: 1602281 - RNA, 20 nt, Human
ccuguuaaaagaugaaaaua

SEQ ID NO: 1602282 - RNA, 21 nt, Human
ccuguuaaaagaugaaaauau

SEQ ID NO: 1602283 - RNA, 12 nt, Human
ccuucagccuga

SEQ ID NO: 1602284 - RNA, 14 nt, Human
ccuucggccuccau

SEQ ID NO: 1602285 - RNA, 20 nt, Human
ccuucggccuccauccugag

SEQ ID NO: 1602286 - RNA, 19 nt, Human
ccuuggggcugaugcaguu

SEQ ID NO: 1602287 - RNA, 16 nt, Human
ccuucggccuccaucc

SEQ ID NO: 1602288 - RNA, 15 nt, Human
ccuucugugaaagua

SEQ ID NO: 1602289 - RNA, 18 nt, Human
cgagcaggcuacugucag

SEQ ID NO: 1602290 - RNA, 21 nt, Human
cgaagaguauuuuugacagaa

SEQ ID NO: 1602291 - RNA, 23 nt, Human
cgaagaguauuuuugacagaaua

SEQ ID NO: 1602292 - RNA, 23 nt, Human
ccuggaaaucaggguuaguauug

SEQ ID NO: 1602293 - RNA, 11 nt, Human
ccugagcccca

SEQ ID NO: 1602294 - RNA, 16 nt, Human
ccugcaauaaaauggg

SEQ ID NO: 1602295 - RNA, 19 nt, Human
ccugcaauuucauaugcug

SEQ ID NO: 1602296 - RNA, 14 nt, Human
ccaccucccugcaa

SEQ ID NO: 1602297 - RNA, 22 nt, Human
ccagccagcaguucagagcugc

SEQ ID NO: 1602298 - RNA, 22 nt, Human
ccagcaguucagagcugcccuc

SEQ ID NO: 1602299 - RNA, 21 nt, Human
ccagcaguucagagcugcccu

SEQ ID NO: 1602300 - RNA, 20 nt, Human
ccagcaguucagagcugccc

SEQ ID NO: 1602301 - RNA, 19 nt, Human
ccagcaguucagagcugcc

SEQ ID NO: 1602302 - RNA, 18 nt, Human
ccagcaguucagagcugc

SEQ ID NO: 1602303 - RNA, 13 nt, Human
ccagcaguucaga

SEQ ID NO: 1602304 - RNA, 23 nt, Human
ccagcaguucagagcugcccucu

SEQ ID NO: 1602305 - RNA, 21 nt, Human
ccaguuauggcuauaggugcu

SEQ ID NO: 1602306 - RNA, 14 nt, Human
ccaguuauggcuau

SEQ ID NO: 1602307 - RNA, 16 nt, Human
ccaugggacagggagg

SEQ ID NO: 1602308 - RNA, 19 nt, Human
ccaugggacagggaggacg

SEQ ID NO: 1602309 - RNA, 13 nt, Human
cauucuggaauaa

SEQ ID NO: 1602310 - RNA, 22 nt, Human
cauuccaacuaucucauuucca

SEQ ID NO: 1602311 - RNA, 21 nt, Human
cauuguaaaugugcuuuuaaa

SEQ ID NO: 1602312 - RNA, 19 nt, Human
cauuguacgaagaguauuu

SEQ ID NO: 1602313 - RNA, 20 nt, Human
cauuguacgaagaguauuuu

SEQ ID NO: 1602314 - RNA, 20 nt, Human
cauggaauuggagcucgugg

SEQ ID NO: 1602315 - RNA, 13 nt, Human
cauggcauauuuu

SEQ ID NO: 1602316 - RNA, 19 nt, Human
cauggcauauuuuucacau

SEQ ID NO: 1602317 - RNA, 15 nt, Human
cauggcauauuuuuc

SEQ ID NO: 1602318 - RNA, 23 nt, Human
cauggcauauuuuucacauaucu

SEQ ID NO: 1602319 - RNA, 20 nt, Human
caugugcuaguaauuggaaa

SEQ ID NO: 1602320 - RNA, 21 nt, Human
cauuaaaaaaucaguuguaca

SEQ ID NO: 1602321 - RNA, 18 nt, Human
caucccuuaccugggaaa

SEQ ID NO: 1602322 - RNA, 23 nt, Human
caucccucccuccaccucccugc

SEQ ID NO: 1602323 - RNA, 22 nt, Human
caucccucccuccaccucccug

SEQ ID NO: 1602324 - RNA, 13 nt, Human
cauauauaacaau

SEQ ID NO: 1602325 - RNA, 15 nt, Human
cauauauaacaaugc

SEQ ID NO: 1602326 - RNA, 20 nt, Human
cauauauaacaaugcuguau

SEQ ID NO: 1602327 - RNA, 18 nt, Human
cauaucuaguaugaaauu

SEQ ID NO: 1602328 - RNA, 17 nt, Human
cauaucuaguaugaaau

SEQ ID NO: 1602329 - RNA, 15 nt, Human
cauaucuaguaugaa

SEQ ID NO: 1602330 - RNA, 21 nt, Human
cauaucuaguaugaaauuaua

SEQ ID NO: 1602331 - RNA, 19 nt, Human
caugagguacugagaguga

SEQ ID NO: 1602332 - RNA, 16 nt, Human
caugagguacugagag

SEQ ID NO: 1602333 - RNA, 18 nt, Human
caugaagauguagaggag

SEQ ID NO: 1602334 - RNA, 19 nt, Human
caugaagauguagaggaga

SEQ ID NO: 1602335 - RNA, 17 nt, Human
caucugacuaugacaua

SEQ ID NO: 1602336 - RNA, 13 nt, Human
caggcuagaugua

SEQ ID NO: 1602337 - RNA, 19 nt, Human
caggcuagauguauguacu

SEQ ID NO: 1602338 - RNA, 14 nt, Human
caggcuacugucag

SEQ ID NO: 1602339 - RNA, 18 nt, Human
cagggacaggauaagagg

SEQ ID NO: 1602340 - RNA, 17 nt, Human
cagggcauggcugggaa

SEQ ID NO: 1602341 - RNA, 11 nt, Human
caggggacagg

SEQ ID NO: 1602342 - RNA, 16 nt, Human
caggggacaggauggu

SEQ ID NO: 1602343 - RNA, 16 nt, Human
caggauuuuaaucuuu

SEQ ID NO: 1602344 - RNA, 21 nt, Human
caggaugguucccuugaugaa

SEQ ID NO: 1602345 - RNA, 23 nt, Human
caggaugguucccuugaugaaga

SEQ ID NO: 1602346 - RNA, 14 nt, Human
caggcccccaggug

SEQ ID NO: 1602347 - RNA, 19 nt, Human
caggcccccaggugccagu

SEQ ID NO: 1602348 - RNA, 20 nt, Human
caggcccccaggugccaguu

SEQ ID NO: 1602349 - RNA, 12 nt, Human
caggagaguaga

SEQ ID NO: 1602350 - RNA, 15 nt, Human
cagucaggaaagaga

SEQ ID NO: 1602351 - RNA, 18 nt, Human
cagucaggaaagagaacu

SEQ ID NO: 1602352 - RNA, 22 nt, Human
cagucaggaaagagaacuucca

SEQ ID NO: 1602353 - RNA, 13 nt, Human
caguccaugaaga

SEQ ID NO: 1602354 - RNA, 12 nt, Human
caguagugauag

SEQ ID NO: 1602355 - RNA, 12 nt, Human
caguauggcagc

SEQ ID NO: 1602356 - RNA, 17 nt, Human
cagugauuaccagggac

SEQ ID NO: 1602357 - RNA, 18 nt, Human
cagugauuaccagggacu

SEQ ID NO: 1602358 - RNA, 20 nt, Human
cagugaaagaaaauaacaau

SEQ ID NO: 1602359 - RNA, 16 nt, Human
cagugaaagaaaauaa

SEQ ID NO: 1602360 - RNA, 15 nt, Human
cagugagacagcucu

SEQ ID NO: 1602361 - RNA, 12 nt, Human
cagugaauucuu

SEQ ID NO: 1602362 - RNA, 21 nt, Human
caggucauauuaauauauuuc

SEQ ID NO: 1602363 - RNA, 20 nt, Human
caggucauauuaauauauuu

SEQ ID NO: 1602364 - RNA, 19 nt, Human
cagcuacuugggaggcuga

SEQ ID NO: 1602365 - RNA, 16 nt, Human
cagccuaguugaucag

SEQ ID NO: 1602366 - RNA, 20 nt, Human
cagcucugcauacucauuag

SEQ ID NO: 1602367 - RNA, 18 nt, Human
cagcuguaugauucccag

SEQ ID NO: 1602368 - RNA, 20 nt, Human
cagcugcugaaacaacaaau

SEQ ID NO: 1602369 - RNA, 21 nt, Human
cagcugcugaaacaacaaaua

SEQ ID NO: 1602370 - RNA, 19 nt, Human
cagcuguaugauucccagc

SEQ ID NO: 1602371 - RNA, 18 nt, Human
cagcuugaaacugagaug

SEQ ID NO: 1602372 - RNA, 18 nt, Human
caggaaccacaagacugc

SEQ ID NO: 1602373 - RNA, 23 nt, Human
cagcuuuccucaaaacuucagac

SEQ ID NO: 1602374 - RNA, 16 nt, Human
caggaaguagaggagg

SEQ ID NO: 1602375 - RNA, 15 nt, Human
caggaaguagaggag

SEQ ID NO: 1602376 - RNA, 22 nt, Human
cagcaagggugaugggaaagca

SEQ ID NO: 1602377 - RNA, 23 nt, Human
cagcaagggugaugggaaagcau

SEQ ID NO: 1602378 - RNA, 19 nt, Human
cagcaagggugaugggaaa

SEQ ID NO: 1602379 - RNA, 23 nt, Human
cagcaacgcaggcccccaggugc

SEQ ID NO: 1602380 - RNA, 14 nt, Human
cagauuuuccugaa

SEQ ID NO: 1602381 - RNA, 15 nt, Human
cagauuuuccugaaa

SEQ ID NO: 1602382 - RNA, 21 nt, Human
cagauggaaugcuguguuaaa

SEQ ID NO: 1602383 - RNA, 19 nt, Human
cagauggaaugcuguguua

SEQ ID NO: 1602384 - RNA, 17 nt, Human
cagauggaaugcugugu

SEQ ID NO: 1602385 - RNA, 16 nt, Human
cagauggaaugcugug

SEQ ID NO: 1602386 - RNA, 17 nt, Human
cagacauagaauuaaca

SEQ ID NO: 1602387 - RNA, 19 nt, Human
cagacauagaauuaacaca

SEQ ID NO: 1602388 - RNA, 19 nt, Human
cagaagcaacccaaauguu

SEQ ID NO: 1602389 - RNA, 20 nt, Human
cagaagcaacccaaauguuc

SEQ ID NO: 1602390 - RNA, 17 nt, Human
cagaaggaucuucaucu

SEQ ID NO: 1602391 - RNA, 18 nt, Human
cagaaagcagaacaguga

SEQ ID NO: 1602392 - RNA, 19 nt, Human
cagaaagcagaacagugau

SEQ ID NO: 1602393 - RNA, 23 nt, Human
cagaacagugauuaccagggacu

SEQ ID NO: 1602394 - RNA, 19 nt, Human
cagaaaauauuauguguuu

SEQ ID NO: 1602395 - RNA, 14 nt, Human
cagauccuggaaau

SEQ ID NO: 1602396 - RNA, 23 nt, Human
cagauaaauaguuuaugauucca

SEQ ID NO: 1602397 - RNA, 14 nt, Human
cagauaaacaguag

SEQ ID NO: 1602398 - RNA, 14 nt, Human
cagauaaucacaau

SEQ ID NO: 1602399 - RNA, 14 nt, Human
cagauaaucagugu

SEQ ID NO: 1602400 - RNA, 10 nt, Human
caccucccug

SEQ ID NO: 1602401 - RNA, 11 nt, Human
caccucaugga

SEQ ID NO: 1602402 - RNA, 12 nt, Human
caccucauggaa

SEQ ID NO: 1602403 - RNA, 14 nt, Human
caccucauggaauu

SEQ ID NO: 1602404 - RNA, 14 nt, Human
caccucccugcaau

SEQ ID NO: 1602405 - RNA, 13 nt, Human
caccucccugcaa

SEQ ID NO: 1602406 - RNA, 17 nt, Human
cacuaagagagaaugag

SEQ ID NO: 1602407 - RNA, 21 nt, Human
cacuaaauugacacuuaaaaa

SEQ ID NO: 1602408 - RNA, 14 nt, Human
cacuaguauuucua

SEQ ID NO: 1602409 - RNA, 19 nt, Human
cacuaguauuucuaugaaa

SEQ ID NO: 1602410 - RNA, 16 nt, Human
cacucaaaucaagaaa

SEQ ID NO: 1602411 - RNA, 13 nt, Human
cacuaaacaaaga

SEQ ID NO: 1602412 - RNA, 22 nt, Human
cacguucuuacuaguuucccuu

SEQ ID NO: 1602413 - RNA, 17 nt, Human
cacgagcaggcuacugu

SEQ ID NO: 1602414 - RNA, 19 nt, Human
cacgagcaggcuacuguca

SEQ ID NO: 1602415 - RNA, 20 nt, Human
cacgagcaggcuacugucag

SEQ ID NO: 1602416 - RNA, 22 nt, Human
cacgagcaggcuacugucagcu

SEQ ID NO: 1602417 - RNA, 14 nt, Human
cacugucaagauga

SEQ ID NO: 1602418 - RNA, 22 nt, Human
cacuguggguagacacacauga

SEQ ID NO: 1602419 - RNA, 24 nt, Human
cacuguggguagacacacaugaag

SEQ ID NO: 1602420 - RNA, 19 nt, Human
cacuguggguagacacaca

SEQ ID NO: 1602421 - RNA, 15 nt, Human
cacuuggucugugag

SEQ ID NO: 1602422 - RNA, 17 nt, Human
cacuuggucugugagau

SEQ ID NO: 1602423 - RNA, 20 nt, Human
cacuugaacccgggaggcag

SEQ ID NO: 1602424 - RNA, 21 nt, Human
cacuugaacccgggaggcaga

SEQ ID NO: 1602425 - RNA, 23 nt, Human
cacuugaacccgggaggcagagg

SEQ ID NO: 1602426 - RNA, 20 nt, Human
cacugccuucucaacuccaa

SEQ ID NO: 1602427 - RNA, 21 nt, Human
cacugacuucuaaguaaaacc

SEQ ID NO: 1602428 - RNA, 14 nt, Human
cacugacuucuaag

SEQ ID NO: 1602429 - RNA, 15 nt, Human
cacugacuucuaagu

SEQ ID NO: 1602430 - RNA, 16 nt, Human
cacugacuucuaagua

SEQ ID NO: 1602431 - RNA, 20 nt, Human
cacugacuucuaaguaaaac

SEQ ID NO: 1602432 - RNA, 22 nt, Human
cacugacagauuuccauccuag

SEQ ID NO: 1602433 - RNA, 17 nt, Human
cacugacagauuuccau

SEQ ID NO: 1602434 - RNA, 13 nt, Human
cacugacagauuu

SEQ ID NO: 1602435 - RNA, 13 nt, Human
aaaaacacagcaa

SEQ ID NO: 1602436 - RNA, 18 nt, Human
aaaaacacagcaagggug

SEQ ID NO: 1602437 - RNA, 21 nt, Human
agugucuuaauuaaaagaaua

SEQ ID NO: 1602438 - RNA, 17 nt, Human
agugucuuaauuaaaag

SEQ ID NO: 1602439 - RNA, 18 nt, Human
agugucuuaauuaaaaga

SEQ ID NO: 1602440 - RNA, 15 nt, Human
agugucuuaauuaaa

SEQ ID NO: 1602441 - RNA, 23 nt, Human
aguugaaaaucuuauaauuuaaa

SEQ ID NO: 1602442 - RNA, 22 nt, Human
aguugaaaagacuccaaagaaa

SEQ ID NO: 1602443 - RNA, 11 nt, Human
aguucauacau

SEQ ID NO: 1602444 - RNA, 10 nt, Human
aguucauaca

SEQ ID NO: 1602445 - RNA, 22 nt, Human
aguugaaaaucuuauaauuuaa

SEQ ID NO: 1602446 - RNA, 15 nt, Human
aguucauacauugua

SEQ ID NO: 1602447 - RNA, 12 nt, Human
aguccuguaaug

SEQ ID NO: 1602448 - RNA, 23 nt, Human
agucaaauugugugaaagguacu

SEQ ID NO: 1602449 - RNA, 19 nt, Human
agucaaauugugugaaagg

SEQ ID NO: 1602450 - RNA, 16 nt, Human
aguaugaaauuauaua

SEQ ID NO: 1602451 - RNA, 14 nt, Human
aguaugaaauuaua

SEQ ID NO: 1602452 - RNA, 18 nt, Human
auaaaggauuaaugucaa

SEQ ID NO: 1602453 - RNA, 14 nt, Human
auaaaaauauugug

SEQ ID NO: 1602454 - RNA, 22 nt, Human
auaaaaauauuguguugugaau

SEQ ID NO: 1602455 - RNA, 17 nt, Human
auacacacucaaaucaa

SEQ ID NO: 1602456 - RNA, 18 nt, Human
auacacacucaaaucaag

SEQ ID NO: 1602457 - RNA, 20 nt, Human
auacacacucaaaucaagaa

SEQ ID NO: 1602458 - RNA, 23 nt, Human
auaauguuucaaacauauauaac

SEQ ID NO: 1602459 - RNA, 20 nt, Human
auaauuaaauuuugaguucu

SEQ ID NO: 1602460 - RNA, 15 nt, Human
auaucaauuuaaaaa

SEQ ID NO: 1602461 - RNA, 23 nt, Human
auaugcuucuguuuuauaauuuu

SEQ ID NO: 1602462 - RNA, 20 nt, Human
auaugcuucuguuuuauaau

SEQ ID NO: 1602463 - RNA, 22 nt, Human
auaugcuucuguuuuauaauuu

SEQ ID NO: 1602464 - RNA, 13 nt, Human
auauuuauuuuaa

SEQ ID NO: 1602465 - RNA, 13 nt, Human
auauuauguguuu

SEQ ID NO: 1602466 - RNA, 14 nt, Human
auaggugcuacaaa

SEQ ID NO: 1602467 - RNA, 23 nt, Human
auaggugcuacaaaaacacagca

SEQ ID NO: 1602468 - RNA, 15 nt, Human
auaggugcuacaaaa

SEQ ID NO: 1602469 - RNA, 21 nt, Human
auaggugcuacaaaaacacag

SEQ ID NO: 1602470 - RNA, 15 nt, Human
auagguuuaauaauu

SEQ ID NO: 1602471 - RNA, 21 nt, Human
auaguauuugagaguucuaaa

SEQ ID NO: 1602472 - RNA, 20 nt, Human
auaguauuugagaguucuaa

SEQ ID NO: 1602473 - RNA, 14 nt, Human
auagucaaauugug

SEQ ID NO: 1602474 - RNA, 23 nt, Human
auaguauuugagaguucuaaauu

SEQ ID NO: 1602475 - RNA, 17 nt, Human
auauuuauuuuaauaau

SEQ ID NO: 1602476 - RNA, 14 nt, Human
auauuuauuuuaau

SEQ ID NO: 1602477 - RNA, 15 nt, Human
auauuuauuuuaaua

SEQ ID NO: 1602478 - RNA, 21 nt, Human
aucagcugcugaaacaacaaa

SEQ ID NO: 1602479 - RNA, 22 nt, Human
aucagcugcugaaacaacaaau

SEQ ID NO: 1602480 - RNA, 23 nt, Human
aucagcugcugaaacaacaaaua

SEQ ID NO: 1602481 - RNA, 17 nt, Human
augcauagguuuagcag

SEQ ID NO: 1602482 - RNA, 21 nt, Human
augcauagguuuagcaguaua

SEQ ID NO: 1602483 - RNA, 18 nt, Human
augugggcagugauguca

SEQ ID NO: 1602484 - RNA, 17 nt, Human
auguucuaagaagugaa

SEQ ID NO: 1602485 - RNA, 13 nt, Human
auguuucaaacuu

SEQ ID NO: 1602486 - RNA, 12 nt, Human
auguuucaaacu

SEQ ID NO: 1602487 - RNA, 17 nt, Human
auguuucaaacuuugga

SEQ ID NO: 1602488 - RNA, 14 nt, Human
auguuucaaacuuu

SEQ ID NO: 1602489 - RNA, 14 nt, Human
auguaagggaaacu

SEQ ID NO: 1602490 - RNA, 16 nt, Human
auguaagggaaacugc

SEQ ID NO: 1602491 - RNA, 19 nt, Human
auguaagggaaacugccag

SEQ ID NO: 1602492 - RNA, 19 nt, Human
auguauucuagcuaaugua

SEQ ID NO: 1602493 - RNA, 20 nt, Human
auguauucuagcuaauguaa

SEQ ID NO: 1602494 - RNA, 23 nt, Human
aggaugguucccuugaugaagaa

SEQ ID NO: 1602495 - RNA, 22 nt, Human
agcuccccucggagaagagcug

SEQ ID NO: 1602496 - RNA, 20 nt, Human
agguaaaagcaucacaugaa

SEQ ID NO: 1602497 - RNA, 18 nt, Human
aggugcuacaaaaacaca

SEQ ID NO: 1602498 - RNA, 19 nt, Human
aggugcuacaaaaacacag

SEQ ID NO: 1602499 - RNA, 20 nt, Human
aggugcuacaaaaacacagc

SEQ ID NO: 1602500 - RNA, 21 nt, Human
aggugcuacaaaaacacagca

SEQ ID NO: 1602501 - RNA, 22 nt, Human
aggugcuacaaaaacacagcaa

SEQ ID NO: 1602502 - RNA, 23 nt, Human
aggugcuacaaaaacacagcaag

SEQ ID NO: 1602503 - RNA, 24 nt, Human
aggugcuacaaaaacacagcaagg

SEQ ID NO: 1602504 - RNA, 17 nt, Human
aggcuacugucagcucc

SEQ ID NO: 1602505 - RNA, 21 nt, Human
aggcuagaaccaccugccuau

SEQ ID NO: 1602506 - RNA, 15 nt, Human
aggcuagauguaugu

SEQ ID NO: 1602507 - RNA, 16 nt, Human
aggcuagauguaugua

SEQ ID NO: 1602508 - RNA, 17 nt, Human
aggcuagauguauguac

SEQ ID NO: 1602509 - RNA, 17 nt, Human
agagaacuuccagaucc

SEQ ID NO: 1602510 - RNA, 21 nt, Human
agacugcauuauauuuauuac

SEQ ID NO: 1602511 - RNA, 21 nt, Human
agccgggcgugguggugagug

SEQ ID NO: 1602512 - RNA, 16 nt, Human
agcaguugaaaagacu

SEQ ID NO: 1602513 - RNA, 23 nt, Human
agcaguucagagcugcccucucc

SEQ ID NO: 1602514 - RNA, 15 nt, Human
agcaguucagagcug

SEQ ID NO: 1602515 - RNA, 13 nt, Human
agcaguugaaaag

SEQ ID NO: 1602516 - RNA, 16 nt, Human
agcacugacuucuaag

SEQ ID NO: 1602517 - RNA, 18 nt, Human
agcacugacagauuucca

SEQ ID NO: 1602518 - RNA, 14 nt, Human
agcacugacagauu

SEQ ID NO: 1602519 - RNA, 13 nt, Human
agcacugacagau

SEQ ID NO: 1602520 - RNA, 21 nt, Human
aaugauuaugaauuacauuug

SEQ ID NO: 1602521 - RNA, 23 nt, Human
aaugauuaugaauuacauuugua

SEQ ID NO: 1602522 - RNA, 15 nt, Human
aaugauuaugaauua

SEQ ID NO: 1602523 - RNA, 15 nt, Human
aauccaaugaaauga

SEQ ID NO: 1602524 - RNA, 15 nt, Human
aaucaccaaaggcuc

SEQ ID NO: 1602525 - RNA, 17 nt, Human
aauauguuucaaacuuu

SEQ ID NO: 1602526 - RNA, 16 nt, Human
aauauguuucaaacuu

SEQ ID NO: 1602527 - RNA, 15 nt, Human
aauauguuucaaacu

SEQ ID NO: 1602528 - RNA, 13 nt, Human
aauauguuucaaa

SEQ ID NO: 1602529 - RNA, 19 nt, Human
aaugcuagguuaauuccaa

SEQ ID NO: 1602530 - RNA, 18 nt, Human
aaugcuagguuaauucca

SEQ ID NO: 1602531 - RNA, 23 nt, Human
aauguuucaaacauauauaacaa

SEQ ID NO: 1602532 - RNA, 21 nt, Human
aaugcuagguuaauuccaauu

SEQ ID NO: 1602533 - RNA, 21 nt, Human
aaguagggacuucugucuuca

SEQ ID NO: 1602534 - RNA, 18 nt, Human
aaguccaagcauuuagau

SEQ ID NO: 1602535 - RNA, 17 nt, Human
aaguccaagcauaccaa

SEQ ID NO: 1602536 - RNA, 23 nt, Human
aagggaaacugccagcaacgcag

SEQ ID NO: 1602537 - RNA, 16 nt, Human
aagggaaacugccagc

SEQ ID NO: 1602538 - RNA, 17 nt, Human
aagggaaacugccagca

SEQ ID NO: 1602539 - RNA, 20 nt, Human
aaggcagcucuaaaugucaa

SEQ ID NO: 1602540 - RNA, 20 nt, Human
aagcagauggaaugcugugu

SEQ ID NO: 1602541 - RNA, 19 nt, Human
aagcagauggaaugcugug

SEQ ID NO: 1602542 - RNA, 17 nt, Human
aagcagauggaaugcug

SEQ ID NO: 1602543 - RNA, 17 nt, Human
aaccuagggugauauua

SEQ ID NO: 1602544 - RNA, 16 nt, Human
aacacaucagcuugcc

SEQ ID NO: 1602545 - RNA, 18 nt, Human
aacaaauuuacagagaca

SEQ ID NO: 1602546 - RNA, 17 nt, Human
aaaucuuauaauuuaaa

SEQ ID NO: 1602547 - RNA, 22 nt, Human
aaauguuguucucuucuuuaaa

SEQ ID NO: 1602548 - RNA, 22 nt, Human
aaauugacacuuaaaaaugguu

SEQ ID NO: 1602549 - RNA, 19 nt, Human
aaauugacacuuaaaaaug

SEQ ID NO: 1602550 - RNA, 15 nt, Human
aacugacucuuaaga

SEQ ID NO: 1602551 - RNA, 18 nt, Human
aacugacucuuaagaaga

SEQ ID NO: 1602552 - RNA, 19 nt, Human
aacugacucuuaagaagac

SEQ ID NO: 1602553 - RNA, 20 nt, Human
aacugacucuuaagaagacu

SEQ ID NO: 1602554 - RNA, 20 nt, Human
aacugagaugugaacacauc

SEQ ID NO: 1602555 - RNA, 21 nt, Human
aacuuuaugcuaagugaaaua

SEQ ID NO: 1602556 - RNA, 20 nt, Human
aacuuuaugcuaagugaaau

SEQ ID NO: 1602557 - RNA, 23 nt, Human
aacuuuauacccagaaaguuauu

SEQ ID NO: 1602558 - RNA, 22 nt, Human
aacuuuauacccagaaaguuau

SEQ ID NO: 1602559 - RNA, 15 nt, Human
aaauauuuauuuuaa

SEQ ID NO: 1602560 - RNA, 13 nt, Human
aaauauuuauuuu

SEQ ID NO: 1602561 - RNA, 20 nt, Human
aaauauuuauuuuaauaaug

SEQ ID NO: 1602562 - RNA, 12 nt, Human
aaaucaaauaug

SEQ ID NO: 1602563 - RNA, 14 nt, Human
aaaucaaauaugca

SEQ ID NO: 1602564 - RNA, 15 nt, Human
aaaucaaauaugcaa

SEQ ID NO: 1602565 - RNA, 16 nt, Human
aaaucaaauaugcaaa

SEQ ID NO: 1602566 - RNA, 14 nt, Human
aaaggcagaagcaa

SEQ ID NO: 1602567 - RNA, 19 nt, Human
aaaggcagaagcaacccaa

SEQ ID NO: 1602568 - RNA, 21 nt, Human
aaacugagaugugaacacauc

SEQ ID NO: 1602569 - RNA, 23 nt, Human
aaacugagaugugaacacaucag

SEQ ID NO: 1602570 - RNA, 15 nt, Human
aaagaaauguaaggg

SEQ ID NO: 1602571 - RNA, 16 nt, Human
aaaaucucaauauuuc

SEQ ID NO: 1602572 - RNA, 17 nt, Human
aaaaucucaauauuuca

SEQ ID NO: 1602573 - RNA, 21 nt, Human
aaaauugauguguuuauuuau

SEQ ID NO: 1602574 - RNA, 14 nt, Human
aaaauugauguguu

SEQ ID NO: 1602575 - RNA, 12 nt, Human
aaaauugaugug

SEQ ID NO: 1602576 - RNA, 24 nt, Human
aaacacucaguuguucaauaauaa

SEQ ID NO: 1602577 - RNA, 16 nt, Human
aaaaagaaacauuugg

SEQ ID NO: 1602578 - RNA, 18 nt, Human
aaaaguucugcagauaaa

SEQ ID NO: 1602579 - RNA, 21 nt, Human
aaaaucuacacuccagugaga

SEQ ID NO: 1602580 - RNA, 17 nt, Human
aaaaucaguuguacagu

SEQ ID NO: 1602581 - RNA, 21 nt, Human
acccacaagaaaugaaagcag

SEQ ID NO: 1602582 - RNA, 17 nt, Human
acccacaagaaaugaaa

SEQ ID NO: 1602583 - RNA, 21 nt, Human
acagcaguugaaaagacucca

SEQ ID NO: 1602584 - RNA, 22 nt, Human
acagcaguugaaaagacuccaa

SEQ ID NO: 1602585 - RNA, 23 nt, Human
acagcaguugaaaagacuccaaa

SEQ ID NO: 1602586 - RNA, 13 nt, Human
aauuuugugaagc

SEQ ID NO: 1602587 - RNA, 13 nt, Human
acaagaaaugaaa

SEQ ID NO: 1602588 - RNA, 14 nt, Human
acacgagcaggcua

SEQ ID NO: 1602589 - RNA, 19 nt, Human
acacgagcaggcuacuguc

SEQ ID NO: 1602590 - RNA, 21 nt, Human
acacgagcaggcuacugucag

SEQ ID NO: 1602591 - RNA, 11 nt, Human
agaaaguuauu

SEQ ID NO: 1602592 - RNA, 23 nt, Human
agaaaguuauugauaaguucaua

SEQ ID NO: 1602593 - RNA, 16 nt, Human
agaaaaucaggcuggc

SEQ ID NO: 1602594 - RNA, 22 nt, Human
acuuuauuuucuauaauuuaaa

SEQ ID NO: 1602595 - RNA, 22 nt, Human
acuuuauacccagaaaguuauu

SEQ ID NO: 1602596 - RNA, 20 nt, Human
acuuuauacccagaaaguua

SEQ ID NO: 1602597 - RNA, 18 nt, Human
acuuguaaaggaauuuaa

SEQ ID NO: 1602598 - RNA, 22 nt, Human
acuucugucuucacaacagauu

SEQ ID NO: 1602599 - RNA, 12 nt, Human
acuucagacaua

SEQ ID NO: 1602600 - RNA, 21 nt, Human
acuucugucuucacaacagau

SEQ ID NO: 1602601 - RNA, 13 nt, Human
acugccagcaacg

SEQ ID NO: 1602602 - RNA, 20 nt, Human
acucugucucaguccaugaa

SEQ ID NO: 1602603 - RNA, 18 nt, Human
acucugucucaguccaug

SEQ ID NO: 1602604 - RNA, 19 nt, Human
acuguaagaaaauaucacu

SEQ ID NO: 1602605 - RNA, 13 nt, Human
acuguaagaaaau

SEQ ID NO: 1602606 - RNA, 22 nt, Human
acuguaagaaaauaucacuugu

SEQ ID NO: 1602607 - RNA, 22 nt, Human
acugugaaguuuacauuguaaa

SEQ ID NO: 1602608 - RNA, 22 nt, Human
acgcaggcccccaggugccagu

SEQ ID NO: 1602609 - RNA, 13 nt, Human
acuaagagagaau

SEQ ID NO: 1602610 - RNA, 15 nt, Human
acuaagagagaauga

SEQ ID NO: 1602611 - RNA, 17 nt, Human
acucuauguucuaagaa

SEQ ID NO: 1602612 - RNA, 20 nt, Human
acuaguauuucuaugaaaua

SEQ ID NO: 1602613 - RNA, 21 nt, Human
acuauucaaacagucucagga

SEQ ID NO: 1602614 - RNA, 22 nt, Human
acuauucaggagaguagaacag

SEQ ID NO: 1602615 - RNA, 13 nt, Human
ggagaaacuggaa

SEQ ID NO: 1602616 - RNA, 22 nt, Human
ggacucauuuuaaaaaauggaa

SEQ ID NO: 1602617 - RNA, 15 nt, Human
gccucuuagaugcag

SEQ ID NO: 1602618 - RNA, 12 nt, Human
gccuccauccug

SEQ ID NO: 1602619 - RNA, 21 nt, Human
gccuucggccuccauccugag

SEQ ID NO: 1602620 - RNA, 23 nt, Human
gccuucggccuccauccugaggc

SEQ ID NO: 1602621 - RNA, 20 nt, Human
gccuucggccuccauccuga

SEQ ID NO: 1602622 - RNA, 15 nt, Human
gcuccacuuggucug

SEQ ID NO: 1602623 - RNA, 18 nt, Human
gcuccacuuggucuguga

SEQ ID NO: 1602624 - RNA, 19 nt, Human
gcuccacuuggucugugag

SEQ ID NO: 1602625 - RNA, 21 nt, Human
gcuccccucggagaagagcug

SEQ ID NO: 1602626 - RNA, 16 nt, Human
gcuagaacucccuuuc

SEQ ID NO: 1602627 - RNA, 18 nt, Human
gcuagaacucccuuucaa

SEQ ID NO: 1602628 - RNA, 12 nt, Human
gcuagaacuccc

SEQ ID NO: 1602629 - RNA, 13 nt, Human
gcuagaacucccu

SEQ ID NO: 1602630 - RNA, 14 nt, Human
gcuagaacucccuu

SEQ ID NO: 1602631 - RNA, 15 nt, Human
gcuagaacucccuuu

SEQ ID NO: 1602632 - RNA, 21 nt, Human
ggcacaguuuucugagaaaga

SEQ ID NO: 1602633 - RNA, 14 nt, Human
ggccuccauccuga

SEQ ID NO: 1602634 - RNA, 15 nt, Human
ggccuccauccugag

SEQ ID NO: 1602635 - RNA, 16 nt, Human
ggccuccauccugagg

SEQ ID NO: 1602636 - RNA, 14 nt, Human
ggcuccacuugguc

SEQ ID NO: 1602637 - RNA, 20 nt, Human
gggacagucaccucauggaa

SEQ ID NO: 1602638 - RNA, 21 nt, Human
gggacagucaccucauggaau

SEQ ID NO: 1602639 - RNA, 22 nt, Human
gggacagucaccucauggaauu

SEQ ID NO: 1602640 - RNA, 20 nt, Human
gggaacccaaguccaagcau

SEQ ID NO: 1602641 - RNA, 14 nt, Human
aaaaauaacaauga

SEQ ID NO: 1602642 - RNA, 19 nt, Human
gggacauuugcucauggaa

SEQ ID NO: 1602643 - RNA, 17 nt, Human
aaaaaugguuuaaaugg

SEQ ID NO: 1602644 - RNA, 15 nt, Human
aaaacuucagacaua

SEQ ID NO: 1602645 - RNA, 21 nt, Human
aaaagauuuucagaaaauauu

SEQ ID NO: 1602646 - RNA, 19 nt, Human
aaaucauuucugcaucagc

SEQ ID NO: 1602647 - RNA, 21 nt, Human
aaaucauuucugcaucagcug

SEQ ID NO: 1602648 - RNA, 22 nt, Human
aaaucauuucugcaucagcugc

SEQ ID NO: 1602649 - RNA, 23 nt, Human
aaaucauuucugcaucagcugcu

SEQ ID NO: 1602650 - RNA, 12 nt, Human
aaaucauuucug

SEQ ID NO: 1602651 - RNA, 17 nt, Human
aaauauuauguuaaaac

SEQ ID NO: 1602652 - RNA, 14 nt, Human
aaauauuauguguu

SEQ ID NO: 1602653 - RNA, 15 nt, Human
aaauauuauguguuu

SEQ ID NO: 1602654 - RNA, 15 nt, Human
aaauccauacauuug

SEQ ID NO: 1602655 - RNA, 18 nt, Human
aaauccauacauuugugu

SEQ ID NO: 1602656 - RNA, 15 nt, Human
guacauuuggagaca

SEQ ID NO: 1602657 - RNA, 21 nt, Human
guacuucaaauccuugaagau

SEQ ID NO: 1602658 - RNA, 22 nt, Human
guacuucaaauccuugaagauu

SEQ ID NO: 1602659 - RNA, 15 nt, Human
guacuucaugcuguc

SEQ ID NO: 1602660 - RNA, 14 nt, Human
guacuuaacuauuc

SEQ ID NO: 1602661 - RNA, 18 nt, Human
aaaguauguuagugcaaa

SEQ ID NO: 1602662 - RNA, 20 nt, Human
aaagguauuuuaaucaccaa

SEQ ID NO: 1602663 - RNA, 23 nt, Human
aaaguucugcagauaaacaguag

SEQ ID NO: 1602664 - RNA, 20 nt, Human
aaaguuauugauaaguucau

SEQ ID NO: 1602665 - RNA, 14 nt, Human
aaauaaaaauauug

SEQ ID NO: 1602666 - RNA, 19 nt, Human
aaauacacacucaaaucaa

SEQ ID NO: 1602667 - RNA, 22 nt, Human
aaauaauuuuuauauuugaaau

SEQ ID NO: 1602668 - RNA, 23 nt, Human
aaauaauuuuuauauuugaaaua

SEQ ID NO: 1602669 - RNA, 15 nt, Human
aaauacacacucaaa

SEQ ID NO: 1602670 - RNA, 23 nt, Human
guacacugccuucucaacuccaa

SEQ ID NO: 1602671 - RNA, 21 nt, Human
aaauaauuuuuauauuugaaa

SEQ ID NO: 1602672 - RNA, 20 nt, Human
guaauaggcguaacuaauuu

SEQ ID NO: 1602673 - RNA, 22 nt, Human
guaauaacugugaaguuuacau

SEQ ID NO: 1602674 - RNA, 16 nt, Human
guaauaacugugaagu

SEQ ID NO: 1602675 - RNA, 15 nt, Human
guaauaacugugaag

SEQ ID NO: 1602676 - RNA, 12 nt, Human
aaaccacagcag

SEQ ID NO: 1602677 - RNA, 15 nt, Human
aaacucguuaauuug

SEQ ID NO: 1602678 - RNA, 11 nt, Human
aaacacagcaa

SEQ ID NO: 1602679 - RNA, 12 nt, Human
aaacacagcaag

SEQ ID NO: 1602680 - RNA, 14 nt, Human
aaacacagcaaggg

SEQ ID NO: 1602681 - RNA, 19 nt, Human
ggggaauugaggacacuga

SEQ ID NO: 1602682 - RNA, 14 nt, Human
aaacaguagugaua

SEQ ID NO: 1602683 - RNA, 15 nt, Human
aaacagucucaggaa

SEQ ID NO: 1602684 - RNA, 15 nt, Human
aaagaggaaugaagu

SEQ ID NO: 1602685 - RNA, 15 nt, Human
aaagaggcagcuuga

SEQ ID NO: 1602686 - RNA, 23 nt, Human
aaacuucagcgguuuauauaagc

SEQ ID NO: 1602687 - RNA, 13 nt, Human
aaagacagugaaa

SEQ ID NO: 1602688 - RNA, 21 nt, Human
aaagacuauucaaacagucuc

SEQ ID NO: 1602689 - RNA, 15 nt, Human
aaagacuccaaagaa

SEQ ID NO: 1602690 - RNA, 21 nt, Human
aaagacuccaaagaaauguaa

SEQ ID NO: 1602691 - RNA, 18 nt, Human
aaagacuauucaaacagu

SEQ ID NO: 1602692 - RNA, 19 nt, Human
aaagacuauucaaacaguc

SEQ ID NO: 1602693 - RNA, 22 nt, Human
aaagaccuuuggagcaaagcug

SEQ ID NO: 1602694 - RNA, 17 nt, Human
aaagcacugacuucuaa

SEQ ID NO: 1602695 - RNA, 21 nt, Human
aaagcacugacuucuaaguaa

SEQ ID NO: 1602696 - RNA, 20 nt, Human
aaagggauggcaagaugugg

SEQ ID NO: 1602697 - RNA, 14 nt, Human
aaagguacuucaaa

SEQ ID NO: 1602698 - RNA, 17 nt, Human
aaagggugaaaauuauu

SEQ ID NO: 1602699 - RNA, 13 nt, Human
ggugaaaauuauu

SEQ ID NO: 1602700 - RNA, 22 nt, Human
ggugaaaauuauuuuguucaua

SEQ ID NO: 1602701 - RNA, 14 nt, Human
ggugaaaauuauuu

SEQ ID NO: 1602702 - RNA, 22 nt, Human
gacuauucaaacagucucagga

SEQ ID NO: 1602703 - RNA, 15 nt, Human
gacuauucaaacagu

SEQ ID NO: 1602704 - RNA, 16 nt, Human
gacuauucaaacaguc

SEQ ID NO: 1602705 - RNA, 21 nt, Human
gacagcccuucuuuccacaga

SEQ ID NO: 1602706 - RNA, 20 nt, Human
gacagaaagcagaacaguga

SEQ ID NO: 1602707 - RNA, 14 nt, Human
gacagaaagcagaa

SEQ ID NO: 1602708 - RNA, 20 nt, Human
gacaguauggcagcuuuccu

SEQ ID NO: 1602709 - RNA, 17 nt, Human
gagcuguucacagccag

SEQ ID NO: 1602710 - RNA, 15 nt, Human
gagcgacagugagac

SEQ ID NO: 1602711 - RNA, 18 nt, Human
gcaauagucaaauugugu

SEQ ID NO: 1602712 - RNA, 16 nt, Human
gcaauaaaauggguuu

SEQ ID NO: 1602713 - RNA, 17 nt, Human
gauguagaggagaaacu

SEQ ID NO: 1602714 - RNA, 15 nt, Human
gcagcuuauucacaa

SEQ ID NO: 1602715 - RNA, 16 nt, Human
gcauuguaaaugugcu

SEQ ID NO: 1602716 - RNA, 18 nt, Human
gcauggcauauuuuucac

SEQ ID NO: 1602717 - RNA, 20 nt, Human
cuucucacauuuauauuuuu

SEQ ID NO: 1602718 - RNA, 13 nt, Human
cuucucacauuua

SEQ ID NO: 1602719 - RNA, 13 nt, Human
cuucuaaguaaaa

SEQ ID NO: 1602720 - RNA, 17 nt, Human
cuucuaaguaaaaccac

SEQ ID NO: 1602721 - RNA, 21 nt, Human
cuucuaaguaaaaccacagca

SEQ ID NO: 1602722 - RNA, 19 nt, Human
cuuggucugugagaugcua

SEQ ID NO: 1602723 - RNA, 16 nt, Human
cuuggucugugagaug

SEQ ID NO: 1602724 - RNA, 16 nt, Human
gaacccaaguccaagc

SEQ ID NO: 1602725 - RNA, 17 nt, Human
gaacccaaguccaagca

SEQ ID NO: 1602726 - RNA, 13 nt, Human
gaacugaaaucau

SEQ ID NO: 1602727 - RNA, 17 nt, Human
gaacccgggaggcagag

SEQ ID NO: 1602728 - RNA, 19 nt, Human
gaacccgggaggcagaggu

SEQ ID NO: 1602729 - RNA, 23 nt, Human
gaaaauuauuuuguucauacaua

SEQ ID NO: 1602730 - RNA, 21 nt, Human
gaaaacuuuaugcuaagugaa

SEQ ID NO: 1602731 - RNA, 14 nt, Human
gaaaagacuccaaa

SEQ ID NO: 1602732 - RNA, 18 nt, Human
gaaaagacuccaaagaaa

SEQ ID NO: 1602733 - RNA, 16 nt, Human
gaaaagacuccaaaga

SEQ ID NO: 1602734 - RNA, 17 nt, Human
gaaaagacuccaaagaa

SEQ ID NO: 1602735 - RNA, 22 nt, Human
gaaaauuauuuuguucauacau

SEQ ID NO: 1602736 - RNA, 21 nt, Human
gaaaauuauuuuguucauaca

SEQ ID NO: 1602737 - RNA, 20 nt, Human
gaaaauuauuuuguucauac

SEQ ID NO: 1602738 - RNA, 17 nt, Human
gaaaugaaagcagggac

SEQ ID NO: 1602739 - RNA, 18 nt, Human
gaaagaaaaucaggcugg

SEQ ID NO: 1602740 - RNA, 12 nt, Human
cuguucacagcc

SEQ ID NO: 1602741 - RNA, 13 nt, Human
cuguuauaaucuu

SEQ ID NO: 1602742 - RNA, 19 nt, Human
cuguuauaaucuuucacag

SEQ ID NO: 1602743 - RNA, 19 nt, Human
cucucuggccuucggccuc

SEQ ID NO: 1602744 - RNA, 22 nt, Human
cucucuggccuucggccuccau

SEQ ID NO: 1602745 - RNA, 17 nt, Human
cucucuggccuucggcc

SEQ ID NO: 1602746 - RNA, 19 nt, Human
cuccccaugauguuuagaa

SEQ ID NO: 1602747 - RNA, 13 nt, Human
cugaaagaggaau

SEQ ID NO: 1602748 - RNA, 17 nt, Human
cugaaagaggaaugaag

SEQ ID NO: 1602749 - RNA, 15 nt, Human
cgguuuauauaagcu

SEQ ID NO: 1602750 - RNA, 23 nt, Human
cggagaagagcuguucacagcca

SEQ ID NO: 1602751 - RNA, 24 nt, Human
cggagaagagcuguucacagccag

SEQ ID NO: 1602752 - RNA, 14 nt, Human
cuaacuggacuggu

SEQ ID NO: 1602753 - RNA, 17 nt, Human
cucaaaacugcacuguc

SEQ ID NO: 1602754 - RNA, 13 nt, Human
cucaaaacugcac

SEQ ID NO: 1602755 - RNA, 23 nt, Human
cuaugucauuugcuggagcucug

SEQ ID NO: 1602756 - RNA, 19 nt, Human
cucagaaaacaaggaugaa

SEQ ID NO: 1602757 - RNA, 23 nt, Human
cucagaaaacaaggaugaauuaa

SEQ ID NO: 1602758 - RNA, 12 nt, Human
cucagaauauug

SEQ ID NO: 1602759 - RNA, 13 nt, Human
cccaacuccagaa

SEQ ID NO: 1602760 - RNA, 13 nt, Human
ccaucccucccuc

SEQ ID NO: 1602761 - RNA, 15 nt, Human
ccaucccucccucca

SEQ ID NO: 1602762 - RNA, 14 nt, Human
ccaucccucccucc

SEQ ID NO: 1602763 - RNA, 22 nt, Human
cccuccucugcuugccaucccu

SEQ ID NO: 1602764 - RNA, 13 nt, Human
cccuccucugcuu

SEQ ID NO: 1602765 - RNA, 13 nt, Human
ccccugcacucca

SEQ ID NO: 1602766 - RNA, 12 nt, Human
ccucggagaaga

SEQ ID NO: 1602767 - RNA, 14 nt, Human
ccucggagaagagc

SEQ ID NO: 1602768 - RNA, 16 nt, Human
ccucccuucucuucac

SEQ ID NO: 1602769 - RNA, 17 nt, Human
ccugucucuacuaaaaa

SEQ ID NO: 1602770 - RNA, 15 nt, Human
caauaaaauggguuu

SEQ ID NO: 1602771 - RNA, 20 nt, Human
caauaaaauccauacauuug

SEQ ID NO: 1602772 - RNA, 23 nt, Human
caauaaaauccauacauuugugu

SEQ ID NO: 1602773 - RNA, 23 nt, Human
cacuccagccugagcgacaguga

SEQ ID NO: 1602774 - RNA, 13 nt, Human
cacuccagccuga

SEQ ID NO: 1602775 - RNA, 12 nt, Human
cacuccagccug

SEQ ID NO: 1602776 - RNA, 11 nt, Human
cagaacaguga

SEQ ID NO: 1602777 - RNA, 12 nt, Human
cagaacagugau

SEQ ID NO: 1602778 - RNA, 17 nt, Human
cagaacagugauuacca

SEQ ID NO: 1602779 - RNA, 18 nt, Human
cagaacagugauuaccag

SEQ ID NO: 1602780 - RNA, 16 nt, Human
cagaaaguuauugaua

SEQ ID NO: 1602781 - RNA, 11 nt, Human
cagaaaguuau

SEQ ID NO: 1602782 - RNA, 17 nt, Human
cacuuguguuuugcaag

SEQ ID NO: 1602783 - RNA, 15 nt, Human
cacuuaaaaaugguu

SEQ ID NO: 1602784 - RNA, 22 nt, Human
cacuguuuugaaucucauaauu

SEQ ID NO: 1602785 - RNA, 15 nt, Human
auuuuuauauuugaa

SEQ ID NO: 1602786 - RNA, 16 nt, Human
auuuuuauauuugaaa

SEQ ID NO: 1602787 - RNA, 21 nt, Human
caaaaggauaaugaauacuuu

SEQ ID NO: 1602788 - RNA, 17 nt, Human
caaacauauauaacaau

SEQ ID NO: 1602789 - RNA, 16 nt, Human
caaacagucucaggaa

SEQ ID NO: 1602790 - RNA, 17 nt, Human
caaacagucucaggaaa

SEQ ID NO: 1602791 - RNA, 15 nt, Human
caaaccaaauaaaaa

SEQ ID NO: 1602792 - RNA, 14 nt, Human
caaaccaaauaaaa

SEQ ID NO: 1602793 - RNA, 21 nt, Human
auuuuauaucaauuuaaaaaa

SEQ ID NO: 1602794 - RNA, 12 nt, Human
auuuuauaucuu

SEQ ID NO: 1602795 - RNA, 16 nt, Human
auuuuauaucuuguag

SEQ ID NO: 1602796 - RNA, 14 nt, Human
auuuuauaucuugu

SEQ ID NO: 1602797 - RNA, 21 nt, Human
caaaucuuaacuugaaggagu

SEQ ID NO: 1602798 - RNA, 18 nt, Human
caaagggugaaaauuauu

SEQ ID NO: 1602799 - RNA, 19 nt, Human
caagacccaaaaggcagaa

SEQ ID NO: 1602800 - RNA, 16 nt, Human
caagaugguucuagca

SEQ ID NO: 1602801 - RNA, 13 nt, Human
caagaugguucua

SEQ ID NO: 1602802 - RNA, 19 nt, Human
auuaugaauuacauuugua

SEQ ID NO: 1602803 - RNA, 20 nt, Human
auuaugaauuacauuuguau

SEQ ID NO: 1602804 - RNA, 22 nt, Human
auuaugaauuacauuuguauaa

SEQ ID NO: 1602805 - RNA, 16 nt, Human
auuuaauaaaugugcc

SEQ ID NO: 1602806 - RNA, 20 nt, Human
auuucauaccuaucaucuua

SEQ ID NO: 1602807 - RNA, 14 nt, Human
auuucuaugaaaua

SEQ ID NO: 1602808 - RNA, 16 nt, Human
auuucauaugcuguau

SEQ ID NO: 1602809 - RNA, 15 nt, Human
auuguuuaaaaucau

SEQ ID NO: 1602810 - RNA, 17 nt, Human
auuguguugugaauguu

SEQ ID NO: 1602811 - RNA, 14 nt, Human
auuguguugugaau

SEQ ID NO: 1602812 - RNA, 22 nt, Human
cagcugccuccccuccucugcu

SEQ ID NO: 1602813 - RNA, 21 nt, Human
cagcugccuccccuccucugc

SEQ ID NO: 1602814 - RNA, 24 nt, Human
cagcugccuccccuccucugcuug

SEQ ID NO: 1602815 - RNA, 23 nt, Human
cagcugccuccccuccucugcuu

SEQ ID NO: 1602816 - RNA, 16 nt, Human
cagcuccccucggaga

SEQ ID NO: 1602817 - RNA, 17 nt, Human
cagcuccccucggagaa

SEQ ID NO: 1602818 - RNA, 18 nt, Human
cagcuccccucggagaag

SEQ ID NO: 1602819 - RNA, 20 nt, Human
cagcuccccucggagaagag

SEQ ID NO: 1602820 - RNA, 23 nt, Human
caggaaaucaaauaugcaaagca

SEQ ID NO: 1602821 - RNA, 15 nt, Human
cagcccuucuuucca

SEQ ID NO: 1602822 - RNA, 19 nt, Human
cagcccuucuuuccacaga

SEQ ID NO: 1602823 - RNA, 20 nt, Human
cagcccuucuuuccacagaa

SEQ ID NO: 1602824 - RNA, 18 nt, Human
cagccugagcgacaguga

SEQ ID NO: 1602825 - RNA, 19 nt, Human
cagccugagcgacagugag

SEQ ID NO: 1602826 - RNA, 22 nt, Human
cagccugagcgacagugagacu

SEQ ID NO: 1602827 - RNA, 22 nt, Human
cagcacagccucuuagaugcag

SEQ ID NO: 1602828 - RNA, 14 nt, Human
cagccagcaguuca

SEQ ID NO: 1602829 - RNA, 21 nt, Human
cagccagcaguucagagcugc

SEQ ID NO: 1602830 - RNA, 15 nt, Human
cagccagcaguucag

SEQ ID NO: 1602831 - RNA, 22 nt, Human
cagccagcaguucagagcugcc

SEQ ID NO: 1602832 - RNA, 22 nt, Human
cagcaguugaaaagacuccaaa

SEQ ID NO: 1602833 - RNA, 17 nt, Human
cagcaguugaaaagacu

SEQ ID NO: 1602834 - RNA, 20 nt, Human
cagcaguugaaaagacucca

SEQ ID NO: 1602835 - RNA, 21 nt, Human
cagcaguugaaaagacuccaa

SEQ ID NO: 1602836 - RNA, 15 nt, Human
cagagcugcccucuc

SEQ ID NO: 1602837 - RNA, 13 nt, Human
cagagcugcccuc

SEQ ID NO: 1602838 - RNA, 17 nt, Human
cagagcugcccucuccu

SEQ ID NO: 1602839 - RNA, 19 nt, Human
cagggaggacgcucucugg

SEQ ID NO: 1602840 - RNA, 17 nt, Human
cagggaggacgcucucu

SEQ ID NO: 1602841 - RNA, 18 nt, Human
cagggaggacgcucucug

SEQ ID NO: 1602842 - RNA, 15 nt, Human
cagucucaggaaauc

SEQ ID NO: 1602843 - RNA, 15 nt, Human
cagucaccucaugga

SEQ ID NO: 1602844 - RNA, 12 nt, Human
cauuaucucaaa

SEQ ID NO: 1602845 - RNA, 13 nt, Human
cauuaucucaaaa

SEQ ID NO: 1602846 - RNA, 20 nt, Human
cauaauuuauacaggucaua

SEQ ID NO: 1602847 - RNA, 13 nt, Human
cauaauuuauaca

SEQ ID NO: 1602848 - RNA, 16 nt, Human
ccacagaagcuccagg

SEQ ID NO: 1602849 - RNA, 18 nt, Human
ccaccagucugacuguuu

SEQ ID NO: 1602850 - RNA, 18 nt, Human
ccacagaagcuccaggua

SEQ ID NO: 1602851 - RNA, 19 nt, Human
cauuguaaauaguauuuga

SEQ ID NO: 1602852 - RNA, 21 nt, Human
cauuuggagacacaacuauuu

SEQ ID NO: 1602853 - RNA, 22 nt, Human
auuuguaguguuggagaagaac

SEQ ID NO: 1602854 - RNA, 14 nt, Human
auuuguauaaaaua

SEQ ID NO: 1602855 - RNA, 15 nt, Human
auuuguauaaaauaa

SEQ ID NO: 1602856 - RNA, 23 nt, Human
auuuuaaaagaaugauuaugaau

SEQ ID NO: 1602857 - RNA, 16 nt, Human
auuuuaaaagaaugau

SEQ ID NO: 1602858 - RNA, 20 nt, Human
auuucuugagguaaaagcau

SEQ ID NO: 1602859 - RNA, 14 nt, Human
auuuauuuuaauaa

SEQ ID NO: 1602860 - RNA, 13 nt, Human
auugucuagugaa

SEQ ID NO: 1602861 - RNA, 16 nt, Human
auuguacgaagaguau

SEQ ID NO: 1602862 - RNA, 19 nt, Human
auuggacaguaaaauccac

SEQ ID NO: 1602863 - RNA, 19 nt, Human
auuggagcucgugggacag

SEQ ID NO: 1602864 - RNA, 13 nt, Human
auugacuuuuuau

SEQ ID NO: 1602865 - RNA, 18 nt, Human
auugacuuuuuauggcac

SEQ ID NO: 1602866 - RNA, 14 nt, Human
auugcuuuggucau

SEQ ID NO: 1602867 - RNA, 18 nt, Human
auugcuuuggucauauga

SEQ ID NO: 1602868 - RNA, 12 nt, Human
auuuuaauaaug

SEQ ID NO: 1602869 - RNA, 15 nt, Human
auuuucuauaauuua

SEQ ID NO: 1602870 - RNA, 14 nt, Human
auuuucuauaauuu

SEQ ID NO: 1602871 - RNA, 14 nt, Human
auuuuccugaaaac

SEQ ID NO: 1602872 - RNA, 18 nt, Human
auuuuguucauacauauu

SEQ ID NO: 1602873 - RNA, 16 nt, Human
auuuuguucauacaua

SEQ ID NO: 1602874 - RNA, 15 nt, Human
auuuuguucauacau

SEQ ID NO: 1602875 - RNA, 14 nt, Human
auuuuguucauaca

SEQ ID NO: 1602876 - RNA, 12 nt, Human
auuuuguucaua

SEQ ID NO: 1602877 - RNA, 21 nt, Human
auuuuucacauaucuaguaug

SEQ ID NO: 1602878 - RNA, 18 nt, Human
auuuuucacauaucuagu

SEQ ID NO: 1602879 - RNA, 15 nt, Human
auuuuucacauaucu

SEQ ID NO: 1602880 - RNA, 15 nt, Human
auuuuuccaaaauaa

SEQ ID NO: 1602881 - RNA, 15 nt, Human
auuuuucuuauuuca

SEQ ID NO: 1602882 - RNA, 19 nt, Human
auuuuucuuauuucauuuc

SEQ ID NO: 1602883 - RNA, 20 nt, Human
auuuuucuuauuucauuucu

SEQ ID NO: 1602884 - RNA, 15 nt, Human
auuuuugacagaaua

SEQ ID NO: 1602885 - RNA, 14 nt, Human
auuuuugacagaau

SEQ ID NO: 1602886 - RNA, 13 nt, Human
auuuuugacagaa

SEQ ID NO: 1602887 - RNA, 12 nt, Human
auuuuugacaga

SEQ ID NO: 1602888 - RNA, 22 nt, Human
auuuuugacagaauauguuuca

SEQ ID NO: 1602889 - RNA, 20 nt, Human
auuuuuucucuaggaaauau

SEQ ID NO: 1602890 - RNA, 23 nt, Human
auuuuuucucuaggaaauauuua

SEQ ID NO: 1602891 - RNA, 18 nt, Human
auuuuuuguuaaaugauu

SEQ ID NO: 1602892 - RNA, 21 nt, Human
auuuuuguuuucauuaucuca

SEQ ID NO: 1602893 - RNA, 22 nt, Human
auuuuugugauuuugugauuga

SEQ ID NO: 1602894 - RNA, 20 nt, Human
auuuuuguagcacugacaga

SEQ ID NO: 1602895 - RNA, 21 nt, Human
auuuuuguagcacugacagau

SEQ ID NO: 1602896 - RNA, 15 nt, Human
auugacacuuaaaaa

SEQ ID NO: 1602897 - RNA, 17 nt, Human
auugacacuuaaaaaug

SEQ ID NO: 1602898 - RNA, 19 nt, Human
auugacacuuaaaaauggu

SEQ ID NO: 1602899 - RNA, 18 nt, Human
auucuagcuaauguaaua

SEQ ID NO: 1602900 - RNA, 15 nt, Human
auucuagcuaaugua

SEQ ID NO: 1602901 - RNA, 15 nt, Human
auuauauuuacaaau

SEQ ID NO: 1602902 - RNA, 15 nt, Human
auuauauuuauuacu

SEQ ID NO: 1602903 - RNA, 18 nt, Human
auuauauuuauuacugua

SEQ ID NO: 1602904 - RNA, 21 nt, Human
auuauguuaaaacugggacag

SEQ ID NO: 1602905 - RNA, 16 nt, Human
auuauuuuguucauac

SEQ ID NO: 1602906 - RNA, 15 nt, Human
auuauuuuguucaua

SEQ ID NO: 1602907 - RNA, 19 nt, Human
auucaaacagucucaggaa

SEQ ID NO: 1602908 - RNA, 20 nt, Human
auucaaacagucucaggaaa

SEQ ID NO: 1602909 - RNA, 18 nt, Human
auucaaacagucucagga

SEQ ID NO: 1602910 - RNA, 21 nt, Human
auuauuuuguucauacauauu

SEQ ID NO: 1602911 - RNA, 19 nt, Human
auuauuuuguucauacaua

SEQ ID NO: 1602912 - RNA, 18 nt, Human
auuauuuuguucauacau

SEQ ID NO: 1602913 - RNA, 17 nt, Human
auuauuuuguucauaca

SEQ ID NO: 1602914 - RNA, 24 nt, Human
auucagaaggaucuucaucugacu

SEQ ID NO: 1602915 - RNA, 18 nt, Human
auucagaaggaucuucau

SEQ ID NO: 1602916 - RNA, 17 nt, Human
uuucucccagucauuua

SEQ ID NO: 1602917 - RNA, 18 nt, Human
uuucucccagucauuuaa

SEQ ID NO: 1602918 - RNA, 21 nt, Human
augguucccuugaugaagaag

SEQ ID NO: 1602919 - RNA, 17 nt, Human
auguccacugguucuuc

SEQ ID NO: 1602920 - RNA, 19 nt, Human
uuuguaguguuggagaaga

SEQ ID NO: 1602921 - RNA, 21 nt, Human
uuuguaguguuggagaagaac

SEQ ID NO: 1602922 - RNA, 17 nt, Human
uuugugaagcaaaauuu

SEQ ID NO: 1602923 - RNA, 14 nt, Human
uuugcaagccagau

SEQ ID NO: 1602924 - RNA, 16 nt, Human
auguacuucaugcugu

SEQ ID NO: 1602925 - RNA, 17 nt, Human
auguagaggagaaacug

SEQ ID NO: 1602926 - RNA, 19 nt, Human
auguagaggagaaacugga

SEQ ID NO: 1602927 - RNA, 12 nt, Human
auguagaggaga

SEQ ID NO: 1602928 - RNA, 13 nt, Human
auguagaggagaa

SEQ ID NO: 1602929 - RNA, 22 nt, Human
uuugacagaauauguuucaaac

SEQ ID NO: 1602930 - RNA, 18 nt, Human
uuuaaauauaugcuaagu

SEQ ID NO: 1602931 - RNA, 13 nt, Human
augcaguucugaa

SEQ ID NO: 1602932 - RNA, 17 nt, Human
augccauuuaaagcuua

SEQ ID NO: 1602933 - RNA, 21 nt, Human
augccauuuaaagcuuauuaa

SEQ ID NO: 1602934 - RNA, 14 nt, Human
augauuaaguaaug

SEQ ID NO: 1602935 - RNA, 18 nt, Human
augauuaaguaaugauaa

SEQ ID NO: 1602936 - RNA, 15 nt, Human
augauaacuggaaac

SEQ ID NO: 1602937 - RNA, 17 nt, Human
augauaaguaaaugcua

SEQ ID NO: 1602938 - RNA, 19 nt, Human
auggcuaagcaaaauguga

SEQ ID NO: 1602939 - RNA, 14 nt, Human
auggcacuaguauu

SEQ ID NO: 1602940 - RNA, 16 nt, Human
auggcacuaguauuuc

SEQ ID NO: 1602941 - RNA, 23 nt, Human
auggcauauuuuucacauaucua

SEQ ID NO: 1602942 - RNA, 22 nt, Human
auggcauauuuuucacauaucu

SEQ ID NO: 1602943 - RNA, 21 nt, Human
auggcauauuuuucacauauc

SEQ ID NO: 1602944 - RNA, 20 nt, Human
auggcauauuuuucacauau

SEQ ID NO: 1602945 - RNA, 18 nt, Human
auggcauauuuuucacau

SEQ ID NO: 1602946 - RNA, 14 nt, Human
uuucaaacuuugga

SEQ ID NO: 1602947 - RNA, 16 nt, Human
uuucaaacauauauaa

SEQ ID NO: 1602948 - RNA, 17 nt, Human
uuucaaacauauauaac

SEQ ID NO: 1602949 - RNA, 20 nt, Human
augcuagaacucccuuucaa

SEQ ID NO: 1602950 - RNA, 21 nt, Human
augcuagaacucccuuucaac

SEQ ID NO: 1602951 - RNA, 22 nt, Human
augcuagaacucccuuucaaca

SEQ ID NO: 1602952 - RNA, 18 nt, Human
augcuagguuaauuccaa

SEQ ID NO: 1602953 - RNA, 13 nt, Human
augcuaagugaaa

SEQ ID NO: 1602954 - RNA, 21 nt, Human
uuuaucaaagggugaaaauua

SEQ ID NO: 1602955 - RNA, 12 nt, Human
uucucuaggaaa

SEQ ID NO: 1602956 - RNA, 17 nt, Human
uugaaauuguauuacaa

SEQ ID NO: 1602957 - RNA, 19 nt, Human
uugaacccgggaggcagag

SEQ ID NO: 1602958 - RNA, 19 nt, Human
uuccguagguuauuuucag

SEQ ID NO: 1602959 - RNA, 14 nt, Human
aucaacagauaaau

SEQ ID NO: 1602960 - RNA, 20 nt, Human
auauuuuuuguuaaaugauu

SEQ ID NO: 1602961 - RNA, 18 nt, Human
auauuuuuuguuaaauga

SEQ ID NO: 1602962 - RNA, 17 nt, Human
auauuuuucacauaucu

SEQ ID NO: 1602963 - RNA, 15 nt, Human
auauuuuucacauau

SEQ ID NO: 1602964 - RNA, 14 nt, Human
auauuuuucacaua

SEQ ID NO: 1602965 - RNA, 13 nt, Human
auauuuuucacau

SEQ ID NO: 1602966 - RNA, 12 nt, Human
auauuuuucaca

SEQ ID NO: 1602967 - RNA, 17 nt, Human
aucaggguuaguauugu

SEQ ID NO: 1602968 - RNA, 22 nt, Human
aucacuugucaauaaaauccau

SEQ ID NO: 1602969 - RNA, 15 nt, Human
uucggccuccauccu

SEQ ID NO: 1602970 - RNA, 14 nt, Human
uucggccuccaucc

SEQ ID NO: 1602971 - RNA, 15 nt, Human
uucuaaguaaaacca

SEQ ID NO: 1602972 - RNA, 17 nt, Human
uucuaaguaaaaccaca

SEQ ID NO: 1602973 - RNA, 16 nt, Human
uucuaaguaaaaccac

SEQ ID NO: 1602974 - RNA, 23 nt, Human
uucuaagaagugaaaaucuacac

SEQ ID NO: 1602975 - RNA, 14 nt, Human
uucuaaauuuuaua

SEQ ID NO: 1602976 - RNA, 21 nt, Human
uucuagcauggcauauuuuuc

SEQ ID NO: 1602977 - RNA, 20 nt, Human
uucuagcauggcauauuuuu

SEQ ID NO: 1602978 - RNA, 18 nt, Human
uucuagcauggcauauuu

SEQ ID NO: 1602979 - RNA, 15 nt, Human
uucuagcauggcaua

SEQ ID NO: 1602980 - RNA, 14 nt, Human
uucuagcauggcau

SEQ ID NO: 1602981 - RNA, 22 nt, Human
uucuagcauggcauauuuuuca

SEQ ID NO: 1602982 - RNA, 17 nt, Human
uucuagcuaauguaaua

SEQ ID NO: 1602983 - RNA, 14 nt, Human
aucucauuuccaag

SEQ ID NO: 1602984 - RNA, 13 nt, Human
uugcaucaauuuu

SEQ ID NO: 1602985 - RNA, 17 nt, Human
uugaagggaaauuucag

SEQ ID NO: 1602986 - RNA, 17 nt, Human
uugacagaauauguuuc

SEQ ID NO: 1602987 - RNA, 18 nt, Human
aucuacacuccagugaga

SEQ ID NO: 1602988 - RNA, 19 nt, Human
aucuacacuccagugagac

SEQ ID NO: 1602989 - RNA, 20 nt, Human
uugacagaauauguuucaaa

SEQ ID NO: 1602990 - RNA, 20 nt, Human
uuggagacacaacuauuuuu

SEQ ID NO: 1602991 - RNA, 15 nt, Human
augaauuacauuugu

SEQ ID NO: 1602992 - RNA, 23 nt, Human
augaauggcuaagcaaaauguga

SEQ ID NO: 1602993 - RNA, 16 nt, Human
augaauuacauuugua

SEQ ID NO: 1602994 - RNA, 17 nt, Human
augaauuacauuuguau

SEQ ID NO: 1602995 - RNA, 18 nt, Human
augaacuuguaaaggaau

SEQ ID NO: 1602996 - RNA, 21 nt, Human
augaaauuauauaaguauucu

SEQ ID NO: 1602997 - RNA, 19 nt, Human
augaaauuauauaaguauu

SEQ ID NO: 1602998 - RNA, 20 nt, Human
aucuuguagcuuuaucaaag

SEQ ID NO: 1602999 - RNA, 19 nt, Human
aucuuguagcuuuaucaaa

SEQ ID NO: 1603000 - RNA, 14 nt, Human
aucuuauaauuuaa

SEQ ID NO: 1603001 - RNA, 18 nt, Human
aucuuguagcuuuaucaa

SEQ ID NO: 1603002 - RNA, 14 nt, Human
uuaggguuaugauu

SEQ ID NO: 1603003 - RNA, 16 nt, Human
uuaggguuaugauuaa

SEQ ID NO: 1603004 - RNA, 15 nt, Human
uuagggagagaagau

SEQ ID NO: 1603005 - RNA, 14 nt, Human
auaagccagacauc

SEQ ID NO: 1603006 - RNA, 14 nt, Human
auaaucuuucacag

SEQ ID NO: 1603007 - RNA, 17 nt, Human
auaauucagaaggaucu

SEQ ID NO: 1603008 - RNA, 21 nt, Human
auaauuuauacaggucauauu

SEQ ID NO: 1603009 - RNA, 19 nt, Human
auaauuuauacaggucaua

SEQ ID NO: 1603010 - RNA, 14 nt, Human
auaauuuuaagaaa

SEQ ID NO: 1603011 - RNA, 16 nt, Human
aguuuuauaugcuucu

SEQ ID NO: 1603012 - RNA, 16 nt, Human
uuaaaaaauggaacau

SEQ ID NO: 1603013 - RNA, 20 nt, Human
uuaaaaaugguuuaaauggu

SEQ ID NO: 1603014 - RNA, 22 nt, Human
uuaaaaucauuucugcaucagc

SEQ ID NO: 1603015 - RNA, 16 nt, Human
aguuuagcuggaaaag

SEQ ID NO: 1603016 - RNA, 15 nt, Human
aguuuagcuggaaaa

SEQ ID NO: 1603017 - RNA, 20 nt, Human
aguuuaaauuguaauaggcg

SEQ ID NO: 1603018 - RNA, 17 nt, Human
aguuuaaauuguaauag

SEQ ID NO: 1603019 - RNA, 17 nt, Human
aguuuacauuguaaaua

SEQ ID NO: 1603020 - RNA, 15 nt, Human
aguuuacauuguaaa

SEQ ID NO: 1603021 - RNA, 13 nt, Human
aguuuacauugua

SEQ ID NO: 1603022 - RNA, 20 nt, Human
uuaaauuuugaguucuacau

SEQ ID NO: 1603023 - RNA, 15 nt, Human
uuaaauuuugaguuc

SEQ ID NO: 1603024 - RNA, 19 nt, Human
uuaugauuaaguaaugaua

SEQ ID NO: 1603025 - RNA, 22 nt, Human
uuaugauuaaguaaugauaacu

SEQ ID NO: 1603026 - RNA, 14 nt, Human
uuaugaauuacauu

SEQ ID NO: 1603027 - RNA, 16 nt, Human
uuaugaauuacauuug

SEQ ID NO: 1603028 - RNA, 17 nt, Human
uuaugaauuacauuugu

SEQ ID NO: 1603029 - RNA, 21 nt, Human
uuaugaauuacauuuguauaa

SEQ ID NO: 1603030 - RNA, 19 nt, Human
uuauauuugaaauauugac

SEQ ID NO: 1603031 - RNA, 17 nt, Human
auacuauggaauuucuc

SEQ ID NO: 1603032 - RNA, 23 nt, Human
auacgcaacauaauuaaauuuug

SEQ ID NO: 1603033 - RNA, 16 nt, Human
auacucauuaggaugg

SEQ ID NO: 1603034 - RNA, 14 nt, Human
uuauuauauuuaca

SEQ ID NO: 1603035 - RNA, 19 nt, Human
uuauguuaaaacugggaca

SEQ ID NO: 1603036 - RNA, 15 nt, Human
uuauuauauuuacaa

SEQ ID NO: 1603037 - RNA, 13 nt, Human
auagaaguaaaaa

SEQ ID NO: 1603038 - RNA, 17 nt, Human
auagaauuaacacauga

SEQ ID NO: 1603039 - RNA, 22 nt, Human
auagagcaaaauugauguguuu

SEQ ID NO: 1603040 - RNA, 21 nt, Human
auagagcaaaauugauguguu

SEQ ID NO: 1603041 - RNA, 17 nt, Human
auagagcaaaauugaug

SEQ ID NO: 1603042 - RNA, 15 nt, Human
auagagcaaaauuga

SEQ ID NO: 1603043 - RNA, 18 nt, Human
auagauaggucagugcaa

SEQ ID NO: 1603044 - RNA, 21 nt, Human
auagaguguacuuaacuauuc

SEQ ID NO: 1603045 - RNA, 19 nt, Human
auagaguguacuuaacuau

SEQ ID NO: 1603046 - RNA, 14 nt, Human
auagaguguacuua

SEQ ID NO: 1603047 - RNA, 14 nt, Human
agugcaaauuguca

SEQ ID NO: 1603048 - RNA, 18 nt, Human
agucuuucacauuuaaau

SEQ ID NO: 1603049 - RNA, 21 nt, Human
agugaacaaauuuacagagac

SEQ ID NO: 1603050 - RNA, 16 nt, Human
agucuuucacauuuaa

SEQ ID NO: 1603051 - RNA, 22 nt, Human
agugaacaaauuuacagagaca

SEQ ID NO: 1603052 - RNA, 23 nt, Human
agugaacaaauuuacagagacag

SEQ ID NO: 1603053 - RNA, 15 nt, Human
uguucuaagaaguga

SEQ ID NO: 1603054 - RNA, 22 nt, Human
uguugcccacagcuguaugauu

SEQ ID NO: 1603055 - RNA, 22 nt, Human
ugugucuaaauuugaauguuaa

SEQ ID NO: 1603056 - RNA, 19 nt, Human
ugugucuaaauuugaaugu

SEQ ID NO: 1603057 - RNA, 14 nt, Human
uguguaaaauguga

SEQ ID NO: 1603058 - RNA, 22 nt, Human
uguguuaaguauguguaaaaug

SEQ ID NO: 1603059 - RNA, 23 nt, Human
uguuaagcagauggaaugcugug

SEQ ID NO: 1603060 - RNA, 14 nt, Human
agucaggaaagaga

SEQ ID NO: 1603061 - RNA, 13 nt, Human
agucucaggaaau

SEQ ID NO: 1603062 - RNA, 16 nt, Human
agucucaggaaaucaa

SEQ ID NO: 1603063 - RNA, 16 nt, Human
aggugcuacaaaaaca

SEQ ID NO: 1603064 - RNA, 13 nt, Human
uguaagggaaacu

SEQ ID NO: 1603065 - RNA, 18 nt, Human
uguaagggaaacugccag

SEQ ID NO: 1603066 - RNA, 19 nt, Human
uguaagggaaacugccagc

SEQ ID NO: 1603067 - RNA, 19 nt, Human
aguacauuuggagacacaa

SEQ ID NO: 1603068 - RNA, 13 nt, Human
aguaaugauaacu

SEQ ID NO: 1603069 - RNA, 12 nt, Human
aguaauuggaaa

SEQ ID NO: 1603070 - RNA, 13 nt, Human
aguaauuggaaag

SEQ ID NO: 1603071 - RNA, 19 nt, Human
aguaauucaagaaaacaac

SEQ ID NO: 1603072 - RNA, 16 nt, Human
aguaaaaccacagcag

SEQ ID NO: 1603073 - RNA, 17 nt, Human
aguaaaaccacagcagu

SEQ ID NO: 1603074 - RNA, 19 nt, Human
aguaaaaccacagcaguug

SEQ ID NO: 1603075 - RNA, 20 nt, Human
aguaaaaccacagcaguuga

SEQ ID NO: 1603076 - RNA, 13 nt, Human
aguaauagagcaa

SEQ ID NO: 1603077 - RNA, 17 nt, Human
uguaguguuggagaaga

SEQ ID NO: 1603078 - RNA, 18 nt, Human
uguaguguuggagaagaa

SEQ ID NO: 1603079 - RNA, 18 nt, Human
uguauauccuuucuaaca

SEQ ID NO: 1603080 - RNA, 16 nt, Human
uguaguguuggagaag

SEQ ID NO: 1603081 - RNA, 16 nt, Human
uggagaagaacugaaa

SEQ ID NO: 1603082 - RNA, 20 nt, Human
aggcagcucuaaaugucaau

SEQ ID NO: 1603083 - RNA, 21 nt, Human
uggaacaagaugguucuagca

SEQ ID NO: 1603084 - RNA, 11 nt, Human
aggcuccacuu

SEQ ID NO: 1603085 - RNA, 17 nt, Human
aggcuccacuuggucug

SEQ ID NO: 1603086 - RNA, 21 nt, Human
aggcuccacuuggucugugag

SEQ ID NO: 1603087 - RNA, 22 nt, Human
aggcuccacuuggucugugaga

SEQ ID NO: 1603088 - RNA, 18 nt, Human
ugggaaacaaaaggauaa

SEQ ID NO: 1603089 - RNA, 14 nt, Human
ugggaaagcauugu

SEQ ID NO: 1603090 - RNA, 16 nt, Human
ugggaaagcauuguaa

SEQ ID NO: 1603091 - RNA, 21 nt, Human
ugggaaagcauuguaaaugug

SEQ ID NO: 1603092 - RNA, 17 nt, Human
ugggaaagcauuguaaa

SEQ ID NO: 1603093 - RNA, 18 nt, Human
ugggaaagcauuguaaau

SEQ ID NO: 1603094 - RNA, 23 nt, Human
uggcuauaggugcuacaaaaaca

SEQ ID NO: 1603095 - RNA, 18 nt, Human
uggcuaagcaaaauguga

SEQ ID NO: 1603096 - RNA, 15 nt, Human
uggcuauaggugcua

SEQ ID NO: 1603097 - RNA, 19 nt, Human
uggcuauaggugcuacaaa

SEQ ID NO: 1603098 - RNA, 20 nt, Human
ugggaacccaaguccaagca

SEQ ID NO: 1603099 - RNA, 14 nt, Human
agggaaacugccag

SEQ ID NO: 1603100 - RNA, 15 nt, Human
agggaaacugccagc

SEQ ID NO: 1603101 - RNA, 16 nt, Human
agggaaacugccagca

SEQ ID NO: 1603102 - RNA, 19 nt, Human
agggaaacugccagcaacg

SEQ ID NO: 1603103 - RNA, 21 nt, Human
agggaaacugccagcaacgca

SEQ ID NO: 1603104 - RNA, 23 nt, Human
agggaaacugccagcaacgcagg

SEQ ID NO: 1603105 - RNA, 22 nt, Human
agggcuguuauaaucuuucaca

SEQ ID NO: 1603106 - RNA, 19 nt, Human
ugggaggcugagaugggag

SEQ ID NO: 1603107 - RNA, 13 nt, Human
agggagagaagau

SEQ ID NO: 1603108 - RNA, 14 nt, Human
agggagagaagaua

SEQ ID NO: 1603109 - RNA, 13 nt, Human
agggaaauuucag

SEQ ID NO: 1603110 - RNA, 23 nt, Human
agggacuucugucuucacaacag

SEQ ID NO: 1603111 - RNA, 14 nt, Human
aggaaauauuuauu

SEQ ID NO: 1603112 - RNA, 18 nt, Human
aggaaauauuuauuuuaa

SEQ ID NO: 1603113 - RNA, 19 nt, Human
aggaaaucaaauaugcaaa

SEQ ID NO: 1603114 - RNA, 19 nt, Human
aggaauugacccacaagaa

SEQ ID NO: 1603115 - RNA, 23 nt, Human
aggaauugacccacaagaaauga

SEQ ID NO: 1603116 - RNA, 21 nt, Human
agcuuauugucuagugaaacu

SEQ ID NO: 1603117 - RNA, 15 nt, Human
agcuuauuaaaacuc

SEQ ID NO: 1603118 - RNA, 20 nt, Human
agcuuauuaaaacucauuuu

SEQ ID NO: 1603119 - RNA, 13 nt, Human
aggaaagagaacu

SEQ ID NO: 1603120 - RNA, 19 nt, Human
aggaaagagaacuuccaga

SEQ ID NO: 1603121 - RNA, 16 nt, Human
ugcuaguaauuggaaa

SEQ ID NO: 1603122 - RNA, 14 nt, Human
ugcuaguaauugga

SEQ ID NO: 1603123 - RNA, 22 nt, Human
agcugccuccccuccucugcuu

SEQ ID NO: 1603124 - RNA, 21 nt, Human
agcugccuccccuccucugcu

SEQ ID NO: 1603125 - RNA, 23 nt, Human
agcugccuccccuccucugcuug

SEQ ID NO: 1603126 - RNA, 20 nt, Human
agcugccuccccuccucugc

SEQ ID NO: 1603127 - RNA, 19 nt, Human
agcugccuccccuccucug

SEQ ID NO: 1603128 - RNA, 18 nt, Human
agcugccuccccuccucu

SEQ ID NO: 1603129 - RNA, 13 nt, Human
agcuggaaaagua

SEQ ID NO: 1603130 - RNA, 19 nt, Human
agcuauggugucauaggcu

SEQ ID NO: 1603131 - RNA, 18 nt, Human
agcccuucuuuccacaga

SEQ ID NO: 1603132 - RNA, 19 nt, Human
agcccuucuuuccacagaa

SEQ ID NO: 1603133 - RNA, 19 nt, Human
agccugagcgacagugaga

SEQ ID NO: 1603134 - RNA, 18 nt, Human
agccugagcgacagugag

SEQ ID NO: 1603135 - RNA, 14 nt, Human
ugcagugagccgag

SEQ ID NO: 1603136 - RNA, 19 nt, Human
ugcagugagccgagauugu

SEQ ID NO: 1603137 - RNA, 13 nt, Human
ugcauacucauua

SEQ ID NO: 1603138 - RNA, 21 nt, Human
agccugcaauuucauaugcug

SEQ ID NO: 1603139 - RNA, 19 nt, Human
agccugcaauuucauaugc

SEQ ID NO: 1603140 - RNA, 14 nt, Human
agaagcuccaggua

SEQ ID NO: 1603141 - RNA, 14 nt, Human
ucugcuugccaucc

SEQ ID NO: 1603142 - RNA, 12 nt, Human
ucugcuugccau

SEQ ID NO: 1603143 - RNA, 21 nt, Human
agaagaacugaaaucauacuu

SEQ ID NO: 1603144 - RNA, 11 nt, Human
ucugcuugcca

SEQ ID NO: 1603145 - RNA, 23 nt, Human
ucugagaaagacuauucaaacag

SEQ ID NO: 1603146 - RNA, 21 nt, Human
ucugagaaagacuauucaaac

SEQ ID NO: 1603147 - RNA, 22 nt, Human
ucugagaaagacuauucaaaca

SEQ ID NO: 1603148 - RNA, 21 nt, Human
ucugacuguuuccaucaaggg

SEQ ID NO: 1603149 - RNA, 14 nt, Human
ucugagaaagacua

SEQ ID NO: 1603150 - RNA, 15 nt, Human
ucugagaaagacuau

SEQ ID NO: 1603151 - RNA, 19 nt, Human
ucugagaaagacuauucaa

SEQ ID NO: 1603152 - RNA, 20 nt, Human
ucugagaaagacuauucaaa

SEQ ID NO: 1603153 - RNA, 19 nt, Human
agaaagacuauucaaacag

SEQ ID NO: 1603154 - RNA, 20 nt, Human
agaaagacuauucaaacagu

SEQ ID NO: 1603155 - RNA, 23 nt, Human
agaaagacuauucaaacagucuc

SEQ ID NO: 1603156 - RNA, 15 nt, Human
ucugcagauaaacag

SEQ ID NO: 1603157 - RNA, 14 nt, Human
agaacucccuuuca

SEQ ID NO: 1603158 - RNA, 15 nt, Human
agaacucccuuucaa

SEQ ID NO: 1603159 - RNA, 15 nt, Human
ucucccagucauuua

SEQ ID NO: 1603160 - RNA, 13 nt, Human
agaaacuggaacu

SEQ ID NO: 1603161 - RNA, 15 nt, Human
agaaacuggaacucu

SEQ ID NO: 1603162 - RNA, 19 nt, Human
agaaaacaaggaugaauua

SEQ ID NO: 1603163 - RNA, 12 nt, Human
ucucuucuuuaa

SEQ ID NO: 1603164 - RNA, 13 nt, Human
ucucuucuuuaaa

SEQ ID NO: 1603165 - RNA, 16 nt, Human
ucucuggccuucggcc

SEQ ID NO: 1603166 - RNA, 17 nt, Human
ucucuggccuucggccu

SEQ ID NO: 1603167 - RNA, 22 nt, Human
agacuccaaagaaauguaaggg

SEQ ID NO: 1603168 - RNA, 23 nt, Human
agacuauucaaacagucucagga

SEQ ID NO: 1603169 - RNA, 16 nt, Human
agacuccaaagaaaug

SEQ ID NO: 1603170 - RNA, 19 nt, Human
agacuccaaagaaauguaa

SEQ ID NO: 1603171 - RNA, 21 nt, Human
agacuauucaaacagucucag

SEQ ID NO: 1603172 - RNA, 18 nt, Human
agacuauucaaacagucu

SEQ ID NO: 1603173 - RNA, 20 nt, Human
agacuauucaaacagucuca

SEQ ID NO: 1603174 - RNA, 12 nt, Human
agacuccaaaga

SEQ ID NO: 1603175 - RNA, 13 nt, Human
agacuccaaagaa

SEQ ID NO: 1603176 - RNA, 14 nt, Human
agacuccaaagaaa

SEQ ID NO: 1603177 - RNA, 17 nt, Human
ucuuuaaaauacacacu

SEQ ID NO: 1603178 - RNA, 21 nt, Human
ucuuuaaagggauggcaagau

SEQ ID NO: 1603179 - RNA, 18 nt, Human
agagacacacugaagaag

SEQ ID NO: 1603180 - RNA, 20 nt, Human
agagacacacugaagaagca

SEQ ID NO: 1603181 - RNA, 17 nt, Human
agagacacacugaagaa

SEQ ID NO: 1603182 - RNA, 15 nt, Human
agagaaugagagaca

SEQ ID NO: 1603183 - RNA, 18 nt, Human
agacuggcacaguuuucu

SEQ ID NO: 1603184 - RNA, 14 nt, Human
agacuggcacaguu

SEQ ID NO: 1603185 - RNA, 15 nt, Human
agacuggcacaguuu

SEQ ID NO: 1603186 - RNA, 22 nt, Human
ucuuagaugcaguucugaagaa

SEQ ID NO: 1603187 - RNA, 18 nt, Human
ucuuaauuaaaagaauau

SEQ ID NO: 1603188 - RNA, 21 nt, Human
ucuuaauuaaaagaauauuuu

SEQ ID NO: 1603189 - RNA, 20 nt, Human
ucuguuuuauaauuuuguga

SEQ ID NO: 1603190 - RNA, 18 nt, Human
ucuguuuuauaauuuugu

SEQ ID NO: 1603191 - RNA, 18 nt, Human
ugaagauguagaggagaa

SEQ ID NO: 1603192 - RNA, 22 nt, Human
ugaagaagcaccaaucaugaau

SEQ ID NO: 1603193 - RNA, 14 nt, Human
ugaagaagauggua

SEQ ID NO: 1603194 - RNA, 20 nt, Human
ugaagaagcaccaaucauga

SEQ ID NO: 1603195 - RNA, 22 nt, Human
agagugaacaaauuuacagaga

SEQ ID NO: 1603196 - RNA, 19 nt, Human
agauaaucagugugucuaa

SEQ ID NO: 1603197 - RNA, 23 nt, Human
agaugcuagaacucccuuucaac

SEQ ID NO: 1603198 - RNA, 15 nt, Human
ugacuguuuccauca

SEQ ID NO: 1603199 - RNA, 16 nt, Human
agauuuaccacuugug

SEQ ID NO: 1603200 - RNA, 16 nt, Human
agauugugccccugca

SEQ ID NO: 1603201 - RNA, 21 nt, Human
agauugugccccugcacucca

SEQ ID NO: 1603202 - RNA, 12 nt, Human
agauuuucagaa

SEQ ID NO: 1603203 - RNA, 14 nt, Human
agauuuuccugaaa

SEQ ID NO: 1603204 - RNA, 17 nt, Human
agauuuucagaaaauau

SEQ ID NO: 1603205 - RNA, 22 nt, Human
agcacagccucuuagaugcagu

SEQ ID NO: 1603206 - RNA, 16 nt, Human
agcaccaaucaugaau

SEQ ID NO: 1603207 - RNA, 14 nt, Human
agcaacgcaggccc

SEQ ID NO: 1603208 - RNA, 14 nt, Human
agcagaacagugau

SEQ ID NO: 1603209 - RNA, 13 nt, Human
ugagcgacaguga

SEQ ID NO: 1603210 - RNA, 14 nt, Human
ugagcgacagugag

SEQ ID NO: 1603211 - RNA, 16 nt, Human
ugagcgacagugagac

SEQ ID NO: 1603212 - RNA, 20 nt, Human
ugagcgacagugagacucug

SEQ ID NO: 1603213 - RNA, 16 nt, Human
ugagcuacaaaugcau

SEQ ID NO: 1603214 - RNA, 14 nt, Human
ugagcuacaaaugc

SEQ ID NO: 1603215 - RNA, 13 nt, Human
ugagcuacaaaug

SEQ ID NO: 1603216 - RNA, 15 nt, Human
ugaggacacugauau

SEQ ID NO: 1603217 - RNA, 17 nt, Human
ugagguacugagaguga

SEQ ID NO: 1603218 - RNA, 22 nt, Human
ugagguacugagagugaacaaa

SEQ ID NO: 1603219 - RNA, 21 nt, Human
agcagauggaaugcuguguua

SEQ ID NO: 1603220 - RNA, 21 nt, Human
acccaaauguucaucaaugaa

SEQ ID NO: 1603221 - RNA, 18 nt, Human
acccaaaaggcagaagca

SEQ ID NO: 1603222 - RNA, 13 nt, Human
acccaaaaggcag

SEQ ID NO: 1603223 - RNA, 15 nt, Human
acccaaaaggcagaa

SEQ ID NO: 1603224 - RNA, 19 nt, Human
accacuuguguuuugcaag

SEQ ID NO: 1603225 - RNA, 23 nt, Human
accacuuguguuuugcaagccag

SEQ ID NO: 1603226 - RNA, 14 nt, Human
accacugcagaaga

SEQ ID NO: 1603227 - RNA, 19 nt, Human
accacugcagaagacagua

SEQ ID NO: 1603228 - RNA, 11 nt, Human
accacagcagu

SEQ ID NO: 1603229 - RNA, 12 nt, Human
uauuucauuucu

SEQ ID NO: 1603230 - RNA, 21 nt, Human
uccagccugagcgacagugag

SEQ ID NO: 1603231 - RNA, 20 nt, Human
uccagccugagcgacaguga

SEQ ID NO: 1603232 - RNA, 21 nt, Human
uccaacuaucucauuuccaag

SEQ ID NO: 1603233 - RNA, 22 nt, Human
ucaugaauuaguuuuauaugcu

SEQ ID NO: 1603234 - RNA, 19 nt, Human
ucauauuaauauauuucca

SEQ ID NO: 1603235 - RNA, 23 nt, Human
uccugggcagcugccuccccucc

SEQ ID NO: 1603236 - RNA, 22 nt, Human
uccugggcagcugccuccccuc

SEQ ID NO: 1603237 - RNA, 19 nt, Human
uccugggcagcugccuccc

SEQ ID NO: 1603238 - RNA, 18 nt, Human
uccugggcagcugccucc

SEQ ID NO: 1603239 - RNA, 17 nt, Human
uccugggcagcugccuc

SEQ ID NO: 1603240 - RNA, 16 nt, Human
uccugggcagcugccu

SEQ ID NO: 1603241 - RNA, 15 nt, Human
uccugggcagcugcc

SEQ ID NO: 1603242 - RNA, 17 nt, Human
acugaggggaggggagc

SEQ ID NO: 1603243 - RNA, 22 nt, Human
acugaggggaggggagcauggg

SEQ ID NO: 1603244 - RNA, 13 nt, Human
uccuucagccuga

SEQ ID NO: 1603245 - RNA, 22 nt, Human
acuggcacaguuuucugagaaa

SEQ ID NO: 1603246 - RNA, 22 nt, Human
acugccuucucaacuccaaacu

SEQ ID NO: 1603247 - RNA, 22 nt, Human
uccuuucuaacaaaaaaauaua

SEQ ID NO: 1603248 - RNA, 19 nt, Human
acuccagugagacagcucu

SEQ ID NO: 1603249 - RNA, 20 nt, Human
acucauuuuaaaaaauggaa

SEQ ID NO: 1603250 - RNA, 13 nt, Human
acuaaaaauacaa

SEQ ID NO: 1603251 - RNA, 15 nt, Human
ucccagugaauucuu

SEQ ID NO: 1603252 - RNA, 12 nt, Human
uccccuccucug

SEQ ID NO: 1603253 - RNA, 14 nt, Human
uccccuccucugcu

SEQ ID NO: 1603254 - RNA, 17 nt, Human
uauggcuauaggugcua

SEQ ID NO: 1603255 - RNA, 16 nt, Human
uauggcuauaggugcu

SEQ ID NO: 1603256 - RNA, 21 nt, Human
uaugagcuuccuucugugaaa

SEQ ID NO: 1603257 - RNA, 18 nt, Human
uaugagcuuccuucugug

SEQ ID NO: 1603258 - RNA, 14 nt, Human
uauauuuacaaaug

SEQ ID NO: 1603259 - RNA, 15 nt, Human
uauauuuacaaaugg

SEQ ID NO: 1603260 - RNA, 17 nt, Human
uaucuaguaugaaauua

SEQ ID NO: 1603261 - RNA, 16 nt, Human
uaucuaguaugaaauu

SEQ ID NO: 1603262 - RNA, 14 nt, Human
uaucuaguaugaaa

SEQ ID NO: 1603263 - RNA, 16 nt, Human
uaguuuuauaugcuuc

SEQ ID NO: 1603264 - RNA, 22 nt, Human
uagugagcagucaggaaagaga

SEQ ID NO: 1603265 - RNA, 21 nt, Human
uauaaaauaauuuuuauauuu

SEQ ID NO: 1603266 - RNA, 22 nt, Human
uauaaaauaauuuuuauauuug

SEQ ID NO: 1603267 - RNA, 22 nt, Human
acacaucagcuugcccuguuaa

SEQ ID NO: 1603268 - RNA, 23 nt, Human
uauaaaauaauuuuuauauuuga

SEQ ID NO: 1603269 - RNA, 14 nt, Human
uauaauuuugugaa

SEQ ID NO: 1603270 - RNA, 19 nt, Human
uauaauuuugugaagcaaa

SEQ ID NO: 1603271 - RNA, 23 nt, Human
uauaggugcuacaaaaacacagc

SEQ ID NO: 1603272 - RNA, 21 nt, Human
uauaggugcuacaaaaacaca

SEQ ID NO: 1603273 - RNA, 20 nt, Human
uauaggugcuacaaaaacac

SEQ ID NO: 1603274 - RNA, 13 nt, Human
uauaggaauugac

SEQ ID NO: 1603275 - RNA, 14 nt, Human
uauaggaauugacc

SEQ ID NO: 1603276 - RNA, 19 nt, Human
uauaggaauugacccacaa

SEQ ID NO: 1603277 - RNA, 17 nt, Human
uauauccuuucuaacaa

SEQ ID NO: 1603278 - RNA, 16 nt, Human
uauauccuuucuaaca

SEQ ID NO: 1603279 - RNA, 22 nt, Human
acaguucggugagcuacaaaug

SEQ ID NO: 1603280 - RNA, 19 nt, Human
acaguucggugagcuacaa

SEQ ID NO: 1603281 - RNA, 23 nt, Human
acaguucggugagcuacaaaugc

SEQ ID NO: 1603282 - RNA, 17 nt, Human
uauugucuagugaaacu

SEQ ID NO: 1603283 - RNA, 14 nt, Human
uauuuauuuuaaua

SEQ ID NO: 1603284 - RNA, 16 nt, Human
uauuuauuuuaauaau

SEQ ID NO: 1603285 - RNA, 18 nt, Human
uauuuauuuuaauaaugu

SEQ ID NO: 1603286 - RNA, 19 nt, Human
uauuuaaugauaaguaaau

SEQ ID NO: 1603287 - RNA, 21 nt, Human
acaguuaccucugccucagaa

SEQ ID NO: 1603288 - RNA, 14 nt, Human
acagugagacucug

SEQ ID NO: 1603289 - RNA, 18 nt, Human
acagugagacucugucuc

SEQ ID NO: 1603290 - RNA, 20 nt, Human
acagugaaagaaaauaacaa

SEQ ID NO: 1603291 - RNA, 17 nt, Human
acagucucaggaaauca

SEQ ID NO: 1603292 - RNA, 13 nt, Human
acagucucaggaa

SEQ ID NO: 1603293 - RNA, 14 nt, Human
acagucucaggaaa

SEQ ID NO: 1603294 - RNA, 15 nt, Human
acagucucaggaaau

SEQ ID NO: 1603295 - RNA, 16 nt, Human
acagucucaggaaauc

SEQ ID NO: 1603296 - RNA, 21 nt, Human
acaguauggcagcuuuccuca

SEQ ID NO: 1603297 - RNA, 21 nt, Human
uauguuuucaggcuagaugua

SEQ ID NO: 1603298 - RNA, 12 nt, Human
uauuaaaacuca

SEQ ID NO: 1603299 - RNA, 16 nt, Human
uauuaaaacucauuuu

SEQ ID NO: 1603300 - RNA, 23 nt, Human
uauucauagcagcuuauucacaa

SEQ ID NO: 1603301 - RNA, 16 nt, Human
uauucaggagaguaga

SEQ ID NO: 1603302 - RNA, 23 nt, Human
aauugugugaaagguacuucaaa

SEQ ID NO: 1603303 - RNA, 13 nt, Human
uacuguaagaaaa

SEQ ID NO: 1603304 - RNA, 14 nt, Human
uacuucaaauccuu

SEQ ID NO: 1603305 - RNA, 19 nt, Human
uacuucaaauccuugaaga

SEQ ID NO: 1603306 - RNA, 20 nt, Human
aauuucucccagucauuuaa

SEQ ID NO: 1603307 - RNA, 16 nt, Human
aauugacccacaagaa

SEQ ID NO: 1603308 - RNA, 19 nt, Human
aauugacccacaagaaaug

SEQ ID NO: 1603309 - RNA, 21 nt, Human
aauucuugccaaauauaaaua

SEQ ID NO: 1603310 - RNA, 21 nt, Human
aauucuugaaggaaaaugaua

SEQ ID NO: 1603311 - RNA, 16 nt, Human
aauucuugaaggaaaa

SEQ ID NO: 1603312 - RNA, 15 nt, Human
aauucuugaaggaaa

SEQ ID NO: 1603313 - RNA, 18 nt, Human
acaagcacuaaacaaaga

SEQ ID NO: 1603314 - RNA, 21 nt, Human
uagcaugucgucaaagcugaa

SEQ ID NO: 1603315 - RNA, 17 nt, Human
uagaugcaguucugaag

SEQ ID NO: 1603316 - RNA, 19 nt, Human
uagaugcaguucugaagaa

SEQ ID NO: 1603317 - RNA, 16 nt, Human
uagaugcaguucugaa

SEQ ID NO: 1603318 - RNA, 19 nt, Human
uagaggagaaacuggaacu

SEQ ID NO: 1603319 - RNA, 21 nt, Human
uacuucaaauccuugaagauu

SEQ ID NO: 1603320 - RNA, 16 nt, Human
uacuucaugcugucua

SEQ ID NO: 1603321 - RNA, 15 nt, Human
uagaacucccuuuca

SEQ ID NO: 1603322 - RNA, 19 nt, Human
aauuuuuauauuugaaaua

SEQ ID NO: 1603323 - RNA, 19 nt, Human
aauuuuuucucuaggaaau

SEQ ID NO: 1603324 - RNA, 20 nt, Human
acaaaaaaauauauuuaaug

SEQ ID NO: 1603325 - RNA, 17 nt, Human
acaaaaaaauauauuua

SEQ ID NO: 1603326 - RNA, 13 nt, Human
acaaaaaaauaua

SEQ ID NO: 1603327 - RNA, 17 nt, Human
uacaaaaacacagcaag

SEQ ID NO: 1603328 - RNA, 18 nt, Human
uacaaaaacacagcaagg

SEQ ID NO: 1603329 - RNA, 19 nt, Human
uaacaaugcuguauuuuaa

SEQ ID NO: 1603330 - RNA, 18 nt, Human
uaaucagugugucuaaau

SEQ ID NO: 1603331 - RNA, 17 nt, Human
uaaucagugugucuaaa

SEQ ID NO: 1603332 - RNA, 13 nt, Human
uaaucuuucacag

SEQ ID NO: 1603333 - RNA, 15 nt, Human
aaugaaugaaugaau

SEQ ID NO: 1603334 - RNA, 17 nt, Human
uaauguaauaacuguga

SEQ ID NO: 1603335 - RNA, 18 nt, Human
uaauguaauaacugugaa

SEQ ID NO: 1603336 - RNA, 16 nt, Human
aaugguuuaaaugguc

SEQ ID NO: 1603337 - RNA, 19 nt, Human
uacauaaguaauucaagaa

SEQ ID NO: 1603338 - RNA, 17 nt, Human
uacauaaguaauucaag

SEQ ID NO: 1603339 - RNA, 16 nt, Human
uacauaaguaauucaa

SEQ ID NO: 1603340 - RNA, 16 nt, Human
uaccaugccauuuaaa

SEQ ID NO: 1603341 - RNA, 18 nt, Human
aauguugacaugggacau

SEQ ID NO: 1603342 - RNA, 22 nt, Human
uacauuguacgaagaguauuuu

SEQ ID NO: 1603343 - RNA, 20 nt, Human
uacauuguacgaagaguauu

SEQ ID NO: 1603344 - RNA, 23 nt, Human
uacauuguacgaagaguauuuuu

SEQ ID NO: 1603345 - RNA, 13 nt, Human
aaggauaaugaau

SEQ ID NO: 1603346 - RNA, 14 nt, Human
aaggaucuucaucu

SEQ ID NO: 1603347 - RNA, 12 nt, Human
aaggaaaaugau

SEQ ID NO: 1603348 - RNA, 14 nt, Human
aaggaaaaugauac

SEQ ID NO: 1603349 - RNA, 13 nt, Human
guugacaugggac

SEQ ID NO: 1603350 - RNA, 19 nt, Human
aaggaaaaaauaacaauga

SEQ ID NO: 1603351 - RNA, 16 nt, Human
aaggaaaaaauaacaa

SEQ ID NO: 1603352 - RNA, 13 nt, Human
guguuuauuuaua

SEQ ID NO: 1603353 - RNA, 22 nt, Human
aagucuuauauauuguagauaa

SEQ ID NO: 1603354 - RNA, 23 nt, Human
guuuuuuuuuaaaaaagaaacau

SEQ ID NO: 1603355 - RNA, 16 nt, Human
guuuucugagaaagac

SEQ ID NO: 1603356 - RNA, 17 nt, Human
guuuucugagaaagacu

SEQ ID NO: 1603357 - RNA, 22 nt, Human
guuuucugagaaagacuauuca

SEQ ID NO: 1603358 - RNA, 23 nt, Human
aaguauguuagugcaaauuguca

SEQ ID NO: 1603359 - RNA, 21 nt, Human
aaguauguuagugcaaauugu

SEQ ID NO: 1603360 - RNA, 13 nt, Human
aaguauucuaaau

SEQ ID NO: 1603361 - RNA, 15 nt, Human
aaguauucuaaauuu

SEQ ID NO: 1603362 - RNA, 15 nt, Human
guuuuauaauuuugu

SEQ ID NO: 1603363 - RNA, 22 nt, Human
guuuuauaauuuugugaagcaa

SEQ ID NO: 1603364 - RNA, 14 nt, Human
aaguaaaaccacag

SEQ ID NO: 1603365 - RNA, 15 nt, Human
aaguaaaaccacagc

SEQ ID NO: 1603366 - RNA, 16 nt, Human
aaguaaaaccacagca

SEQ ID NO: 1603367 - RNA, 21 nt, Human
aagggugaugggaaagcauug

SEQ ID NO: 1603368 - RNA, 17 nt, Human
aaguaaaaccacagcag

SEQ ID NO: 1603369 - RNA, 18 nt, Human
aaguaaaaccacagcagu

SEQ ID NO: 1603370 - RNA, 20 nt, Human
aaguuauugauaaguucaua

SEQ ID NO: 1603371 - RNA, 19 nt, Human
aaguuauugauaaguucau

SEQ ID NO: 1603372 - RNA, 17 nt, Human
aaguucugcagauaaac

SEQ ID NO: 1603373 - RNA, 19 nt, Human
aaguuuacauuguaaauag

SEQ ID NO: 1603374 - RNA, 18 nt, Human
aaguuuacauuguaaaua

SEQ ID NO: 1603375 - RNA, 13 nt, Human
aaguucauacauu

SEQ ID NO: 1603376 - RNA, 12 nt, Human
aaguucauacau

SEQ ID NO: 1603377 - RNA, 15 nt, Human
aaguucauacauugu

SEQ ID NO: 1603378 - RNA, 23 nt, Human
aaguuauugauaaguucauacau

SEQ ID NO: 1603379 - RNA, 22 nt, Human
aaguuauugauaaguucauaca

SEQ ID NO: 1603380 - RNA, 19 nt, Human
uaaaccucaaaaugucuaa

SEQ ID NO: 1603381 - RNA, 18 nt, Human
uaaaccucaaaaugucua

SEQ ID NO: 1603382 - RNA, 17 nt, Human
uaaaugauuucauucaa

SEQ ID NO: 1603383 - RNA, 15 nt, Human
uaacaaugcuguauu

SEQ ID NO: 1603384 - RNA, 17 nt, Human
uaacaaugcuguauuuu

SEQ ID NO: 1603385 - RNA, 23 nt, Human
uaacaaaaaaauauauuuaauga

SEQ ID NO: 1603386 - RNA, 20 nt, Human
uaacaaaaaaauauauuuaa

SEQ ID NO: 1603387 - RNA, 16 nt, Human
uaaauuuugaguucua

SEQ ID NO: 1603388 - RNA, 14 nt, Human
uaaauuuuauaucu

SEQ ID NO: 1603389 - RNA, 14 nt, Human
aauacacacucaaa

SEQ ID NO: 1603390 - RNA, 18 nt, Human
uaaauaguauuugagagu

SEQ ID NO: 1603391 - RNA, 15 nt, Human
aauaacaauaaaaga

SEQ ID NO: 1603392 - RNA, 12 nt, Human
aauaaaugugcc

SEQ ID NO: 1603393 - RNA, 21 nt, Human
aauaaaugugccuucauuuuu

SEQ ID NO: 1603394 - RNA, 22 nt, Human
aauaaaauccauacauuugugu

SEQ ID NO: 1603395 - RNA, 12 nt, Human
aauaaaaauaau

SEQ ID NO: 1603396 - RNA, 22 nt, Human
aauaaaaauauuguguugugaa

SEQ ID NO: 1603397 - RNA, 13 nt, Human
aagacccaaaagg

SEQ ID NO: 1603398 - RNA, 13 nt, Human
aagaauauuuuaa

SEQ ID NO: 1603399 - RNA, 13 nt, Human
aagaaaauaucac

SEQ ID NO: 1603400 - RNA, 22 nt, Human
aagaagcaccaaucaugaauua

SEQ ID NO: 1603401 - RNA, 18 nt, Human
aagagcuguucacagcca

SEQ ID NO: 1603402 - RNA, 19 nt, Human
aagagcuguucacagccag

SEQ ID NO: 1603403 - RNA, 14 nt, Human
aagacuccaaagaa

SEQ ID NO: 1603404 - RNA, 16 nt, Human
aagacuccaaagaaau

SEQ ID NO: 1603405 - RNA, 17 nt, Human
aagacuccaaagaaaug

SEQ ID NO: 1603406 - RNA, 14 nt, Human
aagacuauucaaac

SEQ ID NO: 1603407 - RNA, 22 nt, Human
aagauguagaggagaaacugga

SEQ ID NO: 1603408 - RNA, 19 nt, Human
aagcaaaauuuuuucucua

SEQ ID NO: 1603409 - RNA, 16 nt, Human
aagcaaguauuagaau

SEQ ID NO: 1603410 - RNA, 23 nt, Human
gucucaguccaugaagauguaga

SEQ ID NO: 1603411 - RNA, 19 nt, Human
aacagucucaggaaaucaa

SEQ ID NO: 1603412 - RNA, 17 nt, Human
aacagucucaggaaauc

SEQ ID NO: 1603413 - RNA, 16 nt, Human
aacagauaaauaguuu

SEQ ID NO: 1603414 - RNA, 19 nt, Human
aacagauuauuaccuuaca

SEQ ID NO: 1603415 - RNA, 16 nt, Human
aacauauauaacaaug

SEQ ID NO: 1603416 - RNA, 12 nt, Human
aacauaauuaaa

SEQ ID NO: 1603417 - RNA, 20 nt, Human
aacugaaaucauacuucuua

SEQ ID NO: 1603418 - RNA, 13 nt, Human
aacuauauuguuu

SEQ ID NO: 1603419 - RNA, 20 nt, Human
aacuaucucauuuccaagca

SEQ ID NO: 1603420 - RNA, 23 nt, Human
aacuaucucauuuccaagcaagu

SEQ ID NO: 1603421 - RNA, 16 nt, Human
gugaagugaaugaaac

SEQ ID NO: 1603422 - RNA, 19 nt, Human
caaauaugcaaagcacuga

SEQ ID NO: 1603423 - RNA, 18 nt, Human
caaauaugcaaagcacug

SEQ ID NO: 1603424 - RNA, 16 nt, Human
caaauaugcaaagcac

SEQ ID NO: 1603425 - RNA, 17 nt, Human
caaauaugcaaagcacu

SEQ ID NO: 1603426 - RNA, 21 nt, Human
caaauguucaucaaugaauga

SEQ ID NO: 1603427 - RNA, 23 nt, Human
caaaaaaauauauuuaaugauaa

SEQ ID NO: 1603428 - RNA, 17 nt, Human
caagcacuaaacaaaga

SEQ ID NO: 1603429 - RNA, 14 nt, Human
caaauuuacagaga

SEQ ID NO: 1603430 - RNA, 16 nt, Human
caaauuuacagagaca

SEQ ID NO: 1603431 - RNA, 15 nt, Human
caaauuuacagagac

SEQ ID NO: 1603432 - RNA, 12 nt, Human
caacuuuauacc

SEQ ID NO: 1603433 - RNA, 22 nt, Human
caaugaaugaaugaauggcuaa

SEQ ID NO: 1603434 - RNA, 11 nt, Human
cacaacagauu

SEQ ID NO: 1603435 - RNA, 19 nt, Human
cacacucaaaucaagaaac

SEQ ID NO: 1603436 - RNA, 13 nt, Human
cacaacuauauug

SEQ ID NO: 1603437 - RNA, 19 nt, Human
cacaacuauuuuuccaaaa

SEQ ID NO: 1603438 - RNA, 14 nt, Human
cacaacuauuuuuc

SEQ ID NO: 1603439 - RNA, 19 nt, Human
cacaggaaccacaagacug

SEQ ID NO: 1603440 - RNA, 20 nt, Human
cacaggaaccacaagacugc

SEQ ID NO: 1603441 - RNA, 15 nt, Human
cacaggaaguagagg

SEQ ID NO: 1603442 - RNA, 15 nt, Human
cacaguuuucugaga

SEQ ID NO: 1603443 - RNA, 14 nt, Human
cacaguuuucugag

SEQ ID NO: 1603444 - RNA, 23 nt, Human
cacauaucuaguaugaaauuaua

SEQ ID NO: 1603445 - RNA, 22 nt, Human
cacagcaguugaaaagacucca

SEQ ID NO: 1603446 - RNA, 20 nt, Human
uugauaugccuuuucccaac

SEQ ID NO: 1603447 - RNA, 13 nt, Human
uugccaucccucc

SEQ ID NO: 1603448 - RNA, 18 nt, Human
uugccaucccucccucca

SEQ ID NO: 1603449 - RNA, 17 nt, Human
uugccaucccucccucc

SEQ ID NO: 1603450 - RNA, 16 nt, Human
uugccaucccucccuc

SEQ ID NO: 1603451 - RNA, 14 nt, Human
uugccaucccuccc

SEQ ID NO: 1603452 - RNA, 23 nt, Human
uugccaucccucccuccaccucc

SEQ ID NO: 1603453 - RNA, 22 nt, Human
uugccaucccucccuccaccuc

SEQ ID NO: 1603454 - RNA, 19 nt, Human
uucuuaggguuaugauuaa

SEQ ID NO: 1603455 - RNA, 24 nt, Human
uucuaaguaaaaccacagcaguug

SEQ ID NO: 1603456 - RNA, 18 nt, Human
uucuuuccacagaagcuc

SEQ ID NO: 1603457 - RNA, 21 nt, Human
uugaaaaucuuauaauuuaaa

SEQ ID NO: 1603458 - RNA, 17 nt, Human
uugaauguuaagcagau

SEQ ID NO: 1603459 - RNA, 14 nt, Human
uugaauguuaagca

SEQ ID NO: 1603460 - RNA, 16 nt, Human
uugcuaagcauuccaa

SEQ ID NO: 1603461 - RNA, 18 nt, Human
uugcuaagcauuccaacu

SEQ ID NO: 1603462 - RNA, 20 nt, Human
uugguaaggggaauugagga

SEQ ID NO: 1603463 - RNA, 15 nt, Human
uuggucugugagaug

SEQ ID NO: 1603464 - RNA, 12 nt, Human
uuguaaaauggu

SEQ ID NO: 1603465 - RNA, 13 nt, Human
uuguaaaauggug

SEQ ID NO: 1603466 - RNA, 20 nt, Human
uuguaaaauggugugaccac

SEQ ID NO: 1603467 - RNA, 16 nt, Human
uuguaccgcaauguga

SEQ ID NO: 1603468 - RNA, 19 nt, Human
uuguacgaagaguauuuuu

SEQ ID NO: 1603469 - RNA, 16 nt, Human
uuguacgaagaguauu

SEQ ID NO: 1603470 - RNA, 18 nt, Human
uuguagcacugacagauu

SEQ ID NO: 1603471 - RNA, 17 nt, Human
uuguagcacugacagau

SEQ ID NO: 1603472 - RNA, 16 nt, Human
uuguagcacugacaga

SEQ ID NO: 1603473 - RNA, 14 nt, Human
uuguagcacugaca

SEQ ID NO: 1603474 - RNA, 22 nt, Human
uuguagcacugacagauuucca

SEQ ID NO: 1603475 - RNA, 12 nt, Human
uuuaaaaugucu

SEQ ID NO: 1603476 - RNA, 19 nt, Human
uuuaaaauacacacucaaa

SEQ ID NO: 1603477 - RNA, 16 nt, Human
uuuaaaaucauuucug

SEQ ID NO: 1603478 - RNA, 14 nt, Human
uuuaaaagaaugau

SEQ ID NO: 1603479 - RNA, 17 nt, Human
uuuaaaagaaugauuau

SEQ ID NO: 1603480 - RNA, 18 nt, Human
uuguuuaaaaucauuucu

SEQ ID NO: 1603481 - RNA, 17 nt, Human
uuguuuaaaaucauuuc

SEQ ID NO: 1603482 - RNA, 19 nt, Human
uuguucaauaauaaauauu

SEQ ID NO: 1603483 - RNA, 13 nt, Human
uuuaauaaaccau

SEQ ID NO: 1603484 - RNA, 15 nt, Human
uuuaauaauguuuca

SEQ ID NO: 1603485 - RNA, 19 nt, Human
uuuaauaauguuucaaaca

SEQ ID NO: 1603486 - RNA, 13 nt, Human
uuuacagagacag

SEQ ID NO: 1603487 - RNA, 15 nt, Human
uuuauacaggucaua

SEQ ID NO: 1603488 - RNA, 12 nt, Human
uuucucuaggaa

SEQ ID NO: 1603489 - RNA, 21 nt, Human
uuucuaacaaaaaaauauauu

SEQ ID NO: 1603490 - RNA, 17 nt, Human
uuuauggcacuaguauu

SEQ ID NO: 1603491 - RNA, 21 nt, Human
uuucacauaucuaguaugaaa

SEQ ID NO: 1603492 - RNA, 15 nt, Human
uuucacauaucuagu

SEQ ID NO: 1603493 - RNA, 18 nt, Human
uuugguaaggggaauuga

SEQ ID NO: 1603494 - RNA, 21 nt, Human
uuugaaauuguauuacaaauc

SEQ ID NO: 1603495 - RNA, 13 nt, Human
uuugaguucuaca

SEQ ID NO: 1603496 - RNA, 16 nt, Human
uuugagaguucuaaau

SEQ ID NO: 1603497 - RNA, 14 nt, Human
uucagagcugcccu

SEQ ID NO: 1603498 - RNA, 13 nt, Human
uucagagcugccc

SEQ ID NO: 1603499 - RNA, 20 nt, Human
uucagauaaucacaauacau

SEQ ID NO: 1603500 - RNA, 16 nt, Human
uucagacauagaauua

SEQ ID NO: 1603501 - RNA, 20 nt, Human
uucagacauagaauuaacac

SEQ ID NO: 1603502 - RNA, 17 nt, Human
uucaaauccuugaagau

SEQ ID NO: 1603503 - RNA, 17 nt, Human
uuauuuuaauaauguuu

SEQ ID NO: 1603504 - RNA, 15 nt, Human
uuauuuuaauaaugu

SEQ ID NO: 1603505 - RNA, 16 nt, Human
uuauuuuaauaauguu

SEQ ID NO: 1603506 - RNA, 15 nt, Human
uuauugucuagugaa

SEQ ID NO: 1603507 - RNA, 21 nt, Human
uuauggcacuaguauuucuau

SEQ ID NO: 1603508 - RNA, 16 nt, Human
uuauuacuguaagaaa

SEQ ID NO: 1603509 - RNA, 17 nt, Human
uuauuacuguaagaaaa

SEQ ID NO: 1603510 - RNA, 18 nt, Human
uuauuacuguaagaaaau

SEQ ID NO: 1603511 - RNA, 17 nt, Human
uuauggcuauaggugcu

SEQ ID NO: 1603512 - RNA, 20 nt, Human
uuauugauaaguucauacau

SEQ ID NO: 1603513 - RNA, 19 nt, Human
uuauugauaaguucauaca

SEQ ID NO: 1603514 - RNA, 15 nt, Human
uuauugauaaguuca

SEQ ID NO: 1603515 - RNA, 17 nt, Human
uucccuugaugaagaag

SEQ ID NO: 1603516 - RNA, 18 nt, Human
uucccuugaugaagaagu

SEQ ID NO: 1603517 - RNA, 20 nt, Human
uuccuuggacucauuuuaaa

SEQ ID NO: 1603518 - RNA, 12 nt, Human
uuccaaaauaau

SEQ ID NO: 1603519 - RNA, 19 nt, Human
uucaugcauagguuuagca

SEQ ID NO: 1603520 - RNA, 21 nt, Human
uuccaaaauaauuuuaagaaa

SEQ ID NO: 1603521 - RNA, 13 nt, Human
uuccaaaauaauu

SEQ ID NO: 1603522 - RNA, 19 nt, Human
uuccagauccuggaaauca

SEQ ID NO: 1603523 - RNA, 17 nt, Human
uuacuaguuucccuugc

SEQ ID NO: 1603524 - RNA, 19 nt, Human
uuagaaacacaacuauauu

SEQ ID NO: 1603525 - RNA, 18 nt, Human
uuaggauguugaaaaagu

SEQ ID NO: 1603526 - RNA, 12 nt, Human
uuagcuggaaaa

SEQ ID NO: 1603527 - RNA, 13 nt, Human
uuagcuggaaaag

SEQ ID NO: 1603528 - RNA, 20 nt, Human
uuagaugcaguucugaagaa

SEQ ID NO: 1603529 - RNA, 21 nt, Human
uuagaugcaguucugaagaag

SEQ ID NO: 1603530 - RNA, 21 nt, Human
uguuucaaacauauauaacaa

SEQ ID NO: 1603531 - RNA, 22 nt, Human
uguuucaaacauauauaacaau

SEQ ID NO: 1603532 - RNA, 19 nt, Human
uguuucaaacauauauaac

SEQ ID NO: 1603533 - RNA, 13 nt, Human
uuaaaagaaugau

SEQ ID NO: 1603534 - RNA, 15 nt, Human
uuaaaagaugaaaau

SEQ ID NO: 1603535 - RNA, 18 nt, Human
uuaaaagaugaaaauauu

SEQ ID NO: 1603536 - RNA, 21 nt, Human
uuaaaagaauauuuuaacuuc

SEQ ID NO: 1603537 - RNA, 22 nt, Human
uuaaaagaauauuuuaacuucc

SEQ ID NO: 1603538 - RNA, 22 nt, Human
uuaaugucaauucuugccaaau

SEQ ID NO: 1603539 - RNA, 21 nt, Human
uuaaugauaaguaaaugcuag

SEQ ID NO: 1603540 - RNA, 14 nt, Human
uuaauauauuucca

SEQ ID NO: 1603541 - RNA, 13 nt, Human
uuaauauauuucc

SEQ ID NO: 1603542 - RNA, 21 nt, Human
uuaagcagauggaaugcugug

SEQ ID NO: 1603543 - RNA, 20 nt, Human
uggcaauagucaaauugugu

SEQ ID NO: 1603544 - RNA, 15 nt, Human
uggcacuaguauuuc

SEQ ID NO: 1603545 - RNA, 19 nt, Human
ugggcagcugccuccccuc

SEQ ID NO: 1603546 - RNA, 17 nt, Human
ugggcagcugccucccc

SEQ ID NO: 1603547 - RNA, 15 nt, Human
ugggcagcugccucc

SEQ ID NO: 1603548 - RNA, 14 nt, Human
ugggcagcugccuc

SEQ ID NO: 1603549 - RNA, 13 nt, Human
ugggcagcugccu

SEQ ID NO: 1603550 - RNA, 16 nt, Human
uggucccagccagcag

SEQ ID NO: 1603551 - RNA, 22 nt, Human
uggucacaggaaguagaggagg

SEQ ID NO: 1603552 - RNA, 13 nt, Human
ugguauguuuuca

SEQ ID NO: 1603553 - RNA, 21 nt, Human
ugguauguuuucaggcuagau

SEQ ID NO: 1603554 - RNA, 16 nt, Human
ugccacuaaauugaca

SEQ ID NO: 1603555 - RNA, 17 nt, Human
ugcaugguuuagaaagc

SEQ ID NO: 1603556 - RNA, 13 nt, Human
ugcaucagcugcu

SEQ ID NO: 1603557 - RNA, 19 nt, Human
ugcaucagcugcugaaaca

SEQ ID NO: 1603558 - RNA, 22 nt, Human
ugcaucaauuuuucuuauuuca

SEQ ID NO: 1603559 - RNA, 12 nt, Human
ugcaguucugaa

SEQ ID NO: 1603560 - RNA, 14 nt, Human
ugcaguucugaaga

SEQ ID NO: 1603561 - RNA, 16 nt, Human
ugcauagguuuagcag

SEQ ID NO: 1603562 - RNA, 18 nt, Human
ugcuagaacucccuuuca

SEQ ID NO: 1603563 - RNA, 13 nt, Human
ugcuagaacuccc

SEQ ID NO: 1603564 - RNA, 14 nt, Human
ugcuagaacucccu

SEQ ID NO: 1603565 - RNA, 15 nt, Human
ugcuagaacucccuu

SEQ ID NO: 1603566 - RNA, 17 nt, Human
ugcuagaacucccuuuc

SEQ ID NO: 1603567 - RNA, 20 nt, Human
ugcugggggggauuguaaaa

SEQ ID NO: 1603568 - RNA, 18 nt, Human
ugcuguguuaaauaaacc

SEQ ID NO: 1603569 - RNA, 11 nt, Human
ugcuguguuaa

SEQ ID NO: 1603570 - RNA, 13 nt, Human
ugauuauauguca

SEQ ID NO: 1603571 - RNA, 17 nt, Human
ugauuaugaauuacauu

SEQ ID NO: 1603572 - RNA, 19 nt, Human
ugauuaugaauuacauuug

SEQ ID NO: 1603573 - RNA, 22 nt, Human
ugauguuuagaaacacaacuau

SEQ ID NO: 1603574 - RNA, 21 nt, Human
ugauuaugaauuacauuugua

SEQ ID NO: 1603575 - RNA, 22 nt, Human
ugauuaugaauuacauuuguau

SEQ ID NO: 1603576 - RNA, 17 nt, Human
ugaucagcuuauugucu

SEQ ID NO: 1603577 - RNA, 24 nt, Human
ugaucagcuuauugucuagugaaa

SEQ ID NO: 1603578 - RNA, 14 nt, Human
ugaucuuuaaaaua

SEQ ID NO: 1603579 - RNA, 20 nt, Human
ugaugcuacaggauuugaaa

SEQ ID NO: 1603580 - RNA, 23 nt, Human
ugaugcuacaggauuugaaauug

SEQ ID NO: 1603581 - RNA, 17 nt, Human
ugaucuuuaaaauacac

SEQ ID NO: 1603582 - RNA, 18 nt, Human
ugauguguuuauuuauag

SEQ ID NO: 1603583 - RNA, 14 nt, Human
ugauguguuuauuu

SEQ ID NO: 1603584 - RNA, 18 nt, Human
ugaggcuccacuuggucu

SEQ ID NO: 1603585 - RNA, 20 nt, Human
ugaggcuccacuuggucugu

SEQ ID NO: 1603586 - RNA, 16 nt, Human
ugauaacuggaaacuu

SEQ ID NO: 1603587 - RNA, 16 nt, Human
ugagagugaacaaauu

SEQ ID NO: 1603588 - RNA, 23 nt, Human
ugagacguuuuuggaagaguagu

SEQ ID NO: 1603589 - RNA, 19 nt, Human
ucuuuccacagaagcucca

SEQ ID NO: 1603590 - RNA, 12 nt, Human
ucuuugccaagu

SEQ ID NO: 1603591 - RNA, 16 nt, Human
ugaaauauugacuuuu

SEQ ID NO: 1603592 - RNA, 20 nt, Human
ugaaaagcuccauuuuuagu

SEQ ID NO: 1603593 - RNA, 22 nt, Human
ugaaacaacaaauaggaauugu

SEQ ID NO: 1603594 - RNA, 16 nt, Human
ugaaagguacuucaaa

SEQ ID NO: 1603595 - RNA, 15 nt, Human
ugaaagguacuucaa

SEQ ID NO: 1603596 - RNA, 18 nt, Human
ugaaacccugucucuacu

SEQ ID NO: 1603597 - RNA, 18 nt, Human
ugaaagaggcagcuugaa

SEQ ID NO: 1603598 - RNA, 13 nt, Human
ugaaguccaagca

SEQ ID NO: 1603599 - RNA, 11 nt, Human
ugaaguccaag

SEQ ID NO: 1603600 - RNA, 15 nt, Human
ugaauuacauuugua

SEQ ID NO: 1603601 - RNA, 16 nt, Human
ugaauuacauuuguau

SEQ ID NO: 1603602 - RNA, 18 nt, Human
ugaauuacauuuguauaa

SEQ ID NO: 1603603 - RNA, 16 nt, Human
ugacaugggacauuug

SEQ ID NO: 1603604 - RNA, 17 nt, Human
ugacaugggacauuugc

SEQ ID NO: 1603605 - RNA, 18 nt, Human
ugacaugggacauuugcu

SEQ ID NO: 1603606 - RNA, 20 nt, Human
ugaccacugcagaagacagu

SEQ ID NO: 1603607 - RNA, 12 nt, Human
ugacaagcucac

SEQ ID NO: 1603608 - RNA, 15 nt, Human
ugacaagcucacaga

SEQ ID NO: 1603609 - RNA, 20 nt, Human
ugacaagcucacagaccuuu

SEQ ID NO: 1603610 - RNA, 16 nt, Human
ugacagaauauguuuc

SEQ ID NO: 1603611 - RNA, 17 nt, Human
uccuggcaauagucaaa

SEQ ID NO: 1603612 - RNA, 21 nt, Human
uccugaggcuccacuuggucu

SEQ ID NO: 1603613 - RNA, 19 nt, Human
uccugaggcuccacuuggu

SEQ ID NO: 1603614 - RNA, 20 nt, Human
uccugaggcuccacuugguc

SEQ ID NO: 1603615 - RNA, 17 nt, Human
uccugccccugagccca

SEQ ID NO: 1603616 - RNA, 18 nt, Human
uccugccccugagcccau

SEQ ID NO: 1603617 - RNA, 14 nt, Human
uccuagugaaagag

SEQ ID NO: 1603618 - RNA, 23 nt, Human
uccuagugaaagaggcagcuuga

SEQ ID NO: 1603619 - RNA, 23 nt, Human
ucucaguccaugaagauguagag

SEQ ID NO: 1603620 - RNA, 12 nt, Human
ucggagaagagc

SEQ ID NO: 1603621 - RNA, 14 nt, Human
ucggagaagagcug

SEQ ID NO: 1603622 - RNA, 16 nt, Human
ucggagaagagcuguu

SEQ ID NO: 1603623 - RNA, 17 nt, Human
ucuacacuaagagagaa

SEQ ID NO: 1603624 - RNA, 21 nt, Human
uccacuuggucugugagaugc

SEQ ID NO: 1603625 - RNA, 23 nt, Human
uccacuuggucugugagaugcua

SEQ ID NO: 1603626 - RNA, 20 nt, Human
uccaugggccauaugaaaag

SEQ ID NO: 1603627 - RNA, 15 nt, Human
uccauacauuugugu

SEQ ID NO: 1603628 - RNA, 19 nt, Human
uccagguagagggugugua

SEQ ID NO: 1603629 - RNA, 17 nt, Human
ucaucaaugaaugaaug

SEQ ID NO: 1603630 - RNA, 12 nt, Human
ucauagcagcuu

SEQ ID NO: 1603631 - RNA, 11 nt, Human
ucauagcagcu

SEQ ID NO: 1603632 - RNA, 16 nt, Human
ucauuaggauggcuag

SEQ ID NO: 1603633 - RNA, 14 nt, Human
uccaaagaaaugua

SEQ ID NO: 1603634 - RNA, 17 nt, Human
uccaaagaaauguaagg

SEQ ID NO: 1603635 - RNA, 16 nt, Human
uccaaaccaaauaaaa

SEQ ID NO: 1603636 - RNA, 22 nt, Human
uccaaaaagauuuucagaaaau

SEQ ID NO: 1603637 - RNA, 19 nt, Human
uauggaggcuuugcauaga

SEQ ID NO: 1603638 - RNA, 12 nt, Human
uauguuaaaacu

SEQ ID NO: 1603639 - RNA, 19 nt, Human
uauguuagugcaaauuguc

SEQ ID NO: 1603640 - RNA, 17 nt, Human
uauguucuaagaaguga

SEQ ID NO: 1603641 - RNA, 17 nt, Human
uauuauauuuacaaaug

SEQ ID NO: 1603642 - RNA, 16 nt, Human
uauuauguuaaaacug

SEQ ID NO: 1603643 - RNA, 12 nt, Human
uauuauguguuu

SEQ ID NO: 1603644 - RNA, 14 nt, Human
uauuucuaugaaau

SEQ ID NO: 1603645 - RNA, 15 nt, Human
uauuucuaugaaaua

SEQ ID NO: 1603646 - RNA, 13 nt, Human
uauuucuaugaaa

SEQ ID NO: 1603647 - RNA, 14 nt, Human
uauuuauuacugua

SEQ ID NO: 1603648 - RNA, 20 nt, Human
uauuguuuaaaaucauuucu

SEQ ID NO: 1603649 - RNA, 15 nt, Human
uauuguuuaaaauca

SEQ ID NO: 1603650 - RNA, 16 nt, Human
uauuguuuaaaaucau

SEQ ID NO: 1603651 - RNA, 17 nt, Human
uauuguuuaaaaucauu

SEQ ID NO: 1603652 - RNA, 14 nt, Human
uauuguguugugaa

SEQ ID NO: 1603653 - RNA, 23 nt, Human
uauugauaaguucauacauugua

SEQ ID NO: 1603654 - RNA, 16 nt, Human
uauugauaaguucaua

SEQ ID NO: 1603655 - RNA, 14 nt, Human
uauugauaaguuca

SEQ ID NO: 1603656 - RNA, 14 nt, Human
ucaauaaaauccau

SEQ ID NO: 1603657 - RNA, 22 nt, Human
ucacaagacccaaaaggcagaa

SEQ ID NO: 1603658 - RNA, 12 nt, Human
ucacauuuaaau

SEQ ID NO: 1603659 - RNA, 22 nt, Human
ucaacuccaaacugacucuuaa

SEQ ID NO: 1603660 - RNA, 22 nt, Human
ucaaacagucucaggaaaucaa

SEQ ID NO: 1603661 - RNA, 17 nt, Human
ucaaacauauauaacaa

SEQ ID NO: 1603662 - RNA, 16 nt, Human
ucaaauccuugaagau

SEQ ID NO: 1603663 - RNA, 18 nt, Human
ucaaauaugcaaagcacu

SEQ ID NO: 1603664 - RNA, 19 nt, Human
ucaaauaugcaaagcacug

SEQ ID NO: 1603665 - RNA, 17 nt, Human
ucaaauaugcaaagcac

SEQ ID NO: 1603666 - RNA, 15 nt, Human
ucaaagagagaaaau

SEQ ID NO: 1603667 - RNA, 20 nt, Human
ucaaagagagaaaauaaaga

SEQ ID NO: 1603668 - RNA, 13 nt, Human
uauauaacaaugc

SEQ ID NO: 1603669 - RNA, 13 nt, Human
uauaugcuucugu

SEQ ID NO: 1603670 - RNA, 16 nt, Human
uaggucagugcaaaua

SEQ ID NO: 1603671 - RNA, 12 nt, Human
uaggaauugacc

SEQ ID NO: 1603672 - RNA, 18 nt, Human
uaggccaugggacaggga

SEQ ID NO: 1603673 - RNA, 13 nt, Human
uagucaaauugug

SEQ ID NO: 1603674 - RNA, 14 nt, Human
uagucaaauugugu

SEQ ID NO: 1603675 - RNA, 14 nt, Human
uagugcaaauuguc

SEQ ID NO: 1603676 - RNA, 15 nt, Human
uagugcaaauuguca

SEQ ID NO: 1603677 - RNA, 13 nt, Human
uaguaucaaaaga

SEQ ID NO: 1603678 - RNA, 18 nt, Human
uaggugcuacaaaaacac

SEQ ID NO: 1603679 - RNA, 18 nt, Human
uaguauuucuaugaaaua

SEQ ID NO: 1603680 - RNA, 19 nt, Human
uaguauuucuaugaaauau

SEQ ID NO: 1603681 - RNA, 13 nt, Human
uaguaugaaauua

SEQ ID NO: 1603682 - RNA, 16 nt, Human
uaguauuucuaugaaa

SEQ ID NO: 1603683 - RNA, 23 nt, Human
uaguaugaaauuauauaaguauu

SEQ ID NO: 1603684 - RNA, 15 nt, Human
uaguaugaaauuaua

SEQ ID NO: 1603685 - RNA, 16 nt, Human
uaugauucccagccag

SEQ ID NO: 1603686 - RNA, 15 nt, Human
uaugcaaagcacuga

SEQ ID NO: 1603687 - RNA, 12 nt, Human
uaugcaaagcac

SEQ ID NO: 1603688 - RNA, 13 nt, Human
uaugcaaagcacu

SEQ ID NO: 1603689 - RNA, 14 nt, Human
uaugcaaagcacug

SEQ ID NO: 1603690 - RNA, 15 nt, Human
uaugcuucuguuuua

SEQ ID NO: 1603691 - RNA, 16 nt, Human
uaugcuucuguuuuau

SEQ ID NO: 1603692 - RNA, 15 nt, Human
uauccuucagccuga

SEQ ID NO: 1603693 - RNA, 14 nt, Human
uauccuucagccug

SEQ ID NO: 1603694 - RNA, 17 nt, Human
uauccuuucuaacaaaa

SEQ ID NO: 1603695 - RNA, 17 nt, Human
uaugaauuacauuugua

SEQ ID NO: 1603696 - RNA, 23 nt, Human
uaugaauuacauuuguauaaaau

SEQ ID NO: 1603697 - RNA, 22 nt, Human
uaugacauaaaaacaacuuuau

SEQ ID NO: 1603698 - RNA, 19 nt, Human
uaugacauaaaaacaacuu

SEQ ID NO: 1603699 - RNA, 23 nt, Human
uaugacauaaaaacaacuuuaua

SEQ ID NO: 1603700 - RNA, 18 nt, Human
gugcaaauugucacagga

SEQ ID NO: 1603701 - RNA, 16 nt, Human
gugacaagcucacaga

SEQ ID NO: 1603702 - RNA, 16 nt, Human
gugagcagucaggaaa

SEQ ID NO: 1603703 - RNA, 19 nt, Human
gugaaagaaaauaacaaua

SEQ ID NO: 1603704 - RNA, 20 nt, Human
gugaaacucguuaauuugua

SEQ ID NO: 1603705 - RNA, 15 nt, Human
gugaaaauuauuuug

SEQ ID NO: 1603706 - RNA, 12 nt, Human
gugaaaauuauu

SEQ ID NO: 1603707 - RNA, 17 nt, Human
gugaaaguacauuugga

SEQ ID NO: 1603708 - RNA, 17 nt, Human
gucuacacuaagagaga

SEQ ID NO: 1603709 - RNA, 23 nt, Human
gucuaagauaguaacaaugaaga

SEQ ID NO: 1603710 - RNA, 23 nt, Human
gucuacacuaagagagaaugaga

SEQ ID NO: 1603711 - RNA, 13 nt, Human
gucugacuguuuc

SEQ ID NO: 1603712 - RNA, 20 nt, Human
gucccagccagcaguucaga

SEQ ID NO: 1603713 - RNA, 14 nt, Human
gucaccucauggaa

SEQ ID NO: 1603714 - RNA, 15 nt, Human
gucaauaaaauccau

SEQ ID NO: 1603715 - RNA, 21 nt, Human
gucaauaaaauccauacauuu

SEQ ID NO: 1603716 - RNA, 16 nt, Human
guauuuuaaaagaaug

SEQ ID NO: 1603717 - RNA, 17 nt, Human
guauuuuaaaagaauga

SEQ ID NO: 1603718 - RNA, 18 nt, Human
guauuuuaaaagaaugau

SEQ ID NO: 1603719 - RNA, 17 nt, Human
guauuucuaugaaauau

SEQ ID NO: 1603720 - RNA, 22 nt, Human
guauuucuaugaaauauuaugu

SEQ ID NO: 1603721 - RNA, 21 nt, Human
guauuugagaguucuaaauuu

SEQ ID NO: 1603722 - RNA, 19 nt, Human
guauuugagaguucuaaau

SEQ ID NO: 1603723 - RNA, 21 nt, Human
ggugcuacaaaaacacagcaa

SEQ ID NO: 1603724 - RNA, 19 nt, Human
ggugcuacaaaaacacagc

SEQ ID NO: 1603725 - RNA, 22 nt, Human
gguacuucaaauccuugaagau

SEQ ID NO: 1603726 - RNA, 15 nt, Human
gguagacacacauga

SEQ ID NO: 1603727 - RNA, 22 nt, Human
gguagacacacaugaaguccaa

SEQ ID NO: 1603728 - RNA, 14 nt, Human
guaaaaccacagca

SEQ ID NO: 1603729 - RNA, 15 nt, Human
guaaaaccacagcag

SEQ ID NO: 1603730 - RNA, 16 nt, Human
guaaaaccacagcagu

SEQ ID NO: 1603731 - RNA, 18 nt, Human
guaaaaccacagcaguug

SEQ ID NO: 1603732 - RNA, 23 nt, Human
guaaaaccacagcaguugaaaag

SEQ ID NO: 1603733 - RNA, 17 nt, Human
guaagggaaacugccag

SEQ ID NO: 1603734 - RNA, 18 nt, Human
guaagggaaacugccagc

SEQ ID NO: 1603735 - RNA, 17 nt, Human
guaaauaguauuugaga

SEQ ID NO: 1603736 - RNA, 16 nt, Human
guaaauaguauuugag

SEQ ID NO: 1603737 - RNA, 15 nt, Human
guaaauaguauuuga

SEQ ID NO: 1603738 - RNA, 19 nt, Human
guaaugauaacuggaaacu

SEQ ID NO: 1603739 - RNA, 15 nt, Human
guaauuggaaaggca

SEQ ID NO: 1603740 - RNA, 14 nt, Human
guaauucaagaaaa

SEQ ID NO: 1603741 - RNA, 13 nt, Human
guaauucaagaaa

SEQ ID NO: 1603742 - RNA, 23 nt, Human
guacuuuauuuucuauaauuuaa

SEQ ID NO: 1603743 - RNA, 15 nt, Human
guagaggagaaacug

SEQ ID NO: 1603744 - RNA, 15 nt, Human
guaccgcaaugugac

SEQ ID NO: 1603745 - RNA, 15 nt, Human
guacgaagaguauuu

SEQ ID NO: 1603746 - RNA, 22 nt, Human
gccuauauuuuuuguuaaauga

SEQ ID NO: 1603747 - RNA, 17 nt, Human
gccuaagugcagccccg

SEQ ID NO: 1603748 - RNA, 23 nt, Human
gcccucuccugggcagcugccuc

SEQ ID NO: 1603749 - RNA, 22 nt, Human
gcccucuccugggcagcugccu

SEQ ID NO: 1603750 - RNA, 14 nt, Human
gcccucuccugggc

SEQ ID NO: 1603751 - RNA, 13 nt, Human
gcccucuccuggg

SEQ ID NO: 1603752 - RNA, 12 nt, Human
gcccucuccugg

SEQ ID NO: 1603753 - RNA, 20 nt, Human
gcuccauuuuuagugaaaua

SEQ ID NO: 1603754 - RNA, 14 nt, Human
gcuaagcauuccaa

SEQ ID NO: 1603755 - RNA, 17 nt, Human
gcuaagcaaaaugugau

SEQ ID NO: 1603756 - RNA, 11 nt, Human
gcucucuggcc

SEQ ID NO: 1603757 - RNA, 12 nt, Human
gcucucuggccu

SEQ ID NO: 1603758 - RNA, 13 nt, Human
gcucucuggccuu

SEQ ID NO: 1603759 - RNA, 14 nt, Human
gcucucuggccuuc

SEQ ID NO: 1603760 - RNA, 15 nt, Human
gcucucuggccuucg

SEQ ID NO: 1603761 - RNA, 19 nt, Human
gcucucuggccuucggccu

SEQ ID NO: 1603762 - RNA, 20 nt, Human
gcucucuggccuucggccuc

SEQ ID NO: 1603763 - RNA, 17 nt, Human
ggauuagggagagaaga

SEQ ID NO: 1603764 - RNA, 15 nt, Human
ggauuguaaaauggu

SEQ ID NO: 1603765 - RNA, 14 nt, Human
ggcauggcugggaa

SEQ ID NO: 1603766 - RNA, 20 nt, Human
gcugucuacacuaagagaga

SEQ ID NO: 1603767 - RNA, 17 nt, Human
ggaaaucaaauaugcaa

SEQ ID NO: 1603768 - RNA, 14 nt, Human
gcuuuaucaaaggg

SEQ ID NO: 1603769 - RNA, 15 nt, Human
ggagaaucacuugaa

SEQ ID NO: 1603770 - RNA, 19 nt, Human
ggagaaucacuugaacccg

SEQ ID NO: 1603771 - RNA, 15 nt, Human
ggacgcucucuggcc

SEQ ID NO: 1603772 - RNA, 13 nt, Human
ggacgcucucugg

SEQ ID NO: 1603773 - RNA, 14 nt, Human
ggacgcucucuggc

SEQ ID NO: 1603774 - RNA, 16 nt, Human
ggacauuugcucaugg

SEQ ID NO: 1603775 - RNA, 20 nt, Human
ggaagugacgguuuaauggg

SEQ ID NO: 1603776 - RNA, 16 nt, Human
ggaauuggagcucgug

SEQ ID NO: 1603777 - RNA, 22 nt, Human
ggaauuggagcucgugggacag

SEQ ID NO: 1603778 - RNA, 23 nt, Human
ggaauuucucccagucauuuaau

SEQ ID NO: 1603779 - RNA, 14 nt, Human
ggaaugcuguguua

SEQ ID NO: 1603780 - RNA, 19 nt, Human
gaggcagagguugcaguga

SEQ ID NO: 1603781 - RNA, 22 nt, Human
gauaaauggcuuccuggcaaua

SEQ ID NO: 1603782 - RNA, 19 nt, Human
gagugucuuaauuaaaaga

SEQ ID NO: 1603783 - RNA, 18 nt, Human
gaguguacuuaacuauuc

SEQ ID NO: 1603784 - RNA, 19 nt, Human
gcacuguggguagacacac

SEQ ID NO: 1603785 - RNA, 15 nt, Human
gcacugacuucuaag

SEQ ID NO: 1603786 - RNA, 18 nt, Human
gcacugacuucuaaguaa

SEQ ID NO: 1603787 - RNA, 14 nt, Human
gcaauuucauaugc

SEQ ID NO: 1603788 - RNA, 18 nt, Human
gaugcuagaacucccuuu

SEQ ID NO: 1603789 - RNA, 20 nt, Human
gaugcuagaacucccuuuca

SEQ ID NO: 1603790 - RNA, 22 nt, Human
gaugcuagaacucccuuucaac

SEQ ID NO: 1603791 - RNA, 22 nt, Human
gaugguucccuugaugaagaag

SEQ ID NO: 1603792 - RNA, 16 nt, Human
gcaaauugucacagga

SEQ ID NO: 1603793 - RNA, 23 nt, Human
gcaaagcacugacuucuaaguaa

SEQ ID NO: 1603794 - RNA, 21 nt, Human
gcaaagcugaugacaacuucc

SEQ ID NO: 1603795 - RNA, 17 nt, Human
gacaugggacauuugcu

SEQ ID NO: 1603796 - RNA, 16 nt, Human
gacaugggacauuugc

SEQ ID NO: 1603797 - RNA, 21 nt, Human
gaccacugcagaagacaguau

SEQ ID NO: 1603798 - RNA, 16 nt, Human
gacccaaaaggcagaa

SEQ ID NO: 1603799 - RNA, 15 nt, Human
gacccacaagaaaug

SEQ ID NO: 1603800 - RNA, 22 nt, Human
gacccacaagaaaugaaagcag

SEQ ID NO: 1603801 - RNA, 20 nt, Human
gacauagaauuaacacauga

SEQ ID NO: 1603802 - RNA, 18 nt, Human
gacagggaggacgcucuc

SEQ ID NO: 1603803 - RNA, 17 nt, Human
gacagggaggacgcucu

SEQ ID NO: 1603804 - RNA, 16 nt, Human
gacaaggaaaaaauaa

SEQ ID NO: 1603805 - RNA, 13 nt, Human
gacacaacuauuu

SEQ ID NO: 1603806 - RNA, 18 nt, Human
gaaucucauaauuuauac

SEQ ID NO: 1603807 - RNA, 14 nt, Human
gaaugcuguguuaa

SEQ ID NO: 1603808 - RNA, 13 nt, Human
gaaugcuguguua

SEQ ID NO: 1603809 - RNA, 19 nt, Human
gaaucucauaauuuauaca

SEQ ID NO: 1603810 - RNA, 14 nt, Human
gaauguuaagcaga

SEQ ID NO: 1603811 - RNA, 15 nt, Human
gaauguuaagcagau

SEQ ID NO: 1603812 - RNA, 16 nt, Human
gaauuggagcucgugg

SEQ ID NO: 1603813 - RNA, 16 nt, Human
gaauugacccacaaga

SEQ ID NO: 1603814 - RNA, 21 nt, Human
gaauugacccacaagaaauga

SEQ ID NO: 1603815 - RNA, 18 nt, Human
gaauucuugaaggaaaau

SEQ ID NO: 1603816 - RNA, 17 nt, Human
gagaaugagagacacac

SEQ ID NO: 1603817 - RNA, 13 nt, Human
gagaagagcuguu

SEQ ID NO: 1603818 - RNA, 22 nt, Human
gagaacuuccagauccuggaaa

SEQ ID NO: 1603819 - RNA, 23 nt, Human
gagaacuuccagauccuggaaau

SEQ ID NO: 1603820 - RNA, 21 nt, Human
gagaaccuagggugauauuaa

SEQ ID NO: 1603821 - RNA, 22 nt, Human
gagaaccuagggugauauuaac

SEQ ID NO: 1603822 - RNA, 16 nt, Human
gacuucuaaguaaaac

SEQ ID NO: 1603823 - RNA, 17 nt, Human
gacuucuaaguaaaacc

SEQ ID NO: 1603824 - RNA, 18 nt, Human
gacuucuaaguaaaacca

SEQ ID NO: 1603825 - RNA, 24 nt, Human
gacuucuaaguaaaaccacagcag

SEQ ID NO: 1603826 - RNA, 19 nt, Human
gacuucuaaguaaaaccac

SEQ ID NO: 1603827 - RNA, 23 nt, Human
gacuucuaaguaaaaccacagca

SEQ ID NO: 1603828 - RNA, 20 nt, Human
gacuucugucuucacaacag

SEQ ID NO: 1603829 - RNA, 23 nt, Human
gacuucugucuucacaacagauu

SEQ ID NO: 1603830 - RNA, 24 nt, Human
gacugcauuauauuuauuacugua

SEQ ID NO: 1603831 - RNA, 14 nt, Human
gacugcauuauauu

SEQ ID NO: 1603832 - RNA, 16 nt, Human
gacugcauuauauuua

SEQ ID NO: 1603833 - RNA, 16 nt, Human
gacuccaaagaaaugu

SEQ ID NO: 1603834 - RNA, 18 nt, Human
gacuccaaagaaauguaa

SEQ ID NO: 1603835 - RNA, 21 nt, Human
gacucauuuuaaaaaauggaa

SEQ ID NO: 1603836 - RNA, 11 nt, Human
gacuccaaaga

SEQ ID NO: 1603837 - RNA, 12 nt, Human
gacuccaaagaa

SEQ ID NO: 1603838 - RNA, 15 nt, Human
gacuccaaagaaaug

SEQ ID NO: 1603839 - RNA, 20 nt, Human
gagaaugagagacacacuga

SEQ ID NO: 1603840 - RNA, 21 nt, Human
gagaaugagagacacacugaa

SEQ ID NO: 1603841 - RNA, 20 nt, Human
gagacagcucugcauacuca

SEQ ID NO: 1603842 - RNA, 15 nt, Human
gagaguagaacagau

SEQ ID NO: 1603843 - RNA, 21 nt, Human
cuggcacaguuuucugagaaa

SEQ ID NO: 1603844 - RNA, 22 nt, Human
cuggcacaguuuucugagaaag

SEQ ID NO: 1603845 - RNA, 22 nt, Human
cuggccuucggccuccauccug

SEQ ID NO: 1603846 - RNA, 23 nt, Human
cuggccuucggccuccauccuga

SEQ ID NO: 1603847 - RNA, 16 nt, Human
cuggagcucugcccau

SEQ ID NO: 1603848 - RNA, 13 nt, Human
cuggagcucugcc

SEQ ID NO: 1603849 - RNA, 21 nt, Human
cugcccucuccugggcagcug

SEQ ID NO: 1603850 - RNA, 20 nt, Human
cugcccucuccugggcagcu

SEQ ID NO: 1603851 - RNA, 19 nt, Human
cugcccucuccugggcagc

SEQ ID NO: 1603852 - RNA, 18 nt, Human
cugcccucuccugggcag

SEQ ID NO: 1603853 - RNA, 16 nt, Human
cugcccucuccugggc

SEQ ID NO: 1603854 - RNA, 13 nt, Human
cugccuccccucc

SEQ ID NO: 1603855 - RNA, 14 nt, Human
cugccuccccuccu

SEQ ID NO: 1603856 - RNA, 22 nt, Human
cugggggggauuguaaaauggu

SEQ ID NO: 1603857 - RNA, 23 nt, Human
cuguaaucacagcuacuugggag

SEQ ID NO: 1603858 - RNA, 22 nt, Human
cuguauuuuaaaagaaugauua

SEQ ID NO: 1603859 - RNA, 20 nt, Human
cuguauuuuaaaagaaugau

SEQ ID NO: 1603860 - RNA, 21 nt, Human
cuguuaaaagaugaaaauauu

SEQ ID NO: 1603861 - RNA, 23 nt, Human
cuguuaaaagaugaaaauauuug

SEQ ID NO: 1603862 - RNA, 20 nt, Human
cuguuaaaagaugaaaauau

SEQ ID NO: 1603863 - RNA, 18 nt, Human
cuucugucuucacaacag

SEQ ID NO: 1603864 - RNA, 21 nt, Human
cuucugucuucacaacagauu

SEQ ID NO: 1603865 - RNA, 22 nt, Human
cuucugucuucacaacagauua

SEQ ID NO: 1603866 - RNA, 14 nt, Human
cuugaacccgggag

SEQ ID NO: 1603867 - RNA, 14 nt, Human
cuucugugaaagua

SEQ ID NO: 1603868 - RNA, 19 nt, Human
cuuauaggaauugacccac

SEQ ID NO: 1603869 - RNA, 22 nt, Human
cuuagaugcaguucugaagaag

SEQ ID NO: 1603870 - RNA, 14 nt, Human
cuuauuucauuucu

SEQ ID NO: 1603871 - RNA, 15 nt, Human
cuuauuucauuucuu

SEQ ID NO: 1603872 - RNA, 13 nt, Human
cuucccuuucugc

SEQ ID NO: 1603873 - RNA, 16 nt, Human
cuuucugcuuguguua

SEQ ID NO: 1603874 - RNA, 17 nt, Human
cuuguacuuuauuuucu

SEQ ID NO: 1603875 - RNA, 23 nt, Human
cuugucaauaaaauccauacauu

SEQ ID NO: 1603876 - RNA, 19 nt, Human
cuugaguuuaaauuguaau

SEQ ID NO: 1603877 - RNA, 22 nt, Human
cuuuaucaaagggugaaaauua

SEQ ID NO: 1603878 - RNA, 21 nt, Human
cuuuaucaaagggugaaaauu

SEQ ID NO: 1603879 - RNA, 21 nt, Human
gaaagcuugcccuggugccuc

SEQ ID NO: 1603880 - RNA, 14 nt, Human
gaaagcagggacuu

SEQ ID NO: 1603881 - RNA, 22 nt, Human
gaaagcagaacagugauuacca

SEQ ID NO: 1603882 - RNA, 17 nt, Human
gaaagcagaacagugau

SEQ ID NO: 1603883 - RNA, 20 nt, Human
gaaagaggcagcuugaaacu

SEQ ID NO: 1603884 - RNA, 21 nt, Human
gaaagaggaaugaaguacuca

SEQ ID NO: 1603885 - RNA, 17 nt, Human
gaaagagaacuuccaga

SEQ ID NO: 1603886 - RNA, 23 nt, Human
gaaacucguuaauuuguaguguu

SEQ ID NO: 1603887 - RNA, 14 nt, Human
gaaacccugucucu

SEQ ID NO: 1603888 - RNA, 16 nt, Human
gaaacacaacuauauu

SEQ ID NO: 1603889 - RNA, 20 nt, Human
gaaaaugauacgcaacauaa

SEQ ID NO: 1603890 - RNA, 18 nt, Human
gaaaaucuuauaauuuaa

SEQ ID NO: 1603891 - RNA, 22 nt, Human
gaaaaucuacacuccagugaga

SEQ ID NO: 1603892 - RNA, 18 nt, Human
gaaaauauuuguaucaca

SEQ ID NO: 1603893 - RNA, 21 nt, Human
gaaaauauuauguguuuccau

SEQ ID NO: 1603894 - RNA, 17 nt, Human
ccugccccugagcccau

SEQ ID NO: 1603895 - RNA, 13 nt, Human
ccugaaagaggaa

SEQ ID NO: 1603896 - RNA, 17 nt, Human
ccugaggcuccacuugg

SEQ ID NO: 1603897 - RNA, 13 nt, Human
ccugaggcuccac

SEQ ID NO: 1603898 - RNA, 14 nt, Human
ccugaggcuccacu

SEQ ID NO: 1603899 - RNA, 14 nt, Human
ccugggcagcugcc

SEQ ID NO: 1603900 - RNA, 13 nt, Human
ccugggcagcugc

SEQ ID NO: 1603901 - RNA, 17 nt, Human
ccuucggccuccauccu

SEQ ID NO: 1603902 - RNA, 19 nt, Human
ccuucggccuccauccuga

SEQ ID NO: 1603903 - RNA, 18 nt, Human
ccuucggccuccauccug

SEQ ID NO: 1603904 - RNA, 15 nt, Human
ccuuggacucauuuu

SEQ ID NO: 1603905 - RNA, 22 nt, Human
cucaggaaaucaaauaugcaaa

SEQ ID NO: 1603906 - RNA, 14 nt, Human
cuccccucggagaa

SEQ ID NO: 1603907 - RNA, 12 nt, Human
cucauuuccaag

SEQ ID NO: 1603908 - RNA, 13 nt, Human
cucauuuccaagc

SEQ ID NO: 1603909 - RNA, 14 nt, Human
cucauuuccaagca

SEQ ID NO: 1603910 - RNA, 17 nt, Human
cucauuuccaagcaagu

SEQ ID NO: 1603911 - RNA, 21 nt, Human
cucauaaaaagccugcaauuu

SEQ ID NO: 1603912 - RNA, 12 nt, Human
cucaaauuugga

SEQ ID NO: 1603913 - RNA, 19 nt, Human
cuaugaaauauuauguuaa

SEQ ID NO: 1603914 - RNA, 13 nt, Human
cuauaauuuaaau

SEQ ID NO: 1603915 - RNA, 12 nt, Human
cuauaauuuaaa

SEQ ID NO: 1603916 - RNA, 21 nt, Human
cuauucaggagaguagaacag

SEQ ID NO: 1603917 - RNA, 18 nt, Human
cuagaguuuagcuggaaa

SEQ ID NO: 1603918 - RNA, 19 nt, Human
cuagaguuuagcuggaaaa

SEQ ID NO: 1603919 - RNA, 15 nt, Human
cuauaggugcuacaa

SEQ ID NO: 1603920 - RNA, 14 nt, Human
cuaggaaauauuua

SEQ ID NO: 1603921 - RNA, 15 nt, Human
cuaggaaauauuuau

SEQ ID NO: 1603922 - RNA, 19 nt, Human
cuaggaaauauuuauuuua

SEQ ID NO: 1603923 - RNA, 20 nt, Human
cuaggaaauauuuauuuuaa

SEQ ID NO: 1603924 - RNA, 22 nt, Human
cuagcuaauguaauaacuguga

SEQ ID NO: 1603925 - RNA, 22 nt, Human
cuaggaaauauuuauuuuaaua

SEQ ID NO: 1603926 - RNA, 19 nt, Human
cuaaguaaaaccacagcag

SEQ ID NO: 1603927 - RNA, 14 nt, Human
cuaaguaaaaccac

SEQ ID NO: 1603928 - RNA, 18 nt, Human
cuaaguaaaaccacagca

SEQ ID NO: 1603929 - RNA, 21 nt, Human
cuaagcuucacuguaaaauaa

SEQ ID NO: 1603930 - RNA, 23 nt, Human
cuacacgagauacagaauuuuau

SEQ ID NO: 1603931 - RNA, 14 nt, Human
cuacacuaagagag

SEQ ID NO: 1603932 - RNA, 20 nt, Human
cgggaggcagagguugcagu

SEQ ID NO: 1603933 - RNA, 19 nt, Human
cuaaauugacacuuaaaaa

SEQ ID NO: 1603934 - RNA, 13 nt, Human
cuaaauuuuauau

SEQ ID NO: 1603935 - RNA, 16 nt, Human
cuaaauuuuauaucuu

SEQ ID NO: 1603936 - RNA, 15 nt, Human
cuaaauuuuauaucu

SEQ ID NO: 1603937 - RNA, 20 nt, Human
cuaaauuuuauaucuuguag

SEQ ID NO: 1603938 - RNA, 14 nt, Human
cuaagagagaauga

SEQ ID NO: 1603939 - RNA, 15 nt, Human
cuaagagagaaugag

SEQ ID NO: 1603940 - RNA, 16 nt, Human
cuaagauaguaacaau

SEQ ID NO: 1603941 - RNA, 17 nt, Human
ccccuccucugcuugcc

SEQ ID NO: 1603942 - RNA, 14 nt, Human
ccccuccucugcuu

SEQ ID NO: 1603943 - RNA, 13 nt, Human
ccccuccucugcu

SEQ ID NO: 1603944 - RNA, 15 nt, Human
ccccucggagaagag

SEQ ID NO: 1603945 - RNA, 15 nt, Human
cccuugaugaagaag

SEQ ID NO: 1603946 - RNA, 12 nt, Human
cccucccuccac

SEQ ID NO: 1603947 - RNA, 22 nt, Human
cccucuccugggcagcugccuc

SEQ ID NO: 1603948 - RNA, 21 nt, Human
cccucuccugggcagcugccu

SEQ ID NO: 1603949 - RNA, 20 nt, Human
cccucuccugggcagcugcc

SEQ ID NO: 1603950 - RNA, 23 nt, Human
cccucuccugggcagcugccucc

SEQ ID NO: 1603951 - RNA, 15 nt, Human
ccuaacgaaguaucc

SEQ ID NO: 1603952 - RNA, 14 nt, Human
ccagacaucaacag

SEQ ID NO: 1603953 - RNA, 15 nt, Human
ccacugguucuucuu

SEQ ID NO: 1603954 - RNA, 21 nt, Human
ccaccucccugcaauaaaaug

SEQ ID NO: 1603955 - RNA, 19 nt, Human
ccaccucccugcaauaaaa

SEQ ID NO: 1603956 - RNA, 15 nt, Human
ccaccucccugcaau

SEQ ID NO: 1603957 - RNA, 20 nt, Human
ccagguagaggguguguaag

SEQ ID NO: 1603958 - RNA, 20 nt, Human
ccauccugaggcuccacuug

SEQ ID NO: 1603959 - RNA, 18 nt, Human
ccauccugaggcuccacu

SEQ ID NO: 1603960 - RNA, 12 nt, Human
ccaggugccagu

SEQ ID NO: 1603961 - RNA, 13 nt, Human
ccaggugccaguu

SEQ ID NO: 1603962 - RNA, 23 nt, Human
ccagugaauucuugaaggaaaau

SEQ ID NO: 1603963 - RNA, 17 nt, Human coronavirus OC43 [HCoV-OC43]
acuaguuauauuaauga

SEQ ID NO: 1603964 - RNA, 15 nt, Human coronavirus OC43 [HCoV-OC43]
caacuugauguguau

SEQ ID NO: 1603965 - RNA, 14 nt, Human coronavirus OC43 [HCoV-OC43]
ucuauuuauguguu

SEQ ID NO: 1603966 - RNA, 19 nt, Human coronavirus OC43 [HCoV-OC43]
ccagcauugcuauuucgga

SEQ ID NO: 1603967 - RNA, 21 nt, Human coronavirus OC43 [HCoV-OC43]
acagacauaauucuugguguu

SEQ ID NO: 1603968 - RNA, 16 nt, Human coronavirus OC43 [HCoV-OC43]
guacagguuguugauu

SEQ ID NO: 1603969 - RNA, 17 nt, Human coronavirus OC43 [HCoV-OC43]
auaaaggcuuguuuuau

SEQ ID NO: 1603970 - RNA, 18 nt, Human coronavirus OC43 [HCoV-OC43]
agaacucgcacccacagc

SEQ ID NO: 1603971 - RNA, 16 nt, Human coronavirus OC43 [HCoV-OC43]
aggcagacucauuuac

SEQ ID NO: 1603972 - RNA, 17 nt, Human coronavirus OC43 [HCoV-OC43]
guagagccaauucuggc

SEQ ID NO: 1603973 - RNA, 15 nt, Human coronavirus OC43 [HCoV-OC43]
guaugaugaauauga

SEQ ID NO: 1603974 - RNA, 15 nt, Human coronavirus OC43 [HCoV-OC43]
uugaauaauguguau

SEQ ID NO: 1603975 - RNA, 22 nt, Human coronavirus OC43 [HCoV-OC43]
ugcaggaucgcguaguagagcc

SEQ ID NO: 1603976 - RNA, 13 nt, Human coronavirus OC43 [HCoV-OC43]
gaagcugauuuuu

SEQ ID NO: 1603977 - RNA, 19 nt, Human coronavirus OC43 [HCoV-OC43]
caggaguuaaauguuuaug

SEQ ID NO: 1603978 - RNA, 12 nt, Human coronavirus OC43 [HCoV-OC43]
cagugcccaaaa

SEQ ID NO: 1603979 - RNA, 22 nt, Human coronavirus OC43 [HCoV-OC43]
guaucagguuguuuauuagaac

SEQ ID NO: 1603980 - RNA, 22 nt, Human coronavirus OC43 [HCoV-OC43]
uauaaguguugcagugcccaaa

SEQ ID NO: 1603981 - RNA, 22 nt, Human coronavirus OC43 [HCoV-OC43]
auuucaaaugagcuauuguuaa

SEQ ID NO: 1603982 - RNA, 16 nt, Human coronavirus OC43 [HCoV-OC43]
uuaauuucaauguaga

SEQ ID NO: 1603983 - RNA, 18 nt, Human coronavirus OC43 [HCoV-OC43]
uacaggaaaaguuuucau

SEQ ID NO: 1603984 - RNA, 14 nt, Human coronavirus OC43 [HCoV-OC43]
uuuuaugcauauuu

SEQ ID NO: 1603985 - RNA, 19 nt, Human coronavirus OC43 [HCoV-OC43]
gauuauauaaauguuacau

SEQ ID NO: 1603986 - RNA, 13 nt, Human coronavirus OC43 [HCoV-OC43]
augcauaguuuua

SEQ ID NO: 1603987 - RNA, 18 nt, Human coronavirus OC43 [HCoV-OC43]
gcagacucuuguuuacaa

SEQ ID NO: 1603988 - RNA, 16 nt, Human coronavirus OC43 [HCoV-OC43]
uacuaaguaugucaca

SEQ ID NO: 1603989 - RNA, 19 nt, Human coronavirus OC43 [HCoV-OC43]
auuaugcagcauguaaauc

SEQ ID NO: 1603990 - RNA, 22 nt, Human coronavirus OC43 [HCoV-OC43]
agagaguugacugcagaggaca

SEQ ID NO: 1603991 - RNA, 17 nt, Human coronavirus OC43 [HCoV-OC43]
acagcucuuuguaaauc

SEQ ID NO: 1603992 - RNA, 21 nt, Human coronavirus OC43 [HCoV-OC43]
acacugguaaaauuuagugca

SEQ ID NO: 1603993 - RNA, 18 nt, Human coronavirus OC43 [HCoV-OC43]
gauuauuuguauuuucau

SEQ ID NO: 1603994 - RNA, 22 nt, Human coronavirus OC43 [HCoV-OC43]
uuauauggaccuuaauccuguu

SEQ ID NO: 1603995 - RNA, 16 nt, Human coronavirus OC43 [HCoV-OC43]
acccccauaauuauuc

SEQ ID NO: 1603996 - RNA, 14 nt, Human coronavirus OC43 [HCoV-OC43]
auuaguugaaaguu

SEQ ID NO: 1603997 - RNA, 21 nt, Human coronavirus OC43 [HCoV-OC43]
aaagcuccuaaaaauuucugu

SEQ ID NO: 1603998 - RNA, 17 nt, Human coronavirus OC43 [HCoV-OC43]
gucccagcuacugaagc

SEQ ID NO: 1603999 - RNA, 19 nt, Human coronavirus OC43 [HCoV-OC43]
cucucuaucagaauggaug

SEQ ID NO: 1604000 - RNA, 19 nt, Human coronavirus OC43 [HCoV-OC43]
caguguuuugguaagagag

SEQ ID NO: 1604001 - RNA, 13 nt, Human coronavirus OC43 [HCoV-OC43]
cuugauguggaug

SEQ ID NO: 1604002 - RNA, 12 nt, Human coronavirus OC43 [HCoV-OC43]
agggaagagcca

SEQ ID NO: 1604003 - RNA, 20 nt, Human coronavirus OC43 [HCoV-OC43]
guaauccaaacauuaugagu

SEQ ID NO: 1604004 - RNA, 16 nt, Human coronavirus OC43 [HCoV-OC43]
caggaguuaaauguuu

SEQ ID NO: 1604005 - RNA, 18 nt, Human coronavirus OC43 [HCoV-OC43]
aggugguuuguaugaaau

SEQ ID NO: 1604006 - RNA, 19 nt, Human coronavirus OC43 [HCoV-OC43]
gguuuuaaugucucagaau

SEQ ID NO: 1604007 - RNA, 20 nt, Human coronavirus OC43 [HCoV-OC43]
uuugauaaaguaaaguuauc

SEQ ID NO: 1604008 - RNA, 19 nt, Human coronavirus OC43 [HCoV-OC43]
gaugcaacuaauucugcuu

SEQ ID NO: 1604009 - RNA, 23 nt, Human coronavirus OC43 [HCoV-OC43]
uuuaacggcaaguuuuugucgaa

SEQ ID NO: 1604010 - RNA, 23 nt, Human coronavirus OC43 [HCoV-OC43]
aucagaauggaugucuugcugcu

SEQ ID NO: 1604011 - RNA, 20 nt, Human coronavirus OC43 [HCoV-OC43]
aggcacucucuaucagaaug

SEQ ID NO: 1604012 - RNA, 14 nt, Human coronavirus OC43 [HCoV-OC43]
ggaaaauguugauu

SEQ ID NO: 1604013 - RNA, 15 nt, Human coronavirus OC43 [HCoV-OC43]
guaugagugauuuua

SEQ ID NO: 1604014 - RNA, 20 nt, Human coronavirus OC43 [HCoV-OC43]
aauuguuugggguuuuauga

SEQ ID NO: 1604015 - RNA, 14 nt, Human coronavirus OC43 [HCoV-OC43]
agccccgccagaag

SEQ ID NO: 1604016 - RNA, 16 nt, Human coronavirus OC43 [HCoV-OC43]
agucaauauuauuuua

SEQ ID NO: 1604017 - RNA, 15 nt, Human coronavirus OC43 [HCoV-OC43]
uagugacccacaguu

SEQ ID NO: 1604018 - RNA, 16 nt, Human coronavirus OC43 [HCoV-OC43]
gaggcaauucuuguac

SEQ ID NO: 1604019 - RNA, 15 nt, Human coronavirus OC43 [HCoV-OC43]
ccauuauuaugugga

SEQ ID NO: 1604020 - RNA, 19 nt, Human coronavirus OC43 [HCoV-OC43]
guagagcguccucuggaaa

SEQ ID NO: 1604021 - RNA, 19 nt, Human coronavirus OC43 [HCoV-OC43]
agacaggaguuaaauguuu

SEQ ID NO: 1604022 - RNA, 22 nt, Human coronavirus OC43 [HCoV-OC43]
ggaugccacuaaaccucagcaa

SEQ ID NO: 1604023 - RNA, 15 nt, Human coronavirus OC43 [HCoV-OC43]
guggucauaagaaug

SEQ ID NO: 1604024 - RNA, 15 nt, Human coronavirus OC43 [HCoV-OC43]
uaauauuuuugcuaa

SEQ ID NO: 1604025 - RNA, 13 nt, Human coronavirus OC43 [HCoV-OC43]
uguucuacugauu

SEQ ID NO: 1604026 - RNA, 18 nt, Human coronavirus OC43 [HCoV-OC43]
auaagccccgccagaaga

SEQ ID NO: 1604027 - RNA, 20 nt, Human coronavirus OC43 [HCoV-OC43]
agcuccuaaaaauuucuguc

SEQ ID NO: 1604028 - RNA, 19 nt, Human coronavirus OC43 [HCoV-OC43]
aguagagcguccucuggaa

SEQ ID NO: 1604029 - RNA, 18 nt, Human coronavirus OC43 [HCoV-OC43]
ugagcccuauacugaaga

SEQ ID NO: 1604030 - RNA, 23 nt, Human coronavirus OC43 [HCoV-OC43]
aggcgaaggucaacaaauuauuu

SEQ ID NO: 1604031 - RNA, 15 nt, Human coronavirus OC43 [HCoV-OC43]
acagacacugguguu

SEQ ID NO: 1604032 - RNA, 14 nt, Human coronavirus OC43 [HCoV-OC43]
aaauguuuuugcuu

SEQ ID NO: 1604033 - RNA, 17 nt, Human coronavirus OC43 [HCoV-OC43]
ugcccaagggaagagcc

SEQ ID NO: 1604034 - RNA, 13 nt, Human coronavirus OC43 [HCoV-OC43]
cuagguacuggcu

SEQ ID NO: 1604035 - RNA, 16 nt, Human coronavirus OC43 [HCoV-OC43]
ucauaagaauggacaa

SEQ ID NO: 1604036 - RNA, 20 nt, Human coronavirus OC43 [HCoV-OC43]
uaaauacuacguuguuucuu

SEQ ID NO: 1604037 - RNA, 23 nt, Human coronavirus OC43 [HCoV-OC43]
cauuaugauaaauauuuuggagu

SEQ ID NO: 1604038 - RNA, 14 nt, Human coronavirus OC43 [HCoV-OC43]
gcauccucaagugg

SEQ ID NO: 1604039 - RNA, 14 nt, Human coronavirus OC43 [HCoV-OC43]
accaagguuauuaa

SEQ ID NO: 1604040 - RNA, 16 nt, Human coronavirus OC43 [HCoV-OC43]
ugugguaguacaacca

SEQ ID NO: 1604041 - RNA, 14 nt, Human coronavirus OC43 [HCoV-OC43]
acuaggcugcauga

SEQ ID NO: 1604042 - RNA, 17 nt, Human coronavirus OC43 [HCoV-OC43]
cuauguugguguuuaug

SEQ ID NO: 1604043 - RNA, 20 nt, Human coronavirus OC43 [HCoV-OC43]
aagugaaagacuugcggaag

SEQ ID NO: 1604044 - RNA, 19 nt, Human coronavirus OC43 [HCoV-OC43]
guuuauuagaacuggaagu

SEQ ID NO: 1604045 - RNA, 17 nt, Human coronavirus OC43 [HCoV-OC43]
aagucgcaguauguuug

SEQ ID NO: 1604046 - RNA, 19 nt, Human coronavirus OC43 [HCoV-OC43]
uauauugaaggcucaggaa

SEQ ID NO: 1604047 - RNA, 14 nt, Human coronavirus OC43 [HCoV-OC43]
uugcgauuguaauu

SEQ ID NO: 1604048 - RNA, 16 nt, Human coronavirus OC43 [HCoV-OC43]
gaugugaaugcugauu

SEQ ID NO: 1604049 - RNA, 16 nt, Human coronavirus OC43 [HCoV-OC43]
uucuaaugguaaucuc

SEQ ID NO: 1604050 - RNA, 21 nt, Human coronavirus OC43 [HCoV-OC43]
caagaaauucuaucuagacuu

SEQ ID NO: 1604051 - RNA, 22 nt, Human coronavirus OC43 [HCoV-OC43]
cuugguguuuguguuaauuaug

SEQ ID NO: 1604052 - RNA, 12 nt, Human coronavirus OC43 [HCoV-OC43]
gauuauuauuau

SEQ ID NO: 1604053 - RNA, 19 nt, Human coronavirus OC43 [HCoV-OC43]
gcagaauuuaucugggaau

SEQ ID NO: 1604054 - RNA, 19 nt, Human coronavirus OC43 [HCoV-OC43]
guaccacuuuguauuuuua

SEQ ID NO: 1604055 - RNA, 20 nt, Human coronavirus OC43 [HCoV-OC43]
gauuguguauuuugugaaua

SEQ ID NO: 1604056 - RNA, 17 nt, Human coronavirus OC43 [HCoV-OC43]
uaaugguauuuuugcua

SEQ ID NO: 1604057 - RNA, 14 nt, Human coronavirus OC43 [HCoV-OC43]
aucauauugcaauu

SEQ ID NO: 1604058 - RNA, 20 nt, Human coronavirus OC43 [HCoV-OC43]
uaauuauggccaauuggaag

SEQ ID NO: 1604059 - RNA, 15 nt, Human coronavirus OC43 [HCoV-OC43]
auuauuguaguuuug

SEQ ID NO: 1604060 - RNA, 14 nt, Human coronavirus OC43 [HCoV-OC43]
aaagugauuauugu

SEQ ID NO: 1604061 - RNA, 20 nt, Human coronavirus OC43 [HCoV-OC43]
gcucuccuaaaguuacuauu

SEQ ID NO: 1604062 - RNA, 16 nt, Human coronavirus OC43 [HCoV-OC43]
gccacuaaaccucagc

SEQ ID NO: 1604063 - RNA, 21 nt, Human coronavirus OC43 [HCoV-OC43]
gauacagguguuguuuccugu

SEQ ID NO: 1604064 - RNA, 20 nt, Human coronavirus OC43 [HCoV-OC43]
auauugacggagucuacugg

SEQ ID NO: 1604065 - RNA, 19 nt, Human coronavirus OC43 [HCoV-OC43]
uguacuucagauacuaguu

SEQ ID NO: 1604066 - RNA, 15 nt, Human coronavirus OC43 [HCoV-OC43]
gucaauauuauuuua

SEQ ID NO: 1604067 - RNA, 15 nt, Human coronavirus OC43 [HCoV-OC43]
cugauacuguugaug

SEQ ID NO: 1604068 - RNA, 13 nt, Human coronavirus OC43 [HCoV-OC43]
ugauuauuuguau

SEQ ID NO: 1604069 - RNA, 15 nt, Human coronavirus OC43 [HCoV-OC43]
auuugggcuauuugc

SEQ ID NO: 1604070 - RNA, 22 nt, Human coronavirus OC43 [HCoV-OC43]
uucaacuuugcgguauguguaa

SEQ ID NO: 1604071 - RNA, 13 nt, Human coronavirus OC43 [HCoV-OC43]
uauuaauggacau

SEQ ID NO: 1604072 - RNA, 13 nt, Human coronavirus OC43 [HCoV-OC43]
uuucuuucugauu

SEQ ID NO: 1604073 - RNA, 19 nt, Human coronavirus OC43 [HCoV-OC43]
auaagaauggacaaggaga

SEQ ID NO: 1604074 - RNA, 13 nt, Human coronavirus OC43 [HCoV-OC43]
ugagguuaaugcg

SEQ ID NO: 1604075 - RNA, 20 nt, Human coronavirus OC43 [HCoV-OC43]
augaggguguuaauuuuacg

SEQ ID NO: 1604076 - RNA, 20 nt, Human coronavirus OC43 [HCoV-OC43]
augauguaaaaccaccaguc

SEQ ID NO: 1604077 - RNA, 14 nt, Human coronavirus OC43 [HCoV-OC43]
augcaauucaauua

SEQ ID NO: 1604078 - RNA, 11 nt, Human coronavirus OC43 [HCoV-OC43]
acuguuaauuc

SEQ ID NO: 1604079 - RNA, 15 nt, Human coronavirus OC43 [HCoV-OC43]
ucagcaaccaucagg

SEQ ID NO: 1604080 - RNA, 23 nt, Human coronavirus OC43 [HCoV-OC43]
uauugcaacaacucucuaauaga

SEQ ID NO: 1604081 - RNA, 23 nt, Human coronavirus OC43 [HCoV-OC43]
uguaguuuaugcacaacacuguu

SEQ ID NO: 1604082 - RNA, 22 nt, Human coronavirus OC43 [HCoV-OC43]
agguguaccauuuuauuuaaau

SEQ ID NO: 1604083 - RNA, 15 nt, Human coronavirus OC43 [HCoV-OC43]
agguacuaauuauuu

SEQ ID NO: 1604084 - RNA, 16 nt, Human coronavirus OC43 [HCoV-OC43]
caacuauguugguguu

SEQ ID NO: 1604085 - RNA, 17 nt, Human coronavirus OC43 [HCoV-OC43]
ugucucagaauuagaag

SEQ ID NO: 1604086 - RNA, 17 nt, Human coronavirus OC43 [HCoV-OC43]
auuauaauuuaccugcu

SEQ ID NO: 1604087 - RNA, 14 nt, Human coronavirus OC43 [HCoV-OC43]
aauggcauccucaa

SEQ ID NO: 1604088 - RNA, 19 nt, Human coronavirus OC43 [HCoV-OC43]
cacccaguaauuaguaaau

SEQ ID NO: 1604089 - RNA, 15 nt, Human coronavirus OC43 [HCoV-OC43]
agccuuacuuuuguu

SEQ ID NO: 1604090 - RNA, 15 nt, Human coronavirus OC43 [HCoV-OC43]
cuugcuguuaaaagu

SEQ ID NO: 1604091 - RNA, 21 nt, Human coronavirus OC43 [HCoV-OC43]
auaaguacugauacuguugau

SEQ ID NO: 1604092 - RNA, 20 nt, Human coronavirus OC43 [HCoV-OC43]
auuaugauaaauauuuugga

SEQ ID NO: 1604093 - RNA, 11 nt, Human coronavirus OC43 [HCoV-OC43]
aggguucuggc

SEQ ID NO: 1604094 - RNA, 16 nt, Human coronavirus OC43 [HCoV-OC43]
cuaaucagaauuuugg

SEQ ID NO: 1604095 - RNA, 19 nt, Human coronavirus OC43 [HCoV-OC43]
ugucccacugcugcugaua

SEQ ID NO: 1604096 - RNA, 15 nt, Human coronavirus OC43 [HCoV-OC43]
cucuuguuuacaagg

SEQ ID NO: 1604097 - RNA, 14 nt, Human coronavirus OC43 [HCoV-OC43]
acuuuagaauauug

SEQ ID NO: 1604098 - RNA, 16 nt, Human coronavirus OC43 [HCoV-OC43]
caaaauaagaguagag

SEQ ID NO: 1604099 - RNA, 15 nt, Human coronavirus OC43 [HCoV-OC43]
guucugguaauggca

SEQ ID NO: 1604100 - RNA, 14 nt, Human coronavirus OC43 [HCoV-OC43]
gggguagaagagcu

SEQ ID NO: 1604101 - RNA, 12 nt, Human coronavirus OC43 [HCoV-OC43]
augauauuugga

SEQ ID NO: 1604102 - RNA, 18 nt, Human coronavirus OC43 [HCoV-OC43]
aucgguuuacuaauuuug

SEQ ID NO: 1604103 - RNA, 12 nt, Human coronavirus OC43 [HCoV-OC43]
caggagggaaug

SEQ ID NO: 1604104 - RNA, 19 nt, Human coronavirus OC43 [HCoV-OC43]
agcuccuaaaaauuucugu

SEQ ID NO: 1604105 - RNA, 18 nt, Human coronavirus OC43 [HCoV-OC43]
uauaauaguacugcuauu

SEQ ID NO: 1604106 - RNA, 17 nt, Human coronavirus OC43 [HCoV-OC43]
ucuacaggaaaaguuuu

SEQ ID NO: 1604107 - RNA, 17 nt, Human coronavirus OC43 [HCoV-OC43]
uguguauuuaaauacua

SEQ ID NO: 1604108 - RNA, 19 nt, Human coronavirus OC43 [HCoV-OC43]
aucauuagugcagaaugcu

SEQ ID NO: 1604109 - RNA, 22 nt, Human coronavirus OC43 [HCoV-OC43]
auauagaagcuuggcuuaauga

SEQ ID NO: 1604110 - RNA, 20 nt, Human coronavirus OC43 [HCoV-OC43]
gugcccaagggaagagccag

SEQ ID NO: 1604111 - RNA, 16 nt, Human coronavirus OC43 [HCoV-OC43]
uuuacaauuucaaauu

SEQ ID NO: 1604112 - RNA, 15 nt, Human coronavirus OC43 [HCoV-OC43]
aucuagacuugaugc

SEQ ID NO: 1604113 - RNA, 14 nt, Human coronavirus OC43 [HCoV-OC43]
augcauauuuuaca

SEQ ID NO: 1604114 - RNA, 13 nt, Human coronavirus OC43 [HCoV-OC43]
agugacccacagu

SEQ ID NO: 1604115 - RNA, 12 nt, Human coronavirus OC43 [HCoV-OC43]
agagccagcaug

SEQ ID NO: 1604116 - RNA, 21 nt, Human coronavirus OC43 [HCoV-OC43]
uauagugaguucccugcuaua

SEQ ID NO: 1604117 - RNA, 12 nt, Human coronavirus OC43 [HCoV-OC43]
gcuauuucuguu

SEQ ID NO: 1604118 - RNA, 12 nt, Human coronavirus OC43 [HCoV-OC43]
uuaauguaaaua

SEQ ID NO: 1604119 - RNA, 13 nt, Human coronavirus OC43 [HCoV-OC43]
agacaccucagaa

SEQ ID NO: 1604120 - RNA, 20 nt, Human coronavirus OC43 [HCoV-OC43]
uccuaaccuggguaaucauc

SEQ ID NO: 1604121 - RNA, 20 nt, Human coronavirus OC43 [HCoV-OC43]
cgcauugaauaauguguauc

SEQ ID NO: 1604122 - RNA, 11 nt, Human coronavirus OC43 [HCoV-OC43]
uaaugcuguug

SEQ ID NO: 1604123 - RNA, 19 nt, Human coronavirus OC43 [HCoV-OC43]
aauaaugguauaggcacuu

SEQ ID NO: 1604124 - RNA, 21 nt, Human coronavirus OC43 [HCoV-OC43]
aauauuauguaaaauggccuu

SEQ ID NO: 1604125 - RNA, 22 nt, Human coronavirus OC43 [HCoV-OC43]
uuugcaaucuagcauuuguuaa

SEQ ID NO: 1604126 - RNA, 16 nt, Human coronavirus OC43 [HCoV-OC43]
aaguuaauuauggcca

SEQ ID NO: 1604127 - RNA, 20 nt, Human coronavirus OC43 [HCoV-OC43]
uccuuaccaacggcuuuugc

SEQ ID NO: 1604128 - RNA, 17 nt, Human coronavirus OC43 [HCoV-OC43]
cuaaucaugauguaguu

SEQ ID NO: 1604129 - RNA, 17 nt, Human coronavirus OC43 [HCoV-OC43]
gcagcaaaauaagagua

SEQ ID NO: 1604130 - RNA, 21 nt, Human coronavirus OC43 [HCoV-OC43]
auuuugcaugauguuaauagu

SEQ ID NO: 1604131 - RNA, 17 nt, Human coronavirus OC43 [HCoV-OC43]
auaaguacugauacugu

SEQ ID NO: 1604132 - RNA, 16 nt, Human coronavirus OC43 [HCoV-OC43]
cuccugguaagcaauc

SEQ ID NO: 1604133 - RNA, 16 nt, Human coronavirus OC43 [HCoV-OC43]
gugcugaaugagaauu

SEQ ID NO: 1604134 - RNA, 20 nt, Human coronavirus OC43 [HCoV-OC43]
aauaagagauuugguuuuau

SEQ ID NO: 1604135 - RNA, 22 nt, Human coronavirus OC43 [HCoV-OC43]
agucgcaguauguuuguuuaug

SEQ ID NO: 1604136 - RNA, 13 nt, Human coronavirus OC43 [HCoV-OC43]
uuguauuauaauu

SEQ ID NO: 1604137 - RNA, 14 nt, Human coronavirus OC43 [HCoV-OC43]
auacaaaguauuau

SEQ ID NO: 1604138 - RNA, 17 nt, Human coronavirus OC43 [HCoV-OC43]
agacacugguguuauuu

SEQ ID NO: 1604139 - RNA, 14 nt, Human coronavirus OC43 [HCoV-OC43]
ugagccauuuacug

SEQ ID NO: 1604140 - RNA, 24 nt, Human coronavirus OC43 [HCoV-OC43]
guaaauaauacuuggauguacacu

SEQ ID NO: 1604141 - RNA, 22 nt, Human coronavirus OC43 [HCoV-OC43]
auaguaagguuaagaaugguuu

SEQ ID NO: 1604142 - RNA, 17 nt, Human coronavirus OC43 [HCoV-OC43]
gcuagucuuguucuggc

SEQ ID NO: 1604143 - RNA, 22 nt, Human coronavirus OC43 [HCoV-OC43]
cauaaugaaggugcugaaugag

SEQ ID NO: 1604144 - RNA, 18 nt, Human coronavirus OC43 [HCoV-OC43]
uacugaagacaccucaga

SEQ ID NO: 1604145 - RNA, 17 nt, Human coronavirus OC43 [HCoV-OC43]
agaauauuggguuacac

SEQ ID NO: 1604146 - RNA, 23 nt, Human coronavirus OC43 [HCoV-OC43]
auaaagacacugguguuauuuau

SEQ ID NO: 1604147 - RNA, 16 nt, Human coronavirus OC43 [HCoV-OC43]
caguagaucugcuaua

SEQ ID NO: 1604148 - RNA, 20 nt, Human coronavirus OC43 [HCoV-OC43]
ccuauuaauggacauuugga

SEQ ID NO: 1604149 - RNA, 20 nt, Human coronavirus OC43 [HCoV-OC43]
ccgccagaagaggagcccca

SEQ ID NO: 1604150 - RNA, 17 nt, Human coronavirus OC43 [HCoV-OC43]
gcaccagauuugucacu

SEQ ID NO: 1604151 - RNA, 15 nt, Human coronavirus OC43 [HCoV-OC43]
acucucuaucagaau

SEQ ID NO: 1604152 - RNA, 19 nt, Human coronavirus OC43 [HCoV-OC43]
cuauggagaagguuaauga

SEQ ID NO: 1604153 - RNA, 22 nt, Human coronavirus OC43 [HCoV-OC43]
gugcacauauaagcgugguuuu

SEQ ID NO: 1604154 - RNA, 14 nt, Human coronavirus OC43 [HCoV-OC43]
uguugcagugccca

SEQ ID NO: 1604155 - RNA, 15 nt, Human coronavirus OC43 [HCoV-OC43]
uuucaaauuguaauu

SEQ ID NO: 1604156 - RNA, 18 nt, Human coronavirus OC43 [HCoV-OC43]
cuuguuuuacuauucuuc

SEQ ID NO: 1604157 - RNA, 14 nt, Human coronavirus OC43 [HCoV-OC43]
auuauuuaguuuua

SEQ ID NO: 1604158 - RNA, 22 nt, Human coronavirus OC43 [HCoV-OC43]
uuauguggauuguguauuuugu

SEQ ID NO: 1604159 - RNA, 15 nt, Human coronavirus OC43 [HCoV-OC43]
ugcuuguuuuacuau

SEQ ID NO: 1604160 - RNA, 13 nt, Human coronavirus OC43 [HCoV-OC43]
guucuuuuaaaac

SEQ ID NO: 1604161 - RNA, 12 nt, Human coronavirus OC43 [HCoV-OC43]
acucuuguuuac

SEQ ID NO: 1604162 - RNA, 14 nt, Human coronavirus OC43 [HCoV-OC43]
uaauuaguugaaag

SEQ ID NO: 1604163 - RNA, 18 nt, Human coronavirus OC43 [HCoV-OC43]
aguguugcagugcccaaa

SEQ ID NO: 1604164 - RNA, 16 nt, Human coronavirus OC43 [HCoV-OC43]
aaaacuuggaacuagu

SEQ ID NO: 1604165 - RNA, 21 nt, Human coronavirus OC43 [HCoV-OC43]
cauuaugauaaauauuuugga

SEQ ID NO: 1604166 - RNA, 22 nt, Human coronavirus OC43 [HCoV-OC43]
caaacugguuuucuuagcuguu

SEQ ID NO: 1604167 - RNA, 17 nt, Human coronavirus OC43 [HCoV-OC43]
gcacaacacuguuucaa

SEQ ID NO: 1604168 - RNA, 14 nt, Human coronavirus OC43 [HCoV-OC43]
uuucuuucugauuu

SEQ ID NO: 1604169 - RNA, 19 nt, Human coronavirus OC43 [HCoV-OC43]
guuuaugauauuaaucaug

SEQ ID NO: 1604170 - RNA, 19 nt, Human coronavirus OC43 [HCoV-OC43]
guaucgcagccuuacuuuu

SEQ ID NO: 1604171 - RNA, 23 nt, Human coronavirus OC43 [HCoV-OC43]
cucaguuucaaaagggaaaggag

SEQ ID NO: 1604172 - RNA, 19 nt, Human coronavirus OC43 [HCoV-OC43]
aaaugcaaccguucuggua

SEQ ID NO: 1604173 - RNA, 12 nt, Human coronavirus OC43 [HCoV-OC43]
cuaauguuucug

SEQ ID NO: 1604174 - RNA, 21 nt, Human coronavirus OC43 [HCoV-OC43]
auaaagacacugguguuauuu

SEQ ID NO: 1604175 - RNA, 17 nt, Human coronavirus OC43 [HCoV-OC43]
cauauugcaauuuggau

SEQ ID NO: 1604176 - RNA, 14 nt, Human coronavirus OC43 [HCoV-OC43]
guuaauguaaauaa

SEQ ID NO: 1604177 - RNA, 19 nt, Human coronavirus OC43 [HCoV-OC43]
accagggguagaagagcuc

SEQ ID NO: 1604178 - RNA, 13 nt, Human coronavirus OC43 [HCoV-OC43]
caagugcccaagg

SEQ ID NO: 1604179 - RNA, 16 nt, Human coronavirus OC43 [HCoV-OC43]
gcagugcccaaaagcc

SEQ ID NO: 1604180 - RNA, 11 nt, Human coronavirus OC43 [HCoV-OC43]
acuauaaucuu

SEQ ID NO: 1604181 - RNA, 17 nt, Human coronavirus OC43 [HCoV-OC43]
uccugacgagccccaga

SEQ ID NO: 1604182 - RNA, 15 nt, Human coronavirus OC43 [HCoV-OC43]
auuaaacgguuacac

SEQ ID NO: 1604183 - RNA, 21 nt, Human coronavirus OC43 [HCoV-OC43]
auuuaacaaugcccuuuaugc

SEQ ID NO: 1604184 - RNA, 15 nt, Human coronavirus OC43 [HCoV-OC43]
caucuggugguaacc

SEQ ID NO: 1604185 - RNA, 17 nt, Human coronavirus OC43 [HCoV-OC43]
ugauucguaguugcuau

SEQ ID NO: 1604186 - RNA, 22 nt, Human coronavirus OC43 [HCoV-OC43]
aacaaguugucaguuguauuau

SEQ ID NO: 1604187 - RNA, 20 nt, Human coronavirus OC43 [HCoV-OC43]
auaucuaaauuuuaaggaug

SEQ ID NO: 1604188 - RNA, 16 nt, Human coronavirus OC43 [HCoV-OC43]
augaggguguuaauuu

SEQ ID NO: 1604189 - RNA, 14 nt, Human coronavirus OC43 [HCoV-OC43]
cuaccucucagcaa

SEQ ID NO: 1604190 - RNA, 17 nt, Human coronavirus OC43 [HCoV-OC43]
guaaucauauuguuaau

SEQ ID NO: 1604191 - RNA, 12 nt, Human coronavirus OC43 [HCoV-OC43]
uggcauggacac

SEQ ID NO: 1604192 - RNA, 14 nt, Human coronavirus OC43 [HCoV-OC43]
gccauuuacuguua

SEQ ID NO: 1604193 - RNA, 16 nt, Human coronavirus OC43 [HCoV-OC43]
gaaaauguugauuuua

SEQ ID NO: 1604194 - RNA, 23 nt, Human coronavirus OC43 [HCoV-OC43]
uccagcagagccucuagugcagg

SEQ ID NO: 1604195 - RNA, 15 nt, Human coronavirus OC43 [HCoV-OC43]
aagaaugguuuuacu

SEQ ID NO: 1604196 - RNA, 19 nt, Human coronavirus OC43 [HCoV-OC43]
gcagccugaugucuuuuau

SEQ ID NO: 1604197 - RNA, 22 nt, Human coronavirus OC43 [HCoV-OC43]
uuugaauaagccccgccagaag

SEQ ID NO: 1604198 - RNA, 16 nt, Human coronavirus OC43 [HCoV-OC43]
aaucaagguagauuuu

SEQ ID NO: 1604199 - RNA, 20 nt, Human coronavirus OC43 [HCoV-OC43]
gcaauaaaagucuuaaauca

SEQ ID NO: 1604200 - RNA, 15 nt, Human coronavirus OC43 [HCoV-OC43]
uuguuacuaaguuuu

SEQ ID NO: 1604201 - RNA, 18 nt, Human coronavirus OC43 [HCoV-OC43]
ugacgagccccagaagga

SEQ ID NO: 1604202 - RNA, 22 nt, Human coronavirus OC43 [HCoV-OC43]
gugugccuauugcaccaggagu

SEQ ID NO: 1604203 - RNA, 13 nt, Human coronavirus OC43 [HCoV-OC43]
gaccaguacggca

SEQ ID NO: 1604204 - RNA, 16 nt, Human coronavirus OC43 [HCoV-OC43]
gacaagccuaaucauu

SEQ ID NO: 1604205 - RNA, 15 nt, Human coronavirus OC43 [HCoV-OC43]
uuaauuauggccaau

SEQ ID NO: 1604206 - RNA, 18 nt, Human coronavirus OC43 [HCoV-OC43]
aaacaacuugauguguau

SEQ ID NO: 1604207 - RNA, 22 nt, Human coronavirus OC43 [HCoV-OC43]
guuacacaccugugcacauaua

SEQ ID NO: 1604208 - RNA, 19 nt, Human coronavirus OC43 [HCoV-OC43]
cugcagguacuaauuauuu

SEQ ID NO: 1604209 - RNA, 17 nt, Human coronavirus OC43 [HCoV-OC43]
augaauauuauguaaaa

SEQ ID NO: 1604210 - RNA, 18 nt, Human coronavirus OC43 [HCoV-OC43]
agagugguuauuuuguua

SEQ ID NO: 1604211 - RNA, 15 nt, Human coronavirus OC43 [HCoV-OC43]
auauaagcguaauuu

SEQ ID NO: 1604212 - RNA, 15 nt, Human coronavirus OC43 [HCoV-OC43]
ugguauuuuugcuaa

SEQ ID NO: 1604213 - RNA, 20 nt, Human coronavirus OC43 [HCoV-OC43]
agauuagaguuggccaaagu

SEQ ID NO: 1604214 - RNA, 18 nt, Human coronavirus OC43 [HCoV-OC43]
gaucuuaauuguuauuau

SEQ ID NO: 1604215 - RNA, 15 nt, Human coronavirus OC43 [HCoV-OC43]
agcgccguauguaau

SEQ ID NO: 1604216 - RNA, 21 nt, Human coronavirus OC43 [HCoV-OC43]
agccccagaaggauguuuaug

SEQ ID NO: 1604217 - RNA, 13 nt, Human coronavirus OC43 [HCoV-OC43]
uggagaaauguua

SEQ ID NO: 1604218 - RNA, 13 nt, Human coronavirus OC43 [HCoV-OC43]
ugucucagaauua

SEQ ID NO: 1604219 - RNA, 14 nt, Human coronavirus OC43 [HCoV-OC43]
auaguaagguuaag

SEQ ID NO: 1604220 - RNA, 21 nt, Human coronavirus OC43 [HCoV-OC43]
uauucaaacaagcucuccuaa

SEQ ID NO: 1604221 - RNA, 16 nt, Human coronavirus OC43 [HCoV-OC43]
guucuuacuaaucaug

SEQ ID NO: 1604222 - RNA, 15 nt, Human coronavirus OC43 [HCoV-OC43]
caacuaauucugcuu

SEQ ID NO: 1604223 - RNA, 17 nt, Human coronavirus OC43 [HCoV-OC43]
auccuauuacauuuaaa

SEQ ID NO: 1604224 - RNA, 21 nt, Human coronavirus OC43 [HCoV-OC43]
auggagaagguuaaugaaugu

SEQ ID NO: 1604225 - RNA, 17 nt, Human coronavirus OC43 [HCoV-OC43]
guaggauauuguagagu

SEQ ID NO: 1604226 - RNA, 21 nt, Human coronavirus OC43 [HCoV-OC43]
auauuaauaucccugauuuac

SEQ ID NO: 1604227 - RNA, 14 nt, Human coronavirus OC43 [HCoV-OC43]
guggcauuuuuggc

SEQ ID NO: 1604228 - RNA, 12 nt, Human coronavirus OC43 [HCoV-OC43]
aguguuuuggua

SEQ ID NO: 1604229 - RNA, 18 nt, Human coronavirus OC43 [HCoV-OC43]
caguccuugauguggaug

SEQ ID NO: 1604230 - RNA, 14 nt, Human coronavirus OC43 [HCoV-OC43]
cucgcacccacagc

SEQ ID NO: 1604231 - RNA, 16 nt, Human coronavirus OC43 [HCoV-OC43]
uguacagguuguugau

SEQ ID NO: 1604232 - RNA, 15 nt, Human coronavirus OC43 [HCoV-OC43]
augucccacugcugc

SEQ ID NO: 1604233 - RNA, 17 nt, Human coronavirus OC43 [HCoV-OC43]
guaaaauuuagugcagc

SEQ ID NO: 1604234 - RNA, 16 nt, Human coronavirus OC43 [HCoV-OC43]
ucgaauacaaaguauu

SEQ ID NO: 1604235 - RNA, 15 nt, Human coronavirus OC43 [HCoV-OC43]
uuagaguuggccaaa

SEQ ID NO: 1604236 - RNA, 16 nt, Human coronavirus OC43 [HCoV-OC43]
cagcuuauaugacugu

SEQ ID NO: 1604237 - RNA, 17 nt, Human coronavirus OC43 [HCoV-OC43]
accugcgcuguuaauua

SEQ ID NO: 1604238 - RNA, 14 nt, Human coronavirus OC43 [HCoV-OC43]
uaaugguuugggua

SEQ ID NO: 1604239 - RNA, 14 nt, Human coronavirus OC43 [HCoV-OC43]
cuuguucuggcaaa

SEQ ID NO: 1604240 - RNA, 16 nt, Human coronavirus OC43 [HCoV-OC43]
agucagacagaaaauu

SEQ ID NO: 1604241 - RNA, 13 nt, Human coronavirus OC43 [HCoV-OC43]
ccauuuguuuauu

SEQ ID NO: 1604242 - RNA, 13 nt, Human coronavirus OC43 [HCoV-OC43]
ccauauguuuaua

SEQ ID NO: 1604243 - RNA, 21 nt, Human coronavirus OC43 [HCoV-OC43]
aaucaugauguaguuuaugca

SEQ ID NO: 1604244 - RNA, 23 nt, Human coronavirus OC43 [HCoV-OC43]
uccacauaucguaauauggcacu

SEQ ID NO: 1604245 - RNA, 19 nt, Human coronavirus OC43 [HCoV-OC43]
gaaugcugauuauuuguau

SEQ ID NO: 1604246 - RNA, 14 nt, Human coronavirus OC43 [HCoV-OC43]
gguucucuggaauu

SEQ ID NO: 1604247 - RNA, 18 nt, Human coronavirus OC43 [HCoV-OC43]
uuaaacgguuacacuguu

SEQ ID NO: 1604248 - RNA, 23 nt, Human coronavirus OC43 [HCoV-OC43]
auuuuggugguggagaaauguua

SEQ ID NO: 1604249 - RNA, 23 nt, Human coronavirus OC43 [HCoV-OC43]
gcguaguagagccaauucuggca

SEQ ID NO: 1604250 - RNA, 20 nt, Human coronavirus OC43 [HCoV-OC43]
cuguucgggucuugcuguua

SEQ ID NO: 1604251 - RNA, 17 nt, Human coronavirus OC43 [HCoV-OC43]
ucuggcaauagaacccc

SEQ ID NO: 1604252 - RNA, 17 nt, Human coronavirus OC43 [HCoV-OC43]
gccgacaagugcccaag

SEQ ID NO: 1604253 - RNA, 14 nt, Human coronavirus OC43 [HCoV-OC43]
gucuuguucuggca

SEQ ID NO: 1604254 - RNA, 14 nt, Human coronavirus OC43 [HCoV-OC43]
caguggauacacuu

SEQ ID NO: 1604255 - RNA, 16 nt, Human coronavirus OC43 [HCoV-OC43]
aaagaacuauggcauu

SEQ ID NO: 1604256 - RNA, 17 nt, Human coronavirus OC43 [HCoV-OC43]
cuggaaaucguucuggu

SEQ ID NO: 1604257 - RNA, 12 nt, Human coronavirus OC43 [HCoV-OC43]
auucugcuuuag

SEQ ID NO: 1604258 - RNA, 23 nt, Human coronavirus OC43 [HCoV-OC43]
caguaauuaguaaaugaaugaag

SEQ ID NO: 1604259 - RNA, 12 nt, Human coronavirus OC43 [HCoV-OC43]
gagaagaaauau

SEQ ID NO: 1604260 - RNA, 15 nt, Human coronavirus OC43 [HCoV-OC43]
gcuaccucucagcaa

SEQ ID NO: 1604261 - RNA, 16 nt, Human coronavirus OC43 [HCoV-OC43]
aacagaacuuuuauga

SEQ ID NO: 1604262 - RNA, 12 nt, Human coronavirus OC43 [HCoV-OC43]
gacaagugccca

SEQ ID NO: 1604263 - RNA, 22 nt, Human coronavirus OC43 [HCoV-OC43]
auacugaagacaccucagaaau

SEQ ID NO: 1604264 - RNA, 20 nt, Human coronavirus OC43 [HCoV-OC43]
auggacaccgcauuguugag

SEQ ID NO: 1604265 - RNA, 13 nt, Human coronavirus OC43 [HCoV-OC43]
agaucguguguau

SEQ ID NO: 1604266 - RNA, 13 nt, Human coronavirus OC43 [HCoV-OC43]
agcuuauaugacu

SEQ ID NO: 1604267 - RNA, 19 nt, Human coronavirus OC43 [HCoV-OC43]
guaaauccaaacauuauga

SEQ ID NO: 1604268 - RNA, 20 nt, Human coronavirus OC43 [HCoV-OC43]
ugucaaccuccguacuguua

SEQ ID NO: 1604269 - RNA, 15 nt, Human coronavirus OC43 [HCoV-OC43]
auuugguuuuauaga

SEQ ID NO: 1604270 - RNA, 16 nt, Human coronavirus OC43 [HCoV-OC43]
augguaugaugaauau

SEQ ID NO: 1604271 - RNA, 17 nt, Human coronavirus OC43 [HCoV-OC43]
acaaugcccuuuaugcu

SEQ ID NO: 1604272 - RNA, 22 nt, Human coronavirus OC43 [HCoV-OC43]
caaaagccgcgugcagcaaaau

SEQ ID NO: 1604273 - RNA, 21 nt, Human coronavirus OC43 [HCoV-OC43]
auuuuuggguuggucugcaga

SEQ ID NO: 1604274 - RNA, 12 nt, Human coronavirus OC43 [HCoV-OC43]
ggacaaggugug

SEQ ID NO: 1604275 - RNA, 14 nt, Human coronavirus OC43 [HCoV-OC43]
uuaacuugugauaa

SEQ ID NO: 1604276 - RNA, 18 nt, Human coronavirus OC43 [HCoV-OC43]
gcuccauaugguuuguau

SEQ ID NO: 1604277 - RNA, 15 nt, Human coronavirus OC43 [HCoV-OC43]
acucgcacccacagc

SEQ ID NO: 1604278 - RNA, 20 nt, Human coronavirus OC43 [HCoV-OC43]
augaaaacaauucuugguuc

SEQ ID NO: 1604279 - RNA, 20 nt, Human coronavirus OC43 [HCoV-OC43]
agcgccacacauuagucuua

SEQ ID NO: 1604280 - RNA, 21 nt, Human coronavirus OC43 [HCoV-OC43]
cucuuaaugcuuauguuucuc

SEQ ID NO: 1604281 - RNA, 21 nt, Human coronavirus OC43 [HCoV-OC43]
caaccagcgucaacugcugcc

SEQ ID NO: 1604282 - RNA, 17 nt, Human coronavirus OC43 [HCoV-OC43]
cuauaaaaguguugaug

SEQ ID NO: 1604283 - RNA, 12 nt, Human coronavirus OC43 [HCoV-OC43]
aaggauuuuacg

SEQ ID NO: 1604284 - RNA, 22 nt, Human coronavirus OC43 [HCoV-OC43]
auuuauucuaguuagcugcaua

SEQ ID NO: 1604285 - RNA, 23 nt, Human coronavirus OC43 [HCoV-OC43]
guacugauacuguugauguuacu

SEQ ID NO: 1604286 - RNA, 17 nt, Human coronavirus OC43 [HCoV-OC43]
uauaacuauagguagua

SEQ ID NO: 1604287 - RNA, 17 nt, Human coronavirus OC43 [HCoV-OC43]
aggucaacaaauuauuu

SEQ ID NO: 1604288 - RNA, 18 nt, Human coronavirus OC43 [HCoV-OC43]
caacggcuuuugcuguua

SEQ ID NO: 1604289 - RNA, 18 nt, Human coronavirus OC43 [HCoV-OC43]
auuaaagaucguguaaug

SEQ ID NO: 1604290 - RNA, 16 nt, Human coronavirus OC43 [HCoV-OC43]
gcgcacauccagcaga

SEQ ID NO: 1604291 - RNA, 16 nt, Human coronavirus OC43 [HCoV-OC43]
guagaaggacaaggug

SEQ ID NO: 1604292 - RNA, 15 nt, Human coronavirus OC43 [HCoV-OC43]
cuuacuaaucaugau

SEQ ID NO: 1604293 - RNA, 16 nt, Human coronavirus OC43 [HCoV-OC43]
cagaaggauguuuaug

SEQ ID NO: 1604294 - RNA, 20 nt, Human coronavirus OC43 [HCoV-OC43]
uagauaugaaaggaacaaug

SEQ ID NO: 1604295 - RNA, 14 nt, Human coronavirus OC43 [HCoV-OC43]
aaaucguucuggua

SEQ ID NO: 1604296 - RNA, 16 nt, Human coronavirus OC43 [HCoV-OC43]
gaauggaauuuuucuu

SEQ ID NO: 1604297 - RNA, 20 nt, Human coronavirus OC43 [HCoV-OC43]
aaucugccuugcugguguag

SEQ ID NO: 1604298 - RNA, 19 nt, Human coronavirus OC43 [HCoV-OC43]
ggaauccugacgagcccca

SEQ ID NO: 1604299 - RNA, 19 nt, Human coronavirus OC43 [HCoV-OC43]
auggcacugaagggaagug

SEQ ID NO: 1604300 - RNA, 20 nt, Human coronavirus OC43 [HCoV-OC43]
uggauuguaaaauacaaaca

SEQ ID NO: 1604301 - RNA, 12 nt, Human coronavirus OC43 [HCoV-OC43]
cauugcuauuuc

SEQ ID NO: 1604302 - RNA, 22 nt, Human coronavirus OC43 [HCoV-OC43]
guucagcaguguuuugguaaga

SEQ ID NO: 1604303 - RNA, 14 nt, Human coronavirus OC43 [HCoV-OC43]
aucauuagugcaga

SEQ ID NO: 1604304 - RNA, 14 nt, Human coronavirus OC43 [HCoV-OC43]
cuuuuuaugcauau

SEQ ID NO: 1604305 - RNA, 21 nt, Human coronavirus OC43 [HCoV-OC43]
uuaauuguuauuauuuaguuu

SEQ ID NO: 1604306 - RNA, 21 nt, Human coronavirus OC43 [HCoV-OC43]
cgcgcacauccagcagagccu

SEQ ID NO: 1604307 - RNA, 20 nt, Human coronavirus OC43 [HCoV-OC43]
gauaugaaaggaacaaugua

SEQ ID NO: 1604308 - RNA, 15 nt, Human coronavirus OC43 [HCoV-OC43]
cguuuuucuuuggau

SEQ ID NO: 1604309 - RNA, 21 nt, Human coronavirus OC43 [HCoV-OC43]
cuagugguuuugcuguuuaug

SEQ ID NO: 1604310 - RNA, 13 nt, Human coronavirus OC43 [HCoV-OC43]
auauaaguguugc

SEQ ID NO: 1604311 - RNA, 19 nt, Human coronavirus OC43 [HCoV-OC43]
uaauguguaucuuggccuu

SEQ ID NO: 1604312 - RNA, 13 nt, Human coronavirus OC43 [HCoV-OC43]
uuauuuugcauga

SEQ ID NO: 1604313 - RNA, 19 nt, Human coronavirus OC43 [HCoV-OC43]
aucaugauguaguuuaugc

SEQ ID NO: 1604314 - RNA, 21 nt, Human coronavirus OC43 [HCoV-OC43]
caggaucgcguaguagagcca

SEQ ID NO: 1604315 - RNA, 19 nt, Human coronavirus OC43 [HCoV-OC43]
cugugauaacauuaaugcc

SEQ ID NO: 1604316 - RNA, 18 nt, Human coronavirus OC43 [HCoV-OC43]
uacugaagcuaaggggua

SEQ ID NO: 1604317 - RNA, 14 nt, Human coronavirus OC43 [HCoV-OC43]
aggcugaugucaau

SEQ ID NO: 1604318 - RNA, 23 nt, Human coronavirus OC43 [HCoV-OC43]
auaaucuaaacauguuuuugaua

SEQ ID NO: 1604319 - RNA, 21 nt, Human coronavirus OC43 [HCoV-OC43]
uaucaacccccauaauuauuc

SEQ ID NO: 1604320 - RNA, 19 nt, Human coronavirus OC43 [HCoV-OC43]
cugguacagacacaacaga

SEQ ID NO: 1604321 - RNA, 19 nt, Human coronavirus OC43 [HCoV-OC43]
agcuguuguuaaugcaaau

SEQ ID NO: 1604322 - RNA, 15 nt, Human coronavirus OC43 [HCoV-OC43]
uggccaaagugcaga

SEQ ID NO: 1604323 - RNA, 20 nt, Human coronavirus OC43 [HCoV-OC43]
gcuaugcuuguuuuacuauu

SEQ ID NO: 1604324 - RNA, 14 nt, Human coronavirus OC43 [HCoV-OC43]
uucaacccagaaac

SEQ ID NO: 1604325 - RNA, 17 nt, Human coronavirus OC43 [HCoV-OC43]
ugccaggcagucugaua

SEQ ID NO: 1604326 - RNA, 23 nt, Human coronavirus OC43 [HCoV-OC43]
cuuguacuugccgaccacaagca

SEQ ID NO: 1604327 - RNA, 15 nt, Human coronavirus OC43 [HCoV-OC43]
agaauuuugguggug

SEQ ID NO: 1604328 - RNA, 15 nt, Human coronavirus OC43 [HCoV-OC43]
gauacuagugguuuu

SEQ ID NO: 1604329 - RNA, 17 nt, Human coronavirus OC43 [HCoV-OC43]
gcauuguugagaaauaa

SEQ ID NO: 1604330 - RNA, 23 nt, Human coronavirus OC43 [HCoV-OC43]
acaccucagaaauauaagagaau

SEQ ID NO: 1604331 - RNA, 19 nt, Human coronavirus OC43 [HCoV-OC43]
auuaaacucagugaaaaug

SEQ ID NO: 1604332 - RNA, 16 nt, Human coronavirus OC43 [HCoV-OC43]
cauuauuauguggauu

SEQ ID NO: 1604333 - RNA, 17 nt, Human coronavirus OC43 [HCoV-OC43]
caaugcccuuuaugcua

SEQ ID NO: 1604334 - RNA, 16 nt, Human coronavirus OC43 [HCoV-OC43]
aaguuuuguguuguaa

SEQ ID NO: 1604335 - RNA, 19 nt, Human coronavirus OC43 [HCoV-OC43]
auucaagcuguuguuaaug

SEQ ID NO: 1604336 - RNA, 13 nt, Human coronavirus OC43 [HCoV-OC43]
cagguuguuuauu

SEQ ID NO: 1604337 - RNA, 19 nt, Human coronavirus OC43 [HCoV-OC43]
cuaagcauacugccaaaga

SEQ ID NO: 1604338 - RNA, 17 nt, Human coronavirus OC43 [HCoV-OC43]
uuaagaugauuauuuug

SEQ ID NO: 1604339 - RNA, 18 nt, Human coronavirus OC43 [HCoV-OC43]
auaguguuggagaaagug

SEQ ID NO: 1604340 - RNA, 20 nt, Human coronavirus OC43 [HCoV-OC43]
uaugaguccaaaaccacagc

SEQ ID NO: 1604341 - RNA, 13 nt, Human coronavirus OC43 [HCoV-OC43]
ucgcacccacagc

SEQ ID NO: 1604342 - RNA, 21 nt, Human coronavirus OC43 [HCoV-OC43]
aauggaauuuuucuuugggua

SEQ ID NO: 1604343 - RNA, 15 nt, Human coronavirus OC43 [HCoV-OC43]
aacuagguacuggcu

SEQ ID NO: 1604344 - RNA, 18 nt, Human coronavirus OC43 [HCoV-OC43]
uacuccugguaagcaauc

SEQ ID NO: 1604345 - RNA, 18 nt, Human coronavirus OC43 [HCoV-OC43]
ggaucgcguaguagagcc

SEQ ID NO: 1604346 - RNA, 19 nt, Human coronavirus OC43 [HCoV-OC43]
ucaagcuguuguuaaugca

SEQ ID NO: 1604347 - RNA, 17 nt, Human coronavirus OC43 [HCoV-OC43]
cagaaauauaagagaau

SEQ ID NO: 1604348 - RNA, 23 nt, Human coronavirus OC43 [HCoV-OC43]
guaguacaaccacguacaaucaa

SEQ ID NO: 1604349 - RNA, 17 nt, Human coronavirus OC43 [HCoV-OC43]
caaccuuccugauuuua

SEQ ID NO: 1604350 - RNA, 16 nt, Human coronavirus OC43 [HCoV-OC43]
aguacuuuuguaaaua

SEQ ID NO: 1604351 - RNA, 22 nt, Human coronavirus OC43 [HCoV-OC43]
auacgcauugaauaauguguau

SEQ ID NO: 1604352 - RNA, 14 nt, Human coronavirus OC43 [HCoV-OC43]
agcgugguuuucuu

SEQ ID NO: 1604353 - RNA, 17 nt, Human coronavirus OC43 [HCoV-OC43]
cugguaauggcauccuc

SEQ ID NO: 1604354 - RNA, 22 nt, Human coronavirus OC43 [HCoV-OC43]
auguuuuugauacuuuuaauuu

SEQ ID NO: 1604355 - RNA, 11 nt, Human coronavirus OC43 [HCoV-OC43]
cucauuuacuu

SEQ ID NO: 1604356 - RNA, 16 nt, Human coronavirus OC43 [HCoV-OC43]
cuaaguuuuuguuuaa

SEQ ID NO: 1604357 - RNA, 17 nt, Human coronavirus OC43 [HCoV-OC43]
agagccaauucuggcaa

SEQ ID NO: 1604358 - RNA, 15 nt, Human coronavirus OC43 [HCoV-OC43]
cagauagauagacuu

SEQ ID NO: 1604359 - RNA, 23 nt, Human coronavirus OC43 [HCoV-OC43]
accaucaggagggaauguuguac

SEQ ID NO: 1604360 - RNA, 11 nt, Human coronavirus OC43 [HCoV-OC43]
augauguaaaa

SEQ ID NO: 1604361 - RNA, 22 nt, Human coronavirus OC43 [HCoV-OC43]
agaugguauuauuuuuaaugcu

SEQ ID NO: 1604362 - RNA, 21 nt, Human coronavirus OC43 [HCoV-OC43]
acaguagguagugguuacugu

SEQ ID NO: 1604363 - RNA, 20 nt, Human coronavirus OC43 [HCoV-OC43]
uuccuagauuuauucuaguu

SEQ ID NO: 1604364 - RNA, 21 nt, Human coronavirus OC43 [HCoV-OC43]
uguguuaaauuauaaagguuu

SEQ ID NO: 1604365 - RNA, 20 nt, Human coronavirus OC43 [HCoV-OC43]
uacauccuauagugugguag

SEQ ID NO: 1604366 - RNA, 13 nt, Human coronavirus OC43 [HCoV-OC43]
uuauguggccccu

SEQ ID NO: 1604367 - RNA, 23 nt, Human coronavirus OC43 [HCoV-OC43]
aaacaaugcacuguucagcagug

SEQ ID NO: 1604368 - RNA, 14 nt, Human coronavirus OC43 [HCoV-OC43]
augaugugaaugcu

SEQ ID NO: 1604369 - RNA, 18 nt, Human coronavirus OC43 [HCoV-OC43]
guucagauuguaaucaua

SEQ ID NO: 1604370 - RNA, 23 nt, Human coronavirus OC43 [HCoV-OC43]
gcauggacaccgcauuguugaga

SEQ ID NO: 1604371 - RNA, 18 nt, Human coronavirus OC43 [HCoV-OC43]
auacgcauugaauaaugu

SEQ ID NO: 1604372 - RNA, 16 nt, Human coronavirus OC43 [HCoV-OC43]
auaaacaaugcacugu

SEQ ID NO: 1604373 - RNA, 13 nt, Human coronavirus OC43 [HCoV-OC43]
gguuucacagcau

SEQ ID NO: 1604374 - RNA, 19 nt, Human coronavirus OC43 [HCoV-OC43]
auuguggaggcaauucuug

SEQ ID NO: 1604375 - RNA, 18 nt, Human coronavirus OC43 [HCoV-OC43]
acacaggaugguuauaau

SEQ ID NO: 1604376 - RNA, 21 nt, Human coronavirus OC43 [HCoV-OC43]
caacaagaugguaugaugaau

SEQ ID NO: 1604377 - RNA, 21 nt, Human coronavirus OC43 [HCoV-OC43]
cgucuuaccgcucuuaaugcu

SEQ ID NO: 1604378 - RNA, 15 nt, Human coronavirus OC43 [HCoV-OC43]
gcagcauguaaauca

SEQ ID NO: 1604379 - RNA, 23 nt, Human coronavirus OC43 [HCoV-OC43]
aauaugagcagccugaugucuuu

SEQ ID NO: 1604380 - RNA, 16 nt, Human coronavirus OC43 [HCoV-OC43]
auuccgacuagguuuc

SEQ ID NO: 1604381 - RNA, 14 nt, Human coronavirus OC43 [HCoV-OC43]
uauguuuguuuaug

SEQ ID NO: 1604382 - RNA, 15 nt, Human coronavirus OC43 [HCoV-OC43]
augaguuuuacaaug

SEQ ID NO: 1604383 - RNA, 19 nt, Human coronavirus OC43 [HCoV-OC43]
uccugacgagccccagaag

SEQ ID NO: 1604384 - RNA, 17 nt, Human coronavirus OC43 [HCoV-OC43]
ucacacuauuaugucau

SEQ ID NO: 1604385 - RNA, 19 nt, Human coronavirus OC43 [HCoV-OC43]
ggugcccucuccauuaaau

SEQ ID NO: 1604386 - RNA, 20 nt, Human coronavirus OC43 [HCoV-OC43]
cugcuauagaggauuuacuu

SEQ ID NO: 1604387 - RNA, 16 nt, Human coronavirus OC43 [HCoV-OC43]
gcuacagguacuuaua

SEQ ID NO: 1604388 - RNA, 20 nt, Human coronavirus OC43 [HCoV-OC43]
gcuagucuuguucuggcaaa

SEQ ID NO: 1604389 - RNA, 20 nt, Human coronavirus OC43 [HCoV-OC43]
ugcagaacucgcacccacag

SEQ ID NO: 1604390 - RNA, 16 nt, Human coronavirus OC43 [HCoV-OC43]
auagauagagaagguu

SEQ ID NO: 1604391 - RNA, 17 nt, Human coronavirus OC43 [HCoV-OC43]
agagcguccucuggaaa

SEQ ID NO: 1604392 - RNA, 22 nt, Human coronavirus OC43 [HCoV-OC43]
caccaccuacugguguuuauga

SEQ ID NO: 1604393 - RNA, 16 nt, Human coronavirus OC43 [HCoV-OC43]
uucagcaguguuuugg

SEQ ID NO: 1604394 - RNA, 20 nt, Human coronavirus OC43 [HCoV-OC43]
acaaguguaauauuuuugcu

SEQ ID NO: 1604395 - RNA, 22 nt, Human coronavirus OC43 [HCoV-OC43]
ccagcaccaguuuauaucugga

SEQ ID NO: 1604396 - RNA, 16 nt, Human coronavirus OC43 [HCoV-OC43]
cuugguucucuggaau

SEQ ID NO: 1604397 - RNA, 15 nt, Human coronavirus OC43 [HCoV-OC43]
aagauggaugagccc

SEQ ID NO: 1604398 - RNA, 23 nt, Human coronavirus OC43 [HCoV-OC43]
cuaauuuugagccauuuacuguu

SEQ ID NO: 1604399 - RNA, 15 nt, Human coronavirus OC43 [HCoV-OC43]
guauaaaacuaggua

SEQ ID NO: 1604400 - RNA, 20 nt, Human coronavirus OC43 [HCoV-OC43]
aaggaaaauguugauuuuau

SEQ ID NO: 1604401 - RNA, 16 nt, Human coronavirus OC43 [HCoV-OC43]
auaagaguagagaguu

SEQ ID NO: 1604402 - RNA, 14 nt, Human coronavirus OC43 [HCoV-OC43]
uucgcauguaaaug

SEQ ID NO: 1604403 - RNA, 17 nt, Human coronavirus OC43 [HCoV-OC43]
gucugcagacucuuguu

SEQ ID NO: 1604404 - RNA, 16 nt, Human coronavirus OC43 [HCoV-OC43]
ccuacugguguuuaug

SEQ ID NO: 1604405 - RNA, 21 nt, Human coronavirus OC43 [HCoV-OC43]
uugucauccuaaccuggguaa

SEQ ID NO: 1604406 - RNA, 20 nt, Human coronavirus OC43 [HCoV-OC43]
augaguccaaaaccacagcg

SEQ ID NO: 1604407 - RNA, 17 nt, Human coronavirus OC43 [HCoV-OC43]
cuuaauaacccugcaua

SEQ ID NO: 1604408 - RNA, 15 nt, Human coronavirus OC43 [HCoV-OC43]
guuacuauauugaag

SEQ ID NO: 1604409 - RNA, 22 nt, Human coronavirus OC43 [HCoV-OC43]
guuguacccuacuauucuuggu

SEQ ID NO: 1604410 - RNA, 17 nt, Human coronavirus OC43 [HCoV-OC43]
auaauauugaugcugcu

SEQ ID NO: 1604411 - RNA, 15 nt, Human coronavirus OC43 [HCoV-OC43]
gccaauucuggcaau

SEQ ID NO: 1604412 - RNA, 19 nt, Human coronavirus OC43 [HCoV-OC43]
cauuuguuuauugguuaca

SEQ ID NO: 1604413 - RNA, 13 nt, Human coronavirus OC43 [HCoV-OC43]
acaagugcccaag

SEQ ID NO: 1604414 - RNA, 21 nt, Human coronavirus OC43 [HCoV-OC43]
auguauagugaguucccugcu

SEQ ID NO: 1604415 - RNA, 16 nt, Human coronavirus OC43 [HCoV-OC43]
accaguuauuuugcuu

SEQ ID NO: 1604416 - RNA, 16 nt, Human coronavirus OC43 [HCoV-OC43]
acuacguuuuuaauaa

SEQ ID NO: 1604417 - RNA, 13 nt, Human coronavirus OC43 [HCoV-OC43]
ccaauucuggcaa

SEQ ID NO: 1604418 - RNA, 15 nt, Human coronavirus OC43 [HCoV-OC43]
aauuauuuuuuauga

SEQ ID NO: 1604419 - RNA, 14 nt, Human coronavirus OC43 [HCoV-OC43]
cauacucugacggu

SEQ ID NO: 1604420 - RNA, 17 nt, Human coronavirus OC43 [HCoV-OC43]
agaauuagaagaugcuu

SEQ ID NO: 1604421 - RNA, 14 nt, Human coronavirus OC43 [HCoV-OC43]
uagugacccacagu

SEQ ID NO: 1604422 - RNA, 15 nt, Human coronavirus OC43 [HCoV-OC43]
gugugcaaaguuaua

SEQ ID NO: 1604423 - RNA, 14 nt, Human coronavirus OC43 [HCoV-OC43]
cuuguuuacaagga

SEQ ID NO: 1604424 - RNA, 20 nt, Human coronavirus OC43 [HCoV-OC43]
cuauagauaaguuugcuaua

SEQ ID NO: 1604425 - RNA, 17 nt, Human coronavirus OC43 [HCoV-OC43]
agagugguuauuuuguu

SEQ ID NO: 1604426 - RNA, 17 nt, Human coronavirus OC43 [HCoV-OC43]
gccuuacuuuuguuaau

SEQ ID NO: 1604427 - RNA, 14 nt, Human coronavirus OC43 [HCoV-OC43]
uaguaaaugaauga

SEQ ID NO: 1604428 - RNA, 21 nt, Human coronavirus OC43 [HCoV-OC43]
cuuguuagaucuuuuugcaau

SEQ ID NO: 1604429 - RNA, 23 nt, Human coronavirus OC43 [HCoV-OC43]
auuacucaguuucaaaagggaaa

SEQ ID NO: 1604430 - RNA, 12 nt, Human coronavirus OC43 [HCoV-OC43]
uugcuaaugcau

SEQ ID NO: 1604431 - RNA, 17 nt, Human coronavirus OC43 [HCoV-OC43]
aaugaaggugcugaaug

SEQ ID NO: 1604432 - RNA, 22 nt, Human coronavirus OC43 [HCoV-OC43]
gcauucgcuaauacuguagagg

SEQ ID NO: 1604433 - RNA, 22 nt, Human coronavirus OC43 [HCoV-OC43]
augauuauggguuauuguuguu

SEQ ID NO: 1604434 - RNA, 17 nt, Human coronavirus OC43 [HCoV-OC43]
agaauauggcuguguau

SEQ ID NO: 1604435 - RNA, 15 nt, Human coronavirus OC43 [HCoV-OC43]
acuacaccagcacca

SEQ ID NO: 1604436 - RNA, 15 nt, Human coronavirus OC43 [HCoV-OC43]
agaaugguuuuacuu

SEQ ID NO: 1604437 - RNA, 22 nt, Human coronavirus OC43 [HCoV-OC43]
auguaaaucacaguugguugaa

SEQ ID NO: 1604438 - RNA, 12 nt, Human coronavirus OC43 [HCoV-OC43]
ugguaauuauuu

SEQ ID NO: 1604439 - RNA, 12 nt, Human coronavirus OC43 [HCoV-OC43]
aguuaaauguuu

SEQ ID NO: 1604440 - RNA, 23 nt, Human coronavirus OC43 [HCoV-OC43]
acuaauuuugagccauuuacugu

SEQ ID NO: 1604441 - RNA, 22 nt, Human coronavirus OC43 [HCoV-OC43]
uugaauaagccccgccagaaga

SEQ ID NO: 1604442 - RNA, 17 nt, Human coronavirus OC43 [HCoV-OC43]
ugcgauuguaauuauug

SEQ ID NO: 1604443 - RNA, 22 nt, Human coronavirus OC43 [HCoV-OC43]
cacuucuagacaauauuuacuc

SEQ ID NO: 1604444 - RNA, 15 nt, Human coronavirus OC43 [HCoV-OC43]
aucagaauuuuggug

SEQ ID NO: 1604445 - RNA, 23 nt, Human coronavirus OC43 [HCoV-OC43]
auguuaaaacuuggaacuaguga

SEQ ID NO: 1604446 - RNA, 22 nt, Human coronavirus OC43 [HCoV-OC43]
uuacaaugauguaaaaccacca

SEQ ID NO: 1604447 - RNA, 13 nt, Human coronavirus OC43 [HCoV-OC43]
agcauaacuauag

SEQ ID NO: 1604448 - RNA, 15 nt, Human coronavirus OC43 [HCoV-OC43]
uuaggccaaggcauu

SEQ ID NO: 1604449 - RNA, 14 nt, Human coronavirus OC43 [HCoV-OC43]
uucagcaguguuuu

SEQ ID NO: 1604450 - RNA, 13 nt, Human coronavirus OC43 [HCoV-OC43]
uuaaauuccuaaa

SEQ ID NO: 1604451 - RNA, 20 nt, Human coronavirus OC43 [HCoV-OC43]
cuaaguuuuuguuuaauguu

SEQ ID NO: 1604452 - RNA, 13 nt, Human coronavirus OC43 [HCoV-OC43]
gauugugcugcau

SEQ ID NO: 1604453 - RNA, 18 nt, Human coronavirus OC43 [HCoV-OC43]
gugcuauaagugcuucuu

SEQ ID NO: 1604454 - RNA, 18 nt, Human coronavirus OC43 [HCoV-OC43]
guuaaugcgacuuauuau

SEQ ID NO: 1604455 - RNA, 21 nt, Human coronavirus OC43 [HCoV-OC43]
aaugaugaugaugcuugguuu

SEQ ID NO: 1604456 - RNA, 22 nt, Human coronavirus OC43 [HCoV-OC43]
auugggaacguaagacauuuuc

SEQ ID NO: 1604457 - RNA, 17 nt, Human coronavirus OC43 [HCoV-OC43]
ggcccuaaucagaauuu

SEQ ID NO: 1604458 - RNA, 14 nt, Human coronavirus OC43 [HCoV-OC43]
auuaauuaguugaa

SEQ ID NO: 1604459 - RNA, 15 nt, Human coronavirus OC43 [HCoV-OC43]
agaauggaugucuug

SEQ ID NO: 1604460 - RNA, 13 nt, Human coronavirus OC43 [HCoV-OC43]
auuguaauuauug

SEQ ID NO: 1604461 - RNA, 13 nt, Human coronavirus OC43 [HCoV-OC43]
cucugguguaaca

SEQ ID NO: 1604462 - RNA, 19 nt, Human coronavirus OC43 [HCoV-OC43]
caaguaacuaagcauacug

SEQ ID NO: 1604463 - RNA, 20 nt, Human coronavirus OC43 [HCoV-OC43]
agaguuccuagucaugcuug

SEQ ID NO: 1604464 - RNA, 15 nt, Human coronavirus OC43 [HCoV-OC43]
uccugacgagcccca

SEQ ID NO: 1604465 - RNA, 11 nt, Human coronavirus OC43 [HCoV-OC43]
uagaaauguuc

SEQ ID NO: 1604466 - RNA, 22 nt, Human coronavirus OC43 [HCoV-OC43]
acuauugauugugcugcauuug

SEQ ID NO: 1604467 - RNA, 22 nt, Human coronavirus OC43 [HCoV-OC43]
agacaggaguuaaauguuuaug

SEQ ID NO: 1604468 - RNA, 22 nt, Human coronavirus OC43 [HCoV-OC43]
uuagaccauaaucuaaacaugu

SEQ ID NO: 1604469 - RNA, 18 nt, Human coronavirus OC43 [HCoV-OC43]
uaaauuccuaaaggaaug

SEQ ID NO: 1604470 - RNA, 19 nt, Human coronavirus OC43 [HCoV-OC43]
auaucguaccacuuuguau

SEQ ID NO: 1604471 - RNA, 17 nt, Human coronavirus OC43 [HCoV-OC43]
ggaacuagugacccaca

SEQ ID NO: 1604472 - RNA, 14 nt, Human coronavirus OC43 [HCoV-OC43]
auaaaaguguugau

SEQ ID NO: 1604473 - RNA, 14 nt, Human coronavirus OC43 [HCoV-OC43]
cgccagaagaggag

SEQ ID NO: 1604474 - RNA, 17 nt, Human coronavirus OC43 [HCoV-OC43]
uuacuaggcugcaugau

SEQ ID NO: 1604475 - RNA, 13 nt, Human coronavirus OC43 [HCoV-OC43]
gcuauaacuauag

SEQ ID NO: 1604476 - RNA, 22 nt, Human coronavirus OC43 [HCoV-OC43]
uaacuauagauaaguuugcuau

SEQ ID NO: 1604477 - RNA, 17 nt, Human coronavirus OC43 [HCoV-OC43]
cuuccaguagaucugcu

SEQ ID NO: 1604478 - RNA, 12 nt, Human coronavirus OC43 [HCoV-OC43]
cauaugcuguug

SEQ ID NO: 1604479 - RNA, 16 nt, Human coronavirus OC43 [HCoV-OC43]
ugagccauuuacuguu

SEQ ID NO: 1604480 - RNA, 12 nt, Human coronavirus OC43 [HCoV-OC43]
uuguuaaugcaa

SEQ ID NO: 1604481 - RNA, 13 nt, Human coronavirus OC43 [HCoV-OC43]
ugcagaauuuauc

SEQ ID NO: 1604482 - RNA, 20 nt, Human coronavirus OC43 [HCoV-OC43]
guuuuacuagcauacuuagu

SEQ ID NO: 1604483 - RNA, 15 nt, Human coronavirus OC43 [HCoV-OC43]
aacagccgauggcaa

SEQ ID NO: 1604484 - RNA, 19 nt, Human coronavirus OC43 [HCoV-OC43]
uuacccucugguaauuauu

SEQ ID NO: 1604485 - RNA, 14 nt, Human coronavirus OC43 [HCoV-OC43]
aacggcuuuugcug

SEQ ID NO: 1604486 - RNA, 19 nt, Human coronavirus OC43 [HCoV-OC43]
uguauagauaugaaaggaa

SEQ ID NO: 1604487 - RNA, 15 nt, Human coronavirus OC43 [HCoV-OC43]
auuuuuacuaucugg

SEQ ID NO: 1604488 - RNA, 16 nt, Human coronavirus OC43 [HCoV-OC43]
gcuaagucaaaaucaa

SEQ ID NO: 1604489 - RNA, 16 nt, Human coronavirus OC43 [HCoV-OC43]
aaccagcgucaacugc

SEQ ID NO: 1604490 - RNA, 20 nt, Human coronavirus OC43 [HCoV-OC43]
aaaacuacaccagcaccagu

SEQ ID NO: 1604491 - RNA, 18 nt, Human coronavirus OC43 [HCoV-OC43]
guaggcaguuuuaugagu

SEQ ID NO: 1604492 - RNA, 17 nt, Human coronavirus OC43 [HCoV-OC43]
auggcauuuggauacag

SEQ ID NO: 1604493 - RNA, 15 nt, Human coronavirus OC43 [HCoV-OC43]
auuuaccugcugcua

SEQ ID NO: 1604494 - RNA, 19 nt, Human coronavirus OC43 [HCoV-OC43]
agaacucgcacccacagcu

SEQ ID NO: 1604495 - RNA, 15 nt, Human coronavirus OC43 [HCoV-OC43]
gcccuauacugaaga

SEQ ID NO: 1604496 - RNA, 17 nt, Human coronavirus OC43 [HCoV-OC43]
auugguuuuuauuuggu

SEQ ID NO: 1604497 - RNA, 12 nt, Human coronavirus OC43 [HCoV-OC43]
gguucucuggaa

SEQ ID NO: 1604498 - RNA, 12 nt, Human coronavirus OC43 [HCoV-OC43]
aaugguuauuac

SEQ ID NO: 1604499 - RNA, 18 nt, Human coronavirus OC43 [HCoV-OC43]
uauaaguacugauacugu

SEQ ID NO: 1604500 - RNA, 17 nt, Human coronavirus OC43 [HCoV-OC43]
cugaaaagaaagauggu

SEQ ID NO: 1604501 - RNA, 20 nt, Human coronavirus OC43 [HCoV-OC43]
caaucauauugcaauuugga

SEQ ID NO: 1604502 - RNA, 15 nt, Human coronavirus OC43 [HCoV-OC43]
uuugaguuuguagaa

SEQ ID NO: 1604503 - RNA, 15 nt, Human coronavirus OC43 [HCoV-OC43]
cucugguaauuauuu

SEQ ID NO: 1604504 - RNA, 22 nt, Human coronavirus OC43 [HCoV-OC43]
acuauagauaaguuugcuauac

SEQ ID NO: 1604505 - RNA, 13 nt, Human coronavirus OC43 [HCoV-OC43]
auuuuaucaauuu

SEQ ID NO: 1604506 - RNA, 12 nt, Human coronavirus OC43 [HCoV-OC43]
gcuauuguuaac

SEQ ID NO: 1604507 - RNA, 15 nt, Human coronavirus OC43 [HCoV-OC43]
uaucagguuguuuau

SEQ ID NO: 1604508 - RNA, 15 nt, Human coronavirus OC43 [HCoV-OC43]
uguaaucauauuguu

SEQ ID NO: 1604509 - RNA, 16 nt, Human coronavirus OC43 [HCoV-OC43]
uaaauuucugugguaa

SEQ ID NO: 1604510 - RNA, 19 nt, Human coronavirus OC43 [HCoV-OC43]
uguugacuuuauuaccugg

SEQ ID NO: 1604511 - RNA, 16 nt, Human coronavirus OC43 [HCoV-OC43]
uaagaauggacaagga

SEQ ID NO: 1604512 - RNA, 15 nt, Human coronavirus OC43 [HCoV-OC43]
gcucaacccaagcaa

SEQ ID NO: 1604513 - RNA, 22 nt, Human coronavirus OC43 [HCoV-OC43]
uaauuauuguaguuuuguuguu

SEQ ID NO: 1604514 - RNA, 18 nt, Human coronavirus OC43 [HCoV-OC43]
auucaagaaguuauugau

SEQ ID NO: 1604515 - RNA, 16 nt, Human coronavirus OC43 [HCoV-OC43]
agaucuuuuugcaauc

SEQ ID NO: 1604516 - RNA, 19 nt, Human coronavirus OC43 [HCoV-OC43]
cagcgucaacugcugccac

SEQ ID NO: 1604517 - RNA, 20 nt, Human coronavirus OC43 [HCoV-OC43]
cuugguguuuguguuaauua

SEQ ID NO: 1604518 - RNA, 14 nt, Human coronavirus OC43 [HCoV-OC43]
ggcaucugguggua

SEQ ID NO: 1604519 - RNA, 20 nt, Human coronavirus OC43 [HCoV-OC43]
uaaacauguuuuugauacuu

SEQ ID NO: 1604520 - RNA, 19 nt, Human coronavirus OC43 [HCoV-OC43]
auucuugguucucuggaau

SEQ ID NO: 1604521 - RNA, 16 nt, Human coronavirus OC43 [HCoV-OC43]
cugggucgcuagcaac

SEQ ID NO: 1604522 - RNA, 18 nt, Human coronavirus OC43 [HCoV-OC43]
cagggguagaagagcuca

SEQ ID NO: 1604523 - RNA, 20 nt, Human coronavirus OC43 [HCoV-OC43]
auggagaugcugguuuuacu

SEQ ID NO: 1604524 - RNA, 14 nt, Human coronavirus OC43 [HCoV-OC43]
acuaagcuuaaaga

SEQ ID NO: 1604525 - RNA, 19 nt, Human coronavirus OC43 [HCoV-OC43]
uggaacuagugacccacag

SEQ ID NO: 1604526 - RNA, 20 nt, Human coronavirus OC43 [HCoV-OC43]
augguauuauuuuuaaugcu

SEQ ID NO: 1604527 - RNA, 17 nt, Human coronavirus OC43 [HCoV-OC43]
uaguggcauuuuuggca

SEQ ID NO: 1604528 - RNA, 13 nt, Human coronavirus OC43 [HCoV-OC43]
gcagucauuuaac

SEQ ID NO: 1604529 - RNA, 17 nt, Human coronavirus OC43 [HCoV-OC43]
uccuauaaguacugaua

SEQ ID NO: 1604530 - RNA, 18 nt, Human coronavirus OC43 [HCoV-OC43]
ugaaugaaguuaauuaug

SEQ ID NO: 1604531 - RNA, 16 nt, Human coronavirus OC43 [HCoV-OC43]
acuagugacccacagu

SEQ ID NO: 1604532 - RNA, 22 nt, Human coronavirus OC43 [HCoV-OC43]
acugcugaugaagcuauuaaau

SEQ ID NO: 1604533 - RNA, 15 nt, Human coronavirus OC43 [HCoV-OC43]
gcaaccaucaggagg

SEQ ID NO: 1604534 - RNA, 17 nt, Human coronavirus OC43 [HCoV-OC43]
agaaagaugguuuuuau

SEQ ID NO: 1604535 - RNA, 16 nt, Human coronavirus OC43 [HCoV-OC43]
aagauggcguuaauuu

SEQ ID NO: 1604536 - RNA, 16 nt, Human coronavirus OC43 [HCoV-OC43]
auagauuuggugcuau

SEQ ID NO: 1604537 - RNA, 21 nt, Human coronavirus OC43 [HCoV-OC43]
cuuuggcugccaccucugcua

SEQ ID NO: 1604538 - RNA, 20 nt, Human coronavirus OC43 [HCoV-OC43]
agguuauagcagacuauaga

SEQ ID NO: 1604539 - RNA, 16 nt, Human coronavirus OC43 [HCoV-OC43]
gaugguaugaugaaua

SEQ ID NO: 1604540 - RNA, 14 nt, Human coronavirus OC43 [HCoV-OC43]
aaacugguuuucuu

SEQ ID NO: 1604541 - RNA, 21 nt, Human coronavirus OC43 [HCoV-OC43]
agcuuauugcuaaugcauuua

SEQ ID NO: 1604542 - RNA, 17 nt, Human coronavirus OC43 [HCoV-OC43]
uagagcguccucuggaa

SEQ ID NO: 1604543 - RNA, 15 nt, Human coronavirus OC43 [HCoV-OC43]
aacuaagcauacugc

SEQ ID NO: 1604544 - RNA, 20 nt, Human coronavirus OC43 [HCoV-OC43]
uuaaaacagccgauggcaac

SEQ ID NO: 1604545 - RNA, 19 nt, Human coronavirus OC43 [HCoV-OC43]
auuguaaucauauuguuaa

SEQ ID NO: 1604546 - RNA, 12 nt, Human coronavirus OC43 [HCoV-OC43]
aauuguuauuau

SEQ ID NO: 1604547 - RNA, 20 nt, Human coronavirus OC43 [HCoV-OC43]
uauaacggcgcaauuagguu

SEQ ID NO: 1604548 - RNA, 16 nt, Human coronavirus OC43 [HCoV-OC43]
gaugucuuuuauucag

SEQ ID NO: 1604549 - RNA, 15 nt, Human coronavirus OC43 [HCoV-OC43]
gcguaguagagccaa

SEQ ID NO: 1604550 - RNA, 20 nt, Human coronavirus OC43 [HCoV-OC43]
auguggaugacguuuaggua

SEQ ID NO: 1604551 - RNA, 18 nt, Human coronavirus OC43 [HCoV-OC43]
guuaucgguuuacuaauu

SEQ ID NO: 1604552 - RNA, 17 nt, Human coronavirus OC43 [HCoV-OC43]
ccaguuuagaaauguuc

SEQ ID NO: 1604553 - RNA, 23 nt, Human coronavirus OC43 [HCoV-OC43]
caaugcuuauaauaguacugcua

SEQ ID NO: 1604554 - RNA, 16 nt, Human coronavirus OC43 [HCoV-OC43]
guuaaugcgacuuauu

SEQ ID NO: 1604555 - RNA, 21 nt, Human coronavirus OC43 [HCoV-OC43]
cugauacuguugauguuacua

SEQ ID NO: 1604556 - RNA, 15 nt, Human coronavirus OC43 [HCoV-OC43]
gagaaauaauaucua

SEQ ID NO: 1604557 - RNA, 19 nt, Human coronavirus OC43 [HCoV-OC43]
ggcuauuccgacuagguuu

SEQ ID NO: 1604558 - RNA, 16 nt, Human coronavirus OC43 [HCoV-OC43]
gagcguccucuggaaa

SEQ ID NO: 1604559 - RNA, 17 nt, Human coronavirus OC43 [HCoV-OC43]
auuguguauuuugugaa

SEQ ID NO: 1604560 - RNA, 16 nt, Human coronavirus OC43 [HCoV-OC43]
aacccaagcaaacugc

SEQ ID NO: 1604561 - RNA, 14 nt, Human coronavirus OC43 [HCoV-OC43]
uguucuacugauuu

SEQ ID NO: 1604562 - RNA, 14 nt, Human coronavirus OC43 [HCoV-OC43]
ccacuaaaccucag

SEQ ID NO: 1604563 - RNA, 13 nt, Human coronavirus OC43 [HCoV-OC43]
ucauuagugcaga

SEQ ID NO: 1604564 - RNA, 16 nt, Human coronavirus OC43 [HCoV-OC43]
agucauuuaacuauag

SEQ ID NO: 1604565 - RNA, 15 nt, Human coronavirus OC43 [HCoV-OC43]
augaauagguuacag

SEQ ID NO: 1604566 - RNA, 16 nt, Human coronavirus OC43 [HCoV-OC43]
uguaauguauaguguu

SEQ ID NO: 1604567 - RNA, 17 nt, Human coronavirus OC43 [HCoV-OC43]
acaguuccccauucuug

SEQ ID NO: 1604568 - RNA, 16 nt, Human coronavirus OC43 [HCoV-OC43]
acuuguaauaauauug

SEQ ID NO: 1604569 - RNA, 19 nt, Human coronavirus OC43 [HCoV-OC43]
cuucuuaagaagauggaug

SEQ ID NO: 1604570 - RNA, 16 nt, Human coronavirus OC43 [HCoV-OC43]
aucaagaugguauuau

SEQ ID NO: 1604571 - RNA, 21 nt, Human coronavirus OC43 [HCoV-OC43]
aauuuuucuuuggguauuaua

SEQ ID NO: 1604572 - RNA, 16 nt, Human coronavirus OC43 [HCoV-OC43]
uuuucagauuaaauuu

SEQ ID NO: 1604573 - RNA, 22 nt, Human coronavirus OC43 [HCoV-OC43]
cucuaccccuauggcagauguc

SEQ ID NO: 1604574 - RNA, 17 nt, Human coronavirus OC43 [HCoV-OC43]
gcuaagggguacuggua

SEQ ID NO: 1604575 - RNA, 16 nt, Human coronavirus OC43 [HCoV-OC43]
uuuauaugauucuaau

SEQ ID NO: 1604576 - RNA, 22 nt, Human coronavirus OC43 [HCoV-OC43]
guuaauuauggccaauuggaag

SEQ ID NO: 1604577 - RNA, 18 nt, Human coronavirus OC43 [HCoV-OC43]
gcagcaaaauaagaguag

SEQ ID NO: 1604578 - RNA, 12 nt, Human coronavirus OC43 [HCoV-OC43]
auguauggcuuu

SEQ ID NO: 1604579 - RNA, 20 nt, Human coronavirus OC43 [HCoV-OC43]
uuguccugcagguacuaauu

SEQ ID NO: 1604580 - RNA, 19 nt, Human coronavirus OC43 [HCoV-OC43]
guacuggcuauucuuuggc

SEQ ID NO: 1604581 - RNA, 18 nt, Human coronavirus OC43 [HCoV-OC43]
cagaaaauuuugaauaag

SEQ ID NO: 1604582 - RNA, 15 nt, Human coronavirus OC43 [HCoV-OC43]
cugguuuuacuagca

SEQ ID NO: 1604583 - RNA, 21 nt, Human coronavirus OC43 [HCoV-OC43]
uaacaaugcccuuuaugcuau

SEQ ID NO: 1604584 - RNA, 21 nt, Human coronavirus OC43 [HCoV-OC43]
auuuuuaggaguuuucacuuu

SEQ ID NO: 1604585 - RNA, 14 nt, Human coronavirus OC43 [HCoV-OC43]
cauuaacuauuuug

SEQ ID NO: 1604586 - RNA, 15 nt, Human coronavirus OC43 [HCoV-OC43]
uauuuugcaugaugu

SEQ ID NO: 1604587 - RNA, 19 nt, Human coronavirus OC43 [HCoV-OC43]
uuauguuaaguccaaaguc

SEQ ID NO: 1604588 - RNA, 19 nt, Human coronavirus OC43 [HCoV-OC43]
ugucaaccuccguacuguu

SEQ ID NO: 1604589 - RNA, 16 nt, Human coronavirus OC43 [HCoV-OC43]
aaggaacaauguaugu

SEQ ID NO: 1604590 - RNA, 21 nt, Human coronavirus OC43 [HCoV-OC43]
uggcuauucuuuggcagauuu

SEQ ID NO: 1604591 - RNA, 18 nt, Human coronavirus OC43 [HCoV-OC43]
guuuagaaauguucaaac

SEQ ID NO: 1604592 - RNA, 13 nt, Human coronavirus OC43 [HCoV-OC43]
gaaaaguuuucau

SEQ ID NO: 1604593 - RNA, 21 nt, Human coronavirus OC43 [HCoV-OC43]
uguucuuacuaaucaugaugu

SEQ ID NO: 1604594 - RNA, 17 nt, Human coronavirus OC43 [HCoV-OC43]
gcccaagggaagagcca

SEQ ID NO: 1604595 - RNA, 17 nt, Human coronavirus OC43 [HCoV-OC43]
cuaguuagcugcauaau

SEQ ID NO: 1604596 - RNA, 15 nt, Human coronavirus OC43 [HCoV-OC43]
acuagugguuuugcu

SEQ ID NO: 1604597 - RNA, 18 nt, Human coronavirus OC43 [HCoV-OC43]
ugaguccaaaaccacagc

SEQ ID NO: 1604598 - RNA, 18 nt, Human coronavirus OC43 [HCoV-OC43]
auagguaguacuuuugua

SEQ ID NO: 1604599 - RNA, 13 nt, Human coronavirus OC43 [HCoV-OC43]
ucaguuucaaaag

SEQ ID NO: 1604600 - RNA, 21 nt, Human coronavirus OC43 [HCoV-OC43]
auuauuauguggauuguguau

SEQ ID NO: 1604601 - RNA, 21 nt, Human coronavirus OC43 [HCoV-OC43]
guuaauuuuacgccuuaucau

SEQ ID NO: 1604602 - RNA, 21 nt, Human coronavirus OC43 [HCoV-OC43]
cagacacugguguuguuacua

SEQ ID NO: 1604603 - RNA, 23 nt, Human coronavirus OC43 [HCoV-OC43]
acaagcucuccuaaaguuacuau

SEQ ID NO: 1604604 - RNA, 13 nt, Human coronavirus OC43 [HCoV-OC43]
auuauuuuaauaa

SEQ ID NO: 1604605 - RNA, 23 nt, Human coronavirus OC43 [HCoV-OC43]
uugcuaauuuuauuuugcaugau

SEQ ID NO: 1604606 - RNA, 14 nt, Human coronavirus OC43 [HCoV-OC43]
uucuacugauuuac

SEQ ID NO: 1604607 - RNA, 14 nt, Human coronavirus OC43 [HCoV-OC43]
ucuuucugauuuua

SEQ ID NO: 1604608 - RNA, 20 nt, Human coronavirus OC43 [HCoV-OC43]
ucugggaauccugacgagcc

SEQ ID NO: 1604609 - RNA, 22 nt, Human coronavirus OC43 [HCoV-OC43]
agaaggugguacuuuuuaugca

SEQ ID NO: 1604610 - RNA, 22 nt, Human coronavirus OC43 [HCoV-OC43]
auagaggauuuacuuuuugaua

SEQ ID NO: 1604611 - RNA, 12 nt, Human coronavirus OC43 [HCoV-OC43]
auuuuuguugag

SEQ ID NO: 1604612 - RNA, 16 nt, Human coronavirus OC43 [HCoV-OC43]
ugaaggugcugaauga

SEQ ID NO: 1604613 - RNA, 20 nt, Human coronavirus OC43 [HCoV-OC43]
uuacuagcauacuuaguggu

SEQ ID NO: 1604614 - RNA, 15 nt, Human coronavirus OC43 [HCoV-OC43]
agaagaggagcccca

SEQ ID NO: 1604615 - RNA, 20 nt, Human coronavirus OC43 [HCoV-OC43]
cuauagcggucguguuucug

SEQ ID NO: 1604616 - RNA, 15 nt, Human coronavirus OC43 [HCoV-OC43]
aucgcagauguuuac

SEQ ID NO: 1604617 - RNA, 21 nt, Human coronavirus OC43 [HCoV-OC43]
auugcguauacgcauugaaua

SEQ ID NO: 1604618 - RNA, 17 nt, Human coronavirus OC43 [HCoV-OC43]
uugcagugcccaaaagc

SEQ ID NO: 1604619 - RNA, 18 nt, Human coronavirus OC43 [HCoV-OC43]
uuaugauaaauauuuugg

SEQ ID NO: 1604620 - RNA, 10 nt, Human coronavirus OC43 [HCoV-OC43]
gcagugccca

SEQ ID NO: 1604621 - RNA, 24 nt, Human coronavirus OC43 [HCoV-OC43]
gcuauuucggaauauuaaaugcaa

SEQ ID NO: 1604622 - RNA, 14 nt, Human coronavirus OC43 [HCoV-OC43]
cauccagcagagcc

SEQ ID NO: 1604623 - RNA, 19 nt, Human coronavirus OC43 [HCoV-OC43]
agguuuacaauuucaaauu

SEQ ID NO: 1604624 - RNA, 16 nt, Human coronavirus OC43 [HCoV-OC43]
aaugguauuuuugcua

SEQ ID NO: 1604625 - RNA, 22 nt, Human coronavirus OC43 [HCoV-OC43]
uuaucaagaaggugguacuuuu

SEQ ID NO: 1604626 - RNA, 18 nt, Human coronavirus OC43 [HCoV-OC43]
uagguagugguuacugug

SEQ ID NO: 1604627 - RNA, 16 nt, Human coronavirus OC43 [HCoV-OC43]
aacuaauucugcuuua

SEQ ID NO: 1604628 - RNA, 19 nt, Human coronavirus OC43 [HCoV-OC43]
gugucaaaagccaaucauc

SEQ ID NO: 1604629 - RNA, 23 nt, Human coronavirus OC43 [HCoV-OC43]
guaauauggaggaguuuauucaa

SEQ ID NO: 1604630 - RNA, 19 nt, Human coronavirus OC43 [HCoV-OC43]
uugaccuacaauuggguaa

SEQ ID NO: 1604631 - RNA, 15 nt, Human coronavirus OC43 [HCoV-OC43]
gcuaauguuucuguu

SEQ ID NO: 1604632 - RNA, 15 nt, Human coronavirus OC43 [HCoV-OC43]
cuauagguaguacuu

SEQ ID NO: 1604633 - RNA, 12 nt, Human coronavirus OC43 [HCoV-OC43]
cugcugaugaag

SEQ ID NO: 1604634 - RNA, 16 nt, Human coronavirus OC43 [HCoV-OC43]
uuaucuugguuguguu

SEQ ID NO: 1604635 - RNA, 20 nt, Human coronavirus OC43 [HCoV-OC43]
uuaacuaucaauuuccuaaa

SEQ ID NO: 1604636 - RNA, 13 nt, Human coronavirus OC43 [HCoV-OC43]
guuuugagaccau

SEQ ID NO: 1604637 - RNA, 18 nt, Human coronavirus OC43 [HCoV-OC43]
gcuagucuuguucuggca

SEQ ID NO: 1604638 - RNA, 22 nt, Human coronavirus OC43 [HCoV-OC43]
aaugguguuacucuuagcacua

SEQ ID NO: 1604639 - RNA, 22 nt, Human coronavirus OC43 [HCoV-OC43]
ggacccaaguagcgaugaggcu

SEQ ID NO: 1604640 - RNA, 21 nt, Human coronavirus OC43 [HCoV-OC43]
gcuauaagugcuucuuuacaa

SEQ ID NO: 1604641 - RNA, 16 nt, Human coronavirus OC43 [HCoV-OC43]
gcugcaugaugcuuag

SEQ ID NO: 1604642 - RNA, 23 nt, Human coronavirus OC43 [HCoV-OC43]
acuuuuuaugcauauuuuacaga

SEQ ID NO: 1604643 - RNA, 17 nt, Human coronavirus OC43 [HCoV-OC43]
aacuggaaguuuuugga

SEQ ID NO: 1604644 - RNA, 18 nt, Human coronavirus OC43 [HCoV-OC43]
ucuuaccgcucuuaaugc

SEQ ID NO: 1604645 - RNA, 18 nt, Human coronavirus OC43 [HCoV-OC43]
gagccaauucuggcaaua

SEQ ID NO: 1604646 - RNA, 19 nt, Human coronavirus OC43 [HCoV-OC43]
uaggcagcgaauguaguaa

SEQ ID NO: 1604647 - RNA, 15 nt, Human coronavirus OC43 [HCoV-OC43]
augcagcauguaaau

SEQ ID NO: 1604648 - RNA, 17 nt, Human coronavirus OC43 [HCoV-OC43]
auuuuguuaauguaaau

SEQ ID NO: 1604649 - RNA, 18 nt, Human coronavirus OC43 [HCoV-OC43]
augggaauucguuuugaa

SEQ ID NO: 1604650 - RNA, 20 nt, Human coronavirus OC43 [HCoV-OC43]
aacugcugccacgaugguau

SEQ ID NO: 1604651 - RNA, 22 nt, Human coronavirus OC43 [HCoV-OC43]
cagguguuguuuccuguuuaua

SEQ ID NO: 1604652 - RNA, 16 nt, Human coronavirus OC43 [HCoV-OC43]
cguuuuucuuuggauc

SEQ ID NO: 1604653 - RNA, 21 nt, Human coronavirus OC43 [HCoV-OC43]
uuaaagaucguguaauguaua

SEQ ID NO: 1604654 - RNA, 14 nt, Human coronavirus OC43 [HCoV-OC43]
cucagaauuagaag

SEQ ID NO: 1604655 - RNA, 11 nt, Human coronavirus OC43 [HCoV-OC43]
aggaugucuuu

SEQ ID NO: 1604656 - RNA, 19 nt, Human coronavirus OC43 [HCoV-OC43]
cagagccucuagugcagga

SEQ ID NO: 1604657 - RNA, 22 nt, Human coronavirus OC43 [HCoV-OC43]
cccuauacugaagacaccucag

SEQ ID NO: 1604658 - RNA, 18 nt, Human coronavirus OC43 [HCoV-OC43]
guuacuauauugaaggcu

SEQ ID NO: 1604659 - RNA, 19 nt, Human coronavirus OC43 [HCoV-OC43]
aauuguaauuuuaauauga

SEQ ID NO: 1604660 - RNA, 18 nt, Human coronavirus OC43 [HCoV-OC43]
guaauccaaacauuauga

SEQ ID NO: 1604661 - RNA, 20 nt, Human coronavirus OC43 [HCoV-OC43]
aauuuugagccauuuacugu

SEQ ID NO: 1604662 - RNA, 17 nt, Human coronavirus OC43 [HCoV-OC43]
aaggauguuuaugaauu

SEQ ID NO: 1604663 - RNA, 21 nt, Human coronavirus OC43 [HCoV-OC43]
auacuuagugguuuguuauau

SEQ ID NO: 1604664 - RNA, 21 nt, Human coronavirus OC43 [HCoV-OC43]
auagcuccuaagagugguuau

SEQ ID NO: 1604665 - RNA, 16 nt, Human coronavirus OC43 [HCoV-OC43]
ggcucaggaaggucug

SEQ ID NO: 1604666 - RNA, 15 nt, Human coronavirus OC43 [HCoV-OC43]
acaauuggguaauuu

SEQ ID NO: 1604667 - RNA, 13 nt, Human coronavirus OC43 [HCoV-OC43]
cauacugccaaag

SEQ ID NO: 1604668 - RNA, 19 nt, Human coronavirus OC43 [HCoV-OC43]
uguuaauguaccauauguu

SEQ ID NO: 1604669 - RNA, 20 nt, Human coronavirus OC43 [HCoV-OC43]
uacucaguuucaaaagggaa

SEQ ID NO: 1604670 - RNA, 14 nt, Human coronavirus OC43 [HCoV-OC43]
ugccacgaugguau

SEQ ID NO: 1604671 - RNA, 16 nt, Human coronavirus OC43 [HCoV-OC43]
gacaccucagaaauau

SEQ ID NO: 1604672 - RNA, 16 nt, Human coronavirus OC43 [HCoV-OC43]
ugccgacaagugccca

SEQ ID NO: 1604673 - RNA, 13 nt, Human coronavirus OC43 [HCoV-OC43]
ugaaaauaauguu

SEQ ID NO: 1604674 - RNA, 19 nt, Human coronavirus OC43 [HCoV-OC43]
cucaggaaggucugcuccu

SEQ ID NO: 1604675 - RNA, 19 nt, Human coronavirus OC43 [HCoV-OC43]
uguagaagaauugcaugac

SEQ ID NO: 1604676 - RNA, 20 nt, Human coronavirus OC43 [HCoV-OC43]
ucuaggcagcgaauguagua

SEQ ID NO: 1604677 - RNA, 11 nt, Human coronavirus OC43 [HCoV-OC43]
ugcuguugauu

SEQ ID NO: 1604678 - RNA, 14 nt, Human coronavirus OC43 [HCoV-OC43]
auacagguguuguu

SEQ ID NO: 1604679 - RNA, 20 nt, Human coronavirus OC43 [HCoV-OC43]
gacaccgcauuguugagaaa

SEQ ID NO: 1604680 - RNA, 17 nt, Human coronavirus OC43 [HCoV-OC43]
ugccacuaaaccucagc

SEQ ID NO: 1604681 - RNA, 23 nt, Human coronavirus OC43 [HCoV-OC43]
agcuuauugcuaaugcauuuaac

SEQ ID NO: 1604682 - RNA, 19 nt, Human coronavirus OC43 [HCoV-OC43]
uggccaaagugcagaauuu

SEQ ID NO: 1604683 - RNA, 15 nt, Human coronavirus OC43 [HCoV-OC43]
gcgcaauuagguuug

SEQ ID NO: 1604684 - RNA, 22 nt, Human coronavirus OC43 [HCoV-OC43]
cagaauuuaucugggaauccug

SEQ ID NO: 1604685 - RNA, 23 nt, Human coronavirus OC43 [HCoV-OC43]
uuguauuuuuaacggcaaguuuu

SEQ ID NO: 1604686 - RNA, 13 nt, Human coronavirus OC43 [HCoV-OC43]
auugaugcugcua

SEQ ID NO: 1604687 - RNA, 15 nt, Human coronavirus OC43 [HCoV-OC43]
gaaaaugauaauaua

SEQ ID NO: 1604688 - RNA, 17 nt, Human coronavirus OC43 [HCoV-OC43]
augcaaaugcugaagcu

SEQ ID NO: 1604689 - RNA, 12 nt, Human coronavirus OC43 [HCoV-OC43]
cuaucugggaac

SEQ ID NO: 1604690 - RNA, 17 nt, Human coronavirus OC43 [HCoV-OC43]
aaggaaaauguugauuu

SEQ ID NO: 1604691 - RNA, 16 nt, Human coronavirus OC43 [HCoV-OC43]
uuugauacuuuuaauu

SEQ ID NO: 1604692 - RNA, 21 nt, Human coronavirus OC43 [HCoV-OC43]
ccauaauuauucuuauaugga

SEQ ID NO: 1604693 - RNA, 18 nt, Human coronavirus OC43 [HCoV-OC43]
ucaacaacaagaugguau

SEQ ID NO: 1604694 - RNA, 21 nt, Human coronavirus OC43 [HCoV-OC43]
aacuauagaauugauacuacu

SEQ ID NO: 1604695 - RNA, 17 nt, Human coronavirus OC43 [HCoV-OC43]
ccacuaaaccucagcaa

SEQ ID NO: 1604696 - RNA, 17 nt, Human coronavirus OC43 [HCoV-OC43]
aguccaaaaccacagcg

SEQ ID NO: 1604697 - RNA, 16 nt, Human coronavirus OC43 [HCoV-OC43]
acucgcacccacagcu

SEQ ID NO: 1604698 - RNA, 15 nt, Human coronavirus OC43 [HCoV-OC43]
aagccgcgugcagca

SEQ ID NO: 1604699 - RNA, 18 nt, Human coronavirus OC43 [HCoV-OC43]
gugguaaugguaaucaua

SEQ ID NO: 1604700 - RNA, 15 nt, Human coronavirus OC43 [HCoV-OC43]
cuccuauaaguacug

SEQ ID NO: 1604701 - RNA, 17 nt, Human coronavirus OC43 [HCoV-OC43]
ugacgagccccagaagg

SEQ ID NO: 1604702 - RNA, 19 nt, Human coronavirus OC43 [HCoV-OC43]
gacaagugcccaagggaag

SEQ ID NO: 1604703 - RNA, 15 nt, Human coronavirus OC43 [HCoV-OC43]
guuuggguacuuauu

SEQ ID NO: 1604704 - RNA, 19 nt, Human coronavirus OC43 [HCoV-OC43]
auuucuguccguguaaauu

SEQ ID NO: 1604705 - RNA, 17 nt, Human
cugcccuuaccugccag

SEQ ID NO: 1604706 - RNA, 16 nt, Human
cugcccuuaccugcca

SEQ ID NO: 1604707 - RNA, 12 nt, Human
cugcccuuaccu

SEQ ID NO: 1604708 - RNA, 19 nt, Human
cugccccuccucucugccc

SEQ ID NO: 1604709 - RNA, 20 nt, Human
cugccccuccucucugcccu

SEQ ID NO: 1604710 - RNA, 18 nt, Human
cugccccuccucucugcc

SEQ ID NO: 1604711 - RNA, 17 nt, Human
cugccccuccucucugc

SEQ ID NO: 1604712 - RNA, 13 nt, Human
cugccccucccuu

SEQ ID NO: 1604713 - RNA, 17 nt, Human
cugccccucccuucaac

SEQ ID NO: 1604714 - RNA, 14 nt, Human
cugccccucccuuc

SEQ ID NO: 1604715 - RNA, 23 nt, Human
cugccagggacagaggggguggc

SEQ ID NO: 1604716 - RNA, 22 nt, Human
cugccagggacagagggggugg

SEQ ID NO: 1604717 - RNA, 20 nt, Human
cugccagggacagagggggu

SEQ ID NO: 1604718 - RNA, 17 nt, Human
cugcauuuaaaagauac

SEQ ID NO: 1604719 - RNA, 18 nt, Human
cugcauuuaaaagauaca

SEQ ID NO: 1604720 - RNA, 17 nt, Human
cugccagucccccugcc

SEQ ID NO: 1604721 - RNA, 21 nt, Human
cugccagucccccugccccag

SEQ ID NO: 1604722 - RNA, 20 nt, Human
cugccagucccccugcccca

SEQ ID NO: 1604723 - RNA, 22 nt, Human
cugccagucccccugccccagg

SEQ ID NO: 1604724 - RNA, 13 nt, Human
cugccccccagcc

SEQ ID NO: 1604725 - RNA, 19 nt, Human
cugccauccagguucagcu

SEQ ID NO: 1604726 - RNA, 18 nt, Human
cugccauccagguucagc

SEQ ID NO: 1604727 - RNA, 16 nt, Human
cugccauccagguuca

SEQ ID NO: 1604728 - RNA, 16 nt, Human
cugccauauucuguug

SEQ ID NO: 1604729 - RNA, 14 nt, Human
cugcauuuaaaaga

SEQ ID NO: 1604730 - RNA, 13 nt, Human
cugcauuggcuuu

SEQ ID NO: 1604731 - RNA, 16 nt, Human
cugcacuccagccuga

SEQ ID NO: 1604732 - RNA, 15 nt, Human
cugcacuccagccug

SEQ ID NO: 1604733 - RNA, 20 nt, Human
cugcacuccagccugagcga

SEQ ID NO: 1604734 - RNA, 17 nt, Human
cugcacuccagccugag

SEQ ID NO: 1604735 - RNA, 23 nt, Human
cugcacuauagccuaggugacag

SEQ ID NO: 1604736 - RNA, 22 nt, Human
cugcacuauagccuaggugaca

SEQ ID NO: 1604737 - RNA, 13 nt, Human
cugcacuccagcc

SEQ ID NO: 1604738 - RNA, 20 nt, Human
cugcacuauagccuagguga

SEQ ID NO: 1604739 - RNA, 18 nt, Human
cugcacuauagccuaggu

SEQ ID NO: 1604740 - RNA, 17 nt, Human
cugcacuauagccuagg

SEQ ID NO: 1604741 - RNA, 16 nt, Human
cugcacuauagccuag

SEQ ID NO: 1604742 - RNA, 20 nt, Human
cugcacggugaauggcuuug

SEQ ID NO: 1604743 - RNA, 17 nt, Human
cugcacggugaauggcu

SEQ ID NO: 1604744 - RNA, 15 nt, Human
cugcacggugaaugg

SEQ ID NO: 1604745 - RNA, 14 nt, Human
cugcacggugaaug

SEQ ID NO: 1604746 - RNA, 23 nt, Human
cugcagccucaaccuccugggcu

SEQ ID NO: 1604747 - RNA, 19 nt, Human
cugcacuccagccugggug

SEQ ID NO: 1604748 - RNA, 24 nt, Human
cugcagccucaaccuccugggcua

SEQ ID NO: 1604749 - RNA, 17 nt, Human
cugcacuccagccuggg

SEQ ID NO: 1604750 - RNA, 16 nt, Human
cugcacuccagccugg

SEQ ID NO: 1604751 - RNA, 18 nt, Human
cugcacuccagccugggu

SEQ ID NO: 1604752 - RNA, 20 nt, Human
cugcaggcagccaggccaca

SEQ ID NO: 1604753 - RNA, 19 nt, Human
cugcaggcagccaggccac

SEQ ID NO: 1604754 - RNA, 18 nt, Human
cugcaggcagccaggcca

SEQ ID NO: 1604755 - RNA, 17 nt, Human
cugcaggcagccaggcc

SEQ ID NO: 1604756 - RNA, 16 nt, Human
cugcaggcagccaggc

SEQ ID NO: 1604757 - RNA, 15 nt, Human
cugcaggcagccagg

SEQ ID NO: 1604758 - RNA, 14 nt, Human
cugcaggcagccag

SEQ ID NO: 1604759 - RNA, 13 nt, Human
cugcaggcagcca

SEQ ID NO: 1604760 - RNA, 12 nt, Human
cugcagcuuugu

SEQ ID NO: 1604761 - RNA, 22 nt, Human
cugcaaaggguaucaggugcug

SEQ ID NO: 1604762 - RNA, 21 nt, Human
cugcaaaggguaucaggugcu

SEQ ID NO: 1604763 - RNA, 18 nt, Human
cugcaaagcccagcuuga

SEQ ID NO: 1604764 - RNA, 23 nt, Human
cugaugggcaacccccagccugc

SEQ ID NO: 1604765 - RNA, 22 nt, Human
cugaugggcaacccccagccug

SEQ ID NO: 1604766 - RNA, 24 nt, Human
cugaugggcaacccccagccugcu

SEQ ID NO: 1604767 - RNA, 20 nt, Human
cugaugcuucuucagagacu

SEQ ID NO: 1604768 - RNA, 19 nt, Human
cugaugcuucuucagagac

SEQ ID NO: 1604769 - RNA, 18 nt, Human
cugaugcuucuucagaga

SEQ ID NO: 1604770 - RNA, 21 nt, Human
cugaugggcaacccccagccu

SEQ ID NO: 1604771 - RNA, 18 nt, Human
cugaugggcaacccccag

SEQ ID NO: 1604772 - RNA, 17 nt, Human
cugaugcuucuucagag

SEQ ID NO: 1604773 - RNA, 16 nt, Human
cugaugcuucuucaga

SEQ ID NO: 1604774 - RNA, 15 nt, Human
cucuuaugggcuggg

SEQ ID NO: 1604775 - RNA, 14 nt, Human
cucuuaugggcugg

SEQ ID NO: 1604776 - RNA, 18 nt, Human
cucuuauaucuauauuuu

SEQ ID NO: 1604777 - RNA, 15 nt, Human
cucuuauaucuauau

SEQ ID NO: 1604778 - RNA, 20 nt, Human
cugcaagaauugaagcagga

SEQ ID NO: 1604779 - RNA, 12 nt, Human
cugcaagggagu

SEQ ID NO: 1604780 - RNA, 23 nt, Human
cugcaccgggccacagagaaagu

SEQ ID NO: 1604781 - RNA, 21 nt, Human
cugcaaccugauugugucucu

SEQ ID NO: 1604782 - RNA, 19 nt, Human
cugcaaccugauugugucu

SEQ ID NO: 1604783 - RNA, 14 nt, Human
cugcaaccugauug

SEQ ID NO: 1604784 - RNA, 22 nt, Human
cugcaaccuccgccucuugggu

SEQ ID NO: 1604785 - RNA, 20 nt, Human
cugcaaccuccgccucuugg

SEQ ID NO: 1604786 - RNA, 18 nt, Human
cugcaagaauugaagcag

SEQ ID NO: 1604787 - RNA, 19 nt, Human
cugcaacuuguaaaugugg

SEQ ID NO: 1604788 - RNA, 18 nt, Human
cugcaacuuguaaaugug

SEQ ID NO: 1604789 - RNA, 22 nt, Human
cugcaaccugauugugucucuu

SEQ ID NO: 1604790 - RNA, 22 nt, Human
cugcaaccuucgccaccugggu

SEQ ID NO: 1604791 - RNA, 20 nt, Human
cugcaaccuucgccaccugg

SEQ ID NO: 1604792 - RNA, 19 nt, Human
cugcaaccuucgccaccug

SEQ ID NO: 1604793 - RNA, 17 nt, Human
cugcaaccuucgccacc

SEQ ID NO: 1604794 - RNA, 15 nt, Human
cuggaugcagccuca

SEQ ID NO: 1604795 - RNA, 15 nt, Human
cuggaguucugguuc

SEQ ID NO: 1604796 - RNA, 17 nt, Human
cuggaguucugguuccu

SEQ ID NO: 1604797 - RNA, 16 nt, Human
cuggaguucugguucc

SEQ ID NO: 1604798 - RNA, 23 nt, Human
cuggacugugugcucaggagccc

SEQ ID NO: 1604799 - RNA, 22 nt, Human
cuggacugugugcucaggagcc

SEQ ID NO: 1604800 - RNA, 19 nt, Human
cuggacugugugcucagga

SEQ ID NO: 1604801 - RNA, 19 nt, Human
cugcucacauaucugucau

SEQ ID NO: 1604802 - RNA, 16 nt, Human
cugcucacauaucugu

SEQ ID NO: 1604803 - RNA, 12 nt, Human
cugcugacagug

SEQ ID NO: 1604804 - RNA, 15 nt, Human
cugcugaaggcucga

SEQ ID NO: 1604805 - RNA, 14 nt, Human
cugcugaaggcucg

SEQ ID NO: 1604806 - RNA, 13 nt, Human
cugcugaaggcuc

SEQ ID NO: 1604807 - RNA, 15 nt, Human
cugcugacaguguug

SEQ ID NO: 1604808 - RNA, 13 nt, Human
cugcugacagugu

SEQ ID NO: 1604809 - RNA, 23 nt, Human
cugcugagucccaggcugagccu

SEQ ID NO: 1604810 - RNA, 19 nt, Human
cugcugagucccaggcuga

SEQ ID NO: 1604811 - RNA, 12 nt, Human
cuggcccuuccu

SEQ ID NO: 1604812 - RNA, 22 nt, Human
cuggcuaugcauuugaaaauuu

SEQ ID NO: 1604813 - RNA, 15 nt, Human
cuggcuaugcauuug

SEQ ID NO: 1604814 - RNA, 16 nt, Human
cuggcuaugcauuuga

SEQ ID NO: 1604815 - RNA, 13 nt, Human
cuggcuaugcauu

SEQ ID NO: 1604816 - RNA, 14 nt, Human
cuggcuaugcauuu

SEQ ID NO: 1604817 - RNA, 22 nt, Human
cugggacaugggaaaggggaag

SEQ ID NO: 1604818 - RNA, 18 nt, Human
cugggacaugggaaaggg

SEQ ID NO: 1604819 - RNA, 14 nt, Human
cugggacaugggaa

SEQ ID NO: 1604820 - RNA, 16 nt, Human
cugggacuacaggcac

SEQ ID NO: 1604821 - RNA, 15 nt, Human
cugggacuacaggca

SEQ ID NO: 1604822 - RNA, 13 nt, Human
cugggacuacagg

SEQ ID NO: 1604823 - RNA, 22 nt, Human
cugggagaaccaaaaagaggcu

SEQ ID NO: 1604824 - RNA, 17 nt, Human
cugggagaaaugaaaaa

SEQ ID NO: 1604825 - RNA, 16 nt, Human
cugggagaaaugaaaa

SEQ ID NO: 1604826 - RNA, 12 nt, Human
cugggcagagga

SEQ ID NO: 1604827 - RNA, 16 nt, Human
cugggcagaggaaagc

SEQ ID NO: 1604828 - RNA, 13 nt, Human
cugggcagaggaa

SEQ ID NO: 1604829 - RNA, 13 nt, Human
cugggcagcugcc

SEQ ID NO: 1604830 - RNA, 20 nt, Human
cugggcagaggaaagcaaag

SEQ ID NO: 1604831 - RNA, 16 nt, Human
cugggcagcugccucc

SEQ ID NO: 1604832 - RNA, 14 nt, Human
cugggcagcugccu

SEQ ID NO: 1604833 - RNA, 15 nt, Human
cugggcagcugccuc

SEQ ID NO: 1604834 - RNA, 20 nt, Human
cugggcagguuggugggggc

SEQ ID NO: 1604835 - RNA, 14 nt, Human
cuggggagaaagua

SEQ ID NO: 1604836 - RNA, 13 nt, Human
cuggggagaaagu

SEQ ID NO: 1604837 - RNA, 20 nt, Human
cuggguggcaccagcagccu

SEQ ID NO: 1604838 - RNA, 18 nt, Human
cuggguggcaccagcagc

SEQ ID NO: 1604839 - RNA, 21 nt, Human
cuggugccucaccccuugcca

SEQ ID NO: 1604840 - RNA, 21 nt, Human
cuggguggcaccagcagccug

SEQ ID NO: 1604841 - RNA, 22 nt, Human
cuggguggcaccagcagccugg

SEQ ID NO: 1604842 - RNA, 14 nt, Human
cuggguguggcgca

SEQ ID NO: 1604843 - RNA, 15 nt, Human
cuggguguggcgcag

SEQ ID NO: 1604844 - RNA, 13 nt, Human
cuugcucugcuga

SEQ ID NO: 1604845 - RNA, 23 nt, Human
cuugccgucuaccugaggggccu

SEQ ID NO: 1604846 - RNA, 20 nt, Human
cuugccgucuaccugagggg

SEQ ID NO: 1604847 - RNA, 12 nt, Human
cuugacagggca

SEQ ID NO: 1604848 - RNA, 23 nt, Human
cuugaaugaugccaugaggaaca

SEQ ID NO: 1604849 - RNA, 12 nt, Human
cuugcucugcug

SEQ ID NO: 1604850 - RNA, 20 nt, Human
cuugaaugaugccaugagga

SEQ ID NO: 1604851 - RNA, 22 nt, Human
cuucuucagagacuccugcagg

SEQ ID NO: 1604852 - RNA, 20 nt, Human
cuucuguuuuauaauuuugu

SEQ ID NO: 1604853 - RNA, 15 nt, Human
cuucuguuuuauaau

SEQ ID NO: 1604854 - RNA, 21 nt, Human
cuucuucagagacuccugcag

SEQ ID NO: 1604855 - RNA, 20 nt, Human
cuucuucagagacuccugca

SEQ ID NO: 1604856 - RNA, 15 nt, Human
cuuuucaaaacauuu

SEQ ID NO: 1604857 - RNA, 19 nt, Human
cuuuuauuuagcaccaggg

SEQ ID NO: 1604858 - RNA, 19 nt, Human
cuuuuauaaacuuuaccuu

SEQ ID NO: 1604859 - RNA, 16 nt, Human
cuuuuauaaacuuuac

SEQ ID NO: 1604860 - RNA, 18 nt, Human
cuuuuauaaacuuuaccu

SEQ ID NO: 1604861 - RNA, 15 nt, Human
cuuuuauaaacuuua

SEQ ID NO: 1604862 - RNA, 16 nt, Human
cuuuggucuacacugu

SEQ ID NO: 1604863 - RNA, 20 nt, Human
cuuuggucuacacugugcug

SEQ ID NO: 1604864 - RNA, 22 nt, Human
cuuucggggagaggcugaggac

SEQ ID NO: 1604865 - RNA, 17 nt, Human
cuuucuaaugugugaau

SEQ ID NO: 1604866 - RNA, 21 nt, Human
cuuugagugucuuaauuaaaa

SEQ ID NO: 1604867 - RNA, 22 nt, Human
cuuugacgccaucccagcccca

SEQ ID NO: 1604868 - RNA, 21 nt, Human
cuuugacgccaucccagcccc

SEQ ID NO: 1604869 - RNA, 19 nt, Human
cuuugacgccaucccagcc

SEQ ID NO: 1604870 - RNA, 16 nt, Human
cuuugagcuuaagaau

SEQ ID NO: 1604871 - RNA, 13 nt, Human
cuuucagauacug

SEQ ID NO: 1604872 - RNA, 13 nt, Human
cuuguggacacag

SEQ ID NO: 1604873 - RNA, 15 nt, Human
cuuguggacacagcu

SEQ ID NO: 1604874 - RNA, 14 nt, Human
cuuguggacacagc

SEQ ID NO: 1604875 - RNA, 16 nt, Human
cuuguggacacagcuc

SEQ ID NO: 1604876 - RNA, 15 nt, Human
cuuuaaaugcugcuu

SEQ ID NO: 1604877 - RNA, 14 nt, Human
cuuuaaaugcugcu

SEQ ID NO: 1604878 - RNA, 22 nt, Human
cuuucaauaggaaaaacugauu

SEQ ID NO: 1604879 - RNA, 21 nt, Human
cuuucaauaggaaaaacugau

SEQ ID NO: 1604880 - RNA, 20 nt, Human
cuuucaauaggaaaaacuga

SEQ ID NO: 1604881 - RNA, 23 nt, Human
cuuucaauaggaaaaacugauuu

SEQ ID NO: 1604882 - RNA, 16 nt, Human
cuuuaauuuuggaauu

SEQ ID NO: 1604883 - RNA, 13 nt, Human
cuuuaauuuugga

SEQ ID NO: 1604884 - RNA, 15 nt, Human
cuuuaauuuuggaau

SEQ ID NO: 1604885 - RNA, 14 nt, Human
cuuuaauuuuggaa

SEQ ID NO: 1604886 - RNA, 14 nt, Human
cuguucagcuccag

SEQ ID NO: 1604887 - RNA, 13 nt, Human
cuguucagcucca

SEQ ID NO: 1604888 - RNA, 19 nt, Human
cugugucuugcaauggcag

SEQ ID NO: 1604889 - RNA, 16 nt, Human
cugugucuugcaaugg

SEQ ID NO: 1604890 - RNA, 20 nt, Human
cugugucuugcaauggcagc

SEQ ID NO: 1604891 - RNA, 15 nt, Human
cuguucacucuacuu

SEQ ID NO: 1604892 - RNA, 17 nt, Human
cugugacuucagcucug

SEQ ID NO: 1604893 - RNA, 22 nt, Human
cugugacuucagcucuguuuua

SEQ ID NO: 1604894 - RNA, 19 nt, Human
cugugucucccuucauccu

SEQ ID NO: 1604895 - RNA, 14 nt, Human
cugugucucccuuc

SEQ ID NO: 1604896 - RNA, 14 nt, Human
cugugucuugcaau

SEQ ID NO: 1604897 - RNA, 19 nt, Human
cugugucagguggggcagc

SEQ ID NO: 1604898 - RNA, 20 nt, Human
cugugucagcauagaaguaa

SEQ ID NO: 1604899 - RNA, 21 nt, Human
cugugucagguggggcagcuu

SEQ ID NO: 1604900 - RNA, 22 nt, Human
cugugucagguggggcagcuug

SEQ ID NO: 1604901 - RNA, 11 nt, Human
cugugcugccc

SEQ ID NO: 1604902 - RNA, 22 nt, Human
cugugcugagucugaaggcugg

SEQ ID NO: 1604903 - RNA, 20 nt, Human
cugugcugagucugaaggcu

SEQ ID NO: 1604904 - RNA, 17 nt, Human
cuguugcugccucaugc

SEQ ID NO: 1604905 - RNA, 16 nt, Human
cuguugcugccucaug

SEQ ID NO: 1604906 - RNA, 15 nt, Human
cuguugcugccucau

SEQ ID NO: 1604907 - RNA, 13 nt, Human
cuuaccugccagg

SEQ ID NO: 1604908 - RNA, 21 nt, Human
cuuaccucggugccuuccucu

SEQ ID NO: 1604909 - RNA, 19 nt, Human
cuuaccucggugccuuccu

SEQ ID NO: 1604910 - RNA, 13 nt, Human
cuuaccucggugc

SEQ ID NO: 1604911 - RNA, 17 nt, Human
cuuacccucauguucuu

SEQ ID NO: 1604912 - RNA, 18 nt, Human
cuuacccucauguucuua

SEQ ID NO: 1604913 - RNA, 19 nt, Human
cuuacccucauguucuuaa

SEQ ID NO: 1604914 - RNA, 15 nt, Human
cuuaaagaguguggc

SEQ ID NO: 1604915 - RNA, 21 nt, Human
cuuaaagaguguggcaaaaua

SEQ ID NO: 1604916 - RNA, 13 nt, Human
cuuacacaauggu

SEQ ID NO: 1604917 - RNA, 13 nt, Human
cuuaaaguugaau

SEQ ID NO: 1604918 - RNA, 11 nt, Human
cuuaaaguuga

SEQ ID NO: 1604919 - RNA, 14 nt, Human
cuuaaaguugaauu

SEQ ID NO: 1604920 - RNA, 20 nt, Human
cuguugggccaggagccucc

SEQ ID NO: 1604921 - RNA, 17 nt, Human
cuguugggccaggagcc

SEQ ID NO: 1604922 - RNA, 16 nt, Human
cuguugggccaggagc

SEQ ID NO: 1604923 - RNA, 20 nt, Human
cuuaaaauauuccugcauuu

SEQ ID NO: 1604924 - RNA, 18 nt, Human
cuuaaaauauuccugcau

SEQ ID NO: 1604925 - RNA, 21 nt, Human
cuuaugggcuggguucuaccc

SEQ ID NO: 1604926 - RNA, 14 nt, Human
cuuaugggcugggu

SEQ ID NO: 1604927 - RNA, 23 nt, Human
cuuaugggcuggguucuacccag

SEQ ID NO: 1604928 - RNA, 22 nt, Human
cuuaugggcuggguucuaccca

SEQ ID NO: 1604929 - RNA, 13 nt, Human
cuuauugcccacg

SEQ ID NO: 1604930 - RNA, 12 nt, Human
cuuauugcccac

SEQ ID NO: 1604931 - RNA, 21 nt, Human
cuuagcagggaaacagcuaau

SEQ ID NO: 1604932 - RNA, 18 nt, Human
cuuagcagggaaacagcu

SEQ ID NO: 1604933 - RNA, 20 nt, Human
cuuccaugucgccucugcau

SEQ ID NO: 1604934 - RNA, 19 nt, Human
cuuccaugucgccucugca

SEQ ID NO: 1604935 - RNA, 18 nt, Human
cuuccaugucgccucugc

SEQ ID NO: 1604936 - RNA, 17 nt, Human
cuuccaugucgccucug

SEQ ID NO: 1604937 - RNA, 20 nt, Human
cuuccagugaggcucugccc

SEQ ID NO: 1604938 - RNA, 19 nt, Human
cuuccagugaggcucugcc

SEQ ID NO: 1604939 - RNA, 18 nt, Human
cuuccagugaggcucugc

SEQ ID NO: 1604940 - RNA, 17 nt, Human
cuuccauggacuuuguu

SEQ ID NO: 1604941 - RNA, 16 nt, Human
cuuccauggacuuugu

SEQ ID NO: 1604942 - RNA, 16 nt, Human
cuuccaugucgccucu

SEQ ID NO: 1604943 - RNA, 15 nt, Human
cuuccaugucgccuc

SEQ ID NO: 1604944 - RNA, 23 nt, Human
cuucaugcugucuacacuaagag

SEQ ID NO: 1604945 - RNA, 22 nt, Human
cuucaucucccaaagugcuggg

SEQ ID NO: 1604946 - RNA, 16 nt, Human
cuucauccuccucaga

SEQ ID NO: 1604947 - RNA, 24 nt, Human
cuucagagacuccugcaggcagcc

SEQ ID NO: 1604948 - RNA, 23 nt, Human
cuucagagacuccugcaggcagc

SEQ ID NO: 1604949 - RNA, 18 nt, Human
cuucaguggcagcugcuu

SEQ ID NO: 1604950 - RNA, 17 nt, Human
cuucaguuaagccuuug

SEQ ID NO: 1604951 - RNA, 15 nt, Human
cuucauccuccucag

SEQ ID NO: 1604952 - RNA, 13 nt, Human
cuucaucccucug

SEQ ID NO: 1604953 - RNA, 18 nt, Human
cuucaguuaagccuuugg

SEQ ID NO: 1604954 - RNA, 11 nt, Human
cuucagacaua

SEQ ID NO: 1604955 - RNA, 22 nt, Human
cuucagagacuccugcaggcag

SEQ ID NO: 1604956 - RNA, 21 nt, Human
cuucagagacuccugcaggca

SEQ ID NO: 1604957 - RNA, 16 nt, Human
cuucagagacuccugc

SEQ ID NO: 1604958 - RNA, 18 nt, Human
cuuauugcccacgcugga

SEQ ID NO: 1604959 - RNA, 14 nt, Human
cuucaccuuugucc

SEQ ID NO: 1604960 - RNA, 20 nt, Human
cuucaccuuuguccccaccg

SEQ ID NO: 1604961 - RNA, 17 nt, Human
cuucaccuuugucccca

SEQ ID NO: 1604962 - RNA, 16 nt, Human
gacacacugaagaagc

SEQ ID NO: 1604963 - RNA, 15 nt, Human
gacacacugaagaag

SEQ ID NO: 1604964 - RNA, 16 nt, Human
gacacagcucuucucc

SEQ ID NO: 1604965 - RNA, 14 nt, Human
gacacagcucuucu

SEQ ID NO: 1604966 - RNA, 12 nt, Human
gacacaggcccg

SEQ ID NO: 1604967 - RNA, 23 nt, Human
gacacagcucuucuccaggcugu

SEQ ID NO: 1604968 - RNA, 22 nt, Human
gacacagcucuucuccaggcug

SEQ ID NO: 1604969 - RNA, 17 nt, Human
gacacagcucuucucca

SEQ ID NO: 1604970 - RNA, 21 nt, Human
gacagaaagcagaacagugau

SEQ ID NO: 1604971 - RNA, 17 nt, Human
gacagcccgggcucugc

SEQ ID NO: 1604972 - RNA, 18 nt, Human
gaccagggauuuccauga

SEQ ID NO: 1604973 - RNA, 19 nt, Human
gaccaucccugaaggcccc

SEQ ID NO: 1604974 - RNA, 18 nt, Human
gaccaucccugaaggccc

SEQ ID NO: 1604975 - RNA, 13 nt, Human
gaccaucccugaa

SEQ ID NO: 1604976 - RNA, 12 nt, Human
gaccaucccuga

SEQ ID NO: 1604977 - RNA, 20 nt, Human
gaccagggauuuccaugaug

SEQ ID NO: 1604978 - RNA, 13 nt, Human
gaccauacuaauu

SEQ ID NO: 1604979 - RNA, 21 nt, Human
gacagugagacucugucucag

SEQ ID NO: 1604980 - RNA, 19 nt, Human
gacagcccgggcucugccu

SEQ ID NO: 1604981 - RNA, 18 nt, Human
gacagcccgggcucugcc

SEQ ID NO: 1604982 - RNA, 20 nt, Human
gacagcccgggcucugccuc

SEQ ID NO: 1604983 - RNA, 17 nt, Human
gacauugcggacagcca

SEQ ID NO: 1604984 - RNA, 15 nt, Human
gacauugcggacagc

SEQ ID NO: 1604985 - RNA, 14 nt, Human
gacauugcggacag

SEQ ID NO: 1604986 - RNA, 17 nt, Human
gacauuugcucauggaa

SEQ ID NO: 1604987 - RNA, 16 nt, Human
gacauuugcucaugga

SEQ ID NO: 1604988 - RNA, 19 nt, Human
gacauuguuggccaaagcc

SEQ ID NO: 1604989 - RNA, 21 nt, Human
gacucuuaagaagacugcauu

SEQ ID NO: 1604990 - RNA, 15 nt, Human
gacucuuaagaagac

SEQ ID NO: 1604991 - RNA, 14 nt, Human
gacucuuaagaaga

SEQ ID NO: 1604992 - RNA, 22 nt, Human
gacucaccucccccaucucuuc

SEQ ID NO: 1604993 - RNA, 15 nt, Human
gacucaccuccccca

SEQ ID NO: 1604994 - RNA, 16 nt, Human
gacucugccuccucuu

SEQ ID NO: 1604995 - RNA, 12 nt, Human
gacucugccucc

SEQ ID NO: 1604996 - RNA, 14 nt, Human
gacugaauuucuuu

SEQ ID NO: 1604997 - RNA, 14 nt, Human
gacugaauuaugaa

SEQ ID NO: 1604998 - RNA, 16 nt, Human
gacugaauuucuuuug

SEQ ID NO: 1604999 - RNA, 20 nt, Human
gacugaauuaugaaacuuuu

SEQ ID NO: 1605000 - RNA, 23 nt, Human
gacuguacuccucccaggcgccc

SEQ ID NO: 1605001 - RNA, 18 nt, Human
gacuguacuccucccagg

SEQ ID NO: 1605002 - RNA, 22 nt, Human
gacugugugcucaggagcccug

SEQ ID NO: 1605003 - RNA, 14 nt, Human
gacuguggugacuu

SEQ ID NO: 1605004 - RNA, 13 nt, Human
gacuguggugacu

SEQ ID NO: 1605005 - RNA, 17 nt, Human
gacuguggugacuuugg

SEQ ID NO: 1605006 - RNA, 17 nt, Human
gacgcucucuggccuuc

SEQ ID NO: 1605007 - RNA, 16 nt, Human
gacgcucucuggccuu

SEQ ID NO: 1605008 - RNA, 15 nt, Human
gacgcucucuggccu

SEQ ID NO: 1605009 - RNA, 19 nt, Human
gacgcuacccgggaagggg

SEQ ID NO: 1605010 - RNA, 18 nt, Human
gacgcuacccgggaaggg

SEQ ID NO: 1605011 - RNA, 16 nt, Human
gacgcuacccgggaag

SEQ ID NO: 1605012 - RNA, 18 nt, Human
gacgccaucccagcccca

SEQ ID NO: 1605013 - RNA, 17 nt, Human
gacgccaucccagcccc

SEQ ID NO: 1605014 - RNA, 19 nt, Human
gacgccaucccagccccaa

SEQ ID NO: 1605015 - RNA, 14 nt, Human
gaccaucccugaag

SEQ ID NO: 1605016 - RNA, 20 nt, Human
gaccaucccugaaggccccg

SEQ ID NO: 1605017 - RNA, 14 nt, Human
gaccucugcagcaa

SEQ ID NO: 1605018 - RNA, 16 nt, Human
gacgccaucccagccc

SEQ ID NO: 1605019 - RNA, 14 nt, Human
gaccugaggcccuu

SEQ ID NO: 1605020 - RNA, 13 nt, Human
gaccugaggcccu

SEQ ID NO: 1605021 - RNA, 11 nt, Human
gaccugaggcc

SEQ ID NO: 1605022 - RNA, 15 nt, Human
gaagcagaggaagga

SEQ ID NO: 1605023 - RNA, 21 nt, Human
gaagcacaugccucucucagg

SEQ ID NO: 1605024 - RNA, 14 nt, Human
gaagcaaaauuuuu

SEQ ID NO: 1605025 - RNA, 16 nt, Human
gaagacaaugacuuac

SEQ ID NO: 1605026 - RNA, 23 nt, Human
gaagacaaugugaaaagaaaaau

SEQ ID NO: 1605027 - RNA, 22 nt, Human
gaagacaaugacuuacuguaca

SEQ ID NO: 1605028 - RNA, 23 nt, Human
gaagcaacccaaauguucaucaa

SEQ ID NO: 1605029 - RNA, 20 nt, Human
gaagcaaugcuucaucccuu

SEQ ID NO: 1605030 - RNA, 20 nt, Human
gaagcacaugccucucucag

SEQ ID NO: 1605031 - RNA, 17 nt, Human
gaagcacaugccucucu

SEQ ID NO: 1605032 - RNA, 15 nt, Human
gaagcacaugccucu

SEQ ID NO: 1605033 - RNA, 14 nt, Human
gaacugaaaucaua

SEQ ID NO: 1605034 - RNA, 20 nt, Human
gaacucugacaacagacuuc

SEQ ID NO: 1605035 - RNA, 12 nt, Human
gaacuggcugca

SEQ ID NO: 1605036 - RNA, 11 nt, Human
gaacuggcugc

SEQ ID NO: 1605037 - RNA, 20 nt, Human
gaagcuaucguaaaauuaag

SEQ ID NO: 1605038 - RNA, 19 nt, Human
gaagcuccgcuuucuaccc

SEQ ID NO: 1605039 - RNA, 22 nt, Human
gaagcuccgcuuucuacccagc

SEQ ID NO: 1605040 - RNA, 19 nt, Human
gaaggcuggguucugaucc

SEQ ID NO: 1605041 - RNA, 15 nt, Human
gaaggcuggguucug

SEQ ID NO: 1605042 - RNA, 21 nt, Human
gaaggcucgagcaugccugga

SEQ ID NO: 1605043 - RNA, 19 nt, Human
gaaggccccgcccaggcuu

SEQ ID NO: 1605044 - RNA, 18 nt, Human
gaaggccccgcccaggcu

SEQ ID NO: 1605045 - RNA, 22 nt, Human
gaaggcuggguucugauccuag

SEQ ID NO: 1605046 - RNA, 20 nt, Human
gaaggcuggguucugauccu

SEQ ID NO: 1605047 - RNA, 20 nt, Human
gaauauuagugaccucagcu

SEQ ID NO: 1605048 - RNA, 15 nt, Human
gaauauugcugaugg

SEQ ID NO: 1605049 - RNA, 14 nt, Human
gaauauugcugaug

SEQ ID NO: 1605050 - RNA, 20 nt, Human
gaauauugcugauggugcaa

SEQ ID NO: 1605051 - RNA, 19 nt, Human
gaauauugcugauggugca

SEQ ID NO: 1605052 - RNA, 22 nt, Human
gaaggggagauaaggguaucug

SEQ ID NO: 1605053 - RNA, 15 nt, Human
gaggucgaggcagga

SEQ ID NO: 1605054 - RNA, 23 nt, Human
gaggugaccccagguuucuaugu

SEQ ID NO: 1605055 - RNA, 17 nt, Human
gaguugauucagcucug

SEQ ID NO: 1605056 - RNA, 16 nt, Human
gaguugauucagcucu

SEQ ID NO: 1605057 - RNA, 15 nt, Human
gaguugauucagcuc

SEQ ID NO: 1605058 - RNA, 20 nt, Human
gagugacagaggcagcccca

SEQ ID NO: 1605059 - RNA, 21 nt, Human
gagugaguuggguguauugug

SEQ ID NO: 1605060 - RNA, 18 nt, Human
gagugacagaggcagccc

SEQ ID NO: 1605061 - RNA, 13 nt, Human
gagucccaccuug

SEQ ID NO: 1605062 - RNA, 12 nt, Human
gagucccaccuu

SEQ ID NO: 1605063 - RNA, 22 nt, Human
gagucagaaguuucugccgcag

SEQ ID NO: 1605064 - RNA, 16 nt, Human
gagucaccaagcccag

SEQ ID NO: 1605065 - RNA, 17 nt, Human
gagucaccaagcccagu

SEQ ID NO: 1605066 - RNA, 16 nt, Human
gaguuuaaauuguaau

SEQ ID NO: 1605067 - RNA, 22 nt, Human
gaguuguuacauuuuuaagugc

SEQ ID NO: 1605068 - RNA, 18 nt, Human
gaguugauucagcucugc

SEQ ID NO: 1605069 - RNA, 20 nt, Human
gagccuuccaggggugggac

SEQ ID NO: 1605070 - RNA, 19 nt, Human
gagccuugaacuuugaccu

SEQ ID NO: 1605071 - RNA, 23 nt, Human
gagccuuccaggggugggacacc

SEQ ID NO: 1605072 - RNA, 13 nt, Human
gagccuugaacuu

SEQ ID NO: 1605073 - RNA, 21 nt, Human
gagcgcccacuagacccacug

SEQ ID NO: 1605074 - RNA, 15 nt, Human
gaggacgcucucugg

SEQ ID NO: 1605075 - RNA, 20 nt, Human
gaggacgcucucuggccuuc

SEQ ID NO: 1605076 - RNA, 14 nt, Human
gaggcagggucuca

SEQ ID NO: 1605077 - RNA, 18 nt, Human
gaggcagggucucacucu

SEQ ID NO: 1605078 - RNA, 15 nt, Human
gaggcagggucucac

SEQ ID NO: 1605079 - RNA, 22 nt, Human
gaggccaaggugggaggauugc

SEQ ID NO: 1605080 - RNA, 23 nt, Human
gaggcuccacuuggucugugaga

SEQ ID NO: 1605081 - RNA, 12 nt, Human
gaggcuccacuu

SEQ ID NO: 1605082 - RNA, 19 nt, Human
gaggcuccacuuggucugu

SEQ ID NO: 1605083 - RNA, 22 nt, Human
gaggcuagugugguguuuccug

SEQ ID NO: 1605084 - RNA, 19 nt, Human
gaggccagagacacaagcc

SEQ ID NO: 1605085 - RNA, 14 nt, Human
gaggccagagacac

SEQ ID NO: 1605086 - RNA, 13 nt, Human
gaggccagagaca

SEQ ID NO: 1605087 - RNA, 17 nt, Human
gaggcaucgcaauguaa

SEQ ID NO: 1605088 - RNA, 12 nt, Human
gaggggccucuu

SEQ ID NO: 1605089 - RNA, 22 nt, Human
gcacaucagcacgauuucuguu

SEQ ID NO: 1605090 - RNA, 23 nt, Human
gcacaucagcacgauuucuguuu

SEQ ID NO: 1605091 - RNA, 14 nt, Human
gcaccgggccacag

SEQ ID NO: 1605092 - RNA, 23 nt, Human
gcaccgggccacagagaaaguac

SEQ ID NO: 1605093 - RNA, 21 nt, Human
gcaccuaccaccacgcccggc

SEQ ID NO: 1605094 - RNA, 22 nt, Human
gcaccuaccaccacgcccggcu

SEQ ID NO: 1605095 - RNA, 17 nt, Human
gcacuccccugcugggu

SEQ ID NO: 1605096 - RNA, 17 nt, Human
gcacucagaagacacug

SEQ ID NO: 1605097 - RNA, 16 nt, Human
gcacucagaagacacu

SEQ ID NO: 1605098 - RNA, 13 nt, Human
gcacucagaagac

SEQ ID NO: 1605099 - RNA, 22 nt, Human
gcacuccccugcuggguguggc

SEQ ID NO: 1605100 - RNA, 21 nt, Human
gauuuuuuuguuguuuguuua

SEQ ID NO: 1605101 - RNA, 18 nt, Human
gauuuuuuuguuguuugu

SEQ ID NO: 1605102 - RNA, 20 nt, Human
gcaaguauuagaauaccaca

SEQ ID NO: 1605103 - RNA, 18 nt, Human
gcaagucagaauagaaau

SEQ ID NO: 1605104 - RNA, 22 nt, Human
gcaauagucaaauugugugaaa

SEQ ID NO: 1605105 - RNA, 22 nt, Human
gcacaguuuucugagaaagacu

SEQ ID NO: 1605106 - RNA, 20 nt, Human
gcacaguuuucugagaaaga

SEQ ID NO: 1605107 - RNA, 23 nt, Human
gcacaguuuucugagaaagacua

SEQ ID NO: 1605108 - RNA, 20 nt, Human
gcacaccgggcacucagaag

SEQ ID NO: 1605109 - RNA, 19 nt, Human
gcacagugcaucucagccc

SEQ ID NO: 1605110 - RNA, 21 nt, Human
gcacagugcaucucagcccac

SEQ ID NO: 1605111 - RNA, 20 nt, Human
gcacagugcaucucagccca

SEQ ID NO: 1605112 - RNA, 14 nt, Human
gcacaccgggcacu

SEQ ID NO: 1605113 - RNA, 22 nt, Human
gcacaagcugcacccucaggca

SEQ ID NO: 1605114 - RNA, 17 nt, Human
gauucuccugccucagc

SEQ ID NO: 1605115 - RNA, 15 nt, Human
gauucuccugccuca

SEQ ID NO: 1605116 - RNA, 18 nt, Human
gauucuccugccucagcc

SEQ ID NO: 1605117 - RNA, 15 nt, Human
gauuuaccacuugug

SEQ ID NO: 1605118 - RNA, 12 nt, Human
gauucuucugcu

SEQ ID NO: 1605119 - RNA, 18 nt, Human
gauucuuccucccucccu

SEQ ID NO: 1605120 - RNA, 17 nt, Human
gauucuuccucccuccc

SEQ ID NO: 1605121 - RNA, 23 nt, Human
gauucuucagcaaaaauauuuua

SEQ ID NO: 1605122 - RNA, 16 nt, Human
gauuuaccacuugugu

SEQ ID NO: 1605123 - RNA, 20 nt, Human
gauuuuuuacagcugccugc

SEQ ID NO: 1605124 - RNA, 12 nt, Human
gauuauuggaaa

SEQ ID NO: 1605125 - RNA, 22 nt, Human
gauuauucacugauuugacaua

SEQ ID NO: 1605126 - RNA, 14 nt, Human
gauuauauuaugaa

SEQ ID NO: 1605127 - RNA, 20 nt, Human
gauuauaggcaccuaccacc

SEQ ID NO: 1605128 - RNA, 20 nt, Human
gauguauguugaagccuuug

SEQ ID NO: 1605129 - RNA, 21 nt, Human
gauguauguugaagccuuugu

SEQ ID NO: 1605130 - RNA, 16 nt, Human
gaugaucuuuaaaaua

SEQ ID NO: 1605131 - RNA, 21 nt, Human
gaugaucuaggaagacuuugg

SEQ ID NO: 1605132 - RNA, 15 nt, Human
gaugaucuaggaaga

SEQ ID NO: 1605133 - RNA, 16 nt, Human
gaugagugagcaugcc

SEQ ID NO: 1605134 - RNA, 18 nt, Human
gauguagaggagaaacug

SEQ ID NO: 1605135 - RNA, 14 nt, Human
gaugaucuuugcag

SEQ ID NO: 1605136 - RNA, 23 nt, Human
gaucugccuaaggacuucuuuaa

SEQ ID NO: 1605137 - RNA, 21 nt, Human
gaucugccuaaggacuucuuu

SEQ ID NO: 1605138 - RNA, 20 nt, Human
gaucugccuaaggacuucuu

SEQ ID NO: 1605139 - RNA, 18 nt, Human
gaucugccuaaggacuuc

SEQ ID NO: 1605140 - RNA, 22 nt, Human
gcucagguggggucacucuggc

SEQ ID NO: 1605141 - RNA, 21 nt, Human
gcucagguggggucacucugg

SEQ ID NO: 1605142 - RNA, 15 nt, Human
gcucagagagggugg

SEQ ID NO: 1605143 - RNA, 20 nt, Human
gcucagagagggugggagug

SEQ ID NO: 1605144 - RNA, 18 nt, Human
gcucagagagggugggag

SEQ ID NO: 1605145 - RNA, 22 nt, Human
gcucagagagggugggaguggg

SEQ ID NO: 1605146 - RNA, 14 nt, Human
gcucaggagcccug

SEQ ID NO: 1605147 - RNA, 16 nt, Human
gcucagggccuggcuc

SEQ ID NO: 1605148 - RNA, 13 nt, Human
gcucagggccugg

SEQ ID NO: 1605149 - RNA, 17 nt, Human
gcucagggccuggcuca

SEQ ID NO: 1605150 - RNA, 12 nt, Human
gcucagggccug

SEQ ID NO: 1605151 - RNA, 21 nt, Human
gcucaggagcccugggaggcu

SEQ ID NO: 1605152 - RNA, 18 nt, Human
gcucaggagcccugggag

SEQ ID NO: 1605153 - RNA, 15 nt, Human
gcucaggagcccugg

SEQ ID NO: 1605154 - RNA, 18 nt, Human
gcuaggaacacuccuuca

SEQ ID NO: 1605155 - RNA, 21 nt, Human
gcuaggaacacuccuucacag

SEQ ID NO: 1605156 - RNA, 19 nt, Human
gcuaggaacacuccuucac

SEQ ID NO: 1605157 - RNA, 16 nt, Human
gcuaguaucaaaagaa

SEQ ID NO: 1605158 - RNA, 21 nt, Human
gcuaguaauuggaaaggcagc

SEQ ID NO: 1605159 - RNA, 15 nt, Human
gcuaggccuggccag

SEQ ID NO: 1605160 - RNA, 14 nt, Human
gcuaggccuggcca

SEQ ID NO: 1605161 - RNA, 21 nt, Human
gcuauugucaccagggcugga

SEQ ID NO: 1605162 - RNA, 20 nt, Human
gcuauugucaccagggcugg

SEQ ID NO: 1605163 - RNA, 16 nt, Human
gcuauugucaccaggg

SEQ ID NO: 1605164 - RNA, 19 nt, Human
gccuguucagcuccagcuc

SEQ ID NO: 1605165 - RNA, 14 nt, Human
gccugugucuuuaa

SEQ ID NO: 1605166 - RNA, 20 nt, Human
gccuguucagcuccagcuca

SEQ ID NO: 1605167 - RNA, 14 nt, Human
gccuguucagcucc

SEQ ID NO: 1605168 - RNA, 23 nt, Human
gcucuggagcccacuguacuugc

SEQ ID NO: 1605169 - RNA, 21 nt, Human
gcucugagcaaauguggcucc

SEQ ID NO: 1605170 - RNA, 20 nt, Human
gcucugagcaaauguggcuc

SEQ ID NO: 1605171 - RNA, 15 nt, Human
gcucuguccugggag

SEQ ID NO: 1605172 - RNA, 16 nt, Human
gcucuguccugggagu

SEQ ID NO: 1605173 - RNA, 23 nt, Human
gcucugucgcccaggcuggagug

SEQ ID NO: 1605174 - RNA, 19 nt, Human
gcucugucgcccaggcugg

SEQ ID NO: 1605175 - RNA, 12 nt, Human
gcucuuccaggc

SEQ ID NO: 1605176 - RNA, 16 nt, Human
gcucuuccaggcuggg

SEQ ID NO: 1605177 - RNA, 15 nt, Human
gcucuuccaggcugg

SEQ ID NO: 1605178 - RNA, 17 nt, Human
gcugaaugguuuucaaa

SEQ ID NO: 1605179 - RNA, 23 nt, Human
gcugaaggcucgagcaugccugg

SEQ ID NO: 1605180 - RNA, 20 nt, Human
gcugaaggcucgagcaugcc

SEQ ID NO: 1605181 - RNA, 12 nt, Human
gcugaaggcucg

SEQ ID NO: 1605182 - RNA, 15 nt, Human
gcugacagacacagg

SEQ ID NO: 1605183 - RNA, 14 nt, Human
gcugacagacacag

SEQ ID NO: 1605184 - RNA, 16 nt, Human
gcugacagacacaggc

SEQ ID NO: 1605185 - RNA, 17 nt, Human
gcugacagacacaggcc

SEQ ID NO: 1605186 - RNA, 16 nt, Human
gcucucaggccagcug

SEQ ID NO: 1605187 - RNA, 15 nt, Human
gcucucaggccagcu

SEQ ID NO: 1605188 - RNA, 14 nt, Human
gcucucaggccagc

SEQ ID NO: 1605189 - RNA, 13 nt, Human
gcucucaggccag

SEQ ID NO: 1605190 - RNA, 22 nt, Human
gcucuacagcuaaucagcauuc

SEQ ID NO: 1605191 - RNA, 20 nt, Human
gcucuacagcuaaucagcau

SEQ ID NO: 1605192 - RNA, 21 nt, Human
gcucccaggcauuccccagga

SEQ ID NO: 1605193 - RNA, 20 nt, Human
gcucccaggcauuccccagg

SEQ ID NO: 1605194 - RNA, 23 nt, Human
gcucccaggcauuccccaggagg

SEQ ID NO: 1605195 - RNA, 22 nt, Human
gcucccaggcauuccccaggag

SEQ ID NO: 1605196 - RNA, 14 nt, Human
gcuccccagcccca

SEQ ID NO: 1605197 - RNA, 15 nt, Human
gcuccccucggagaa

SEQ ID NO: 1605198 - RNA, 18 nt, Human
gcuccccucggagaagag

SEQ ID NO: 1605199 - RNA, 22 nt, Human
gcuccugccaccacgcccggcu

SEQ ID NO: 1605200 - RNA, 18 nt, Human
gcugccugggaucccuca

SEQ ID NO: 1605201 - RNA, 16 nt, Human
gcugccugggaucccu

SEQ ID NO: 1605202 - RNA, 19 nt, Human
gcugccugggaucccucau

SEQ ID NO: 1605203 - RNA, 16 nt, Human
gcugccuccccuccuc

SEQ ID NO: 1605204 - RNA, 17 nt, Human
gcugccuccccuccucu

SEQ ID NO: 1605205 - RNA, 20 nt, Human
gcugccuccccuccucugcu

SEQ ID NO: 1605206 - RNA, 21 nt, Human
gcugccuccccuccucugcuu

SEQ ID NO: 1605207 - RNA, 22 nt, Human
gcugccuccccuccucugcuug

SEQ ID NO: 1605208 - RNA, 13 nt, Human
gcugccugggauc

SEQ ID NO: 1605209 - RNA, 18 nt, Human
gcugagggugagugggug

SEQ ID NO: 1605210 - RNA, 17 nt, Human
gcugcaccggcuggccu

SEQ ID NO: 1605211 - RNA, 16 nt, Human
gcugcaccggcuggcc

SEQ ID NO: 1605212 - RNA, 22 nt, Human
gcugcaccggcuggccuggccc

SEQ ID NO: 1605213 - RNA, 19 nt, Human
gcugcaccggcuggccugg

SEQ ID NO: 1605214 - RNA, 18 nt, Human
gcugcaccggcuggccug

SEQ ID NO: 1605215 - RNA, 23 nt, Human
gcugccauccagguucagcuugu

SEQ ID NO: 1605216 - RNA, 22 nt, Human
gcugccaucucaccuccugcug

SEQ ID NO: 1605217 - RNA, 23 nt, Human
gcugccaucucaccuccugcugg

SEQ ID NO: 1605218 - RNA, 21 nt, Human
gcugccauccagguucagcuu

SEQ ID NO: 1605219 - RNA, 21 nt, Human
gcugccagccgagauagccaa

SEQ ID NO: 1605220 - RNA, 19 nt, Human
gcugccagccgagauagcc

SEQ ID NO: 1605221 - RNA, 17 nt, Human
gcuggagcucugcccau

SEQ ID NO: 1605222 - RNA, 12 nt, Human
gcuggagugcag

SEQ ID NO: 1605223 - RNA, 14 nt, Human
gcuggagcucugcc

SEQ ID NO: 1605224 - RNA, 19 nt, Human
gcugggauuacagguguga

SEQ ID NO: 1605225 - RNA, 18 nt, Human
gcugggauuacaggugug

SEQ ID NO: 1605226 - RNA, 17 nt, Human
gcugggauuacaggugu

SEQ ID NO: 1605227 - RNA, 15 nt, Human
gcugggcagaggaaa

SEQ ID NO: 1605228 - RNA, 14 nt, Human
gcugggcagaggaa

SEQ ID NO: 1605229 - RNA, 13 nt, Human
gcugggcagagga

SEQ ID NO: 1605230 - RNA, 19 nt, Human
gcuggccuggccccucagg

SEQ ID NO: 1605231 - RNA, 18 nt, Human
gcuggccuggccccucag

SEQ ID NO: 1605232 - RNA, 16 nt, Human
gcugggauuacaggug

SEQ ID NO: 1605233 - RNA, 23 nt, Human
gcugggauuacaggcuccugcca

SEQ ID NO: 1605234 - RNA, 22 nt, Human
gcugggauuacaggcuccugcc

SEQ ID NO: 1605235 - RNA, 17 nt, Human
gcuggccuggccccuca

SEQ ID NO: 1605236 - RNA, 16 nt, Human
gcuggccuggccccuc

SEQ ID NO: 1605237 - RNA, 15 nt, Human
gcuggagugcaguga

SEQ ID NO: 1605238 - RNA, 14 nt, Human
gcuggagugcagug

SEQ ID NO: 1605239 - RNA, 20 nt, Human
gcugggcucccuucccaccu

SEQ ID NO: 1605240 - RNA, 17 nt, Human
gcugggcucccuuccca

SEQ ID NO: 1605241 - RNA, 16 nt, Human
gcugggcucccuuccc

SEQ ID NO: 1605242 - RNA, 19 nt, Human
gcugggcagaggaaagcaa

SEQ ID NO: 1605243 - RNA, 17 nt, Human
gcugggcagaggaaagc

SEQ ID NO: 1605244 - RNA, 16 nt, Human
gcugggcagaggaaag

SEQ ID NO: 1605245 - RNA, 14 nt, Human
gcugggcagguugg

SEQ ID NO: 1605246 - RNA, 16 nt, Human
gcugggucgcccugga

SEQ ID NO: 1605247 - RNA, 18 nt, Human
gcugggucgcccuggacu

SEQ ID NO: 1605248 - RNA, 17 nt, Human
gcugggucgcccuggac

SEQ ID NO: 1605249 - RNA, 15 nt, Human
gcuggguguggcgca

SEQ ID NO: 1605250 - RNA, 19 nt, Human
gcugggucgcccuggacug

SEQ ID NO: 1605251 - RNA, 20 nt, Human
gcuucacggaagagccuugc

SEQ ID NO: 1605252 - RNA, 15 nt, Human
gcuucacggaagagc

SEQ ID NO: 1605253 - RNA, 14 nt, Human
gcuuaacuucacau

SEQ ID NO: 1605254 - RNA, 22 nt, Human
gcuucaaggauccugagccaga

SEQ ID NO: 1605255 - RNA, 14 nt, Human
gcugugcugcccug

SEQ ID NO: 1605256 - RNA, 13 nt, Human
gcugugcugcccu

SEQ ID NO: 1605257 - RNA, 12 nt, Human
gcugugcugccc

SEQ ID NO: 1605258 - RNA, 21 nt, Human
gcugugcucuggacaggcaug

SEQ ID NO: 1605259 - RNA, 22 nt, Human
gcugugcugcccugcccaccug

SEQ ID NO: 1605260 - RNA, 19 nt, Human
gcugugcugcccugcccac

SEQ ID NO: 1605261 - RNA, 22 nt, Human
gcuguuggcugggggccucagu

SEQ ID NO: 1605262 - RNA, 21 nt, Human
gcuguuggcugggggccucag

SEQ ID NO: 1605263 - RNA, 23 nt, Human
gcuguaucccaugagccucagca

SEQ ID NO: 1605264 - RNA, 20 nt, Human
gcuguaucccaugagccuca

SEQ ID NO: 1605265 - RNA, 17 nt, Human
gcuggguucuacccagg

SEQ ID NO: 1605266 - RNA, 21 nt, Human
gcuggguuggaggguguccca

SEQ ID NO: 1605267 - RNA, 14 nt, Human
gcuggguuggaggg

SEQ ID NO: 1605268 - RNA, 15 nt, Human
gcuggguucugaucc

SEQ ID NO: 1605269 - RNA, 15 nt, Human
gcuggguucuaccca

SEQ ID NO: 1605270 - RNA, 23 nt, Human
gcuucccgcucagcccucccugc

SEQ ID NO: 1605271 - RNA, 18 nt, Human
gcuucccgcucagcccuc

SEQ ID NO: 1605272 - RNA, 17 nt, Human
gcuucccgcucagcccu

SEQ ID NO: 1605273 - RNA, 16 nt, Human
gcuucccgcucagccc

SEQ ID NO: 1605274 - RNA, 15 nt, Human
gcuucccgcucagcc

SEQ ID NO: 1605275 - RNA, 14 nt, Human
gcuuguacauaaug

SEQ ID NO: 1605276 - RNA, 16 nt, Human
gcuuguacauaaugcg

SEQ ID NO: 1605277 - RNA, 19 nt, Human
gcuugggcuucauccuccu

SEQ ID NO: 1605278 - RNA, 19 nt, Human
gcuugaaacccguggcgcu

SEQ ID NO: 1605279 - RNA, 15 nt, Human
gccuggccccucagg

SEQ ID NO: 1605280 - RNA, 17 nt, Human
gccuggccccucagggu

SEQ ID NO: 1605281 - RNA, 16 nt, Human
gccuggccccucaggg

SEQ ID NO: 1605282 - RNA, 10 nt, Human
gccuggccug

SEQ ID NO: 1605283 - RNA, 22 nt, Human
gccuggccccucagggucccug

SEQ ID NO: 1605284 - RNA, 20 nt, Human
gccuggccccucaggguccc

SEQ ID NO: 1605285 - RNA, 18 nt, Human
gccugggaucccucaucc

SEQ ID NO: 1605286 - RNA, 21 nt, Human
gccugggaucccucauccuca

SEQ ID NO: 1605287 - RNA, 22 nt, Human
gccugugucuuuaaaugcugcu

SEQ ID NO: 1605288 - RNA, 13 nt, Human
gccugugucuuua

SEQ ID NO: 1605289 - RNA, 14 nt, Human
gccugggaucccuc

SEQ ID NO: 1605290 - RNA, 22 nt, Human
gccugggaggucaaggcugcag

SEQ ID NO: 1605291 - RNA, 21 nt, Human
gccugggaggucaaggcugca

SEQ ID NO: 1605292 - RNA, 16 nt, Human
gccugccucuucucua

SEQ ID NO: 1605293 - RNA, 17 nt, Human
gccugccuguucccauu

SEQ ID NO: 1605294 - RNA, 13 nt, Human
gccuccuccagcc

SEQ ID NO: 1605295 - RNA, 13 nt, Human
gccuccugugugu

SEQ ID NO: 1605296 - RNA, 12 nt, Human
gccucugggacu

SEQ ID NO: 1605297 - RNA, 14 nt, Human
gccucugggacugg

SEQ ID NO: 1605298 - RNA, 20 nt, Human
gccugcccaggccccugcca

SEQ ID NO: 1605299 - RNA, 19 nt, Human
gccugcccaggccccugcc

SEQ ID NO: 1605300 - RNA, 18 nt, Human
gccugcccaggccccugc

SEQ ID NO: 1605301 - RNA, 23 nt, Human
gccucuucucuacucuagggaaa

SEQ ID NO: 1605302 - RNA, 12 nt, Human
gccucuucucua

SEQ ID NO: 1605303 - RNA, 12 nt, Human
gccucuuccucc

SEQ ID NO: 1605304 - RNA, 22 nt, Human
gccucuuccucccucauuccac

SEQ ID NO: 1605305 - RNA, 16 nt, Human
gcccccaggugccagu

SEQ ID NO: 1605306 - RNA, 19 nt, Human
gccccaaaacucuccucug

SEQ ID NO: 1605307 - RNA, 18 nt, Human
gccccaaaacucuccucu

SEQ ID NO: 1605308 - RNA, 14 nt, Human
gccccugcccggcu

SEQ ID NO: 1605309 - RNA, 13 nt, Human
gccccugcccggc

SEQ ID NO: 1605310 - RNA, 14 nt, Human
gcccccucugcccu

SEQ ID NO: 1605311 - RNA, 22 nt, Human
gccccuggaugcagccucacag

SEQ ID NO: 1605312 - RNA, 18 nt, Human
gccccuggaugcagccuc

SEQ ID NO: 1605313 - RNA, 16 nt, Human
gccccuggaugcagcc

SEQ ID NO: 1605314 - RNA, 15 nt, Human
gccccugcccggcug

SEQ ID NO: 1605315 - RNA, 22 nt, Human
gcccuaaaguguauuuuuuuac

SEQ ID NO: 1605316 - RNA, 15 nt, Human
gcccacucccugcaa

SEQ ID NO: 1605317 - RNA, 14 nt, Human
gcccacucccugca

SEQ ID NO: 1605318 - RNA, 19 nt, Human
gcccacucccugcaaccug

SEQ ID NO: 1605319 - RNA, 13 nt, Human
gcccacucccugc

SEQ ID NO: 1605320 - RNA, 23 nt, Human
gcccacuagacccacuggacuca

SEQ ID NO: 1605321 - RNA, 17 nt, Human
gcccacuagacccacug

SEQ ID NO: 1605322 - RNA, 13 nt, Human
gcccuguuaaaag

SEQ ID NO: 1605323 - RNA, 23 nt, Human
gcccugcugagucccaggcugag

SEQ ID NO: 1605324 - RNA, 22 nt, Human
gcccugcugagucccaggcuga

SEQ ID NO: 1605325 - RNA, 21 nt, Human
gcccugcugagucccaggcug

SEQ ID NO: 1605326 - RNA, 17 nt, Human
gcccuguuaaaagauga

SEQ ID NO: 1605327 - RNA, 14 nt, Human
gcccuguuaaaaga

SEQ ID NO: 1605328 - RNA, 22 nt, Human
gcccugccuccuuugugaggaa

SEQ ID NO: 1605329 - RNA, 16 nt, Human
gcccugccuccuuugu

SEQ ID NO: 1605330 - RNA, 16 nt, Human
gcccugcugaguccca

SEQ ID NO: 1605331 - RNA, 16 nt, Human
gccgccaugcuccugg

SEQ ID NO: 1605332 - RNA, 15 nt, Human
gccgccaugcuccug

SEQ ID NO: 1605333 - RNA, 21 nt, Human
gcccuuaccugccaggaagcc

SEQ ID NO: 1605334 - RNA, 20 nt, Human
gcccuuaccugccaggaagc

SEQ ID NO: 1605335 - RNA, 16 nt, Human
gcccuuaccugccagg

SEQ ID NO: 1605336 - RNA, 20 nt, Human
gccauauucuguuggccagu

SEQ ID NO: 1605337 - RNA, 19 nt, Human
gccauauucuguuggccag

SEQ ID NO: 1605338 - RNA, 14 nt, Human
gccauguuggccag

SEQ ID NO: 1605339 - RNA, 18 nt, Human
gccauguuggccaggcug

SEQ ID NO: 1605340 - RNA, 17 nt, Human
gccauguuggccaggcu

SEQ ID NO: 1605341 - RNA, 16 nt, Human
gccauguuggccaggc

SEQ ID NO: 1605342 - RNA, 15 nt, Human
gccauguuggccagg

SEQ ID NO: 1605343 - RNA, 24 nt, Human
gccauguuggccaggcuggucuca

SEQ ID NO: 1605344 - RNA, 22 nt, Human
gccauguuggccaggcuggucu

SEQ ID NO: 1605345 - RNA, 20 nt, Human
gccauguuggccaggcuggu

SEQ ID NO: 1605346 - RNA, 19 nt, Human
gccauguuggccaggcugg

SEQ ID NO: 1605347 - RNA, 11 nt, Human
gccauguuuau

SEQ ID NO: 1605348 - RNA, 18 nt, Human
gccauuccccgucucugg

SEQ ID NO: 1605349 - RNA, 17 nt, Human
gccauuccccgucucug

SEQ ID NO: 1605350 - RNA, 17 nt, Human
gcccacgcuggagugca

SEQ ID NO: 1605351 - RNA, 16 nt, Human
gcccacgcuggagugc

SEQ ID NO: 1605352 - RNA, 15 nt, Human
gcccacgcuggagug

SEQ ID NO: 1605353 - RNA, 15 nt, Human
gcccacgcccccacu

SEQ ID NO: 1605354 - RNA, 14 nt, Human
gcccacgcccccac

SEQ ID NO: 1605355 - RNA, 13 nt, Human
gcccacgccccca

SEQ ID NO: 1605356 - RNA, 18 nt, Human
gcccaccuuggcucaagu

SEQ ID NO: 1605357 - RNA, 13 nt, Human
gccaggccagagg

SEQ ID NO: 1605358 - RNA, 17 nt, Human
gccaggcccucugccca

SEQ ID NO: 1605359 - RNA, 16 nt, Human
gccaggcccucugccc

SEQ ID NO: 1605360 - RNA, 21 nt, Human
gccaggcccucugcccacucc

SEQ ID NO: 1605361 - RNA, 20 nt, Human
gccaggcccucugcccacuc

SEQ ID NO: 1605362 - RNA, 19 nt, Human
gccaggcccucugcccacu

SEQ ID NO: 1605363 - RNA, 12 nt, Human
gccaggccagag

SEQ ID NO: 1605364 - RNA, 22 nt, Human
gccagcaguucagagcugcccu

SEQ ID NO: 1605365 - RNA, 23 nt, Human
gccagcaguucagagcugcccuc

SEQ ID NO: 1605366 - RNA, 23 nt, Human
gccagcaggcucucaggccagcu

SEQ ID NO: 1605367 - RNA, 21 nt, Human
gccagcaggcucucaggccag

SEQ ID NO: 1605368 - RNA, 20 nt, Human
gccagcaggcucucaggcca

SEQ ID NO: 1605369 - RNA, 19 nt, Human
gccagcaggcucucaggcc

SEQ ID NO: 1605370 - RNA, 18 nt, Human
gccagcaggcucucaggc

SEQ ID NO: 1605371 - RNA, 17 nt, Human
gccagcaggcucucagg

SEQ ID NO: 1605372 - RNA, 16 nt, Human
gccagcaggcucucag

SEQ ID NO: 1605373 - RNA, 13 nt, Human
gccagcaggcucu

SEQ ID NO: 1605374 - RNA, 22 nt, Human
gccagacaucaacagauaaaua

SEQ ID NO: 1605375 - RNA, 15 nt, Human
gccagaauuucaaac

SEQ ID NO: 1605376 - RNA, 18 nt, Human
gcacuuggagacuuguau

SEQ ID NO: 1605377 - RNA, 20 nt, Human
gccacauuccugaugcuucu

SEQ ID NO: 1605378 - RNA, 16 nt, Human
gccacauuccugaugc

SEQ ID NO: 1605379 - RNA, 21 nt, Human
gccaccaacauacucccaucu

SEQ ID NO: 1605380 - RNA, 20 nt, Human
gccaccaacauacucccauc

SEQ ID NO: 1605381 - RNA, 19 nt, Human
gccaccaacauacucccau

SEQ ID NO: 1605382 - RNA, 22 nt, Human
gccaccaacauacucccaucug

SEQ ID NO: 1605383 - RNA, 13 nt, Human
gccaccacgcccg

SEQ ID NO: 1605384 - RNA, 14 nt, Human
gccaccacgcccgg

SEQ ID NO: 1605385 - RNA, 19 nt, Human
gccacugugaagagaacca

SEQ ID NO: 1605386 - RNA, 18 nt, Human
gccacugugaagagaacc

SEQ ID NO: 1605387 - RNA, 17 nt, Human
gccacugccucuuccuc

SEQ ID NO: 1605388 - RNA, 16 nt, Human
gccacugccucuuccu

SEQ ID NO: 1605389 - RNA, 13 nt, Human
gccacugccucuu

SEQ ID NO: 1605390 - RNA, 12 nt, Human
gccacugccucu

SEQ ID NO: 1605391 - RNA, 21 nt, Human
gccacuugaugacccccaacc

SEQ ID NO: 1605392 - RNA, 23 nt, Human
gccacugcaccgggccacagaga

SEQ ID NO: 1605393 - RNA, 19 nt, Human
gccacccuggggagaaagu

SEQ ID NO: 1605394 - RNA, 13 nt, Human
gccacccugggga

SEQ ID NO: 1605395 - RNA, 21 nt, Human
gccacugcacuauagccuagg

SEQ ID NO: 1605396 - RNA, 15 nt, Human
ggagagcuagcagca

SEQ ID NO: 1605397 - RNA, 18 nt, Human
ggagagccuuccaggggu

SEQ ID NO: 1605398 - RNA, 17 nt, Human
ggagagccuuccagggg

SEQ ID NO: 1605399 - RNA, 22 nt, Human
ggagagccuuccagggguggga

SEQ ID NO: 1605400 - RNA, 16 nt, Human
ggagagccuuccaggg

SEQ ID NO: 1605401 - RNA, 13 nt, Human
ggagagccuucca

SEQ ID NO: 1605402 - RNA, 14 nt, Human
ggagagagacucca

SEQ ID NO: 1605403 - RNA, 22 nt, Human
ggagaaccaaaaagaggcuaug

SEQ ID NO: 1605404 - RNA, 13 nt, Human
ggagaacuagaga

SEQ ID NO: 1605405 - RNA, 16 nt, Human
ggagacugucucaaga

SEQ ID NO: 1605406 - RNA, 17 nt, Human
ggacuuggaagcuccgc

SEQ ID NO: 1605407 - RNA, 18 nt, Human
ggacuucuuuaauuuugg

SEQ ID NO: 1605408 - RNA, 15 nt, Human
ggacuuggaagcucc

SEQ ID NO: 1605409 - RNA, 19 nt, Human
ggagaaaauggacguguua

SEQ ID NO: 1605410 - RNA, 18 nt, Human
ggacuuuuauuuccagug

SEQ ID NO: 1605411 - RNA, 12 nt, Human
ggacuuguuaga

SEQ ID NO: 1605412 - RNA, 22 nt, Human
ggacucaaugcacugacauugu

SEQ ID NO: 1605413 - RNA, 16 nt, Human
ggacuaggguccuggg

SEQ ID NO: 1605414 - RNA, 12 nt, Human
ggaccucaggcc

SEQ ID NO: 1605415 - RNA, 20 nt, Human
ggacuacaggugugagucac

SEQ ID NO: 1605416 - RNA, 23 nt, Human
ggacugugugcucaggagcccug

SEQ ID NO: 1605417 - RNA, 22 nt, Human
ggacugugugcucaggagcccu

SEQ ID NO: 1605418 - RNA, 17 nt, Human
ggacuuagcugggagaa

SEQ ID NO: 1605419 - RNA, 19 nt, Human
gcuuguacauaaugcgugc

SEQ ID NO: 1605420 - RNA, 18 nt, Human
ggacccugaggcccagag

SEQ ID NO: 1605421 - RNA, 15 nt, Human
ggacccugaggccca

SEQ ID NO: 1605422 - RNA, 14 nt, Human
ggacccugaggccc

SEQ ID NO: 1605423 - RNA, 21 nt, Human
ggacccggaggggccuggcag

SEQ ID NO: 1605424 - RNA, 20 nt, Human
ggacccggaggggccuggca

SEQ ID NO: 1605425 - RNA, 19 nt, Human
ggacccugaggcccagagg

SEQ ID NO: 1605426 - RNA, 21 nt, Human
ggagcagccacauuccugaug

SEQ ID NO: 1605427 - RNA, 13 nt, Human
ggagcagccacau

SEQ ID NO: 1605428 - RNA, 15 nt, Human
ggagcccacuguacu

SEQ ID NO: 1605429 - RNA, 19 nt, Human
ggaggcugagaugggagaa

SEQ ID NO: 1605430 - RNA, 15 nt, Human
ggaggcugagauggg

SEQ ID NO: 1605431 - RNA, 21 nt, Human
ggaggcucuggagcccacugu

SEQ ID NO: 1605432 - RNA, 16 nt, Human
ggaggucgaggcagga

SEQ ID NO: 1605433 - RNA, 15 nt, Human
ggaggucgaggcagg

SEQ ID NO: 1605434 - RNA, 18 nt, Human
ggaggucgaggcaggagg

SEQ ID NO: 1605435 - RNA, 21 nt, Human
ggaggcaugugaugagaggaa

SEQ ID NO: 1605436 - RNA, 12 nt, Human
ggaggaagagaa

SEQ ID NO: 1605437 - RNA, 20 nt, Human
ggaggaaaaccaagccgugg

SEQ ID NO: 1605438 - RNA, 22 nt, Human
ggaggaaaaccaagccguggcu

SEQ ID NO: 1605439 - RNA, 21 nt, Human
ggaggaaaaccaagccguggc

SEQ ID NO: 1605440 - RNA, 13 nt, Human
ggaggccagccuu

SEQ ID NO: 1605441 - RNA, 20 nt, Human
ggaggccaaggugggaggau

SEQ ID NO: 1605442 - RNA, 18 nt, Human
ggaggccaaggugggagg

SEQ ID NO: 1605443 - RNA, 20 nt, Human
ggaggcucuggagcccacug

SEQ ID NO: 1605444 - RNA, 17 nt, Human
ggaggcucuggagccca

SEQ ID NO: 1605445 - RNA, 16 nt, Human
ggagcugaguggggga

SEQ ID NO: 1605446 - RNA, 22 nt, Human
ggagcugccuguucagcuccag

SEQ ID NO: 1605447 - RNA, 22 nt, Human
ggagcccacuguacuugcucuu

SEQ ID NO: 1605448 - RNA, 18 nt, Human
ggagcccacuguacuugc

SEQ ID NO: 1605449 - RNA, 14 nt, Human
ggccucccaacuca

SEQ ID NO: 1605450 - RNA, 13 nt, Human
ggccucccaacuc

SEQ ID NO: 1605451 - RNA, 14 nt, Human
ggcccuuccuuuuc

SEQ ID NO: 1605452 - RNA, 22 nt, Human
ggcccuuccucuccacugccuu

SEQ ID NO: 1605453 - RNA, 19 nt, Human
ggcccuuccucuccacugc

SEQ ID NO: 1605454 - RNA, 23 nt, Human
ggcccuuccucuccacugccuuc

SEQ ID NO: 1605455 - RNA, 17 nt, Human
ggcccgacagccuggca

SEQ ID NO: 1605456 - RNA, 16 nt, Human
ggcccgacagccuggc

SEQ ID NO: 1605457 - RNA, 19 nt, Human
ggccagguggccacuccag

SEQ ID NO: 1605458 - RNA, 12 nt, Human
ggcauuguggga

SEQ ID NO: 1605459 - RNA, 12 nt, Human
ggccaaaggaag

SEQ ID NO: 1605460 - RNA, 15 nt, Human
ggccaaagccaaagc

SEQ ID NO: 1605461 - RNA, 13 nt, Human
ggccaaaggaagc

SEQ ID NO: 1605462 - RNA, 20 nt, Human
ggccagaugcaccagcccuu

SEQ ID NO: 1605463 - RNA, 19 nt, Human
ggccagaugcaccagcccu

SEQ ID NO: 1605464 - RNA, 23 nt, Human
ggccagagggagugacagaggca

SEQ ID NO: 1605465 - RNA, 13 nt, Human
ggccaagguggga

SEQ ID NO: 1605466 - RNA, 21 nt, Human
ggccaaggaugccccgucccc

SEQ ID NO: 1605467 - RNA, 12 nt, Human
ggcagaaggaag

SEQ ID NO: 1605468 - RNA, 17 nt, Human
ggcagccaggccacaag

SEQ ID NO: 1605469 - RNA, 15 nt, Human
ggcagccaggccaca

SEQ ID NO: 1605470 - RNA, 12 nt, Human
ggcagagcagag

SEQ ID NO: 1605471 - RNA, 10 nt, Human
ggcagagcag

SEQ ID NO: 1605472 - RNA, 18 nt, Human
ggcagccgugccuucagc

SEQ ID NO: 1605473 - RNA, 21 nt, Human
ggcagccgugccuucagcucu

SEQ ID NO: 1605474 - RNA, 19 nt, Human
ggcagccgugccuucagcu

SEQ ID NO: 1605475 - RNA, 22 nt, Human
ggcagccgugccuucagcucua

SEQ ID NO: 1605476 - RNA, 21 nt, Human
ggaugaauuccaaauucugcu

SEQ ID NO: 1605477 - RNA, 22 nt, Human
ggaugagaaagguugaagcacc

SEQ ID NO: 1605478 - RNA, 12 nt, Human
ggaugagaaagg

SEQ ID NO: 1605479 - RNA, 13 nt, Human
ggauguucuggga

SEQ ID NO: 1605480 - RNA, 23 nt, Human
ggaugguucccuugaugaagaag

SEQ ID NO: 1605481 - RNA, 22 nt, Human
ggaugguucccuugaugaagaa

SEQ ID NO: 1605482 - RNA, 23 nt, Human
ggauuaaacuuaaucuaaaugga

SEQ ID NO: 1605483 - RNA, 21 nt, Human
ggauuuugauccaagcugguc

SEQ ID NO: 1605484 - RNA, 11 nt, Human
ggcaaaauaau

SEQ ID NO: 1605485 - RNA, 17 nt, Human
aaacaaggaugaauuaa

SEQ ID NO: 1605486 - RNA, 18 nt, Human
aaacaagaccacguuucu

SEQ ID NO: 1605487 - RNA, 13 nt, Human
aaacaaagaaauu

SEQ ID NO: 1605488 - RNA, 19 nt, Human
aaaauuuuuucucuaggaa

SEQ ID NO: 1605489 - RNA, 19 nt, Human
aaaauuuuuaaucuuuaau

SEQ ID NO: 1605490 - RNA, 16 nt, Human
aaaauuuuuaaucuuu

SEQ ID NO: 1605491 - RNA, 21 nt, Human
aaaauguaggguuauaauaau

SEQ ID NO: 1605492 - RNA, 23 nt, Human
aaaauuggggauucuuaaaguug

SEQ ID NO: 1605493 - RNA, 21 nt, Human
aaaauuggggauucuuaaagu

SEQ ID NO: 1605494 - RNA, 21 nt, Human
aaaauggacguguuaugacuc

SEQ ID NO: 1605495 - RNA, 12 nt, Human
aaaauggaauac

SEQ ID NO: 1605496 - RNA, 22 nt, Human
aaaauggacuguggugacuuug

SEQ ID NO: 1605497 - RNA, 21 nt, Human
aaacauauauaacaaugcugu

SEQ ID NO: 1605498 - RNA, 16 nt, Human
aaacaugcuacacacu

SEQ ID NO: 1605499 - RNA, 22 nt, Human
aaacaugcuacacacugcaugu

SEQ ID NO: 1605500 - RNA, 19 nt, Human
aaacauauauaacaaugcu

SEQ ID NO: 1605501 - RNA, 16 nt, Human
aaacauauauaacaau

SEQ ID NO: 1605502 - RNA, 13 nt, Human
aaacauauauaac

SEQ ID NO: 1605503 - RNA, 14 nt, Human
aaacacaacuauau

SEQ ID NO: 1605504 - RNA, 19 nt, Human
aaacaagucagucauucag

SEQ ID NO: 1605505 - RNA, 17 nt, Human
ggggaccucaggccugg

SEQ ID NO: 1605506 - RNA, 16 nt, Human
ggggaccucaggccug

SEQ ID NO: 1605507 - RNA, 15 nt, Human
ggggaccucaggccu

SEQ ID NO: 1605508 - RNA, 13 nt, Human
ggggaccucaggc

SEQ ID NO: 1605509 - RNA, 23 nt, Human
ggggcccugccuccuuugugagg

SEQ ID NO: 1605510 - RNA, 19 nt, Human
ggggcccugccuccuuugu

SEQ ID NO: 1605511 - RNA, 16 nt, Human
ggggcccugccuccuu

SEQ ID NO: 1605512 - RNA, 19 nt, Human
ggggccaguuggucccccu

SEQ ID NO: 1605513 - RNA, 17 nt, Human
ggggccaguuggucccc

SEQ ID NO: 1605514 - RNA, 16 nt, Human
ggggccaggcuggguc

SEQ ID NO: 1605515 - RNA, 14 nt, Human
ggggccaggcuggg

SEQ ID NO: 1605516 - RNA, 13 nt, Human
ggggccaggcugg

SEQ ID NO: 1605517 - RNA, 15 nt, Human
aaaccacagcaguug

SEQ ID NO: 1605518 - RNA, 16 nt, Human
aaaccacagcaguuga

SEQ ID NO: 1605519 - RNA, 21 nt, Human
aaaccacauuggagauguuua

SEQ ID NO: 1605520 - RNA, 23 nt, Human
aaacggccucacuaggcuucugg

SEQ ID NO: 1605521 - RNA, 18 nt, Human
aaacggaugauuucuaug

SEQ ID NO: 1605522 - RNA, 16 nt, Human
aaacggaugauuucua

SEQ ID NO: 1605523 - RNA, 20 nt, Human
aaacguggcugcuucaagga

SEQ ID NO: 1605524 - RNA, 17 nt, Human
aaacguggcugcuucaa

SEQ ID NO: 1605525 - RNA, 16 nt, Human
aaacguggcugcuuca

SEQ ID NO: 1605526 - RNA, 15 nt, Human
aaacgucuuaaauau

SEQ ID NO: 1605527 - RNA, 12 nt, Human
aaacgugaaaau

SEQ ID NO: 1605528 - RNA, 16 nt, Human
aaacuggauuaaacuu

SEQ ID NO: 1605529 - RNA, 21 nt, Human
aaacugcccccucugcccugc

SEQ ID NO: 1605530 - RNA, 20 nt, Human
aaacugcccccucugcccug

SEQ ID NO: 1605531 - RNA, 19 nt, Human
aaacugcccccucugcccu

SEQ ID NO: 1605532 - RNA, 17 nt, Human
aaacugcccccucugcc

SEQ ID NO: 1605533 - RNA, 13 nt, Human
aaacugcccccuc

SEQ ID NO: 1605534 - RNA, 12 nt, Human
aaacugcccccu

SEQ ID NO: 1605535 - RNA, 23 nt, Human
gggucucacuauguugcccaggc

SEQ ID NO: 1605536 - RNA, 12 nt, Human
gggucucacucu

SEQ ID NO: 1605537 - RNA, 22 nt, Human
gggucucacuauguugcccagg

SEQ ID NO: 1605538 - RNA, 23 nt, Human
aaacauguuucuuuguaaugaaa

SEQ ID NO: 1605539 - RNA, 22 nt, Human
aaacauguuucuuuguaaugaa

SEQ ID NO: 1605540 - RNA, 19 nt, Human
aaacauguuucuuuguaau

SEQ ID NO: 1605541 - RNA, 16 nt, Human
aaaccaagccguggcu

SEQ ID NO: 1605542 - RNA, 14 nt, Human
aaaccaagccgugg

SEQ ID NO: 1605543 - RNA, 20 nt, Human
ggguaucaggugcugccauc

SEQ ID NO: 1605544 - RNA, 20 nt, Human
aaagaggcagcuugaaacug

SEQ ID NO: 1605545 - RNA, 18 nt, Human
aaagaggcuaugugagca

SEQ ID NO: 1605546 - RNA, 13 nt, Human
aaagaggcuaugu

SEQ ID NO: 1605547 - RNA, 15 nt, Human
aaagaugagugagca

SEQ ID NO: 1605548 - RNA, 23 nt, Human
aaagacuauucaaacagucucag

SEQ ID NO: 1605549 - RNA, 13 nt, Human
aaagacuccaaag

SEQ ID NO: 1605550 - RNA, 14 nt, Human
aaagacuccaaaga

SEQ ID NO: 1605551 - RNA, 15 nt, Human
aaagacuguacaaag

SEQ ID NO: 1605552 - RNA, 22 nt, Human
aaagacuauucaaacagucuca

SEQ ID NO: 1605553 - RNA, 17 nt, Human
aaagaauggaaggugga

SEQ ID NO: 1605554 - RNA, 18 nt, Human
aaagagaacuuccagauc

SEQ ID NO: 1605555 - RNA, 19 nt, Human
aaagacuuuuccaacccuc

SEQ ID NO: 1605556 - RNA, 23 nt, Human
gguauuggcuagagguucaaaga

SEQ ID NO: 1605557 - RNA, 18 nt, Human
gguauaaguggugugugu

SEQ ID NO: 1605558 - RNA, 16 nt, Human
aaagaaugauuaugaa

SEQ ID NO: 1605559 - RNA, 17 nt, Human
aaacuuuucugauagag

SEQ ID NO: 1605560 - RNA, 16 nt, Human
aaacuuuucugauaga

SEQ ID NO: 1605561 - RNA, 14 nt, Human
aaacuuuaccuuuu

SEQ ID NO: 1605562 - RNA, 14 nt, Human
aaacuuuucugaua

SEQ ID NO: 1605563 - RNA, 13 nt, Human
aaacuuuucugau

SEQ ID NO: 1605564 - RNA, 22 nt, Human
gguccacccaggagccccgagg

SEQ ID NO: 1605565 - RNA, 20 nt, Human
gguccacccaggagccccga

SEQ ID NO: 1605566 - RNA, 12 nt, Human
ggucccacccca

SEQ ID NO: 1605567 - RNA, 14 nt, Human
ggucccaccccaca

SEQ ID NO: 1605568 - RNA, 17 nt, Human
aaacuuguguaaauaca

SEQ ID NO: 1605569 - RNA, 24 nt, Human
ggucugugagaugcuagaacuccc

SEQ ID NO: 1605570 - RNA, 14 nt, Human
ggucugugagaugc

SEQ ID NO: 1605571 - RNA, 12 nt, Human
ggucuguucuuu

SEQ ID NO: 1605572 - RNA, 22 nt, Human
ggucuugaacuccuggccucaa

SEQ ID NO: 1605573 - RNA, 21 nt, Human
ggucuugaacuccuggccuca

SEQ ID NO: 1605574 - RNA, 17 nt, Human
ggucuguucuuuccaaa

SEQ ID NO: 1605575 - RNA, 19 nt, Human
ggucuguucuuuccaaagu

SEQ ID NO: 1605576 - RNA, 21 nt, Human
ggugauccacucgccuucauc

SEQ ID NO: 1605577 - RNA, 22 nt, Human
ggugcacaagcuccaagcuccc

SEQ ID NO: 1605578 - RNA, 16 nt, Human
ggugcacaagcuccaa

SEQ ID NO: 1605579 - RNA, 18 nt, Human
ggugcaaaguucccuacu

SEQ ID NO: 1605580 - RNA, 13 nt, Human
aaaggaauuuaaa

SEQ ID NO: 1605581 - RNA, 11 nt, Human
aaaggaaagag

SEQ ID NO: 1605582 - RNA, 17 nt, Human
aaagcagugcaugcugu

SEQ ID NO: 1605583 - RNA, 22 nt, Human
aaagcagugcaugcugucccuu

SEQ ID NO: 1605584 - RNA, 21 nt, Human
aaagcagugcaugcugucccu

SEQ ID NO: 1605585 - RNA, 18 nt, Human
aaagcuaggccuggccag

SEQ ID NO: 1605586 - RNA, 17 nt, Human
aaagcuacuuauuguag

SEQ ID NO: 1605587 - RNA, 16 nt, Human
aaagcuacuuauugua

SEQ ID NO: 1605588 - RNA, 18 nt, Human
aaaauauauaucaaauau

SEQ ID NO: 1605589 - RNA, 12 nt, Human
aaaauagccugc

SEQ ID NO: 1605590 - RNA, 18 nt, Human
aaaauaguggugugauuu

SEQ ID NO: 1605591 - RNA, 23 nt, Human
aaaauaauuuuuauauuugaaau

SEQ ID NO: 1605592 - RNA, 21 nt, Human
aaaauaauuuuuauauuugaa

SEQ ID NO: 1605593 - RNA, 14 nt, Human
aaaauaccagccag

SEQ ID NO: 1605594 - RNA, 15 nt, Human
aaaauaccagccagu

SEQ ID NO: 1605595 - RNA, 12 nt, Human
aaaauaaauuau

SEQ ID NO: 1605596 - RNA, 20 nt, Human
gggcagcugccuccccuccu

SEQ ID NO: 1605597 - RNA, 23 nt, Human
gggcagcugccuccccuccucug

SEQ ID NO: 1605598 - RNA, 13 nt, Human
gggcagcugccuc

SEQ ID NO: 1605599 - RNA, 14 nt, Human
gggcagcugccucc

SEQ ID NO: 1605600 - RNA, 19 nt, Human
gggcagcugccuccccucc

SEQ ID NO: 1605601 - RNA, 19 nt, Human
aaaagggacugagaaauuu

SEQ ID NO: 1605602 - RNA, 16 nt, Human
aaaagggacugagaaa

SEQ ID NO: 1605603 - RNA, 15 nt, Human
gggauuuccaugaug

SEQ ID NO: 1605604 - RNA, 14 nt, Human
gggcagaggaaagc

SEQ ID NO: 1605605 - RNA, 20 nt, Human
gggauucuuaaaguugaauu

SEQ ID NO: 1605606 - RNA, 15 nt, Human
gggauucuuaaaguu

SEQ ID NO: 1605607 - RNA, 18 nt, Human
aaaagccuguuuaagaga

SEQ ID NO: 1605608 - RNA, 16 nt, Human
aaaagccuguuuaaga

SEQ ID NO: 1605609 - RNA, 21 nt, Human
aaaacuuuaugcuaagugaaa

SEQ ID NO: 1605610 - RNA, 22 nt, Human
aaaagcuccauuuuuagugaaa

SEQ ID NO: 1605611 - RNA, 14 nt, Human
aaaagcugggcagg

SEQ ID NO: 1605612 - RNA, 20 nt, Human
gggaggcagagguugcagug

SEQ ID NO: 1605613 - RNA, 19 nt, Human
gggaggccaaggugggagg

SEQ ID NO: 1605614 - RNA, 13 nt, Human
gggagggcuccag

SEQ ID NO: 1605615 - RNA, 11 nt, Human
gggagggcucc

SEQ ID NO: 1605616 - RNA, 13 nt, Human
gggagggccuggg

SEQ ID NO: 1605617 - RNA, 21 nt, Human
aaaacguggcugcuucaagga

SEQ ID NO: 1605618 - RNA, 19 nt, Human
aaaaccaagccguggcuuc

SEQ ID NO: 1605619 - RNA, 22 nt, Human
aaaacugauuuuuuuuuccuuc

SEQ ID NO: 1605620 - RNA, 18 nt, Human
aaaacugauuuuuuuuuc

SEQ ID NO: 1605621 - RNA, 20 nt, Human
aaaacugcugacuguuuucu

SEQ ID NO: 1605622 - RNA, 19 nt, Human
aaaacugcucauaugaugu

SEQ ID NO: 1605623 - RNA, 18 nt, Human
aaaacguggcugcuucaa

SEQ ID NO: 1605624 - RNA, 17 nt, Human
aaaacguggcugcuuca

SEQ ID NO: 1605625 - RNA, 16 nt, Human
aaaacguggcugcuuc

SEQ ID NO: 1605626 - RNA, 21 nt, Human
aaaaccaauguucucucuucu

SEQ ID NO: 1605627 - RNA, 14 nt, Human
aaaacguggcugcu

SEQ ID NO: 1605628 - RNA, 15 nt, Human
aaaaccaauguucuc

SEQ ID NO: 1605629 - RNA, 22 nt, Human
gggaacagacuggaagcacagc

SEQ ID NO: 1605630 - RNA, 19 nt, Human
aaaaaucucaaauuucuaa

SEQ ID NO: 1605631 - RNA, 20 nt, Human
aaaaaucucaaauuucuaaa

SEQ ID NO: 1605632 - RNA, 14 nt, Human
gggaacagacugga

SEQ ID NO: 1605633 - RNA, 13 nt, Human
aaaaaaacacaaa

SEQ ID NO: 1605634 - RNA, 20 nt, Human
aaaaagcuccaaaugcagcu

SEQ ID NO: 1605635 - RNA, 23 nt, Human
gggaaaaucagccugcuccagcu

SEQ ID NO: 1605636 - RNA, 13 nt, Human
gggaaaaucagcc

SEQ ID NO: 1605637 - RNA, 16 nt, Human
ggcuucaguggcagcu

SEQ ID NO: 1605638 - RNA, 17 nt, Human
ggcuucaguggcagcug

SEQ ID NO: 1605639 - RNA, 15 nt, Human
ggcugucaauuacag

SEQ ID NO: 1605640 - RNA, 23 nt, Human
ggcuguaucccaugagccucagc

SEQ ID NO: 1605641 - RNA, 22 nt, Human
ggcuguaucccaugagccucag

SEQ ID NO: 1605642 - RNA, 20 nt, Human
ggcuguaucccaugagccuc

SEQ ID NO: 1605643 - RNA, 15 nt, Human
ggcuucaguggcagc

SEQ ID NO: 1605644 - RNA, 16 nt, Human
ggcuggugucaccuga

SEQ ID NO: 1605645 - RNA, 19 nt, Human
ggcuguaucccaugagccu

SEQ ID NO: 1605646 - RNA, 13 nt, Human
ggcugggagagcc

SEQ ID NO: 1605647 - RNA, 22 nt, Human
ggcuggccuggccccucagggu

SEQ ID NO: 1605648 - RNA, 17 nt, Human
ggcuggccuggccccuc

SEQ ID NO: 1605649 - RNA, 15 nt, Human
ggcuggcccugcccu

SEQ ID NO: 1605650 - RNA, 14 nt, Human
ggcuggcccugccc

SEQ ID NO: 1605651 - RNA, 13 nt, Human
ggcuggcccugcc

SEQ ID NO: 1605652 - RNA, 20 nt, Human
ggcuggcgugcaguggugcg

SEQ ID NO: 1605653 - RNA, 16 nt, Human
ggcuggcgugcagugg

SEQ ID NO: 1605654 - RNA, 14 nt, Human
ggcuggcgugcagu

SEQ ID NO: 1605655 - RNA, 17 nt, Human
ggcuggcccugcccugg

SEQ ID NO: 1605656 - RNA, 16 nt, Human
ggcuggcccugcccug

SEQ ID NO: 1605657 - RNA, 23 nt, Human
ggcugccaucucaccuccugcug

SEQ ID NO: 1605658 - RNA, 22 nt, Human
ggcugccaucucaccuccugcu

SEQ ID NO: 1605659 - RNA, 21 nt, Human
ggcugccaucucaccuccugc

SEQ ID NO: 1605660 - RNA, 16 nt, Human
ggcucccuucccaccu

SEQ ID NO: 1605661 - RNA, 18 nt, Human
ggcucccuucccaccucu

SEQ ID NO: 1605662 - RNA, 17 nt, Human
ggcucccuucccaccuc

SEQ ID NO: 1605663 - RNA, 22 nt, Human
ggcucccuucccaccucucuca

SEQ ID NO: 1605664 - RNA, 20 nt, Human
ggcucccuucccaccucucu

SEQ ID NO: 1605665 - RNA, 17 nt, Human
ggcuccucccggugccc

SEQ ID NO: 1605666 - RNA, 12 nt, Human
ggcuccugccac

SEQ ID NO: 1605667 - RNA, 13 nt, Human
ggcuccugccacc

SEQ ID NO: 1605668 - RNA, 24 nt, Human
ggcucuuccaggcugggagagccu

SEQ ID NO: 1605669 - RNA, 23 nt, Human
ggcucuuccaggcugggagagcc

SEQ ID NO: 1605670 - RNA, 18 nt, Human
ggcucgagcaugccugga

SEQ ID NO: 1605671 - RNA, 20 nt, Human
ggcugcaugcgggcuuccuc

SEQ ID NO: 1605672 - RNA, 22 nt, Human
ggcugcaugcgggcuuccuccu

SEQ ID NO: 1605673 - RNA, 17 nt, Human
ggcugcagggaguccga

SEQ ID NO: 1605674 - RNA, 12 nt, Human
caacuccagaaa

SEQ ID NO: 1605675 - RNA, 14 nt, Human
caacuauggccugu

SEQ ID NO: 1605676 - RNA, 20 nt, Human
caacucccugccccccagcc

SEQ ID NO: 1605677 - RNA, 19 nt, Human
caacucccugccccccagc

SEQ ID NO: 1605678 - RNA, 15 nt, Human
caagaagcccaggaa

SEQ ID NO: 1605679 - RNA, 21 nt, Human
caacucccugccccccagccc

SEQ ID NO: 1605680 - RNA, 17 nt, Human
caagaaggaugauucaa

SEQ ID NO: 1605681 - RNA, 18 nt, Human
caagaagcccaggaaagg

SEQ ID NO: 1605682 - RNA, 18 nt, Human
caagaauagaugcugacu

SEQ ID NO: 1605683 - RNA, 19 nt, Human
caacuaucucauuuccaag

SEQ ID NO: 1605684 - RNA, 19 nt, Human
caacuauauuguuugcuaa

SEQ ID NO: 1605685 - RNA, 13 nt, Human
caacuauggccug

SEQ ID NO: 1605686 - RNA, 16 nt, Human
caaccccuucgcuccu

SEQ ID NO: 1605687 - RNA, 14 nt, Human
caaccccuucgcuc

SEQ ID NO: 1605688 - RNA, 17 nt, Human
caaccccuucgcuccug

SEQ ID NO: 1605689 - RNA, 14 nt, Human
caacccccagccug

SEQ ID NO: 1605690 - RNA, 14 nt, Human
caagcaaguauuag

SEQ ID NO: 1605691 - RNA, 18 nt, Human
caagcaagaaacacuggg

SEQ ID NO: 1605692 - RNA, 13 nt, Human
caagcaagaaaca

SEQ ID NO: 1605693 - RNA, 19 nt, Human
caagcaaaugugaaucauu

SEQ ID NO: 1605694 - RNA, 17 nt, Human
caagcaaaugugaauca

SEQ ID NO: 1605695 - RNA, 15 nt, Human
caagcaaaugugaau

SEQ ID NO: 1605696 - RNA, 14 nt, Human
caagaccacguuuc

SEQ ID NO: 1605697 - RNA, 16 nt, Human
caagaccacguuucua

SEQ ID NO: 1605698 - RNA, 13 nt, Human
caagcaccuccug

SEQ ID NO: 1605699 - RNA, 14 nt, Human
caagcaccuccugc

SEQ ID NO: 1605700 - RNA, 18 nt, Human
caagcaccuagccucgcu

SEQ ID NO: 1605701 - RNA, 17 nt, Human
caaucagccuaguugau

SEQ ID NO: 1605702 - RNA, 14 nt, Human
caaucaaaucugcu

SEQ ID NO: 1605703 - RNA, 15 nt, Human
caauggcagccuugg

SEQ ID NO: 1605704 - RNA, 14 nt, Human
caauggcagccuug

SEQ ID NO: 1605705 - RNA, 13 nt, Human
caauggcagccuu

SEQ ID NO: 1605706 - RNA, 16 nt, Human
caauggcagccuuggc

SEQ ID NO: 1605707 - RNA, 12 nt, Human
caaugcuggcug

SEQ ID NO: 1605708 - RNA, 20 nt, Human
caauuuauuauggcacauca

SEQ ID NO: 1605709 - RNA, 18 nt, Human
caagcuccaagcucccag

SEQ ID NO: 1605710 - RNA, 21 nt, Human
caagcuccaagcucccaggca

SEQ ID NO: 1605711 - RNA, 19 nt, Human
caagcuccaagcucccagg

SEQ ID NO: 1605712 - RNA, 17 nt, Human
caagcuccaucuccacu

SEQ ID NO: 1605713 - RNA, 21 nt, Human
caagcuccaucuccacuccag

SEQ ID NO: 1605714 - RNA, 17 nt, Human
caagcucccaggcauuc

SEQ ID NO: 1605715 - RNA, 15 nt, Human
caagcucccaggcau

SEQ ID NO: 1605716 - RNA, 14 nt, Human
caagcucccaggca

SEQ ID NO: 1605717 - RNA, 12 nt, Human
caagcucccagg

SEQ ID NO: 1605718 - RNA, 16 nt, Human
caagcucugcuccucu

SEQ ID NO: 1605719 - RNA, 15 nt, Human
caagcucugcuccuc

SEQ ID NO: 1605720 - RNA, 16 nt, Human
caaggcaaggcuguca

SEQ ID NO: 1605721 - RNA, 14 nt, Human
caaggcaaggcugu

SEQ ID NO: 1605722 - RNA, 20 nt, Human
caaggauugcuacuguccua

SEQ ID NO: 1605723 - RNA, 13 nt, Human
caagcugcacccu

SEQ ID NO: 1605724 - RNA, 17 nt, Human
caaguauuauaccuuuu

SEQ ID NO: 1605725 - RNA, 22 nt, Human
caaguauuauaccuuuuuuaga

SEQ ID NO: 1605726 - RNA, 20 nt, Human
caaguuauuuuuaauuuggu

SEQ ID NO: 1605727 - RNA, 13 nt, Human
cacaucagcuugc

SEQ ID NO: 1605728 - RNA, 23 nt, Human
cacaucagcuugcccuguuaaaa

SEQ ID NO: 1605729 - RNA, 22 nt, Human
cacaucuugcucugcugacaga

SEQ ID NO: 1605730 - RNA, 21 nt, Human
cacaucuugcucugcugacag

SEQ ID NO: 1605731 - RNA, 20 nt, Human
cacaucuugcucugcugaca

SEQ ID NO: 1605732 - RNA, 15 nt, Human
cacaucuugcucugc

SEQ ID NO: 1605733 - RNA, 14 nt, Human
cacaucuugcucug

SEQ ID NO: 1605734 - RNA, 13 nt, Human
cacaucuugcucu

SEQ ID NO: 1605735 - RNA, 12 nt, Human
cacccagcccac

SEQ ID NO: 1605736 - RNA, 16 nt, Human
cacccagcccacuucu

SEQ ID NO: 1605737 - RNA, 22 nt, Human
caccagccccagugcccacagg

SEQ ID NO: 1605738 - RNA, 21 nt, Human
caccagccccagugcccacag

SEQ ID NO: 1605739 - RNA, 18 nt, Human
caccagccccagugccca

SEQ ID NO: 1605740 - RNA, 19 nt, Human
caccagcccuuagcaggga

SEQ ID NO: 1605741 - RNA, 21 nt, Human
caccagcccuuagcagggaaa

SEQ ID NO: 1605742 - RNA, 17 nt, Human
caccagccccagugccc

SEQ ID NO: 1605743 - RNA, 18 nt, Human
cacauuuauucugcucac

SEQ ID NO: 1605744 - RNA, 17 nt, Human
cacauuuauucugcuca

SEQ ID NO: 1605745 - RNA, 16 nt, Human
cacaucuugcucugcu

SEQ ID NO: 1605746 - RNA, 23 nt, Human
cacaucuugcucugcugacagac

SEQ ID NO: 1605747 - RNA, 21 nt, Human
cacuccagugagacagcucug

SEQ ID NO: 1605748 - RNA, 17 nt, Human
cacuccagaccccuggc

SEQ ID NO: 1605749 - RNA, 23 nt, Human
cacugaagaagcaccaaucauga

SEQ ID NO: 1605750 - RNA, 13 nt, Human
cacuacauucugu

SEQ ID NO: 1605751 - RNA, 14 nt, Human
cacuacauucuguu

SEQ ID NO: 1605752 - RNA, 22 nt, Human
cacggaagagccuugcggaagg

SEQ ID NO: 1605753 - RNA, 16 nt, Human
cacggaagagccuugc

SEQ ID NO: 1605754 - RNA, 15 nt, Human
cacuacauucuguua

SEQ ID NO: 1605755 - RNA, 16 nt, Human
cacuagacccacugga

SEQ ID NO: 1605756 - RNA, 16 nt, Human
cacuccagaccccugg

SEQ ID NO: 1605757 - RNA, 14 nt, Human
cacuccagaccccu

SEQ ID NO: 1605758 - RNA, 15 nt, Human
cacgcuggagugcag

SEQ ID NO: 1605759 - RNA, 20 nt, Human
cacgcuggagugcagugagc

SEQ ID NO: 1605760 - RNA, 18 nt, Human
cacgcuggagugcaguga

SEQ ID NO: 1605761 - RNA, 17 nt, Human
cacgcuggagugcagug

SEQ ID NO: 1605762 - RNA, 16 nt, Human
cacgcuggagugcagu

SEQ ID NO: 1605763 - RNA, 21 nt, Human
cacgcuggagugcagugagcc

SEQ ID NO: 1605764 - RNA, 20 nt, Human
caccugcggugcuaucuccc

SEQ ID NO: 1605765 - RNA, 19 nt, Human
caccugcggugcuaucucc

SEQ ID NO: 1605766 - RNA, 17 nt, Human
caccugcggugcuaucu

SEQ ID NO: 1605767 - RNA, 16 nt, Human
caccugcggugcuauc

SEQ ID NO: 1605768 - RNA, 12 nt, Human
cacccuccuuuc

SEQ ID NO: 1605769 - RNA, 12 nt, Human
cacccugcucuc

SEQ ID NO: 1605770 - RNA, 12 nt, Human
caccugccaggg

SEQ ID NO: 1605771 - RNA, 11 nt, Human
caccugccagg

SEQ ID NO: 1605772 - RNA, 21 nt, Human
caccugccccucaacucuccu

SEQ ID NO: 1605773 - RNA, 18 nt, Human
caccugccccucaacucu

SEQ ID NO: 1605774 - RNA, 13 nt, Human
caccugccaggga

SEQ ID NO: 1605775 - RNA, 14 nt, Human
auuucacucuccuu

SEQ ID NO: 1605776 - RNA, 12 nt, Human
auuucacucucc

SEQ ID NO: 1605777 - RNA, 22 nt, Human
auuuaauagguuuggacaaaau

SEQ ID NO: 1605778 - RNA, 18 nt, Human
auuuaauaauuauaugcu

SEQ ID NO: 1605779 - RNA, 15 nt, Human
auuuaauaauuauau

SEQ ID NO: 1605780 - RNA, 20 nt, Human
auuucuguuuagauaauaca

SEQ ID NO: 1605781 - RNA, 19 nt, Human
auuucuguuuagauaauac

SEQ ID NO: 1605782 - RNA, 21 nt, Human
auuucuguuuagauaauacac

SEQ ID NO: 1605783 - RNA, 17 nt, Human
auuuucuauaauuuaaa

SEQ ID NO: 1605784 - RNA, 18 nt, Human
auuuucuauaauuuaaau

SEQ ID NO: 1605785 - RNA, 19 nt, Human
auuuucuauaauuuaaaua

SEQ ID NO: 1605786 - RNA, 15 nt, Human
auuuugaaaaacugc

SEQ ID NO: 1605787 - RNA, 13 nt, Human
auuuugaaaaacu

SEQ ID NO: 1605788 - RNA, 14 nt, Human
auuuguuauaauga

SEQ ID NO: 1605789 - RNA, 22 nt, Human
auuuguguugaagagguuuuaa

SEQ ID NO: 1605790 - RNA, 18 nt, Human
auuuguguugaagagguu

SEQ ID NO: 1605791 - RNA, 15 nt, Human
auuuguguugaagag

SEQ ID NO: 1605792 - RNA, 14 nt, Human
auuuguguugaaga

SEQ ID NO: 1605793 - RNA, 19 nt, Human
auuuguucuauagcuuuuc

SEQ ID NO: 1605794 - RNA, 21 nt, Human
caaaagguauuuuaaucacca

SEQ ID NO: 1605795 - RNA, 19 nt, Human
caaaagcaucuaugugaga

SEQ ID NO: 1605796 - RNA, 13 nt, Human
caaaagcauguga

SEQ ID NO: 1605797 - RNA, 20 nt, Human
caaaagguuaauaaaguaau

SEQ ID NO: 1605798 - RNA, 19 nt, Human
auuuuuauauuugaaauau

SEQ ID NO: 1605799 - RNA, 22 nt, Human
auuuuguuuuugucuuaaaaag

SEQ ID NO: 1605800 - RNA, 16 nt, Human
auuuuuauuaaauuau

SEQ ID NO: 1605801 - RNA, 17 nt, Human
auuuuuuucugaaauuu

SEQ ID NO: 1605802 - RNA, 16 nt, Human
auuuuuuucugaaauu

SEQ ID NO: 1605803 - RNA, 15 nt, Human
auuuuuuucugaauu

SEQ ID NO: 1605804 - RNA, 17 nt, Human
caaaccaucauugaaau

SEQ ID NO: 1605805 - RNA, 16 nt, Human
caaaccaucauugaaa

SEQ ID NO: 1605806 - RNA, 14 nt, Human
caaaccaucauuga

SEQ ID NO: 1605807 - RNA, 22 nt, Human
auugaggacacugauauggguc

SEQ ID NO: 1605808 - RNA, 15 nt, Human
auucucuuauccaac

SEQ ID NO: 1605809 - RNA, 16 nt, Human
auucucuccuguaccu

SEQ ID NO: 1605810 - RNA, 20 nt, Human
auucucuaguuugauuaaau

SEQ ID NO: 1605811 - RNA, 14 nt, Human
auucucuuauccaa

SEQ ID NO: 1605812 - RNA, 12 nt, Human
auucucuuaucc

SEQ ID NO: 1605813 - RNA, 23 nt, Human
auucucuaguuugauuaaauucu

SEQ ID NO: 1605814 - RNA, 16 nt, Human
auuacaggugugaacc

SEQ ID NO: 1605815 - RNA, 14 nt, Human
auuauguaaauccc

SEQ ID NO: 1605816 - RNA, 13 nt, Human
auuauguaaaucc

SEQ ID NO: 1605817 - RNA, 23 nt, Human
auuauguaaaucccauuauucaa

SEQ ID NO: 1605818 - RNA, 22 nt, Human
auuauguaaaucccauuauuca

SEQ ID NO: 1605819 - RNA, 17 nt, Human
auuauguaaaucccauu

SEQ ID NO: 1605820 - RNA, 15 nt, Human
auuauguaaauccca

SEQ ID NO: 1605821 - RNA, 23 nt, Human
auuaugugccagauuuaugcaua

SEQ ID NO: 1605822 - RNA, 21 nt, Human
auuaugugccagauuuaugca

SEQ ID NO: 1605823 - RNA, 13 nt, Human
auuaugugccaga

SEQ ID NO: 1605824 - RNA, 14 nt, Human
auucauauuuacuu

SEQ ID NO: 1605825 - RNA, 21 nt, Human
auuaacaugaauauuuagugu

SEQ ID NO: 1605826 - RNA, 16 nt, Human
auuacaggcuccugcc

SEQ ID NO: 1605827 - RNA, 15 nt, Human
auuacaggcuccugc

SEQ ID NO: 1605828 - RNA, 13 nt, Human
auuacagguguga

SEQ ID NO: 1605829 - RNA, 19 nt, Human
auuacaggcuccugccacc

SEQ ID NO: 1605830 - RNA, 17 nt, Human
auuacaggcuccugcca

SEQ ID NO: 1605831 - RNA, 15 nt, Human
auuaauggaaauguu

SEQ ID NO: 1605832 - RNA, 19 nt, Human
cauagcagcuuauucacaa

SEQ ID NO: 1605833 - RNA, 23 nt, Human
cauagcagagaaugaaagggccc

SEQ ID NO: 1605834 - RNA, 20 nt, Human
cauagcagcuuauucacaag

SEQ ID NO: 1605835 - RNA, 16 nt, Human
cauagguuuaauaauu

SEQ ID NO: 1605836 - RNA, 21 nt, Human
cauauuauuuuauguugcaua

SEQ ID NO: 1605837 - RNA, 23 nt, Human
cauaaugcgugcauaccacuuuu

SEQ ID NO: 1605838 - RNA, 16 nt, Human
cauacaguuugcacuu

SEQ ID NO: 1605839 - RNA, 23 nt, Human
cauacaggaagguagaaauaucu

SEQ ID NO: 1605840 - RNA, 18 nt, Human
cauaauuauuauuuggcc

SEQ ID NO: 1605841 - RNA, 22 nt, Human
caguuguuagugugucuuagug

SEQ ID NO: 1605842 - RNA, 23 nt, Human
caguuuguuaguaugaggcauuu

SEQ ID NO: 1605843 - RNA, 13 nt, Human
caucagcugcuga

SEQ ID NO: 1605844 - RNA, 19 nt, Human
caucccaaacccuucagug

SEQ ID NO: 1605845 - RNA, 21 nt, Human
caucagcacgauuucuguuua

SEQ ID NO: 1605846 - RNA, 22 nt, Human
cauccucuguacagagcccacg

SEQ ID NO: 1605847 - RNA, 12 nt, Human
caucccagcccc

SEQ ID NO: 1605848 - RNA, 11 nt, Human
caucccagccc

SEQ ID NO: 1605849 - RNA, 20 nt, Human
caucccaaacccuucagugc

SEQ ID NO: 1605850 - RNA, 19 nt, Human
cauccugaggcuccacuug

SEQ ID NO: 1605851 - RNA, 18 nt, Human
cauccugaggcuccacuu

SEQ ID NO: 1605852 - RNA, 21 nt, Human
caucuaaacugcccccucugc

SEQ ID NO: 1605853 - RNA, 15 nt, Human
caucuaaacugcccc

SEQ ID NO: 1605854 - RNA, 22 nt, Human
cagugauuaccagggacugagg

SEQ ID NO: 1605855 - RNA, 23 nt, Human
cagucugauucccaagcucugcu

SEQ ID NO: 1605856 - RNA, 22 nt, Human
cagugcccacaggaucagucug

SEQ ID NO: 1605857 - RNA, 21 nt, Human
cagugcccacaggaucagucu

SEQ ID NO: 1605858 - RNA, 18 nt, Human
cagugggagcugccuguu

SEQ ID NO: 1605859 - RNA, 17 nt, Human
cagugggagcugccugu

SEQ ID NO: 1605860 - RNA, 16 nt, Human
cagugggagcugccug

SEQ ID NO: 1605861 - RNA, 20 nt, Human
cagugguaugaucacggcuc

SEQ ID NO: 1605862 - RNA, 20 nt, Human
caguuauggcuauaggugcu

SEQ ID NO: 1605863 - RNA, 19 nt, Human
caguuauggcuauaggugc

SEQ ID NO: 1605864 - RNA, 13 nt, Human
caguuauggcuau

SEQ ID NO: 1605865 - RNA, 17 nt, Human
caguuauuauauuuaca

SEQ ID NO: 1605866 - RNA, 21 nt, Human
caguuauuauauuuacaaaug

SEQ ID NO: 1605867 - RNA, 20 nt, Human
caguggugcgaucuggguuc

SEQ ID NO: 1605868 - RNA, 19 nt, Human
caguggugcgaucuggguu

SEQ ID NO: 1605869 - RNA, 21 nt, Human
cagugguaugaucacggcuca

SEQ ID NO: 1605870 - RNA, 20 nt, Human
caguuacucagaauucucua

SEQ ID NO: 1605871 - RNA, 22 nt, Human
cagucugauucccaagcucugc

SEQ ID NO: 1605872 - RNA, 21 nt, Human
cagucugauucccaagcucug

SEQ ID NO: 1605873 - RNA, 22 nt, Human
caguuauuauauuuacaaaugg

SEQ ID NO: 1605874 - RNA, 15 nt, Human
caguucagagcugcc

SEQ ID NO: 1605875 - RNA, 16 nt, Human
caguucagagcugccc

SEQ ID NO: 1605876 - RNA, 17 nt, Human
caguucagagcugcccu

SEQ ID NO: 1605877 - RNA, 23 nt, Human
caguucagagcugcccucuccug

SEQ ID NO: 1605878 - RNA, 24 nt, Human
caguucagagcugcccucuccugg

SEQ ID NO: 1605879 - RNA, 18 nt, Human
caguucagagcugcccuc

SEQ ID NO: 1605880 - RNA, 19 nt, Human
caguucagagcugcccucu

SEQ ID NO: 1605881 - RNA, 21 nt, Human
caguucagagcugcccucucc

SEQ ID NO: 1605882 - RNA, 22 nt, Human
caguucagagcugcccucuccu

SEQ ID NO: 1605883 - RNA, 14 nt, Human
ccaaugggagcuca

SEQ ID NO: 1605884 - RNA, 23 nt, Human
ccaauggacuaacuugucuuugg

SEQ ID NO: 1605885 - RNA, 21 nt, Human
ccaauggagacugucucaaga

SEQ ID NO: 1605886 - RNA, 21 nt, Human
ccaacuccagaaagugacaag

SEQ ID NO: 1605887 - RNA, 21 nt, Human
ccaacucaccccagccccaaa

SEQ ID NO: 1605888 - RNA, 15 nt, Human
ccaagcucugcuccu

SEQ ID NO: 1605889 - RNA, 14 nt, Human
ccaagcucugcucc

SEQ ID NO: 1605890 - RNA, 16 nt, Human
ccaagcucugcuccuc

SEQ ID NO: 1605891 - RNA, 17 nt, Human
ccaagcucugcuccucu

SEQ ID NO: 1605892 - RNA, 16 nt, Human
ccaaaucauaguggcu

SEQ ID NO: 1605893 - RNA, 23 nt, Human
ccaaaucagcugcuacuacuccu

SEQ ID NO: 1605894 - RNA, 15 nt, Human
ccaaaucagcugcua

SEQ ID NO: 1605895 - RNA, 13 nt, Human
ccaacucacccca

SEQ ID NO: 1605896 - RNA, 16 nt, Human
ccaacuauggccugug

SEQ ID NO: 1605897 - RNA, 15 nt, Human
ccaacuauggccugu

SEQ ID NO: 1605898 - RNA, 14 nt, Human
ccaacuauggccug

SEQ ID NO: 1605899 - RNA, 22 nt, Human
ccaaaguacacuguuucaaacu

SEQ ID NO: 1605900 - RNA, 14 nt, Human
ccaaagugcuggga

SEQ ID NO: 1605901 - RNA, 16 nt, Human
cauuuguauaaaauaa

SEQ ID NO: 1605902 - RNA, 14 nt, Human
cauuuguauaaaau

SEQ ID NO: 1605903 - RNA, 17 nt, Human
cauuuguauaaaauaau

SEQ ID NO: 1605904 - RNA, 23 nt, Human
cauuuuuuuuaagaaaaaggaug

SEQ ID NO: 1605905 - RNA, 21 nt, Human
cauuuggugguuucagaaaug

SEQ ID NO: 1605906 - RNA, 14 nt, Human
ccaaaaggcagaag

SEQ ID NO: 1605907 - RNA, 17 nt, Human
ccaaaaaaugcuugcuu

SEQ ID NO: 1605908 - RNA, 16 nt, Human
cauuuaggugaggaag

SEQ ID NO: 1605909 - RNA, 17 nt, Human
cauugguguuguacuca

SEQ ID NO: 1605910 - RNA, 18 nt, Human
cauuuaggugaggaagca

SEQ ID NO: 1605911 - RNA, 16 nt, Human
cauuggagauguuuag

SEQ ID NO: 1605912 - RNA, 21 nt, Human
cauucuccaccugccagggac

SEQ ID NO: 1605913 - RNA, 19 nt, Human
cauucuccaccugccaggg

SEQ ID NO: 1605914 - RNA, 18 nt, Human
cauucuccaccugccagg

SEQ ID NO: 1605915 - RNA, 17 nt, Human
cauucuccaccugccag

SEQ ID NO: 1605916 - RNA, 14 nt, Human
cauuauucaaaguu

SEQ ID NO: 1605917 - RNA, 16 nt, Human
cauuauucaaaguugc

SEQ ID NO: 1605918 - RNA, 15 nt, Human
cauuauucaaaguug

SEQ ID NO: 1605919 - RNA, 19 nt, Human
cauguuggccaggcugguc

SEQ ID NO: 1605920 - RNA, 19 nt, Human
cauuauauuuauuacugua

SEQ ID NO: 1605921 - RNA, 17 nt, Human
cauguuggccaggcugg

SEQ ID NO: 1605922 - RNA, 18 nt, Human
cauguuggccaggcuggu

SEQ ID NO: 1605923 - RNA, 18 nt, Human
cauguucuuaauucuuag

SEQ ID NO: 1605924 - RNA, 17 nt, Human
cauguuacauaagauaa

SEQ ID NO: 1605925 - RNA, 16 nt, Human
cauguuacauaagaua

SEQ ID NO: 1605926 - RNA, 16 nt, Human
cauguccaagaagccc

SEQ ID NO: 1605927 - RNA, 15 nt, Human
cauguccaagaagcc

SEQ ID NO: 1605928 - RNA, 13 nt, Human
cauguucuuaauu

SEQ ID NO: 1605929 - RNA, 16 nt, Human
cauguucuuaauucuu

SEQ ID NO: 1605930 - RNA, 21 nt, Human
cauguuacauaagauaaaugu

SEQ ID NO: 1605931 - RNA, 18 nt, Human
caugggaaaggggaaguu

SEQ ID NO: 1605932 - RNA, 20 nt, Human
caugggaaaugucaacaagu

SEQ ID NO: 1605933 - RNA, 21 nt, Human
cauggccucuucagaucucua

SEQ ID NO: 1605934 - RNA, 14 nt, Human
cauggccgugaacu

SEQ ID NO: 1605935 - RNA, 22 nt, Human
cauggccucuucagaucucuaa

SEQ ID NO: 1605936 - RNA, 16 nt, Human
caugcuccuggcccac

SEQ ID NO: 1605937 - RNA, 14 nt, Human
caugcuccuggccc

SEQ ID NO: 1605938 - RNA, 17 nt, Human
caugcuccuggcccacu

SEQ ID NO: 1605939 - RNA, 20 nt, Human
caugcuccuggcccacugca

SEQ ID NO: 1605940 - RNA, 15 nt, Human
cauggccagguggcc

SEQ ID NO: 1605941 - RNA, 12 nt, Human
caugcaagguca

SEQ ID NO: 1605942 - RNA, 15 nt, Human
caugcaaggucauuu

SEQ ID NO: 1605943 - RNA, 14 nt, Human
caugaugcgggcca

SEQ ID NO: 1605944 - RNA, 20 nt, Human
caugaugcgggccagugcuc

SEQ ID NO: 1605945 - RNA, 15 nt, Human
caugaugcgggccag

SEQ ID NO: 1605946 - RNA, 13 nt, Human
caugacaaagacu

SEQ ID NO: 1605947 - RNA, 16 nt, Human
caugaauuugugaagg

SEQ ID NO: 1605948 - RNA, 21 nt, Human
caugaauauuuaguguucaua

SEQ ID NO: 1605949 - RNA, 11 nt, Human
caggcuacugu

SEQ ID NO: 1605950 - RNA, 21 nt, Human
caggcugggagagccuuccag

SEQ ID NO: 1605951 - RNA, 21 nt, Human
caggcgugagccaccgugccu

SEQ ID NO: 1605952 - RNA, 14 nt, Human
caggccuccuacag

SEQ ID NO: 1605953 - RNA, 12 nt, Human
caggccuccuac

SEQ ID NO: 1605954 - RNA, 16 nt, Human
caggggaaaagaggag

SEQ ID NO: 1605955 - RNA, 14 nt, Human
caggggaaaagagg

SEQ ID NO: 1605956 - RNA, 17 nt, Human
caggggaaaaucagccu

SEQ ID NO: 1605957 - RNA, 23 nt, Human
caggcugggagagccuuccaggg

SEQ ID NO: 1605958 - RNA, 22 nt, Human
caggcugggagagccuuccagg

SEQ ID NO: 1605959 - RNA, 19 nt, Human
caggaggaucacuugaguc

SEQ ID NO: 1605960 - RNA, 19 nt, Human
caggaggccagccuugacc

SEQ ID NO: 1605961 - RNA, 18 nt, Human
caggaggccagccuugac

SEQ ID NO: 1605962 - RNA, 22 nt, Human
caggaggccagccuugaccauu

SEQ ID NO: 1605963 - RNA, 17 nt, Human
caggcaaugcuggcugu

SEQ ID NO: 1605964 - RNA, 16 nt, Human
caggcaaugcuggcug

SEQ ID NO: 1605965 - RNA, 15 nt, Human
caggcaaugcuggcu

SEQ ID NO: 1605966 - RNA, 23 nt, Human
caggaccucaggugagaagcaga

SEQ ID NO: 1605967 - RNA, 16 nt, Human
caggaccucaggugag

SEQ ID NO: 1605968 - RNA, 12 nt, Human
caggccaggccc

SEQ ID NO: 1605969 - RNA, 11 nt, Human
caggccaggcc

SEQ ID NO: 1605970 - RNA, 10 nt, Human
cagcugccuc

SEQ ID NO: 1605971 - RNA, 19 nt, Human
cagcugagggugagugggu

SEQ ID NO: 1605972 - RNA, 11 nt, Human
cagcugccucc

SEQ ID NO: 1605973 - RNA, 9 nt, Human
cagcugccu

SEQ ID NO: 1605974 - RNA, 14 nt, Human
cagcugccuccccu

SEQ ID NO: 1605975 - RNA, 15 nt, Human
cagcugccuccccuc

SEQ ID NO: 1605976 - RNA, 16 nt, Human
cagcugccuccccucc

SEQ ID NO: 1605977 - RNA, 17 nt, Human
cagcugccuccccuccu

SEQ ID NO: 1605978 - RNA, 18 nt, Human
cagcugccuccccuccuc

SEQ ID NO: 1605979 - RNA, 19 nt, Human
cagcugccuccccuccucu

SEQ ID NO: 1605980 - RNA, 20 nt, Human
cagcugccuccccuccucug

SEQ ID NO: 1605981 - RNA, 21 nt, Human
cagcugacuuuucuguccgag

SEQ ID NO: 1605982 - RNA, 20 nt, Human
caggaaagagaacuuccaga

SEQ ID NO: 1605983 - RNA, 16 nt, Human
caggaaagagaacuuc

SEQ ID NO: 1605984 - RNA, 17 nt, Human
caggaaaggcuccagga

SEQ ID NO: 1605985 - RNA, 16 nt, Human
caggaaaggcuccagg

SEQ ID NO: 1605986 - RNA, 20 nt, Human
caggaaaggcuccaggagca

SEQ ID NO: 1605987 - RNA, 19 nt, Human
caggaaaggcuccaggagc

SEQ ID NO: 1605988 - RNA, 20 nt, Human
cagcuuauugucuagugaaa

SEQ ID NO: 1605989 - RNA, 14 nt, Human
cagcuuauugucua

SEQ ID NO: 1605990 - RNA, 20 nt, Human
cagcuguaugauucccagcc

SEQ ID NO: 1605991 - RNA, 16 nt, Human
cagccugcuccagcug

SEQ ID NO: 1605992 - RNA, 19 nt, Human
cagccugcuccagcuguuc

SEQ ID NO: 1605993 - RNA, 17 nt, Human
cagccugcuccagcugu

SEQ ID NO: 1605994 - RNA, 15 nt, Human
cagcuaacauggaag

SEQ ID NO: 1605995 - RNA, 21 nt, Human
cagcggaaagcccugugcucc

SEQ ID NO: 1605996 - RNA, 18 nt, Human
cagacuggcacaguuuuc

SEQ ID NO: 1605997 - RNA, 17 nt, Human
cagacuggcacaguuuu

SEQ ID NO: 1605998 - RNA, 21 nt, Human
cagacuggaagcacagcuuca

SEQ ID NO: 1605999 - RNA, 20 nt, Human
cagacuggaagcacagcuuc

SEQ ID NO: 1606000 - RNA, 23 nt, Human
cagacuggcacaguuuucugaga

SEQ ID NO: 1606001 - RNA, 22 nt, Human
cagacuggcacaguuuucugag

SEQ ID NO: 1606002 - RNA, 18 nt, Human
cagacuggaagcacagcu

SEQ ID NO: 1606003 - RNA, 17 nt, Human
cagacuggaagcacagc

SEQ ID NO: 1606004 - RNA, 16 nt, Human
cagacuggaagcacag

SEQ ID NO: 1606005 - RNA, 14 nt, Human
cagacuggaagcac

SEQ ID NO: 1606006 - RNA, 13 nt, Human
cagacuggaagca

SEQ ID NO: 1606007 - RNA, 23 nt, Human
cagacaggcaagcaccuccugcc

SEQ ID NO: 1606008 - RNA, 22 nt, Human
cagacaggcaagcaccuccugc

SEQ ID NO: 1606009 - RNA, 17 nt, Human
cagacucuacagaggcc

SEQ ID NO: 1606010 - RNA, 21 nt, Human
cagacucuacagaggccaugg

SEQ ID NO: 1606011 - RNA, 20 nt, Human
cagacucuacagaggccaug

SEQ ID NO: 1606012 - RNA, 19 nt, Human
cagacucuacagaggccau

SEQ ID NO: 1606013 - RNA, 18 nt, Human
cagacucuacagaggcca

SEQ ID NO: 1606014 - RNA, 23 nt, Human
cagacucuacagaggccaugggc

SEQ ID NO: 1606015 - RNA, 21 nt, Human
cagacaggcaagcaccuccug

SEQ ID NO: 1606016 - RNA, 20 nt, Human
cagacaggcaagcaccuccu

SEQ ID NO: 1606017 - RNA, 18 nt, Human
cagacaggcaagcaccuc

SEQ ID NO: 1606018 - RNA, 13 nt, Human
cagacaggcaagc

SEQ ID NO: 1606019 - RNA, 11 nt, Human
cagacaggcaa

SEQ ID NO: 1606020 - RNA, 24 nt, Human
cagacaggaccagggauuuccaug

SEQ ID NO: 1606021 - RNA, 17 nt, Human
cagacaggaccagggau

SEQ ID NO: 1606022 - RNA, 18 nt, Human
cagacagcugccugggau

SEQ ID NO: 1606023 - RNA, 17 nt, Human
cagacagcugccuggga

SEQ ID NO: 1606024 - RNA, 16 nt, Human
cagacagcugccuggg

SEQ ID NO: 1606025 - RNA, 15 nt, Human
cagacagcugccugg

SEQ ID NO: 1606026 - RNA, 16 nt, Human
cagacaggaccaggga

SEQ ID NO: 1606027 - RNA, 15 nt, Human
cagacaggaccaggg

SEQ ID NO: 1606028 - RNA, 13 nt, Human
cagacaggaccag

SEQ ID NO: 1606029 - RNA, 14 nt, Human
cagacagcugccug

SEQ ID NO: 1606030 - RNA, 13 nt, Human
cagacagcugccu

SEQ ID NO: 1606031 - RNA, 14 nt, Human
cagacagcccucca

SEQ ID NO: 1606032 - RNA, 23 nt, Human
cagagcugcccucuccugggcag

SEQ ID NO: 1606033 - RNA, 18 nt, Human
cagagcugcccucuccug

SEQ ID NO: 1606034 - RNA, 19 nt, Human
cagagcugcccucuccugg

SEQ ID NO: 1606035 - RNA, 20 nt, Human
cagagcugcccucuccuggg

SEQ ID NO: 1606036 - RNA, 21 nt, Human
cagagcugcccucuccugggc

SEQ ID NO: 1606037 - RNA, 19 nt, Human
cagaggaaagcaaaggaga

SEQ ID NO: 1606038 - RNA, 17 nt, Human
cagaggaaagcaaagga

SEQ ID NO: 1606039 - RNA, 13 nt, Human
cagaggggguggc

SEQ ID NO: 1606040 - RNA, 20 nt, Human
cagaggaaagcaaaggagau

SEQ ID NO: 1606041 - RNA, 23 nt, Human
cagagaggguggugaccucugcc

SEQ ID NO: 1606042 - RNA, 20 nt, Human
cagagagguuaaggugggua

SEQ ID NO: 1606043 - RNA, 13 nt, Human
cagagcugccacc

SEQ ID NO: 1606044 - RNA, 16 nt, Human
cagagcugccaccugc

SEQ ID NO: 1606045 - RNA, 22 nt, Human
cagagaggguggugaccucugc

SEQ ID NO: 1606046 - RNA, 20 nt, Human
cagagaggguggugaccucu

SEQ ID NO: 1606047 - RNA, 17 nt, Human
cagagaggguggugacc

SEQ ID NO: 1606048 - RNA, 13 nt, Human
cagagaggguggg

SEQ ID NO: 1606049 - RNA, 12 nt, Human
cagagagggugg

SEQ ID NO: 1606050 - RNA, 16 nt, Human
cagaggggguggccuc

SEQ ID NO: 1606051 - RNA, 14 nt, Human
cagaggggguggcc

SEQ ID NO: 1606052 - RNA, 19 nt, Human
cagauacuuggggggcuga

SEQ ID NO: 1606053 - RNA, 17 nt, Human
cagaggggguggccucc

SEQ ID NO: 1606054 - RNA, 14 nt, Human
cagauacuggauug

SEQ ID NO: 1606055 - RNA, 19 nt, Human
cagauagauauaugcucug

SEQ ID NO: 1606056 - RNA, 18 nt, Human
cagauacuggauuguacu

SEQ ID NO: 1606057 - RNA, 14 nt, Human
cagauaugauucaa

SEQ ID NO: 1606058 - RNA, 15 nt, Human
cagauccccaagccu

SEQ ID NO: 1606059 - RNA, 14 nt, Human
cagauccccaagcc

SEQ ID NO: 1606060 - RNA, 18 nt, Human
cagccagacuggcacagu

SEQ ID NO: 1606061 - RNA, 15 nt, Human
cagccagacuggcac

SEQ ID NO: 1606062 - RNA, 20 nt, Human
cagccagacuggcacaguuu

SEQ ID NO: 1606063 - RNA, 23 nt, Human
cagccagcaguucagagcugccc

SEQ ID NO: 1606064 - RNA, 14 nt, Human
cagccagacuggca

SEQ ID NO: 1606065 - RNA, 14 nt, Human
cagcacgauuucug

SEQ ID NO: 1606066 - RNA, 15 nt, Human
cagcacgauuucugu

SEQ ID NO: 1606067 - RNA, 18 nt, Human
cagcacgggggccaagga

SEQ ID NO: 1606068 - RNA, 18 nt, Human
cagauugcaacaggcugg

SEQ ID NO: 1606069 - RNA, 20 nt, Human
cagauugcaacaggcugggc

SEQ ID NO: 1606070 - RNA, 19 nt, Human
cagauugcaacaggcuggg

SEQ ID NO: 1606071 - RNA, 21 nt, Human
cagauugcaacaggcugggcu

SEQ ID NO: 1606072 - RNA, 20 nt, Human
cagauuucacucuccuuggu

SEQ ID NO: 1606073 - RNA, 13 nt, Human
cagauuucacucu

SEQ ID NO: 1606074 - RNA, 13 nt, Human
cagauuuaugcau

SEQ ID NO: 1606075 - RNA, 19 nt, Human
cagcaccaucucuccuccu

SEQ ID NO: 1606076 - RNA, 17 nt, Human
cagcaccaucucuccuc

SEQ ID NO: 1606077 - RNA, 19 nt, Human
cagauuugaacucuucaau

SEQ ID NO: 1606078 - RNA, 19 nt, Human
ccacuuggucugugagaug

SEQ ID NO: 1606079 - RNA, 17 nt, Human
ccacuuggucugugaga

SEQ ID NO: 1606080 - RNA, 16 nt, Human
ccacuuggucugugag

SEQ ID NO: 1606081 - RNA, 15 nt, Human
ccacuuggucuguga

SEQ ID NO: 1606082 - RNA, 22 nt, Human
ccacuuggucugugagaugcua

SEQ ID NO: 1606083 - RNA, 20 nt, Human
ccacuuggucugugagaugc

SEQ ID NO: 1606084 - RNA, 19 nt, Human
ccacuuucuagccagagga

SEQ ID NO: 1606085 - RNA, 18 nt, Human
ccacuuucuagccagagg

SEQ ID NO: 1606086 - RNA, 13 nt, Human
ccacuuucuagcc

SEQ ID NO: 1606087 - RNA, 20 nt, Human
ccacuuucuagccagaggag

SEQ ID NO: 1606088 - RNA, 17 nt, Human
ccagacccggcugcgug

SEQ ID NO: 1606089 - RNA, 14 nt, Human
ccacuuuuguucuu

SEQ ID NO: 1606090 - RNA, 15 nt, Human
ccacuuuuguucuug

SEQ ID NO: 1606091 - RNA, 21 nt, Human
ccacuuuuguucuugguuugu

SEQ ID NO: 1606092 - RNA, 22 nt, Human
ccacuuuuguucuugguuugua

SEQ ID NO: 1606093 - RNA, 12 nt, Human
ccacuuggucug

SEQ ID NO: 1606094 - RNA, 19 nt, Human
ccacugcaccgggccacag

SEQ ID NO: 1606095 - RNA, 17 nt, Human
ccacugcaccgggccac

SEQ ID NO: 1606096 - RNA, 14 nt, Human
ccacugcaccgggc

SEQ ID NO: 1606097 - RNA, 13 nt, Human
ccacugcaccggg

SEQ ID NO: 1606098 - RNA, 20 nt, Human
ccacugcacuauagccuagg

SEQ ID NO: 1606099 - RNA, 19 nt, Human
ccacugcacuauagccuag

SEQ ID NO: 1606100 - RNA, 18 nt, Human
ccacugcacuccagccug

SEQ ID NO: 1606101 - RNA, 18 nt, Human
ccagagacacaagccuuc

SEQ ID NO: 1606102 - RNA, 16 nt, Human
ccagagacacaagccu

SEQ ID NO: 1606103 - RNA, 14 nt, Human
ccagaugcaccagc

SEQ ID NO: 1606104 - RNA, 13 nt, Human
ccagaugcaccag

SEQ ID NO: 1606105 - RNA, 13 nt, Human
ccagagagggugg

SEQ ID NO: 1606106 - RNA, 15 nt, Human
ccaggggccaugaau

SEQ ID NO: 1606107 - RNA, 13 nt, Human
ccaggcugagccu

SEQ ID NO: 1606108 - RNA, 16 nt, Human
ccaggcugagccucag

SEQ ID NO: 1606109 - RNA, 14 nt, Human
ccaggcugagccuc

SEQ ID NO: 1606110 - RNA, 22 nt, Human
ccaggcugagccucagucuccc

SEQ ID NO: 1606111 - RNA, 19 nt, Human
ccaggcugagccucagucu

SEQ ID NO: 1606112 - RNA, 17 nt, Human
ccaggcugagccucagu

SEQ ID NO: 1606113 - RNA, 23 nt, Human
ccaggggugggacacccugugau

SEQ ID NO: 1606114 - RNA, 22 nt, Human
ccaggggugggacacccuguga

SEQ ID NO: 1606115 - RNA, 21 nt, Human
ccaggggugggacacccugug

SEQ ID NO: 1606116 - RNA, 20 nt, Human
ccaggggugggacacccugu

SEQ ID NO: 1606117 - RNA, 22 nt, Human
ccaguaucuugaagacuuuucu

SEQ ID NO: 1606118 - RNA, 19 nt, Human
ccaguaucuugaagacuuu

SEQ ID NO: 1606119 - RNA, 16 nt, Human
ccagucaccccggcca

SEQ ID NO: 1606120 - RNA, 14 nt, Human
ccaguauuguacaa

SEQ ID NO: 1606121 - RNA, 18 nt, Human
ccagucaccccggccacc

SEQ ID NO: 1606122 - RNA, 17 nt, Human
ccagucaccccggccac

SEQ ID NO: 1606123 - RNA, 19 nt, Human
ccagucaccccggccaccu

SEQ ID NO: 1606124 - RNA, 19 nt, Human
ccaggaaaggcuccaggag

SEQ ID NO: 1606125 - RNA, 18 nt, Human
ccaggaaaggcuccagga

SEQ ID NO: 1606126 - RNA, 17 nt, Human
ccaggaaaggcuccagg

SEQ ID NO: 1606127 - RNA, 20 nt, Human
ccaggaaaggcuccaggagc

SEQ ID NO: 1606128 - RNA, 17 nt, Human
ccagccccuucugaccc

SEQ ID NO: 1606129 - RNA, 16 nt, Human
ccagccccuucugacc

SEQ ID NO: 1606130 - RNA, 15 nt, Human
ccagccccuucugac

SEQ ID NO: 1606131 - RNA, 18 nt, Human
ccagccccuggaugcagc

SEQ ID NO: 1606132 - RNA, 18 nt, Human
ccagccccuucugaccca

SEQ ID NO: 1606133 - RNA, 15 nt, Human
ccagccccuggaugc

SEQ ID NO: 1606134 - RNA, 14 nt, Human
ccagccccuggaug

SEQ ID NO: 1606135 - RNA, 13 nt, Human
ccagccccuggau

SEQ ID NO: 1606136 - RNA, 23 nt, Human
ccagccccauccucuguacagag

SEQ ID NO: 1606137 - RNA, 13 nt, Human
ccagcagccugga

SEQ ID NO: 1606138 - RNA, 14 nt, Human
ccagcagccuggac

SEQ ID NO: 1606139 - RNA, 12 nt, Human
ccagcagccugg

SEQ ID NO: 1606140 - RNA, 11 nt, Human
ccagcagccug

SEQ ID NO: 1606141 - RNA, 16 nt, Human
ccagcagaaaugccuu

SEQ ID NO: 1606142 - RNA, 17 nt, Human
ccagcagaaaugccuua

SEQ ID NO: 1606143 - RNA, 22 nt, Human
ccagcagaaaugccuuacccuc

SEQ ID NO: 1606144 - RNA, 15 nt, Human
ccccauuguggucac

SEQ ID NO: 1606145 - RNA, 14 nt, Human
cccccuuccaugga

SEQ ID NO: 1606146 - RNA, 12 nt, Human
ccccgcccaggc

SEQ ID NO: 1606147 - RNA, 14 nt, Human
ccccgcccaggcuu

SEQ ID NO: 1606148 - RNA, 18 nt, Human
ccccggccaccugcggug

SEQ ID NO: 1606149 - RNA, 14 nt, Human
ccccggccaccugc

SEQ ID NO: 1606150 - RNA, 21 nt, Human
ccccaaaacucuccucugcug

SEQ ID NO: 1606151 - RNA, 20 nt, Human
ccccaaaacucuccucugcu

SEQ ID NO: 1606152 - RNA, 18 nt, Human
ccccaaaacucuccucug

SEQ ID NO: 1606153 - RNA, 14 nt, Human
ccccagccccaaaa

SEQ ID NO: 1606154 - RNA, 14 nt, Human
ccccagccccaucc

SEQ ID NO: 1606155 - RNA, 21 nt, Human
ccccauucugccugcccaggc

SEQ ID NO: 1606156 - RNA, 12 nt, Human
ccccagccccaa

SEQ ID NO: 1606157 - RNA, 23 nt, Human
cccagccccaaaacucuccucug

SEQ ID NO: 1606158 - RNA, 21 nt, Human
cccagccccaaaacucuccuc

SEQ ID NO: 1606159 - RNA, 19 nt, Human
cccagcccacuucugccau

SEQ ID NO: 1606160 - RNA, 19 nt, Human
cccauccucuguacagagc

SEQ ID NO: 1606161 - RNA, 15 nt, Human
cccauccucuguaca

SEQ ID NO: 1606162 - RNA, 20 nt, Human
cccauccucuguacagagcc

SEQ ID NO: 1606163 - RNA, 14 nt, Human
cccauccucuguac

SEQ ID NO: 1606164 - RNA, 20 nt, Human
cccaggcuggcgugcagugg

SEQ ID NO: 1606165 - RNA, 19 nt, Human
cccaggcuggcgugcagug

SEQ ID NO: 1606166 - RNA, 21 nt, Human
cccaggcuggcgugcaguggu

SEQ ID NO: 1606167 - RNA, 18 nt, Human
cccaggcuggcgugcagu

SEQ ID NO: 1606168 - RNA, 23 nt, Human
cccagcuggggccaggcuggguc

SEQ ID NO: 1606169 - RNA, 22 nt, Human
cccagcuggggccaggcugggu

SEQ ID NO: 1606170 - RNA, 18 nt, Human
ccaugggcacugugggua

SEQ ID NO: 1606171 - RNA, 19 nt, Human
ccaugggauaaaugccauc

SEQ ID NO: 1606172 - RNA, 18 nt, Human
ccaugaggaacaaggcaa

SEQ ID NO: 1606173 - RNA, 17 nt, Human
ccaugaggaacaaggca

SEQ ID NO: 1606174 - RNA, 16 nt, Human
ccaugaggaacaaggc

SEQ ID NO: 1606175 - RNA, 13 nt, Human
ccaugagccucag

SEQ ID NO: 1606176 - RNA, 20 nt, Human
ccaugucucugagcauuaga

SEQ ID NO: 1606177 - RNA, 15 nt, Human
ccaugucucgacuca

SEQ ID NO: 1606178 - RNA, 14 nt, Human
ccaugucucgacuc

SEQ ID NO: 1606179 - RNA, 13 nt, Human
ccauuuaaagcuu

SEQ ID NO: 1606180 - RNA, 14 nt, Human
cccaaccugcucuc

SEQ ID NO: 1606181 - RNA, 13 nt, Human
cccaaccugcucu

SEQ ID NO: 1606182 - RNA, 21 nt, Human
cccaaccugcucuccucuugc

SEQ ID NO: 1606183 - RNA, 23 nt, Human
cccaaccugcucuccucuugcca

SEQ ID NO: 1606184 - RNA, 22 nt, Human
ccauuguggucacaggaaguag

SEQ ID NO: 1606185 - RNA, 15 nt, Human
cccacccaagggccu

SEQ ID NO: 1606186 - RNA, 18 nt, Human
cccacccaagggccuggc

SEQ ID NO: 1606187 - RNA, 17 nt, Human
cccaagcucugcuccuc

SEQ ID NO: 1606188 - RNA, 12 nt, Human
cccaagcucugc

SEQ ID NO: 1606189 - RNA, 21 nt, Human
cccaagaauagaugcugacug

SEQ ID NO: 1606190 - RNA, 20 nt, Human
cccaagaauagaugcugacu

SEQ ID NO: 1606191 - RNA, 23 nt, Human
cccaagccuacuuuugccauuga

SEQ ID NO: 1606192 - RNA, 16 nt, Human
cccaagccuggcaagg

SEQ ID NO: 1606193 - RNA, 18 nt, Human
cccaccgcagacaggacc

SEQ ID NO: 1606194 - RNA, 15 nt, Human
cccaccgcagacagg

SEQ ID NO: 1606195 - RNA, 23 nt, Human
cccacuguacuugcucuugaugc

SEQ ID NO: 1606196 - RNA, 19 nt, Human
cccacuguacuugcucuug

SEQ ID NO: 1606197 - RNA, 18 nt, Human
cccacuguacuugcucuu

SEQ ID NO: 1606198 - RNA, 21 nt, Human
ccucuccugggcagcugccuc

SEQ ID NO: 1606199 - RNA, 22 nt, Human
ccucuccugggcagcugccucc

SEQ ID NO: 1606200 - RNA, 15 nt, Human
ccucuccugggcagc

SEQ ID NO: 1606201 - RNA, 16 nt, Human
ccucuccugggcagcu

SEQ ID NO: 1606202 - RNA, 17 nt, Human
ccucuccugggcagcug

SEQ ID NO: 1606203 - RNA, 18 nt, Human
ccucuccugggcagcugc

SEQ ID NO: 1606204 - RNA, 19 nt, Human
ccucuccugggcagcugcc

SEQ ID NO: 1606205 - RNA, 20 nt, Human
ccucuccugggcagcugccu

SEQ ID NO: 1606206 - RNA, 20 nt, Human
ccucugccugaagucacaca

SEQ ID NO: 1606207 - RNA, 11 nt, Human
ccucugccuga

SEQ ID NO: 1606208 - RNA, 23 nt, Human
ccucugccucugacacacagcuc

SEQ ID NO: 1606209 - RNA, 21 nt, Human
ccucugccucugacacacagc

SEQ ID NO: 1606210 - RNA, 20 nt, Human
ccucugccucugacacacag

SEQ ID NO: 1606211 - RNA, 14 nt, Human
ccucugcccugcgg

SEQ ID NO: 1606212 - RNA, 13 nt, Human
ccucugcccugcg

SEQ ID NO: 1606213 - RNA, 12 nt, Human
ccucugcccugc

SEQ ID NO: 1606214 - RNA, 11 nt, Human
ccucugcccug

SEQ ID NO: 1606215 - RNA, 12 nt, Human
ccucucucacuc

SEQ ID NO: 1606216 - RNA, 20 nt, Human
ccucucugcaggucccuaau

SEQ ID NO: 1606217 - RNA, 19 nt, Human
ccucucugcaggucccuaa

SEQ ID NO: 1606218 - RNA, 18 nt, Human
ccucucugcaggucccua

SEQ ID NO: 1606219 - RNA, 17 nt, Human
ccucucugcaggucccu

SEQ ID NO: 1606220 - RNA, 16 nt, Human
ccucucugcagguccc

SEQ ID NO: 1606221 - RNA, 13 nt, Human
ccuccgccucuug

SEQ ID NO: 1606222 - RNA, 16 nt, Human
ccuccgccucccgggu

SEQ ID NO: 1606223 - RNA, 13 nt, Human
ccuccgccucccg

SEQ ID NO: 1606224 - RNA, 15 nt, Human
ccucgaacuggcugc

SEQ ID NO: 1606225 - RNA, 16 nt, Human
ccucgaacuggcugca

SEQ ID NO: 1606226 - RNA, 20 nt, Human
ccuccuuugugaggaagccg

SEQ ID NO: 1606227 - RNA, 19 nt, Human
ccuccuuugugaggaagcc

SEQ ID NO: 1606228 - RNA, 18 nt, Human
ccuccuuugugaggaagc

SEQ ID NO: 1606229 - RNA, 18 nt, Human
ccucagccuccugaguag

SEQ ID NO: 1606230 - RNA, 23 nt, Human
ccucccaacucaccccagcccca

SEQ ID NO: 1606231 - RNA, 21 nt, Human
ccucccaacucaccccagccc

SEQ ID NO: 1606232 - RNA, 20 nt, Human
ccucccaacucaccccagcc

SEQ ID NO: 1606233 - RNA, 17 nt, Human
ccucccaacucacccca

SEQ ID NO: 1606234 - RNA, 11 nt, Human
ccucaggcagg

SEQ ID NO: 1606235 - RNA, 16 nt, Human
ccugaggggccucuua

SEQ ID NO: 1606236 - RNA, 12 nt, Human
ccugaggggccu

SEQ ID NO: 1606237 - RNA, 21 nt, Human
ccugaggcugggcucccuucc

SEQ ID NO: 1606238 - RNA, 19 nt, Human
ccugaggcugggcucccuu

SEQ ID NO: 1606239 - RNA, 17 nt, Human
ccugaggcugggcuccc

SEQ ID NO: 1606240 - RNA, 21 nt, Human
ccugcaggcagccaggccaca

SEQ ID NO: 1606241 - RNA, 20 nt, Human
ccugcaggcagccaggccac

SEQ ID NO: 1606242 - RNA, 19 nt, Human
ccugcaggcagccaggcca

SEQ ID NO: 1606243 - RNA, 18 nt, Human
ccugcaggcagccaggcc

SEQ ID NO: 1606244 - RNA, 23 nt, Human
ccugcaggcagccaggccacaag

SEQ ID NO: 1606245 - RNA, 14 nt, Human
ccugcagagggcac

SEQ ID NO: 1606246 - RNA, 17 nt, Human
ccugcaggcagccaggc

SEQ ID NO: 1606247 - RNA, 16 nt, Human
ccugcaggcagccagg

SEQ ID NO: 1606248 - RNA, 12 nt, Human
ccugcagagggc

SEQ ID NO: 1606249 - RNA, 21 nt, Human
ccucugccugaagucacacag

SEQ ID NO: 1606250 - RNA, 15 nt, Human
ccucugccugucucc

SEQ ID NO: 1606251 - RNA, 19 nt, Human
ccucugccugucuccccca

SEQ ID NO: 1606252 - RNA, 19 nt, Human
ccucuuuggucuacacugu

SEQ ID NO: 1606253 - RNA, 16 nt, Human
ccucuuugagugaagc

SEQ ID NO: 1606254 - RNA, 20 nt, Human
ccugccuccuuugugaggaa

SEQ ID NO: 1606255 - RNA, 19 nt, Human
ccugccuccuuugugagga

SEQ ID NO: 1606256 - RNA, 15 nt, Human
ccugccuccuuugug

SEQ ID NO: 1606257 - RNA, 13 nt, Human
ccugccuccuuug

SEQ ID NO: 1606258 - RNA, 22 nt, Human
ccugccuccuuugugaggaagc

SEQ ID NO: 1606259 - RNA, 21 nt, Human
ccugccuccuuugugaggaag

SEQ ID NO: 1606260 - RNA, 23 nt, Human
ccugccuccuuugugaggaagcc

SEQ ID NO: 1606261 - RNA, 17 nt, Human
ccugccucucugcaggu

SEQ ID NO: 1606262 - RNA, 16 nt, Human
ccugcugcaguugcca

SEQ ID NO: 1606263 - RNA, 12 nt, Human
ccugcugcaguu

SEQ ID NO: 1606264 - RNA, 11 nt, Human
ccugcugcagu

SEQ ID NO: 1606265 - RNA, 22 nt, Human
ccugcugcaguugccagucacc

SEQ ID NO: 1606266 - RNA, 15 nt, Human
ccugccucuucucua

SEQ ID NO: 1606267 - RNA, 21 nt, Human
ccugccucucugcaggucccu

SEQ ID NO: 1606268 - RNA, 20 nt, Human
ccugccucucugcagguccc

SEQ ID NO: 1606269 - RNA, 14 nt, Human
cccugagcaggauu

SEQ ID NO: 1606270 - RNA, 16 nt, Human
cccugagcuuucugcu

SEQ ID NO: 1606271 - RNA, 20 nt, Human
cccugcccaccuggccucug

SEQ ID NO: 1606272 - RNA, 17 nt, Human
cccugcccggcugcgga

SEQ ID NO: 1606273 - RNA, 14 nt, Human
cccugcccggcugc

SEQ ID NO: 1606274 - RNA, 17 nt, Human
cccugccccucccuuca

SEQ ID NO: 1606275 - RNA, 23 nt, Human
cccugccccucccuucaaccauu

SEQ ID NO: 1606276 - RNA, 19 nt, Human
cccugccccucccuucaac

SEQ ID NO: 1606277 - RNA, 18 nt, Human
cccugccccucccuucaa

SEQ ID NO: 1606278 - RNA, 14 nt, Human
cccugccccccagc

SEQ ID NO: 1606279 - RNA, 15 nt, Human
cccugccccccagcc

SEQ ID NO: 1606280 - RNA, 20 nt, Human
cccugccccccagcccuccu

SEQ ID NO: 1606281 - RNA, 22 nt, Human
cccugcccaccuggccucugca

SEQ ID NO: 1606282 - RNA, 19 nt, Human
cccuggauccaucaggcca

SEQ ID NO: 1606283 - RNA, 21 nt, Human
cccuggaugcagccucacagu

SEQ ID NO: 1606284 - RNA, 17 nt, Human
cccuggaugcagccuca

SEQ ID NO: 1606285 - RNA, 13 nt, Human
cccuggaugcagc

SEQ ID NO: 1606286 - RNA, 11 nt, Human
cccugcccugu

SEQ ID NO: 1606287 - RNA, 23 nt, Human
cccugcccugguuuccugcccug

SEQ ID NO: 1606288 - RNA, 22 nt, Human
cccugcccugguuuccugcccu

SEQ ID NO: 1606289 - RNA, 12 nt, Human
cccugcccuggu

SEQ ID NO: 1606290 - RNA, 11 nt, Human
cccugcccugg

SEQ ID NO: 1606291 - RNA, 20 nt, Human
cccuggcucccacaggcccu

SEQ ID NO: 1606292 - RNA, 13 nt, Human
cccucggagaaga

SEQ ID NO: 1606293 - RNA, 18 nt, Human
cccugaaagcccugagcu

SEQ ID NO: 1606294 - RNA, 14 nt, Human
cccuccucucugcc

SEQ ID NO: 1606295 - RNA, 18 nt, Human
cccuccuccuggacuccu

SEQ ID NO: 1606296 - RNA, 16 nt, Human
cccuccuccuggacuc

SEQ ID NO: 1606297 - RNA, 11 nt, Human
cccuccuccug

SEQ ID NO: 1606298 - RNA, 20 nt, Human
cccugaauuuaaauagcuuu

SEQ ID NO: 1606299 - RNA, 22 nt, Human
cccugacaacacucauugaccu

SEQ ID NO: 1606300 - RNA, 16 nt, Human
cccugacaacacucau

SEQ ID NO: 1606301 - RNA, 22 nt, Human
cccugaaggccccgcccaggcu

SEQ ID NO: 1606302 - RNA, 20 nt, Human
cccugaaggccccgcccagg

SEQ ID NO: 1606303 - RNA, 14 nt, Human
cccugacaacacuc

SEQ ID NO: 1606304 - RNA, 19 nt, Human
cccugaaggccccgcccag

SEQ ID NO: 1606305 - RNA, 16 nt, Human
cccugaaggccccgcc

SEQ ID NO: 1606306 - RNA, 14 nt, Human
cccugaaggccccg

SEQ ID NO: 1606307 - RNA, 13 nt, Human
cccugaaggcccc

SEQ ID NO: 1606308 - RNA, 12 nt, Human
cccugaaggccc

SEQ ID NO: 1606309 - RNA, 20 nt, Human
ccuaacgaaguauccuucag

SEQ ID NO: 1606310 - RNA, 16 nt, Human
ccgugaggccagagac

SEQ ID NO: 1606311 - RNA, 14 nt, Human
ccgugaggccagag

SEQ ID NO: 1606312 - RNA, 13 nt, Human
ccgugaggccaga

SEQ ID NO: 1606313 - RNA, 12 nt, Human
ccgugaggccag

SEQ ID NO: 1606314 - RNA, 17 nt, Human
ccgucuaccugaggggc

SEQ ID NO: 1606315 - RNA, 14 nt, Human
ccggcuccaggcuc

SEQ ID NO: 1606316 - RNA, 13 nt, Human
ccggcuccaggcu

SEQ ID NO: 1606317 - RNA, 15 nt, Human
ccgucuaccugaggg

SEQ ID NO: 1606318 - RNA, 14 nt, Human
ccgucuaccugagg

SEQ ID NO: 1606319 - RNA, 15 nt, Human
ccggcuccaggcucc

SEQ ID NO: 1606320 - RNA, 14 nt, Human
ccuaaucuucugaa

SEQ ID NO: 1606321 - RNA, 12 nt, Human
ccuaaggacuuc

SEQ ID NO: 1606322 - RNA, 11 nt, Human
ccuaaggacuu

SEQ ID NO: 1606323 - RNA, 23 nt, Human
ccuaaggacuucuuuaauuuugg

SEQ ID NO: 1606324 - RNA, 18 nt, Human
ccuaaggacuucuuuaau

SEQ ID NO: 1606325 - RNA, 17 nt, Human
ccuaaggacuucuuuaa

SEQ ID NO: 1606326 - RNA, 16 nt, Human
ccuaaggacuucuuua

SEQ ID NO: 1606327 - RNA, 19 nt, Human
ccuagcauacguacacauu

SEQ ID NO: 1606328 - RNA, 20 nt, Human
ccuaaugcgcaggcuggccc

SEQ ID NO: 1606329 - RNA, 20 nt, Human
ccuagccugugccucuggga

SEQ ID NO: 1606330 - RNA, 21 nt, Human
ccuagcauacguacacauuuu

SEQ ID NO: 1606331 - RNA, 16 nt, Human
ccggccaccugcggug

SEQ ID NO: 1606332 - RNA, 22 nt, Human
cccugugauggggcccugccuc

SEQ ID NO: 1606333 - RNA, 21 nt, Human
cccugugauggggcccugccu

SEQ ID NO: 1606334 - RNA, 23 nt, Human
cccugugauggggcccugccucc

SEQ ID NO: 1606335 - RNA, 13 nt, Human
cccugucuaauga

SEQ ID NO: 1606336 - RNA, 17 nt, Human
ccgcagacaggaccagg

SEQ ID NO: 1606337 - RNA, 16 nt, Human
ccgcagacaggaccag

SEQ ID NO: 1606338 - RNA, 12 nt, Human
ccgcccaggcuu

SEQ ID NO: 1606339 - RNA, 15 nt, Human
cccuuccucuuucca

SEQ ID NO: 1606340 - RNA, 17 nt, Human
ccgaaaacguggcugcu

SEQ ID NO: 1606341 - RNA, 16 nt, Human
ccgaaaacguggcugc

SEQ ID NO: 1606342 - RNA, 19 nt, Human
ccgaaagggacuuggaagc

SEQ ID NO: 1606343 - RNA, 17 nt, Human
ccgaccagacaccuuga

SEQ ID NO: 1606344 - RNA, 13 nt, Human
ccgaccagacacc

SEQ ID NO: 1606345 - RNA, 18 nt, Human
ccgaccagacaccuugac

SEQ ID NO: 1606346 - RNA, 15 nt, Human
ccgaccaccugccca

SEQ ID NO: 1606347 - RNA, 17 nt, Human
ccgaauagcugggacua

SEQ ID NO: 1606348 - RNA, 16 nt, Human
ccgaauagcugggacu

SEQ ID NO: 1606349 - RNA, 23 nt, Human
ccgaaggugaggagcuugaaacc

SEQ ID NO: 1606350 - RNA, 12 nt, Human
ccuuuucccaac

SEQ ID NO: 1606351 - RNA, 20 nt, Human
ccuuuucgcaggauucuucc

SEQ ID NO: 1606352 - RNA, 22 nt, Human
cgcaggcuggcccugcccuggu

SEQ ID NO: 1606353 - RNA, 21 nt, Human
cgagucucuucuccacuggau

SEQ ID NO: 1606354 - RNA, 20 nt, Human
cgagucucuucuccacugga

SEQ ID NO: 1606355 - RNA, 18 nt, Human
cgagucucuucuccacug

SEQ ID NO: 1606356 - RNA, 17 nt, Human
cgagucucuucuccacu

SEQ ID NO: 1606357 - RNA, 18 nt, Human
cgcuggagugcagugagc

SEQ ID NO: 1606358 - RNA, 17 nt, Human
cgcuggagugcagugag

SEQ ID NO: 1606359 - RNA, 20 nt, Human
cgcugccccuggcagccccu

SEQ ID NO: 1606360 - RNA, 19 nt, Human
cgcugccccuggcagcccc

SEQ ID NO: 1606361 - RNA, 19 nt, Human
cgcugauaagcguucaugg

SEQ ID NO: 1606362 - RNA, 21 nt, Human
cgcucuuggcagguacucagc

SEQ ID NO: 1606363 - RNA, 20 nt, Human
cgcucugucgcccaggcugg

SEQ ID NO: 1606364 - RNA, 18 nt, Human
cggcuaauuuuuguauuu

SEQ ID NO: 1606365 - RNA, 23 nt, Human
cggagucccaccuuggcugcagg

SEQ ID NO: 1606366 - RNA, 15 nt, Human
cggaggggccuggca

SEQ ID NO: 1606367 - RNA, 22 nt, Human
cggagucccaccuuggcugcag

SEQ ID NO: 1606368 - RNA, 21 nt, Human
cggagucccaccuuggcugca

SEQ ID NO: 1606369 - RNA, 17 nt, Human
cggagacggagucccac

SEQ ID NO: 1606370 - RNA, 20 nt, Human
cggagacggagucccaccuu

SEQ ID NO: 1606371 - RNA, 14 nt, Human
cggcucacugcagc

SEQ ID NO: 1606372 - RNA, 14 nt, Human
cgggccagugcucc

SEQ ID NO: 1606373 - RNA, 18 nt, Human
cgggccagugcuccagcc

SEQ ID NO: 1606374 - RNA, 13 nt, Human
cgggcucugccuc

SEQ ID NO: 1606375 - RNA, 12 nt, Human
cgggcucugccu

SEQ ID NO: 1606376 - RNA, 20 nt, Human
cgggcugggagcucugcaga

SEQ ID NO: 1606377 - RNA, 16 nt, Human
cgggcugggagcucug

SEQ ID NO: 1606378 - RNA, 19 nt, Human
cgggcucagcaaaagaugc

SEQ ID NO: 1606379 - RNA, 20 nt, Human
cgggccuggagaacuagaga

SEQ ID NO: 1606380 - RNA, 16 nt, Human
cgggccuggagaacua

SEQ ID NO: 1606381 - RNA, 22 nt, Human
cguacacauuuuauuuuauuau

SEQ ID NO: 1606382 - RNA, 20 nt, Human
cgguggcucacgccuguaau

SEQ ID NO: 1606383 - RNA, 20 nt, Human
cuacaaaaacacagcaaggg

SEQ ID NO: 1606384 - RNA, 19 nt, Human
cuacaaaaagcauaaaaau

SEQ ID NO: 1606385 - RNA, 20 nt, Human
cuaauaaaauuuaaaagucu

SEQ ID NO: 1606386 - RNA, 14 nt, Human
cuaaguuuuuaugg

SEQ ID NO: 1606387 - RNA, 15 nt, Human
cgugacaacacuugu

SEQ ID NO: 1606388 - RNA, 14 nt, Human
cgugacaacacuug

SEQ ID NO: 1606389 - RNA, 20 nt, Human
cgugagccacugcaccgggc

SEQ ID NO: 1606390 - RNA, 15 nt, Human
cgugagccacugcac

SEQ ID NO: 1606391 - RNA, 14 nt, Human
cgugagccacugca

SEQ ID NO: 1606392 - RNA, 14 nt, Human
cgugaggccagaga

SEQ ID NO: 1606393 - RNA, 22 nt, Human
cgugagccacugcaccgggcca

SEQ ID NO: 1606394 - RNA, 16 nt, Human
cuaacuuuccuucauu

SEQ ID NO: 1606395 - RNA, 22 nt, Human
cuaacuugucuuuggacccuga

SEQ ID NO: 1606396 - RNA, 14 nt, Human
cuaacuugucuuug

SEQ ID NO: 1606397 - RNA, 19 nt, Human
cuaaaguguauuuuuuuac

SEQ ID NO: 1606398 - RNA, 23 nt, Human
cuaaaguaaaaacaaagaaauua

SEQ ID NO: 1606399 - RNA, 19 nt, Human
cguguuaugacuccagaau

SEQ ID NO: 1606400 - RNA, 15 nt, Human
cguguuaugacucca

SEQ ID NO: 1606401 - RNA, 19 nt, Human
cgugaguccuggcauggga

SEQ ID NO: 1606402 - RNA, 16 nt, Human
cgugaggccagagaca

SEQ ID NO: 1606403 - RNA, 11 nt, Human
cuaaagcugcc

SEQ ID NO: 1606404 - RNA, 21 nt, Human
cguucauggaacgcguugaaa

SEQ ID NO: 1606405 - RNA, 17 nt, Human
ccuucucuucacaguca

SEQ ID NO: 1606406 - RNA, 21 nt, Human
ccuucuguccuacucuguguc

SEQ ID NO: 1606407 - RNA, 20 nt, Human
ccuucuguccuacucugugu

SEQ ID NO: 1606408 - RNA, 22 nt, Human
ccuucuguccuacucuguguca

SEQ ID NO: 1606409 - RNA, 19 nt, Human
ccuucccccuccaauccca

SEQ ID NO: 1606410 - RNA, 18 nt, Human
ccuuccuaauuccacagc

SEQ ID NO: 1606411 - RNA, 20 nt, Human
ccuuccuaauuccacagcug

SEQ ID NO: 1606412 - RNA, 19 nt, Human
ccuuccuaauuccacagcu

SEQ ID NO: 1606413 - RNA, 16 nt, Human
ccuucucugaaggaca

SEQ ID NO: 1606414 - RNA, 14 nt, Human
ccuucucugaagga

SEQ ID NO: 1606415 - RNA, 23 nt, Human
ccuucucuccagccccuggaugc

SEQ ID NO: 1606416 - RNA, 21 nt, Human
ccuucucuccagccccuggau

SEQ ID NO: 1606417 - RNA, 20 nt, Human
ccuuccucuccacugccuuc

SEQ ID NO: 1606418 - RNA, 20 nt, Human
ccuucucuccagccccugga

SEQ ID NO: 1606419 - RNA, 17 nt, Human
ccuuccucuccacugcc

SEQ ID NO: 1606420 - RNA, 16 nt, Human
ccuuccucuccacugc

SEQ ID NO: 1606421 - RNA, 15 nt, Human
ccuuccucuccacug

SEQ ID NO: 1606422 - RNA, 14 nt, Human
ccuuccucuccacu

SEQ ID NO: 1606423 - RNA, 21 nt, Human
ccuuccuaauuccacagcugc

SEQ ID NO: 1606424 - RNA, 15 nt, Human
ccuuucaauaggaaa

SEQ ID NO: 1606425 - RNA, 14 nt, Human
ccuuuauucuggca

SEQ ID NO: 1606426 - RNA, 17 nt, Human
ccuuucaauaggaaaaa

SEQ ID NO: 1606427 - RNA, 18 nt, Human
ccuuucaauaggaaaaac

SEQ ID NO: 1606428 - RNA, 14 nt, Human
ccuugcauaauggu

SEQ ID NO: 1606429 - RNA, 19 nt, Human
ccuguucagcuccagcuca

SEQ ID NO: 1606430 - RNA, 16 nt, Human
ccuguucagcuccagc

SEQ ID NO: 1606431 - RNA, 15 nt, Human
ccuguucagcuccag

SEQ ID NO: 1606432 - RNA, 14 nt, Human
ccuguucagcucca

SEQ ID NO: 1606433 - RNA, 21 nt, Human
ccuguucagcuccagcucacc

SEQ ID NO: 1606434 - RNA, 20 nt, Human
ccuguucagcuccagcucac

SEQ ID NO: 1606435 - RNA, 23 nt, Human
ccuguucagcuccagcucaccag

SEQ ID NO: 1606436 - RNA, 17 nt, Human
ccuguucuggcagaguu

SEQ ID NO: 1606437 - RNA, 12 nt, Human
ccuguucuggca

SEQ ID NO: 1606438 - RNA, 16 nt, Human
ccuguucugcuuuccu

SEQ ID NO: 1606439 - RNA, 18 nt, Human
ccuguucccaugagauga

SEQ ID NO: 1606440 - RNA, 12 nt, Human
ccuguucccauu

SEQ ID NO: 1606441 - RNA, 20 nt, Human
ccuguugggccaggagccuc

SEQ ID NO: 1606442 - RNA, 19 nt, Human
ccuguugggccaggagccu

SEQ ID NO: 1606443 - RNA, 18 nt, Human
ccuguugggccaggagcc

SEQ ID NO: 1606444 - RNA, 17 nt, Human
ccuguugggccaggagc

SEQ ID NO: 1606445 - RNA, 16 nt, Human
ccuguugggccaggag

SEQ ID NO: 1606446 - RNA, 20 nt, Human
ccuuagcagggaaacagcua

SEQ ID NO: 1606447 - RNA, 19 nt, Human
ccuuagcagggaaacagcu

SEQ ID NO: 1606448 - RNA, 16 nt, Human
ccuuagcaaauucugu

SEQ ID NO: 1606449 - RNA, 12 nt, Human
ccuuauggaaca

SEQ ID NO: 1606450 - RNA, 18 nt, Human
ccuuaucaaaggacacca

SEQ ID NO: 1606451 - RNA, 14 nt, Human
ccuuaucaaaggac

SEQ ID NO: 1606452 - RNA, 20 nt, Human
ccuuaggugauccacucgcc

SEQ ID NO: 1606453 - RNA, 13 nt, Human
ccuuaucaaagga

SEQ ID NO: 1606454 - RNA, 18 nt, Human
ccuuauggaacacucuga

SEQ ID NO: 1606455 - RNA, 17 nt, Human
ccuuauggaacacucug

SEQ ID NO: 1606456 - RNA, 16 nt, Human
ccuuauggaacacucu

SEQ ID NO: 1606457 - RNA, 14 nt, Human
ccuuauggaacacu

SEQ ID NO: 1606458 - RNA, 20 nt, Human
ccuuauggaacacucugaga

SEQ ID NO: 1606459 - RNA, 19 nt, Human
ccuuauggaacacucugag

SEQ ID NO: 1606460 - RNA, 22 nt, Human
ccuuauggaacacucugagacu

SEQ ID NO: 1606461 - RNA, 19 nt, Human
ccuucccaccucucucacu

SEQ ID NO: 1606462 - RNA, 14 nt, Human
ccuucccaccucuc

SEQ ID NO: 1606463 - RNA, 12 nt, Human
ccuucccaccuc

SEQ ID NO: 1606464 - RNA, 15 nt, Human
ccuucccaugcccug

SEQ ID NO: 1606465 - RNA, 13 nt, Human
ccuguucagcucc

SEQ ID NO: 1606466 - RNA, 21 nt, Human
ccuguucacucuacuuagcau

SEQ ID NO: 1606467 - RNA, 18 nt, Human
cuauguucuaagaaguga

SEQ ID NO: 1606468 - RNA, 14 nt, Human
cuauguugcccagg

SEQ ID NO: 1606469 - RNA, 17 nt, Human
cuaugugagcacaaagg

SEQ ID NO: 1606470 - RNA, 22 nt, Human
cuauguugcccaggcaggucuu

SEQ ID NO: 1606471 - RNA, 21 nt, Human
cuauguugcccaggcaggucu

SEQ ID NO: 1606472 - RNA, 19 nt, Human
cuauguugcccaggcaggu

SEQ ID NO: 1606473 - RNA, 18 nt, Human
cuauguugcccaggcagg

SEQ ID NO: 1606474 - RNA, 18 nt, Human
cuaucucauuuccaagca

SEQ ID NO: 1606475 - RNA, 14 nt, Human
cuaucucccccagc

SEQ ID NO: 1606476 - RNA, 13 nt, Human
cuaucucccccag

SEQ ID NO: 1606477 - RNA, 14 nt, Human
cuaugugagaccau

SEQ ID NO: 1606478 - RNA, 18 nt, Human
cuaucaugucaaacguga

SEQ ID NO: 1606479 - RNA, 17 nt, Human
cuauccuacuuccccuu

SEQ ID NO: 1606480 - RNA, 23 nt, Human
cucaauuauuuugcauuuuuucu

SEQ ID NO: 1606481 - RNA, 16 nt, Human
cucaguccaugaagau

SEQ ID NO: 1606482 - RNA, 17 nt, Human
cucaguccauagcagag

SEQ ID NO: 1606483 - RNA, 15 nt, Human
cucaguccauagcag

SEQ ID NO: 1606484 - RNA, 14 nt, Human
cucagguugucuga

SEQ ID NO: 1606485 - RNA, 22 nt, Human
cucagucuggcccuuccuuuuc

SEQ ID NO: 1606486 - RNA, 23 nt, Human
cucaggugucccugcacuugcag

SEQ ID NO: 1606487 - RNA, 22 nt, Human
cucagguugucugaagucacug

SEQ ID NO: 1606488 - RNA, 22 nt, Human
cucagaagacacugaugggcaa

SEQ ID NO: 1606489 - RNA, 20 nt, Human
cucagaagacacugaugggc

SEQ ID NO: 1606490 - RNA, 17 nt, Human
cucagaagacacugaug

SEQ ID NO: 1606491 - RNA, 15 nt, Human
cucagaagacacuga

SEQ ID NO: 1606492 - RNA, 13 nt, Human
cucagaagacacu

SEQ ID NO: 1606493 - RNA, 17 nt, Human
cucaccuuucccaucuu

SEQ ID NO: 1606494 - RNA, 23 nt, Human
cucagaagacacugaugggcaac

SEQ ID NO: 1606495 - RNA, 23 nt, Human
cucagccucccgaauagcuggga

SEQ ID NO: 1606496 - RNA, 22 nt, Human
cucagccucccgaauagcuggg

SEQ ID NO: 1606497 - RNA, 21 nt, Human
cucagccucccgaauagcugg

SEQ ID NO: 1606498 - RNA, 19 nt, Human
cucagccucccgaauagcu

SEQ ID NO: 1606499 - RNA, 13 nt, Human
cucaggccugggg

SEQ ID NO: 1606500 - RNA, 20 nt, Human
cucaggccagcugcuugggc

SEQ ID NO: 1606501 - RNA, 18 nt, Human
cucaggccagcugcuugg

SEQ ID NO: 1606502 - RNA, 17 nt, Human
cucaggccagcugcuug

SEQ ID NO: 1606503 - RNA, 16 nt, Human
cucaggccagcugcuu

SEQ ID NO: 1606504 - RNA, 11 nt, Human
cucaggccugg

SEQ ID NO: 1606505 - RNA, 22 nt, Human
cucaggccugggggcugggcag

SEQ ID NO: 1606506 - RNA, 20 nt, Human
cucaggccaaacucaccugc

SEQ ID NO: 1606507 - RNA, 19 nt, Human
cucaggccaaacucaccug

SEQ ID NO: 1606508 - RNA, 21 nt, Human
cucaggccaaacucaccugcc

SEQ ID NO: 1606509 - RNA, 20 nt, Human
cucccuccaccucccugcaa

SEQ ID NO: 1606510 - RNA, 21 nt, Human
cucccuccaccucccugcaau

SEQ ID NO: 1606511 - RNA, 22 nt, Human
cucccuccaccucccugcaaua

SEQ ID NO: 1606512 - RNA, 19 nt, Human
cucccuccaccucccugca

SEQ ID NO: 1606513 - RNA, 15 nt, Human
cucccaggcauuccc

SEQ ID NO: 1606514 - RNA, 20 nt, Human
cucccucuuucccucccuuc

SEQ ID NO: 1606515 - RNA, 20 nt, Human
cucccugaaguaagcaaaga

SEQ ID NO: 1606516 - RNA, 22 nt, Human
cuccaggcuguaucccaugagc

SEQ ID NO: 1606517 - RNA, 20 nt, Human
cuccaggcuguaucccauga

SEQ ID NO: 1606518 - RNA, 23 nt, Human
cuccaggcuccuuuagcgcccag

SEQ ID NO: 1606519 - RNA, 23 nt, Human
cuccaggugcacaagcuccaagc

SEQ ID NO: 1606520 - RNA, 21 nt, Human
cucccacaggcccuuccucuc

SEQ ID NO: 1606521 - RNA, 20 nt, Human
cucccacaggcccuuccucu

SEQ ID NO: 1606522 - RNA, 16 nt, Human
cucccacaggcccuuc

SEQ ID NO: 1606523 - RNA, 14 nt, Human
cucccacaggcccu

SEQ ID NO: 1606524 - RNA, 15 nt, Human
cucccacaggcccuu

SEQ ID NO: 1606525 - RNA, 13 nt, Human
cuccuaccuggua

SEQ ID NO: 1606526 - RNA, 18 nt, Human
cuccugggcuaagugauc

SEQ ID NO: 1606527 - RNA, 19 nt, Human
cuccuggccucaagugauu

SEQ ID NO: 1606528 - RNA, 19 nt, Human
cuccuggcccacugcaucg

SEQ ID NO: 1606529 - RNA, 18 nt, Human
cuccucuugccacugccu

SEQ ID NO: 1606530 - RNA, 12 nt, Human
cuccucuugcca

SEQ ID NO: 1606531 - RNA, 16 nt, Human
cuccucuugccacugc

SEQ ID NO: 1606532 - RNA, 15 nt, Human
cuccucuugccacug

SEQ ID NO: 1606533 - RNA, 14 nt, Human
cuccucugcugcug

SEQ ID NO: 1606534 - RNA, 13 nt, Human
cuccucugcugcu

SEQ ID NO: 1606535 - RNA, 15 nt, Human
cuccucugcugcugg

SEQ ID NO: 1606536 - RNA, 15 nt, Human
cuccucuguccaggc

SEQ ID NO: 1606537 - RNA, 12 nt, Human
cuccucugucca

SEQ ID NO: 1606538 - RNA, 16 nt, Human
cuccuguaccucuuga

SEQ ID NO: 1606539 - RNA, 14 nt, Human
cuccuggggguucu

SEQ ID NO: 1606540 - RNA, 15 nt, Human
cuccuuucaccacau

SEQ ID NO: 1606541 - RNA, 17 nt, Human
cuccuuucacaaccuuc

SEQ ID NO: 1606542 - RNA, 16 nt, Human
cuccuuucacaaccuu

SEQ ID NO: 1606543 - RNA, 13 nt, Human
cuccuuucacaac

SEQ ID NO: 1606544 - RNA, 14 nt, Human
cuccuuguguuacu

SEQ ID NO: 1606545 - RNA, 13 nt, Human
cucucuggccuuc

SEQ ID NO: 1606546 - RNA, 16 nt, Human
cucuccuccagaguca

SEQ ID NO: 1606547 - RNA, 16 nt, Human
cucucuggccuucggc

SEQ ID NO: 1606548 - RNA, 14 nt, Human
cucucuggccuucg

SEQ ID NO: 1606549 - RNA, 15 nt, Human
cucuccuccagaguc

SEQ ID NO: 1606550 - RNA, 13 nt, Human
cucuccuccagag

SEQ ID NO: 1606551 - RNA, 19 nt, Human
cucuauguucuaagaagug

SEQ ID NO: 1606552 - RNA, 15 nt, Human
cucuccccaugaugu

SEQ ID NO: 1606553 - RNA, 16 nt, Human
cucuccccaugauguu

SEQ ID NO: 1606554 - RNA, 16 nt, Human
cucgguguggagaagc

SEQ ID NO: 1606555 - RNA, 23 nt, Human
cucgguguggagaagcggcuggc

SEQ ID NO: 1606556 - RNA, 17 nt, Human
cucgguguggagaagcg

SEQ ID NO: 1606557 - RNA, 23 nt, Human
cuccuuugugaggaagccgcugg

SEQ ID NO: 1606558 - RNA, 18 nt, Human
cuccuuugugaggaagcc

SEQ ID NO: 1606559 - RNA, 17 nt, Human
cuccuuugugaggaagc

SEQ ID NO: 1606560 - RNA, 20 nt, Human
cuccuuucacaaccuucugu

SEQ ID NO: 1606561 - RNA, 21 nt, Human
cucugcacaagcugcacccuc

SEQ ID NO: 1606562 - RNA, 20 nt, Human
cucugcacaagcugcacccu

SEQ ID NO: 1606563 - RNA, 16 nt, Human
cucugcacuccccugc

SEQ ID NO: 1606564 - RNA, 15 nt, Human
cucugcacuccccug

SEQ ID NO: 1606565 - RNA, 13 nt, Human
cucuguacagagc

SEQ ID NO: 1606566 - RNA, 15 nt, Human
cucuguacagagccc

SEQ ID NO: 1606567 - RNA, 14 nt, Human
cucuguacagagcc

SEQ ID NO: 1606568 - RNA, 15 nt, Human
cucugcugcuggcug

SEQ ID NO: 1606569 - RNA, 14 nt, Human
cucugcugcuggcu

SEQ ID NO: 1606570 - RNA, 16 nt, Human
cucugcugcuggcugg

SEQ ID NO: 1606571 - RNA, 16 nt, Human
cucuguacagagccca

SEQ ID NO: 1606572 - RNA, 13 nt, Human
cucuguccuggga

SEQ ID NO: 1606573 - RNA, 13 nt, Human
cucugcugcuggc

SEQ ID NO: 1606574 - RNA, 23 nt, Human
cucugcugacagacacaggcccg

SEQ ID NO: 1606575 - RNA, 22 nt, Human
cucugcugacagacacaggccc

SEQ ID NO: 1606576 - RNA, 21 nt, Human
cucugcugacagacacaggcc

SEQ ID NO: 1606577 - RNA, 18 nt, Human
cucugcacuccccugcug

SEQ ID NO: 1606578 - RNA, 17 nt, Human
cucugcacuccccugcu

SEQ ID NO: 1606579 - RNA, 21 nt, Human
cucugcuccucuccccagcaa

SEQ ID NO: 1606580 - RNA, 13 nt, Human
cucugcagguccc

SEQ ID NO: 1606581 - RNA, 14 nt, Human
aaauucaugcugcu

SEQ ID NO: 1606582 - RNA, 22 nt, Human
aaauuaacuuuuauaaacuuua

SEQ ID NO: 1606583 - RNA, 23 nt, Human
aaauuaacuuuuauaaacuuuac

SEQ ID NO: 1606584 - RNA, 21 nt, Human
aaauuaacuuuuauaaacuuu

SEQ ID NO: 1606585 - RNA, 20 nt, Human
aaauguuaaguugaugguga

SEQ ID NO: 1606586 - RNA, 22 nt, Human
guauuggcuagagguucaaaga

SEQ ID NO: 1606587 - RNA, 20 nt, Human
guauuuaauagguuuggaca

SEQ ID NO: 1606588 - RNA, 16 nt, Human
guauuuaauucauguu

SEQ ID NO: 1606589 - RNA, 12 nt, Human
aaauuucuaaau

SEQ ID NO: 1606590 - RNA, 22 nt, Human
aaauuuccugggagcuuuugua

SEQ ID NO: 1606591 - RNA, 14 nt, Human
guauuuuuuuacua

SEQ ID NO: 1606592 - RNA, 15 nt, Human
guauuuuuuuacuaa

SEQ ID NO: 1606593 - RNA, 17 nt, Human
aaauuucagcagcugca

SEQ ID NO: 1606594 - RNA, 18 nt, Human
aaauuucagcagcugcag

SEQ ID NO: 1606595 - RNA, 20 nt, Human
aaauuuaguauuuuguuuca

SEQ ID NO: 1606596 - RNA, 16 nt, Human
gucaaauugugugaaa

SEQ ID NO: 1606597 - RNA, 20 nt, Human
gucacacaguauuacuucug

SEQ ID NO: 1606598 - RNA, 16 nt, Human
gucacacacuuuggcu

SEQ ID NO: 1606599 - RNA, 19 nt, Human
gucaacucauauuuucaug

SEQ ID NO: 1606600 - RNA, 17 nt, Human
guauuuuuuuacuaaua

SEQ ID NO: 1606601 - RNA, 21 nt, Human
guauuuuuuuacuaauagaca

SEQ ID NO: 1606602 - RNA, 19 nt, Human
gucaaaguggugagaggca

SEQ ID NO: 1606603 - RNA, 22 nt, Human
aaauguaagggaaacugccagc

SEQ ID NO: 1606604 - RNA, 19 nt, Human
aaaugggggugcauuugag

SEQ ID NO: 1606605 - RNA, 17 nt, Human
aaaugggggugcauuug

SEQ ID NO: 1606606 - RNA, 18 nt, Human
aaaugggggugcauuuga

SEQ ID NO: 1606607 - RNA, 15 nt, Human
aaaugggggugcauu

SEQ ID NO: 1606608 - RNA, 16 nt, Human
aaaugggggugcauuu

SEQ ID NO: 1606609 - RNA, 17 nt, Human
guauaaaagccuguuua

SEQ ID NO: 1606610 - RNA, 22 nt, Human
guauauugauccagaaagaaaa

SEQ ID NO: 1606611 - RNA, 18 nt, Human
guauaaaagggacugaga

SEQ ID NO: 1606612 - RNA, 21 nt, Human
guauaaaagccuguuuaagag

SEQ ID NO: 1606613 - RNA, 18 nt, Human
guauaaaagccuguuuaa

SEQ ID NO: 1606614 - RNA, 14 nt, Human
guaugauucccagc

SEQ ID NO: 1606615 - RNA, 14 nt, Human
guaugggagagaag

SEQ ID NO: 1606616 - RNA, 15 nt, Human
guaucccuacuguaa

SEQ ID NO: 1606617 - RNA, 15 nt, Human
guauucuuauuuaau

SEQ ID NO: 1606618 - RNA, 21 nt, Human
guaugugugaagugagugagu

SEQ ID NO: 1606619 - RNA, 17 nt, Human
guaugugugaagugagu

SEQ ID NO: 1606620 - RNA, 13 nt, Human
guaugugugaagu

SEQ ID NO: 1606621 - RNA, 13 nt, Human
guaugguggcugg

SEQ ID NO: 1606622 - RNA, 15 nt, Human
guaugggagagaaga

SEQ ID NO: 1606623 - RNA, 16 nt, Human
guaugggacuggccuc

SEQ ID NO: 1606624 - RNA, 14 nt, Human
aaaugcauuucuaa

SEQ ID NO: 1606625 - RNA, 13 nt, Human
aaaugcccagccc

SEQ ID NO: 1606626 - RNA, 13 nt, Human
aaaugcccagcuu

SEQ ID NO: 1606627 - RNA, 18 nt, Human
aaaugcccagccccuucu

SEQ ID NO: 1606628 - RNA, 15 nt, Human
aaaugcccagccccu

SEQ ID NO: 1606629 - RNA, 14 nt, Human
aaaugcccagcccc

SEQ ID NO: 1606630 - RNA, 19 nt, Human
aaauggcuuccuggcaaua

SEQ ID NO: 1606631 - RNA, 23 nt, Human
aaaugccuuacccucauguucuu

SEQ ID NO: 1606632 - RNA, 20 nt, Human
aaaugggcagagcagagacc

SEQ ID NO: 1606633 - RNA, 18 nt, Human
aaaugggcagagcagaga

SEQ ID NO: 1606634 - RNA, 15 nt, Human
aaaugggcagagcag

SEQ ID NO: 1606635 - RNA, 14 nt, Human
aaaugcaccuggaa

SEQ ID NO: 1606636 - RNA, 18 nt, Human
aaaugcaccuggaauaua

SEQ ID NO: 1606637 - RNA, 22 nt, Human
aaaugcaccuggaauauauaac

SEQ ID NO: 1606638 - RNA, 13 nt, Human
aaaugcauguugc

SEQ ID NO: 1606639 - RNA, 22 nt, Human
aaaugaaagcagggacuugaac

SEQ ID NO: 1606640 - RNA, 21 nt, Human
aaaugaaagcagggacuugaa

SEQ ID NO: 1606641 - RNA, 11 nt, Human
aaaugagaaau

SEQ ID NO: 1606642 - RNA, 19 nt, Human
aaaugaggucagagccugc

SEQ ID NO: 1606643 - RNA, 17 nt, Human
aaaugaggucagagccu

SEQ ID NO: 1606644 - RNA, 23 nt, Human
aaaugagguacucuccuggaaau

SEQ ID NO: 1606645 - RNA, 16 nt, Human
aaaugagguacucucc

SEQ ID NO: 1606646 - RNA, 19 nt, Human
aaaugagccuggcaagaau

SEQ ID NO: 1606647 - RNA, 13 nt, Human
aaaugagccuggc

SEQ ID NO: 1606648 - RNA, 16 nt, Human
aaaugagaaaucuaaa

SEQ ID NO: 1606649 - RNA, 14 nt, Human
aaaugagaaaucua

SEQ ID NO: 1606650 - RNA, 13 nt, Human
aaaugagaaaucu

SEQ ID NO: 1606651 - RNA, 19 nt, Human
aaaucuacacuccagugag

SEQ ID NO: 1606652 - RNA, 17 nt, Human
aaaugaaaaucgugaca

SEQ ID NO: 1606653 - RNA, 11 nt, Human
aaaugaaaauu

SEQ ID NO: 1606654 - RNA, 15 nt, Human
aaaucucaaauuucu

SEQ ID NO: 1606655 - RNA, 16 nt, Human
aaaucucaaauuucua

SEQ ID NO: 1606656 - RNA, 17 nt, Human
aaaucucaaauuucuaa

SEQ ID NO: 1606657 - RNA, 19 nt, Human
aaaucucaaauuucuaaau

SEQ ID NO: 1606658 - RNA, 14 nt, Human
aaauccuugaagau

SEQ ID NO: 1606659 - RNA, 13 nt, Human
aaaucgaugcagu

SEQ ID NO: 1606660 - RNA, 18 nt, Human
aaaucccuuaccucggug

SEQ ID NO: 1606661 - RNA, 15 nt, Human
aaaucccauuuaaaa

SEQ ID NO: 1606662 - RNA, 22 nt, Human
aaaucccauuauucaaaguugc

SEQ ID NO: 1606663 - RNA, 21 nt, Human
aaaucccauuauucaaaguug

SEQ ID NO: 1606664 - RNA, 20 nt, Human
aaaucccauuauucaaaguu

SEQ ID NO: 1606665 - RNA, 19 nt, Human
aaaucccauuauucaaagu

SEQ ID NO: 1606666 - RNA, 17 nt, Human
aaaucccauuauucaaa

SEQ ID NO: 1606667 - RNA, 16 nt, Human
aaaucccauuauucaa

SEQ ID NO: 1606668 - RNA, 15 nt, Human
aaaucccauuauuca

SEQ ID NO: 1606669 - RNA, 13 nt, Human
aaaucccauuauu

SEQ ID NO: 1606670 - RNA, 23 nt, Human
aaauccauuuggaaaucuuuaaa

SEQ ID NO: 1606671 - RNA, 22 nt, Human
aaauccauuuggaaaucuuuaa

SEQ ID NO: 1606672 - RNA, 21 nt, Human
aaauccauuuggaaaucuuua

SEQ ID NO: 1606673 - RNA, 18 nt, Human
aaauccauuuggaaaucu

SEQ ID NO: 1606674 - RNA, 21 nt, Human
guagcugggacuacaggcacc

SEQ ID NO: 1606675 - RNA, 18 nt, Human
guagcugggauuacaggc

SEQ ID NO: 1606676 - RNA, 19 nt, Human
guagcugggacuacaggca

SEQ ID NO: 1606677 - RNA, 18 nt, Human
guagcugggacuacaggc

SEQ ID NO: 1606678 - RNA, 12 nt, Human
guagcugggacu

SEQ ID NO: 1606679 - RNA, 14 nt, Human
aaaggaugcacaga

SEQ ID NO: 1606680 - RNA, 17 nt, Human
aaaggagagcuagcagc

SEQ ID NO: 1606681 - RNA, 18 nt, Human
guaggaagguuaauguuc

SEQ ID NO: 1606682 - RNA, 15 nt, Human
guaggaagacuuugg

SEQ ID NO: 1606683 - RNA, 14 nt, Human
aaauccauuuggaa

SEQ ID NO: 1606684 - RNA, 16 nt, Human
aaauccauuuggaaau

SEQ ID NO: 1606685 - RNA, 15 nt, Human
aaauccauuuggaaa

SEQ ID NO: 1606686 - RNA, 20 nt, Human
aaccuagggugauauuaacc

SEQ ID NO: 1606687 - RNA, 15 nt, Human
aacccccagccugcu

SEQ ID NO: 1606688 - RNA, 14 nt, Human
aacccccagccugc

SEQ ID NO: 1606689 - RNA, 13 nt, Human
aacccccagccug

SEQ ID NO: 1606690 - RNA, 14 nt, Human
aaccuccugggcua

SEQ ID NO: 1606691 - RNA, 17 nt, Human
aaccuccgccucuuggg

SEQ ID NO: 1606692 - RNA, 18 nt, Human
aacccaaauguucaucaa

SEQ ID NO: 1606693 - RNA, 11 nt, Human
aacccagcucu

SEQ ID NO: 1606694 - RNA, 14 nt, Human
aacccagcucuggu

SEQ ID NO: 1606695 - RNA, 13 nt, Human
aacccagcucugg

SEQ ID NO: 1606696 - RNA, 13 nt, Human
aacccaaauguuc

SEQ ID NO: 1606697 - RNA, 21 nt, Human
aaccaugggauaaaugccauc

SEQ ID NO: 1606698 - RNA, 20 nt, Human
aacccauauuuguacaccaa

SEQ ID NO: 1606699 - RNA, 17 nt, Human
aacccagcucuggucca

SEQ ID NO: 1606700 - RNA, 12 nt, Human
aaccacagcagu

SEQ ID NO: 1606701 - RNA, 20 nt, Human
aaccaucauugaaaucuuuu

SEQ ID NO: 1606702 - RNA, 19 nt, Human
aaccaucauugaaaucuuu

SEQ ID NO: 1606703 - RNA, 22 nt, Human
aaccacaucuugcucugcugac

SEQ ID NO: 1606704 - RNA, 20 nt, Human
aaccacaucuugcucugcug

SEQ ID NO: 1606705 - RNA, 21 nt, Human
aaccaucauugaaaucuuuuu

SEQ ID NO: 1606706 - RNA, 23 nt, Human
aaccaucauugaaaucuuuuugc

SEQ ID NO: 1606707 - RNA, 20 nt, Human
aaccacauuggagauguuua

SEQ ID NO: 1606708 - RNA, 20 nt, Human
aaccaugggauaaaugccau

SEQ ID NO: 1606709 - RNA, 18 nt, Human
aaccaugggauaaaugcc

SEQ ID NO: 1606710 - RNA, 17 nt, Human
aaccaugggauaaaugc

SEQ ID NO: 1606711 - RNA, 15 nt, Human
aaccaugggauaaau

SEQ ID NO: 1606712 - RNA, 16 nt, Human
gucucccucccuuggg

SEQ ID NO: 1606713 - RNA, 21 nt, Human
gucuuaauuaaaagaauauuu

SEQ ID NO: 1606714 - RNA, 19 nt, Human
gucuuaauuaaaagaauau

SEQ ID NO: 1606715 - RNA, 22 nt, Human
gucuuaauuaaaagaauauuuu

SEQ ID NO: 1606716 - RNA, 15 nt, Human
gucuggcuucacaga

SEQ ID NO: 1606717 - RNA, 19 nt, Human
gucuuauauauuguagaua

SEQ ID NO: 1606718 - RNA, 15 nt, Human
gucuuagauguauau

SEQ ID NO: 1606719 - RNA, 15 nt, Human
gucuuuggacccuga

SEQ ID NO: 1606720 - RNA, 14 nt, Human
gucuuuggacccug

SEQ ID NO: 1606721 - RNA, 17 nt, Human
gucuuuggacccugagg

SEQ ID NO: 1606722 - RNA, 18 nt, Human
gucuuuggacccugaggc

SEQ ID NO: 1606723 - RNA, 19 nt, Human
gucuuuucuugcaugaggc

SEQ ID NO: 1606724 - RNA, 14 nt, Human
gucuuuucuugcau

SEQ ID NO: 1606725 - RNA, 24 nt, Human
gucuuuucuugcaugaggcuagug

SEQ ID NO: 1606726 - RNA, 14 nt, Human
aacucccuuucaac

SEQ ID NO: 1606727 - RNA, 13 nt, Human
aacucccuuucaa

SEQ ID NO: 1606728 - RNA, 18 nt, Human
aacucguuaauuuguagu

SEQ ID NO: 1606729 - RNA, 19 nt, Human
gugaaccaccacacccagc

SEQ ID NO: 1606730 - RNA, 15 nt, Human
gugaacacaucagcu

SEQ ID NO: 1606731 - RNA, 21 nt, Human
aacuccagaaagugacaagcu

SEQ ID NO: 1606732 - RNA, 19 nt, Human
aacucccugccccccagcc

SEQ ID NO: 1606733 - RNA, 13 nt, Human
aacucccugcccc

SEQ ID NO: 1606734 - RNA, 14 nt, Human
aacuccagaaagug

SEQ ID NO: 1606735 - RNA, 15 nt, Human
aacguggcugcuuca

SEQ ID NO: 1606736 - RNA, 20 nt, Human
aaccugcucuccucuugcca

SEQ ID NO: 1606737 - RNA, 11 nt, Human
aaccugcucuc

SEQ ID NO: 1606738 - RNA, 15 nt, Human
aaccugcucuccucu

SEQ ID NO: 1606739 - RNA, 19 nt, Human
aacguggcugcuucaagga

SEQ ID NO: 1606740 - RNA, 16 nt, Human
aacguggcugcuucaa

SEQ ID NO: 1606741 - RNA, 22 nt, Human
aacguggcugcuucaaggaucc

SEQ ID NO: 1606742 - RNA, 18 nt, Human
aacaagucagucauucag

SEQ ID NO: 1606743 - RNA, 15 nt, Human
aacaagucagucauu

SEQ ID NO: 1606744 - RNA, 23 nt, Human
aacaaggcaaggcugucaauuac

SEQ ID NO: 1606745 - RNA, 21 nt, Human
aacaagccuccuuuuaaagua

SEQ ID NO: 1606746 - RNA, 15 nt, Human
aacaaggaugaauua

SEQ ID NO: 1606747 - RNA, 15 nt, Human
aacaaggcaaggcug

SEQ ID NO: 1606748 - RNA, 16 nt, Human
aacaagaccacguuuc

SEQ ID NO: 1606749 - RNA, 17 nt, Human
aacaagaccacguuucu

SEQ ID NO: 1606750 - RNA, 19 nt, Human
aacaagaccacguuucuaa

SEQ ID NO: 1606751 - RNA, 20 nt, Human
aacaagaccacguuucuaaa

SEQ ID NO: 1606752 - RNA, 15 nt, Human
gucacaggcaggucc

SEQ ID NO: 1606753 - RNA, 13 nt, Human
gucacaggcaggu

SEQ ID NO: 1606754 - RNA, 16 nt, Human
gucacaggcaggucca

SEQ ID NO: 1606755 - RNA, 21 nt, Human
gucacacaguauuacuucugc

SEQ ID NO: 1606756 - RNA, 23 nt, Human
aaauuuuuaaucuuuaauuuuac

SEQ ID NO: 1606757 - RNA, 24 nt, Human
guccaagcauaccaacacgagcag

SEQ ID NO: 1606758 - RNA, 22 nt, Human
gucauuugagcagggcucagcg

SEQ ID NO: 1606759 - RNA, 21 nt, Human
aacacuguucucugcccucca

SEQ ID NO: 1606760 - RNA, 21 nt, Human
gucauuugagcagggcucagc

SEQ ID NO: 1606761 - RNA, 11 nt, Human
aacacuuccau

SEQ ID NO: 1606762 - RNA, 21 nt, Human
guccaagcauuuagauguaua

SEQ ID NO: 1606763 - RNA, 15 nt, Human
guccacaacacacag

SEQ ID NO: 1606764 - RNA, 11 nt, Human
aacacucugag

SEQ ID NO: 1606765 - RNA, 12 nt, Human
aacacuccuuca

SEQ ID NO: 1606766 - RNA, 21 nt, Human
aacacucauugaccugaggcc

SEQ ID NO: 1606767 - RNA, 13 nt, Human
aacacucugagac

SEQ ID NO: 1606768 - RNA, 12 nt, Human
aacacucugaga

SEQ ID NO: 1606769 - RNA, 14 nt, Human
aacacucugagacu

SEQ ID NO: 1606770 - RNA, 20 nt, Human
aacacuguucucugcccucc

SEQ ID NO: 1606771 - RNA, 15 nt, Human
aacacuguucucugc

SEQ ID NO: 1606772 - RNA, 18 nt, Human
aacauuugguaaggggaa

SEQ ID NO: 1606773 - RNA, 20 nt, Human
aacauuuguucuauagcuuu

SEQ ID NO: 1606774 - RNA, 15 nt, Human
aacauacucccaucu

SEQ ID NO: 1606775 - RNA, 14 nt, Human
aacauacucccauc

SEQ ID NO: 1606776 - RNA, 16 nt, Human
aacauacucccaucug

SEQ ID NO: 1606777 - RNA, 22 nt, Human
aacauuuguucuauagcuuuuc

SEQ ID NO: 1606778 - RNA, 22 nt, Human
aacaguagugauaguuguaccg

SEQ ID NO: 1606779 - RNA, 23 nt, Human
aacaggcugggcuucaguggcag

SEQ ID NO: 1606780 - RNA, 13 nt, Human
aacaggcugggcu

SEQ ID NO: 1606781 - RNA, 22 nt, Human
aacaggcugggcuucaguggca

SEQ ID NO: 1606782 - RNA, 20 nt, Human
aacagacuggaagcacagcu

SEQ ID NO: 1606783 - RNA, 19 nt, Human
aacagacuggaagcacagc

SEQ ID NO: 1606784 - RNA, 19 nt, Human
aacaguuguguuugaagca

SEQ ID NO: 1606785 - RNA, 21 nt, Human
guccggucccugucccagugc

SEQ ID NO: 1606786 - RNA, 15 nt, Human
gucccaacuuguaaa

SEQ ID NO: 1606787 - RNA, 10 nt, Human
aacagaaaug

SEQ ID NO: 1606788 - RNA, 11 nt, Human
aacagaaaugu

SEQ ID NO: 1606789 - RNA, 21 nt, Human
aacagaaauguacagcaagga

SEQ ID NO: 1606790 - RNA, 22 nt, Human
aagcuaggccuggccagaugca

SEQ ID NO: 1606791 - RNA, 18 nt, Human
aagcuaggccuggccaga

SEQ ID NO: 1606792 - RNA, 17 nt, Human
aagcuaggccuggccag

SEQ ID NO: 1606793 - RNA, 19 nt, Human
guucaggguuggccccugc

SEQ ID NO: 1606794 - RNA, 18 nt, Human
guucaggguuggccccug

SEQ ID NO: 1606795 - RNA, 17 nt, Human
guucaggguuggccccu

SEQ ID NO: 1606796 - RNA, 17 nt, Human
guucagcuccagcucac

SEQ ID NO: 1606797 - RNA, 16 nt, Human
guucagcuccagcuca

SEQ ID NO: 1606798 - RNA, 18 nt, Human
guucagcuccagcucacc

SEQ ID NO: 1606799 - RNA, 22 nt, Human
guuaaguugauggugaugaaau

SEQ ID NO: 1606800 - RNA, 18 nt, Human
guuaaugauagcuacugu

SEQ ID NO: 1606801 - RNA, 18 nt, Human
guguuuuaaaaugagaaa

SEQ ID NO: 1606802 - RNA, 16 nt, Human
guuaagccuuuggaaa

SEQ ID NO: 1606803 - RNA, 13 nt, Human
guuaagccuuugg

SEQ ID NO: 1606804 - RNA, 12 nt, Human
guuaagccuuug

SEQ ID NO: 1606805 - RNA, 20 nt, Human
guuaguaugaggcauuuguu

SEQ ID NO: 1606806 - RNA, 17 nt, Human
guuaguaugaggcauuu

SEQ ID NO: 1606807 - RNA, 12 nt, Human
guuagaucuagu

SEQ ID NO: 1606808 - RNA, 16 nt, Human
guucuacccaggugcu

SEQ ID NO: 1606809 - RNA, 22 nt, Human
guucccuuugacgccaucccag

SEQ ID NO: 1606810 - RNA, 21 nt, Human
guucccuuugacgccauccca

SEQ ID NO: 1606811 - RNA, 20 nt, Human
guucccuuugacgccauccc

SEQ ID NO: 1606812 - RNA, 13 nt, Human
guucucuccuucu

SEQ ID NO: 1606813 - RNA, 18 nt, Human
guugacaugggacauuug

SEQ ID NO: 1606814 - RNA, 14 nt, Human
guugacaugggaca

SEQ ID NO: 1606815 - RNA, 22 nt, Human
guugaugaucuuugcagacagg

SEQ ID NO: 1606816 - RNA, 21 nt, Human
guucuugguuuguaaauuaac

SEQ ID NO: 1606817 - RNA, 17 nt, Human
guucuuaguuugcaguu

SEQ ID NO: 1606818 - RNA, 13 nt, Human
guugacaugggac

SEQ ID NO: 1606819 - RNA, 20 nt, Human
guuccauggccucuucagau

SEQ ID NO: 1606820 - RNA, 20 nt, Human
guucccauuugcuccuuucu

SEQ ID NO: 1606821 - RNA, 16 nt, Human
guucccauuugcuccu

SEQ ID NO: 1606822 - RNA, 20 nt, Human
guucccuacuuccugugacu

SEQ ID NO: 1606823 - RNA, 21 nt, Human
aagcucuacugaggugcuaug

SEQ ID NO: 1606824 - RNA, 22 nt, Human
aagcuauucaguaauaacucua

SEQ ID NO: 1606825 - RNA, 17 nt, Human
aagcuaucguaaaauua

SEQ ID NO: 1606826 - RNA, 18 nt, Human
guuguaccgcaaugugac

SEQ ID NO: 1606827 - RNA, 18 nt, Human
guuggucccccuuccaug

SEQ ID NO: 1606828 - RNA, 13 nt, Human
guuggguggaugc

SEQ ID NO: 1606829 - RNA, 17 nt, Human
guugccuaaauccauuu

SEQ ID NO: 1606830 - RNA, 16 nt, Human
guuuaaaaucauuucu

SEQ ID NO: 1606831 - RNA, 10 nt, Human
guuuaaaauc

SEQ ID NO: 1606832 - RNA, 20 nt, Human
guuuaagacauuuuuggaag

SEQ ID NO: 1606833 - RNA, 23 nt, Human
aaggaugaucuaggaagacuuug

SEQ ID NO: 1606834 - RNA, 18 nt, Human
aaggaugaucuaggaaga

SEQ ID NO: 1606835 - RNA, 17 nt, Human
aaggauccugagccaga

SEQ ID NO: 1606836 - RNA, 15 nt, Human
aaggauccugagcca

SEQ ID NO: 1606837 - RNA, 14 nt, Human
aaggauccugagcc

SEQ ID NO: 1606838 - RNA, 23 nt, Human
guugaugaucuuugcagacaggc

SEQ ID NO: 1606839 - RNA, 21 nt, Human
guugaugccugugaacugaac

SEQ ID NO: 1606840 - RNA, 20 nt, Human
aaggauccugagccagauuu

SEQ ID NO: 1606841 - RNA, 22 nt, Human
aaggaugcacagaguuguuaca

SEQ ID NO: 1606842 - RNA, 18 nt, Human
aaggaugcacagaguugu

SEQ ID NO: 1606843 - RNA, 15 nt, Human
aaggaugcuuguaca

SEQ ID NO: 1606844 - RNA, 16 nt, Human
aaggaugcuuguacau

SEQ ID NO: 1606845 - RNA, 17 nt, Human
aaggaugcuuguacaua

SEQ ID NO: 1606846 - RNA, 19 nt, Human
aaggaugcuuguacauaau

SEQ ID NO: 1606847 - RNA, 19 nt, Human
aaggaugccccgucccccu

SEQ ID NO: 1606848 - RNA, 19 nt, Human
aaggcuaccuuuguauucu

SEQ ID NO: 1606849 - RNA, 18 nt, Human
aaggccaaaggaagcaca

SEQ ID NO: 1606850 - RNA, 19 nt, Human
guugcccaggcaggucuug

SEQ ID NO: 1606851 - RNA, 18 nt, Human
guugcccaggcaggucuu

SEQ ID NO: 1606852 - RNA, 17 nt, Human
guugcccaggcaggucu

SEQ ID NO: 1606853 - RNA, 14 nt, Human
aaggcuccaggagc

SEQ ID NO: 1606854 - RNA, 21 nt, Human
guugcccaggcuggcgugcag

SEQ ID NO: 1606855 - RNA, 14 nt, Human
guugccuaaaucca

SEQ ID NO: 1606856 - RNA, 16 nt, Human
guugccuaaauccauu

SEQ ID NO: 1606857 - RNA, 15 nt, Human
guugccuaaauccau

SEQ ID NO: 1606858 - RNA, 13 nt, Human
aagguacuucaaa

SEQ ID NO: 1606859 - RNA, 16 nt, Human
aaggguaucaggugcu

SEQ ID NO: 1606860 - RNA, 17 nt, Human
aaggguaucaggugcug

SEQ ID NO: 1606861 - RNA, 15 nt, Human
aaguaauaugcacac

SEQ ID NO: 1606862 - RNA, 16 nt, Human
aaguaauaugcacaca

SEQ ID NO: 1606863 - RNA, 19 nt, Human
guuucuaaaggcuaccuuu

SEQ ID NO: 1606864 - RNA, 12 nt, Human
aaguaauaugca

SEQ ID NO: 1606865 - RNA, 22 nt, Human
aaguaaaaacaaagaaauuaug

SEQ ID NO: 1606866 - RNA, 20 nt, Human
aaguaaaaacaaagaaauua

SEQ ID NO: 1606867 - RNA, 13 nt, Human
aaguaaaaacaaa

SEQ ID NO: 1606868 - RNA, 21 nt, Human
guuucaaacauauauaacaau

SEQ ID NO: 1606869 - RNA, 23 nt, Human
aaggggaauguuugccucugccu

SEQ ID NO: 1606870 - RNA, 22 nt, Human
aaggggaauguuugccucugcc

SEQ ID NO: 1606871 - RNA, 17 nt, Human
aagggccuggccugagc

SEQ ID NO: 1606872 - RNA, 14 nt, Human
aagggccuggccug

SEQ ID NO: 1606873 - RNA, 19 nt, Human
aagggccuggccugagcug

SEQ ID NO: 1606874 - RNA, 23 nt, Human
guuuucugagaaagacuauucaa

SEQ ID NO: 1606875 - RNA, 11 nt, Human
guuuucuguuc

SEQ ID NO: 1606876 - RNA, 12 nt, Human
guuuucuguucu

SEQ ID NO: 1606877 - RNA, 20 nt, Human
guuuucuuaaccagaucauu

SEQ ID NO: 1606878 - RNA, 15 nt, Human
guuuuacugcagcuu

SEQ ID NO: 1606879 - RNA, 18 nt, Human
guuuggggaugagaaagg

SEQ ID NO: 1606880 - RNA, 20 nt, Human
guuugggccccagaggcugg

SEQ ID NO: 1606881 - RNA, 23 nt, Human
guuuuacaauaaaaucuugaaaa

SEQ ID NO: 1606882 - RNA, 22 nt, Human
guuugauucagacagcugccug

SEQ ID NO: 1606883 - RNA, 22 nt, Human
guuucuaaaggcuaccuuugua

SEQ ID NO: 1606884 - RNA, 23 nt, Human
guuucuaaaggcuaccuuuguau

SEQ ID NO: 1606885 - RNA, 20 nt, Human
guuucuguacuuuuuggcau

SEQ ID NO: 1606886 - RNA, 16 nt, Human
guuugccucugccucu

SEQ ID NO: 1606887 - RNA, 13 nt, Human
guuugccucugcc

SEQ ID NO: 1606888 - RNA, 23 nt, Human
guguuuccuggcacugcuuccag

SEQ ID NO: 1606889 - RNA, 19 nt, Human
guguuguacucaauuuuaa

SEQ ID NO: 1606890 - RNA, 18 nt, Human
guguguaugcgugugugu

SEQ ID NO: 1606891 - RNA, 17 nt, Human
gugugacuacuccccca

SEQ ID NO: 1606892 - RNA, 18 nt, Human
gugucuuuuuucacuaca

SEQ ID NO: 1606893 - RNA, 17 nt, Human
gugugaaaaugugugug

SEQ ID NO: 1606894 - RNA, 18 nt, Human
gugucuugcaauggcagc

SEQ ID NO: 1606895 - RNA, 17 nt, Human
gugucuugcaauggcag

SEQ ID NO: 1606896 - RNA, 18 nt, Human
aagaugugacauguuuua

SEQ ID NO: 1606897 - RNA, 14 nt, Human
aagaugugacaugu

SEQ ID NO: 1606898 - RNA, 22 nt, Human
aagcaaagacuuuccucuuagu

SEQ ID NO: 1606899 - RNA, 13 nt, Human
aagcaaaggagau

SEQ ID NO: 1606900 - RNA, 12 nt, Human
aagcaaaggaga

SEQ ID NO: 1606901 - RNA, 12 nt, Human
aagaugcagccg

SEQ ID NO: 1606902 - RNA, 20 nt, Human
guggugguuuucuguucuuu

SEQ ID NO: 1606903 - RNA, 17 nt, Human
gugguuuucuguucuuu

SEQ ID NO: 1606904 - RNA, 18 nt, Human
aagagguuuuaaaaaaau

SEQ ID NO: 1606905 - RNA, 18 nt, Human
aagagguuuuaaagcuuc

SEQ ID NO: 1606906 - RNA, 14 nt, Human
aagagguuuuaaag

SEQ ID NO: 1606907 - RNA, 13 nt, Human
aagacuauucaaa

SEQ ID NO: 1606908 - RNA, 18 nt, Human
aagacuaucuaaauguug

SEQ ID NO: 1606909 - RNA, 17 nt, Human
aagacugaguacguugu

SEQ ID NO: 1606910 - RNA, 17 nt, Human
aagacuguacaaaguag

SEQ ID NO: 1606911 - RNA, 21 nt, Human
aagacugaguacguugugcau

SEQ ID NO: 1606912 - RNA, 22 nt, Human
aagacugaguacguugugcauu

SEQ ID NO: 1606913 - RNA, 17 nt, Human
aagacuaucuaaauguu

SEQ ID NO: 1606914 - RNA, 16 nt, Human
aagacuaucuaaaugu

SEQ ID NO: 1606915 - RNA, 21 nt, Human
aagacccuuguggucccaccc

SEQ ID NO: 1606916 - RNA, 18 nt, Human
aagacccuugugguccca

SEQ ID NO: 1606917 - RNA, 22 nt, Human
aagacccuuguggucccacccc

SEQ ID NO: 1606918 - RNA, 19 nt, Human
guggcccgacagccuggca

SEQ ID NO: 1606919 - RNA, 18 nt, Human
guggcccgacagccuggc

SEQ ID NO: 1606920 - RNA, 16 nt, Human
aagagcuuaacagugu

SEQ ID NO: 1606921 - RNA, 14 nt, Human
guggguagacacac

SEQ ID NO: 1606922 - RNA, 16 nt, Human
gugguuucagaaaugu

SEQ ID NO: 1606923 - RNA, 14 nt, Human
guggugguuuucug

SEQ ID NO: 1606924 - RNA, 14 nt, Human
guggguacgggagg

SEQ ID NO: 1606925 - RNA, 20 nt, Human
gugggggaucacagccucug

SEQ ID NO: 1606926 - RNA, 21 nt, Human
gugggacagucaccucaugga

SEQ ID NO: 1606927 - RNA, 22 nt, Human
gugggacacccugugauggggc

SEQ ID NO: 1606928 - RNA, 23 nt, Human
guggcgcagcauauucaggaagc

SEQ ID NO: 1606929 - RNA, 13 nt, Human
gugggauccucca

SEQ ID NO: 1606930 - RNA, 14 nt, Human
gugggagugggccc

SEQ ID NO: 1606931 - RNA, 13 nt, Human
gugggagugggcc

SEQ ID NO: 1606932 - RNA, 13 nt, Human
aagaaagaaaauc

SEQ ID NO: 1606933 - RNA, 22 nt, Human
aagaaagacuaucuaaauguug

SEQ ID NO: 1606934 - RNA, 20 nt, Human
aagaaagacuaucuaaaugu

SEQ ID NO: 1606935 - RNA, 13 nt, Human
aagaaauauaccu

SEQ ID NO: 1606936 - RNA, 15 nt, Human
aagaaaaaggaugca

SEQ ID NO: 1606937 - RNA, 17 nt, Human
aagaaaaaggaugcaca

SEQ ID NO: 1606938 - RNA, 18 nt, Human
aagaaaaaggaugcacag

SEQ ID NO: 1606939 - RNA, 22 nt, Human
aagaagugaaaaucuacacucc

SEQ ID NO: 1606940 - RNA, 16 nt, Human
aagaagugaaaaucua

SEQ ID NO: 1606941 - RNA, 18 nt, Human
gugcuaguaauuggaaag

SEQ ID NO: 1606942 - RNA, 21 nt, Human
gugcuaucucccccagcccca

SEQ ID NO: 1606943 - RNA, 22 nt, Human
gugcuaggaacacuccuucaca

SEQ ID NO: 1606944 - RNA, 18 nt, Human
gugcuaggaacacuccuu

SEQ ID NO: 1606945 - RNA, 21 nt, Human
gugaaccaccacacccagccc

SEQ ID NO: 1606946 - RNA, 15 nt, Human
gugccucaagagaag

SEQ ID NO: 1606947 - RNA, 23 nt, Human
gugccuuauggaacacucugaga

SEQ ID NO: 1606948 - RNA, 21 nt, Human
gugccuuauggaacacucuga

SEQ ID NO: 1606949 - RNA, 14 nt, Human
gugccuuauggaac

SEQ ID NO: 1606950 - RNA, 14 nt, Human
gugccucugggacu

SEQ ID NO: 1606951 - RNA, 15 nt, Human
gugccucugccuguc

SEQ ID NO: 1606952 - RNA, 13 nt, Human
gugccucugggac

SEQ ID NO: 1606953 - RNA, 12 nt, Human
gugccucuggga

SEQ ID NO: 1606954 - RNA, 13 nt, Human
gugccucugccug

SEQ ID NO: 1606955 - RNA, 13 nt, Human
aacuuuaccuuuu

SEQ ID NO: 1606956 - RNA, 18 nt, Human
aacuugucuuuggacccu

SEQ ID NO: 1606957 - RNA, 22 nt, Human
aacuugucuuuggacccugagg

SEQ ID NO: 1606958 - RNA, 16 nt, Human
aacuuguauuaugugu

SEQ ID NO: 1606959 - RNA, 15 nt, Human
aacuuguauuaugug

SEQ ID NO: 1606960 - RNA, 12 nt, Human
aacuugggaacu

SEQ ID NO: 1606961 - RNA, 18 nt, Human
aagaaugauuaugaauua

SEQ ID NO: 1606962 - RNA, 16 nt, Human
aagaauugaagcagga

SEQ ID NO: 1606963 - RNA, 22 nt, Human
aagaaugguccgugcuaaggac

SEQ ID NO: 1606964 - RNA, 19 nt, Human
aagaaugguccgugcuaag

SEQ ID NO: 1606965 - RNA, 23 nt, Human
aagacaaaaagcuacuuauugua

SEQ ID NO: 1606966 - RNA, 20 nt, Human
aagacaaaaagcuacuuauu

SEQ ID NO: 1606967 - RNA, 16 nt, Human
aagaaugauuaugaau

SEQ ID NO: 1606968 - RNA, 16 nt, Human
guggcagcucaccucu

SEQ ID NO: 1606969 - RNA, 14 nt, Human
guggcagcucaccu

SEQ ID NO: 1606970 - RNA, 20 nt, Human
guggcagcucaccucucccu

SEQ ID NO: 1606971 - RNA, 19 nt, Human
guggcaccagcagccugga

SEQ ID NO: 1606972 - RNA, 20 nt, Human
guggauuuaacagaaaugua

SEQ ID NO: 1606973 - RNA, 18 nt, Human
guggauuuaacagaaaug

SEQ ID NO: 1606974 - RNA, 19 nt, Human
guggauuuaacagaaaugu

SEQ ID NO: 1606975 - RNA, 21 nt, Human
guggaugccugguggcagcug

SEQ ID NO: 1606976 - RNA, 21 nt, Human
guggauggaaggggcugacag

SEQ ID NO: 1606977 - RNA, 22 nt, Human
guggacacagcucuucuccagg

SEQ ID NO: 1606978 - RNA, 18 nt, Human
guggacacagcucuucuc

SEQ ID NO: 1606979 - RNA, 23 nt, Human
guggacacagcucuucuccaggc

SEQ ID NO: 1606980 - RNA, 20 nt, Human
gugcugggauuacaggugug

SEQ ID NO: 1606981 - RNA, 20 nt, Human
gugcugggauuacaggcgug

SEQ ID NO: 1606982 - RNA, 22 nt, Human
gugcugggauuacaagcgugag

SEQ ID NO: 1606983 - RNA, 21 nt, Human
gugcugggauuacaagcguga

SEQ ID NO: 1606984 - RNA, 22 nt, Human
gugcuaucucccccagccccau

SEQ ID NO: 1606985 - RNA, 12 nt, Human
gugcuauguucu

SEQ ID NO: 1606986 - RNA, 16 nt, Human
gugcucaggagcccug

SEQ ID NO: 1606987 - RNA, 15 nt, Human
gugcucaggagcccu

SEQ ID NO: 1606988 - RNA, 16 nt, Human
aauggacguguuauga

SEQ ID NO: 1606989 - RNA, 24 nt, Human
aaugcccagccccuucugacccau

SEQ ID NO: 1606990 - RNA, 23 nt, Human
aaugcccagccccuucugaccca

SEQ ID NO: 1606991 - RNA, 22 nt, Human
aaugcccagccccuucugaccc

SEQ ID NO: 1606992 - RNA, 20 nt, Human
aaugcccagccccuucugac

SEQ ID NO: 1606993 - RNA, 20 nt, Human
aaugcugugcccuaaagugu

SEQ ID NO: 1606994 - RNA, 21 nt, Human
aaugcugugcccuaaagugua

SEQ ID NO: 1606995 - RNA, 13 nt, Human
aaugcugugcccu

SEQ ID NO: 1606996 - RNA, 21 nt, Human
aaugccccugaauuuaaauag

SEQ ID NO: 1606997 - RNA, 15 nt, Human
aaugcccagccccuu

SEQ ID NO: 1606998 - RNA, 14 nt, Human
aaugcccagccccu

SEQ ID NO: 1606999 - RNA, 16 nt, Human
aaugcauaaaauguua

SEQ ID NO: 1607000 - RNA, 14 nt, Human
uacaaggacagccc

SEQ ID NO: 1607001 - RNA, 13 nt, Human
aaugcauaaaaug

SEQ ID NO: 1607002 - RNA, 13 nt, Human
uaauuccacagcu

SEQ ID NO: 1607003 - RNA, 17 nt, Human
uaauuccacagcugcuc

SEQ ID NO: 1607004 - RNA, 14 nt, Human
uaauuccacagcug

SEQ ID NO: 1607005 - RNA, 16 nt, Human
uacaaaaacacagcaa

SEQ ID NO: 1607006 - RNA, 15 nt, Human
uacaaaaacacagca

SEQ ID NO: 1607007 - RNA, 20 nt, Human
uacaaaaagcauaaaaauua

SEQ ID NO: 1607008 - RNA, 15 nt, Human
uacaaaagcauguga

SEQ ID NO: 1607009 - RNA, 14 nt, Human
uacaaaaacacagc

SEQ ID NO: 1607010 - RNA, 13 nt, Human
uacaaaaacacag

SEQ ID NO: 1607011 - RNA, 12 nt, Human
aauguacugcau

SEQ ID NO: 1607012 - RNA, 22 nt, Human
uacauauaagugauugcugguu

SEQ ID NO: 1607013 - RNA, 19 nt, Human
uacauauaagugauugcug

SEQ ID NO: 1607014 - RNA, 15 nt, Human
uacaguaucucaggg

SEQ ID NO: 1607015 - RNA, 17 nt, Human
uacauaaugcgugcaua

SEQ ID NO: 1607016 - RNA, 23 nt, Human
uacaguauaauuaacauguuaaa

SEQ ID NO: 1607017 - RNA, 19 nt, Human
uacaguauaauuaacaugu

SEQ ID NO: 1607018 - RNA, 18 nt, Human
uacaguauaauuaacaug

SEQ ID NO: 1607019 - RNA, 19 nt, Human
uacauaaugcgugcauacc

SEQ ID NO: 1607020 - RNA, 20 nt, Human
uacauaaugcgugcauacca

SEQ ID NO: 1607021 - RNA, 21 nt, Human
uacauaaugcgugcauaccac

SEQ ID NO: 1607022 - RNA, 11 nt, Human
aaugugauaug

SEQ ID NO: 1607023 - RNA, 14 nt, Human
aauguggcuccugg

SEQ ID NO: 1607024 - RNA, 14 nt, Human
aauguauguguaag

SEQ ID NO: 1607025 - RNA, 12 nt, Human
aauguaugugua

SEQ ID NO: 1607026 - RNA, 18 nt, Human
aauguacugcauaugaaa

SEQ ID NO: 1607027 - RNA, 14 nt, Human
aauguacugcauau

SEQ ID NO: 1607028 - RNA, 19 nt, Human
aauggacuuuuguacauag

SEQ ID NO: 1607029 - RNA, 21 nt, Human
aauggacguguuaugacucca

SEQ ID NO: 1607030 - RNA, 20 nt, Human
aauggacuguggugacuuug

SEQ ID NO: 1607031 - RNA, 19 nt, Human
uacaccacuacauucuguu

SEQ ID NO: 1607032 - RNA, 20 nt, Human
uacaccacuacauucuguua

SEQ ID NO: 1607033 - RNA, 15 nt, Human
uacaccacuacauuc

SEQ ID NO: 1607034 - RNA, 16 nt, Human
uacaccacuacauucu

SEQ ID NO: 1607035 - RNA, 17 nt, Human
uacaccacuacauucug

SEQ ID NO: 1607036 - RNA, 18 nt, Human
uacaccacuacauucugu

SEQ ID NO: 1607037 - RNA, 14 nt, Human
uacacuccagugag

SEQ ID NO: 1607038 - RNA, 19 nt, Human
uacacuaagagagaaugag

SEQ ID NO: 1607039 - RNA, 14 nt, Human
uacaccauuaugug

SEQ ID NO: 1607040 - RNA, 18 nt, Human
uacagaggccaugggccu

SEQ ID NO: 1607041 - RNA, 22 nt, Human
uacaggcgugagccaccgugcc

SEQ ID NO: 1607042 - RNA, 15 nt, Human
uacaggcuccugcca

SEQ ID NO: 1607043 - RNA, 14 nt, Human
uacaggcuccugcc

SEQ ID NO: 1607044 - RNA, 17 nt, Human
uacaggcuccugccacc

SEQ ID NO: 1607045 - RNA, 14 nt, Human
uacaguauaauuaa

SEQ ID NO: 1607046 - RNA, 17 nt, Human
uacaguauaauuaacau

SEQ ID NO: 1607047 - RNA, 16 nt, Human
uacaguauaauuaaca

SEQ ID NO: 1607048 - RNA, 16 nt, Human
uaaugauaacuggaaa

SEQ ID NO: 1607049 - RNA, 13 nt, Human
uaaugaggaaacu

SEQ ID NO: 1607050 - RNA, 20 nt, Human
aaucuuuaaaaaaaaaauug

SEQ ID NO: 1607051 - RNA, 19 nt, Human
aaucuuuaaaaaaaaaauu

SEQ ID NO: 1607052 - RNA, 21 nt, Human
aaugagagacacacugaagaa

SEQ ID NO: 1607053 - RNA, 15 nt, Human
aaugagccuggcaag

SEQ ID NO: 1607054 - RNA, 18 nt, Human
aaugacuuacuguacaug

SEQ ID NO: 1607055 - RNA, 14 nt, Human
aaugacuuacugua

SEQ ID NO: 1607056 - RNA, 17 nt, Human
aaugacuuacuguacau

SEQ ID NO: 1607057 - RNA, 15 nt, Human
aaugaaaaccacauu

SEQ ID NO: 1607058 - RNA, 14 nt, Human
uaauagguuuggac

SEQ ID NO: 1607059 - RNA, 19 nt, Human
uaauagguuuggacaaaau

SEQ ID NO: 1607060 - RNA, 20 nt, Human
aaucuucugaacuuggcgcu

SEQ ID NO: 1607061 - RNA, 13 nt, Human
aaucuucugaacu

SEQ ID NO: 1607062 - RNA, 23 nt, Human
uaaugaaagacuguacaaaguag

SEQ ID NO: 1607063 - RNA, 22 nt, Human
uaaugaaagacuguacaaagua

SEQ ID NO: 1607064 - RNA, 21 nt, Human
uaaugacuuaagcacacuuga

SEQ ID NO: 1607065 - RNA, 15 nt, Human
uaaugacuuaagcac

SEQ ID NO: 1607066 - RNA, 19 nt, Human
uaaugaaagacuguacaaa

SEQ ID NO: 1607067 - RNA, 18 nt, Human
uaaugaaagacuguacaa

SEQ ID NO: 1607068 - RNA, 17 nt, Human
uaaugaaagacuguaca

SEQ ID NO: 1607069 - RNA, 14 nt, Human
uaaugaaagacugu

SEQ ID NO: 1607070 - RNA, 12 nt, Human
aaucagcauucu

SEQ ID NO: 1607071 - RNA, 17 nt, Human
aaucagacuaugaaguu

SEQ ID NO: 1607072 - RNA, 14 nt, Human
aaucagacuaugaa

SEQ ID NO: 1607073 - RNA, 18 nt, Human
uaaguuuuuuuuuaaaaa

SEQ ID NO: 1607074 - RNA, 20 nt, Human
uaaguuuuuauggcuuuugu

SEQ ID NO: 1607075 - RNA, 23 nt, Human
aaucaugaauuaguuuuauaugc

SEQ ID NO: 1607076 - RNA, 17 nt, Human
aaucaugaauuaguuuu

SEQ ID NO: 1607077 - RNA, 19 nt, Human
aaucaugaauuaguuuuau

SEQ ID NO: 1607078 - RNA, 17 nt, Human
aaucauggugcucagag

SEQ ID NO: 1607079 - RNA, 15 nt, Human
aaucaucaagucuuu

SEQ ID NO: 1607080 - RNA, 14 nt, Human
aaucuuauaauuua

SEQ ID NO: 1607081 - RNA, 16 nt, Human
aaucuuauaauuuaaa

SEQ ID NO: 1607082 - RNA, 19 nt, Human
aaucugugaacuugaaauu

SEQ ID NO: 1607083 - RNA, 18 nt, Human
aaucugugaacuugaaau

SEQ ID NO: 1607084 - RNA, 17 nt, Human
aaucugugaacuugaaa

SEQ ID NO: 1607085 - RNA, 15 nt, Human
aaucugugaacuuga

SEQ ID NO: 1607086 - RNA, 13 nt, Human
aaucugugaacuu

SEQ ID NO: 1607087 - RNA, 15 nt, Human
aaucucaaauuucua

SEQ ID NO: 1607088 - RNA, 14 nt, Human
aaucucaaauuucu

SEQ ID NO: 1607089 - RNA, 15 nt, Human
aaucucaaauaacua

SEQ ID NO: 1607090 - RNA, 12 nt, Human
aaucucaaauuu

SEQ ID NO: 1607091 - RNA, 13 nt, Human
aauccuugaagau

SEQ ID NO: 1607092 - RNA, 18 nt, Human
aaucuaaauggaaccacu

SEQ ID NO: 1607093 - RNA, 13 nt, Human
aaucuaaauggaa

SEQ ID NO: 1607094 - RNA, 15 nt, Human
aaucuaaauggaacc

SEQ ID NO: 1607095 - RNA, 20 nt, Human
aauccucaguuuuugugaaa

SEQ ID NO: 1607096 - RNA, 18 nt, Human
aauagacaauuuauuaug

SEQ ID NO: 1607097 - RNA, 23 nt, Human
aauagacaauuuauuauggcaca

SEQ ID NO: 1607098 - RNA, 18 nt, Human
aauagacccacaagaggc

SEQ ID NO: 1607099 - RNA, 14 nt, Human
aauagcugggacua

SEQ ID NO: 1607100 - RNA, 13 nt, Human
aauagcugggacu

SEQ ID NO: 1607101 - RNA, 20 nt, Human
aauagccugccucuucucua

SEQ ID NO: 1607102 - RNA, 16 nt, Human
aauagaugcugacugu

SEQ ID NO: 1607103 - RNA, 18 nt, Human
aauaggcguaacuaauuu

SEQ ID NO: 1607104 - RNA, 16 nt, Human
aauaggaaaaacugau

SEQ ID NO: 1607105 - RNA, 15 nt, Human
aauaggaaaaacuga

SEQ ID NO: 1607106 - RNA, 18 nt, Human
aauaggaaaaacugauuu

SEQ ID NO: 1607107 - RNA, 17 nt, Human
aauaggaaaaacugauu

SEQ ID NO: 1607108 - RNA, 19 nt, Human
aauaggaaaaacugauuuu

SEQ ID NO: 1607109 - RNA, 24 nt, Human
aauagcuuuuuucucugauacaga

SEQ ID NO: 1607110 - RNA, 12 nt, Human
aauaucacuugu

SEQ ID NO: 1607111 - RNA, 15 nt, Human
aauaucacuugucaa

SEQ ID NO: 1607112 - RNA, 14 nt, Human
uaacauggaaguac

SEQ ID NO: 1607113 - RNA, 14 nt, Human
uaacaugauuuggg

SEQ ID NO: 1607114 - RNA, 15 nt, Human
uaacauaaaucugug

SEQ ID NO: 1607115 - RNA, 20 nt, Human
uaacauaaaucugugaacuu

SEQ ID NO: 1607116 - RNA, 18 nt, Human
uaacauaaaucugugaac

SEQ ID NO: 1607117 - RNA, 17 nt, Human
uaacauaaaucugugaa

SEQ ID NO: 1607118 - RNA, 16 nt, Human
uaacauaaaucuguga

SEQ ID NO: 1607119 - RNA, 15 nt, Human
uaacuaaaagguaug

SEQ ID NO: 1607120 - RNA, 16 nt, Human
uaacauggaaguacua

SEQ ID NO: 1607121 - RNA, 15 nt, Human
uaacauggaaguacu

SEQ ID NO: 1607122 - RNA, 16 nt, Human
uaaccucuaaauucuu

SEQ ID NO: 1607123 - RNA, 15 nt, Human
aauauuucagauaau

SEQ ID NO: 1607124 - RNA, 18 nt, Human
aauauuuuaugauccagc

SEQ ID NO: 1607125 - RNA, 17 nt, Human
aauauuuuaugauccag

SEQ ID NO: 1607126 - RNA, 24 nt, Human
aauaugcaaagcacugacuucuaa

SEQ ID NO: 1607127 - RNA, 15 nt, Human
aauaugcacacauuu

SEQ ID NO: 1607128 - RNA, 18 nt, Human
aauauugauaugcuuaua

SEQ ID NO: 1607129 - RNA, 17 nt, Human
aauaugcaaagcacuga

SEQ ID NO: 1607130 - RNA, 15 nt, Human
aauaugcaaagcacu

SEQ ID NO: 1607131 - RNA, 22 nt, Human
aauauugcugauggugcaauga

SEQ ID NO: 1607132 - RNA, 21 nt, Human
aauauugcugauggugcaaug

SEQ ID NO: 1607133 - RNA, 18 nt, Human
aauauugcugauggugca

SEQ ID NO: 1607134 - RNA, 15 nt, Human
aauauugcugauggu

SEQ ID NO: 1607135 - RNA, 13 nt, Human
aauauugcugaug

SEQ ID NO: 1607136 - RNA, 12 nt, Human
aauauugcugau

SEQ ID NO: 1607137 - RNA, 11 nt, Human
aauauugcuga

SEQ ID NO: 1607138 - RNA, 19 nt, Human
aauaucuuuuuuuuaauaa

SEQ ID NO: 1607139 - RNA, 20 nt, Human
aauaucugaaaauguaugug

SEQ ID NO: 1607140 - RNA, 19 nt, Human
aauaucugaaaauguaugu

SEQ ID NO: 1607141 - RNA, 18 nt, Human
aauaucugaaaauguaug

SEQ ID NO: 1607142 - RNA, 17 nt, Human
aauaucugaaaauguau

SEQ ID NO: 1607143 - RNA, 16 nt, Human
aauaucugaaaaugua

SEQ ID NO: 1607144 - RNA, 21 nt, Human
aauaucuccgucaacucauau

SEQ ID NO: 1607145 - RNA, 16 nt, Human
aauaucuccgucaacu

SEQ ID NO: 1607146 - RNA, 15 nt, Human
uaacuuuuauaaacu

SEQ ID NO: 1607147 - RNA, 17 nt, Human
uaacuuuuauaaacuuu

SEQ ID NO: 1607148 - RNA, 18 nt, Human
uaacuuuuauaaacuuua

SEQ ID NO: 1607149 - RNA, 19 nt, Human
uaacuuuuauaaacuuuac

SEQ ID NO: 1607150 - RNA, 17 nt, Human
uaagacauuuuuggaag

SEQ ID NO: 1607151 - RNA, 19 nt, Human
aauaauuuuuauauuugaa

SEQ ID NO: 1607152 - RNA, 17 nt, Human
aauaauuuuuauauuug

SEQ ID NO: 1607153 - RNA, 16 nt, Human
aauaauuuuuauauuu

SEQ ID NO: 1607154 - RNA, 20 nt, Human
aauaauuuuuauauuugaaa

SEQ ID NO: 1607155 - RNA, 21 nt, Human
uaaauaaaguuuguugaaaca

SEQ ID NO: 1607156 - RNA, 12 nt, Human
uaaauaaaguuu

SEQ ID NO: 1607157 - RNA, 14 nt, Human
uaaauaaauagcua

SEQ ID NO: 1607158 - RNA, 17 nt, Human
uaaauaaauaaauagcu

SEQ ID NO: 1607159 - RNA, 19 nt, Human
uaaauaaugugaaacugga

SEQ ID NO: 1607160 - RNA, 18 nt, Human
uaaauuaacuuuuauaaa

SEQ ID NO: 1607161 - RNA, 17 nt, Human
uaaauuaacuuuuauaa

SEQ ID NO: 1607162 - RNA, 15 nt, Human
uaaauuaacuuuuau

SEQ ID NO: 1607163 - RNA, 16 nt, Human
uaaauuaacuuuuaua

SEQ ID NO: 1607164 - RNA, 12 nt, Human
uaaauuaacuuu

SEQ ID NO: 1607165 - RNA, 14 nt, Human
uaaauuaacuuuua

SEQ ID NO: 1607166 - RNA, 24 nt, Human
uaaauguuuuuuuuuaaagacuuu

SEQ ID NO: 1607167 - RNA, 15 nt, Human
uaaauguugacaugg

SEQ ID NO: 1607168 - RNA, 20 nt, Human
uaaauguugaaagaucaaaa

SEQ ID NO: 1607169 - RNA, 15 nt, Human
uaaauguugaaagau

SEQ ID NO: 1607170 - RNA, 23 nt, Human
uaaaugcaccuggaauauauaac

SEQ ID NO: 1607171 - RNA, 14 nt, Human
uaaaucuccaaaau

SEQ ID NO: 1607172 - RNA, 19 nt, Human
uaaauagcuagacugguga

SEQ ID NO: 1607173 - RNA, 15 nt, Human
uaaaucuccaaaaua

SEQ ID NO: 1607174 - RNA, 18 nt, Human
uaaaucuccaaaauaaaa

SEQ ID NO: 1607175 - RNA, 18 nt, Human
uaaauagcuagacuggug

SEQ ID NO: 1607176 - RNA, 22 nt, Human
uaaaucugugaacuugaaauuu

SEQ ID NO: 1607177 - RNA, 21 nt, Human
uaaaucugugaacuugaaauu

SEQ ID NO: 1607178 - RNA, 19 nt, Human
uaaaucugugaacuugaaa

SEQ ID NO: 1607179 - RNA, 18 nt, Human
uaaaucugugaacuugaa

SEQ ID NO: 1607180 - RNA, 17 nt, Human
uaaaucugugaacuuga

SEQ ID NO: 1607181 - RNA, 16 nt, Human
uaaaucugugaacuug

SEQ ID NO: 1607182 - RNA, 15 nt, Human
uaaaucugugaacuu

SEQ ID NO: 1607183 - RNA, 15 nt, Human
aauaacgauaaaaga

SEQ ID NO: 1607184 - RNA, 21 nt, Human
aauaacaaugaaaguugauaa

SEQ ID NO: 1607185 - RNA, 20 nt, Human
aauaaauugcuccuugacau

SEQ ID NO: 1607186 - RNA, 16 nt, Human
aauaaauugcuccuug

SEQ ID NO: 1607187 - RNA, 18 nt, Human
aauaaaacuuuuuaaaau

SEQ ID NO: 1607188 - RNA, 12 nt, Human
aauaaaacuuuu

SEQ ID NO: 1607189 - RNA, 14 nt, Human
aauaaaacuuuuua

SEQ ID NO: 1607190 - RNA, 15 nt, Human
aauaaaacuuuuuaa

SEQ ID NO: 1607191 - RNA, 16 nt, Human
aauaaaucauaaaacu

SEQ ID NO: 1607192 - RNA, 20 nt, Human
aaguuuuuauggcuuuugug

SEQ ID NO: 1607193 - RNA, 22 nt, Human
uaaaguaaaaacaaagaaauua

SEQ ID NO: 1607194 - RNA, 21 nt, Human
uaaaguaaaaacaaagaaauu

SEQ ID NO: 1607195 - RNA, 19 nt, Human
uaaaguaaaaacaaagaaa

SEQ ID NO: 1607196 - RNA, 22 nt, Human
uaaagguucaugcaaacuuuau

SEQ ID NO: 1607197 - RNA, 22 nt, Human
aauuuauaaacuuuuuucuuac

SEQ ID NO: 1607198 - RNA, 19 nt, Human
aauuucucccagucauuua

SEQ ID NO: 1607199 - RNA, 23 nt, Human
aauuucuaggacugaauuaugaa

SEQ ID NO: 1607200 - RNA, 13 nt, Human
aauuuauuauggc

SEQ ID NO: 1607201 - RNA, 14 nt, Human
aauuuauuauggca

SEQ ID NO: 1607202 - RNA, 17 nt, Human
aauuuauuauggcacau

SEQ ID NO: 1607203 - RNA, 17 nt, Human
aauuucuaggacugaau

SEQ ID NO: 1607204 - RNA, 22 nt, Human
aauuucuaggacugaauuauga

SEQ ID NO: 1607205 - RNA, 18 nt, Human
aauuucuaggacugaauu

SEQ ID NO: 1607206 - RNA, 18 nt, Human
aauuuacagagacagaaa

SEQ ID NO: 1607207 - RNA, 17 nt, Human
aauuuacagagacagaa

SEQ ID NO: 1607208 - RNA, 17 nt, Human
aauuuaccugaagucuu

SEQ ID NO: 1607209 - RNA, 15 nt, Human
aauuuacauacucug

SEQ ID NO: 1607210 - RNA, 13 nt, Human
aauuuaguauuuu

SEQ ID NO: 1607211 - RNA, 15 nt, Human
aauuggagcucgugg

SEQ ID NO: 1607212 - RNA, 19 nt, Human
uacuucuuaggguuaugau

SEQ ID NO: 1607213 - RNA, 15 nt, Human
uacuucugcuacaua

SEQ ID NO: 1607214 - RNA, 20 nt, Human
uacuucuccacccugcucuc

SEQ ID NO: 1607215 - RNA, 15 nt, Human
uacuucuuauacauu

SEQ ID NO: 1607216 - RNA, 14 nt, Human
uacuucuuauacau

SEQ ID NO: 1607217 - RNA, 16 nt, Human
uacuucuuauacauuu

SEQ ID NO: 1607218 - RNA, 15 nt, Human
uacuugaaaauuaac

SEQ ID NO: 1607219 - RNA, 23 nt, Human
uacuuugauauuuucaacgcagc

SEQ ID NO: 1607220 - RNA, 18 nt, Human
uacuucuccacccugcuc

SEQ ID NO: 1607221 - RNA, 13 nt, Human
uacuucuccaccc

SEQ ID NO: 1607222 - RNA, 23 nt, Human
uacuuccugugacuucagcucug

SEQ ID NO: 1607223 - RNA, 20 nt, Human
uacuuccccuuccuaauucc

SEQ ID NO: 1607224 - RNA, 18 nt, Human
uacuuccccuuccuaauu

SEQ ID NO: 1607225 - RNA, 15 nt, Human
uacuuccccuuccua

SEQ ID NO: 1607226 - RNA, 14 nt, Human
uacuuccccuuccu

SEQ ID NO: 1607227 - RNA, 15 nt, Human
aauuugaaacacuuu

SEQ ID NO: 1607228 - RNA, 13 nt, Human
aauugacccacaa

SEQ ID NO: 1607229 - RNA, 24 nt, Human
uacgcuccaucgcugucaucucag

SEQ ID NO: 1607230 - RNA, 15 nt, Human
uacgucugacaggca

SEQ ID NO: 1607231 - RNA, 14 nt, Human
uacuaaaaauacaa

SEQ ID NO: 1607232 - RNA, 13 nt, Human
uacgugaguccug

SEQ ID NO: 1607233 - RNA, 16 nt, Human
uacgucugacaggcaa

SEQ ID NO: 1607234 - RNA, 18 nt, Human
uacgggaggguaaggcug

SEQ ID NO: 1607235 - RNA, 18 nt, Human
uacuaaaaauacaaaaaa

SEQ ID NO: 1607236 - RNA, 15 nt, Human
uacuaaaauggacug

SEQ ID NO: 1607237 - RNA, 22 nt, Human
uacucuacccucuuagaaaaac

SEQ ID NO: 1607238 - RNA, 18 nt, Human
uacuagggaaaugccuuu

SEQ ID NO: 1607239 - RNA, 18 nt, Human
aauugaggacacugauau

SEQ ID NO: 1607240 - RNA, 18 nt, Human
uacuguacaugaaaacac

SEQ ID NO: 1607241 - RNA, 23 nt, Human
uacuguacagacagaaaaaacug

SEQ ID NO: 1607242 - RNA, 19 nt, Human
uacuguacagacagaaaaa

SEQ ID NO: 1607243 - RNA, 12 nt, Human
aauugcauuucc

SEQ ID NO: 1607244 - RNA, 19 nt, Human
uacugagagugaacaaauu

SEQ ID NO: 1607245 - RNA, 16 nt, Human
uacuguaauuugugau

SEQ ID NO: 1607246 - RNA, 17 nt, Human
uacuguaauuugugaua

SEQ ID NO: 1607247 - RNA, 15 nt, Human
uacuguaauuuguga

SEQ ID NO: 1607248 - RNA, 17 nt, Human
uacugagagugaacaaa

SEQ ID NO: 1607249 - RNA, 22 nt, Human
uacugaaauaaacgucuuaaau

SEQ ID NO: 1607250 - RNA, 19 nt, Human
uacugaaauaaacgucuua

SEQ ID NO: 1607251 - RNA, 16 nt, Human
uagcuacuaauuuuaa

SEQ ID NO: 1607252 - RNA, 16 nt, Human
uagcucaggugucccu

SEQ ID NO: 1607253 - RNA, 18 nt, Human
uagcuagacuggugacug

SEQ ID NO: 1607254 - RNA, 15 nt, Human
uagcuagacugguga

SEQ ID NO: 1607255 - RNA, 19 nt, Human
acaagcuccaagcucccag

SEQ ID NO: 1607256 - RNA, 17 nt, Human
acaagcuccaagcuccc

SEQ ID NO: 1607257 - RNA, 16 nt, Human
acaagcuccaagcucc

SEQ ID NO: 1607258 - RNA, 15 nt, Human
acaagcuccaagcuc

SEQ ID NO: 1607259 - RNA, 22 nt, Human
acaagcuccaagcucccaggca

SEQ ID NO: 1607260 - RNA, 18 nt, Human
acaagcgugagccacugc

SEQ ID NO: 1607261 - RNA, 20 nt, Human
acaaucucggcucacugcau

SEQ ID NO: 1607262 - RNA, 18 nt, Human
acaaucucggcucacugc

SEQ ID NO: 1607263 - RNA, 22 nt, Human
acaagagcccaggccuccuaca

SEQ ID NO: 1607264 - RNA, 19 nt, Human
acaagagcuuaacagugug

SEQ ID NO: 1607265 - RNA, 18 nt, Human
acaagagcuuaacagugu

SEQ ID NO: 1607266 - RNA, 16 nt, Human
acaagaccacguuucu

SEQ ID NO: 1607267 - RNA, 14 nt, Human
acaagacacaguga

SEQ ID NO: 1607268 - RNA, 17 nt, Human
acaagaccacguuucua

SEQ ID NO: 1607269 - RNA, 18 nt, Human
acaagaccacguuucuaa

SEQ ID NO: 1607270 - RNA, 22 nt, Human
acaagcucacagaccuuugaac

SEQ ID NO: 1607271 - RNA, 13 nt, Human
acaagcuccaagc

SEQ ID NO: 1607272 - RNA, 17 nt, Human
acaagcgugagccacug

SEQ ID NO: 1607273 - RNA, 17 nt, Human
acaaauuuacagagaca

SEQ ID NO: 1607274 - RNA, 17 nt, Human
acaacaucuuuuucuac

SEQ ID NO: 1607275 - RNA, 13 nt, Human
acaagacacagug

SEQ ID NO: 1607276 - RNA, 15 nt, Human
acaacagcuggugcc

SEQ ID NO: 1607277 - RNA, 21 nt, Human
acaaauucugucucuggauua

SEQ ID NO: 1607278 - RNA, 20 nt, Human
uagaugcaguucugaagaag

SEQ ID NO: 1607279 - RNA, 21 nt, Human
uagaugcaguucugaagaaga

SEQ ID NO: 1607280 - RNA, 14 nt, Human
uagaucuaguucac

SEQ ID NO: 1607281 - RNA, 17 nt, Human
uagauaggccaugggca

SEQ ID NO: 1607282 - RNA, 22 nt, Human
uagauaggucagugcaaauacu

SEQ ID NO: 1607283 - RNA, 21 nt, Human
acaaagcgugguggacaugca

SEQ ID NO: 1607284 - RNA, 18 nt, Human
acaaagcccuuccauguc

SEQ ID NO: 1607285 - RNA, 14 nt, Human
acaaaacuuuucua

SEQ ID NO: 1607286 - RNA, 20 nt, Human
acaaaguauuaagcauauau

SEQ ID NO: 1607287 - RNA, 22 nt, Human
aauuuuuucucuaggaaauauu

SEQ ID NO: 1607288 - RNA, 22 nt, Human
aauuuuuuuaucgucacugcuu

SEQ ID NO: 1607289 - RNA, 21 nt, Human
aauuuuucuuauuucauuucu

SEQ ID NO: 1607290 - RNA, 22 nt, Human
aauuuuuaaucuuuaauuuuac

SEQ ID NO: 1607291 - RNA, 16 nt, Human
aauuuuguuucuguac

SEQ ID NO: 1607292 - RNA, 16 nt, Human
aauuuguuauaaugaa

SEQ ID NO: 1607293 - RNA, 21 nt, Human
aauuugguuuucacauuggaa

SEQ ID NO: 1607294 - RNA, 15 nt, Human
aauuugguuuucaca

SEQ ID NO: 1607295 - RNA, 13 nt, Human
aauuugguuuuca

SEQ ID NO: 1607296 - RNA, 22 nt, Human
uacuuugugcugggguuaucug

SEQ ID NO: 1607297 - RNA, 16 nt, Human
uacuuugugcuggggu

SEQ ID NO: 1607298 - RNA, 14 nt, Human
uacuuuuuggcaua

SEQ ID NO: 1607299 - RNA, 20 nt, Human
uacuuuuuggcauaacauaa

SEQ ID NO: 1607300 - RNA, 19 nt, Human
uacuuuuuggcauaacaua

SEQ ID NO: 1607301 - RNA, 14 nt, Human
acacuccagugaga

SEQ ID NO: 1607302 - RNA, 13 nt, Human
acacucugagacu

SEQ ID NO: 1607303 - RNA, 11 nt, Human
acacucugaga

SEQ ID NO: 1607304 - RNA, 14 nt, Human
acacugaagaagca

SEQ ID NO: 1607305 - RNA, 12 nt, Human
acacugaagaag

SEQ ID NO: 1607306 - RNA, 15 nt, Human
acacuguucucugcc

SEQ ID NO: 1607307 - RNA, 14 nt, Human
acacuguucucugc

SEQ ID NO: 1607308 - RNA, 20 nt, Human
acacuguucucugcccucca

SEQ ID NO: 1607309 - RNA, 18 nt, Human
acacuguucucugcccuc

SEQ ID NO: 1607310 - RNA, 17 nt, Human
acacuguucucugcccu

SEQ ID NO: 1607311 - RNA, 16 nt, Human
acacuguucucugccc

SEQ ID NO: 1607312 - RNA, 23 nt, Human
acacuguucucugcccuccaaga

SEQ ID NO: 1607313 - RNA, 22 nt, Human
acacuguucucugcccuccaag

SEQ ID NO: 1607314 - RNA, 12 nt, Human
uauauuuacaaa

SEQ ID NO: 1607315 - RNA, 19 nt, Human
acagaaagcagaacaguga

SEQ ID NO: 1607316 - RNA, 17 nt, Human
acagacacaggcccggc

SEQ ID NO: 1607317 - RNA, 22 nt, Human
acagacacaggcccggcuccag

SEQ ID NO: 1607318 - RNA, 18 nt, Human
acagacacaggcccggcu

SEQ ID NO: 1607319 - RNA, 22 nt, Human
acagacuggaagcacagcuuca

SEQ ID NO: 1607320 - RNA, 21 nt, Human
acagacuggaagcacagcuuc

SEQ ID NO: 1607321 - RNA, 19 nt, Human
acagacuggaagcacagcu

SEQ ID NO: 1607322 - RNA, 15 nt, Human
acacuuaaaaauggu

SEQ ID NO: 1607323 - RNA, 13 nt, Human
acacuuaaaaaug

SEQ ID NO: 1607324 - RNA, 16 nt, Human
acacuguuucaaacuu

SEQ ID NO: 1607325 - RNA, 15 nt, Human
acacuguuucaaacu

SEQ ID NO: 1607326 - RNA, 23 nt, Human
acacuuguugauuaauggaaaug

SEQ ID NO: 1607327 - RNA, 20 nt, Human
acacuuguugauuaauggaa

SEQ ID NO: 1607328 - RNA, 23 nt, Human
uaugaaagauggcugugccucug

SEQ ID NO: 1607329 - RNA, 22 nt, Human
uaugaaagauggcugugccucu

SEQ ID NO: 1607330 - RNA, 20 nt, Human
uaugaaagauggcugugccu

SEQ ID NO: 1607331 - RNA, 21 nt, Human
acagcccuucuuuccacagaa

SEQ ID NO: 1607332 - RNA, 20 nt, Human
acagcccuucuuuccacaga

SEQ ID NO: 1607333 - RNA, 23 nt, Human
acagcccgggcucugccucccau

SEQ ID NO: 1607334 - RNA, 22 nt, Human
acagcccgggcucugccuccca

SEQ ID NO: 1607335 - RNA, 21 nt, Human
acagcccgggcucugccuccc

SEQ ID NO: 1607336 - RNA, 16 nt, Human
acagcaaggagauuua

SEQ ID NO: 1607337 - RNA, 21 nt, Human
acagaguuguuacauuuuuaa

SEQ ID NO: 1607338 - RNA, 22 nt, Human
acagaguuguuacauuuuuaag

SEQ ID NO: 1607339 - RNA, 20 nt, Human
acagauagauauaugcucug

SEQ ID NO: 1607340 - RNA, 20 nt, Human
acagauacuccuccaagguu

SEQ ID NO: 1607341 - RNA, 23 nt, Human
acagaugggugcuuggaggaagg

SEQ ID NO: 1607342 - RNA, 19 nt, Human
uauauuuauuacuguaaga

SEQ ID NO: 1607343 - RNA, 15 nt, Human
uauauuuauuacugu

SEQ ID NO: 1607344 - RNA, 19 nt, Human
uaucccuacuguaauuugu

SEQ ID NO: 1607345 - RNA, 20 nt, Human
uaucccuacuguaauuugug

SEQ ID NO: 1607346 - RNA, 16 nt, Human
uaucccggcugcccuu

SEQ ID NO: 1607347 - RNA, 15 nt, Human
uaucucagggccugg

SEQ ID NO: 1607348 - RNA, 13 nt, Human
uaucucagggccu

SEQ ID NO: 1607349 - RNA, 17 nt, Human
uauccuacuuccccuuc

SEQ ID NO: 1607350 - RNA, 14 nt, Human
uauccuacuucccc

SEQ ID NO: 1607351 - RNA, 14 nt, Human
acagagcccacgcc

SEQ ID NO: 1607352 - RNA, 21 nt, Human
acagagcaagugagacccugu

SEQ ID NO: 1607353 - RNA, 17 nt, Human
acagaguuguuacauuu

SEQ ID NO: 1607354 - RNA, 18 nt, Human
acagaguuguuacauuuu

SEQ ID NO: 1607355 - RNA, 19 nt, Human
acagaguuguuacauuuuu

SEQ ID NO: 1607356 - RNA, 20 nt, Human
acagaguuguuacauuuuua

SEQ ID NO: 1607357 - RNA, 16 nt, Human
acagaguuguuacauu

SEQ ID NO: 1607358 - RNA, 22 nt, Human
uagguuuggacaaaauggaaua

SEQ ID NO: 1607359 - RNA, 21 nt, Human
uagguuggcaaaaaggcagga

SEQ ID NO: 1607360 - RNA, 13 nt, Human
acacagugagucg

SEQ ID NO: 1607361 - RNA, 17 nt, Human
acacagugaccauacua

SEQ ID NO: 1607362 - RNA, 14 nt, Human
acacacugaagaag

SEQ ID NO: 1607363 - RNA, 11 nt, Human
acacagugagu

SEQ ID NO: 1607364 - RNA, 13 nt, Human
uaguagagacagg

SEQ ID NO: 1607365 - RNA, 14 nt, Human
uaguagagacaggg

SEQ ID NO: 1607366 - RNA, 17 nt, Human
uaguguuggagaagaac

SEQ ID NO: 1607367 - RNA, 16 nt, Human
uaguguuggagaagaa

SEQ ID NO: 1607368 - RNA, 12 nt, Human
uaguguuggaga

SEQ ID NO: 1607369 - RNA, 22 nt, Human
uagucuugucucagauuuuauu

SEQ ID NO: 1607370 - RNA, 17 nt, Human
uagucuugucucagauu

SEQ ID NO: 1607371 - RNA, 17 nt, Human
acacaacuauauuguuu

SEQ ID NO: 1607372 - RNA, 14 nt, Human
acacaacuauauug

SEQ ID NO: 1607373 - RNA, 21 nt, Human
acaaugguuuucuuguguguu

SEQ ID NO: 1607374 - RNA, 18 nt, Human
acaaugcuguauuuuaaa

SEQ ID NO: 1607375 - RNA, 15 nt, Human
acaaugguuuucuug

SEQ ID NO: 1607376 - RNA, 17 nt, Human
acaaugcuguauuuuaa

SEQ ID NO: 1607377 - RNA, 14 nt, Human
acaaugcuguauuu

SEQ ID NO: 1607378 - RNA, 13 nt, Human
acacacugaagaa

SEQ ID NO: 1607379 - RNA, 14 nt, Human
acacacacauacac

SEQ ID NO: 1607380 - RNA, 12 nt, Human
acacacagcucu

SEQ ID NO: 1607381 - RNA, 11 nt, Human
acacacagcuc

SEQ ID NO: 1607382 - RNA, 17 nt, Human
acacuaagagagaauga

SEQ ID NO: 1607383 - RNA, 19 nt, Human
acacuaaccacgcuggacc

SEQ ID NO: 1607384 - RNA, 17 nt, Human
acacuaaccacgcugga

SEQ ID NO: 1607385 - RNA, 16 nt, Human
acacuaaccacgcugg

SEQ ID NO: 1607386 - RNA, 19 nt, Human
acacuaagagagaaugaga

SEQ ID NO: 1607387 - RNA, 18 nt, Human
acacuaagagagaaugag

SEQ ID NO: 1607388 - RNA, 20 nt, Human
acacuaaccacgcuggaccu

SEQ ID NO: 1607389 - RNA, 22 nt, Human
uauaaccaguguuguggauuua

SEQ ID NO: 1607390 - RNA, 19 nt, Human
uauaacuauguugauaaaa

SEQ ID NO: 1607391 - RNA, 19 nt, Human
acaccucugcacaagcugc

SEQ ID NO: 1607392 - RNA, 16 nt, Human
acaccuugacagggca

SEQ ID NO: 1607393 - RNA, 15 nt, Human
acaccuugacagggc

SEQ ID NO: 1607394 - RNA, 14 nt, Human
acaccuugacaggg

SEQ ID NO: 1607395 - RNA, 18 nt, Human
acaccucugcacaagcug

SEQ ID NO: 1607396 - RNA, 18 nt, Human
uaguucagguaacaggca

SEQ ID NO: 1607397 - RNA, 21 nt, Human
uauaaaaauaaaaaacacugg

SEQ ID NO: 1607398 - RNA, 20 nt, Human
uauaaaaauaaaaaacacug

SEQ ID NO: 1607399 - RNA, 22 nt, Human
acacauguccaagaagcccagg

SEQ ID NO: 1607400 - RNA, 21 nt, Human
acacauguccaagaagcccag

SEQ ID NO: 1607401 - RNA, 13 nt, Human
acacccagcccac

SEQ ID NO: 1607402 - RNA, 12 nt, Human
acacccagccca

SEQ ID NO: 1607403 - RNA, 13 nt, Human
acacauuuuauuu

SEQ ID NO: 1607404 - RNA, 19 nt, Human
acacauguccaagaagccc

SEQ ID NO: 1607405 - RNA, 18 nt, Human
acacauguccaagaagcc

SEQ ID NO: 1607406 - RNA, 13 nt, Human
acacauguccaag

SEQ ID NO: 1607407 - RNA, 15 nt, Human
ucacaguucucuccu

SEQ ID NO: 1607408 - RNA, 15 nt, Human
ucacauaucugucau

SEQ ID NO: 1607409 - RNA, 12 nt, Human
ucacauaucugu

SEQ ID NO: 1607410 - RNA, 21 nt, Human
ucacaacagauuauuaccuua

SEQ ID NO: 1607411 - RNA, 22 nt, Human
ucacacgucuggcuucacagau

SEQ ID NO: 1607412 - RNA, 16 nt, Human
ucacaacaaccugguc

SEQ ID NO: 1607413 - RNA, 15 nt, Human
ucaccccggccaccu

SEQ ID NO: 1607414 - RNA, 20 nt, Human
ucaccccagccccaaaacuc

SEQ ID NO: 1607415 - RNA, 14 nt, Human
ucaccccagcccca

SEQ ID NO: 1607416 - RNA, 13 nt, Human
ucaccccagcccc

SEQ ID NO: 1607417 - RNA, 15 nt, Human
accaaucaugaauua

SEQ ID NO: 1607418 - RNA, 15 nt, Human
accaauguucucucu

SEQ ID NO: 1607419 - RNA, 13 nt, Human
accaaucaugaau

SEQ ID NO: 1607420 - RNA, 22 nt, Human
accaacauacucccaucuguga

SEQ ID NO: 1607421 - RNA, 21 nt, Human
accaacauacucccaucugug

SEQ ID NO: 1607422 - RNA, 19 nt, Human
accaacauacucccaucug

SEQ ID NO: 1607423 - RNA, 20 nt, Human
ucaagugauucucaugccuc

SEQ ID NO: 1607424 - RNA, 23 nt, Human
ucaagugaaaaaggaggaagaga

SEQ ID NO: 1607425 - RNA, 17 nt, Human
ucaagugauucucaugc

SEQ ID NO: 1607426 - RNA, 15 nt, Human
ucaagugaaaaagga

SEQ ID NO: 1607427 - RNA, 22 nt, Human
ucaaguccucuuuucugagagg

SEQ ID NO: 1607428 - RNA, 23 nt, Human
ucaauuuuucuuauuucauuucu

SEQ ID NO: 1607429 - RNA, 20 nt, Human
ucaauuuuucuuauuucauu

SEQ ID NO: 1607430 - RNA, 15 nt, Human
ucaauucuugccaaa

SEQ ID NO: 1607431 - RNA, 14 nt, Human
accacacuccagcu

SEQ ID NO: 1607432 - RNA, 20 nt, Human
ucacuauguugcccaggcag

SEQ ID NO: 1607433 - RNA, 19 nt, Human
ucacuauguugcccaggca

SEQ ID NO: 1607434 - RNA, 18 nt, Human
ucacuauguugcccaggc

SEQ ID NO: 1607435 - RNA, 14 nt, Human
accagggacugagg

SEQ ID NO: 1607436 - RNA, 17 nt, Human
accagagcccaccuugg

SEQ ID NO: 1607437 - RNA, 21 nt, Human
accagccuccaugcugccucc

SEQ ID NO: 1607438 - RNA, 20 nt, Human
accagccuccaugcugccuc

SEQ ID NO: 1607439 - RNA, 19 nt, Human
accagccuccaugcugccu

SEQ ID NO: 1607440 - RNA, 14 nt, Human
accagccuccaugc

SEQ ID NO: 1607441 - RNA, 16 nt, Human
ucaccugaagacucau

SEQ ID NO: 1607442 - RNA, 15 nt, Human
ucaccucucccuugg

SEQ ID NO: 1607443 - RNA, 15 nt, Human
ucaccugccccucaa

SEQ ID NO: 1607444 - RNA, 16 nt, Human
ucaccugccccucaac

SEQ ID NO: 1607445 - RNA, 13 nt, Human
ucaccugccccuc

SEQ ID NO: 1607446 - RNA, 13 nt, Human
accacugcagaag

SEQ ID NO: 1607447 - RNA, 22 nt, Human
ucaccccggccaccugcggugc

SEQ ID NO: 1607448 - RNA, 21 nt, Human
accacugcacuccagccuggg

SEQ ID NO: 1607449 - RNA, 23 nt, Human
accacugcucugaugaagaggag

SEQ ID NO: 1607450 - RNA, 17 nt, Human
accacugcucugaugaa

SEQ ID NO: 1607451 - RNA, 15 nt, Human
accacugcucugaug

SEQ ID NO: 1607452 - RNA, 20 nt, Human
accacugcacuccagccugg

SEQ ID NO: 1607453 - RNA, 17 nt, Human
accacugcacuccagcc

SEQ ID NO: 1607454 - RNA, 18 nt, Human
ucaccccggccaccugcg

SEQ ID NO: 1607455 - RNA, 17 nt, Human
ucaccccggccaccugc

SEQ ID NO: 1607456 - RNA, 18 nt, Human
accacuuguguuuugcaa

SEQ ID NO: 1607457 - RNA, 15 nt, Human
accacuuuuguucuu

SEQ ID NO: 1607458 - RNA, 16 nt, Human
accacuuuuguucuug

SEQ ID NO: 1607459 - RNA, 21 nt, Human
accacuuuuguucuugguuug

SEQ ID NO: 1607460 - RNA, 17 nt, Human
accagacaccuugacag

SEQ ID NO: 1607461 - RNA, 14 nt, Human
accagacaccuuga

SEQ ID NO: 1607462 - RNA, 16 nt, Human
accagagcccaccuug

SEQ ID NO: 1607463 - RNA, 14 nt, Human
accagagcccaccu

SEQ ID NO: 1607464 - RNA, 12 nt, Human
accagagcccac

SEQ ID NO: 1607465 - RNA, 22 nt, Human
accacuuuuguucuugguuugu

SEQ ID NO: 1607466 - RNA, 23 nt, Human
accauuucuugagguaaaagcau

SEQ ID NO: 1607467 - RNA, 11 nt, Human
acccacugcuc

SEQ ID NO: 1607468 - RNA, 10 nt, Human
acccacugcu

SEQ ID NO: 1607469 - RNA, 11 nt, Human
acccacugcuu

SEQ ID NO: 1607470 - RNA, 15 nt, Human
acccacugcucuggu

SEQ ID NO: 1607471 - RNA, 14 nt, Human
acccacugcucugg

SEQ ID NO: 1607472 - RNA, 13 nt, Human
acccacugcucug

SEQ ID NO: 1607473 - RNA, 21 nt, Human
acccagauaaagguucaugca

SEQ ID NO: 1607474 - RNA, 12 nt, Human
accauuccccau

SEQ ID NO: 1607475 - RNA, 23 nt, Human
ucacucuuauugcccacgcugga

SEQ ID NO: 1607476 - RNA, 21 nt, Human
ucacucuuauugcccacgcug

SEQ ID NO: 1607477 - RNA, 15 nt, Human
ucacuccuaccuggu

SEQ ID NO: 1607478 - RNA, 22 nt, Human
accauggucggaaaacaugcua

SEQ ID NO: 1607479 - RNA, 19 nt, Human
accaugggauaaaugccau

SEQ ID NO: 1607480 - RNA, 22 nt, Human
ucagaaguuucugccgcagccc

SEQ ID NO: 1607481 - RNA, 19 nt, Human
ucagaaguuucugccgcag

SEQ ID NO: 1607482 - RNA, 19 nt, Human
ucagaaguuucucagcucc

SEQ ID NO: 1607483 - RNA, 14 nt, Human
ucagaagacacuga

SEQ ID NO: 1607484 - RNA, 18 nt, Human
ucagagccugcaguuauu

SEQ ID NO: 1607485 - RNA, 15 nt, Human
ucagagccugcaguu

SEQ ID NO: 1607486 - RNA, 14 nt, Human
ucagagccugcagu

SEQ ID NO: 1607487 - RNA, 13 nt, Human
ucagagccugcag

SEQ ID NO: 1607488 - RNA, 12 nt, Human
ucagagccugca

SEQ ID NO: 1607489 - RNA, 23 nt, Human
ucagagagggugggagugggccc

SEQ ID NO: 1607490 - RNA, 21 nt, Human
ucagagagggugggagugggc

SEQ ID NO: 1607491 - RNA, 16 nt, Human
ucagagagggugggag

SEQ ID NO: 1607492 - RNA, 20 nt, Human
ucagagacuccugcaggcag

SEQ ID NO: 1607493 - RNA, 17 nt, Human
ucagagacuccugcagg

SEQ ID NO: 1607494 - RNA, 21 nt, Human
ucagagacuccugcaggcagc

SEQ ID NO: 1607495 - RNA, 22 nt, Human
ucagagacuccugcaggcagcc

SEQ ID NO: 1607496 - RNA, 19 nt, Human
ucagaaucucaaauaacua

SEQ ID NO: 1607497 - RNA, 18 nt, Human
ucagaaucucaaauaacu

SEQ ID NO: 1607498 - RNA, 23 nt, Human
ucagaaguuucugccgcagcccu

SEQ ID NO: 1607499 - RNA, 21 nt, Human
ucaggaaaucaaauaugcaaa

SEQ ID NO: 1607500 - RNA, 20 nt, Human
ucaggaaaucaaauaugcaa

SEQ ID NO: 1607501 - RNA, 19 nt, Human
ucaggaaagagaacuucca

SEQ ID NO: 1607502 - RNA, 13 nt, Human
ucaggaaagagaa

SEQ ID NO: 1607503 - RNA, 14 nt, Human
ucagcggggacagc

SEQ ID NO: 1607504 - RNA, 16 nt, Human
ucagcucacugcaacc

SEQ ID NO: 1607505 - RNA, 13 nt, Human
ucagcucacugca

SEQ ID NO: 1607506 - RNA, 20 nt, Human
ucagcuuguaaauagcucag

SEQ ID NO: 1607507 - RNA, 12 nt, Human
ucagcucaugga

SEQ ID NO: 1607508 - RNA, 15 nt, Human
accccuucgcuccug

SEQ ID NO: 1607509 - RNA, 14 nt, Human
accccuucgcuccu

SEQ ID NO: 1607510 - RNA, 16 nt, Human
accccuucgcuccugu

SEQ ID NO: 1607511 - RNA, 12 nt, Human
acccccacccaa

SEQ ID NO: 1607512 - RNA, 12 nt, Human
ucagagcugccc

SEQ ID NO: 1607513 - RNA, 22 nt, Human
ucagccaagaauucuuaaauau

SEQ ID NO: 1607514 - RNA, 23 nt, Human
ucagccguguaaccauggaccca

SEQ ID NO: 1607515 - RNA, 23 nt, Human
acccagcgagcccugguggcagu

SEQ ID NO: 1607516 - RNA, 19 nt, Human
acccagcgagcccuggugg

SEQ ID NO: 1607517 - RNA, 24 nt, Human
acccagcgagcccugguggcagug

SEQ ID NO: 1607518 - RNA, 23 nt, Human
accccagcuggggccaggcuggg

SEQ ID NO: 1607519 - RNA, 19 nt, Human
ucaaaauuguuacaaauug

SEQ ID NO: 1607520 - RNA, 16 nt, Human
ucaaaauuguuacaaa

SEQ ID NO: 1607521 - RNA, 21 nt, Human
ucaaaauaccaugccauuuaa

SEQ ID NO: 1607522 - RNA, 23 nt, Human
ucaaaauaccaugccauuuaaag

SEQ ID NO: 1607523 - RNA, 21 nt, Human
ucaaaauaugccccauucaac

SEQ ID NO: 1607524 - RNA, 16 nt, Human
uauuuuuauauuuacu

SEQ ID NO: 1607525 - RNA, 18 nt, Human
ucaaaagaaagaaaauca

SEQ ID NO: 1607526 - RNA, 21 nt, Human
ucaaaguugccuaaauccauu

SEQ ID NO: 1607527 - RNA, 19 nt, Human
ucaaaguugccuaaaucca

SEQ ID NO: 1607528 - RNA, 22 nt, Human
ucaaaguugccuaaauccauuu

SEQ ID NO: 1607529 - RNA, 14 nt, Human
ucaaagcugaaaug

SEQ ID NO: 1607530 - RNA, 19 nt, Human
acaugauccugcaauucca

SEQ ID NO: 1607531 - RNA, 19 nt, Human
acaugagcaucaggccagg

SEQ ID NO: 1607532 - RNA, 18 nt, Human
acaugagcaucaggccag

SEQ ID NO: 1607533 - RNA, 17 nt, Human
acaugagcaucaggcca

SEQ ID NO: 1607534 - RNA, 17 nt, Human
acaugaucuucuuuaua

SEQ ID NO: 1607535 - RNA, 15 nt, Human
acaugaucuucuuua

SEQ ID NO: 1607536 - RNA, 19 nt, Human
acaugaucuucuuuauaau

SEQ ID NO: 1607537 - RNA, 20 nt, Human
acaugagcaucaggccaggc

SEQ ID NO: 1607538 - RNA, 16 nt, Human
acaugaaguccaagca

SEQ ID NO: 1607539 - RNA, 20 nt, Human
ucaaauacgugggcauucaa

SEQ ID NO: 1607540 - RNA, 18 nt, Human
ucaaauaacuaaaaggua

SEQ ID NO: 1607541 - RNA, 22 nt, Human
ucaagaugaugaugaucuuuaa

SEQ ID NO: 1607542 - RNA, 23 nt, Human
ucaaguauuauaccuuuuuuaga

SEQ ID NO: 1607543 - RNA, 16 nt, Human
ucaaguauuauaccuu

SEQ ID NO: 1607544 - RNA, 21 nt, Human
ucaaguauuauaccuuuuuua

SEQ ID NO: 1607545 - RNA, 15 nt, Human
ucaaguauuauaccu

SEQ ID NO: 1607546 - RNA, 11 nt, Human
ucaaguauuau

SEQ ID NO: 1607547 - RNA, 15 nt, Human
acauucuguuaauca

SEQ ID NO: 1607548 - RNA, 15 nt, Human
ucaaauuucuaaauc

SEQ ID NO: 1607549 - RNA, 16 nt, Human
ucaaauuucuaaaucu

SEQ ID NO: 1607550 - RNA, 12 nt, Human
acauucuguuaa

SEQ ID NO: 1607551 - RNA, 16 nt, Human
ucaacagguuuuccug

SEQ ID NO: 1607552 - RNA, 17 nt, Human
ucaaauuucuaaaucuc

SEQ ID NO: 1607553 - RNA, 21 nt, Human
acauguccaagaagcccagga

SEQ ID NO: 1607554 - RNA, 22 nt, Human
acauuagcaguuugcuuuguau

SEQ ID NO: 1607555 - RNA, 18 nt, Human
acauuagcaguuugcuuu

SEQ ID NO: 1607556 - RNA, 14 nt, Human
acauauugauuucc

SEQ ID NO: 1607557 - RNA, 16 nt, Human
acauauugauuuccgu

SEQ ID NO: 1607558 - RNA, 18 nt, Human
acauauugauuuccguua

SEQ ID NO: 1607559 - RNA, 22 nt, Human
acauauugauuuccguuaaaau

SEQ ID NO: 1607560 - RNA, 23 nt, Human
acauauugauuuccguuaaaaua

SEQ ID NO: 1607561 - RNA, 18 nt, Human
acauagaauuaacacaug

SEQ ID NO: 1607562 - RNA, 14 nt, Human
acauagaauuaaca

SEQ ID NO: 1607563 - RNA, 19 nt, Human
acauauauaacaaugcugu

SEQ ID NO: 1607564 - RNA, 20 nt, Human
acauagucuggcuguaccca

SEQ ID NO: 1607565 - RNA, 21 nt, Human
acauagugaugguuccccugu

SEQ ID NO: 1607566 - RNA, 16 nt, Human
acauagugaugguucc

SEQ ID NO: 1607567 - RNA, 15 nt, Human
acauagucuggcugu

SEQ ID NO: 1607568 - RNA, 14 nt, Human
acauagucuggcug

SEQ ID NO: 1607569 - RNA, 13 nt, Human
acaucaacagaua

SEQ ID NO: 1607570 - RNA, 18 nt, Human
acaucaacaucuugguca

SEQ ID NO: 1607571 - RNA, 16 nt, Human
acaucaacaucuuggu

SEQ ID NO: 1607572 - RNA, 14 nt, Human
acaucuugcucugc

SEQ ID NO: 1607573 - RNA, 13 nt, Human
acaucuugcucug

SEQ ID NO: 1607574 - RNA, 19 nt, Human
acaucuugcucugcugaca

SEQ ID NO: 1607575 - RNA, 18 nt, Human
acaucuugcucugcugac

SEQ ID NO: 1607576 - RNA, 21 nt, Human
acaucuugcucugcugacaga

SEQ ID NO: 1607577 - RNA, 17 nt, Human
acaugaaaacacauuuu

SEQ ID NO: 1607578 - RNA, 18 nt, Human
acaugaaaacacauuuuu

SEQ ID NO: 1607579 - RNA, 19 nt, Human
acaugaaaacacauuuuuc

SEQ ID NO: 1607580 - RNA, 22 nt, Human
acaucuugcucugcugacagac

SEQ ID NO: 1607581 - RNA, 22 nt, Human
acaugaaaacacauuuuucuua

SEQ ID NO: 1607582 - RNA, 21 nt, Human
acaguuuucugagaaagacua

SEQ ID NO: 1607583 - RNA, 20 nt, Human
acaguuuucugagaaagacu

SEQ ID NO: 1607584 - RNA, 19 nt, Human
acaguuuucugagaaagac

SEQ ID NO: 1607585 - RNA, 18 nt, Human
acaguuuucugagaaaga

SEQ ID NO: 1607586 - RNA, 17 nt, Human
acaguuuucugagaaag

SEQ ID NO: 1607587 - RNA, 16 nt, Human
acaguuuucugagaaa

SEQ ID NO: 1607588 - RNA, 15 nt, Human
acaguuuucugagaa

SEQ ID NO: 1607589 - RNA, 16 nt, Human
acaguuuguuaguaug

SEQ ID NO: 1607590 - RNA, 20 nt, Human
acaguuuguuaguaugaggc

SEQ ID NO: 1607591 - RNA, 13 nt, Human
acauacuaaccag

SEQ ID NO: 1607592 - RNA, 21 nt, Human
acauacuaaccagcagaaaug

SEQ ID NO: 1607593 - RNA, 22 nt, Human
acauacuaaccagcagaaaugc

SEQ ID NO: 1607594 - RNA, 13 nt, Human
acauacucccauc

SEQ ID NO: 1607595 - RNA, 14 nt, Human
acauacucugcuua

SEQ ID NO: 1607596 - RNA, 17 nt, Human
acauacucccaucugug

SEQ ID NO: 1607597 - RNA, 13 nt, Human
uauuucauuucuu

SEQ ID NO: 1607598 - RNA, 21 nt, Human
uaugaaauauuauguuaaaac

SEQ ID NO: 1607599 - RNA, 23 nt, Human
uauuuccuauauuguuuucagug

SEQ ID NO: 1607600 - RNA, 22 nt, Human
uauuucccucaccuuucccauc

SEQ ID NO: 1607601 - RNA, 20 nt, Human
acaguugaaaaacagcugag

SEQ ID NO: 1607602 - RNA, 16 nt, Human
acaguugaaaaacagc

SEQ ID NO: 1607603 - RNA, 15 nt, Human
acaguugaaaaacag

SEQ ID NO: 1607604 - RNA, 18 nt, Human
uauuucuauauuuucauu

SEQ ID NO: 1607605 - RNA, 17 nt, Human
uauuucuauauuuucau

SEQ ID NO: 1607606 - RNA, 16 nt, Human
uauuucuauauuuuca

SEQ ID NO: 1607607 - RNA, 21 nt, Human
accuagggugauauuaaccag

SEQ ID NO: 1607608 - RNA, 20 nt, Human
accuaccaccacgcccggcu

SEQ ID NO: 1607609 - RNA, 16 nt, Human
accuaccaccacgccc

SEQ ID NO: 1607610 - RNA, 23 nt, Human
ucaggaaaucaaauaugcaaagc

SEQ ID NO: 1607611 - RNA, 22 nt, Human
ucaggaaaucaaauaugcaaag

SEQ ID NO: 1607612 - RNA, 16 nt, Human
ucaggaagcucagggc

SEQ ID NO: 1607613 - RNA, 15 nt, Human
ucaggaagcucaggg

SEQ ID NO: 1607614 - RNA, 14 nt, Human
ucaggaagcucagg

SEQ ID NO: 1607615 - RNA, 13 nt, Human
ucaggaagcucag

SEQ ID NO: 1607616 - RNA, 12 nt, Human
accucccugcaa

SEQ ID NO: 1607617 - RNA, 13 nt, Human
accucccugcaau

SEQ ID NO: 1607618 - RNA, 12 nt, Human
accuccugccuc

SEQ ID NO: 1607619 - RNA, 13 nt, Human
accuccugccucg

SEQ ID NO: 1607620 - RNA, 23 nt, Human
accuccugccucgaacuggcugc

SEQ ID NO: 1607621 - RNA, 13 nt, Human
accuccugcuggg

SEQ ID NO: 1607622 - RNA, 12 nt, Human
accuccugcugg

SEQ ID NO: 1607623 - RNA, 11 nt, Human
accuccugcug

SEQ ID NO: 1607624 - RNA, 15 nt, Human
ucauccuaagcuauu

SEQ ID NO: 1607625 - RNA, 16 nt, Human
ucaugaauuaguuuua

SEQ ID NO: 1607626 - RNA, 22 nt, Human
ucauccuucuggaauaaggaga

SEQ ID NO: 1607627 - RNA, 14 nt, Human
ucaucuaggauuuu

SEQ ID NO: 1607628 - RNA, 18 nt, Human
ucaucuagguaaauuaca

SEQ ID NO: 1607629 - RNA, 19 nt, Human
ucauccuccucagaucuuc

SEQ ID NO: 1607630 - RNA, 13 nt, Human
ucauccuccucag

SEQ ID NO: 1607631 - RNA, 18 nt, Human
ucauccucauacccaccc

SEQ ID NO: 1607632 - RNA, 14 nt, Human
ucauccuucuggaa

SEQ ID NO: 1607633 - RNA, 21 nt, Human
ucaugaauuaguuuuauaugc

SEQ ID NO: 1607634 - RNA, 13 nt, Human
ucauugaaaucuu

SEQ ID NO: 1607635 - RNA, 12 nt, Human
ucauugaaaucu

SEQ ID NO: 1607636 - RNA, 12 nt, Human
ucauucuucugu

SEQ ID NO: 1607637 - RNA, 19 nt, Human
accucggugccuuccucuu

SEQ ID NO: 1607638 - RNA, 13 nt, Human
accuccugggcua

SEQ ID NO: 1607639 - RNA, 16 nt, Human
accuccugcugggcag

SEQ ID NO: 1607640 - RNA, 14 nt, Human
accuccugcugggc

SEQ ID NO: 1607641 - RNA, 15 nt, Human
ucauugaccugaggc

SEQ ID NO: 1607642 - RNA, 14 nt, Human
ucauugaccugagg

SEQ ID NO: 1607643 - RNA, 12 nt, Human
ucauugaccuga

SEQ ID NO: 1607644 - RNA, 22 nt, Human
ucauugaaaucuuuuugcuuug

SEQ ID NO: 1607645 - RNA, 19 nt, Human
ucauugaccugaggcccuu

SEQ ID NO: 1607646 - RNA, 18 nt, Human
accugauugugucucuug

SEQ ID NO: 1607647 - RNA, 17 nt, Human
accugauugugucucuu

SEQ ID NO: 1607648 - RNA, 15 nt, Human
accugauugugucuc

SEQ ID NO: 1607649 - RNA, 21 nt, Human
accugaggcccuucucuccag

SEQ ID NO: 1607650 - RNA, 20 nt, Human
accugaggcccuucucucca

SEQ ID NO: 1607651 - RNA, 16 nt, Human
accugaggcccuucuc

SEQ ID NO: 1607652 - RNA, 15 nt, Human
accugaggcccuucu

SEQ ID NO: 1607653 - RNA, 22 nt, Human
accugaggcccuucucuccagc

SEQ ID NO: 1607654 - RNA, 14 nt, Human
accugaggcccuuc

SEQ ID NO: 1607655 - RNA, 14 nt, Human
accucuaaauucuu

SEQ ID NO: 1607656 - RNA, 20 nt, Human
acgagcaggcuacugucagc

SEQ ID NO: 1607657 - RNA, 19 nt, Human
acgagcaggcuacugucag

SEQ ID NO: 1607658 - RNA, 19 nt, Human
acgccagauucuuuccuga

SEQ ID NO: 1607659 - RNA, 16 nt, Human
acgagcaggcuucuuc

SEQ ID NO: 1607660 - RNA, 14 nt, Human
acgagaaaacaaua

SEQ ID NO: 1607661 - RNA, 21 nt, Human
accuuuuuuauacauaaacaa

SEQ ID NO: 1607662 - RNA, 22 nt, Human
accuuuuuuauacauaaacaag

SEQ ID NO: 1607663 - RNA, 19 nt, Human
accuuuuuuauacauaaac

SEQ ID NO: 1607664 - RNA, 20 nt, Human
accuuuuuuauacauaaaca

SEQ ID NO: 1607665 - RNA, 21 nt, Human
uccaggcuguaucccaugagc

SEQ ID NO: 1607666 - RNA, 12 nt, Human
uccagccccugg

SEQ ID NO: 1607667 - RNA, 15 nt, Human
uccagagaguggcuc

SEQ ID NO: 1607668 - RNA, 17 nt, Human
uccagagaguggcuccu

SEQ ID NO: 1607669 - RNA, 16 nt, Human
uccagagaguggcucc

SEQ ID NO: 1607670 - RNA, 13 nt, Human
uccagccccugga

SEQ ID NO: 1607671 - RNA, 14 nt, Human
uccagccccuggau

SEQ ID NO: 1607672 - RNA, 20 nt, Human
accuuuugagugccuuacac

SEQ ID NO: 1607673 - RNA, 17 nt, Human
accuuuugagugccuua

SEQ ID NO: 1607674 - RNA, 14 nt, Human
accuuuugagugcc

SEQ ID NO: 1607675 - RNA, 19 nt, Human
uccaccuucccaugcccug

SEQ ID NO: 1607676 - RNA, 18 nt, Human
uccaccuucccaugcccu

SEQ ID NO: 1607677 - RNA, 16 nt, Human
uccaccuucccaugcc

SEQ ID NO: 1607678 - RNA, 13 nt, Human
uccagacacaugu

SEQ ID NO: 1607679 - RNA, 22 nt, Human
uccagaauuucccaaagcagug

SEQ ID NO: 1607680 - RNA, 20 nt, Human
uccagaauuucccaaagcag

SEQ ID NO: 1607681 - RNA, 22 nt, Human
uccacugccuucgauacaccgg

SEQ ID NO: 1607682 - RNA, 15 nt, Human
uccacugccuucgau

SEQ ID NO: 1607683 - RNA, 13 nt, Human
uccacugccuucg

SEQ ID NO: 1607684 - RNA, 18 nt, Human
uccagacccggcugcgug

SEQ ID NO: 1607685 - RNA, 15 nt, Human
uccagacccggcugc

SEQ ID NO: 1607686 - RNA, 19 nt, Human
uccagacccggcugcgugg

SEQ ID NO: 1607687 - RNA, 17 nt, Human
accuggccucugcacuc

SEQ ID NO: 1607688 - RNA, 16 nt, Human
accuggccucugcacu

SEQ ID NO: 1607689 - RNA, 14 nt, Human
accuggccucugca

SEQ ID NO: 1607690 - RNA, 17 nt, Human
uccacccaggagccccg

SEQ ID NO: 1607691 - RNA, 15 nt, Human
uccacccaggagccc

SEQ ID NO: 1607692 - RNA, 14 nt, Human
uccacccaggagcc

SEQ ID NO: 1607693 - RNA, 12 nt, Human
uccacccaggag

SEQ ID NO: 1607694 - RNA, 19 nt, Human
uccacccaccucagccucc

SEQ ID NO: 1607695 - RNA, 18 nt, Human
uccacccaccucagccuc

SEQ ID NO: 1607696 - RNA, 20 nt, Human
accuuagacagucccugcca

SEQ ID NO: 1607697 - RNA, 19 nt, Human
accuuagacagucccugcc

SEQ ID NO: 1607698 - RNA, 18 nt, Human
accuuagacagucccugc

SEQ ID NO: 1607699 - RNA, 19 nt, Human
accuguuucugcagccacu

SEQ ID NO: 1607700 - RNA, 21 nt, Human
accuggucacaggacucugcc

SEQ ID NO: 1607701 - RNA, 20 nt, Human
accuggccucugcacucccc

SEQ ID NO: 1607702 - RNA, 18 nt, Human
accuggccucugcacucc

SEQ ID NO: 1607703 - RNA, 23 nt, Human
accuggccucugcacuccccugc

SEQ ID NO: 1607704 - RNA, 21 nt, Human
uccaagcuggucccacucagu

SEQ ID NO: 1607705 - RNA, 18 nt, Human
uccaaucccaccaacccu

SEQ ID NO: 1607706 - RNA, 20 nt, Human
uccaagcuggucccacucag

SEQ ID NO: 1607707 - RNA, 12 nt, Human
uccaagaagccc

SEQ ID NO: 1607708 - RNA, 15 nt, Human
accugccaggaagcc

SEQ ID NO: 1607709 - RNA, 14 nt, Human
accugccaggaagc

SEQ ID NO: 1607710 - RNA, 12 nt, Human
accugccaggaa

SEQ ID NO: 1607711 - RNA, 14 nt, Human
uccaacccucauca

SEQ ID NO: 1607712 - RNA, 17 nt, Human
uccaacccucaucacca

SEQ ID NO: 1607713 - RNA, 16 nt, Human
uccaacccucaucacc

SEQ ID NO: 1607714 - RNA, 23 nt, Human
uccaacccucaucaccaacgucu

SEQ ID NO: 1607715 - RNA, 12 nt, Human
ucccuuuuccuu

SEQ ID NO: 1607716 - RNA, 16 nt, Human
uccuagaaauucccca

SEQ ID NO: 1607717 - RNA, 14 nt, Human
uccuacuuccccuu

SEQ ID NO: 1607718 - RNA, 17 nt, Human
uccggucccugucccag

SEQ ID NO: 1607719 - RNA, 19 nt, Human
uccuaaauauauuuuaaga

SEQ ID NO: 1607720 - RNA, 12 nt, Human
ucccugucccag

SEQ ID NO: 1607721 - RNA, 15 nt, Human
ucccugguggcagcu

SEQ ID NO: 1607722 - RNA, 21 nt, Human
acuccugcaggcagccaggcc

SEQ ID NO: 1607723 - RNA, 17 nt, Human
ucccuuacgugaguccu

SEQ ID NO: 1607724 - RNA, 21 nt, Human
acuccaaagaaauguaaggga

SEQ ID NO: 1607725 - RNA, 17 nt, Human
acuccagaauuucccaa

SEQ ID NO: 1607726 - RNA, 15 nt, Human
acuccagaauuuccc

SEQ ID NO: 1607727 - RNA, 18 nt, Human
acuccaaagaaauguaag

SEQ ID NO: 1607728 - RNA, 15 nt, Human
acuccaaagaaaugu

SEQ ID NO: 1607729 - RNA, 14 nt, Human
acuccaaagaaaug

SEQ ID NO: 1607730 - RNA, 15 nt, Human
acucauugaccugag

SEQ ID NO: 1607731 - RNA, 14 nt, Human
acucauugaccuga

SEQ ID NO: 1607732 - RNA, 15 nt, Human
acucauucuucugua

SEQ ID NO: 1607733 - RNA, 13 nt, Human
acuccagccuggg

SEQ ID NO: 1607734 - RNA, 12 nt, Human
acuccagccugg

SEQ ID NO: 1607735 - RNA, 23 nt, Human
acuccagaauuucccaaagcagu

SEQ ID NO: 1607736 - RNA, 13 nt, Human
acuccagaccccu

SEQ ID NO: 1607737 - RNA, 19 nt, Human
acuccugcaggcagccagg

SEQ ID NO: 1607738 - RNA, 18 nt, Human
acuccugcaggcagccag

SEQ ID NO: 1607739 - RNA, 13 nt, Human
acuccucugucca

SEQ ID NO: 1607740 - RNA, 14 nt, Human
acuccucuguccag

SEQ ID NO: 1607741 - RNA, 11 nt, Human
ucccugagcag

SEQ ID NO: 1607742 - RNA, 17 nt, Human
ucccugaaggccccgcc

SEQ ID NO: 1607743 - RNA, 16 nt, Human
ucccugaaggccccgc

SEQ ID NO: 1607744 - RNA, 16 nt, Human
ucccugcaauaaaaug

SEQ ID NO: 1607745 - RNA, 15 nt, Human
ucccucccuccaccu

SEQ ID NO: 1607746 - RNA, 16 nt, Human
ucccucccuccaccuc

SEQ ID NO: 1607747 - RNA, 20 nt, Human
ucccucuuucccucccuucc

SEQ ID NO: 1607748 - RNA, 18 nt, Human
ucccucuuucccucccuu

SEQ ID NO: 1607749 - RNA, 17 nt, Human
ucccucccuccaccucc

SEQ ID NO: 1607750 - RNA, 21 nt, Human
ucccucuuucccucccuuccu

SEQ ID NO: 1607751 - RNA, 15 nt, Human
ucccugaaggccccg

SEQ ID NO: 1607752 - RNA, 11 nt, Human
ucccugaaggc

SEQ ID NO: 1607753 - RNA, 21 nt, Human
ucccuccaccucccugcaaua

SEQ ID NO: 1607754 - RNA, 23 nt, Human
ucccuccaccucccugcaauaaa

SEQ ID NO: 1607755 - RNA, 22 nt, Human
ucccggcugcccuuucugggca

SEQ ID NO: 1607756 - RNA, 18 nt, Human
ucccggcugcccuuucug

SEQ ID NO: 1607757 - RNA, 15 nt, Human
ucccggcugcccuuu

SEQ ID NO: 1607758 - RNA, 14 nt, Human
ucccggcugcccuu

SEQ ID NO: 1607759 - RNA, 13 nt, Human
ucccggcugcccu

SEQ ID NO: 1607760 - RNA, 13 nt, Human
ucccucccuccac

SEQ ID NO: 1607761 - RNA, 14 nt, Human
ucccucccuccacc

SEQ ID NO: 1607762 - RNA, 17 nt, Human
uccccucggagaagagc

SEQ ID NO: 1607763 - RNA, 16 nt, Human
uccccucggagaagag

SEQ ID NO: 1607764 - RNA, 17 nt, Human
ucccgaguagcugggac

SEQ ID NO: 1607765 - RNA, 16 nt, Human
ucccgaguagcuggga

SEQ ID NO: 1607766 - RNA, 18 nt, Human
ucccgaguagcugggacu

SEQ ID NO: 1607767 - RNA, 20 nt, Human
ucccgaguagcugggacuac

SEQ ID NO: 1607768 - RNA, 20 nt, Human
ucccgaguagcugagauuau

SEQ ID NO: 1607769 - RNA, 15 nt, Human
ucccgaguagcuggg

SEQ ID NO: 1607770 - RNA, 20 nt, Human
ucccgaauagcugggacuac

SEQ ID NO: 1607771 - RNA, 12 nt, Human
acucaccccagc

SEQ ID NO: 1607772 - RNA, 17 nt, Human
acuacucccccaggugg

SEQ ID NO: 1607773 - RNA, 21 nt, Human
acuacuagggaaaugccuuug

SEQ ID NO: 1607774 - RNA, 21 nt, Human
uccauccugaggcuccacuug

SEQ ID NO: 1607775 - RNA, 20 nt, Human
uccauccugaggcuccacuu

SEQ ID NO: 1607776 - RNA, 23 nt, Human
acgccagauucuuuccugaggcu

SEQ ID NO: 1607777 - RNA, 22 nt, Human
acgccagauucuuuccugaggc

SEQ ID NO: 1607778 - RNA, 16 nt, Human
uccaucuaaacugccc

SEQ ID NO: 1607779 - RNA, 18 nt, Human
uccaucuaaacugccccc

SEQ ID NO: 1607780 - RNA, 21 nt, Human
uccaugaagauguagaggaga

SEQ ID NO: 1607781 - RNA, 13 nt, Human
uccaugaagaugu

SEQ ID NO: 1607782 - RNA, 18 nt, Human
uccauuuaauaauuauau

SEQ ID NO: 1607783 - RNA, 18 nt, Human
ucccaaacccuucagugc

SEQ ID NO: 1607784 - RNA, 16 nt, Human
ucccaaagcagugcau

SEQ ID NO: 1607785 - RNA, 18 nt, Human
ucccaaagcagugcaugc

SEQ ID NO: 1607786 - RNA, 17 nt, Human
ucccaaagcagugcaug

SEQ ID NO: 1607787 - RNA, 21 nt, Human
ucccaaagcagugcaugcugu

SEQ ID NO: 1607788 - RNA, 14 nt, Human
ucccaaagugcugg

SEQ ID NO: 1607789 - RNA, 13 nt, Human
ucccaaagugcug

SEQ ID NO: 1607790 - RNA, 20 nt, Human
acgggaggguaaggcugugg

SEQ ID NO: 1607791 - RNA, 20 nt, Human
ucccaccccacacacgccag

SEQ ID NO: 1607792 - RNA, 15 nt, Human
ucccaccccacacac

SEQ ID NO: 1607793 - RNA, 16 nt, Human
ucccacaaaggagagc

SEQ ID NO: 1607794 - RNA, 23 nt, Human
acguggcugcuucaaggauccug

SEQ ID NO: 1607795 - RNA, 17 nt, Human
acgguuuuacugcagcu

SEQ ID NO: 1607796 - RNA, 15 nt, Human
acgguuuuacugcag

SEQ ID NO: 1607797 - RNA, 22 nt, Human
acguauaaaagccuguuuaaga

SEQ ID NO: 1607798 - RNA, 20 nt, Human
acgugggcauucaaauguau

SEQ ID NO: 1607799 - RNA, 17 nt, Human
acgugggcauucaaaug

SEQ ID NO: 1607800 - RNA, 22 nt, Human
ucccagucauuuaauaaaugug

SEQ ID NO: 1607801 - RNA, 14 nt, Human
ucccagucauuuaa

SEQ ID NO: 1607802 - RNA, 22 nt, Human
ucccauaugccugggcagaagg

SEQ ID NO: 1607803 - RNA, 15 nt, Human
ucccaucacccgcua

SEQ ID NO: 1607804 - RNA, 21 nt, Human
uccccaccgcagacaggacca

SEQ ID NO: 1607805 - RNA, 18 nt, Human
uccccaccgcagacagga

SEQ ID NO: 1607806 - RNA, 17 nt, Human
uccccaccgcagacagg

SEQ ID NO: 1607807 - RNA, 22 nt, Human
uccccaccgcagacaggaccag

SEQ ID NO: 1607808 - RNA, 12 nt, Human
uccccacccuga

SEQ ID NO: 1607809 - RNA, 17 nt, Human
uccccaugucucgacuc

SEQ ID NO: 1607810 - RNA, 15 nt, Human
acuacauucuguuaa

SEQ ID NO: 1607811 - RNA, 17 nt, Human
ucccagccagcaguuca

SEQ ID NO: 1607812 - RNA, 18 nt, Human
ucccagccagcaguucag

SEQ ID NO: 1607813 - RNA, 17 nt, Human
ucccagcugugcucugg

SEQ ID NO: 1607814 - RNA, 12 nt, Human
ucccagccccaa

SEQ ID NO: 1607815 - RNA, 15 nt, Human
acuacaguuuguuag

SEQ ID NO: 1607816 - RNA, 11 nt, Human
acuacauucug

SEQ ID NO: 1607817 - RNA, 12 nt, Human
acuacauucugu

SEQ ID NO: 1607818 - RNA, 13 nt, Human
acuacauucuguu

SEQ ID NO: 1607819 - RNA, 14 nt, Human
acuacauucuguua

SEQ ID NO: 1607820 - RNA, 12 nt, Human
acuaaccacgcu

SEQ ID NO: 1607821 - RNA, 11 nt, Human
acuacaggcac

SEQ ID NO: 1607822 - RNA, 13 nt, Human
acuacaguuuguu

SEQ ID NO: 1607823 - RNA, 14 nt, Human
acuacaguuuguua

SEQ ID NO: 1607824 - RNA, 15 nt, Human
acuacaggcacccac

SEQ ID NO: 1607825 - RNA, 16 nt, Human
ucuacauacuauggaa

SEQ ID NO: 1607826 - RNA, 23 nt, Human
ucuaaguaaaaccacagcaguug

SEQ ID NO: 1607827 - RNA, 22 nt, Human
ucuaaguaaaaccacagcaguu

SEQ ID NO: 1607828 - RNA, 21 nt, Human
ucuaaguaaaaccacagcagu

SEQ ID NO: 1607829 - RNA, 20 nt, Human
ucuaaagccauuguaguccu

SEQ ID NO: 1607830 - RNA, 14 nt, Human
ucuaaagcugccag

SEQ ID NO: 1607831 - RNA, 13 nt, Human
ucuaaagcugcca

SEQ ID NO: 1607832 - RNA, 15 nt, Human
ucuaaagcugccagc

SEQ ID NO: 1607833 - RNA, 16 nt, Human
ucuaaagcugccagcc

SEQ ID NO: 1607834 - RNA, 14 nt, Human
acuguucucugccc

SEQ ID NO: 1607835 - RNA, 20 nt, Human
acuguucucugcccuccaag

SEQ ID NO: 1607836 - RNA, 15 nt, Human
acuguucucugcccu

SEQ ID NO: 1607837 - RNA, 21 nt, Human
acuguucucugcccuccaaga

SEQ ID NO: 1607838 - RNA, 14 nt, Human
acuucagcucuguu

SEQ ID NO: 1607839 - RNA, 16 nt, Human
acuuagaaauugcauu

SEQ ID NO: 1607840 - RNA, 13 nt, Human
acuuaaucuaaau

SEQ ID NO: 1607841 - RNA, 15 nt, Human
acuuaaucuaaaugg

SEQ ID NO: 1607842 - RNA, 16 nt, Human
acuuaaucuaaaugga

SEQ ID NO: 1607843 - RNA, 18 nt, Human
acuguugcccaggcuggc

SEQ ID NO: 1607844 - RNA, 17 nt, Human
acuguugcccaggcugg

SEQ ID NO: 1607845 - RNA, 14 nt, Human
acuguugcccaggc

SEQ ID NO: 1607846 - RNA, 13 nt, Human
acuguugcccagg

SEQ ID NO: 1607847 - RNA, 12 nt, Human
acuguugcccag

SEQ ID NO: 1607848 - RNA, 17 nt, Human
acuuaaauaaugugaaa

SEQ ID NO: 1607849 - RNA, 18 nt, Human
acuuaaauaaugugaaac

SEQ ID NO: 1607850 - RNA, 16 nt, Human
acuuaaauaaugugaa

SEQ ID NO: 1607851 - RNA, 22 nt, Human
ucggguuuuauuguuuaaaauc

SEQ ID NO: 1607852 - RNA, 12 nt, Human
ucgggcaugaca

SEQ ID NO: 1607853 - RNA, 11 nt, Human
ucgggcaugac

SEQ ID NO: 1607854 - RNA, 21 nt, Human
ucgggaggucgaggcaggagg

SEQ ID NO: 1607855 - RNA, 19 nt, Human
ucgggaggucgaggcagga

SEQ ID NO: 1607856 - RNA, 17 nt, Human
ucgggaggucgaggcag

SEQ ID NO: 1607857 - RNA, 18 nt, Human
ucggcucacugcauccuc

SEQ ID NO: 1607858 - RNA, 13 nt, Human
ucguaaaauuaag

SEQ ID NO: 1607859 - RNA, 16 nt, Human
ucguaaaauuaagaaa

SEQ ID NO: 1607860 - RNA, 22 nt, Human
ucguuuucaaaauuguuacaaa

SEQ ID NO: 1607861 - RNA, 17 nt, Human
ucguuugaaucacagua

SEQ ID NO: 1607862 - RNA, 22 nt, Human
acugucagcuccccucggagaa

SEQ ID NO: 1607863 - RNA, 17 nt, Human
acuguccuacccacccu

SEQ ID NO: 1607864 - RNA, 23 nt, Human
acuguccuacccacccuccuuuc

SEQ ID NO: 1607865 - RNA, 18 nt, Human
acuguccuacccacccuc

SEQ ID NO: 1607866 - RNA, 18 nt, Human
acugggacaggggagaac

SEQ ID NO: 1607867 - RNA, 16 nt, Human
acugggagaaaugaaa

SEQ ID NO: 1607868 - RNA, 21 nt, Human
acugucagcuccccucggaga

SEQ ID NO: 1607869 - RNA, 17 nt, Human
acugggagaaaugaaaa

SEQ ID NO: 1607870 - RNA, 18 nt, Human
acuguggguagacacaca

SEQ ID NO: 1607871 - RNA, 15 nt, Human
acuguggugacuuug

SEQ ID NO: 1607872 - RNA, 14 nt, Human
acuguggugacuuu

SEQ ID NO: 1607873 - RNA, 12 nt, Human
acuguggugacu

SEQ ID NO: 1607874 - RNA, 21 nt, Human
acuguggugacuuuggauaau

SEQ ID NO: 1607875 - RNA, 20 nt, Human
acuguggugacuuuggauaa

SEQ ID NO: 1607876 - RNA, 18 nt, Human
acuguggugacuuuggau

SEQ ID NO: 1607877 - RNA, 21 nt, Human
acugugugcucaggagcccug

SEQ ID NO: 1607878 - RNA, 20 nt, Human
acugugugcucaggagcccu

SEQ ID NO: 1607879 - RNA, 19 nt, Human
acugugugcucaggagccc

SEQ ID NO: 1607880 - RNA, 15 nt, Human
acugugugcucagga

SEQ ID NO: 1607881 - RNA, 12 nt, Human
acugugugcuca

SEQ ID NO: 1607882 - RNA, 14 nt, Human
acugcauuauauuu

SEQ ID NO: 1607883 - RNA, 15 nt, Human
acugcauuauauuua

SEQ ID NO: 1607884 - RNA, 21 nt, Human
acugccuauuuuaauaaacac

SEQ ID NO: 1607885 - RNA, 16 nt, Human
acugccuauuuuaaua

SEQ ID NO: 1607886 - RNA, 15 nt, Human
acugccucuuccucc

SEQ ID NO: 1607887 - RNA, 14 nt, Human
acugccucuuccuc

SEQ ID NO: 1607888 - RNA, 22 nt, Human
uccuagaaauuccccacccuga

SEQ ID NO: 1607889 - RNA, 21 nt, Human
uccuagaaauuccccacccug

SEQ ID NO: 1607890 - RNA, 16 nt, Human
acugcauaugaaagga

SEQ ID NO: 1607891 - RNA, 15 nt, Human
acugcauguuuguga

SEQ ID NO: 1607892 - RNA, 16 nt, Human
acugcauguuugugau

SEQ ID NO: 1607893 - RNA, 23 nt, Human
acugcauccuccgccucccgggu

SEQ ID NO: 1607894 - RNA, 22 nt, Human
acugcaucaagaugugacaugu

SEQ ID NO: 1607895 - RNA, 20 nt, Human
acugcaucaagaugugacau

SEQ ID NO: 1607896 - RNA, 20 nt, Human
acugcauccuccgccucccg

SEQ ID NO: 1607897 - RNA, 17 nt, Human
acugcauccuccgccuc

SEQ ID NO: 1607898 - RNA, 13 nt, Human
acuggcacaguuu

SEQ ID NO: 1607899 - RNA, 22 nt, Human
acuggauuaaacuuaaucuaaa

SEQ ID NO: 1607900 - RNA, 15 nt, Human
acuggauuaaacuua

SEQ ID NO: 1607901 - RNA, 20 nt, Human
acuggcacaguuuucugaga

SEQ ID NO: 1607902 - RNA, 19 nt, Human
acuggcacaguuuucugag

SEQ ID NO: 1607903 - RNA, 21 nt, Human
acuggcacaguuuucugagaa

SEQ ID NO: 1607904 - RNA, 14 nt, Human
acugcuuuuggucu

SEQ ID NO: 1607905 - RNA, 20 nt, Human
acugcuuaacuucacauauu

SEQ ID NO: 1607906 - RNA, 17 nt, Human
acugcuuccagugaggc

SEQ ID NO: 1607907 - RNA, 20 nt, Human
acugccuucucaacuccaaa

SEQ ID NO: 1607908 - RNA, 19 nt, Human
acugccuucucaacuccaa

SEQ ID NO: 1607909 - RNA, 13 nt, Human
acugccuucucaa

SEQ ID NO: 1607910 - RNA, 18 nt, Human
acugcuuaacuucacaua

SEQ ID NO: 1607911 - RNA, 15 nt, Human
acugcuggcugccuu

SEQ ID NO: 1607912 - RNA, 14 nt, Human
acugcuggcugccu

SEQ ID NO: 1607913 - RNA, 16 nt, Human
ucgcgacaaugcaaac

SEQ ID NO: 1607914 - RNA, 13 nt, Human
ucgaggacaggga

SEQ ID NO: 1607915 - RNA, 19 nt, Human
ucgcgacaaugcaaaccau

SEQ ID NO: 1607916 - RNA, 18 nt, Human
ucgagcaugccuggaugg

SEQ ID NO: 1607917 - RNA, 16 nt, Human
ucgagcaugccuggau

SEQ ID NO: 1607918 - RNA, 18 nt, Human
ucgcuauugucaccaggg

SEQ ID NO: 1607919 - RNA, 18 nt, Human
ucgagaaacagccugugu

SEQ ID NO: 1607920 - RNA, 23 nt, Human
uccuuuagcgcccaguugggugg

SEQ ID NO: 1607921 - RNA, 22 nt, Human
uccuuuagcgcccaguugggug

SEQ ID NO: 1607922 - RNA, 19 nt, Human
uccuuuagcgcccaguugg

SEQ ID NO: 1607923 - RNA, 15 nt, Human
uccuuuagcgcccag

SEQ ID NO: 1607924 - RNA, 14 nt, Human
uccuuguguuacua

SEQ ID NO: 1607925 - RNA, 23 nt, Human
uccuuguguuacuaaguuuuuau

SEQ ID NO: 1607926 - RNA, 17 nt, Human
uccuucagugccuuaug

SEQ ID NO: 1607927 - RNA, 16 nt, Human
uccuucagugccuuau

SEQ ID NO: 1607928 - RNA, 20 nt, Human
uccuucagugccuuauggaa

SEQ ID NO: 1607929 - RNA, 15 nt, Human
uccuucagugccuua

SEQ ID NO: 1607930 - RNA, 16 nt, Human
acuggccucugcugau

SEQ ID NO: 1607931 - RNA, 14 nt, Human
acuggccucugcug

SEQ ID NO: 1607932 - RNA, 23 nt, Human
ucugagacucgcgacaaugcaaa

SEQ ID NO: 1607933 - RNA, 19 nt, Human
ucugcacuccccugcuggg

SEQ ID NO: 1607934 - RNA, 18 nt, Human
ucugcacuccccugcugg

SEQ ID NO: 1607935 - RNA, 18 nt, Human
ucugauucccaagcucug

SEQ ID NO: 1607936 - RNA, 13 nt, Human
ucugauacagaaa

SEQ ID NO: 1607937 - RNA, 23 nt, Human
ucugaugcaagcaagaaacacug

SEQ ID NO: 1607938 - RNA, 22 nt, Human
ucugcacuccccugcugggugu

SEQ ID NO: 1607939 - RNA, 20 nt, Human
ucugcacuccccugcugggu

SEQ ID NO: 1607940 - RNA, 17 nt, Human
ucugcaggucccuaaua

SEQ ID NO: 1607941 - RNA, 16 nt, Human
ucugcaggucccuaau

SEQ ID NO: 1607942 - RNA, 15 nt, Human
ucugcaggucccuaa

SEQ ID NO: 1607943 - RNA, 17 nt, Human
agaaauuuauaaacuuu

SEQ ID NO: 1607944 - RNA, 16 nt, Human
agaaauuuauaaacuu

SEQ ID NO: 1607945 - RNA, 22 nt, Human
agaaauuaugugccagauuuau

SEQ ID NO: 1607946 - RNA, 21 nt, Human
agaaauuaugugccagauuua

SEQ ID NO: 1607947 - RNA, 13 nt, Human
agaaauuaugugc

SEQ ID NO: 1607948 - RNA, 18 nt, Human
ucugcaggucccuaauaa

SEQ ID NO: 1607949 - RNA, 20 nt, Human
agaaauaucugaaaauguau

SEQ ID NO: 1607950 - RNA, 19 nt, Human
agaaauaucugaaaaugua

SEQ ID NO: 1607951 - RNA, 14 nt, Human
agaaauauaauuga

SEQ ID NO: 1607952 - RNA, 17 nt, Human
agaaaugaaaaaauaua

SEQ ID NO: 1607953 - RNA, 15 nt, Human
agaaaucuaaaaaac

SEQ ID NO: 1607954 - RNA, 12 nt, Human
agaaaucuaaaa

SEQ ID NO: 1607955 - RNA, 14 nt, Human
agaaagaaaaucag

SEQ ID NO: 1607956 - RNA, 12 nt, Human
ucugaagaagau

SEQ ID NO: 1607957 - RNA, 14 nt, Human
agaaaugaaagcag

SEQ ID NO: 1607958 - RNA, 23 nt, Human
agaaaugaaaaaauauauaucaa

SEQ ID NO: 1607959 - RNA, 18 nt, Human
agaaaugaaaaaauauau

SEQ ID NO: 1607960 - RNA, 12 nt, Human
ucugacacacag

SEQ ID NO: 1607961 - RNA, 16 nt, Human
ucugacaacagacuuc

SEQ ID NO: 1607962 - RNA, 15 nt, Human
ucugacaacagacuu

SEQ ID NO: 1607963 - RNA, 19 nt, Human
ucugaagucagaucugccu

SEQ ID NO: 1607964 - RNA, 16 nt, Human
ucugaagucacugcac

SEQ ID NO: 1607965 - RNA, 15 nt, Human
ucugaagucacugca

SEQ ID NO: 1607966 - RNA, 18 nt, Human
ucugaagucacugcacag

SEQ ID NO: 1607967 - RNA, 15 nt, Human
ucugaagucagaucu

SEQ ID NO: 1607968 - RNA, 18 nt, Human
ucucuugagccugggagg

SEQ ID NO: 1607969 - RNA, 16 nt, Human
ucucuugauucauaau

SEQ ID NO: 1607970 - RNA, 14 nt, Human
ucucuugauucaua

SEQ ID NO: 1607971 - RNA, 23 nt, Human
ucucuggccuucggccuccaucc

SEQ ID NO: 1607972 - RNA, 22 nt, Human
ucucuggccuucggccuccauc

SEQ ID NO: 1607973 - RNA, 21 nt, Human
ucucuggccuucggccuccau

SEQ ID NO: 1607974 - RNA, 21 nt, Human
ucucuuuaaugucacaggcag

SEQ ID NO: 1607975 - RNA, 20 nt, Human
ucucuuuaaugucacaggca

SEQ ID NO: 1607976 - RNA, 13 nt, Human
agaaaaagaaaaa

SEQ ID NO: 1607977 - RNA, 16 nt, Human
ucucuugguccugcug

SEQ ID NO: 1607978 - RNA, 17 nt, Human
agaaaaaggaugcacag

SEQ ID NO: 1607979 - RNA, 18 nt, Human
agaaaaaggaugcacaga

SEQ ID NO: 1607980 - RNA, 21 nt, Human
agaaaacuuguauuaugugug

SEQ ID NO: 1607981 - RNA, 12 nt, Human
ucucuggccuuc

SEQ ID NO: 1607982 - RNA, 19 nt, Human
ucucuggaauuugaaacac

SEQ ID NO: 1607983 - RNA, 15 nt, Human
ucucuggaauuugaa

SEQ ID NO: 1607984 - RNA, 17 nt, Human
ucucugcccuccaagac

SEQ ID NO: 1607985 - RNA, 16 nt, Human
ucucugcccuccaaga

SEQ ID NO: 1607986 - RNA, 15 nt, Human
ucucugcccuccaag

SEQ ID NO: 1607987 - RNA, 11 nt, Human
ucucugcccuc

SEQ ID NO: 1607988 - RNA, 14 nt, Human
ucucuccuguaccu

SEQ ID NO: 1607989 - RNA, 16 nt, Human
ucucuccuguaccucu

SEQ ID NO: 1607990 - RNA, 17 nt, Human
ucucuccuguaccucuu

SEQ ID NO: 1607991 - RNA, 19 nt, Human
ucucuccagccccuggaug

SEQ ID NO: 1607992 - RNA, 18 nt, Human
ucucuccagccccuggau

SEQ ID NO: 1607993 - RNA, 17 nt, Human
ucucuccagccccugga

SEQ ID NO: 1607994 - RNA, 15 nt, Human
acuuugaccucugca

SEQ ID NO: 1607995 - RNA, 16 nt, Human
acuuugaccucugcag

SEQ ID NO: 1607996 - RNA, 18 nt, Human
acuuugaccucugcagca

SEQ ID NO: 1607997 - RNA, 14 nt, Human
acuuucugaaauaa

SEQ ID NO: 1607998 - RNA, 15 nt, Human
ucucucacuccuuga

SEQ ID NO: 1607999 - RNA, 13 nt, Human
ucucucacuccuu

SEQ ID NO: 1608000 - RNA, 21 nt, Human
ucucucacuuguuuuauuuaa

SEQ ID NO: 1608001 - RNA, 17 nt, Human
ucucucacuuguuuuau

SEQ ID NO: 1608002 - RNA, 21 nt, Human
acuugaacccgggaggcagag

SEQ ID NO: 1608003 - RNA, 19 nt, Human
acuugagcccagagugaac

SEQ ID NO: 1608004 - RNA, 20 nt, Human
acuugaacccgggaggcaga

SEQ ID NO: 1608005 - RNA, 19 nt, Human
acuugaacccgggaggcag

SEQ ID NO: 1608006 - RNA, 21 nt, Human
acuugaacccauauuuguaca

SEQ ID NO: 1608007 - RNA, 16 nt, Human
acuucuccacccugcu

SEQ ID NO: 1608008 - RNA, 15 nt, Human
acuucuccacccugc

SEQ ID NO: 1608009 - RNA, 18 nt, Human
acuucuccacccugcucu

SEQ ID NO: 1608010 - RNA, 19 nt, Human
acuugaaauuugaauuuug

SEQ ID NO: 1608011 - RNA, 20 nt, Human
acuugaaauuugaauuuugu

SEQ ID NO: 1608012 - RNA, 16 nt, Human
acuugucaauaaaauc

SEQ ID NO: 1608013 - RNA, 18 nt, Human
acuuguggacacagcucu

SEQ ID NO: 1608014 - RNA, 17 nt, Human
acuuguggacacagcuc

SEQ ID NO: 1608015 - RNA, 16 nt, Human
acuuguggacacagcu

SEQ ID NO: 1608016 - RNA, 14 nt, Human
acuugcucuugaug

SEQ ID NO: 1608017 - RNA, 23 nt, Human
acuucuaaguaaaaccacagcag

SEQ ID NO: 1608018 - RNA, 14 nt, Human
acuucuccacccug

SEQ ID NO: 1608019 - RNA, 12 nt, Human
ucucacucuguc

SEQ ID NO: 1608020 - RNA, 16 nt, Human
ucucacucugucgccc

SEQ ID NO: 1608021 - RNA, 13 nt, Human
ucucacuccuuga

SEQ ID NO: 1608022 - RNA, 16 nt, Human
ucucacuauguugccc

SEQ ID NO: 1608023 - RNA, 15 nt, Human
acuuccugugacuuc

SEQ ID NO: 1608024 - RNA, 16 nt, Human
acuucagcugacuuuu

SEQ ID NO: 1608025 - RNA, 11 nt, Human
acuucagcuga

SEQ ID NO: 1608026 - RNA, 16 nt, Human
acuucaggcucuucuc

SEQ ID NO: 1608027 - RNA, 14 nt, Human
acuucaggcucuuc

SEQ ID NO: 1608028 - RNA, 11 nt, Human
ucucacuccuu

SEQ ID NO: 1608029 - RNA, 21 nt, Human
ucucacagcuccaagaauuuc

SEQ ID NO: 1608030 - RNA, 16 nt, Human
acuuguguuuugcaag

SEQ ID NO: 1608031 - RNA, 15 nt, Human
acuuguuagaucuag

SEQ ID NO: 1608032 - RNA, 14 nt, Human
acuuguuagaucua

SEQ ID NO: 1608033 - RNA, 23 nt, Human
acuuguuagaucuaguucacucu

SEQ ID NO: 1608034 - RNA, 21 nt, Human
ucuccuccuuuucacaguucu

SEQ ID NO: 1608035 - RNA, 17 nt, Human
acuuucuagccagagga

SEQ ID NO: 1608036 - RNA, 14 nt, Human
acuuugaccucugc

SEQ ID NO: 1608037 - RNA, 16 nt, Human
ucuccauguuugaugu

SEQ ID NO: 1608038 - RNA, 12 nt, Human
ucucaggaaauc

SEQ ID NO: 1608039 - RNA, 13 nt, Human
ucucagggccugg

SEQ ID NO: 1608040 - RNA, 12 nt, Human
ucucagggccug

SEQ ID NO: 1608041 - RNA, 15 nt, Human
ucucagggccugguc

SEQ ID NO: 1608042 - RNA, 14 nt, Human
ucucagggccuggu

SEQ ID NO: 1608043 - RNA, 19 nt, Human
ucucagggccuggucguuu

SEQ ID NO: 1608044 - RNA, 16 nt, Human
ucuccaggcuguaucc

SEQ ID NO: 1608045 - RNA, 15 nt, Human
ucuccaagcaggaca

SEQ ID NO: 1608046 - RNA, 17 nt, Human
ucuccaaaauaaaacuu

SEQ ID NO: 1608047 - RNA, 19 nt, Human
ucuccaaaauaaaacuuuu

SEQ ID NO: 1608048 - RNA, 22 nt, Human
ucuccaaaauaaaacuuuuuaa

SEQ ID NO: 1608049 - RNA, 13 nt, Human
agacacaagccuu

SEQ ID NO: 1608050 - RNA, 14 nt, Human
agacacaagccuuc

SEQ ID NO: 1608051 - RNA, 12 nt, Human
agaauucuguau

SEQ ID NO: 1608052 - RNA, 17 nt, Human
agaauucucuuauccaa

SEQ ID NO: 1608053 - RNA, 19 nt, Human
agaauucucuaguuugauu

SEQ ID NO: 1608054 - RNA, 17 nt, Human
agacacacugaagaagc

SEQ ID NO: 1608055 - RNA, 17 nt, Human
agacacaggcccggcuc

SEQ ID NO: 1608056 - RNA, 16 nt, Human
agacacacugaagaag

SEQ ID NO: 1608057 - RNA, 22 nt, Human
agacacaggcccggcuccaggc

SEQ ID NO: 1608058 - RNA, 21 nt, Human
agacacaggcccggcuccagg

SEQ ID NO: 1608059 - RNA, 20 nt, Human
agacacaggcccggcuccag

SEQ ID NO: 1608060 - RNA, 19 nt, Human
agacacaggcccggcucca

SEQ ID NO: 1608061 - RNA, 24 nt, Human
agacacauguccaagaagcccagg

SEQ ID NO: 1608062 - RNA, 22 nt, Human
agacaccuugacagggcacacc

SEQ ID NO: 1608063 - RNA, 22 nt, Human
agacacauguccaagaagccca

SEQ ID NO: 1608064 - RNA, 21 nt, Human
agacacauguccaagaagccc

SEQ ID NO: 1608065 - RNA, 23 nt, Human
agacacaggcccggcuccaggcu

SEQ ID NO: 1608066 - RNA, 14 nt, Human
agacagcugccugg

SEQ ID NO: 1608067 - RNA, 13 nt, Human
agacagcugccug

SEQ ID NO: 1608068 - RNA, 12 nt, Human
agacagaaaaaa

SEQ ID NO: 1608069 - RNA, 14 nt, Human
ucuuaauuaaaaga

SEQ ID NO: 1608070 - RNA, 12 nt, Human
agacagucccug

SEQ ID NO: 1608071 - RNA, 16 nt, Human
agacagcugccuggga

SEQ ID NO: 1608072 - RNA, 15 nt, Human
agacagcugccuggg

SEQ ID NO: 1608073 - RNA, 14 nt, Human
agacagucccugcc

SEQ ID NO: 1608074 - RNA, 13 nt, Human
agacagucccugc

SEQ ID NO: 1608075 - RNA, 23 nt, Human
ucuuagaugcaguucugaagaag

SEQ ID NO: 1608076 - RNA, 12 nt, Human
ucuuagauguau

SEQ ID NO: 1608077 - RNA, 14 nt, Human
ucuuagauguauau

SEQ ID NO: 1608078 - RNA, 19 nt, Human
ucuuacugucuuuuuucua

SEQ ID NO: 1608079 - RNA, 20 nt, Human
agaauucucagaaucucaaa

SEQ ID NO: 1608080 - RNA, 20 nt, Human
agaauuauaauuaguuccuc

SEQ ID NO: 1608081 - RNA, 18 nt, Human
agaauucucuaguuugau

SEQ ID NO: 1608082 - RNA, 14 nt, Human
agaauucucuaguu

SEQ ID NO: 1608083 - RNA, 23 nt, Human
ucuggguuccuuccucugagccu

SEQ ID NO: 1608084 - RNA, 22 nt, Human
ucuggguuccuuccucugagcc

SEQ ID NO: 1608085 - RNA, 19 nt, Human
agaauuaguggcacuugcu

SEQ ID NO: 1608086 - RNA, 21 nt, Human
agaauguguuuaaacuugguu

SEQ ID NO: 1608087 - RNA, 23 nt, Human
agaaccccaggguccuguagccc

SEQ ID NO: 1608088 - RNA, 23 nt, Human
ucuguuuagauaauacaccacua

SEQ ID NO: 1608089 - RNA, 16 nt, Human
ucuguuuagauaauac

SEQ ID NO: 1608090 - RNA, 19 nt, Human
ucuguuuagauaauacacc

SEQ ID NO: 1608091 - RNA, 19 nt, Human
ucuguucugcacacagcac

SEQ ID NO: 1608092 - RNA, 18 nt, Human
ucuguucugcacacagca

SEQ ID NO: 1608093 - RNA, 17 nt, Human
ucuguucugcacacagc

SEQ ID NO: 1608094 - RNA, 19 nt, Human
ucugugaacuugaaauuug

SEQ ID NO: 1608095 - RNA, 22 nt, Human
ucugugaacuugaaauuugaau

SEQ ID NO: 1608096 - RNA, 13 nt, Human
ucuguacuuuuug

SEQ ID NO: 1608097 - RNA, 17 nt, Human
ucuguacuuuuuggcau

SEQ ID NO: 1608098 - RNA, 14 nt, Human
ucuguacuuuuugg

SEQ ID NO: 1608099 - RNA, 24 nt, Human
agagacagaaagcagaacagugau

SEQ ID NO: 1608100 - RNA, 15 nt, Human
agagacacaagccuu

SEQ ID NO: 1608101 - RNA, 22 nt, Human
agagaaaaaauauuuuccugcc

SEQ ID NO: 1608102 - RNA, 19 nt, Human
agacuuuuuuuaaauagua

SEQ ID NO: 1608103 - RNA, 18 nt, Human
agacuuguaugaaagaug

SEQ ID NO: 1608104 - RNA, 16 nt, Human
agacuguacaaaguag

SEQ ID NO: 1608105 - RNA, 15 nt, Human
agacuguacaaagua

SEQ ID NO: 1608106 - RNA, 19 nt, Human
agacuggugacugauucuu

SEQ ID NO: 1608107 - RNA, 17 nt, Human
agacuggugacugauuc

SEQ ID NO: 1608108 - RNA, 16 nt, Human
agacuggugacugauu

SEQ ID NO: 1608109 - RNA, 20 nt, Human
agacucgcgacaaugcaaac

SEQ ID NO: 1608110 - RNA, 14 nt, Human
agacuggugacuga

SEQ ID NO: 1608111 - RNA, 13 nt, Human
agacuggugacug

SEQ ID NO: 1608112 - RNA, 12 nt, Human
agacuggugacu

SEQ ID NO: 1608113 - RNA, 14 nt, Human
agacugucucaaga

SEQ ID NO: 1608114 - RNA, 19 nt, Human
agacucgcgacaaugcaaa

SEQ ID NO: 1608115 - RNA, 18 nt, Human
agacucgcgacaaugcaa

SEQ ID NO: 1608116 - RNA, 17 nt, Human
agacucgcgacaaugca

SEQ ID NO: 1608117 - RNA, 15 nt, Human
agacucgcgacaaug

SEQ ID NO: 1608118 - RNA, 17 nt, Human
ucuuucuuccucugcug

SEQ ID NO: 1608119 - RNA, 16 nt, Human
ucuuucuuccucugcu

SEQ ID NO: 1608120 - RNA, 15 nt, Human
ucuuucuuccucugc

SEQ ID NO: 1608121 - RNA, 13 nt, Human
ucuuucugcuuug

SEQ ID NO: 1608122 - RNA, 20 nt, Human
ucuuuauaauucuacuuuga

SEQ ID NO: 1608123 - RNA, 18 nt, Human
ucuuucuggcuaugcauu

SEQ ID NO: 1608124 - RNA, 19 nt, Human
ucuuucuggcuaugcauuu

SEQ ID NO: 1608125 - RNA, 14 nt, Human
ucuuucuuccucug

SEQ ID NO: 1608126 - RNA, 14 nt, Human
ucuugguuuguaaa

SEQ ID NO: 1608127 - RNA, 20 nt, Human
ucuuuaaugucacaggcagg

SEQ ID NO: 1608128 - RNA, 16 nt, Human
ucuugguuuguaaauu

SEQ ID NO: 1608129 - RNA, 22 nt, Human
ucuuuaaugucacaggcagguc

SEQ ID NO: 1608130 - RNA, 14 nt, Human
ucuuuaauuuuaca

SEQ ID NO: 1608131 - RNA, 15 nt, Human
ucuuauuucauuucu

SEQ ID NO: 1608132 - RNA, 16 nt, Human
ucuuauuucauuucuu

SEQ ID NO: 1608133 - RNA, 22 nt, Human
ucuucugcuucagccucccgag

SEQ ID NO: 1608134 - RNA, 22 nt, Human
ucuucuguacgucugacaggca

SEQ ID NO: 1608135 - RNA, 21 nt, Human
ucuucuguacgucugacaggc

SEQ ID NO: 1608136 - RNA, 14 nt, Human
agacauagaauuaa

SEQ ID NO: 1608137 - RNA, 23 nt, Human
agacauacuaaccagcagaaaug

SEQ ID NO: 1608138 - RNA, 23 nt, Human
ucuucuguacgucugacaggcaa

SEQ ID NO: 1608139 - RNA, 20 nt, Human
ucuugagccuugaacuuuga

SEQ ID NO: 1608140 - RNA, 18 nt, Human
ucuugagccuugaacuuu

SEQ ID NO: 1608141 - RNA, 19 nt, Human
ucuugagccuugaacuuug

SEQ ID NO: 1608142 - RNA, 15 nt, Human
agacucauucuucug

SEQ ID NO: 1608143 - RNA, 17 nt, Human
ucuugagccuugaacuu

SEQ ID NO: 1608144 - RNA, 21 nt, Human
agacucaguggggaggggcug

SEQ ID NO: 1608145 - RNA, 16 nt, Human
agaccugccccuccuc

SEQ ID NO: 1608146 - RNA, 23 nt, Human
agaccugccccuccucucugccc

SEQ ID NO: 1608147 - RNA, 22 nt, Human
agaccugccccuccucucugcc

SEQ ID NO: 1608148 - RNA, 14 nt, Human
agacccggcugcgu

SEQ ID NO: 1608149 - RNA, 21 nt, Human
agaccccuggcuuuucacugc

SEQ ID NO: 1608150 - RNA, 15 nt, Human
agaccccuggcuuuu

SEQ ID NO: 1608151 - RNA, 12 nt, Human
agagcagagacc

SEQ ID NO: 1608152 - RNA, 21 nt, Human
agagcaccuuagacagucccu

SEQ ID NO: 1608153 - RNA, 21 nt, Human
ucuuuggacccugaggcccag

SEQ ID NO: 1608154 - RNA, 17 nt, Human
ucuuuggacccugaggc

SEQ ID NO: 1608155 - RNA, 22 nt, Human
agagauuuuuuuguuguuuguu

SEQ ID NO: 1608156 - RNA, 23 nt, Human
agagauuuuuuuguuguuuguuu

SEQ ID NO: 1608157 - RNA, 18 nt, Human
agagcagagaccaucccu

SEQ ID NO: 1608158 - RNA, 17 nt, Human
agagcagagaccauccc

SEQ ID NO: 1608159 - RNA, 20 nt, Human
agagcagagaccaucccuga

SEQ ID NO: 1608160 - RNA, 21 nt, Human
agagccuugcggaagguucua

SEQ ID NO: 1608161 - RNA, 11 nt, Human
agagccuugcg

SEQ ID NO: 1608162 - RNA, 23 nt, Human
ugaaauaagccagacaucaacag

SEQ ID NO: 1608163 - RNA, 20 nt, Human
ugaaauaagccagacaucaa

SEQ ID NO: 1608164 - RNA, 18 nt, Human
ugaaauaagccagacauc

SEQ ID NO: 1608165 - RNA, 17 nt, Human
ugaaauaagccagacau

SEQ ID NO: 1608166 - RNA, 15 nt, Human
agagcugcccucucc

SEQ ID NO: 1608167 - RNA, 13 nt, Human
agagcugcccucu

SEQ ID NO: 1608168 - RNA, 14 nt, Human
agagcugcccucuc

SEQ ID NO: 1608169 - RNA, 18 nt, Human
agagcugccaccugccug

SEQ ID NO: 1608170 - RNA, 18 nt, Human
ugaaauauuauguuaaaa

SEQ ID NO: 1608171 - RNA, 15 nt, Human
ugaaauuguauuaca

SEQ ID NO: 1608172 - RNA, 23 nt, Human
ugaaauuuccugggagcuuuugu

SEQ ID NO: 1608173 - RNA, 21 nt, Human
ugaaauuguaauuauaucuga

SEQ ID NO: 1608174 - RNA, 16 nt, Human
ugaaauuugaauuuug

SEQ ID NO: 1608175 - RNA, 15 nt, Human
ugaaauuugaauuuu

SEQ ID NO: 1608176 - RNA, 14 nt, Human
ugaaauuugaauuu

SEQ ID NO: 1608177 - RNA, 17 nt, Human
ugaaauuugaauuuugu

SEQ ID NO: 1608178 - RNA, 20 nt, Human
ugaacaaauuuacagagaca

SEQ ID NO: 1608179 - RNA, 19 nt, Human
ugaacaaauuuacagagac

SEQ ID NO: 1608180 - RNA, 15 nt, Human
ugaaauuuuuauuaa

SEQ ID NO: 1608181 - RNA, 15 nt, Human
ugaacuccuggccuc

SEQ ID NO: 1608182 - RNA, 14 nt, Human
ugaacuccuggccu

SEQ ID NO: 1608183 - RNA, 12 nt, Human
ugaacuccuggc

SEQ ID NO: 1608184 - RNA, 21 nt, Human
ugaacuaggauuguaguccca

SEQ ID NO: 1608185 - RNA, 22 nt, Human
agagcugcccucuccugggcag

SEQ ID NO: 1608186 - RNA, 19 nt, Human
ugaacuuugaccucugcag

SEQ ID NO: 1608187 - RNA, 20 nt, Human
ugaacuuugaccucugcagc

SEQ ID NO: 1608188 - RNA, 22 nt, Human
ugaacuuugaccucugcagcaa

SEQ ID NO: 1608189 - RNA, 21 nt, Human
agagcuguucacagccagacu

SEQ ID NO: 1608190 - RNA, 15 nt, Human
agagcuuaacagugu

SEQ ID NO: 1608191 - RNA, 15 nt, Human
agagguugcagugag

SEQ ID NO: 1608192 - RNA, 19 nt, Human
agagguccacaacacacag

SEQ ID NO: 1608193 - RNA, 13 nt, Human
agaggcugaggac

SEQ ID NO: 1608194 - RNA, 22 nt, Human
ugaagcacagugaucaaguuau

SEQ ID NO: 1608195 - RNA, 12 nt, Human
agagguuuuaaa

SEQ ID NO: 1608196 - RNA, 19 nt, Human
agaggcagccccauucugc

SEQ ID NO: 1608197 - RNA, 13 nt, Human
agaggcagcccca

SEQ ID NO: 1608198 - RNA, 13 nt, Human
agaggcagggucu

SEQ ID NO: 1608199 - RNA, 10 nt, Human
agaggcaggg

SEQ ID NO: 1608200 - RNA, 21 nt, Human
agaggcagggucucacucugu

SEQ ID NO: 1608201 - RNA, 19 nt, Human
agaggccaugggccuccug

SEQ ID NO: 1608202 - RNA, 21 nt, Human
ugacauuguuggccaaagcca

SEQ ID NO: 1608203 - RNA, 20 nt, Human
ugacauuguuggccaaagcc

SEQ ID NO: 1608204 - RNA, 18 nt, Human
ugaccaaugauggucacc

SEQ ID NO: 1608205 - RNA, 15 nt, Human
agaucagccugggca

SEQ ID NO: 1608206 - RNA, 13 nt, Human
agaucagccuggg

SEQ ID NO: 1608207 - RNA, 12 nt, Human
agaucauuguga

SEQ ID NO: 1608208 - RNA, 20 nt, Human
ugacagggcacaccgggcac

SEQ ID NO: 1608209 - RNA, 21 nt, Human
ugacagggcacaccgggcacu

SEQ ID NO: 1608210 - RNA, 16 nt, Human
ugacagggcacaccgg

SEQ ID NO: 1608211 - RNA, 11 nt, Human
ugacagggcac

SEQ ID NO: 1608212 - RNA, 21 nt, Human
ugacacacagcucuguccugg

SEQ ID NO: 1608213 - RNA, 20 nt, Human
ugacaggcaaugcuggcugu

SEQ ID NO: 1608214 - RNA, 17 nt, Human
ugacccacaagaaauga

SEQ ID NO: 1608215 - RNA, 13 nt, Human
ugacccacugcuu

SEQ ID NO: 1608216 - RNA, 12 nt, Human
ugacccacugcu

SEQ ID NO: 1608217 - RNA, 15 nt, Human
agaugcuucucacug

SEQ ID NO: 1608218 - RNA, 16 nt, Human
agaugcuucucacugc

SEQ ID NO: 1608219 - RNA, 15 nt, Human
agaugcuagaacucc

SEQ ID NO: 1608220 - RNA, 14 nt, Human
agaugcuagaacuc

SEQ ID NO: 1608221 - RNA, 20 nt, Human
agaugcaguucugaagaaga

SEQ ID NO: 1608222 - RNA, 19 nt, Human
agaugcaguucugaagaag

SEQ ID NO: 1608223 - RNA, 18 nt, Human
agaugcaguucugaagaa

SEQ ID NO: 1608224 - RNA, 15 nt, Human
agaugcaccagcccu

SEQ ID NO: 1608225 - RNA, 14 nt, Human
agaugcaccagccc

SEQ ID NO: 1608226 - RNA, 14 nt, Human
agagugaacaaauu

SEQ ID NO: 1608227 - RNA, 17 nt, Human
agaguugauacuacagu

SEQ ID NO: 1608228 - RNA, 20 nt, Human
agaguugauacuacaguuug

SEQ ID NO: 1608229 - RNA, 22 nt, Human
agaguugauacuacaguuuguu

SEQ ID NO: 1608230 - RNA, 17 nt, Human
agaguuuagcuggaaaa

SEQ ID NO: 1608231 - RNA, 16 nt, Human
agaguuuagcuggaaa

SEQ ID NO: 1608232 - RNA, 16 nt, Human
agaguuguuacauuuu

SEQ ID NO: 1608233 - RNA, 12 nt, Human
agaguuguuaca

SEQ ID NO: 1608234 - RNA, 20 nt, Human
agaguugaugguuguacaua

SEQ ID NO: 1608235 - RNA, 20 nt, Human
ugaaugguuuucaaaauaaa

SEQ ID NO: 1608236 - RNA, 19 nt, Human
ugaaugucagugugacuga

SEQ ID NO: 1608237 - RNA, 18 nt, Human
agaucacgccacugcacu

SEQ ID NO: 1608238 - RNA, 17 nt, Human
agaucacgccacugcac

SEQ ID NO: 1608239 - RNA, 21 nt, Human
ugaauuuauuggcuuuucuga

SEQ ID NO: 1608240 - RNA, 15 nt, Human
ugaauuucuuuugcc

SEQ ID NO: 1608241 - RNA, 16 nt, Human
ugaauuuuacauggcu

SEQ ID NO: 1608242 - RNA, 23 nt, Human
ugaauuuauuggcuuuucugauc

SEQ ID NO: 1608243 - RNA, 22 nt, Human
ugaauuuauuggcuuuucugau

SEQ ID NO: 1608244 - RNA, 16 nt, Human
agaucacgccacugca

SEQ ID NO: 1608245 - RNA, 15 nt, Human
agaucacgccacugc

SEQ ID NO: 1608246 - RNA, 14 nt, Human
agaucacgccacug

SEQ ID NO: 1608247 - RNA, 14 nt, Human
agauacuggauugu

SEQ ID NO: 1608248 - RNA, 12 nt, Human
agauaaaugugc

SEQ ID NO: 1608249 - RNA, 17 nt, Human
agauaaagguucaugca

SEQ ID NO: 1608250 - RNA, 15 nt, Human
agauacugaaauaaa

SEQ ID NO: 1608251 - RNA, 13 nt, Human
agauacugaaaua

SEQ ID NO: 1608252 - RNA, 12 nt, Human
agauacugaaau

SEQ ID NO: 1608253 - RNA, 14 nt, Human
ugauacaaugcugu

SEQ ID NO: 1608254 - RNA, 15 nt, Human
ugauacaaugcugug

SEQ ID NO: 1608255 - RNA, 23 nt, Human
ugagugggggaucacagccucug

SEQ ID NO: 1608256 - RNA, 21 nt, Human
ugagugggggaucacagccuc

SEQ ID NO: 1608257 - RNA, 14 nt, Human
ugagugccuuacac

SEQ ID NO: 1608258 - RNA, 13 nt, Human
ugagugccuuaca

SEQ ID NO: 1608259 - RNA, 17 nt, Human
ugagugcagcucuggag

SEQ ID NO: 1608260 - RNA, 16 nt, Human
ugagugccuuacacaa

SEQ ID NO: 1608261 - RNA, 13 nt, Human
ugaguccagaagu

SEQ ID NO: 1608262 - RNA, 14 nt, Human
ugaguacuacaguc

SEQ ID NO: 1608263 - RNA, 20 nt, Human
ugaguacguugugcauuugg

SEQ ID NO: 1608264 - RNA, 18 nt, Human
ugagucaccaagcccagu

SEQ ID NO: 1608265 - RNA, 13 nt, Human
agcauaccaacac

SEQ ID NO: 1608266 - RNA, 23 nt, Human
agcauaaaaauuagccaagugug

SEQ ID NO: 1608267 - RNA, 22 nt, Human
agcauaccaacacgagcaggcu

SEQ ID NO: 1608268 - RNA, 19 nt, Human
agcauaccaacacgagcag

SEQ ID NO: 1608269 - RNA, 15 nt, Human
agcauauauuuuuau

SEQ ID NO: 1608270 - RNA, 16 nt, Human
ugaguacguugugcau

SEQ ID NO: 1608271 - RNA, 17 nt, Human
ugaguacguugugcauu

SEQ ID NO: 1608272 - RNA, 18 nt, Human
ugaguacguugugcauuu

SEQ ID NO: 1608273 - RNA, 19 nt, Human
ugaguacguugugcauuug

SEQ ID NO: 1608274 - RNA, 22 nt, Human
agcauauauuuuuauauuuacu

SEQ ID NO: 1608275 - RNA, 20 nt, Human
agcauauauuuuuauauuua

SEQ ID NO: 1608276 - RNA, 18 nt, Human
agcauauauuuuuauauu

SEQ ID NO: 1608277 - RNA, 19 nt, Human
agcagucaggaaagagaac

SEQ ID NO: 1608278 - RNA, 19 nt, Human
agcauaaaaauuagccaag

SEQ ID NO: 1608279 - RNA, 14 nt, Human
agcaguuugcuuug

SEQ ID NO: 1608280 - RNA, 18 nt, Human
agcagucaggaaagagaa

SEQ ID NO: 1608281 - RNA, 17 nt, Human
agcagucaggaaagaga

SEQ ID NO: 1608282 - RNA, 20 nt, Human
agcaggcuacugucagcucc

SEQ ID NO: 1608283 - RNA, 19 nt, Human
agcaggcuacugucagcuc

SEQ ID NO: 1608284 - RNA, 17 nt, Human
agcaggcuacugucagc

SEQ ID NO: 1608285 - RNA, 16 nt, Human
agcaggcuacugucag

SEQ ID NO: 1608286 - RNA, 14 nt, Human
agcaggcuacuguc

SEQ ID NO: 1608287 - RNA, 11 nt, Human
agcagccacau

SEQ ID NO: 1608288 - RNA, 15 nt, Human
agcagccacauuccu

SEQ ID NO: 1608289 - RNA, 13 nt, Human
agcaggacaugga

SEQ ID NO: 1608290 - RNA, 16 nt, Human
agcagcagggagggcu

SEQ ID NO: 1608291 - RNA, 19 nt, Human
ugacccaugcugcccugug

SEQ ID NO: 1608292 - RNA, 18 nt, Human
ugacccaugcugcccugu

SEQ ID NO: 1608293 - RNA, 20 nt, Human
ugacccaugcugcccuguga

SEQ ID NO: 1608294 - RNA, 19 nt, Human
agcagggcauggcugggaa

SEQ ID NO: 1608295 - RNA, 20 nt, Human
agcagggagggcuucugcca

SEQ ID NO: 1608296 - RNA, 15 nt, Human
agcagggcucagcgg

SEQ ID NO: 1608297 - RNA, 14 nt, Human
agcagggcucagcg

SEQ ID NO: 1608298 - RNA, 13 nt, Human
agcagggcucagc

SEQ ID NO: 1608299 - RNA, 22 nt, Human
agcagggcucagcggggacagc

SEQ ID NO: 1608300 - RNA, 19 nt, Human
agcaggcucucaggccagc

SEQ ID NO: 1608301 - RNA, 18 nt, Human
agcaggcucucaggccag

SEQ ID NO: 1608302 - RNA, 17 nt, Human
agcaggcucucaggcca

SEQ ID NO: 1608303 - RNA, 16 nt, Human
agcaggcucucaggcc

SEQ ID NO: 1608304 - RNA, 15 nt, Human
agcaggcucucaggc

SEQ ID NO: 1608305 - RNA, 14 nt, Human
agcaggcucucagg

SEQ ID NO: 1608306 - RNA, 13 nt, Human
agcaggcucucag

SEQ ID NO: 1608307 - RNA, 17 nt, Human
agcaggcucgggcuccc

SEQ ID NO: 1608308 - RNA, 23 nt, Human
agcaggcucucaggccagcugcu

SEQ ID NO: 1608309 - RNA, 22 nt, Human
agcaggcucucaggccagcugc

SEQ ID NO: 1608310 - RNA, 21 nt, Human
agcaggcucucaggccagcug

SEQ ID NO: 1608311 - RNA, 15 nt, Human
agcagggaaacagcu

SEQ ID NO: 1608312 - RNA, 14 nt, Human
agcagggaaacagc

SEQ ID NO: 1608313 - RNA, 13 nt, Human
agcagggaaacag

SEQ ID NO: 1608314 - RNA, 15 nt, Human
agcaggcugugaguu

SEQ ID NO: 1608315 - RNA, 22 nt, Human
agcauuuagauguauagguuga

SEQ ID NO: 1608316 - RNA, 22 nt, Human
agcauucucacuccuaccuggu

SEQ ID NO: 1608317 - RNA, 20 nt, Human
agcauucucacuccuaccug

SEQ ID NO: 1608318 - RNA, 18 nt, Human
agcauucucacuccuacc

SEQ ID NO: 1608319 - RNA, 19 nt, Human
agcauggcugccaauggga

SEQ ID NO: 1608320 - RNA, 17 nt, Human
agcauuagauuucucau

SEQ ID NO: 1608321 - RNA, 15 nt, Human
agcauuuugcuaaau

SEQ ID NO: 1608322 - RNA, 22 nt, Human
agcauuuugcuaaaugugaaug

SEQ ID NO: 1608323 - RNA, 18 nt, Human
agccaaacauccuacaag

SEQ ID NO: 1608324 - RNA, 18 nt, Human
agcauuuguguugaagag

SEQ ID NO: 1608325 - RNA, 17 nt, Human
agcauuuguguugaaga

SEQ ID NO: 1608326 - RNA, 21 nt, Human
agcauauucaggaagcucagg

SEQ ID NO: 1608327 - RNA, 19 nt, Human
agcauauucaggaagcuca

SEQ ID NO: 1608328 - RNA, 17 nt, Human
agcauauucaggaagcu

SEQ ID NO: 1608329 - RNA, 14 nt, Human
ugaucacggcucac

SEQ ID NO: 1608330 - RNA, 13 nt, Human
ugaucacggcuca

SEQ ID NO: 1608331 - RNA, 15 nt, Human
ugaucacggcucacu

SEQ ID NO: 1608332 - RNA, 18 nt, Human
ugaucacggcucacugca

SEQ ID NO: 1608333 - RNA, 14 nt, Human
ugaucaccugcccu

SEQ ID NO: 1608334 - RNA, 18 nt, Human
ugauacaaugcugugccc

SEQ ID NO: 1608335 - RNA, 12 nt, Human
agcaucaggcca

SEQ ID NO: 1608336 - RNA, 21 nt, Human
agcaucaggccaggcccucug

SEQ ID NO: 1608337 - RNA, 22 nt, Human
agcaucaggccaggcccucugc

SEQ ID NO: 1608338 - RNA, 23 nt, Human
agcaucaggccaggcccucugcc

SEQ ID NO: 1608339 - RNA, 13 nt, Human
agcauccuggaau

SEQ ID NO: 1608340 - RNA, 15 nt, Human
agcauccuggaauau

SEQ ID NO: 1608341 - RNA, 14 nt, Human
agcauccuggaaua

SEQ ID NO: 1608342 - RNA, 13 nt, Human
agcauggcugcca

SEQ ID NO: 1608343 - RNA, 14 nt, Human
ugaugggaaagcau

SEQ ID NO: 1608344 - RNA, 13 nt, Human
ugauggggcccug

SEQ ID NO: 1608345 - RNA, 22 nt, Human
ugaugggcaacccccagccugc

SEQ ID NO: 1608346 - RNA, 21 nt, Human
ugaugaucuuugcagacaggc

SEQ ID NO: 1608347 - RNA, 20 nt, Human
ugaugaucuuugcagacagg

SEQ ID NO: 1608348 - RNA, 19 nt, Human
ugaugaucuuugcagacag

SEQ ID NO: 1608349 - RNA, 23 nt, Human
ugaugaaaugaggucagagccug

SEQ ID NO: 1608350 - RNA, 18 nt, Human
ugaugaaauguaaauacu

SEQ ID NO: 1608351 - RNA, 15 nt, Human
ugaucuaggaagacu

SEQ ID NO: 1608352 - RNA, 14 nt, Human
ugaucuaggaagac

SEQ ID NO: 1608353 - RNA, 22 nt, Human
ugaugaaaugaggucagagccu

SEQ ID NO: 1608354 - RNA, 16 nt, Human
ugauuaaguaaugaua

SEQ ID NO: 1608355 - RNA, 16 nt, Human
agccacggccaggcca

SEQ ID NO: 1608356 - RNA, 15 nt, Human
ugauuaaguaaugau

SEQ ID NO: 1608357 - RNA, 17 nt, Human
ugauuaaauucuugcaa

SEQ ID NO: 1608358 - RNA, 13 nt, Human
ugauuaaauucuu

SEQ ID NO: 1608359 - RNA, 16 nt, Human
ugauuaaauucuugca

SEQ ID NO: 1608360 - RNA, 22 nt, Human
ugauggggcccugccuccuuug

SEQ ID NO: 1608361 - RNA, 23 nt, Human
ugauggguuaguggauggaaggg

SEQ ID NO: 1608362 - RNA, 19 nt, Human
ugauggguuaguggaugga

SEQ ID NO: 1608363 - RNA, 19 nt, Human
ugauguuuuccaugagucc

SEQ ID NO: 1608364 - RNA, 23 nt, Human
ugauguuuuccaugaguccccug

SEQ ID NO: 1608365 - RNA, 17 nt, Human
ugauguuuuccaugagu

SEQ ID NO: 1608366 - RNA, 21 nt, Human
ugauguuuuaaggaugcuugu

SEQ ID NO: 1608367 - RNA, 13 nt, Human
agccaccacgccc

SEQ ID NO: 1608368 - RNA, 20 nt, Human
ugauccucccaccucagccu

SEQ ID NO: 1608369 - RNA, 19 nt, Human
ugauccucccaccucagcc

SEQ ID NO: 1608370 - RNA, 13 nt, Human
ugaucuaggaaga

SEQ ID NO: 1608371 - RNA, 22 nt, Human
ugauccuaaugaaugcauaaaa

SEQ ID NO: 1608372 - RNA, 18 nt, Human
ugauccucccaccucagc

SEQ ID NO: 1608373 - RNA, 23 nt, Human
ugauccagaaagaaaacuuguau

SEQ ID NO: 1608374 - RNA, 19 nt, Human
ugauccagcagauuauuca

SEQ ID NO: 1608375 - RNA, 20 nt, Human
ugauccagcagauuauucac

SEQ ID NO: 1608376 - RNA, 13 nt, Human
ugauccagaaaga

SEQ ID NO: 1608377 - RNA, 14 nt, Human
ugauccacucgccu

SEQ ID NO: 1608378 - RNA, 18 nt, Human
ugauccacucgccuucau

SEQ ID NO: 1608379 - RNA, 22 nt, Human
ugcaaagcacugacuucuaagu

SEQ ID NO: 1608380 - RNA, 20 nt, Human
ugcaaagcacugacuucuaa

SEQ ID NO: 1608381 - RNA, 18 nt, Human
ugcaaagcacugacuucu

SEQ ID NO: 1608382 - RNA, 20 nt, Human
ugcaaaccaucauugaaauc

SEQ ID NO: 1608383 - RNA, 18 nt, Human
ugcaaaccaucauugaaa

SEQ ID NO: 1608384 - RNA, 21 nt, Human
ugcaaaggguaucaggugcug

SEQ ID NO: 1608385 - RNA, 17 nt, Human
ugcaaagcccagcuuga

SEQ ID NO: 1608386 - RNA, 15 nt, Human
ugcaaagcccagcuu

SEQ ID NO: 1608387 - RNA, 14 nt, Human
ugcaaagcccagcu

SEQ ID NO: 1608388 - RNA, 20 nt, Human
ugcaaaguaucccuacugua

SEQ ID NO: 1608389 - RNA, 23 nt, Human
ugcaaaguucccuacuuccugug

SEQ ID NO: 1608390 - RNA, 13 nt, Human
ugauuucauucaa

SEQ ID NO: 1608391 - RNA, 18 nt, Human
agccacggccaggccaga

SEQ ID NO: 1608392 - RNA, 17 nt, Human
agccacggccaggccag

SEQ ID NO: 1608393 - RNA, 13 nt, Human
ugcaaaccaucau

SEQ ID NO: 1608394 - RNA, 12 nt, Human
ugcaaaccauca

SEQ ID NO: 1608395 - RNA, 12 nt, Human
ugauuuggaaaa

SEQ ID NO: 1608396 - RNA, 18 nt, Human
ugauuuccguuaaaauac

SEQ ID NO: 1608397 - RNA, 23 nt, Human
ugauuugacauagucuggcugua

SEQ ID NO: 1608398 - RNA, 21 nt, Human
ugcaagccagauuuuccugaa

SEQ ID NO: 1608399 - RNA, 15 nt, Human
ugcaagccagauuuu

SEQ ID NO: 1608400 - RNA, 13 nt, Human
ugcaacaggcugg

SEQ ID NO: 1608401 - RNA, 17 nt, Human
ugcaauaaaauggguuu

SEQ ID NO: 1608402 - RNA, 21 nt, Human
ugcaauaaaauggguuuuacu

SEQ ID NO: 1608403 - RNA, 12 nt, Human
agcccaggccuc

SEQ ID NO: 1608404 - RNA, 15 nt, Human
ugcaaggucauuuuu

SEQ ID NO: 1608405 - RNA, 18 nt, Human
agccccgugggguuccuc

SEQ ID NO: 1608406 - RNA, 21 nt, Human
agcccaggccuccuacagcuu

SEQ ID NO: 1608407 - RNA, 19 nt, Human
agcccaggccuccuacagc

SEQ ID NO: 1608408 - RNA, 14 nt, Human
agcccaggccuccu

SEQ ID NO: 1608409 - RNA, 14 nt, Human
agccccgaggccuu

SEQ ID NO: 1608410 - RNA, 16 nt, Human
agccccgaggccuucu

SEQ ID NO: 1608411 - RNA, 15 nt, Human
agcccgggcucugcc

SEQ ID NO: 1608412 - RNA, 14 nt, Human
agcccgggcucugc

SEQ ID NO: 1608413 - RNA, 13 nt, Human
agcccgggcucug

SEQ ID NO: 1608414 - RNA, 19 nt, Human
agccccuucugacccaugc

SEQ ID NO: 1608415 - RNA, 16 nt, Human
agccccuucugaccca

SEQ ID NO: 1608416 - RNA, 15 nt, Human
agccccuucugaccc

SEQ ID NO: 1608417 - RNA, 14 nt, Human
agccccuucugacc

SEQ ID NO: 1608418 - RNA, 19 nt, Human
agcccugcagagggcacag

SEQ ID NO: 1608419 - RNA, 16 nt, Human
agcccugcagagggca

SEQ ID NO: 1608420 - RNA, 15 nt, Human
agcccugcagagggc

SEQ ID NO: 1608421 - RNA, 14 nt, Human
agcccugcagaggg

SEQ ID NO: 1608422 - RNA, 16 nt, Human
agcccgggcucugccu

SEQ ID NO: 1608423 - RNA, 15 nt, Human
ugcacuccagccuga

SEQ ID NO: 1608424 - RNA, 14 nt, Human
ugcacuccagccug

SEQ ID NO: 1608425 - RNA, 18 nt, Human
ugcaccggcuggccuggc

SEQ ID NO: 1608426 - RNA, 16 nt, Human
ugcaccggcuggccug

SEQ ID NO: 1608427 - RNA, 15 nt, Human
ugcaccggcuggccu

SEQ ID NO: 1608428 - RNA, 14 nt, Human
ugcaccggcuggcc

SEQ ID NO: 1608429 - RNA, 17 nt, Human
ugcacuccagccugagc

SEQ ID NO: 1608430 - RNA, 15 nt, Human
ugcacuccagccugg

SEQ ID NO: 1608431 - RNA, 16 nt, Human
ugcacuccagccuggg

SEQ ID NO: 1608432 - RNA, 22 nt, Human
ugcagaagacaguauggcagcu

SEQ ID NO: 1608433 - RNA, 13 nt, Human
ugcaccagcccuu

SEQ ID NO: 1608434 - RNA, 21 nt, Human
ugcaccacugcacuccagccu

SEQ ID NO: 1608435 - RNA, 20 nt, Human
agcccugggaggcucuggag

SEQ ID NO: 1608436 - RNA, 18 nt, Human
agcccugggaggcucugg

SEQ ID NO: 1608437 - RNA, 17 nt, Human
agcccugggaggcucug

SEQ ID NO: 1608438 - RNA, 17 nt, Human
ugccaguuauggcuaua

SEQ ID NO: 1608439 - RNA, 13 nt, Human
ugccauaauuacu

SEQ ID NO: 1608440 - RNA, 22 nt, Human
ugccagccgagauagccaaggc

SEQ ID NO: 1608441 - RNA, 17 nt, Human
ugccagccgagauagcc

SEQ ID NO: 1608442 - RNA, 16 nt, Human
ugcauuuaaaagauac

SEQ ID NO: 1608443 - RNA, 14 nt, Human
ugccaaugggagcu

SEQ ID NO: 1608444 - RNA, 13 nt, Human
ugccaauggacua

SEQ ID NO: 1608445 - RNA, 18 nt, Human
ugccaaugggagcucaug

SEQ ID NO: 1608446 - RNA, 19 nt, Human
agccuugcggaagguucua

SEQ ID NO: 1608447 - RNA, 21 nt, Human
agccuugaccauucuccaccu

SEQ ID NO: 1608448 - RNA, 19 nt, Human
agccuugaccauucuccac

SEQ ID NO: 1608449 - RNA, 18 nt, Human
agccuugaccauucucca

SEQ ID NO: 1608450 - RNA, 22 nt, Human
agccuugaccauucuccaccug

SEQ ID NO: 1608451 - RNA, 16 nt, Human
agccuugggaccccug

SEQ ID NO: 1608452 - RNA, 20 nt, Human
agccuuagaagucacacagu

SEQ ID NO: 1608453 - RNA, 22 nt, Human
agccuuagaagucacacaguau

SEQ ID NO: 1608454 - RNA, 15 nt, Human
agccuguuuaagaga

SEQ ID NO: 1608455 - RNA, 13 nt, Human
agccuugaacuuu

SEQ ID NO: 1608456 - RNA, 19 nt, Human
agccugugccucugggacu

SEQ ID NO: 1608457 - RNA, 18 nt, Human
agccugugccucugggac

SEQ ID NO: 1608458 - RNA, 17 nt, Human
agccugugccucuggga

SEQ ID NO: 1608459 - RNA, 19 nt, Human
ugcauacucauuaggaugg

SEQ ID NO: 1608460 - RNA, 21 nt, Human
ugcauaccacuuuuguucuug

SEQ ID NO: 1608461 - RNA, 13 nt, Human
ugcauacucauua

SEQ ID NO: 1608462 - RNA, 20 nt, Human
ugcauagauucccugagcag

SEQ ID NO: 1608463 - RNA, 17 nt, Human
ugcauagaauaaaauuu

SEQ ID NO: 1608464 - RNA, 16 nt, Human
ugcauaccacuuuugu

SEQ ID NO: 1608465 - RNA, 18 nt, Human
ugcauaccacuuuuguuc

SEQ ID NO: 1608466 - RNA, 20 nt, Human
ugcauaccacuuuuguucuu

SEQ ID NO: 1608467 - RNA, 15 nt, Human
ugcaucucagcccac

SEQ ID NO: 1608468 - RNA, 14 nt, Human
ugcaucucagccca

SEQ ID NO: 1608469 - RNA, 13 nt, Human
ugcaucucagccc

SEQ ID NO: 1608470 - RNA, 18 nt, Human
ugcaugcugucccuuacg

SEQ ID NO: 1608471 - RNA, 21 nt, Human
ugcaugcugucccuuacguga

SEQ ID NO: 1608472 - RNA, 19 nt, Human
ugcaugcugucccuuacgu

SEQ ID NO: 1608473 - RNA, 18 nt, Human
ugcagccucacaguccuu

SEQ ID NO: 1608474 - RNA, 21 nt, Human
ugcagccucacaguccuuacc

SEQ ID NO: 1608475 - RNA, 22 nt, Human
ugcaggucccuaauaaagcugu

SEQ ID NO: 1608476 - RNA, 11 nt, Human
ugcaggucccu

SEQ ID NO: 1608477 - RNA, 18 nt, Human
agccuccugcccuuaccu

SEQ ID NO: 1608478 - RNA, 14 nt, Human
agccuccugcccuu

SEQ ID NO: 1608479 - RNA, 13 nt, Human
agccuccugcccu

SEQ ID NO: 1608480 - RNA, 21 nt, Human
ugcagacaggcaagcaccucc

SEQ ID NO: 1608481 - RNA, 13 nt, Human
ugcagacaggcaa

SEQ ID NO: 1608482 - RNA, 12 nt, Human
ugcagacaggca

SEQ ID NO: 1608483 - RNA, 17 nt, Human
ugcuuuuaaaaaaaaau

SEQ ID NO: 1608484 - RNA, 18 nt, Human
ugcuuuuggucuguguga

SEQ ID NO: 1608485 - RNA, 23 nt, Human
ugcuuuuuaauauugauaugcuu

SEQ ID NO: 1608486 - RNA, 20 nt, Human
ugcuuuugucuaugggacuc

SEQ ID NO: 1608487 - RNA, 22 nt, Human
ugcuuugugauuuuuguaauuu

SEQ ID NO: 1608488 - RNA, 17 nt, Human
ugcuuugggcugcccug

SEQ ID NO: 1608489 - RNA, 16 nt, Human
ugcuuugggcugcccu

SEQ ID NO: 1608490 - RNA, 15 nt, Human
ugcuugagcucagga

SEQ ID NO: 1608491 - RNA, 17 nt, Human
aggagccuccugcccuu

SEQ ID NO: 1608492 - RNA, 15 nt, Human
ugcuuugggcugccc

SEQ ID NO: 1608493 - RNA, 14 nt, Human
ugcuuugggcugcc

SEQ ID NO: 1608494 - RNA, 16 nt, Human
uggaagacagcucuua

SEQ ID NO: 1608495 - RNA, 23 nt, Human
uggaaauuuguuauaaugaauga

SEQ ID NO: 1608496 - RNA, 21 nt, Human
uggaaauuuguuauaaugaau

SEQ ID NO: 1608497 - RNA, 16 nt, Human
ugcuuuuuauggccug

SEQ ID NO: 1608498 - RNA, 17 nt, Human
ugcuuuuucucaaaaug

SEQ ID NO: 1608499 - RNA, 19 nt, Human
aggauucuuccucccuccc

SEQ ID NO: 1608500 - RNA, 17 nt, Human
aggauucuuccucccuc

SEQ ID NO: 1608501 - RNA, 23 nt, Human
aggaugaucuaggaagacuuugg

SEQ ID NO: 1608502 - RNA, 22 nt, Human
aggaugaucuaggaagacuuug

SEQ ID NO: 1608503 - RNA, 22 nt, Human
aggaugcacagaguuguuacau

SEQ ID NO: 1608504 - RNA, 13 nt, Human
aggaucagucuga

SEQ ID NO: 1608505 - RNA, 13 nt, Human
aggagcagccaca

SEQ ID NO: 1608506 - RNA, 12 nt, Human
aggagcagccac

SEQ ID NO: 1608507 - RNA, 16 nt, Human
aggagccuccugcccu

SEQ ID NO: 1608508 - RNA, 17 nt, Human
aggagccccgaggccuu

SEQ ID NO: 1608509 - RNA, 14 nt, Human
aggagcagccacau

SEQ ID NO: 1608510 - RNA, 19 nt, Human
aggagaaacuggaacucuc

SEQ ID NO: 1608511 - RNA, 18 nt, Human
aggagaaacuggaacucu

SEQ ID NO: 1608512 - RNA, 23 nt, Human
aggacuuuucuuuguggcuuccu

SEQ ID NO: 1608513 - RNA, 22 nt, Human
aggacuuuucuuuguggcuucc

SEQ ID NO: 1608514 - RNA, 19 nt, Human
aggacuuuucuuuguggcu

SEQ ID NO: 1608515 - RNA, 17 nt, Human
aggacuuuucuuugugg

SEQ ID NO: 1608516 - RNA, 23 nt, Human
aggacuucuuuaauuuuggaauu

SEQ ID NO: 1608517 - RNA, 22 nt, Human
aggacuucuuuaauuuuggaau

SEQ ID NO: 1608518 - RNA, 21 nt, Human
aggacuucuuuaauuuuggaa

SEQ ID NO: 1608519 - RNA, 16 nt, Human
aggacuucuuuaauuu

SEQ ID NO: 1608520 - RNA, 14 nt, Human
aggacuucuuuaau

SEQ ID NO: 1608521 - RNA, 19 nt, Human
aggacucugccuccucuuc

SEQ ID NO: 1608522 - RNA, 18 nt, Human
aggacucugccuccucuu

SEQ ID NO: 1608523 - RNA, 17 nt, Human
aggacucugccuccucu

SEQ ID NO: 1608524 - RNA, 16 nt, Human
aggacucugccuccuc

SEQ ID NO: 1608525 - RNA, 14 nt, Human
aggacucugccucc

SEQ ID NO: 1608526 - RNA, 13 nt, Human
aggacucugccuc

SEQ ID NO: 1608527 - RNA, 12 nt, Human
aggacucugccu

SEQ ID NO: 1608528 - RNA, 20 nt, Human
aggacgcucucuggccuucg

SEQ ID NO: 1608529 - RNA, 19 nt, Human
aggacgcucucuggccuuc

SEQ ID NO: 1608530 - RNA, 17 nt, Human
aggacgcucucuggccu

SEQ ID NO: 1608531 - RNA, 16 nt, Human
aggacgcucucuggcc

SEQ ID NO: 1608532 - RNA, 14 nt, Human
aggacgcucucugg

SEQ ID NO: 1608533 - RNA, 13 nt, Human
aggacgcucucug

SEQ ID NO: 1608534 - RNA, 15 nt, Human
aggaauucuguauag

SEQ ID NO: 1608535 - RNA, 14 nt, Human
aggaauucuguaua

SEQ ID NO: 1608536 - RNA, 13 nt, Human
aggaauucuguau

SEQ ID NO: 1608537 - RNA, 15 nt, Human
aggacuaggguccug

SEQ ID NO: 1608538 - RNA, 18 nt, Human
aggacuaggguccugggg

SEQ ID NO: 1608539 - RNA, 16 nt, Human
aggacuaggguccugg

SEQ ID NO: 1608540 - RNA, 19 nt, Human
aggacuaggguccugggga

SEQ ID NO: 1608541 - RNA, 14 nt, Human
uggaguugaaaauc

SEQ ID NO: 1608542 - RNA, 14 nt, Human
uggagugcagugag

SEQ ID NO: 1608543 - RNA, 20 nt, Human
aggcauuugcugaauacaga

SEQ ID NO: 1608544 - RNA, 16 nt, Human
aggcauuugcugaaua

SEQ ID NO: 1608545 - RNA, 13 nt, Human
uggauggaagggg

SEQ ID NO: 1608546 - RNA, 23 nt, Human
uggaugccugguggcagcugcgg

SEQ ID NO: 1608547 - RNA, 21 nt, Human
uggaugccugguggcagcugc

SEQ ID NO: 1608548 - RNA, 23 nt, Human
uggcacaucagcacgauuucugu

SEQ ID NO: 1608549 - RNA, 15 nt, Human
aggcccccaggugcc

SEQ ID NO: 1608550 - RNA, 14 nt, Human
aggccccgcccagg

SEQ ID NO: 1608551 - RNA, 13 nt, Human
aggcccggcucca

SEQ ID NO: 1608552 - RNA, 15 nt, Human
aggcccggccucuca

SEQ ID NO: 1608553 - RNA, 14 nt, Human
aggcccggccucuc

SEQ ID NO: 1608554 - RNA, 13 nt, Human
aggcccggccucu

SEQ ID NO: 1608555 - RNA, 13 nt, Human
aggcccagagggc

SEQ ID NO: 1608556 - RNA, 15 nt, Human
aggccagccuugacc

SEQ ID NO: 1608557 - RNA, 12 nt, Human
aggccagcugcu

SEQ ID NO: 1608558 - RNA, 13 nt, Human
aggccagccuuga

SEQ ID NO: 1608559 - RNA, 22 nt, Human
uggcagcucaccucucccuugg

SEQ ID NO: 1608560 - RNA, 21 nt, Human
uggcagcucaccucucccuug

SEQ ID NO: 1608561 - RNA, 23 nt, Human
uggcagcucaccucucccuugga

SEQ ID NO: 1608562 - RNA, 13 nt, Human
uggcagcucagag

SEQ ID NO: 1608563 - RNA, 20 nt, Human
uggcacccggccccugcugg

SEQ ID NO: 1608564 - RNA, 19 nt, Human
uggcacccggccccugcug

SEQ ID NO: 1608565 - RNA, 18 nt, Human
uggcacccggccccugcu

SEQ ID NO: 1608566 - RNA, 20 nt, Human
aggcauuuaggccaugggac

SEQ ID NO: 1608567 - RNA, 18 nt, Human
aggcauugugggaagggg

SEQ ID NO: 1608568 - RNA, 22 nt, Human
aggcauaaagucagggguuccc

SEQ ID NO: 1608569 - RNA, 22 nt, Human
aggcaggucuugaacuccuggc

SEQ ID NO: 1608570 - RNA, 18 nt, Human
aggcagggucucacucug

SEQ ID NO: 1608571 - RNA, 12 nt, Human
aggcagggucuc

SEQ ID NO: 1608572 - RNA, 17 nt, Human
aggcaggugggauggau

SEQ ID NO: 1608573 - RNA, 15 nt, Human
aggcauaaagucagg

SEQ ID NO: 1608574 - RNA, 15 nt, Human
aggcagcuugaaacu

SEQ ID NO: 1608575 - RNA, 21 nt, Human
uggagcucgugggacagucac

SEQ ID NO: 1608576 - RNA, 21 nt, Human
uggagcucguggaacaguuac

SEQ ID NO: 1608577 - RNA, 17 nt, Human
uggagcucguggaacag

SEQ ID NO: 1608578 - RNA, 17 nt, Human
uggagccaauggagacu

SEQ ID NO: 1608579 - RNA, 19 nt, Human
aggcaagcaccuccugccu

SEQ ID NO: 1608580 - RNA, 18 nt, Human
aggcaagcaccuccugcc

SEQ ID NO: 1608581 - RNA, 20 nt, Human
aggcaagcaccuccugccuc

SEQ ID NO: 1608582 - RNA, 16 nt, Human
aggcaaggcugucaau

SEQ ID NO: 1608583 - RNA, 17 nt, Human
aggcaaggcugucaauu

SEQ ID NO: 1608584 - RNA, 17 nt, Human
aggauugcuacuguccu

SEQ ID NO: 1608585 - RNA, 15 nt, Human
aggauugcuacuguc

SEQ ID NO: 1608586 - RNA, 18 nt, Human
aggauugcuacuguccua

SEQ ID NO: 1608587 - RNA, 22 nt, Human
aggauugcuacuguccuaccca

SEQ ID NO: 1608588 - RNA, 20 nt, Human
ugcccuguuaaaagaugaaa

SEQ ID NO: 1608589 - RNA, 13 nt, Human
agcugcccucucc

SEQ ID NO: 1608590 - RNA, 14 nt, Human
agcugcccucuccu

SEQ ID NO: 1608591 - RNA, 15 nt, Human
agcugcccucuccug

SEQ ID NO: 1608592 - RNA, 16 nt, Human
agcugcccucuccugg

SEQ ID NO: 1608593 - RNA, 19 nt, Human
ugcccuuaccugccaggaa

SEQ ID NO: 1608594 - RNA, 18 nt, Human
ugcccuuaccugccagga

SEQ ID NO: 1608595 - RNA, 13 nt, Human
ugccucagccucc

SEQ ID NO: 1608596 - RNA, 12 nt, Human
ugccucagccuc

SEQ ID NO: 1608597 - RNA, 14 nt, Human
ugccgcagcccugc

SEQ ID NO: 1608598 - RNA, 12 nt, Human
ugccgcagcccu

SEQ ID NO: 1608599 - RNA, 23 nt, Human
agcucuguccugggagugagcug

SEQ ID NO: 1608600 - RNA, 21 nt, Human
agcucuguccugggagugagc

SEQ ID NO: 1608601 - RNA, 16 nt, Human
agcucuguccugggag

SEQ ID NO: 1608602 - RNA, 20 nt, Human
agcugccagccgagauagcc

SEQ ID NO: 1608603 - RNA, 15 nt, Human
agcuccuucuguccu

SEQ ID NO: 1608604 - RNA, 23 nt, Human
agcucccaggcauuccccaggag

SEQ ID NO: 1608605 - RNA, 13 nt, Human
agcucccaggcau

SEQ ID NO: 1608606 - RNA, 16 nt, Human
agcuccaucuccacuc

SEQ ID NO: 1608607 - RNA, 15 nt, Human
agcuccaucuccacu

SEQ ID NO: 1608608 - RNA, 13 nt, Human
agcuccaucucca

SEQ ID NO: 1608609 - RNA, 22 nt, Human
ugccaucaauaaaaaauuauga

SEQ ID NO: 1608610 - RNA, 14 nt, Human
ugccaucaauaaaa

SEQ ID NO: 1608611 - RNA, 21 nt, Human
agcuccuucuguccuacucug

SEQ ID NO: 1608612 - RNA, 16 nt, Human
agcuccuucuguccua

SEQ ID NO: 1608613 - RNA, 22 nt, Human
agcuccuucuguccuacucugu

SEQ ID NO: 1608614 - RNA, 20 nt, Human
agcucugguccauagagagc

SEQ ID NO: 1608615 - RNA, 17 nt, Human
agcucugguccauagag

SEQ ID NO: 1608616 - RNA, 12 nt, Human
agcucuggucca

SEQ ID NO: 1608617 - RNA, 14 nt, Human
agcuguucacagcc

SEQ ID NO: 1608618 - RNA, 19 nt, Human
agcuguuacugucuucagu

SEQ ID NO: 1608619 - RNA, 14 nt, Human
ugccuguucccauu

SEQ ID NO: 1608620 - RNA, 17 nt, Human
ugccuguugggccagga

SEQ ID NO: 1608621 - RNA, 16 nt, Human
ugccuguugggccagg

SEQ ID NO: 1608622 - RNA, 19 nt, Human
ugccuguugggccaggagc

SEQ ID NO: 1608623 - RNA, 20 nt, Human
ugccuuacccucauguucuu

SEQ ID NO: 1608624 - RNA, 16 nt, Human
ugccuuggggacaaga

SEQ ID NO: 1608625 - RNA, 21 nt, Human
ugccuuacccucauguucuua

SEQ ID NO: 1608626 - RNA, 20 nt, Human
agcugggguggggaccucag

SEQ ID NO: 1608627 - RNA, 16 nt, Human
agcugggacuacaggu

SEQ ID NO: 1608628 - RNA, 23 nt, Human
agcugggacuacaggcacccacc

SEQ ID NO: 1608629 - RNA, 20 nt, Human
agcugggacuacaggcaccc

SEQ ID NO: 1608630 - RNA, 23 nt, Human
agcugggguggggaccucaggcc

SEQ ID NO: 1608631 - RNA, 22 nt, Human
agcugggguggggaccucaggc

SEQ ID NO: 1608632 - RNA, 18 nt, Human
agcugugcucuggacagg

SEQ ID NO: 1608633 - RNA, 17 nt, Human
agcugugcucuggacag

SEQ ID NO: 1608634 - RNA, 19 nt, Human
agcugugcucuggacaggc

SEQ ID NO: 1608635 - RNA, 18 nt, Human
agcuguuacugucuucag

SEQ ID NO: 1608636 - RNA, 19 nt, Human
agcuggccgggagccugau

SEQ ID NO: 1608637 - RNA, 18 nt, Human
agcuggccgggagccuga

SEQ ID NO: 1608638 - RNA, 16 nt, Human
agcugcuugggcuuca

SEQ ID NO: 1608639 - RNA, 20 nt, Human
agcugcuugggcuucauccu

SEQ ID NO: 1608640 - RNA, 21 nt, Human
ugccuggauggggcugcaccg

SEQ ID NO: 1608641 - RNA, 20 nt, Human
ugccuggauggggcugcacc

SEQ ID NO: 1608642 - RNA, 17 nt, Human
ugccuggauggggcugc

SEQ ID NO: 1608643 - RNA, 16 nt, Human
ugccuggauggggcug

SEQ ID NO: 1608644 - RNA, 16 nt, Human
agcugccuguucagcu

SEQ ID NO: 1608645 - RNA, 14 nt, Human
agcugccuguucag

SEQ ID NO: 1608646 - RNA, 18 nt, Human
agcugccuguucagcucc

SEQ ID NO: 1608647 - RNA, 19 nt, Human
agcugccuguucagcucca

SEQ ID NO: 1608648 - RNA, 17 nt, Human
ugccucugccucugaca

SEQ ID NO: 1608649 - RNA, 20 nt, Human
ugccucugccucugacacac

SEQ ID NO: 1608650 - RNA, 18 nt, Human
ugccucugccucugacac

SEQ ID NO: 1608651 - RNA, 14 nt, Human
ugccucagccuccc

SEQ ID NO: 1608652 - RNA, 23 nt, Human
ugccugcccaggccccugccacc

SEQ ID NO: 1608653 - RNA, 22 nt, Human
ugccugcccaggccccugccac

SEQ ID NO: 1608654 - RNA, 12 nt, Human
ugccucugccug

SEQ ID NO: 1608655 - RNA, 24 nt, Human
ugccugcccaggccccugccaccc

SEQ ID NO: 1608656 - RNA, 22 nt, Human
ugccugcuuuuuauggccugug

SEQ ID NO: 1608657 - RNA, 21 nt, Human
ugccugcuuuuuauggccugu

SEQ ID NO: 1608658 - RNA, 20 nt, Human
ugccugcuuuuuauggccug

SEQ ID NO: 1608659 - RNA, 20 nt, Human
agcuugcccuggugccucac

SEQ ID NO: 1608660 - RNA, 23 nt, Human
agcuugaccgugaggccagagac

SEQ ID NO: 1608661 - RNA, 22 nt, Human
agcuugaccgugaggccagaga

SEQ ID NO: 1608662 - RNA, 20 nt, Human
agcuugaccgugaggccaga

SEQ ID NO: 1608663 - RNA, 19 nt, Human
agcuugcccuguuaaaaga

SEQ ID NO: 1608664 - RNA, 18 nt, Human
agcuugcccuguuaaaag

SEQ ID NO: 1608665 - RNA, 16 nt, Human
agcuugcccuguuaaa

SEQ ID NO: 1608666 - RNA, 14 nt, Human
aggaaaagcugcug

SEQ ID NO: 1608667 - RNA, 22 nt, Human
agcuuuccccaugucucgacuc

SEQ ID NO: 1608668 - RNA, 19 nt, Human
ugccuuuucccaacuccag

SEQ ID NO: 1608669 - RNA, 17 nt, Human
ugccuuuucccaacucc

SEQ ID NO: 1608670 - RNA, 15 nt, Human
ugcgguccacccagg

SEQ ID NO: 1608671 - RNA, 14 nt, Human
ugcgguccacccag

SEQ ID NO: 1608672 - RNA, 17 nt, Human
ugcgguccacccaggag

SEQ ID NO: 1608673 - RNA, 15 nt, Human
ugcuacaaaaacaca

SEQ ID NO: 1608674 - RNA, 14 nt, Human
ugcuacaaaaacac

SEQ ID NO: 1608675 - RNA, 20 nt, Human
ugcuaauuuugaaaaacugc

SEQ ID NO: 1608676 - RNA, 19 nt, Human
ugcuaauuuugaaaaacug

SEQ ID NO: 1608677 - RNA, 18 nt, Human
ugcuaauuuugaaaaacu

SEQ ID NO: 1608678 - RNA, 16 nt, Human
ugcuaauuuugaaaaa

SEQ ID NO: 1608679 - RNA, 13 nt, Human
agcuuaacagugu

SEQ ID NO: 1608680 - RNA, 20 nt, Human
aggaaaucaaauaugcaaag

SEQ ID NO: 1608681 - RNA, 22 nt, Human
aggaaaucaaauaugcaaagca

SEQ ID NO: 1608682 - RNA, 21 nt, Human
aggaaaucaaauaugcaaagc

SEQ ID NO: 1608683 - RNA, 23 nt, Human
aggaaaucaaauaugcaaagcac

SEQ ID NO: 1608684 - RNA, 14 nt, Human
aggaagcucagggc

SEQ ID NO: 1608685 - RNA, 13 nt, Human
aggaagcucaggg

SEQ ID NO: 1608686 - RNA, 13 nt, Human
aggaagccagcag

SEQ ID NO: 1608687 - RNA, 18 nt, Human
aggaagcagcuuucccca

SEQ ID NO: 1608688 - RNA, 16 nt, Human
aggaagcucagggccu

SEQ ID NO: 1608689 - RNA, 15 nt, Human
aggaagcucagggcc

SEQ ID NO: 1608690 - RNA, 15 nt, Human
aggaaggcugagagg

SEQ ID NO: 1608691 - RNA, 19 nt, Human
ugcucugaucauccacugu

SEQ ID NO: 1608692 - RNA, 21 nt, Human
ugcuccagcuguucagcuggu

SEQ ID NO: 1608693 - RNA, 15 nt, Human
ugcucugcugacaga

SEQ ID NO: 1608694 - RNA, 14 nt, Human
ugcucugcugacag

SEQ ID NO: 1608695 - RNA, 16 nt, Human
ugcucugcugacagac

SEQ ID NO: 1608696 - RNA, 17 nt, Human
ugcucuugaugccuggc

SEQ ID NO: 1608697 - RNA, 22 nt, Human
ugcucuugaacuccugaccuca

SEQ ID NO: 1608698 - RNA, 20 nt, Human
ugcucuugaacuccugaccu

SEQ ID NO: 1608699 - RNA, 15 nt, Human
ugcucuugaacuccu

SEQ ID NO: 1608700 - RNA, 18 nt, Human
ugcuaucucccccagccc

SEQ ID NO: 1608701 - RNA, 22 nt, Human
ugcuauuucuauauuuucauuc

SEQ ID NO: 1608702 - RNA, 16 nt, Human
aggaaaagcugcugac

SEQ ID NO: 1608703 - RNA, 17 nt, Human
ugcuaucucccccagcc

SEQ ID NO: 1608704 - RNA, 14 nt, Human
ugcuaucuccccca

SEQ ID NO: 1608705 - RNA, 13 nt, Human
ugcuaucuccccc

SEQ ID NO: 1608706 - RNA, 23 nt, Human
aggaaaccaguuaggucucaaua

SEQ ID NO: 1608707 - RNA, 21 nt, Human
uguaaauacuguuuuuaacaa

SEQ ID NO: 1608708 - RNA, 16 nt, Human
uguaaauagcucaggu

SEQ ID NO: 1608709 - RNA, 15 nt, Human
uguaaauagcucagg

SEQ ID NO: 1608710 - RNA, 15 nt, Human
uguaaauacaauuuu

SEQ ID NO: 1608711 - RNA, 19 nt, Human
uguaaauaaagaacuagca

SEQ ID NO: 1608712 - RNA, 14 nt, Human
ugguuauggagagg

SEQ ID NO: 1608713 - RNA, 13 nt, Human
ugguuuccugccc

SEQ ID NO: 1608714 - RNA, 12 nt, Human
ugguuuccugcc

SEQ ID NO: 1608715 - RNA, 20 nt, Human
ugguuuccugcccugggagg

SEQ ID NO: 1608716 - RNA, 15 nt, Human
ugguuuccugcccug

SEQ ID NO: 1608717 - RNA, 14 nt, Human
ugguuuccugcccu

SEQ ID NO: 1608718 - RNA, 17 nt, Human
ugguuuucaaaauaaaa

SEQ ID NO: 1608719 - RNA, 15 nt, Human
ugguuuucaaaauaa

SEQ ID NO: 1608720 - RNA, 21 nt, Human
ugguuuguaaauuaacuuuua

SEQ ID NO: 1608721 - RNA, 14 nt, Human
ugguuuucaaaaua

SEQ ID NO: 1608722 - RNA, 15 nt, Human
ugguuuguaaauuaa

SEQ ID NO: 1608723 - RNA, 21 nt, Human
aggugauccacccaccucagc

SEQ ID NO: 1608724 - RNA, 20 nt, Human
aggugcauauuuauaaaaau

SEQ ID NO: 1608725 - RNA, 20 nt, Human
aggugauccacccaccucag

SEQ ID NO: 1608726 - RNA, 14 nt, Human
aggugauccaccca

SEQ ID NO: 1608727 - RNA, 23 nt, Human
agguggggcagcuugaggguugg

SEQ ID NO: 1608728 - RNA, 18 nt, Human
aggugggauccuccaggu

SEQ ID NO: 1608729 - RNA, 17 nt, Human
aggugggauccuccagg

SEQ ID NO: 1608730 - RNA, 16 nt, Human
aggugggauccuccag

SEQ ID NO: 1608731 - RNA, 18 nt, Human
aggugccucaagagaagg

SEQ ID NO: 1608732 - RNA, 15 nt, Human
aggugggauccucca

SEQ ID NO: 1608733 - RNA, 20 nt, Human
aggugugcucugaucaucca

SEQ ID NO: 1608734 - RNA, 15 nt, Human
aggugugcucugauc

SEQ ID NO: 1608735 - RNA, 17 nt, Human
aggugugaaccaccaca

SEQ ID NO: 1608736 - RNA, 23 nt, Human
agguggggucacucuggcagcuc

SEQ ID NO: 1608737 - RNA, 19 nt, Human
agguggggucacucuggca

SEQ ID NO: 1608738 - RNA, 14 nt, Human
agguuuaagcuguu

SEQ ID NO: 1608739 - RNA, 23 nt, Human
uggugugaccacugcagaagaca

SEQ ID NO: 1608740 - RNA, 20 nt, Human
ugguuaggcauugugggaag

SEQ ID NO: 1608741 - RNA, 18 nt, Human
ugguuaggcauuguggga

SEQ ID NO: 1608742 - RNA, 12 nt, Human
ugguggcagugg

SEQ ID NO: 1608743 - RNA, 15 nt, Human
ugguggcagcugcgg

SEQ ID NO: 1608744 - RNA, 14 nt, Human
ugguggcagcugcg

SEQ ID NO: 1608745 - RNA, 21 nt, Human
ugguggagaggcccggccucu

SEQ ID NO: 1608746 - RNA, 20 nt, Human
uggugcccugcuuucagaua

SEQ ID NO: 1608747 - RNA, 19 nt, Human
uggugcccugcuuucagau

SEQ ID NO: 1608748 - RNA, 16 nt, Human
uggugcccugcuuuca

SEQ ID NO: 1608749 - RNA, 17 nt, Human
uggugcgaucuggguuc

SEQ ID NO: 1608750 - RNA, 16 nt, Human
uggugcgaucuggguu

SEQ ID NO: 1608751 - RNA, 18 nt, Human
uggugcugccacacuuca

SEQ ID NO: 1608752 - RNA, 13 nt, Human
uggugcugccaca

SEQ ID NO: 1608753 - RNA, 18 nt, Human
aggucagagccugcaguu

SEQ ID NO: 1608754 - RNA, 17 nt, Human
aggucagagccugcagu

SEQ ID NO: 1608755 - RNA, 15 nt, Human
aggucagagccugca

SEQ ID NO: 1608756 - RNA, 14 nt, Human
aggucagagccugc

SEQ ID NO: 1608757 - RNA, 13 nt, Human
aggucagagccug

SEQ ID NO: 1608758 - RNA, 16 nt, Human
uggucagauuugaacu

SEQ ID NO: 1608759 - RNA, 15 nt, Human
uggucagauuugaac

SEQ ID NO: 1608760 - RNA, 16 nt, Human
aggucuugaacuccug

SEQ ID NO: 1608761 - RNA, 19 nt, Human
agguccacaacacacagau

SEQ ID NO: 1608762 - RNA, 15 nt, Human
aggugacagagugag

SEQ ID NO: 1608763 - RNA, 13 nt, Human
aggugacagagug

SEQ ID NO: 1608764 - RNA, 17 nt, Human
aggucuugaacuccugg

SEQ ID NO: 1608765 - RNA, 18 nt, Human
aggucuugaacuccuggc

SEQ ID NO: 1608766 - RNA, 13 nt, Human
aggugaccccagg

SEQ ID NO: 1608767 - RNA, 22 nt, Human
aggugacagagugagacucugu

SEQ ID NO: 1608768 - RNA, 16 nt, Human
aggugagaagcagagg

SEQ ID NO: 1608769 - RNA, 23 nt, Human
aggugagaagcagaggaaggaga

SEQ ID NO: 1608770 - RNA, 21 nt, Human
aggugagaagcagaggaagga

SEQ ID NO: 1608771 - RNA, 22 nt, Human
uguauuacaaauccaaugaaau

SEQ ID NO: 1608772 - RNA, 13 nt, Human
uguauuacaaauc

SEQ ID NO: 1608773 - RNA, 19 nt, Human
uguauucucuccuguaccu

SEQ ID NO: 1608774 - RNA, 20 nt, Human
uguauucucuccuguaccuc

SEQ ID NO: 1608775 - RNA, 18 nt, Human
uguaucacaaaucuuaac

SEQ ID NO: 1608776 - RNA, 15 nt, Human
uguaucacaaaucuu

SEQ ID NO: 1608777 - RNA, 17 nt, Human
uguaucaaugaguaaca

SEQ ID NO: 1608778 - RNA, 15 nt, Human
uguaguguuggagaa

SEQ ID NO: 1608779 - RNA, 14 nt, Human
uguaguguuggaga

SEQ ID NO: 1608780 - RNA, 17 nt, Human
ugucaauuacaggaagu

SEQ ID NO: 1608781 - RNA, 19 nt, Human
ugucaauuacaggaaguac

SEQ ID NO: 1608782 - RNA, 15 nt, Human
ugucaauuacaggaa

SEQ ID NO: 1608783 - RNA, 14 nt, Human
ugucaauuacagga

SEQ ID NO: 1608784 - RNA, 18 nt, Human
aguauuagaauaccacag

SEQ ID NO: 1608785 - RNA, 18 nt, Human
aguauuacuucugcuaca

SEQ ID NO: 1608786 - RNA, 17 nt, Human
aguaugguggcuggguu

SEQ ID NO: 1608787 - RNA, 15 nt, Human
aguauuacuucugcu

SEQ ID NO: 1608788 - RNA, 16 nt, Human
aguaugguggcugggu

SEQ ID NO: 1608789 - RNA, 15 nt, Human
aguaugguggcuggg

SEQ ID NO: 1608790 - RNA, 17 nt, Human
agucaccucauggaauu

SEQ ID NO: 1608791 - RNA, 15 nt, Human
agucaccucauggaa

SEQ ID NO: 1608792 - RNA, 14 nt, Human
agucaccucaugga

SEQ ID NO: 1608793 - RNA, 23 nt, Human
agucacacagugagucgaggaca

SEQ ID NO: 1608794 - RNA, 15 nt, Human
agucacacagugagu

SEQ ID NO: 1608795 - RNA, 19 nt, Human
agucaccccggccaccugc

SEQ ID NO: 1608796 - RNA, 18 nt, Human
aguauuucuaugaaauau

SEQ ID NO: 1608797 - RNA, 16 nt, Human
aguauuucuaugaaau

SEQ ID NO: 1608798 - RNA, 17 nt, Human
aguauuucuaugaaaua

SEQ ID NO: 1608799 - RNA, 14 nt, Human
aguaauaugcacac

SEQ ID NO: 1608800 - RNA, 15 nt, Human
aguaauaugcacaca

SEQ ID NO: 1608801 - RNA, 17 nt, Human
aguaaugauaacuggaa

SEQ ID NO: 1608802 - RNA, 17 nt, Human
aguaauaugcacacauu

SEQ ID NO: 1608803 - RNA, 20 nt, Human
aguaaugauaacuggaaacu

SEQ ID NO: 1608804 - RNA, 18 nt, Human
aguaaugauaacuggaaa

SEQ ID NO: 1608805 - RNA, 13 nt, Human
aguaaaauccaca

SEQ ID NO: 1608806 - RNA, 16 nt, Human
uguagaggagaaacug

SEQ ID NO: 1608807 - RNA, 14 nt, Human
uguagagcuucugg

SEQ ID NO: 1608808 - RNA, 18 nt, Human
uguagagccagggucuca

SEQ ID NO: 1608809 - RNA, 16 nt, Human
uguagagccagggucu

SEQ ID NO: 1608810 - RNA, 23 nt, Human
uguacuugcucuugaugccuggc

SEQ ID NO: 1608811 - RNA, 22 nt, Human
uguacuugcucuugaugccugg

SEQ ID NO: 1608812 - RNA, 20 nt, Human
aguagaagucuuagauguau

SEQ ID NO: 1608813 - RNA, 19 nt, Human
aguagaagucuuagaugua

SEQ ID NO: 1608814 - RNA, 21 nt, Human
aguagaagucuuagauguaua

SEQ ID NO: 1608815 - RNA, 20 nt, Human
uguaggcauaaagucagggg

SEQ ID NO: 1608816 - RNA, 17 nt, Human
uguaggcauaaagucag

SEQ ID NO: 1608817 - RNA, 11 nt, Human
aguagagacag

SEQ ID NO: 1608818 - RNA, 18 nt, Human
aggggagcaugggaagug

SEQ ID NO: 1608819 - RNA, 16 nt, Human
aggggaauugaggaca

SEQ ID NO: 1608820 - RNA, 21 nt, Human
aggggaauguuugccucugcc

SEQ ID NO: 1608821 - RNA, 20 nt, Human
aggggaauguuugccucugc

SEQ ID NO: 1608822 - RNA, 19 nt, Human
aggggaauguuugccucug

SEQ ID NO: 1608823 - RNA, 18 nt, Human
aggggugggacacccugu

SEQ ID NO: 1608824 - RNA, 20 nt, Human
aggggguggccucccaacuc

SEQ ID NO: 1608825 - RNA, 13 nt, Human
agggggcugggac

SEQ ID NO: 1608826 - RNA, 15 nt, Human
aggguaaggcugugg

SEQ ID NO: 1608827 - RNA, 15 nt, Human
agggucucacucugu

SEQ ID NO: 1608828 - RNA, 14 nt, Human
agggucucacucug

SEQ ID NO: 1608829 - RNA, 16 nt, Human
agggucucacucuguc

SEQ ID NO: 1608830 - RNA, 21 nt, Human
agggucucacucugucgccca

SEQ ID NO: 1608831 - RNA, 22 nt, Human
uggguggcaccagcagccugga

SEQ ID NO: 1608832 - RNA, 21 nt, Human
uggguggcaccagcagccugg

SEQ ID NO: 1608833 - RNA, 20 nt, Human
uggguggcaccagcagccug

SEQ ID NO: 1608834 - RNA, 17 nt, Human
uggguggcaccagcagc

SEQ ID NO: 1608835 - RNA, 20 nt, Human
ugguagagugugccugaagu

SEQ ID NO: 1608836 - RNA, 17 nt, Human
ugguagcuuuucccuuc

SEQ ID NO: 1608837 - RNA, 16 nt, Human
aggguggugaccucug

SEQ ID NO: 1608838 - RNA, 18 nt, Human
ugggucgcccuggacugu

SEQ ID NO: 1608839 - RNA, 16 nt, Human
ugggucgcccuggacu

SEQ ID NO: 1608840 - RNA, 15 nt, Human
uggggaggggcugug

SEQ ID NO: 1608841 - RNA, 12 nt, Human
uggggcccugcc

SEQ ID NO: 1608842 - RNA, 23 nt, Human
uggggcugcaccggcuggccugg

SEQ ID NO: 1608843 - RNA, 15 nt, Human
uggggaccucaggcc

SEQ ID NO: 1608844 - RNA, 14 nt, Human
uggggaccucaggc

SEQ ID NO: 1608845 - RNA, 15 nt, Human
agggcuccagacaca

SEQ ID NO: 1608846 - RNA, 12 nt, Human
agggcuccagac

SEQ ID NO: 1608847 - RNA, 17 nt, Human
uggggaccucaggccug

SEQ ID NO: 1608848 - RNA, 16 nt, Human
uggggaccucaggccu

SEQ ID NO: 1608849 - RNA, 22 nt, Human
uggggucacucuggcagcucag

SEQ ID NO: 1608850 - RNA, 16 nt, Human
uggggucacucuggca

SEQ ID NO: 1608851 - RNA, 14 nt, Human
uggggucacucugg

SEQ ID NO: 1608852 - RNA, 13 nt, Human
uggggucacucug

SEQ ID NO: 1608853 - RNA, 20 nt, Human
ugggguacccacugcucugg

SEQ ID NO: 1608854 - RNA, 19 nt, Human
ugggguacccacugcucug

SEQ ID NO: 1608855 - RNA, 18 nt, Human
ugggguacccacugcucu

SEQ ID NO: 1608856 - RNA, 17 nt, Human
ugggguacccacugcuc

SEQ ID NO: 1608857 - RNA, 13 nt, Human
aggggaaaagagg

SEQ ID NO: 1608858 - RNA, 14 nt, Human
aggggaacagacug

SEQ ID NO: 1608859 - RNA, 22 nt, Human
aggggaaaaucagccugcucca

SEQ ID NO: 1608860 - RNA, 18 nt, Human
aggggaaaaucagccugc

SEQ ID NO: 1608861 - RNA, 13 nt, Human
aggggaauguuug

SEQ ID NO: 1608862 - RNA, 21 nt, Human
aggggaauaaacuguugaguc

SEQ ID NO: 1608863 - RNA, 22 nt, Human
agggaggacgcucucuggccuu

SEQ ID NO: 1608864 - RNA, 21 nt, Human
agggaggacgcucucuggccu

SEQ ID NO: 1608865 - RNA, 23 nt, Human
agggaggacgcucucuggccuuc

SEQ ID NO: 1608866 - RNA, 16 nt, Human
ugggacuacaggcacc

SEQ ID NO: 1608867 - RNA, 15 nt, Human
ugggacuacaggcac

SEQ ID NO: 1608868 - RNA, 14 nt, Human
ugggacuacaggca

SEQ ID NO: 1608869 - RNA, 20 nt, Human
ugggacucaaugcacugaca

SEQ ID NO: 1608870 - RNA, 16 nt, Human
ugggagagccuuccag

SEQ ID NO: 1608871 - RNA, 18 nt, Human
ugggagacugcugaguca

SEQ ID NO: 1608872 - RNA, 21 nt, Human
ugggagagaagagaaugcaca

SEQ ID NO: 1608873 - RNA, 19 nt, Human
ugggagagaagagaaugca

SEQ ID NO: 1608874 - RNA, 20 nt, Human
aggcccggcuccaggcuccu

SEQ ID NO: 1608875 - RNA, 18 nt, Human
aggcccggcuccaggcuc

SEQ ID NO: 1608876 - RNA, 21 nt, Human
aggcccggcuccaggcuccuu

SEQ ID NO: 1608877 - RNA, 22 nt, Human
agggaaggauacaaaagcaugu

SEQ ID NO: 1608878 - RNA, 22 nt, Human
agggaaggggacaaggacuagg

SEQ ID NO: 1608879 - RNA, 13 nt, Human
agggaaggggaca

SEQ ID NO: 1608880 - RNA, 21 nt, Human
agggaauuucuucaacucccu

SEQ ID NO: 1608881 - RNA, 17 nt, Human
agggagggagggcucca

SEQ ID NO: 1608882 - RNA, 15 nt, Human
agggagggagggcuc

SEQ ID NO: 1608883 - RNA, 19 nt, Human
ugggccccugccucucugc

SEQ ID NO: 1608884 - RNA, 15 nt, Human
ugggccccugccucu

SEQ ID NO: 1608885 - RNA, 20 nt, Human
ugggccccugccucucugca

SEQ ID NO: 1608886 - RNA, 21 nt, Human
ugggcccccaaauggaaaugg

SEQ ID NO: 1608887 - RNA, 16 nt, Human
ugggcccccaaaugga

SEQ ID NO: 1608888 - RNA, 22 nt, Human
ugggccccaguuguauuuauuu

SEQ ID NO: 1608889 - RNA, 18 nt, Human
ugggccccaguuguauuu

SEQ ID NO: 1608890 - RNA, 20 nt, Human
ugggaggccaaggugggagg

SEQ ID NO: 1608891 - RNA, 19 nt, Human
ugggaggccaaggugggag

SEQ ID NO: 1608892 - RNA, 22 nt, Human
ugggaggaucucuugagccugg

SEQ ID NO: 1608893 - RNA, 21 nt, Human
ugggaggaucucuugagccug

SEQ ID NO: 1608894 - RNA, 20 nt, Human
ugggaggaucucuugagccu

SEQ ID NO: 1608895 - RNA, 13 nt, Human
ugggcagagcaga

SEQ ID NO: 1608896 - RNA, 18 nt, Human
ugggccaggagccuccug

SEQ ID NO: 1608897 - RNA, 12 nt, Human
ugggcagagcag

SEQ ID NO: 1608898 - RNA, 11 nt, Human
ugggcagagca

SEQ ID NO: 1608899 - RNA, 12 nt, Human
ugggcagaagga

SEQ ID NO: 1608900 - RNA, 23 nt, Human
agggcucagcggggacagcuccu

SEQ ID NO: 1608901 - RNA, 22 nt, Human
agggcucagcggggacagcucc

SEQ ID NO: 1608902 - RNA, 20 nt, Human
agggcucagcggggacagcu

SEQ ID NO: 1608903 - RNA, 19 nt, Human
agggcucagcggggacagc

SEQ ID NO: 1608904 - RNA, 15 nt, Human
agggagggcuccaga

SEQ ID NO: 1608905 - RNA, 14 nt, Human
agggagggcuccag

SEQ ID NO: 1608906 - RNA, 16 nt, Human
agggagggcuccagac

SEQ ID NO: 1608907 - RNA, 17 nt, Human
agggagggcuccagaca

SEQ ID NO: 1608908 - RNA, 14 nt, Human
agggcacugguggc

SEQ ID NO: 1608909 - RNA, 16 nt, Human
agggcacugguggccc

SEQ ID NO: 1608910 - RNA, 17 nt, Human
agggcauggccaggugg

SEQ ID NO: 1608911 - RNA, 15 nt, Human
uuaauucuuagcuca

SEQ ID NO: 1608912 - RNA, 20 nt, Human
uuaaugaaagacuguacaaa

SEQ ID NO: 1608913 - RNA, 23 nt, Human
uuaaugaaagacuguacaaagua

SEQ ID NO: 1608914 - RNA, 17 nt, Human
uuaauaaacacucuuga

SEQ ID NO: 1608915 - RNA, 13 nt, Human
uuaauaaacacuc

SEQ ID NO: 1608916 - RNA, 19 nt, Human
uuaauuuuuuugagacaga

SEQ ID NO: 1608917 - RNA, 16 nt, Human
auaaaauuaaagcuga

SEQ ID NO: 1608918 - RNA, 23 nt, Human
auaaacaagaccacguuucuaaa

SEQ ID NO: 1608919 - RNA, 15 nt, Human
auaaacaagaccacg

SEQ ID NO: 1608920 - RNA, 22 nt, Human
auaaacaagaccacguuucuaa

SEQ ID NO: 1608921 - RNA, 20 nt, Human
auaaaauuuuuaaucuuuaa

SEQ ID NO: 1608922 - RNA, 22 nt, Human
uuaagaagacugcauuauauuu

SEQ ID NO: 1608923 - RNA, 13 nt, Human
uuaagaggcaggg

SEQ ID NO: 1608924 - RNA, 16 nt, Human
uuaagaggcagggucu

SEQ ID NO: 1608925 - RNA, 15 nt, Human
uuaagaggcaggguc

SEQ ID NO: 1608926 - RNA, 18 nt, Human
uuaaguaaggaauuuuau

SEQ ID NO: 1608927 - RNA, 18 nt, Human
uuaaguaaugauaacugg

SEQ ID NO: 1608928 - RNA, 17 nt, Human
uuaaguacuauguauca

SEQ ID NO: 1608929 - RNA, 14 nt, Human
uuaagugcugcauu

SEQ ID NO: 1608930 - RNA, 22 nt, Human
uuaagugcugcauuuaaaagau

SEQ ID NO: 1608931 - RNA, 19 nt, Human
auaaaauccauacauuugu

SEQ ID NO: 1608932 - RNA, 18 nt, Human
auaaaauccauacauuug

SEQ ID NO: 1608933 - RNA, 22 nt, Human
auaaaauaauuuuuauauuuga

SEQ ID NO: 1608934 - RNA, 21 nt, Human
auaaaauaauuuuuauauuug

SEQ ID NO: 1608935 - RNA, 16 nt, Human
auaaaauaauuuuuau

SEQ ID NO: 1608936 - RNA, 14 nt, Human
uuaccuuacagaag

SEQ ID NO: 1608937 - RNA, 18 nt, Human
uuacucagaauucucuag

SEQ ID NO: 1608938 - RNA, 23 nt, Human
uuacucagaauucucuaguuuga

SEQ ID NO: 1608939 - RNA, 15 nt, Human
uuacuguaagaaaau

SEQ ID NO: 1608940 - RNA, 14 nt, Human
uuagaaauauaauu

SEQ ID NO: 1608941 - RNA, 12 nt, Human
uuagaaauauaa

SEQ ID NO: 1608942 - RNA, 11 nt, Human
uuagaaauaua

SEQ ID NO: 1608943 - RNA, 11 nt, Human
uuagacagagu

SEQ ID NO: 1608944 - RNA, 13 nt, Human
uuagaaccuuucu

SEQ ID NO: 1608945 - RNA, 14 nt, Human
uuacaggaaguacu

SEQ ID NO: 1608946 - RNA, 14 nt, Human
uuacagcugccugc

SEQ ID NO: 1608947 - RNA, 13 nt, Human
uuacagcugccug

SEQ ID NO: 1608948 - RNA, 13 nt, Human
uuacaguauaauu

SEQ ID NO: 1608949 - RNA, 17 nt, Human
uuacaguauaauuaaca

SEQ ID NO: 1608950 - RNA, 16 nt, Human
uuacaguauaauuaac

SEQ ID NO: 1608951 - RNA, 20 nt, Human
uuacaguauaauuaacaugu

SEQ ID NO: 1608952 - RNA, 19 nt, Human
uuacaguauaauuaacaug

SEQ ID NO: 1608953 - RNA, 18 nt, Human
uuacaguauaauuaacau

SEQ ID NO: 1608954 - RNA, 18 nt, Human
auaaacacucuugaaaaa

SEQ ID NO: 1608955 - RNA, 21 nt, Human
auaaauagcuagacuggugac

SEQ ID NO: 1608956 - RNA, 18 nt, Human
auaaauagcuagacuggu

SEQ ID NO: 1608957 - RNA, 16 nt, Human
auaaauagcuagacug

SEQ ID NO: 1608958 - RNA, 22 nt, Human
auaaaucugugaacuugaaauu

SEQ ID NO: 1608959 - RNA, 21 nt, Human
auaaaucugugaacuugaaau

SEQ ID NO: 1608960 - RNA, 20 nt, Human
auaaaucugugaacuugaaa

SEQ ID NO: 1608961 - RNA, 19 nt, Human
uguuucuuuguaaugaaaa

SEQ ID NO: 1608962 - RNA, 18 nt, Human
uguuucuuuguaaugaaa

SEQ ID NO: 1608963 - RNA, 22 nt, Human
uguuugauucagacagcugccu

SEQ ID NO: 1608964 - RNA, 17 nt, Human
uguuugauucagacagc

SEQ ID NO: 1608965 - RNA, 19 nt, Human
uguuuauugucaaaguggu

SEQ ID NO: 1608966 - RNA, 14 nt, Human
uguuuauuacagua

SEQ ID NO: 1608967 - RNA, 18 nt, Human
uguuuauuacaguauaau

SEQ ID NO: 1608968 - RNA, 19 nt, Human
uguugcccaggcaggucuu

SEQ ID NO: 1608969 - RNA, 19 nt, Human
uguugccuugcauaauggu

SEQ ID NO: 1608970 - RNA, 22 nt, Human
uguuuagucuugucucagauuu

SEQ ID NO: 1608971 - RNA, 23 nt, Human
uguuuagucuugucucagauuuu

SEQ ID NO: 1608972 - RNA, 19 nt, Human
uguuuucauuaucucaaaa

SEQ ID NO: 1608973 - RNA, 20 nt, Human
uguuuuccaugaguccccug

SEQ ID NO: 1608974 - RNA, 21 nt, Human
uguuuuauuuuaauucaguug

SEQ ID NO: 1608975 - RNA, 21 nt, Human
uguuuuauuuaaccucuaaau

SEQ ID NO: 1608976 - RNA, 13 nt, Human
uguuuggagacag

SEQ ID NO: 1608977 - RNA, 19 nt, Human
uguuuggaccaaaaaccag

SEQ ID NO: 1608978 - RNA, 16 nt, Human
aguucugcagauaaac

SEQ ID NO: 1608979 - RNA, 21 nt, Human
aguucugcagauaaacaguag

SEQ ID NO: 1608980 - RNA, 14 nt, Human
uguuuugcaagcca

SEQ ID NO: 1608981 - RNA, 14 nt, Human
aguucugguuccua

SEQ ID NO: 1608982 - RNA, 22 nt, Human
aguugcauagguuuaauaauuu

SEQ ID NO: 1608983 - RNA, 23 nt, Human
aguugccuaaauccauuuggaaa

SEQ ID NO: 1608984 - RNA, 22 nt, Human
aguugccuaaauccauuuggaa

SEQ ID NO: 1608985 - RNA, 13 nt, Human
aguugggcuuccu

SEQ ID NO: 1608986 - RNA, 13 nt, Human
aguuggcuucuaa

SEQ ID NO: 1608987 - RNA, 21 nt, Human
aguuggguggaugccuggugg

SEQ ID NO: 1608988 - RNA, 16 nt, Human
aguuggguguauugug

SEQ ID NO: 1608989 - RNA, 16 nt, Human
aguuggcuaggacccc

SEQ ID NO: 1608990 - RNA, 23 nt, Human
aguuguuugauucagacagcugc

SEQ ID NO: 1608991 - RNA, 21 nt, Human
aguuguuugauucagacagcu

SEQ ID NO: 1608992 - RNA, 18 nt, Human
aguuggucccccuuccau

SEQ ID NO: 1608993 - RNA, 20 nt, Human
aguuggguguauugugcgcu

SEQ ID NO: 1608994 - RNA, 17 nt, Human
aguuggguguauugugc

SEQ ID NO: 1608995 - RNA, 20 nt, Human
aguuuaauauuaaagccaug

SEQ ID NO: 1608996 - RNA, 19 nt, Human
aguuuaauauuaaagccau

SEQ ID NO: 1608997 - RNA, 18 nt, Human
aguuuaauauuaaagcca

SEQ ID NO: 1608998 - RNA, 16 nt, Human
aguuuaauauuaaagc

SEQ ID NO: 1608999 - RNA, 15 nt, Human
aguuuaauauuaaag

SEQ ID NO: 1609000 - RNA, 13 nt, Human
uuaaauaauguga

SEQ ID NO: 1609001 - RNA, 14 nt, Human
uuaacaacagcugg

SEQ ID NO: 1609002 - RNA, 20 nt, Human
uguggucacaggaaguagag

SEQ ID NO: 1609003 - RNA, 23 nt, Human
uguggguuucuaaagcugccagc

SEQ ID NO: 1609004 - RNA, 21 nt, Human
uguggguuucuaaagcugcca

SEQ ID NO: 1609005 - RNA, 15 nt, Human
uguggucccacccca

SEQ ID NO: 1609006 - RNA, 13 nt, Human
uguggucccaccc

SEQ ID NO: 1609007 - RNA, 16 nt, Human
uguggucccaccccac

SEQ ID NO: 1609008 - RNA, 16 nt, Human
ugugguguuuccuggc

SEQ ID NO: 1609009 - RNA, 14 nt, Human
ugugguguuuccug

SEQ ID NO: 1609010 - RNA, 20 nt, Human
ugugguguuuccuggcacug

SEQ ID NO: 1609011 - RNA, 18 nt, Human
uguguaagacaaaaagcu

SEQ ID NO: 1609012 - RNA, 21 nt, Human
agugcugggauuacaggugug

SEQ ID NO: 1609013 - RNA, 16 nt, Human
agugcugcauuuaaaa

SEQ ID NO: 1609014 - RNA, 17 nt, Human
agugcugcauuuaaaag

SEQ ID NO: 1609015 - RNA, 20 nt, Human
agugcugggauuacaggugu

SEQ ID NO: 1609016 - RNA, 19 nt, Human
agugcugcauuuaaaagau

SEQ ID NO: 1609017 - RNA, 23 nt, Human
agugaguugauagcacagacccu

SEQ ID NO: 1609018 - RNA, 22 nt, Human
agugaguugauagcacagaccc

SEQ ID NO: 1609019 - RNA, 20 nt, Human
agugaguuggguguauugug

SEQ ID NO: 1609020 - RNA, 19 nt, Human
agugaguuggguguauugu

SEQ ID NO: 1609021 - RNA, 12 nt, Human
agugcugcauuu

SEQ ID NO: 1609022 - RNA, 13 nt, Human
agugcugcauuua

SEQ ID NO: 1609023 - RNA, 13 nt, Human
uguguugaagagg

SEQ ID NO: 1609024 - RNA, 13 nt, Human
uguguaaguagau

SEQ ID NO: 1609025 - RNA, 20 nt, Human
ugugucucuugguccugcug

SEQ ID NO: 1609026 - RNA, 17 nt, Human
ugugucucuugguccug

SEQ ID NO: 1609027 - RNA, 22 nt, Human
ugugucucuugguccugcugca

SEQ ID NO: 1609028 - RNA, 21 nt, Human
ugugucucuugguccugcugc

SEQ ID NO: 1609029 - RNA, 21 nt, Human
ugugucuugcaauggcagccu

SEQ ID NO: 1609030 - RNA, 19 nt, Human
ugugucuuuaaaugcugcu

SEQ ID NO: 1609031 - RNA, 20 nt, Human
ugugugaaagguacuucaaa

SEQ ID NO: 1609032 - RNA, 23 nt, Human
uguguguuuauugucaaaguggu

SEQ ID NO: 1609033 - RNA, 19 nt, Human
uguguguuuauugucaaag

SEQ ID NO: 1609034 - RNA, 11 nt, Human
ugugugugugc

SEQ ID NO: 1609035 - RNA, 20 nt, Human
agugugucuuagugugugca

SEQ ID NO: 1609036 - RNA, 15 nt, Human
uguuauaaucuuuca

SEQ ID NO: 1609037 - RNA, 20 nt, Human
uguuccacaaguuaaauaaa

SEQ ID NO: 1609038 - RNA, 18 nt, Human
uguuccuagugaaagagg

SEQ ID NO: 1609039 - RNA, 14 nt, Human
uguuccuagugaaa

SEQ ID NO: 1609040 - RNA, 16 nt, Human
uguucugggacacagu

SEQ ID NO: 1609041 - RNA, 18 nt, Human
uguugcccaggcaggucu

SEQ ID NO: 1609042 - RNA, 17 nt, Human
uguugcccaggcagguc

SEQ ID NO: 1609043 - RNA, 16 nt, Human
uguugcccaggcaggu

SEQ ID NO: 1609044 - RNA, 15 nt, Human
uguugcccaggcagg

SEQ ID NO: 1609045 - RNA, 13 nt, Human
uguugcccaggca

SEQ ID NO: 1609046 - RNA, 18 nt, Human
uguucugugauauaagug

SEQ ID NO: 1609047 - RNA, 15 nt, Human
uguucugugauauaa

SEQ ID NO: 1609048 - RNA, 20 nt, Human
agugugguguuuccuggcac

SEQ ID NO: 1609049 - RNA, 19 nt, Human
agugugguguuuccuggca

SEQ ID NO: 1609050 - RNA, 17 nt, Human
agugugguguuuccugg

SEQ ID NO: 1609051 - RNA, 20 nt, Human
agugugccugaagucccaga

SEQ ID NO: 1609052 - RNA, 16 nt, Human
agugugguguuuccug

SEQ ID NO: 1609053 - RNA, 21 nt, Human
agugguggugaacagaacaaa

SEQ ID NO: 1609054 - RNA, 17 nt, Human
aguggugguuuucuguu

SEQ ID NO: 1609055 - RNA, 18 nt, Human
aguggugguuuucuguuc

SEQ ID NO: 1609056 - RNA, 19 nt, Human
aguggugguuuucuguucu

SEQ ID NO: 1609057 - RNA, 20 nt, Human
aguggugguuuucuguucuu

SEQ ID NO: 1609058 - RNA, 21 nt, Human
aguggugguuuucuguucuuu

SEQ ID NO: 1609059 - RNA, 23 nt, Human
aguggugguuuucuguucuuucu

SEQ ID NO: 1609060 - RNA, 17 nt, Human
aguggugcgaucugggu

SEQ ID NO: 1609061 - RNA, 14 nt, Human
uguuacaaauugua

SEQ ID NO: 1609062 - RNA, 21 nt, Human
ugugaaaggaaagagggaggu

SEQ ID NO: 1609063 - RNA, 18 nt, Human
ugugaaaggaaagaggcu

SEQ ID NO: 1609064 - RNA, 15 nt, Human
ugugaaaggaaagag

SEQ ID NO: 1609065 - RNA, 12 nt, Human
ugugaaauuauu

SEQ ID NO: 1609066 - RNA, 14 nt, Human
ugugaagagaacca

SEQ ID NO: 1609067 - RNA, 21 nt, Human
ugugaaccaccacacccagcc

SEQ ID NO: 1609068 - RNA, 20 nt, Human
ugugaaccaccacacccagc

SEQ ID NO: 1609069 - RNA, 19 nt, Human
ugugaaccaccacacccag

SEQ ID NO: 1609070 - RNA, 20 nt, Human
ugugaacaguuguguuugaa

SEQ ID NO: 1609071 - RNA, 12 nt, Human
ugugaacuugaa

SEQ ID NO: 1609072 - RNA, 16 nt, Human
ugugaacuugaaauuu

SEQ ID NO: 1609073 - RNA, 15 nt, Human
ugugaacuugaaauu

SEQ ID NO: 1609074 - RNA, 14 nt, Human
ugugaacuugaaau

SEQ ID NO: 1609075 - RNA, 22 nt, Human
agucucaggaaaucaaauaugc

SEQ ID NO: 1609076 - RNA, 22 nt, Human
ugugagaugcuagaacucccuu

SEQ ID NO: 1609077 - RNA, 19 nt, Human
ugugagaugcuagaacucc

SEQ ID NO: 1609078 - RNA, 15 nt, Human
ugugagaugcuagaa

SEQ ID NO: 1609079 - RNA, 16 nt, Human
ugugacugaucucucg

SEQ ID NO: 1609080 - RNA, 16 nt, Human
ugugacugaauuucuu

SEQ ID NO: 1609081 - RNA, 15 nt, Human
ugugacugaauuucu

SEQ ID NO: 1609082 - RNA, 14 nt, Human
agucucuucuccac

SEQ ID NO: 1609083 - RNA, 13 nt, Human
agucucuucucca

SEQ ID NO: 1609084 - RNA, 14 nt, Human
agucuuuguacaga

SEQ ID NO: 1609085 - RNA, 17 nt, Human
agucucuucuccacugg

SEQ ID NO: 1609086 - RNA, 18 nt, Human
agucucuucuccacugga

SEQ ID NO: 1609087 - RNA, 16 nt, Human
agucucuucuccacug

SEQ ID NO: 1609088 - RNA, 15 nt, Human
agucucuucuccacu

SEQ ID NO: 1609089 - RNA, 20 nt, Human
ugugauggggcccugccucc

SEQ ID NO: 1609090 - RNA, 19 nt, Human
ugugauggggcccugccuc

SEQ ID NO: 1609091 - RNA, 18 nt, Human
ugugaugagaggaaauca

SEQ ID NO: 1609092 - RNA, 20 nt, Human
agugaacaaauuuacagaga

SEQ ID NO: 1609093 - RNA, 16 nt, Human
agugaacaaauuuaca

SEQ ID NO: 1609094 - RNA, 15 nt, Human
agugaaagaaaauaa

SEQ ID NO: 1609095 - RNA, 17 nt, Human
agugaaagaaaauaaca

SEQ ID NO: 1609096 - RNA, 18 nt, Human
ugugccagauuuaugcau

SEQ ID NO: 1609097 - RNA, 16 nt, Human
ugugccaugugccagg

SEQ ID NO: 1609098 - RNA, 12 nt, Human
ugugccaugugc

SEQ ID NO: 1609099 - RNA, 20 nt, Human
ugugccagguuuuuggucug

SEQ ID NO: 1609100 - RNA, 20 nt, Human
ugugccagauuuaugcauau

SEQ ID NO: 1609101 - RNA, 17 nt, Human
uguggaguucaucuuga

SEQ ID NO: 1609102 - RNA, 18 nt, Human
ugugcugggguuaucuga

SEQ ID NO: 1609103 - RNA, 21 nt, Human
uguggaguucaucuugaauug

SEQ ID NO: 1609104 - RNA, 21 nt, Human
ugugcccccauguaagcaccc

SEQ ID NO: 1609105 - RNA, 15 nt, Human
agugagucgaggaca

SEQ ID NO: 1609106 - RNA, 20 nt, Human
agugaggcucugcccuuggu

SEQ ID NO: 1609107 - RNA, 19 nt, Human
agugaggcucugcccuugg

SEQ ID NO: 1609108 - RNA, 21 nt, Human
agugaggcucugcccuugguu

SEQ ID NO: 1609109 - RNA, 14 nt, Human
agugagggauuauc

SEQ ID NO: 1609110 - RNA, 17 nt, Human
agugaggcucugcccuu

SEQ ID NO: 1609111 - RNA, 16 nt, Human
agugaggcucugcccu

SEQ ID NO: 1609112 - RNA, 15 nt, Human
agugaggcucugccc

SEQ ID NO: 1609113 - RNA, 18 nt, Human
auauguuuuaagaggcag

SEQ ID NO: 1609114 - RNA, 20 nt, Human
auauguuuuaagaggcaggg

SEQ ID NO: 1609115 - RNA, 22 nt, Human
auauuaaggaagacaaugugaa

SEQ ID NO: 1609116 - RNA, 24 nt, Human
auauuaagaaagacuaucuaaaug

SEQ ID NO: 1609117 - RNA, 23 nt, Human
auauuaaagccauguuuauuaca

SEQ ID NO: 1609118 - RNA, 18 nt, Human
auauuaaagccauguuua

SEQ ID NO: 1609119 - RNA, 15 nt, Human
auauuaaagccaugu

SEQ ID NO: 1609120 - RNA, 19 nt, Human
auauugauuuccguuaaaa

SEQ ID NO: 1609121 - RNA, 21 nt, Human
auauugauuuccguuaaaaua

SEQ ID NO: 1609122 - RNA, 22 nt, Human
auauugauuuccguuaaaauac

SEQ ID NO: 1609123 - RNA, 22 nt, Human
auauugauccagaaagaaaacu

SEQ ID NO: 1609124 - RNA, 15 nt, Human
auauugauccagaaa

SEQ ID NO: 1609125 - RNA, 16 nt, Human
auauucuguuggccag

SEQ ID NO: 1609126 - RNA, 23 nt, Human
auauucucacagcuccaagaauu

SEQ ID NO: 1609127 - RNA, 22 nt, Human
auauucucacagcuccaagaau

SEQ ID NO: 1609128 - RNA, 21 nt, Human
auauugcugauggugcaauga

SEQ ID NO: 1609129 - RNA, 17 nt, Human
auauugcugauggugca

SEQ ID NO: 1609130 - RNA, 13 nt, Human
auauuugaaauau

SEQ ID NO: 1609131 - RNA, 20 nt, Human
auauuguuuucaguguacau

SEQ ID NO: 1609132 - RNA, 22 nt, Human
auauuuguaucacaaaucuuaa

SEQ ID NO: 1609133 - RNA, 12 nt, Human
auauuuuaacuu

SEQ ID NO: 1609134 - RNA, 23 nt, Human
auauuugaaauauugacuuuuua

SEQ ID NO: 1609135 - RNA, 19 nt, Human
auauuugaaauauugacuu

SEQ ID NO: 1609136 - RNA, 14 nt, Human
auauuugaaauauu

SEQ ID NO: 1609137 - RNA, 21 nt, Human
aucaagaugugacauguuuua

SEQ ID NO: 1609138 - RNA, 13 nt, Human
aucaaguauuaua

SEQ ID NO: 1609139 - RNA, 14 nt, Human
aucaaguauuauac

SEQ ID NO: 1609140 - RNA, 18 nt, Human
aucaaguauuauaccuuu

SEQ ID NO: 1609141 - RNA, 13 nt, Human
auauuuucauucu

SEQ ID NO: 1609142 - RNA, 22 nt, Human
aucacggcucacugcagccuca

SEQ ID NO: 1609143 - RNA, 20 nt, Human
uuccuuuuaaaacacuucca

SEQ ID NO: 1609144 - RNA, 22 nt, Human
uuccuuuuaaaacacuuccaua

SEQ ID NO: 1609145 - RNA, 21 nt, Human
uuccuuuuaaaacacuuccau

SEQ ID NO: 1609146 - RNA, 15 nt, Human
uuccuaauccucuag

SEQ ID NO: 1609147 - RNA, 13 nt, Human
uuccuaauccucu

SEQ ID NO: 1609148 - RNA, 14 nt, Human
auauuuuaagacga

SEQ ID NO: 1609149 - RNA, 13 nt, Human
auauuuuaugauc

SEQ ID NO: 1609150 - RNA, 12 nt, Human
auauuuuaugau

SEQ ID NO: 1609151 - RNA, 22 nt, Human
auauuuuaugauccagcagauu

SEQ ID NO: 1609152 - RNA, 17 nt, Human
auauuuuaugauccagc

SEQ ID NO: 1609153 - RNA, 17 nt, Human
uuccuaauccucuagga

SEQ ID NO: 1609154 - RNA, 17 nt, Human
uuccuguucccaugaga

SEQ ID NO: 1609155 - RNA, 11 nt, Human
uuccucuuucc

SEQ ID NO: 1609156 - RNA, 15 nt, Human
uuccugggagcuuuu

SEQ ID NO: 1609157 - RNA, 16 nt, Human
uuccugggagcuuuug

SEQ ID NO: 1609158 - RNA, 14 nt, Human
uuccuucagugccu

SEQ ID NO: 1609159 - RNA, 11 nt, Human
uuccuucagug

SEQ ID NO: 1609160 - RNA, 15 nt, Human
uuccuucagugccuu

SEQ ID NO: 1609161 - RNA, 20 nt, Human
auauuuucaacgcagcccug

SEQ ID NO: 1609162 - RNA, 19 nt, Human
auauuuucaacgcagcccu

SEQ ID NO: 1609163 - RNA, 21 nt, Human
auauuuucaugcuguucauga

SEQ ID NO: 1609164 - RNA, 18 nt, Human
auauuuucaugcuguuca

SEQ ID NO: 1609165 - RNA, 17 nt, Human
aucagcacgauuucugu

SEQ ID NO: 1609166 - RNA, 18 nt, Human
aucagcacgauuucuguu

SEQ ID NO: 1609167 - RNA, 15 nt, Human
aucagcacgauuucu

SEQ ID NO: 1609168 - RNA, 16 nt, Human
aucagcacgauuucug

SEQ ID NO: 1609169 - RNA, 23 nt, Human
aucauaguggcuuaaaacaacac

SEQ ID NO: 1609170 - RNA, 15 nt, Human
aucauugaaaucuuu

SEQ ID NO: 1609171 - RNA, 14 nt, Human
aucauugaaaucuu

SEQ ID NO: 1609172 - RNA, 22 nt, Human
aucauuaaagccugaguuugcu

SEQ ID NO: 1609173 - RNA, 14 nt, Human
aucauucauuuucu

SEQ ID NO: 1609174 - RNA, 18 nt, Human
uucucaacuccaaacuga

SEQ ID NO: 1609175 - RNA, 14 nt, Human
uucucaacuccaaa

SEQ ID NO: 1609176 - RNA, 13 nt, Human
uucuaggccuggg

SEQ ID NO: 1609177 - RNA, 23 nt, Human
uucucagaaucucaaauaacuaa

SEQ ID NO: 1609178 - RNA, 22 nt, Human
uucucagaaucucaaauaacua

SEQ ID NO: 1609179 - RNA, 19 nt, Human
uucucagaaucucaaauaa

SEQ ID NO: 1609180 - RNA, 20 nt, Human
uucucacagcuccaagaauu

SEQ ID NO: 1609181 - RNA, 14 nt, Human
aucccucccuccac

SEQ ID NO: 1609182 - RNA, 23 nt, Human
aucccucccuccaccucccugca

SEQ ID NO: 1609183 - RNA, 11 nt, Human
aucccucccuc

SEQ ID NO: 1609184 - RNA, 13 nt, Human
aucccucccucca

SEQ ID NO: 1609185 - RNA, 16 nt, Human
aucccauaugccuggg

SEQ ID NO: 1609186 - RNA, 17 nt, Human
aucccauaugccugggc

SEQ ID NO: 1609187 - RNA, 16 nt, Human
auccagguucagcuug

SEQ ID NO: 1609188 - RNA, 15 nt, Human
auccagguucagcuu

SEQ ID NO: 1609189 - RNA, 17 nt, Human
auccaggguggugguga

SEQ ID NO: 1609190 - RNA, 17 nt, Human
aucccaggauguacaag

SEQ ID NO: 1609191 - RNA, 13 nt, Human
uucugaagaagau

SEQ ID NO: 1609192 - RNA, 12 nt, Human
uucugaagaaga

SEQ ID NO: 1609193 - RNA, 21 nt, Human
uucugaaauuuccugggagcu

SEQ ID NO: 1609194 - RNA, 23 nt, Human
uucugcaucagcugcugaaacaa

SEQ ID NO: 1609195 - RNA, 14 nt, Human
uucugaagaagaug

SEQ ID NO: 1609196 - RNA, 15 nt, Human
uucugaaagggacgc

SEQ ID NO: 1609197 - RNA, 19 nt, Human
aucauugaaaucuuuuugc

SEQ ID NO: 1609198 - RNA, 20 nt, Human
aucauugaaaucuuuuugcu

SEQ ID NO: 1609199 - RNA, 22 nt, Human
uucugggacacaguucaauucu

SEQ ID NO: 1609200 - RNA, 11 nt, Human
uucugggacac

SEQ ID NO: 1609201 - RNA, 10 nt, Human
uucugggaca

SEQ ID NO: 1609202 - RNA, 23 nt, Human
uucugccgcagcccugcagaggg

SEQ ID NO: 1609203 - RNA, 15 nt, Human
uucaaacauauauaa

SEQ ID NO: 1609204 - RNA, 16 nt, Human
uucaaaauuguuacaa

SEQ ID NO: 1609205 - RNA, 15 nt, Human
uucaaggauccugag

SEQ ID NO: 1609206 - RNA, 21 nt, Human
uucaaggauccugagccagau

SEQ ID NO: 1609207 - RNA, 19 nt, Human
uucaaggauccugagccag

SEQ ID NO: 1609208 - RNA, 18 nt, Human
uucaaggauccugagcca

SEQ ID NO: 1609209 - RNA, 16 nt, Human
uucaaggauccugagc

SEQ ID NO: 1609210 - RNA, 22 nt, Human
uucaagugauucucaugccuca

SEQ ID NO: 1609211 - RNA, 20 nt, Human
uucaagugauucucaugccu

SEQ ID NO: 1609212 - RNA, 17 nt, Human
uucacauauugauuucc

SEQ ID NO: 1609213 - RNA, 13 nt, Human
uucacauuggaaa

SEQ ID NO: 1609214 - RNA, 19 nt, Human
uucacauuguauucagagu

SEQ ID NO: 1609215 - RNA, 22 nt, Human
uucaccacaugugcacaugcac

SEQ ID NO: 1609216 - RNA, 14 nt, Human
uucacauuggaaac

SEQ ID NO: 1609217 - RNA, 13 nt, Human
uucacaguucucu

SEQ ID NO: 1609218 - RNA, 21 nt, Human
auaggaauugacccacaagaa

SEQ ID NO: 1609219 - RNA, 19 nt, Human
auaggaacuuaaauaaugu

SEQ ID NO: 1609220 - RNA, 22 nt, Human
uucaccauguuggccaggcugg

SEQ ID NO: 1609221 - RNA, 22 nt, Human
uucaccauguuggccaggcugc

SEQ ID NO: 1609222 - RNA, 22 nt, Human
auaggaauugacccacaagaaa

SEQ ID NO: 1609223 - RNA, 17 nt, Human
auaggcacaggaaacca

SEQ ID NO: 1609224 - RNA, 22 nt, Human
auaggcaccuaccaccacgccc

SEQ ID NO: 1609225 - RNA, 17 nt, Human
uuauuguuuaaaaucau

SEQ ID NO: 1609226 - RNA, 17 nt, Human
auagcugggacuacagg

SEQ ID NO: 1609227 - RNA, 22 nt, Human
auagcuggucuuauuuguaaag

SEQ ID NO: 1609228 - RNA, 23 nt, Human
auagcuggucuuauuuguaaagc

SEQ ID NO: 1609229 - RNA, 14 nt, Human
uuauuuaaauuuua

SEQ ID NO: 1609230 - RNA, 22 nt, Human
uuauuuaaugaaagacuguaca

SEQ ID NO: 1609231 - RNA, 18 nt, Human
uuauuuaaugaaagacug

SEQ ID NO: 1609232 - RNA, 16 nt, Human
uuauuuaguuccuuga

SEQ ID NO: 1609233 - RNA, 15 nt, Human
uuauuuaguauuuau

SEQ ID NO: 1609234 - RNA, 17 nt, Human
uuauuuagcaccaggga

SEQ ID NO: 1609235 - RNA, 18 nt, Human
auagcuacuaauuuuaaa

SEQ ID NO: 1609236 - RNA, 16 nt, Human
auagcuagacugguga

SEQ ID NO: 1609237 - RNA, 15 nt, Human
auagcuagacuggug

SEQ ID NO: 1609238 - RNA, 14 nt, Human
auagcuagacuggu

SEQ ID NO: 1609239 - RNA, 19 nt, Human
auagcucaggugucccugc

SEQ ID NO: 1609240 - RNA, 23 nt, Human
auagcuagacuggugacugauuc

SEQ ID NO: 1609241 - RNA, 19 nt, Human
auagcuagacuggugacug

SEQ ID NO: 1609242 - RNA, 18 nt, Human
auagcuagacuggugacu

SEQ ID NO: 1609243 - RNA, 21 nt, Human
auagcucaggugucccugcac

SEQ ID NO: 1609244 - RNA, 20 nt, Human
auagcucaggugucccugca

SEQ ID NO: 1609245 - RNA, 22 nt, Human
auagcucaggugucccugcacu

SEQ ID NO: 1609246 - RNA, 12 nt, Human
auagcugggacu

SEQ ID NO: 1609247 - RNA, 14 nt, Human
auagcuacuaauuu

SEQ ID NO: 1609248 - RNA, 17 nt, Human
auagcuacuaauuuuaa

SEQ ID NO: 1609249 - RNA, 17 nt, Human
auaagauaaaugugcug

SEQ ID NO: 1609250 - RNA, 13 nt, Human
auaagauaaaugu

SEQ ID NO: 1609251 - RNA, 18 nt, Human
auagccugccucuucucu

SEQ ID NO: 1609252 - RNA, 19 nt, Human
auauaagcuuguauuccuu

SEQ ID NO: 1609253 - RNA, 17 nt, Human
auauaacaaugcuguau

SEQ ID NO: 1609254 - RNA, 15 nt, Human
auauaacaaugcugu

SEQ ID NO: 1609255 - RNA, 12 nt, Human
auauaacaaugc

SEQ ID NO: 1609256 - RNA, 19 nt, Human
auauauaacaaugcuguau

SEQ ID NO: 1609257 - RNA, 18 nt, Human
auauauaacaaugcugua

SEQ ID NO: 1609258 - RNA, 17 nt, Human
auauauaacaaugcugu

SEQ ID NO: 1609259 - RNA, 18 nt, Human
auagucaaauugugugaa

SEQ ID NO: 1609260 - RNA, 17 nt, Human
auagucaaauuguguga

SEQ ID NO: 1609261 - RNA, 15 nt, Human
uucagaaagaagugg

SEQ ID NO: 1609262 - RNA, 19 nt, Human
uucacugcuggcugccuua

SEQ ID NO: 1609263 - RNA, 18 nt, Human
uucacugcuggcugccuu

SEQ ID NO: 1609264 - RNA, 17 nt, Human
uucacugcuggcugccu

SEQ ID NO: 1609265 - RNA, 16 nt, Human
uucacugcuggcugcc

SEQ ID NO: 1609266 - RNA, 15 nt, Human
uucacugcuggcugc

SEQ ID NO: 1609267 - RNA, 13 nt, Human
uucacugcuggcu

SEQ ID NO: 1609268 - RNA, 14 nt, Human
uucagacagcugcc

SEQ ID NO: 1609269 - RNA, 17 nt, Human
uucagaucucuaacuuc

SEQ ID NO: 1609270 - RNA, 21 nt, Human
uucagcaaaaauauuuuauga

SEQ ID NO: 1609271 - RNA, 19 nt, Human
uucagccaagaauucuuaa

SEQ ID NO: 1609272 - RNA, 16 nt, Human
auaugcaaagcacuga

SEQ ID NO: 1609273 - RNA, 23 nt, Human
auaugcaaagcacugacuucuaa

SEQ ID NO: 1609274 - RNA, 13 nt, Human
auaugcacacauu

SEQ ID NO: 1609275 - RNA, 14 nt, Human
auaugucaagccau

SEQ ID NO: 1609276 - RNA, 13 nt, Human
auaugugaacagu

SEQ ID NO: 1609277 - RNA, 22 nt, Human
auaucugaaaauguauguguaa

SEQ ID NO: 1609278 - RNA, 18 nt, Human
auaucugaggaauucugu

SEQ ID NO: 1609279 - RNA, 17 nt, Human
auaucugaggaauucug

SEQ ID NO: 1609280 - RNA, 16 nt, Human
auaucugaggaauucu

SEQ ID NO: 1609281 - RNA, 15 nt, Human
auaucugaggaauuc

SEQ ID NO: 1609282 - RNA, 23 nt, Human
auaucugaggaauucuguauaga

SEQ ID NO: 1609283 - RNA, 22 nt, Human
auaucugaggaauucuguauag

SEQ ID NO: 1609284 - RNA, 21 nt, Human
auaucugaggaauucuguaua

SEQ ID NO: 1609285 - RNA, 20 nt, Human
auaucugaggaauucuguau

SEQ ID NO: 1609286 - RNA, 19 nt, Human
auaucugaggaauucugua

SEQ ID NO: 1609287 - RNA, 12 nt, Human
auaugauucaaa

SEQ ID NO: 1609288 - RNA, 20 nt, Human
auaugauuuaaaucagccgu

SEQ ID NO: 1609289 - RNA, 22 nt, Human
auaugauucaaaugucuauaaa

SEQ ID NO: 1609290 - RNA, 13 nt, Human
auaugauucaaau

SEQ ID NO: 1609291 - RNA, 14 nt, Human
uucaguaauaacuc

SEQ ID NO: 1609292 - RNA, 15 nt, Human
uucagccugccuucu

SEQ ID NO: 1609293 - RNA, 14 nt, Human
uucagccugccuuc

SEQ ID NO: 1609294 - RNA, 21 nt, Human
uucauauuuacuucuuauaca

SEQ ID NO: 1609295 - RNA, 16 nt, Human
uucauauuuacuucuu

SEQ ID NO: 1609296 - RNA, 18 nt, Human
uucaucauccuaagcuau

SEQ ID NO: 1609297 - RNA, 21 nt, Human
uucaucauccuaagcuauuca

SEQ ID NO: 1609298 - RNA, 22 nt, Human
auaucuauauuuuacauaaauu

SEQ ID NO: 1609299 - RNA, 20 nt, Human
auaucuauauuuuacauaaa

SEQ ID NO: 1609300 - RNA, 16 nt, Human
auaucuauauuuuaca

SEQ ID NO: 1609301 - RNA, 17 nt, Human
auaucuauauuuuacau

SEQ ID NO: 1609302 - RNA, 18 nt, Human
auauauucagccuggcuu

SEQ ID NO: 1609303 - RNA, 15 nt, Human
uuggagaagaacuga

SEQ ID NO: 1609304 - RNA, 22 nt, Human
uuggagaagaacugaaaucaua

SEQ ID NO: 1609305 - RNA, 17 nt, Human
uuggagaagaacugaaa

SEQ ID NO: 1609306 - RNA, 17 nt, Human
uuggaaaauaaauuauu

SEQ ID NO: 1609307 - RNA, 15 nt, Human
uuggaaaauaaauca

SEQ ID NO: 1609308 - RNA, 12 nt, Human
uuggaaaauaaa

SEQ ID NO: 1609309 - RNA, 20 nt, Human
uugcuuugugauuuuuguaa

SEQ ID NO: 1609310 - RNA, 16 nt, Human
uugcuuuguaugcacu

SEQ ID NO: 1609311 - RNA, 16 nt, Human
uugcuuuuaaaaucca

SEQ ID NO: 1609312 - RNA, 15 nt, Human
aucuuuaaaauacac

SEQ ID NO: 1609313 - RNA, 12 nt, Human
aucuuuaaaaua

SEQ ID NO: 1609314 - RNA, 18 nt, Human
uugcucuugaugccuggc

SEQ ID NO: 1609315 - RNA, 17 nt, Human
uugcucuugaugccugg

SEQ ID NO: 1609316 - RNA, 14 nt, Human
uugcucuugaugcc

SEQ ID NO: 1609317 - RNA, 15 nt, Human
uugcuuugugauuuu

SEQ ID NO: 1609318 - RNA, 13 nt, Human
uugcuuuguaugc

SEQ ID NO: 1609319 - RNA, 16 nt, Human
aucuuauaauuuaaaa

SEQ ID NO: 1609320 - RNA, 14 nt, Human
aucuugcucugcug

SEQ ID NO: 1609321 - RNA, 15 nt, Human
aucuuauaauuuaaa

SEQ ID NO: 1609322 - RNA, 16 nt, Human
aucuugcucugcugac

SEQ ID NO: 1609323 - RNA, 15 nt, Human
aucuugcucugcuga

SEQ ID NO: 1609324 - RNA, 17 nt, Human
aucuugcucugcugaca

SEQ ID NO: 1609325 - RNA, 22 nt, Human
aucugucauuugagcagggcuc

SEQ ID NO: 1609326 - RNA, 17 nt, Human
aucugucauuugagcag

SEQ ID NO: 1609327 - RNA, 12 nt, Human
aucugucauuug

SEQ ID NO: 1609328 - RNA, 17 nt, Human
augaaugaaacauuuug

SEQ ID NO: 1609329 - RNA, 15 nt, Human
augaagcaaugcuuc

SEQ ID NO: 1609330 - RNA, 14 nt, Human
augaagcaaugcuu

SEQ ID NO: 1609331 - RNA, 23 nt, Human
augaaccacaucuugcucugcug

SEQ ID NO: 1609332 - RNA, 18 nt, Human
augaaugucagugugacu

SEQ ID NO: 1609333 - RNA, 16 nt, Human
augaaugucaguguga

SEQ ID NO: 1609334 - RNA, 18 nt, Human
uuggugguuucagaaaug

SEQ ID NO: 1609335 - RNA, 19 nt, Human
uuggugguuucagaaaugu

SEQ ID NO: 1609336 - RNA, 19 nt, Human
uuggugucgggcaugacac

SEQ ID NO: 1609337 - RNA, 18 nt, Human
uuggugucgggcaugaca

SEQ ID NO: 1609338 - RNA, 17 nt, Human
uuggugucgggcaugac

SEQ ID NO: 1609339 - RNA, 14 nt, Human
uugguuuguaaauu

SEQ ID NO: 1609340 - RNA, 20 nt, Human
uugguuuucacauuggaaac

SEQ ID NO: 1609341 - RNA, 13 nt, Human
uuguaaauuguca

SEQ ID NO: 1609342 - RNA, 12 nt, Human
uuguaaugaaaa

SEQ ID NO: 1609343 - RNA, 22 nt, Human
uuguaagcaugcacaaauucug

SEQ ID NO: 1609344 - RNA, 23 nt, Human
uugauguucuuucacccuuuucu

SEQ ID NO: 1609345 - RNA, 22 nt, Human
uugcaagccagauuuuccugaa

SEQ ID NO: 1609346 - RNA, 18 nt, Human
uugcaacuuuguauaaaa

SEQ ID NO: 1609347 - RNA, 17 nt, Human
uugcaacuuuguauaaa

SEQ ID NO: 1609348 - RNA, 16 nt, Human
uugcaacuuuguauaa

SEQ ID NO: 1609349 - RNA, 15 nt, Human
uugauuaaauucuug

SEQ ID NO: 1609350 - RNA, 16 nt, Human
uugauuaaauucuugc

SEQ ID NO: 1609351 - RNA, 20 nt, Human
uugauuaaauucuugcaaag

SEQ ID NO: 1609352 - RNA, 21 nt, Human
uugauuaaauucuugcaaagu

SEQ ID NO: 1609353 - RNA, 23 nt, Human
aucucacacaugagcaucaggcc

SEQ ID NO: 1609354 - RNA, 16 nt, Human
aucucaaauuucuaaa

SEQ ID NO: 1609355 - RNA, 17 nt, Human
aucucaaauuucuaaau

SEQ ID NO: 1609356 - RNA, 16 nt, Human
aucucaccuccugcug

SEQ ID NO: 1609357 - RNA, 15 nt, Human
aucucaccuccugcu

SEQ ID NO: 1609358 - RNA, 12 nt, Human
aucugaaaaugu

SEQ ID NO: 1609359 - RNA, 16 nt, Human
aucucuuguuuaaauu

SEQ ID NO: 1609360 - RNA, 23 nt, Human
aucugaagucagaucugccuaag

SEQ ID NO: 1609361 - RNA, 18 nt, Human
aucugaagucagaucugc

SEQ ID NO: 1609362 - RNA, 17 nt, Human
aucugaagucagaucug

SEQ ID NO: 1609363 - RNA, 16 nt, Human
aucugaagucagaucu

SEQ ID NO: 1609364 - RNA, 23 nt, Human
uugcccaggcuggcgugcagugg

SEQ ID NO: 1609365 - RNA, 14 nt, Human
uugcccaggcuggc

SEQ ID NO: 1609366 - RNA, 12 nt, Human
uugcccaggcug

SEQ ID NO: 1609367 - RNA, 11 nt, Human
uugcccaggcu

SEQ ID NO: 1609368 - RNA, 18 nt, Human
uugcccaggcaggucuug

SEQ ID NO: 1609369 - RNA, 16 nt, Human
uugcccaggcaggucu

SEQ ID NO: 1609370 - RNA, 14 nt, Human
uugcccaggcaggu

SEQ ID NO: 1609371 - RNA, 13 nt, Human
uugcccaggcagg

SEQ ID NO: 1609372 - RNA, 14 nt, Human
uugcaauggcagcc

SEQ ID NO: 1609373 - RNA, 21 nt, Human
uugcaccacugcacuccagcc

SEQ ID NO: 1609374 - RNA, 14 nt, Human
uugcaugaggcuag

SEQ ID NO: 1609375 - RNA, 20 nt, Human
aucucaaaacugcacuguca

SEQ ID NO: 1609376 - RNA, 19 nt, Human
aucucaaaacugcacuguc

SEQ ID NO: 1609377 - RNA, 15 nt, Human
aucucaaaacugcac

SEQ ID NO: 1609378 - RNA, 21 nt, Human
aucucaaauaacuaaaaggua

SEQ ID NO: 1609379 - RNA, 14 nt, Human
aucucaaauaacua

SEQ ID NO: 1609380 - RNA, 23 nt, Human
aucucaaauaacuaaaagguaug

SEQ ID NO: 1609381 - RNA, 14 nt, Human
aucucaaauuucua

SEQ ID NO: 1609382 - RNA, 19 nt, Human
aucuaggaagacuuuggaa

SEQ ID NO: 1609383 - RNA, 18 nt, Human
aucuaggaagacuuugga

SEQ ID NO: 1609384 - RNA, 17 nt, Human
aucuaggaagacuuugg

SEQ ID NO: 1609385 - RNA, 19 nt, Human
aucuagauacuguaucaug

SEQ ID NO: 1609386 - RNA, 21 nt, Human
uugagugcugucuccauguuu

SEQ ID NO: 1609387 - RNA, 17 nt, Human
uugauacuacaguuugu

SEQ ID NO: 1609388 - RNA, 18 nt, Human
uugauagcacagacccug

SEQ ID NO: 1609389 - RNA, 18 nt, Human
aucuagauacuguaucau

SEQ ID NO: 1609390 - RNA, 23 nt, Human
aucuaauauguaacaagccaccc

SEQ ID NO: 1609391 - RNA, 12 nt, Human
uugacuuuuuau

SEQ ID NO: 1609392 - RNA, 17 nt, Human
uugaccauucuccaccu

SEQ ID NO: 1609393 - RNA, 11 nt, Human
uugagacagag

SEQ ID NO: 1609394 - RNA, 10 nt, Human
uugagacaga

SEQ ID NO: 1609395 - RNA, 12 nt, Human
uugagcagggcu

SEQ ID NO: 1609396 - RNA, 12 nt, Human
uugagacagagu

SEQ ID NO: 1609397 - RNA, 16 nt, Human
uugagcagggcucagc

SEQ ID NO: 1609398 - RNA, 13 nt, Human
uugacaugggaca

SEQ ID NO: 1609399 - RNA, 16 nt, Human
uugacaucaacugcau

SEQ ID NO: 1609400 - RNA, 19 nt, Human
uugacagggcacaccgggc

SEQ ID NO: 1609401 - RNA, 12 nt, Human
uugacagggcac

SEQ ID NO: 1609402 - RNA, 10 nt, Human
uugacagggc

SEQ ID NO: 1609403 - RNA, 19 nt, Human
uugacaggauuauuggaaa

SEQ ID NO: 1609404 - RNA, 15 nt, Human
augagguacugagag

SEQ ID NO: 1609405 - RNA, 18 nt, Human
augagguacugagaguga

SEQ ID NO: 1609406 - RNA, 17 nt, Human
augagguacugagagug

SEQ ID NO: 1609407 - RNA, 18 nt, Human
uuguagcauccuggaaua

SEQ ID NO: 1609408 - RNA, 16 nt, Human
uuguagcauccuggaa

SEQ ID NO: 1609409 - RNA, 18 nt, Human
augaggucagagccugca

SEQ ID NO: 1609410 - RNA, 16 nt, Human
augaggucagagccug

SEQ ID NO: 1609411 - RNA, 15 nt, Human
augaggucagagccu

SEQ ID NO: 1609412 - RNA, 21 nt, Human
augagguacaaccuguucugc

SEQ ID NO: 1609413 - RNA, 20 nt, Human
augaggucagagccugcagu

SEQ ID NO: 1609414 - RNA, 19 nt, Human
augaggucagagccugcag

SEQ ID NO: 1609415 - RNA, 22 nt, Human
augaggucagagccugcaguua

SEQ ID NO: 1609416 - RNA, 20 nt, Human
uugucaauaaaauccauaca

SEQ ID NO: 1609417 - RNA, 23 nt, Human
augaguccccuguuuguuucuga

SEQ ID NO: 1609418 - RNA, 13 nt, Human
augaguccccugu

SEQ ID NO: 1609419 - RNA, 21 nt, Human
uugucauauaagauucauauu

SEQ ID NO: 1609420 - RNA, 18 nt, Human
uugucacacacuuuggcu

SEQ ID NO: 1609421 - RNA, 17 nt, Human
uugucacacacuuuggc

SEQ ID NO: 1609422 - RNA, 22 nt, Human
uugugaugucccaacuuguaaa

SEQ ID NO: 1609423 - RNA, 18 nt, Human
uugugaugucccaacuug

SEQ ID NO: 1609424 - RNA, 20 nt, Human
uuguccccaccgcagacagg

SEQ ID NO: 1609425 - RNA, 18 nt, Human
uuguccccaccgcagaca

SEQ ID NO: 1609426 - RNA, 16 nt, Human
uuguccccgacccuug

SEQ ID NO: 1609427 - RNA, 15 nt, Human
uuguccccgacccuu

SEQ ID NO: 1609428 - RNA, 18 nt, Human
uugugaggaagccgcugg

SEQ ID NO: 1609429 - RNA, 17 nt, Human
uugugaggaagccgcug

SEQ ID NO: 1609430 - RNA, 20 nt, Human
uugugauacaaugcugugcc

SEQ ID NO: 1609431 - RNA, 13 nt, Human
uugugaggaagcc

SEQ ID NO: 1609432 - RNA, 17 nt, Human
uuguucuugguuuguaa

SEQ ID NO: 1609433 - RNA, 19 nt, Human
uuguucuugguuuguaaau

SEQ ID NO: 1609434 - RNA, 20 nt, Human
uuguucuugguuuguaaauu

SEQ ID NO: 1609435 - RNA, 13 nt, Human
augauuucauuca

SEQ ID NO: 1609436 - RNA, 14 nt, Human
augcaaagcacuga

SEQ ID NO: 1609437 - RNA, 13 nt, Human
augcaaagcacug

SEQ ID NO: 1609438 - RNA, 12 nt, Human
augcaaagcacu

SEQ ID NO: 1609439 - RNA, 18 nt, Human
uuuaaaaaaauuccaagu

SEQ ID NO: 1609440 - RNA, 18 nt, Human
augcagagguccacaaca

SEQ ID NO: 1609441 - RNA, 17 nt, Human
augcagagguccacaac

SEQ ID NO: 1609442 - RNA, 23 nt, Human
augcacuuuguucuggcucuucc

SEQ ID NO: 1609443 - RNA, 21 nt, Human
uuuaaauauaugcuaagucuu

SEQ ID NO: 1609444 - RNA, 11 nt, Human
uuuaaaugcac

SEQ ID NO: 1609445 - RNA, 14 nt, Human
uuuaaaugcugcuu

SEQ ID NO: 1609446 - RNA, 23 nt, Human
uuuaaaaauacagauagauauau

SEQ ID NO: 1609447 - RNA, 16 nt, Human
uuuaaugaaagacugu

SEQ ID NO: 1609448 - RNA, 22 nt, Human
uuuaaggguuuguggaaaauga

SEQ ID NO: 1609449 - RNA, 20 nt, Human
uuuaaggguuuguggaaaau

SEQ ID NO: 1609450 - RNA, 17 nt, Human
uuuaaggguuuguggaa

SEQ ID NO: 1609451 - RNA, 20 nt, Human
uuuaaggaugcuuguacaua

SEQ ID NO: 1609452 - RNA, 21 nt, Human
uuuaaggaugcuuguacauaa

SEQ ID NO: 1609453 - RNA, 22 nt, Human
uuuaaggaugcuuguacauaau

SEQ ID NO: 1609454 - RNA, 21 nt, Human
uuuaagcuguuacugucuuca

SEQ ID NO: 1609455 - RNA, 19 nt, Human
uuuaaggaugcuuguacau

SEQ ID NO: 1609456 - RNA, 12 nt, Human
uuuaagagaaau

SEQ ID NO: 1609457 - RNA, 14 nt, Human
uuuaagaggcaggg

SEQ ID NO: 1609458 - RNA, 14 nt, Human
uuuaagagacagcc

SEQ ID NO: 1609459 - RNA, 15 nt, Human
uuucaaacuuuacua

SEQ ID NO: 1609460 - RNA, 19 nt, Human
uuucaaacauauauaacaa

SEQ ID NO: 1609461 - RNA, 12 nt, Human
uuucaaacuuua

SEQ ID NO: 1609462 - RNA, 19 nt, Human
uuucacauuggaaacaagu

SEQ ID NO: 1609463 - RNA, 14 nt, Human
uuucacauuggaaa

SEQ ID NO: 1609464 - RNA, 13 nt, Human
uuucacauuggaa

SEQ ID NO: 1609465 - RNA, 21 nt, Human
uuucagaaagaaguggggaca

SEQ ID NO: 1609466 - RNA, 16 nt, Human
uuucccuauuagagaa

SEQ ID NO: 1609467 - RNA, 11 nt, Human
uuucagaaaug

SEQ ID NO: 1609468 - RNA, 12 nt, Human
uuucagaaaugu

SEQ ID NO: 1609469 - RNA, 13 nt, Human
uuucagaaaugug

SEQ ID NO: 1609470 - RNA, 19 nt, Human
uuucaugcuguucaugaaa

SEQ ID NO: 1609471 - RNA, 21 nt, Human
uuucaugcuguucaugaaaga

SEQ ID NO: 1609472 - RNA, 21 nt, Human
augcuucuguuuuauaauuuu

SEQ ID NO: 1609473 - RNA, 20 nt, Human
augcuucucacugccaugcc

SEQ ID NO: 1609474 - RNA, 16 nt, Human
augcuucucacugcca

SEQ ID NO: 1609475 - RNA, 18 nt, Human
auggaagacagcucuuau

SEQ ID NO: 1609476 - RNA, 17 nt, Human
auggaagacagcucuua

SEQ ID NO: 1609477 - RNA, 14 nt, Human
auggaaggggcuga

SEQ ID NO: 1609478 - RNA, 22 nt, Human
augcuguauuuuaaaagaauga

SEQ ID NO: 1609479 - RNA, 19 nt, Human
augcuguauuuuaaaagaa

SEQ ID NO: 1609480 - RNA, 20 nt, Human
augcuggcuguuggcugggg

SEQ ID NO: 1609481 - RNA, 19 nt, Human
augcuggcuguuggcuggg

SEQ ID NO: 1609482 - RNA, 23 nt, Human
augcuguauuuuaaaagaaugau

SEQ ID NO: 1609483 - RNA, 18 nt, Human
augcuggcuguuggcugg

SEQ ID NO: 1609484 - RNA, 19 nt, Human
augcuccuggcccacugca

SEQ ID NO: 1609485 - RNA, 14 nt, Human
augcuccuggccca

SEQ ID NO: 1609486 - RNA, 14 nt, Human
uuuaucagaauucu

SEQ ID NO: 1609487 - RNA, 21 nt, Human
uuuauaugcuucuguuuuaua

SEQ ID NO: 1609488 - RNA, 23 nt, Human
uuuagucuugucucagauuuuau

SEQ ID NO: 1609489 - RNA, 17 nt, Human
uuuagucuugucucaga

SEQ ID NO: 1609490 - RNA, 17 nt, Human
uuuagggguagcauuug

SEQ ID NO: 1609491 - RNA, 15 nt, Human
uuuagucuugucuca

SEQ ID NO: 1609492 - RNA, 15 nt, Human
uuuacuucuuauaca

SEQ ID NO: 1609493 - RNA, 14 nt, Human
uuuacuucuuauac

SEQ ID NO: 1609494 - RNA, 13 nt, Human
uuuacuucuuaua

SEQ ID NO: 1609495 - RNA, 11 nt, Human
uuuacuuaaac

SEQ ID NO: 1609496 - RNA, 16 nt, Human
uuuacugcagcuuugu

SEQ ID NO: 1609497 - RNA, 18 nt, Human
uuuaccugaagucuuugu

SEQ ID NO: 1609498 - RNA, 22 nt, Human
uuuaccugaagucuuuguacag

SEQ ID NO: 1609499 - RNA, 16 nt, Human
augcgugugugugugu

SEQ ID NO: 1609500 - RNA, 18 nt, Human
augcuacaggauuugaaa

SEQ ID NO: 1609501 - RNA, 22 nt, Human
augcgugcauaccacuuuuguu

SEQ ID NO: 1609502 - RNA, 12 nt, Human
augcgugugugu

SEQ ID NO: 1609503 - RNA, 17 nt, Human
augccucucucaggcca

SEQ ID NO: 1609504 - RNA, 13 nt, Human
augcgcaggcugg

SEQ ID NO: 1609505 - RNA, 22 nt, Human
augcgcaggcuggcccugcccu

SEQ ID NO: 1609506 - RNA, 20 nt, Human
augcgcaggcuggcccugcc

SEQ ID NO: 1609507 - RNA, 18 nt, Human
augcgcaggcuggcccug

SEQ ID NO: 1609508 - RNA, 14 nt, Human
augcgcaggcuggc

SEQ ID NO: 1609509 - RNA, 22 nt, Human
augccuuuucccaacuccagaa

SEQ ID NO: 1609510 - RNA, 20 nt, Human
augccuuuucccaacuccag

SEQ ID NO: 1609511 - RNA, 15 nt, Human
augccucucucaggc

SEQ ID NO: 1609512 - RNA, 14 nt, Human
augccucucucagg

SEQ ID NO: 1609513 - RNA, 13 nt, Human
augccucucucag

SEQ ID NO: 1609514 - RNA, 23 nt, Human
uuuaaugaaagacuguacaaagu

SEQ ID NO: 1609515 - RNA, 21 nt, Human
uuuaaugaaagacuguacaaa

SEQ ID NO: 1609516 - RNA, 14 nt, Human
augccaucaauaaa

SEQ ID NO: 1609517 - RNA, 16 nt, Human
augcccagccccuucu

SEQ ID NO: 1609518 - RNA, 21 nt, Human
augccaugaggaacaaggcaa

SEQ ID NO: 1609519 - RNA, 17 nt, Human
augcccagccccuucug

SEQ ID NO: 1609520 - RNA, 20 nt, Human
augccccugaauuuaaauag

SEQ ID NO: 1609521 - RNA, 15 nt, Human
augccccugaauuua

SEQ ID NO: 1609522 - RNA, 21 nt, Human
augccccgucccccucuggcu

SEQ ID NO: 1609523 - RNA, 13 nt, Human
auuugaauuuugu

SEQ ID NO: 1609524 - RNA, 15 nt, Human
auuugaauuuugugu

SEQ ID NO: 1609525 - RNA, 16 nt, Human
auuugagcagggcuca

SEQ ID NO: 1609526 - RNA, 15 nt, Human
auuugagcagggcuc

SEQ ID NO: 1609527 - RNA, 17 nt, Human
auuugaggucuguucuu

SEQ ID NO: 1609528 - RNA, 18 nt, Human
auuugaggucuguucuuu

SEQ ID NO: 1609529 - RNA, 16 nt, Human
auuucuuccacaagag

SEQ ID NO: 1609530 - RNA, 21 nt, Human
auuugaggucuguucuuucca

SEQ ID NO: 1609531 - RNA, 22 nt, Human
auuugaggucuguucuuuccaa

SEQ ID NO: 1609532 - RNA, 19 nt, Human
auuugauaugugaacaguu

SEQ ID NO: 1609533 - RNA, 18 nt, Human
auuugauaugugaacagu

SEQ ID NO: 1609534 - RNA, 21 nt, Human
auuuggugguuucagaaaugu

SEQ ID NO: 1609535 - RNA, 14 nt, Human
auuugguuuucaca

SEQ ID NO: 1609536 - RNA, 12 nt, Human
auuugguuuuca

SEQ ID NO: 1609537 - RNA, 21 nt, Human
auuuauuuuaauaauguuuca

SEQ ID NO: 1609538 - RNA, 23 nt, Human
auuuauuggcuuuucugauccag

SEQ ID NO: 1609539 - RNA, 20 nt, Human
auuuauuggcuuuucugauc

SEQ ID NO: 1609540 - RNA, 16 nt, Human
auuucccaaagcagug

SEQ ID NO: 1609541 - RNA, 14 nt, Human
auuucccaaagcag

SEQ ID NO: 1609542 - RNA, 14 nt, Human
auuuccuaaauaua

SEQ ID NO: 1609543 - RNA, 21 nt, Human
auuuccuaaauauauuuuaag

SEQ ID NO: 1609544 - RNA, 20 nt, Human
auuuauuacuguaagaaaau

SEQ ID NO: 1609545 - RNA, 19 nt, Human
auuuauuacuguaagaaaa

SEQ ID NO: 1609546 - RNA, 18 nt, Human
auuuauuggcuuuucuga

SEQ ID NO: 1609547 - RNA, 14 nt, Human
auuuauuggcuuuu

SEQ ID NO: 1609548 - RNA, 17 nt, Human
auuuaaaaaaaaaccug

SEQ ID NO: 1609549 - RNA, 19 nt, Human
auuguuuucaguguacaug

SEQ ID NO: 1609550 - RNA, 18 nt, Human
auuguuuucaguguacau

SEQ ID NO: 1609551 - RNA, 14 nt, Human
auuuaaaaaaaauc

SEQ ID NO: 1609552 - RNA, 16 nt, Human
auuguaguccuguaau

SEQ ID NO: 1609553 - RNA, 17 nt, Human
auuguagcauccuggaa

SEQ ID NO: 1609554 - RNA, 15 nt, Human
auuguacuuugugcu

SEQ ID NO: 1609555 - RNA, 17 nt, Human
auuguuuucaguguaca

SEQ ID NO: 1609556 - RNA, 20 nt, Human
auuguagcauccuggaauau

SEQ ID NO: 1609557 - RNA, 22 nt, Human
auuuaccacuuguguuuugcaa

SEQ ID NO: 1609558 - RNA, 15 nt, Human
auuuaccacuugugu

SEQ ID NO: 1609559 - RNA, 20 nt, Human
auuuacuaaaauggacugug

SEQ ID NO: 1609560 - RNA, 19 nt, Human
auuuacuaaaauggacugu

SEQ ID NO: 1609561 - RNA, 16 nt, Human
auuuacuaaaauggac

SEQ ID NO: 1609562 - RNA, 16 nt, Human
auuuaaauagcuuuuu

SEQ ID NO: 1609563 - RNA, 20 nt, Human
auuuacuucuuauacauuug

SEQ ID NO: 1609564 - RNA, 19 nt, Human
auuuacuucuuauacauuu

SEQ ID NO: 1609565 - RNA, 16 nt, Human
auuuaguguucauaaa

SEQ ID NO: 1609566 - RNA, 17 nt, Human
auuuaguguucauaaau

SEQ ID NO: 1609567 - RNA, 15 nt, Human
auuuauaaacuuuuu

SEQ ID NO: 1609568 - RNA, 12 nt, Human
auugcaccacug

SEQ ID NO: 1609569 - RNA, 19 nt, Human
auugcaacaggcugggcuu

SEQ ID NO: 1609570 - RNA, 18 nt, Human
auugcaacaggcugggcu

SEQ ID NO: 1609571 - RNA, 17 nt, Human
auugcaacaggcugggc

SEQ ID NO: 1609572 - RNA, 22 nt, Human
auuggggauucuuaaaguugaa

SEQ ID NO: 1609573 - RNA, 21 nt, Human
auuggggauucuuaaaguuga

SEQ ID NO: 1609574 - RNA, 20 nt, Human
auuggggauucuuaaaguug

SEQ ID NO: 1609575 - RNA, 16 nt, Human
auuggggauucuuaaa

SEQ ID NO: 1609576 - RNA, 15 nt, Human
auuggggauucuuaa

SEQ ID NO: 1609577 - RNA, 23 nt, Human
auuggcuagagguucaaagauau

SEQ ID NO: 1609578 - RNA, 14 nt, Human
auuggggauucuua

SEQ ID NO: 1609579 - RNA, 17 nt, Human
auuggagcucgugggac

SEQ ID NO: 1609580 - RNA, 16 nt, Human
auuggagcucguggaa

SEQ ID NO: 1609581 - RNA, 19 nt, Human
auuggcuagagguucaaag

SEQ ID NO: 1609582 - RNA, 20 nt, Human
auuggcuagagguucaaaga

SEQ ID NO: 1609583 - RNA, 22 nt, Human
auuggcuagagguucaaagaua

SEQ ID NO: 1609584 - RNA, 16 nt, Human
auugcauuuccugaca

SEQ ID NO: 1609585 - RNA, 13 nt, Human
auuggaaacaagu

SEQ ID NO: 1609586 - RNA, 14 nt, Human
auuggaaacaaguc

SEQ ID NO: 1609587 - RNA, 22 nt, Human
uuuuugggaaaagaaaagucaa

SEQ ID NO: 1609588 - RNA, 24 nt, Human
uuuuuggcauaacauaaaucugug

SEQ ID NO: 1609589 - RNA, 23 nt, Human
uuuuuggcauaacauaaaucugu

SEQ ID NO: 1609590 - RNA, 19 nt, Human
auuaaguacuauguaucaa

SEQ ID NO: 1609591 - RNA, 18 nt, Human
auuaaguacuauguauca

SEQ ID NO: 1609592 - RNA, 13 nt, Human
auuaaggaagaca

SEQ ID NO: 1609593 - RNA, 11 nt, Human
uuuuuguauuu

SEQ ID NO: 1609594 - RNA, 15 nt, Human
uuuuugaagcuguau

SEQ ID NO: 1609595 - RNA, 17 nt, Human
uuuuuauauuugaaaua

SEQ ID NO: 1609596 - RNA, 14 nt, Human
uuuugugaagcaaa

SEQ ID NO: 1609597 - RNA, 15 nt, Human
uuuuggaauuuuccu

SEQ ID NO: 1609598 - RNA, 15 nt, Human
uuuuguuuucauuau

SEQ ID NO: 1609599 - RNA, 16 nt, Human
uuuuguuuuugucuua

SEQ ID NO: 1609600 - RNA, 20 nt, Human
uuuuuauauuuacuaaaaug

SEQ ID NO: 1609601 - RNA, 16 nt, Human
auuacuguaagaaaau

SEQ ID NO: 1609602 - RNA, 15 nt, Human
auuacuguaagaaaa

SEQ ID NO: 1609603 - RNA, 13 nt, Human
auuacuucugcua

SEQ ID NO: 1609604 - RNA, 14 nt, Human
auuacuucugcuac

SEQ ID NO: 1609605 - RNA, 13 nt, Human
auuagagaagaga

SEQ ID NO: 1609606 - RNA, 17 nt, Human
auuauaugcuauuucua

SEQ ID NO: 1609607 - RNA, 16 nt, Human
auucaguuguuagugu

SEQ ID NO: 1609608 - RNA, 14 nt, Human
auucagccuggcuu

SEQ ID NO: 1609609 - RNA, 17 nt, Human
auucacugauuugacau

SEQ ID NO: 1609610 - RNA, 12 nt, Human
auucacugauuu

SEQ ID NO: 1609611 - RNA, 17 nt, Human
auuccaagugauugaaa

SEQ ID NO: 1609612 - RNA, 12 nt, Human
auuccacagcug

SEQ ID NO: 1609613 - RNA, 13 nt, Human
auuccacagcugc

SEQ ID NO: 1609614 - RNA, 18 nt, Human
auuccagagaguggcucc

SEQ ID NO: 1609615 - RNA, 19 nt, Human
auucccaagcucugcuccu

SEQ ID NO: 1609616 - RNA, 18 nt, Human
auucccaagcucugcucc

SEQ ID NO: 1609617 - RNA, 20 nt, Human
auuccccaggaggccagccu

SEQ ID NO: 1609618 - RNA, 22 nt, Human
auuccccaggaggccagccuug

SEQ ID NO: 1609619 - RNA, 20 nt, Human
auuauauggcuugaguuuaa

SEQ ID NO: 1609620 - RNA, 19 nt, Human
auuauaugcuauuucuaua

SEQ ID NO: 1609621 - RNA, 18 nt, Human
auuauaugcuauuucuau

SEQ ID NO: 1609622 - RNA, 19 nt, Human
auuauucacugauuugaca

SEQ ID NO: 1609623 - RNA, 24 nt, Human
auuauucaaaguugccuaaaucca

SEQ ID NO: 1609624 - RNA, 18 nt, Human
auuauucaaaguugccua

SEQ ID NO: 1609625 - RNA, 22 nt, Human
auuauucaaaguugccuaaauc

SEQ ID NO: 1609626 - RNA, 19 nt, Human
auuauucaaaguugccuaa

SEQ ID NO: 1609627 - RNA, 19 nt, Human
auuauaucugaggaauucu

SEQ ID NO: 1609628 - RNA, 18 nt, Human
auuauaucugaggaauuc

SEQ ID NO: 1609629 - RNA, 16 nt, Human
auuauaugcuauuucu

SEQ ID NO: 1609630 - RNA, 22 nt, Human
auuauaucugaggaauucugua

SEQ ID NO: 1609631 - RNA, 21 nt, Human
auuauaucugaggaauucugu

SEQ ID NO: 1609632 - RNA, 20 nt, Human
auuauaucugaggaauucug

SEQ ID NO: 1609633 - RNA, 22 nt, Human
auucaaacagucucaggaaauc

SEQ ID NO: 1609634 - RNA, 15 nt, Human
auucagccuggcuuc

SEQ ID NO: 1609635 - RNA, 19 nt, Human
uuugaccucugcagcaaua

SEQ ID NO: 1609636 - RNA, 21 nt, Human
uuugaccucugcagcaauaaa

SEQ ID NO: 1609637 - RNA, 14 nt, Human
uuugacaaggggca

SEQ ID NO: 1609638 - RNA, 18 nt, Human
uuugacaaagguaaauca

SEQ ID NO: 1609639 - RNA, 23 nt, Human
uuucccucccuuccucuuuccau

SEQ ID NO: 1609640 - RNA, 14 nt, Human
uuugaauuuugugu

SEQ ID NO: 1609641 - RNA, 12 nt, Human
uuugaauuuugu

SEQ ID NO: 1609642 - RNA, 15 nt, Human
uuugauccaagcugg

SEQ ID NO: 1609643 - RNA, 15 nt, Human
uuugauucagacagc

SEQ ID NO: 1609644 - RNA, 13 nt, Human
uuugagacagagu

SEQ ID NO: 1609645 - RNA, 20 nt, Human
uuugcuggagcucugcccau

SEQ ID NO: 1609646 - RNA, 19 nt, Human
uuugcuaagcauuccaacu

SEQ ID NO: 1609647 - RNA, 19 nt, Human
uuugcuggggccgaaagaa

SEQ ID NO: 1609648 - RNA, 22 nt, Human
uuugcuggggccgaaagaacag

SEQ ID NO: 1609649 - RNA, 22 nt, Human
uuuggauuggaugaauuccaaa

SEQ ID NO: 1609650 - RNA, 18 nt, Human
uuugauucagacagcugc

SEQ ID NO: 1609651 - RNA, 13 nt, Human
uuuggcugcugaa

SEQ ID NO: 1609652 - RNA, 12 nt, Human
uuuggcugcuga

SEQ ID NO: 1609653 - RNA, 14 nt, Human
uuugggcugcccug

SEQ ID NO: 1609654 - RNA, 22 nt, Human
uuugggguacccacugcucugg

SEQ ID NO: 1609655 - RNA, 21 nt, Human
uuugggguacccacugcucug

SEQ ID NO: 1609656 - RNA, 13 nt, Human
uuuggggaagaac

SEQ ID NO: 1609657 - RNA, 19 nt, Human
auguauauuuuauaucaau

SEQ ID NO: 1609658 - RNA, 12 nt, Human
auguaucaauga

SEQ ID NO: 1609659 - RNA, 18 nt, Human
auguccaagaagcccagg

SEQ ID NO: 1609660 - RNA, 17 nt, Human
auguccaagaagcccag

SEQ ID NO: 1609661 - RNA, 16 nt, Human
auguccaagaagccca

SEQ ID NO: 1609662 - RNA, 23 nt, Human
augucgucaaagcugaaauggac

SEQ ID NO: 1609663 - RNA, 13 nt, Human
augugagaccauu

SEQ ID NO: 1609664 - RNA, 14 nt, Human
augugagacugguu

SEQ ID NO: 1609665 - RNA, 17 nt, Human
uuuguaguguuggagaa

SEQ ID NO: 1609666 - RNA, 14 nt, Human
uuuguacagacaac

SEQ ID NO: 1609667 - RNA, 16 nt, Human
uuuguaauuuuuuuau

SEQ ID NO: 1609668 - RNA, 15 nt, Human
augugaugagaggaa

SEQ ID NO: 1609669 - RNA, 18 nt, Human
augugauccuuuuggagu

SEQ ID NO: 1609670 - RNA, 14 nt, Human
uuugucuuaaaaag

SEQ ID NO: 1609671 - RNA, 13 nt, Human
uuugucuuaaaaa

SEQ ID NO: 1609672 - RNA, 23 nt, Human
uuugucuuaaaaaguggaaaaau

SEQ ID NO: 1609673 - RNA, 16 nt, Human
uuugugauacaaugcu

SEQ ID NO: 1609674 - RNA, 22 nt, Human
uuugugauacaaugcugugccc

SEQ ID NO: 1609675 - RNA, 19 nt, Human
uuugugcauuaucuagaua

SEQ ID NO: 1609676 - RNA, 22 nt, Human
uuugugcauuaucuagauacug

SEQ ID NO: 1609677 - RNA, 16 nt, Human
uuuguuucugaaaggg

SEQ ID NO: 1609678 - RNA, 14 nt, Human
uuuguuucugaaag

SEQ ID NO: 1609679 - RNA, 15 nt, Human
auguguguuuuaaaa

SEQ ID NO: 1609680 - RNA, 21 nt, Human
augugcuaguaauuggaaagg

SEQ ID NO: 1609681 - RNA, 21 nt, Human
augugccagguuuuuggucug

SEQ ID NO: 1609682 - RNA, 18 nt, Human
uuuuaaaaaacugcugac

SEQ ID NO: 1609683 - RNA, 21 nt, Human
uuuuaaaaaacugcugacugu

SEQ ID NO: 1609684 - RNA, 19 nt, Human
auguuacauaagauaaaug

SEQ ID NO: 1609685 - RNA, 20 nt, Human
auguuacauaagauaaaugu

SEQ ID NO: 1609686 - RNA, 13 nt, Human
auguuggccaggc

SEQ ID NO: 1609687 - RNA, 21 nt, Human
uuuuagacccuauugcugcuu

SEQ ID NO: 1609688 - RNA, 17 nt, Human
uuuuagaguugauacua

SEQ ID NO: 1609689 - RNA, 16 nt, Human
auguugcccaggcagg

SEQ ID NO: 1609690 - RNA, 15 nt, Human
auguugaagccuuug

SEQ ID NO: 1609691 - RNA, 15 nt, Human
auguugcccaggcag

SEQ ID NO: 1609692 - RNA, 14 nt, Human
auguugcccaggca

SEQ ID NO: 1609693 - RNA, 13 nt, Human
auguugcccaggc

SEQ ID NO: 1609694 - RNA, 18 nt, Human
auguugaaagaucaaaag

SEQ ID NO: 1609695 - RNA, 12 nt, Human
auguugaaagau

SEQ ID NO: 1609696 - RNA, 20 nt, Human
uuuucaggcuagauguaugu

SEQ ID NO: 1609697 - RNA, 14 nt, Human
uuuucaguguacau

SEQ ID NO: 1609698 - RNA, 16 nt, Human
uuuucuauaauuuaaa

SEQ ID NO: 1609699 - RNA, 17 nt, Human
uuuucucugauacagaa

SEQ ID NO: 1609700 - RNA, 12 nt, Human
uuuuauuaaauu

SEQ ID NO: 1609701 - RNA, 21 nt, Human
uuuuauggcuuuugugcauua

SEQ ID NO: 1609702 - RNA, 15 nt, Human
uuuuaguagagacag

SEQ ID NO: 1609703 - RNA, 23 nt, Human
uuuuagaguugauacuacaguuu

SEQ ID NO: 1609704 - RNA, 18 nt, Human
uuuuauggcuuuugugca

SEQ ID NO: 1609705 - RNA, 19 nt, Human
uuuuauggcuuuugugcau

SEQ ID NO: 1609706 - RNA, 17 nt, Human
auguuggccaggcuggu

SEQ ID NO: 1609707 - RNA, 12 nt, Human
auguuuauuaca

SEQ ID NO: 1609708 - RNA, 13 nt, Human
uuuucuguucuuu

SEQ ID NO: 1609709 - RNA, 21 nt, Human
uuuucuuaaccagaucauugu

SEQ ID NO: 1609710 - RNA, 19 nt, Human
uuuucugauccaguuuugu

SEQ ID NO: 1609711 - RNA, 19 nt, Human
auuaaaacacaacaucuuu

SEQ ID NO: 1609712 - RNA, 23 nt, Human
auuaaaaaucucaaauuucuaaa

SEQ ID NO: 1609713 - RNA, 15 nt, Human
auguuuuuuuuuaaa

SEQ ID NO: 1609714 - RNA, 23 nt, Human
auguuuauuacaguauaauuaac

SEQ ID NO: 1609715 - RNA, 22 nt, Human
auguuuauuacaguauaauuaa

SEQ ID NO: 1609716 - RNA, 19 nt, Human
auguuuauuacaguauaau

SEQ ID NO: 1609717 - RNA, 18 nt, Human
auguuuauuacaguauaa

SEQ ID NO: 1609718 - RNA, 16 nt, Human
auguuuauuacaguau

SEQ ID NO: 1609719 - RNA, 15 nt, Human
auguuuauuacagua

SEQ ID NO: 1609720 - RNA, 12 nt, Human
aucaaaggacac

SEQ ID NO: 1609721 - RNA, 19 nt, Human
aucaaagagguuuuaaaaa

SEQ ID NO: 1609722 - RNA, 20 nt, Human
aucaaaagguuaauaaagua

SEQ ID NO: 1609723 - RNA, 24 nt, Human
aucaaaagguuaauaaaguaauua

SEQ ID NO: 1609724 - RNA, 14 nt, Human
aucaaaagaaagaa

SEQ ID NO: 1609725 - RNA, 19 nt, Human
auauuuuuuucugaaauuu

SEQ ID NO: 1609726 - RNA, 18 nt, Human
auauuuuuuucuuuucuu

SEQ ID NO: 1609727 - RNA, 18 nt, Human
auauuuuuuucugaaauu

SEQ ID NO: 1609728 - RNA, 16 nt, Human
auauuuuuuucugaaa

SEQ ID NO: 1609729 - RNA, 14 nt, Human
auauuuuuuucuga

SEQ ID NO: 1609730 - RNA, 14 nt, Human
auagcacagacccu

SEQ ID NO: 1609731 - RNA, 15 nt, Human
auagcacagacccug

SEQ ID NO: 1609732 - RNA, 21 nt, Human
aucaugaauuaguuuuauaug

SEQ ID NO: 1609733 - RNA, 20 nt, Human
aucaugacaaagacugagua

SEQ ID NO: 1609734 - RNA, 15 nt, Human
aucauccuaagcuau

SEQ ID NO: 1609735 - RNA, 19 nt, Human
aucauggagguuugaagau

SEQ ID NO: 1609736 - RNA, 21 nt, Human
auccacugugccaugugccag

SEQ ID NO: 1609737 - RNA, 23 nt, Human
auccacuuuaucuugaauaaugu

SEQ ID NO: 1609738 - RNA, 18 nt, Human
auccagcagauuauucac

SEQ ID NO: 1609739 - RNA, 12 nt, Human
auccuugaagau

SEQ ID NO: 1609740 - RNA, 14 nt, Human
aucgaccugccucg

SEQ ID NO: 1609741 - RNA, 22 nt, Human
aucuaggaagacuuuggaaaga

SEQ ID NO: 1609742 - RNA, 23 nt, Human
auggcuuccuggcaauagucaaa

SEQ ID NO: 1609743 - RNA, 18 nt, Human
auggcuuuguauagaacc

SEQ ID NO: 1609744 - RNA, 16 nt, Human
auggcuuuguauagaa

SEQ ID NO: 1609745 - RNA, 15 nt, Human
auggcuuuguauaga

SEQ ID NO: 1609746 - RNA, 20 nt, Human
augggaaagcauuguaaaug

SEQ ID NO: 1609747 - RNA, 14 nt, Human
augggaaagcauug

SEQ ID NO: 1609748 - RNA, 15 nt, Human
augggacagggagga

SEQ ID NO: 1609749 - RNA, 20 nt, Human
augggacauuugcucaugga

SEQ ID NO: 1609750 - RNA, 22 nt, Human
augcuucuucagagacuccugc

SEQ ID NO: 1609751 - RNA, 20 nt, Human
augcuucuucagagacuccu

SEQ ID NO: 1609752 - RNA, 17 nt, Human
augcuucuucagagacu

SEQ ID NO: 1609753 - RNA, 14 nt, Human
augcuucuucagag

SEQ ID NO: 1609754 - RNA, 19 nt, Human
augcucugcauguuacaua

SEQ ID NO: 1609755 - RNA, 18 nt, Human
augcucugcauguuacau

SEQ ID NO: 1609756 - RNA, 16 nt, Human
augcuuugaucccuuc

SEQ ID NO: 1609757 - RNA, 24 nt, Human
augcauauuauuuuauguugcaua

SEQ ID NO: 1609758 - RNA, 21 nt, Human
augccugguggcagcugcggu

SEQ ID NO: 1609759 - RNA, 19 nt, Human
augccugguggcagcugcg

SEQ ID NO: 1609760 - RNA, 14 nt, Human
augccugguggcag

SEQ ID NO: 1609761 - RNA, 13 nt, Human
augccugguggca

SEQ ID NO: 1609762 - RNA, 12 nt, Human
augccugguggc

SEQ ID NO: 1609763 - RNA, 13 nt, Human
augaaguacucau

SEQ ID NO: 1609764 - RNA, 23 nt, Human
augaaguaauaugcacacauuuu

SEQ ID NO: 1609765 - RNA, 14 nt, Human
augaaguaauaugc

SEQ ID NO: 1609766 - RNA, 21 nt, Human
augaaguaauaugcacacauu

SEQ ID NO: 1609767 - RNA, 17 nt, Human
augaauaaagacaccua

SEQ ID NO: 1609768 - RNA, 23 nt, Human
augaagcauuuacuuuguguuca

SEQ ID NO: 1609769 - RNA, 12 nt, Human
augaaagacugu

SEQ ID NO: 1609770 - RNA, 16 nt, Human
augaaacuuuuggaag

SEQ ID NO: 1609771 - RNA, 18 nt, Human
augaaacuuguguaaaua

SEQ ID NO: 1609772 - RNA, 12 nt, Human
augagccuggca

SEQ ID NO: 1609773 - RNA, 11 nt, Human
augagccuggc

SEQ ID NO: 1609774 - RNA, 21 nt, Human
augagccucagcauccuggca

SEQ ID NO: 1609775 - RNA, 18 nt, Human
augaccuuucaauaggaa

SEQ ID NO: 1609776 - RNA, 15 nt, Human
augaccuuucaauag

SEQ ID NO: 1609777 - RNA, 13 nt, Human
augaccuuucaau

SEQ ID NO: 1609778 - RNA, 23 nt, Human
aucuaggaagacuuuggaaagag

SEQ ID NO: 1609779 - RNA, 11 nt, Human
aucuaggauuu

SEQ ID NO: 1609780 - RNA, 19 nt, Human
aucuaggauuuuaagggaa

SEQ ID NO: 1609781 - RNA, 14 nt, Human
agugacagaggcag

SEQ ID NO: 1609782 - RNA, 19 nt, Human
agugacagaggcagcccca

SEQ ID NO: 1609783 - RNA, 16 nt, Human
agugacagaggcagcc

SEQ ID NO: 1609784 - RNA, 19 nt, Human
agugaugucacuagggcag

SEQ ID NO: 1609785 - RNA, 23 nt, Human
agugauccucccaccucagccuc

SEQ ID NO: 1609786 - RNA, 13 nt, Human
agugauuaccagg

SEQ ID NO: 1609787 - RNA, 22 nt, Human
agugauccucccaccucagccu

SEQ ID NO: 1609788 - RNA, 20 nt, Human
agugauccucccaccucagc

SEQ ID NO: 1609789 - RNA, 15 nt, Human
agugauuaccaggga

SEQ ID NO: 1609790 - RNA, 20 nt, Human
agugauucuccugccucagc

SEQ ID NO: 1609791 - RNA, 19 nt, Human
agugauucuccugccucag

SEQ ID NO: 1609792 - RNA, 18 nt, Human
agugauucuccugccuca

SEQ ID NO: 1609793 - RNA, 22 nt, Human
agugccuuauggaacacucuga

SEQ ID NO: 1609794 - RNA, 21 nt, Human
agugccuuauggaacacucug

SEQ ID NO: 1609795 - RNA, 20 nt, Human
agugccuuauggaacacucu

SEQ ID NO: 1609796 - RNA, 19 nt, Human
agugccuuauggaacacuc

SEQ ID NO: 1609797 - RNA, 13 nt, Human
agucauuuaauaa

SEQ ID NO: 1609798 - RNA, 18 nt, Human
aguccuuaccagcagagc

SEQ ID NO: 1609799 - RNA, 16 nt, Human
aguccuuaccagcaga

SEQ ID NO: 1609800 - RNA, 14 nt, Human
aguccucuuuucug

SEQ ID NO: 1609801 - RNA, 16 nt, Human
agucgaggacagggag

SEQ ID NO: 1609802 - RNA, 19 nt, Human
aguccuuaccagcagagca

SEQ ID NO: 1609803 - RNA, 22 nt, Human
agucugauucccaagcucugcu

SEQ ID NO: 1609804 - RNA, 21 nt, Human
agucugauucccaagcucugc

SEQ ID NO: 1609805 - RNA, 18 nt, Human
agucuggcccuuccuuuu

SEQ ID NO: 1609806 - RNA, 21 nt, Human
agucuggcuguacccaggaau

SEQ ID NO: 1609807 - RNA, 19 nt, Human
agucuggcuguacccagga

SEQ ID NO: 1609808 - RNA, 21 nt, Human
aguaaaugggggugcauuuga

SEQ ID NO: 1609809 - RNA, 19 nt, Human
aguaaaugggggugcauuu

SEQ ID NO: 1609810 - RNA, 20 nt, Human
aguaaaugggggugcauuug

SEQ ID NO: 1609811 - RNA, 17 nt, Human
aguaacuuacuuaggug

SEQ ID NO: 1609812 - RNA, 15 nt, Human
aguacuggagaaaau

SEQ ID NO: 1609813 - RNA, 22 nt, Human
aguacuucuccacccugcucuc

SEQ ID NO: 1609814 - RNA, 21 nt, Human
aguacuucuccacccugcucu

SEQ ID NO: 1609815 - RNA, 20 nt, Human
aguacuucuccacccugcuc

SEQ ID NO: 1609816 - RNA, 22 nt, Human
aguauauugauccagaaagaaa

SEQ ID NO: 1609817 - RNA, 16 nt, Human
auaaaaaauuaugaca

SEQ ID NO: 1609818 - RNA, 16 nt, Human
auaaaagacagugaaa

SEQ ID NO: 1609819 - RNA, 15 nt, Human
auaaaagacagugaa

SEQ ID NO: 1609820 - RNA, 11 nt, Human
aguuugcaguu

SEQ ID NO: 1609821 - RNA, 16 nt, Human
aguuugauuaaauucu

SEQ ID NO: 1609822 - RNA, 14 nt, Human
aguuugauuaaauu

SEQ ID NO: 1609823 - RNA, 22 nt, Human
aguuguuagugugucuuagugu

SEQ ID NO: 1609824 - RNA, 17 nt, Human
aguuguuagugugucuu

SEQ ID NO: 1609825 - RNA, 14 nt, Human
aguugaaaagacuc

SEQ ID NO: 1609826 - RNA, 18 nt, Human
aguugaaaaacagcugag

SEQ ID NO: 1609827 - RNA, 17 nt, Human
aguugaagacagagcua

SEQ ID NO: 1609828 - RNA, 16 nt, Human
aguugaagacagagcu

SEQ ID NO: 1609829 - RNA, 17 nt, Human
aguugaaaaacagcuga

SEQ ID NO: 1609830 - RNA, 18 nt, Human
aguuacacuaaaagguga

SEQ ID NO: 1609831 - RNA, 14 nt, Human
aguucauacccugu

SEQ ID NO: 1609832 - RNA, 21 nt, Human
aguuccaccaucaagccacca

SEQ ID NO: 1609833 - RNA, 18 nt, Human
aguuccaccaucaagcca

SEQ ID NO: 1609834 - RNA, 12 nt, Human
agugcuccagcc

SEQ ID NO: 1609835 - RNA, 15 nt, Human
auaaguggugugugu

SEQ ID NO: 1609836 - RNA, 15 nt, Human
auacaccacuacauu

SEQ ID NO: 1609837 - RNA, 18 nt, Human
auacaauuuuguuucugu

SEQ ID NO: 1609838 - RNA, 17 nt, Human
auacaauuuuguuucug

SEQ ID NO: 1609839 - RNA, 16 nt, Human
auacaauuuuguuucu

SEQ ID NO: 1609840 - RNA, 14 nt, Human
auacaauuuuguuu

SEQ ID NO: 1609841 - RNA, 12 nt, Human
auaauguuaaca

SEQ ID NO: 1609842 - RNA, 23 nt, Human
auacaaugcugugcccuaaagug

SEQ ID NO: 1609843 - RNA, 21 nt, Human
auaaagaugagugagcaugcc

SEQ ID NO: 1609844 - RNA, 17 nt, Human
auacaccacuacauucu

SEQ ID NO: 1609845 - RNA, 18 nt, Human
auacaccacuacauucug

SEQ ID NO: 1609846 - RNA, 18 nt, Human
auacaccgggccuggaga

SEQ ID NO: 1609847 - RNA, 14 nt, Human
auacaccgggccug

SEQ ID NO: 1609848 - RNA, 22 nt, Human
agaacagugauuaccagggacu

SEQ ID NO: 1609849 - RNA, 18 nt, Human
agaaccaaaaagaggcua

SEQ ID NO: 1609850 - RNA, 17 nt, Human
agaaccaaaaagaggcu

SEQ ID NO: 1609851 - RNA, 17 nt, Human
agaacaucccuccuggg

SEQ ID NO: 1609852 - RNA, 13 nt, Human
agaacaucccucc

SEQ ID NO: 1609853 - RNA, 13 nt, Human
agaagagcuguuc

SEQ ID NO: 1609854 - RNA, 23 nt, Human
agaagagaaugcacaaacagagg

SEQ ID NO: 1609855 - RNA, 15 nt, Human
agaagagaaugcaca

SEQ ID NO: 1609856 - RNA, 21 nt, Human
agaagagcuguucacagccag

SEQ ID NO: 1609857 - RNA, 20 nt, Human
agaagagcuguucacagcca

SEQ ID NO: 1609858 - RNA, 21 nt, Human
agaagacugcauuauauuuau

SEQ ID NO: 1609859 - RNA, 20 nt, Human
agaaccaggcaacuugggaa

SEQ ID NO: 1609860 - RNA, 21 nt, Human
agaaccaaaaagaggcuaugu

SEQ ID NO: 1609861 - RNA, 17 nt, Human
agaaccaggcaacuugg

SEQ ID NO: 1609862 - RNA, 14 nt, Human
agaagucacacagu

SEQ ID NO: 1609863 - RNA, 19 nt, Human
agaagucuuagauguauau

SEQ ID NO: 1609864 - RNA, 17 nt, Human
agaagucuuagauguau

SEQ ID NO: 1609865 - RNA, 23 nt, Human
agaaugcacaaacagaggccgcc

SEQ ID NO: 1609866 - RNA, 18 nt, Human
agaaugcucuuuacuuca

SEQ ID NO: 1609867 - RNA, 17 nt, Human
agaaucucaaauaacua

SEQ ID NO: 1609868 - RNA, 16 nt, Human
agaaugaaagggccca

SEQ ID NO: 1609869 - RNA, 19 nt, Human
agacaaggaaaaaauaaca

SEQ ID NO: 1609870 - RNA, 20 nt, Human
agacaaugugaaaagaaaaa

SEQ ID NO: 1609871 - RNA, 15 nt, Human
agaauuuugagcagg

SEQ ID NO: 1609872 - RNA, 17 nt, Human
agacccaaaaggcagaa

SEQ ID NO: 1609873 - RNA, 18 nt, Human
agacgaaacauuuguucu

SEQ ID NO: 1609874 - RNA, 23 nt, Human
agaccaucccugaaggccccgcc

SEQ ID NO: 1609875 - RNA, 14 nt, Human
agaccacguuucua

SEQ ID NO: 1609876 - RNA, 15 nt, Human
agaccacguuucuaa

SEQ ID NO: 1609877 - RNA, 23 nt, Human
agacagcccgggcucugccuccc

SEQ ID NO: 1609878 - RNA, 22 nt, Human
agacagcccgggcucugccucc

SEQ ID NO: 1609879 - RNA, 14 nt, Human
agacaauuuauuau

SEQ ID NO: 1609880 - RNA, 13 nt, Human
agacagcccucca

SEQ ID NO: 1609881 - RNA, 15 nt, Human
agacuaucuaaaugu

SEQ ID NO: 1609882 - RNA, 19 nt, Human
agacgcugugcugcccugc

SEQ ID NO: 1609883 - RNA, 18 nt, Human
agacgcugugcugcccug

SEQ ID NO: 1609884 - RNA, 17 nt, Human
agacgcugugcugcccu

SEQ ID NO: 1609885 - RNA, 20 nt, Human
agacgcugugcugcccugcc

SEQ ID NO: 1609886 - RNA, 16 nt, Human
agacucuuuggacacu

SEQ ID NO: 1609887 - RNA, 23 nt, Human
agagagcaagacgcugugcugcc

SEQ ID NO: 1609888 - RNA, 19 nt, Human
agagagcaagacgcugugc

SEQ ID NO: 1609889 - RNA, 11 nt, Human
agagagcaaga

SEQ ID NO: 1609890 - RNA, 18 nt, Human
agagcccacgcccccacu

SEQ ID NO: 1609891 - RNA, 19 nt, Human
agauugcaacaggcugggc

SEQ ID NO: 1609892 - RNA, 17 nt, Human
agauugcaacaggcugg

SEQ ID NO: 1609893 - RNA, 16 nt, Human
agauugcaccacugca

SEQ ID NO: 1609894 - RNA, 16 nt, Human
agauucuuuccugagg

SEQ ID NO: 1609895 - RNA, 15 nt, Human
agauucuuuccugag

SEQ ID NO: 1609896 - RNA, 18 nt, Human
agauucuuuccugaggcu

SEQ ID NO: 1609897 - RNA, 16 nt, Human
agauugcaacaggcug

SEQ ID NO: 1609898 - RNA, 17 nt, Human
agauugagauguguuca

SEQ ID NO: 1609899 - RNA, 23 nt, Human
agcaaaauuuuuucucuaggaaa

SEQ ID NO: 1609900 - RNA, 19 nt, Human
agcaaauucuguuuuucua

SEQ ID NO: 1609901 - RNA, 14 nt, Human
agauucuuuccuga

SEQ ID NO: 1609902 - RNA, 20 nt, Human
agaugggugcuuggaggaag

SEQ ID NO: 1609903 - RNA, 22 nt, Human
agaugggugcuuggaggaagga

SEQ ID NO: 1609904 - RNA, 18 nt, Human
agaugacaucugucuagg

SEQ ID NO: 1609905 - RNA, 22 nt, Human
agauggcugugccucugccugu

SEQ ID NO: 1609906 - RNA, 21 nt, Human
agauggcugugccucugccug

SEQ ID NO: 1609907 - RNA, 20 nt, Human
agauggcugugccucugccu

SEQ ID NO: 1609908 - RNA, 19 nt, Human
agauggcugugccucugcc

SEQ ID NO: 1609909 - RNA, 18 nt, Human
agauggcugugccucugc

SEQ ID NO: 1609910 - RNA, 17 nt, Human
agauggcugugccucug

SEQ ID NO: 1609911 - RNA, 18 nt, Human
agaucugccuaaggacuu

SEQ ID NO: 1609912 - RNA, 13 nt, Human
agaucugccuaag

SEQ ID NO: 1609913 - RNA, 23 nt, Human
agaucucugcuuuggaaaucaca

SEQ ID NO: 1609914 - RNA, 18 nt, Human
agaucucugcuuuggaaa

SEQ ID NO: 1609915 - RNA, 20 nt, Human
agauagauaggucagugcaa

SEQ ID NO: 1609916 - RNA, 20 nt, Human
agauagccaaggccaaagga

SEQ ID NO: 1609917 - RNA, 13 nt, Human
agaguugaagaca

SEQ ID NO: 1609918 - RNA, 15 nt, Human
agaguugaagacaga

SEQ ID NO: 1609919 - RNA, 14 nt, Human
agaguugaagacag

SEQ ID NO: 1609920 - RNA, 19 nt, Human
agaggguggugaccucugc

SEQ ID NO: 1609921 - RNA, 20 nt, Human
agagggucugaggaauccag

SEQ ID NO: 1609922 - RNA, 15 nt, Human
agaguggcuccuccc

SEQ ID NO: 1609923 - RNA, 14 nt, Human
agaguggcuccucc

SEQ ID NO: 1609924 - RNA, 13 nt, Human
agaguggcuccuc

SEQ ID NO: 1609925 - RNA, 12 nt, Human
agaguggcuccu

SEQ ID NO: 1609926 - RNA, 16 nt, Human
agauaugauucaaaug

SEQ ID NO: 1609927 - RNA, 15 nt, Human
agauaugauucaaau

SEQ ID NO: 1609928 - RNA, 14 nt, Human
agauaugauucaaa

SEQ ID NO: 1609929 - RNA, 14 nt, Human
agccagcaguucag

SEQ ID NO: 1609930 - RNA, 23 nt, Human
agccagcaggcucucaggccagc

SEQ ID NO: 1609931 - RNA, 21 nt, Human
agccagcaggcucucaggcca

SEQ ID NO: 1609932 - RNA, 22 nt, Human
agccagcaggcucucaggccag

SEQ ID NO: 1609933 - RNA, 20 nt, Human
agcccacgcccccacuggug

SEQ ID NO: 1609934 - RNA, 14 nt, Human
agcccaccuuggcu

SEQ ID NO: 1609935 - RNA, 19 nt, Human
agcccacgcccccacuggu

SEQ ID NO: 1609936 - RNA, 18 nt, Human
agcccacgcccccacugg

SEQ ID NO: 1609937 - RNA, 17 nt, Human
agcccacgcccccacug

SEQ ID NO: 1609938 - RNA, 13 nt, Human
agcccaccuuggc

SEQ ID NO: 1609939 - RNA, 23 nt, Human
agcccaccccucaacaccucugc

SEQ ID NO: 1609940 - RNA, 22 nt, Human
agccagauuucacucuccuugg

SEQ ID NO: 1609941 - RNA, 20 nt, Human
agccagauuucacucuccuu

SEQ ID NO: 1609942 - RNA, 17 nt, Human
agccagauuucacucuc

SEQ ID NO: 1609943 - RNA, 14 nt, Human
agccagauuucacu

SEQ ID NO: 1609944 - RNA, 17 nt, Human
agccaacuauggccugu

SEQ ID NO: 1609945 - RNA, 16 nt, Human
agcaucuaugugagac

SEQ ID NO: 1609946 - RNA, 17 nt, Human
agcacugacuucuaagu

SEQ ID NO: 1609947 - RNA, 19 nt, Human
agcacugacuucuaaguaa

SEQ ID NO: 1609948 - RNA, 16 nt, Human
agcagccuggacccug

SEQ ID NO: 1609949 - RNA, 16 nt, Human
agcagugcaugcuguc

SEQ ID NO: 1609950 - RNA, 13 nt, Human
agcagugcaugcu

SEQ ID NO: 1609951 - RNA, 19 nt, Human
agcagcguuucuaugacac

SEQ ID NO: 1609952 - RNA, 20 nt, Human
agcagccuggacccugugga

SEQ ID NO: 1609953 - RNA, 18 nt, Human
agcagugcaugcuguccc

SEQ ID NO: 1609954 - RNA, 17 nt, Human
agcagugcaugcugucc

SEQ ID NO: 1609955 - RNA, 21 nt, Human
agcacagacccugcccugugg

SEQ ID NO: 1609956 - RNA, 20 nt, Human
agcaauucuccugccucagc

SEQ ID NO: 1609957 - RNA, 19 nt, Human
agcaauucuccugccucag

SEQ ID NO: 1609958 - RNA, 18 nt, Human
agcaauucuccugccuca

SEQ ID NO: 1609959 - RNA, 17 nt, Human
agcaauucuccugccuc

SEQ ID NO: 1609960 - RNA, 15 nt, Human
agcaauucuccugcc

SEQ ID NO: 1609961 - RNA, 17 nt, Human
agggacaggauaagagg

SEQ ID NO: 1609962 - RNA, 19 nt, Human
aggcugcagugagccgaga

SEQ ID NO: 1609963 - RNA, 17 nt, Human
aggcugcagugagccga

SEQ ID NO: 1609964 - RNA, 12 nt, Human
aggcugucaauu

SEQ ID NO: 1609965 - RNA, 19 nt, Human
aggcugucaauuacaggaa

SEQ ID NO: 1609966 - RNA, 24 nt, Human
aggcuguaucccaugagccucagc

SEQ ID NO: 1609967 - RNA, 22 nt, Human
aggcucuggagcccacuguacu

SEQ ID NO: 1609968 - RNA, 13 nt, Human
aggcugaggacuu

SEQ ID NO: 1609969 - RNA, 11 nt, Human
aggcugaggac

SEQ ID NO: 1609970 - RNA, 14 nt, Human
aggcucuucuccuu

SEQ ID NO: 1609971 - RNA, 13 nt, Human
aggcugagccuca

SEQ ID NO: 1609972 - RNA, 11 nt, Human
aggcugagccu

SEQ ID NO: 1609973 - RNA, 13 nt, Human
aggcucuucuccu

SEQ ID NO: 1609974 - RNA, 20 nt, Human
aggcccucugcccacucccu

SEQ ID NO: 1609975 - RNA, 19 nt, Human
aggcccucugcccacuccc

SEQ ID NO: 1609976 - RNA, 21 nt, Human
aggcccucugcccacucccug

SEQ ID NO: 1609977 - RNA, 14 nt, Human
agggccuggcucag

SEQ ID NO: 1609978 - RNA, 13 nt, Human
agggccuggcuca

SEQ ID NO: 1609979 - RNA, 18 nt, Human
agggccuggcucaggugg

SEQ ID NO: 1609980 - RNA, 14 nt, Human
agggacugagaaau

SEQ ID NO: 1609981 - RNA, 13 nt, Human
agggacugagaaa

SEQ ID NO: 1609982 - RNA, 15 nt, Human
agggacugagaaauu

SEQ ID NO: 1609983 - RNA, 17 nt, Human
agggacugagaaauuua

SEQ ID NO: 1609984 - RNA, 20 nt, Human
aggcagagguugcagugagc

SEQ ID NO: 1609985 - RNA, 13 nt, Human
aggcagauacagg

SEQ ID NO: 1609986 - RNA, 22 nt, Human
aggcagaacucaucuagguaaa

SEQ ID NO: 1609987 - RNA, 16 nt, Human
aggcagccaggccaca

SEQ ID NO: 1609988 - RNA, 15 nt, Human
aggcagccaggccac

SEQ ID NO: 1609989 - RNA, 14 nt, Human
aggcagccaggcca

SEQ ID NO: 1609990 - RNA, 23 nt, Human
aggccaggcccucugcccacucc

SEQ ID NO: 1609991 - RNA, 19 nt, Human
aggccaggcccucugccca

SEQ ID NO: 1609992 - RNA, 18 nt, Human
aggccaggcccucugccc

SEQ ID NO: 1609993 - RNA, 17 nt, Human
aggccaggcccucugcc

SEQ ID NO: 1609994 - RNA, 16 nt, Human
aggccagcugcuuggg

SEQ ID NO: 1609995 - RNA, 14 nt, Human
aggccagcugcuug

SEQ ID NO: 1609996 - RNA, 13 nt, Human
aggccagcugcuu

SEQ ID NO: 1609997 - RNA, 17 nt, Human
aggcccucugcccacuc

SEQ ID NO: 1609998 - RNA, 17 nt, Human
aggccaugggccuccug

SEQ ID NO: 1609999 - RNA, 16 nt, Human
aggccaugggccuccu

SEQ ID NO: 1610000 - RNA, 14 nt, Human
aggccaugggccuc

SEQ ID NO: 1610001 - RNA, 23 nt, Human
aggccagcugcuugggcuucauc

SEQ ID NO: 1610002 - RNA, 23 nt, Human
aggcauuccccaggaggccagcc

SEQ ID NO: 1610003 - RNA, 22 nt, Human
aggcauuccccaggaggccagc

SEQ ID NO: 1610004 - RNA, 17 nt, Human
aggcauuccccaggagg

SEQ ID NO: 1610005 - RNA, 22 nt, Human
aggcauguucucugaggacacu

SEQ ID NO: 1610006 - RNA, 20 nt, Human
aggcauguucucugaggaca

SEQ ID NO: 1610007 - RNA, 21 nt, Human
aggcauuccccaggaggccag

SEQ ID NO: 1610008 - RNA, 18 nt, Human
aggcagccaggccacaag

SEQ ID NO: 1610009 - RNA, 17 nt, Human
aggcaucgcaauguaag

SEQ ID NO: 1610010 - RNA, 24 nt, Human
aggcaugugaugagaggaaaucac

SEQ ID NO: 1610011 - RNA, 23 nt, Human
aggcaugugaugagaggaaauca

SEQ ID NO: 1610012 - RNA, 12 nt, Human
aggcauguucuc

SEQ ID NO: 1610013 - RNA, 13 nt, Human
aggaaguagagga

SEQ ID NO: 1610014 - RNA, 19 nt, Human
aggaaguacuggagaaaau

SEQ ID NO: 1610015 - RNA, 16 nt, Human
aggagagcccuucauu

SEQ ID NO: 1610016 - RNA, 14 nt, Human
aggaggucucuaag

SEQ ID NO: 1610017 - RNA, 12 nt, Human
aggagugagcac

SEQ ID NO: 1610018 - RNA, 15 nt, Human
aggaggucucuaaga

SEQ ID NO: 1610019 - RNA, 14 nt, Human
aggagugagcacua

SEQ ID NO: 1610020 - RNA, 18 nt, Human
aggaguuucguuuucaaa

SEQ ID NO: 1610021 - RNA, 22 nt, Human
aggauguucuagcauggcugcc

SEQ ID NO: 1610022 - RNA, 13 nt, Human
agcuacaaaugca

SEQ ID NO: 1610023 - RNA, 21 nt, Human
agcucaccagccccagugccc

SEQ ID NO: 1610024 - RNA, 15 nt, Human
agcucaccagcccca

SEQ ID NO: 1610025 - RNA, 14 nt, Human
agcucaccagcccc

SEQ ID NO: 1610026 - RNA, 13 nt, Human
agcucaccagccc

SEQ ID NO: 1610027 - RNA, 15 nt, Human
agcuaaugggacacu

SEQ ID NO: 1610028 - RNA, 14 nt, Human
agcuaaugggacac

SEQ ID NO: 1610029 - RNA, 13 nt, Human
agcuaaugggaca

SEQ ID NO: 1610030 - RNA, 17 nt, Human
agcgacagugagacucu

SEQ ID NO: 1610031 - RNA, 15 nt, Human
agcgauucuucugcu

SEQ ID NO: 1610032 - RNA, 19 nt, Human
agcgauucuucugcuucag

SEQ ID NO: 1610033 - RNA, 17 nt, Human
agcgauucuucugcuuc

SEQ ID NO: 1610034 - RNA, 15 nt, Human
agcgacagugagacu

SEQ ID NO: 1610035 - RNA, 13 nt, Human
agcgacagugaga

SEQ ID NO: 1610036 - RNA, 20 nt, Human
agcuaacauggaaguacuau

SEQ ID NO: 1610037 - RNA, 19 nt, Human
agcuaacauggaaguacua

SEQ ID NO: 1610038 - RNA, 18 nt, Human
agccugggcaaugugaua

SEQ ID NO: 1610039 - RNA, 14 nt, Human
agccuggacccugu

SEQ ID NO: 1610040 - RNA, 18 nt, Human
agccuggcacagggcagu

SEQ ID NO: 1610041 - RNA, 17 nt, Human
agccuggcacagggcag

SEQ ID NO: 1610042 - RNA, 20 nt, Human
agccuggcacagggcagugg

SEQ ID NO: 1610043 - RNA, 17 nt, Human
agccugcugccugcuuu

SEQ ID NO: 1610044 - RNA, 20 nt, Human
agcugcugaaacaacaaaua

SEQ ID NO: 1610045 - RNA, 16 nt, Human
agcugcugaaacaaca

SEQ ID NO: 1610046 - RNA, 15 nt, Human
agcugcugaaacaac

SEQ ID NO: 1610047 - RNA, 14 nt, Human
agcugcugaaacaa

SEQ ID NO: 1610048 - RNA, 15 nt, Human
agcuggucccacuca

SEQ ID NO: 1610049 - RNA, 16 nt, Human
agcuggucccacucag

SEQ ID NO: 1610050 - RNA, 16 nt, Human
agcuggguuggaaaac

SEQ ID NO: 1610051 - RNA, 20 nt, Human
agcuggguuggaaaacagua

SEQ ID NO: 1610052 - RNA, 16 nt, Human
agcugguugagguuuc

SEQ ID NO: 1610053 - RNA, 21 nt, Human
agcugacuuuucuguccgagc

SEQ ID NO: 1610054 - RNA, 15 nt, Human
agcugacuuuucugu

SEQ ID NO: 1610055 - RNA, 23 nt, Human
agcucaccagccccagugcccac

SEQ ID NO: 1610056 - RNA, 22 nt, Human
agcucaccagccccagugccca

SEQ ID NO: 1610057 - RNA, 18 nt, Human
aggaaaaaauaacaauga

SEQ ID NO: 1610058 - RNA, 19 nt, Human
aggaaaaccaagccguggc

SEQ ID NO: 1610059 - RNA, 23 nt, Human
agcuuuuuucucugauacagaaa

SEQ ID NO: 1610060 - RNA, 22 nt, Human
agcuuuuuucucugauacagaa

SEQ ID NO: 1610061 - RNA, 20 nt, Human
agcuuuuuucucugauacag

SEQ ID NO: 1610062 - RNA, 19 nt, Human
agcuuuuuucucugauaca

SEQ ID NO: 1610063 - RNA, 22 nt, Human
agcuuuguuuguugucagcuga

SEQ ID NO: 1610064 - RNA, 21 nt, Human
agcuuuguuuguugucagcug

SEQ ID NO: 1610065 - RNA, 15 nt, Human
aggaaguacuggaga

SEQ ID NO: 1610066 - RNA, 11 nt, Human
aggaaguacug

SEQ ID NO: 1610067 - RNA, 14 nt, Human
aggaagguagaaau

SEQ ID NO: 1610068 - RNA, 12 nt, Human
aggaacacuccu

SEQ ID NO: 1610069 - RNA, 23 nt, Human
aggaaaaccaagccguggcuucc

SEQ ID NO: 1610070 - RNA, 22 nt, Human
aggaaaaccaagccguggcuuc

SEQ ID NO: 1610071 - RNA, 21 nt, Human
aggaaaaccaagccguggcuu

SEQ ID NO: 1610072 - RNA, 20 nt, Human
aggaaaaccaagccguggcu

SEQ ID NO: 1610073 - RNA, 15 nt, Human
aggaacacuccuuca

SEQ ID NO: 1610074 - RNA, 18 nt, Human
agcuguaugauucccagc

SEQ ID NO: 1610075 - RNA, 17 nt, Human
agcuguaugauucccag

SEQ ID NO: 1610076 - RNA, 18 nt, Human
acugacauuguuggccaa

SEQ ID NO: 1610077 - RNA, 17 nt, Human
acugacauuguuggcca

SEQ ID NO: 1610078 - RNA, 23 nt, Human
acugaauuucuuuugccguuauu

SEQ ID NO: 1610079 - RNA, 13 nt, Human
acucuacccucuu

SEQ ID NO: 1610080 - RNA, 12 nt, Human
acugaauuucuu

SEQ ID NO: 1610081 - RNA, 20 nt, Human
acugaauuaugaaacuuuug

SEQ ID NO: 1610082 - RNA, 15 nt, Human
acugaauuaugaaac

SEQ ID NO: 1610083 - RNA, 14 nt, Human
acugaauuaugaaa

SEQ ID NO: 1610084 - RNA, 13 nt, Human
acugaauuaugaa

SEQ ID NO: 1610085 - RNA, 19 nt, Human
acugauaugggucuugaua

SEQ ID NO: 1610086 - RNA, 22 nt, Human
acugacauuguuggccaaagcc

SEQ ID NO: 1610087 - RNA, 14 nt, Human
acugauuacugccu

SEQ ID NO: 1610088 - RNA, 20 nt, Human
acugauuuuuuuuuccuuca

SEQ ID NO: 1610089 - RNA, 19 nt, Human
acugauuuuuuuuuccuuc

SEQ ID NO: 1610090 - RNA, 18 nt, Human
acugauuuuuuuuuccuu

SEQ ID NO: 1610091 - RNA, 17 nt, Human
acugauuuuuuuuuccu

SEQ ID NO: 1610092 - RNA, 16 nt, Human
acugauuuuuuuuucc

SEQ ID NO: 1610093 - RNA, 22 nt, Human
acugauuugacauagucuggcu

SEQ ID NO: 1610094 - RNA, 14 nt, Human
acucccuuucaaca

SEQ ID NO: 1610095 - RNA, 18 nt, Human
acucccugccccccagcc

SEQ ID NO: 1610096 - RNA, 22 nt, Human
acucccaucugugaaaggaaag

SEQ ID NO: 1610097 - RNA, 15 nt, Human
acucccaagcuggac

SEQ ID NO: 1610098 - RNA, 19 nt, Human
acucguuaauuuguagugu

SEQ ID NO: 1610099 - RNA, 14 nt, Human
acucguuaauuugu

SEQ ID NO: 1610100 - RNA, 15 nt, Human
acucuacagaggcca

SEQ ID NO: 1610101 - RNA, 12 nt, Human
acuggaacucuc

SEQ ID NO: 1610102 - RNA, 15 nt, Human
acugccuauuuuaau

SEQ ID NO: 1610103 - RNA, 17 nt, Human
acuguaaaauaauaacu

SEQ ID NO: 1610104 - RNA, 12 nt, Human
acugguggcccg

SEQ ID NO: 1610105 - RNA, 20 nt, Human
acuggugacugauucuucag

SEQ ID NO: 1610106 - RNA, 19 nt, Human
acuggugacugauucuuca

SEQ ID NO: 1610107 - RNA, 18 nt, Human
acuggugacugauucuuc

SEQ ID NO: 1610108 - RNA, 19 nt, Human
acugcccaggccugccugu

SEQ ID NO: 1610109 - RNA, 14 nt, Human
acugccaugccagc

SEQ ID NO: 1610110 - RNA, 18 nt, Human
acugugccaugugccagg

SEQ ID NO: 1610111 - RNA, 17 nt, Human
acugugccaugugccag

SEQ ID NO: 1610112 - RNA, 16 nt, Human
acugugaagagaacca

SEQ ID NO: 1610113 - RNA, 23 nt, Human
acugucuuuuuucuaaaguaaaa

SEQ ID NO: 1610114 - RNA, 22 nt, Human
acugucuuuuuucuaaaguaaa

SEQ ID NO: 1610115 - RNA, 16 nt, Human
acugucuuuuuucuaa

SEQ ID NO: 1610116 - RNA, 20 nt, Human
acugguggcccgacagccug

SEQ ID NO: 1610117 - RNA, 22 nt, Human
acuuaaaaaugguuuaaauggu

SEQ ID NO: 1610118 - RNA, 19 nt, Human
acuucaaauccuugaagau

SEQ ID NO: 1610119 - RNA, 18 nt, Human
acuucaaauccuugaaga

SEQ ID NO: 1610120 - RNA, 17 nt, Human
acuucaaauccuugaag

SEQ ID NO: 1610121 - RNA, 20 nt, Human
acuuaaaauauuccugcauu

SEQ ID NO: 1610122 - RNA, 15 nt, Human
acuguuucaaacuuu

SEQ ID NO: 1610123 - RNA, 18 nt, Human
acuguuucaaacuuuacu

SEQ ID NO: 1610124 - RNA, 19 nt, Human
acuguuucaaacuuuacua

SEQ ID NO: 1610125 - RNA, 13 nt, Human
acuuggucuguga

SEQ ID NO: 1610126 - RNA, 23 nt, Human
acuuggggggcugaggugggagg

SEQ ID NO: 1610127 - RNA, 16 nt, Human
acuugaaaauuaacau

SEQ ID NO: 1610128 - RNA, 14 nt, Human
acuugaaaauuaac

SEQ ID NO: 1610129 - RNA, 12 nt, Human
acuugaaaauua

SEQ ID NO: 1610130 - RNA, 21 nt, Human
acuucagacauagaauuaaca

SEQ ID NO: 1610131 - RNA, 17 nt, Human
acuucagcgguuuauau

SEQ ID NO: 1610132 - RNA, 18 nt, Human
acuucuuuaauuuuggaa

SEQ ID NO: 1610133 - RNA, 20 nt, Human
acuucuuuaauuuuggaauu

SEQ ID NO: 1610134 - RNA, 19 nt, Human
acuucuuuaauuuuggaau

SEQ ID NO: 1610135 - RNA, 19 nt, Human
acgcaggcccccaggugcc

SEQ ID NO: 1610136 - RNA, 19 nt, Human
acgcugugcugcccugccc

SEQ ID NO: 1610137 - RNA, 22 nt, Human
acgcugugcugcccugcccacc

SEQ ID NO: 1610138 - RNA, 23 nt, Human
acgcagcccugcuuugggcugcc

SEQ ID NO: 1610139 - RNA, 22 nt, Human
acgcagcccugcuuugggcugc

SEQ ID NO: 1610140 - RNA, 12 nt, Human
acgcagcccugc

SEQ ID NO: 1610141 - RNA, 19 nt, Human
acggacacucaaaagcugg

SEQ ID NO: 1610142 - RNA, 17 nt, Human
acggacacucaaaagcu

SEQ ID NO: 1610143 - RNA, 19 nt, Human
acggaauaguuggcuagga

SEQ ID NO: 1610144 - RNA, 13 nt, Human
acgucugugccau

SEQ ID NO: 1610145 - RNA, 14 nt, Human
acgucuuaaauauu

SEQ ID NO: 1610146 - RNA, 13 nt, Human
acgucuuaaauau

SEQ ID NO: 1610147 - RNA, 20 nt, Human
acgauuucuguuuagauaau

SEQ ID NO: 1610148 - RNA, 23 nt, Human
acgauuucuguuuagauaauaca

SEQ ID NO: 1610149 - RNA, 19 nt, Human
acgauuucuguuuagauaa

SEQ ID NO: 1610150 - RNA, 18 nt, Human
acuaauggggcggugaga

SEQ ID NO: 1610151 - RNA, 20 nt, Human
acuaauguguaagacaaaaa

SEQ ID NO: 1610152 - RNA, 12 nt, Human
accuuggcucaa

SEQ ID NO: 1610153 - RNA, 23 nt, Human
accucugccugaagucacacagu

SEQ ID NO: 1610154 - RNA, 20 nt, Human
accucugccugaagucacac

SEQ ID NO: 1610155 - RNA, 12 nt, Human
accucugccuga

SEQ ID NO: 1610156 - RNA, 20 nt, Human
accugccccucaacucuccu

SEQ ID NO: 1610157 - RNA, 15 nt, Human
accugccccucaacu

SEQ ID NO: 1610158 - RNA, 12 nt, Human
accugccccuca

SEQ ID NO: 1610159 - RNA, 23 nt, Human
accugccaggaagccagcaggcu

SEQ ID NO: 1610160 - RNA, 22 nt, Human
accugccaggaagccagcaggc

SEQ ID NO: 1610161 - RNA, 21 nt, Human
accugccaggaagccagcagg

SEQ ID NO: 1610162 - RNA, 21 nt, Human
acccugucucuacuaaaaaua

SEQ ID NO: 1610163 - RNA, 16 nt, Human
acccugugauggggcc

SEQ ID NO: 1610164 - RNA, 16 nt, Human
acccuggggagaaagu

SEQ ID NO: 1610165 - RNA, 16 nt, Human
acccucaggcaggugg

SEQ ID NO: 1610166 - RNA, 15 nt, Human
acccucaggcaggug

SEQ ID NO: 1610167 - RNA, 13 nt, Human
acccucaucacca

SEQ ID NO: 1610168 - RNA, 14 nt, Human
acccucaggcaggu

SEQ ID NO: 1610169 - RNA, 13 nt, Human
acccucaggcagg

SEQ ID NO: 1610170 - RNA, 18 nt, Human
acccucagagccaccccu

SEQ ID NO: 1610171 - RNA, 23 nt, Human
acccuggcacuauaauguaagcu

SEQ ID NO: 1610172 - RNA, 18 nt, Human
acccuggcacccagggug

SEQ ID NO: 1610173 - RNA, 23 nt, Human
acccucaucaccaacgucugugc

SEQ ID NO: 1610174 - RNA, 13 nt, Human
acccuauugcugc

SEQ ID NO: 1610175 - RNA, 19 nt, Human
acccuauugcugcuugagg

SEQ ID NO: 1610176 - RNA, 14 nt, Human
acccuauugcugcu

SEQ ID NO: 1610177 - RNA, 11 nt, Human
acccucagagc

SEQ ID NO: 1610178 - RNA, 21 nt, Human
accucaggugauccacccacc

SEQ ID NO: 1610179 - RNA, 20 nt, Human
accucaggugauccacccac

SEQ ID NO: 1610180 - RNA, 11 nt, Human
accucaggccu

SEQ ID NO: 1610181 - RNA, 16 nt, Human
accgggcacucagaag

SEQ ID NO: 1610182 - RNA, 14 nt, Human
accgggcacucaga

SEQ ID NO: 1610183 - RNA, 12 nt, Human
accgggcacuca

SEQ ID NO: 1610184 - RNA, 21 nt, Human
acccugugauggggcccugcc

SEQ ID NO: 1610185 - RNA, 20 nt, Human
acccugugauggggcccugc

SEQ ID NO: 1610186 - RNA, 19 nt, Human
acccugugauggggcccug

SEQ ID NO: 1610187 - RNA, 17 nt, Human
acccugugauggggccc

SEQ ID NO: 1610188 - RNA, 23 nt, Human
accgugaggccagagacacaagc

SEQ ID NO: 1610189 - RNA, 19 nt, Human
accgugccuggccacgccc

SEQ ID NO: 1610190 - RNA, 12 nt, Human
accucagccucc

SEQ ID NO: 1610191 - RNA, 18 nt, Human
accgugaggccagagaca

SEQ ID NO: 1610192 - RNA, 23 nt, Human
accgggcugggagcucugcagag

SEQ ID NO: 1610193 - RNA, 21 nt, Human
accgggcugggagcucugcag

SEQ ID NO: 1610194 - RNA, 21 nt, Human
aauuauaugcuauuucuauau

SEQ ID NO: 1610195 - RNA, 20 nt, Human
aauuauaugcuauuucuaua

SEQ ID NO: 1610196 - RNA, 19 nt, Human
aauuauaugcuauuucuau

SEQ ID NO: 1610197 - RNA, 23 nt, Human
aauuauaucugaggaauucugua

SEQ ID NO: 1610198 - RNA, 22 nt, Human
aauuauaucugaggaauucugu

SEQ ID NO: 1610199 - RNA, 20 nt, Human
aauuauaucugaggaauucu

SEQ ID NO: 1610200 - RNA, 19 nt, Human
aauuauacccccugcaaag

SEQ ID NO: 1610201 - RNA, 19 nt, Human
aauuaugaguuauuuuuau

SEQ ID NO: 1610202 - RNA, 18 nt, Human
aauuaugaaacuuuugga

SEQ ID NO: 1610203 - RNA, 15 nt, Human
aauuaugaaacuuuu

SEQ ID NO: 1610204 - RNA, 13 nt, Human
aauuaugaaacuu

SEQ ID NO: 1610205 - RNA, 12 nt, Human
aauuaugaaacu

SEQ ID NO: 1610206 - RNA, 13 nt, Human
aauucuuaaauau

SEQ ID NO: 1610207 - RNA, 18 nt, Human
aauucuguuuuucuaggc

SEQ ID NO: 1610208 - RNA, 14 nt, Human
aauucuguuuuucu

SEQ ID NO: 1610209 - RNA, 22 nt, Human
aauuguaaggaaugauuaauua

SEQ ID NO: 1610210 - RNA, 15 nt, Human
aauuggggauucuua

SEQ ID NO: 1610211 - RNA, 12 nt, Human
aauucuguauag

SEQ ID NO: 1610212 - RNA, 20 nt, Human
aauucuguauagauuagaga

SEQ ID NO: 1610213 - RNA, 14 nt, Human
aauucuguauagau

SEQ ID NO: 1610214 - RNA, 13 nt, Human
aauucuguauaga

SEQ ID NO: 1610215 - RNA, 21 nt, Human
aauucucauuugucacacacu

SEQ ID NO: 1610216 - RNA, 14 nt, Human
aauucuccugccuc

SEQ ID NO: 1610217 - RNA, 16 nt, Human
aauucuccugccucag

SEQ ID NO: 1610218 - RNA, 15 nt, Human
aauucuccugccuca

SEQ ID NO: 1610219 - RNA, 15 nt, Human
aauucucuuauccaa

SEQ ID NO: 1610220 - RNA, 15 nt, Human
aauucucuaguuuga

SEQ ID NO: 1610221 - RNA, 17 nt, Human
aauucucuaguuugauu

SEQ ID NO: 1610222 - RNA, 19 nt, Human
aauucucagaaucucaaau

SEQ ID NO: 1610223 - RNA, 14 nt, Human
aauucuacuuugag

SEQ ID NO: 1610224 - RNA, 22 nt, Human
aauucuagcuuugagcuuaaga

SEQ ID NO: 1610225 - RNA, 17 nt, Human
aauuucccaaagcagug

SEQ ID NO: 1610226 - RNA, 15 nt, Human
aauuucccaaagcag

SEQ ID NO: 1610227 - RNA, 11 nt, Human
aauuguaauag

SEQ ID NO: 1610228 - RNA, 14 nt, Human
aauuguaauuauau

SEQ ID NO: 1610229 - RNA, 16 nt, Human
aauuguaauuauaucu

SEQ ID NO: 1610230 - RNA, 15 nt, Human
aauuguaauuauauc

SEQ ID NO: 1610231 - RNA, 17 nt, Human
aauuguaauuauaucug

SEQ ID NO: 1610232 - RNA, 15 nt, Human
aauuuccugggagcu

SEQ ID NO: 1610233 - RNA, 12 nt, Human
aauuuccuggga

SEQ ID NO: 1610234 - RNA, 17 nt, Human
aauuuccugggagcuuu

SEQ ID NO: 1610235 - RNA, 15 nt, Human
acaccaauauucaua

SEQ ID NO: 1610236 - RNA, 23 nt, Human
acaccagagcccaccuuggcuca

SEQ ID NO: 1610237 - RNA, 18 nt, Human
acaccagagcccaccuug

SEQ ID NO: 1610238 - RNA, 18 nt, Human
acacagcucuucuccagg

SEQ ID NO: 1610239 - RNA, 19 nt, Human
acacagcucuucuccaggc

SEQ ID NO: 1610240 - RNA, 16 nt, Human
acacagcucuucucca

SEQ ID NO: 1610241 - RNA, 14 nt, Human
acacagcucuucuc

SEQ ID NO: 1610242 - RNA, 15 nt, Human
acaaguuaaauaaau

SEQ ID NO: 1610243 - RNA, 20 nt, Human
acaaggcaaggcugucaauu

SEQ ID NO: 1610244 - RNA, 19 nt, Human
acaaggcaaggcugucaau

SEQ ID NO: 1610245 - RNA, 17 nt, Human
acaaggcaaggcuguca

SEQ ID NO: 1610246 - RNA, 16 nt, Human
acaaggcaaggcuguc

SEQ ID NO: 1610247 - RNA, 15 nt, Human
acauaagauaaaugu

SEQ ID NO: 1610248 - RNA, 20 nt, Human
acauaaguauuuaauucaug

SEQ ID NO: 1610249 - RNA, 20 nt, Human
acauacaggaagguagaaau

SEQ ID NO: 1610250 - RNA, 21 nt, Human
acauaaugcgugcauaccacu

SEQ ID NO: 1610251 - RNA, 16 nt, Human
acauacaauuccaaac

SEQ ID NO: 1610252 - RNA, 20 nt, Human
acaucccuuaccugggaaag

SEQ ID NO: 1610253 - RNA, 13 nt, Human
acaugcacgugug

SEQ ID NO: 1610254 - RNA, 19 nt, Human
acauguuuuucuucucccu

SEQ ID NO: 1610255 - RNA, 17 nt, Human
acauguguuggcagccu

SEQ ID NO: 1610256 - RNA, 14 nt, Human
acauguuaaaccau

SEQ ID NO: 1610257 - RNA, 23 nt, Human
acauguuaaaccaugggauaaau

SEQ ID NO: 1610258 - RNA, 21 nt, Human
acauguuaaaccaugggauaa

SEQ ID NO: 1610259 - RNA, 16 nt, Human
acauguuaaaccaugg

SEQ ID NO: 1610260 - RNA, 21 nt, Human
acauuuguauaaaauaauuuu

SEQ ID NO: 1610261 - RNA, 17 nt, Human
accaacgucugugccau

SEQ ID NO: 1610262 - RNA, 14 nt, Human
accaacgucugugc

SEQ ID NO: 1610263 - RNA, 19 nt, Human
acauuuguauaaaauaauu

SEQ ID NO: 1610264 - RNA, 16 nt, Human
acauuuguauaaaaua

SEQ ID NO: 1610265 - RNA, 16 nt, Human
acauuugcucauggaa

SEQ ID NO: 1610266 - RNA, 15 nt, Human
acauuugcucaugga

SEQ ID NO: 1610267 - RNA, 13 nt, Human
accacguuucuaa

SEQ ID NO: 1610268 - RNA, 14 nt, Human
accacguuucuaaa

SEQ ID NO: 1610269 - RNA, 16 nt, Human
accacgcuggaccuug

SEQ ID NO: 1610270 - RNA, 14 nt, Human
accacgcuggaccu

SEQ ID NO: 1610271 - RNA, 18 nt, Human
accacgcuggaccuugaa

SEQ ID NO: 1610272 - RNA, 21 nt, Human
accaacgucugugccauuuug

SEQ ID NO: 1610273 - RNA, 14 nt, Human
accaagccguggcu

SEQ ID NO: 1610274 - RNA, 18 nt, Human
accaagccguggcuuccc

SEQ ID NO: 1610275 - RNA, 17 nt, Human
accaagccguggcuucc

SEQ ID NO: 1610276 - RNA, 16 nt, Human
accaagccguggcuuc

SEQ ID NO: 1610277 - RNA, 15 nt, Human
accaagccguggcuu

SEQ ID NO: 1610278 - RNA, 16 nt, Human
accagagcugccaccu

SEQ ID NO: 1610279 - RNA, 14 nt, Human
accagagcugccac

SEQ ID NO: 1610280 - RNA, 13 nt, Human
accagagcugcca

SEQ ID NO: 1610281 - RNA, 19 nt, Human
accagagcugccaccugcc

SEQ ID NO: 1610282 - RNA, 22 nt, Human
acaggaugguucccuugaugaa

SEQ ID NO: 1610283 - RNA, 24 nt, Human
acaggaugguucccuugaugaaga

SEQ ID NO: 1610284 - RNA, 14 nt, Human
acaggauuauugga

SEQ ID NO: 1610285 - RNA, 17 nt, Human
acaggcaaugcuggcug

SEQ ID NO: 1610286 - RNA, 14 nt, Human
acaggcacccacca

SEQ ID NO: 1610287 - RNA, 16 nt, Human
acaggcaaugcuggcu

SEQ ID NO: 1610288 - RNA, 15 nt, Human
acaggcaaugcuggc

SEQ ID NO: 1610289 - RNA, 20 nt, Human
acagcucuucuccaggcugu

SEQ ID NO: 1610290 - RNA, 19 nt, Human
acagcucuucuccaggcug

SEQ ID NO: 1610291 - RNA, 20 nt, Human
acagugauuaccagggacug

SEQ ID NO: 1610292 - RNA, 19 nt, Human
acagugauuaccagggacu

SEQ ID NO: 1610293 - RNA, 18 nt, Human
acagugcaucucagccca

SEQ ID NO: 1610294 - RNA, 17 nt, Human
acagugcaucucagccc

SEQ ID NO: 1610295 - RNA, 15 nt, Human
acagugcaucucagc

SEQ ID NO: 1610296 - RNA, 23 nt, Human
acaggcacccaccaucaugucug

SEQ ID NO: 1610297 - RNA, 18 nt, Human
acaggcaaugcuggcugu

SEQ ID NO: 1610298 - RNA, 23 nt, Human
acagugaucaaguuauuuuuaau

SEQ ID NO: 1610299 - RNA, 16 nt, Human
aaucucaauauuucag

SEQ ID NO: 1610300 - RNA, 20 nt, Human
aaugaauacuuuauaaagga

SEQ ID NO: 1610301 - RNA, 20 nt, Human
aaugaugccaugaggaacaa

SEQ ID NO: 1610302 - RNA, 20 nt, Human
aaugauguauguugaagccu

SEQ ID NO: 1610303 - RNA, 20 nt, Human
aaugaaagacuguacaaagu

SEQ ID NO: 1610304 - RNA, 18 nt, Human
aaugaaagacuguacaaa

SEQ ID NO: 1610305 - RNA, 21 nt, Human
aaugaaagacuguacaaagua

SEQ ID NO: 1610306 - RNA, 20 nt, Human
aaugaagauacugaaauaaa

SEQ ID NO: 1610307 - RNA, 14 nt, Human
aaugaagcaaugcu

SEQ ID NO: 1610308 - RNA, 21 nt, Human
aaucaccgaaaacguggcugc

SEQ ID NO: 1610309 - RNA, 22 nt, Human
aaucaaugcuauaacuauguug

SEQ ID NO: 1610310 - RNA, 23 nt, Human
aaucaccgaaaacguggcugcuu

SEQ ID NO: 1610311 - RNA, 13 nt, Human
aauauuaagaaag

SEQ ID NO: 1610312 - RNA, 23 nt, Human
aauauguggaguucaucuugaau

SEQ ID NO: 1610313 - RNA, 16 nt, Human
aauauauaucaaauau

SEQ ID NO: 1610314 - RNA, 19 nt, Human
aauaauguuaacauggaca

SEQ ID NO: 1610315 - RNA, 14 nt, Human
aauaaagcagcguu

SEQ ID NO: 1610316 - RNA, 17 nt, Human
aauaaugugaaacugga

SEQ ID NO: 1610317 - RNA, 22 nt, Human
aauaaugugaaacuggauuaaa

SEQ ID NO: 1610318 - RNA, 12 nt, Human
aagugcugggau

SEQ ID NO: 1610319 - RNA, 22 nt, Human
aagugcugggauuacaggugug

SEQ ID NO: 1610320 - RNA, 17 nt, Human
aaguugaauuuauuggc

SEQ ID NO: 1610321 - RNA, 15 nt, Human
aaguugaauuuauug

SEQ ID NO: 1610322 - RNA, 14 nt, Human
aaguugaauuuauu

SEQ ID NO: 1610323 - RNA, 22 nt, Human
aagugcugcauuuaaaagauac

SEQ ID NO: 1610324 - RNA, 22 nt, Human
aaguuguaggcauaaagucagg

SEQ ID NO: 1610325 - RNA, 24 nt, Human
aaguugaauuuauuggcuuuucug

SEQ ID NO: 1610326 - RNA, 23 nt, Human
aaguugaauuuauuggcuuuucu

SEQ ID NO: 1610327 - RNA, 16 nt, Human
aauaaacacucuugaa

SEQ ID NO: 1610328 - RNA, 11 nt, Human
aauaaacacuc

SEQ ID NO: 1610329 - RNA, 15 nt, Human
aaguuuaauauuaaa

SEQ ID NO: 1610330 - RNA, 18 nt, Human
aaguuuaauauuaaagcc

SEQ ID NO: 1610331 - RNA, 17 nt, Human
aaguuuaauauuaaagc

SEQ ID NO: 1610332 - RNA, 19 nt, Human
aauaaacacucuugaaaaa

SEQ ID NO: 1610333 - RNA, 13 nt, Human
aagagaaaaaaua

SEQ ID NO: 1610334 - RNA, 19 nt, Human
aagacuuuucuuucagcca

SEQ ID NO: 1610335 - RNA, 12 nt, Human
aagacuuuucuu

SEQ ID NO: 1610336 - RNA, 21 nt, Human
aagacuuuuccaacccucauc

SEQ ID NO: 1610337 - RNA, 15 nt, Human
aagaccacguuucua

SEQ ID NO: 1610338 - RNA, 17 nt, Human
aagaccacguuucuaaa

SEQ ID NO: 1610339 - RNA, 23 nt, Human
aagacagauacuccuccaagguu

SEQ ID NO: 1610340 - RNA, 15 nt, Human
aagaagacugcauua

SEQ ID NO: 1610341 - RNA, 20 nt, Human
aagaagacugcauuauauuu

SEQ ID NO: 1610342 - RNA, 21 nt, Human
aagacaaggaaaaaauaacaa

SEQ ID NO: 1610343 - RNA, 20 nt, Human
aagacaaugugaaaagaaaa

SEQ ID NO: 1610344 - RNA, 19 nt, Human
aagacaaugugaaaagaaa

SEQ ID NO: 1610345 - RNA, 22 nt, Human
aagacaaugacuuacuguacau

SEQ ID NO: 1610346 - RNA, 15 nt, Human
aagaacugaaaucau

SEQ ID NO: 1610347 - RNA, 13 nt, Human
aagaacugaaauc

SEQ ID NO: 1610348 - RNA, 12 nt, Human
aagaacugaaau

SEQ ID NO: 1610349 - RNA, 11 nt, Human
aagaacugaaa

SEQ ID NO: 1610350 - RNA, 20 nt, Human
aacgcaggcccccaggugcc

SEQ ID NO: 1610351 - RNA, 16 nt, Human
aacgcagcccugcuuu

SEQ ID NO: 1610352 - RNA, 12 nt, Human
aacgcagcccug

SEQ ID NO: 1610353 - RNA, 14 nt, Human
aagaacuagcauaa

SEQ ID NO: 1610354 - RNA, 12 nt, Human
aagaguguggca

SEQ ID NO: 1610355 - RNA, 19 nt, Human
aagcugcacccucaggcag

SEQ ID NO: 1610356 - RNA, 13 nt, Human
aagcugcacccuc

SEQ ID NO: 1610357 - RNA, 21 nt, Human
aaggacuuguuagaucuaguu

SEQ ID NO: 1610358 - RNA, 15 nt, Human
aaggacuuguuagau

SEQ ID NO: 1610359 - RNA, 22 nt, Human
aagcuagacgagcaggcuucuu

SEQ ID NO: 1610360 - RNA, 13 nt, Human
aaggcaaggcugu

SEQ ID NO: 1610361 - RNA, 23 nt, Human
aaggacuuguuagaucuaguuca

SEQ ID NO: 1610362 - RNA, 15 nt, Human
aaggcaaggcuguca

SEQ ID NO: 1610363 - RNA, 16 nt, Human
aaggcaaggcugucaa

SEQ ID NO: 1610364 - RNA, 22 nt, Human
aaggcagggagggccugggccc

SEQ ID NO: 1610365 - RNA, 19 nt, Human
aaggcagggagggccuggg

SEQ ID NO: 1610366 - RNA, 17 nt, Human
aagauacaguuacucag

SEQ ID NO: 1610367 - RNA, 23 nt, Human
aagauacaguuacucagaauucu

SEQ ID NO: 1610368 - RNA, 21 nt, Human
aagauaauauuaaggaagaca

SEQ ID NO: 1610369 - RNA, 19 nt, Human
aagauaauauuaaggaaga

SEQ ID NO: 1610370 - RNA, 18 nt, Human
aagccauaauuguucuua

SEQ ID NO: 1610371 - RNA, 14 nt, Human
aagcggcuggcagc

SEQ ID NO: 1610372 - RNA, 15 nt, Human
aagcgugagccacug

SEQ ID NO: 1610373 - RNA, 16 nt, Human
aagcgugagccacugc

SEQ ID NO: 1610374 - RNA, 13 nt, Human
aagcuacuuauug

SEQ ID NO: 1610375 - RNA, 10 nt, Human
aagccuuugu

SEQ ID NO: 1610376 - RNA, 18 nt, Human
aaaucucaauauuucaga

SEQ ID NO: 1610377 - RNA, 14 nt, Human
aaaucuuuuugcuu

SEQ ID NO: 1610378 - RNA, 13 nt, Human
aaaucuuuuugcu

SEQ ID NO: 1610379 - RNA, 19 nt, Human
aaaucuccaaaauaaaacu

SEQ ID NO: 1610380 - RNA, 19 nt, Human
aaaugcuguaacuuucuga

SEQ ID NO: 1610381 - RNA, 14 nt, Human
aaaugaaaaaauau

SEQ ID NO: 1610382 - RNA, 23 nt, Human
aaaugcugcuuuuucucaaaaug

SEQ ID NO: 1610383 - RNA, 10 nt, Human
aaaugcugcu

SEQ ID NO: 1610384 - RNA, 23 nt, Human
aaauggacuguggugacuuugga

SEQ ID NO: 1610385 - RNA, 21 nt, Human
aaauggacuguggugacuuug

SEQ ID NO: 1610386 - RNA, 21 nt, Human
aaauauuuauuuuaauaaugu

SEQ ID NO: 1610387 - RNA, 20 nt, Human
aaaggaugcccaaagaugca

SEQ ID NO: 1610388 - RNA, 23 nt, Human
aaauguugacaugggacauuugc

SEQ ID NO: 1610389 - RNA, 13 nt, Human
aaauguucaucaa

SEQ ID NO: 1610390 - RNA, 17 nt, Human
aaauguucaucaaugaa

SEQ ID NO: 1610391 - RNA, 22 nt, Human
aaauguugacaugggacauuug

SEQ ID NO: 1610392 - RNA, 23 nt, Human
aacauggccuuugcuugaaagaa

SEQ ID NO: 1610393 - RNA, 19 nt, Human
aacccucagagccaccccu

SEQ ID NO: 1610394 - RNA, 23 nt, Human
aaccuuuugagugccuuacacaa

SEQ ID NO: 1610395 - RNA, 16 nt, Human
aaccuuuugagugccu

SEQ ID NO: 1610396 - RNA, 18 nt, Human
aaccuuuguuugcaucug

SEQ ID NO: 1610397 - RNA, 23 nt, Human
aaauucuucuccacuuucuagcc

SEQ ID NO: 1610398 - RNA, 15 nt, Human
aaauucuugcaaagu

SEQ ID NO: 1610399 - RNA, 18 nt, Human
aaauucuugcaaaguauc

SEQ ID NO: 1610400 - RNA, 11 nt, Human
aacaggcagau

SEQ ID NO: 1610401 - RNA, 15 nt, Human
aacagccugugucuu

SEQ ID NO: 1610402 - RNA, 12 nt, Human
aacagccugugu

SEQ ID NO: 1610403 - RNA, 22 nt, Human
aacauggccuuugcuugaaaga

SEQ ID NO: 1610404 - RNA, 16 nt, Human
aaagccauguuuauua

SEQ ID NO: 1610405 - RNA, 14 nt, Human
aaagccauguuuau

SEQ ID NO: 1610406 - RNA, 23 nt, Human
aaagccauguuuauuacaguaua

SEQ ID NO: 1610407 - RNA, 18 nt, Human
aaagccauguuuauuaca

SEQ ID NO: 1610408 - RNA, 17 nt, Human
aaagccauguuuauuac

SEQ ID NO: 1610409 - RNA, 17 nt, Human
aaagcauuguaaaugug

SEQ ID NO: 1610410 - RNA, 15 nt, Human
aaagcauuguaaaug

SEQ ID NO: 1610411 - RNA, 21 nt, Human
aaaaucauuucugcaucagcu

SEQ ID NO: 1610412 - RNA, 15 nt, Human
aaaaucucaaauuuc

SEQ ID NO: 1610413 - RNA, 16 nt, Human
aaaaucucaaauuucu

SEQ ID NO: 1610414 - RNA, 18 nt, Human
aaaaucucaaauuucuaa

SEQ ID NO: 1610415 - RNA, 15 nt, Human
aaacugcacugucaa

SEQ ID NO: 1610416 - RNA, 23 nt, Human
aaacugauuuuuuuuuccuucag

SEQ ID NO: 1610417 - RNA, 23 nt, Human
aaacucuuaaaacccaagugccu

SEQ ID NO: 1610418 - RNA, 12 nt, Human
aaacucuuaaaa

SEQ ID NO: 1610419 - RNA, 16 nt, Human
aaaccgccaaggcugg

SEQ ID NO: 1610420 - RNA, 15 nt, Human
aaaccgccaaggcug

SEQ ID NO: 1610421 - RNA, 16 nt, Human
aaacccagcucugguc

SEQ ID NO: 1610422 - RNA, 12 nt, Human
aaacccagcucu

SEQ ID NO: 1610423 - RNA, 18 nt, Human
aaacccagcucuggucca

SEQ ID NO: 1610424 - RNA, 22 nt, Human
aaaccgaacugauguaaguaaa

SEQ ID NO: 1610425 - RNA, 22 nt, Human
aaaccaguauuguacaaaguau

SEQ ID NO: 1610426 - RNA, 18 nt, Human
aaaccaguauuguacaaa

SEQ ID NO: 1610427 - RNA, 17 nt, Human
aaaccaguauuguacaa

SEQ ID NO: 1610428 - RNA, 16 nt, Human
aaaccaguauuguaca

SEQ ID NO: 1610429 - RNA, 14 nt, Human
aaaccaguauugua

SEQ ID NO: 1610430 - RNA, 13 nt, Human
aaaagacuccaaa

SEQ ID NO: 1610431 - RNA, 11 nt, Human
aaaagaaugau

SEQ ID NO: 1610432 - RNA, 13 nt, Human
aaaagaauauuuu

SEQ ID NO: 1610433 - RNA, 20 nt, Human
aaaagacaaggaaaaaauaa

SEQ ID NO: 1610434 - RNA, 12 nt, Human
aaaagaauauuu

SEQ ID NO: 1610435 - RNA, 17 nt, Human
aaaagaaagaaaaucag

SEQ ID NO: 1610436 - RNA, 16 nt, Human
aaaagaaaagucaagg

SEQ ID NO: 1610437 - RNA, 17 nt, Human
aaaacacauuuuucuua

SEQ ID NO: 1610438 - RNA, 19 nt, Human
aaaacacuguucucugccc

SEQ ID NO: 1610439 - RNA, 11 nt, Human
aaaagaaaaag

SEQ ID NO: 1610440 - RNA, 12 nt, Human
aaaaucauuucu

SEQ ID NO: 1610441 - RNA, 11 nt, Human
aaaaucauuuc

SEQ ID NO: 1610442 - RNA, 10 nt, Human
aaaaucauuu

SEQ ID NO: 1610443 - RNA, 21 nt, Human
aaaaucagccugcuccagcug

SEQ ID NO: 1610444 - RNA, 17 nt, Human
aaaaucagccugcucca

SEQ ID NO: 1610445 - RNA, 13 nt, Human
aaaaucagccugc

SEQ ID NO: 1610446 - RNA, 16 nt, Human
aaaauaaaacuuuuua

SEQ ID NO: 1610447 - RNA, 14 nt, Human
aaaauaaaacuuuu

SEQ ID NO: 1610448 - RNA, 18 nt, Human
aaaaguuuaauauuaaag

SEQ ID NO: 1610449 - RNA, 20 nt, Human
aaaaguuuaauauuaaagcc

SEQ ID NO: 1610450 - RNA, 18 nt, Human
aaaaguugaauuuuacau

SEQ ID NO: 1610451 - RNA, 16 nt, Human
aaaaguuuaauauuaa

SEQ ID NO: 1610452 - RNA, 14 nt, Human
aaaaguuuaauauu

SEQ ID NO: 1610453 - RNA, 22 nt, Human
cacaguuuucugagaaagacua

SEQ ID NO: 1610454 - RNA, 21 nt, Human
cacaguuuucugagaaagacu

SEQ ID NO: 1610455 - RNA, 20 nt, Human
cacaugaaguccaagcauuu

SEQ ID NO: 1610456 - RNA, 17 nt, Human
cacaugaaguccaagca

SEQ ID NO: 1610457 - RNA, 16 nt, Human
cacaugaaguccaagc

SEQ ID NO: 1610458 - RNA, 21 nt, Human
cacaugagcaucaggccaggc

SEQ ID NO: 1610459 - RNA, 20 nt, Human
cacaugagcaucaggccagg

SEQ ID NO: 1610460 - RNA, 19 nt, Human
cacaugagcaucaggccag

SEQ ID NO: 1610461 - RNA, 18 nt, Human
cacaugagcaucaggcca

SEQ ID NO: 1610462 - RNA, 17 nt, Human
cacaugagcaucaggcc

SEQ ID NO: 1610463 - RNA, 13 nt, Human
cacaugagcauca

SEQ ID NO: 1610464 - RNA, 21 nt, Human
cacaugccucucucaggccaa

SEQ ID NO: 1610465 - RNA, 20 nt, Human
cacaugccucucucaggcca

SEQ ID NO: 1610466 - RNA, 17 nt, Human
cacauguccaagaagcc

SEQ ID NO: 1610467 - RNA, 16 nt, Human
cacauguccaagaagc

SEQ ID NO: 1610468 - RNA, 18 nt, Human
cacaugcacgugugugca

SEQ ID NO: 1610469 - RNA, 20 nt, Human
cacaugcaaggucauuuuuu

SEQ ID NO: 1610470 - RNA, 17 nt, Human
cacaugcaaggucauuu

SEQ ID NO: 1610471 - RNA, 19 nt, Human
cacaugcaaggucauuuuu

SEQ ID NO: 1610472 - RNA, 20 nt, Human
cacagcucuucuccaggcug

SEQ ID NO: 1610473 - RNA, 19 nt, Human
cacagcucuucuccaggcu

SEQ ID NO: 1610474 - RNA, 21 nt, Human
cacagcucuucuccaggcugu

SEQ ID NO: 1610475 - RNA, 16 nt, Human
cacaggacucugccuc

SEQ ID NO: 1610476 - RNA, 15 nt, Human
cacaggacucugccu

SEQ ID NO: 1610477 - RNA, 23 nt, Human
cacaguccuuaccagcagagcac

SEQ ID NO: 1610478 - RNA, 14 nt, Human
cacaggcccggcuc

SEQ ID NO: 1610479 - RNA, 22 nt, Human
cacacggacacucaaaagcugg

SEQ ID NO: 1610480 - RNA, 15 nt, Human
caccagagcccaccu

SEQ ID NO: 1610481 - RNA, 22 nt, Human
caccagagcccaccuuggcuca

SEQ ID NO: 1610482 - RNA, 20 nt, Human
caccagagcccaccuuggcu

SEQ ID NO: 1610483 - RNA, 18 nt, Human
caccagagcccaccuugg

SEQ ID NO: 1610484 - RNA, 17 nt, Human
caccagagcccaccuug

SEQ ID NO: 1610485 - RNA, 19 nt, Human
caccacacccagcccacuu

SEQ ID NO: 1610486 - RNA, 15 nt, Human
caccacgcccggcua

SEQ ID NO: 1610487 - RNA, 14 nt, Human
caccacgcccggcu

SEQ ID NO: 1610488 - RNA, 22 nt, Human
cacauguccaagaagcccagga

SEQ ID NO: 1610489 - RNA, 21 nt, Human
cacauguccaagaagcccagg

SEQ ID NO: 1610490 - RNA, 19 nt, Human
cacauguccaagaagccca

SEQ ID NO: 1610491 - RNA, 18 nt, Human
cacauguccaagaagccc

SEQ ID NO: 1610492 - RNA, 17 nt, Human
caccaacgucugugcca

SEQ ID NO: 1610493 - RNA, 23 nt, Human
cacauguccaagaagcccaggaa

SEQ ID NO: 1610494 - RNA, 12 nt, Human
caccaagcccag

SEQ ID NO: 1610495 - RNA, 13 nt, Human
caccaagcccagu

SEQ ID NO: 1610496 - RNA, 15 nt, Human
caccaagcccaguua

SEQ ID NO: 1610497 - RNA, 18 nt, Human
caccaucaugucuggcua

SEQ ID NO: 1610498 - RNA, 17 nt, Human
caccaucaugucuggcu

SEQ ID NO: 1610499 - RNA, 15 nt, Human
caccaucaugucugg

SEQ ID NO: 1610500 - RNA, 24 nt, Human
caccaucaagccaccaacauacuc

SEQ ID NO: 1610501 - RNA, 19 nt, Human
caccaucaagccaccaaca

SEQ ID NO: 1610502 - RNA, 17 nt, Human
caccaucaagccaccaa

SEQ ID NO: 1610503 - RNA, 16 nt, Human
caccaucaagccacca

SEQ ID NO: 1610504 - RNA, 20 nt, Human
caccauguuggccaggcugg

SEQ ID NO: 1610505 - RNA, 20 nt, Human
caccauguuggccaggcugc

SEQ ID NO: 1610506 - RNA, 19 nt, Human
caccauguuggccaggcug

SEQ ID NO: 1610507 - RNA, 12 nt, Human
caccagcagccu

SEQ ID NO: 1610508 - RNA, 21 nt, Human
caccauauuaccacagacaua

SEQ ID NO: 1610509 - RNA, 18 nt, Human
caccauaggucaccuuua

SEQ ID NO: 1610510 - RNA, 15 nt, Human
caccaucaagccacc

SEQ ID NO: 1610511 - RNA, 14 nt, Human
caccaucaagccac

SEQ ID NO: 1610512 - RNA, 13 nt, Human
caccaucaagcca

SEQ ID NO: 1610513 - RNA, 13 nt, Human
cacccaagggccu

SEQ ID NO: 1610514 - RNA, 23 nt, Human
cacaagacccaaaaggcagaagc

SEQ ID NO: 1610515 - RNA, 23 nt, Human
cacaagaaaugaaagcagggacu

SEQ ID NO: 1610516 - RNA, 19 nt, Human
cacaaucucggcucacugc

SEQ ID NO: 1610517 - RNA, 15 nt, Human
cacaagaaaugaaag

SEQ ID NO: 1610518 - RNA, 13 nt, Human
cacaagaaaugaa

SEQ ID NO: 1610519 - RNA, 17 nt, Human
cacaaacgggcucagca

SEQ ID NO: 1610520 - RNA, 13 nt, Human
caauuuuguuucu

SEQ ID NO: 1610521 - RNA, 17 nt, Human
caauuuuguuucuguac

SEQ ID NO: 1610522 - RNA, 16 nt, Human
caauuuuguuucugua

SEQ ID NO: 1610523 - RNA, 14 nt, Human
caauuuuguuucug

SEQ ID NO: 1610524 - RNA, 18 nt, Human
caaugguuuucuugugug

SEQ ID NO: 1610525 - RNA, 14 nt, Human
caaugcacuuuguu

SEQ ID NO: 1610526 - RNA, 14 nt, Human
cacacacuuuggcu

SEQ ID NO: 1610527 - RNA, 20 nt, Human
cacacagauuugagcucagc

SEQ ID NO: 1610528 - RNA, 18 nt, Human
cacacagauuugagcuca

SEQ ID NO: 1610529 - RNA, 20 nt, Human
cacacaccagagcccaccuu

SEQ ID NO: 1610530 - RNA, 16 nt, Human
cacacaccagagccca

SEQ ID NO: 1610531 - RNA, 15 nt, Human
cacacaccagagccc

SEQ ID NO: 1610532 - RNA, 24 nt, Human
cacaaucucggcucacugcauccu

SEQ ID NO: 1610533 - RNA, 23 nt, Human
cacaaucucggcucacugcaucc

SEQ ID NO: 1610534 - RNA, 22 nt, Human
cacaaucucggcucacugcauc

SEQ ID NO: 1610535 - RNA, 20 nt, Human
cacaaucucggcucacugca

SEQ ID NO: 1610536 - RNA, 15 nt, Human
cacacagcucugucc

SEQ ID NO: 1610537 - RNA, 14 nt, Human
cacacagcucuguc

SEQ ID NO: 1610538 - RNA, 13 nt, Human
cacacagcucugu

SEQ ID NO: 1610539 - RNA, 22 nt, Human
cacacagauuugagcucagccc

SEQ ID NO: 1610540 - RNA, 22 nt, Human
cacaccagagcccaccuuggcu

SEQ ID NO: 1610541 - RNA, 21 nt, Human
cacaccagagcccaccuuggc

SEQ ID NO: 1610542 - RNA, 16 nt, Human
cacacagcucuguccu

SEQ ID NO: 1610543 - RNA, 20 nt, Human
cacacccagcccacuucugc

SEQ ID NO: 1610544 - RNA, 14 nt, Human
cacacccagcccac

SEQ ID NO: 1610545 - RNA, 13 nt, Human
caaugcacuuugu

SEQ ID NO: 1610546 - RNA, 14 nt, Human
caaugcacugacau

SEQ ID NO: 1610547 - RNA, 23 nt, Human
caaugcaaaccaucauugaaauc

SEQ ID NO: 1610548 - RNA, 22 nt, Human
caaugcaaaccaucauugaaau

SEQ ID NO: 1610549 - RNA, 21 nt, Human
caaugcaaaccaucauugaaa

SEQ ID NO: 1610550 - RNA, 14 nt, Human
caaugcaaaccauc

SEQ ID NO: 1610551 - RNA, 14 nt, Human
caaugauggucacc

SEQ ID NO: 1610552 - RNA, 14 nt, Human
caaugaccuuucaa

SEQ ID NO: 1610553 - RNA, 16 nt, Human
caaugaccuuucaaua

SEQ ID NO: 1610554 - RNA, 15 nt, Human
caaugaccuuucaau

SEQ ID NO: 1610555 - RNA, 13 nt, Human
caaugauggucac

SEQ ID NO: 1610556 - RNA, 21 nt, Human
caaugaccuuucaauaggaaa

SEQ ID NO: 1610557 - RNA, 18 nt, Human
caaucucggcucacugca

SEQ ID NO: 1610558 - RNA, 14 nt, Human
caaagaaauguaag

SEQ ID NO: 1610559 - RNA, 12 nt, Human
caaagaaauuau

SEQ ID NO: 1610560 - RNA, 15 nt, Human
caaagaaauuaugug

SEQ ID NO: 1610561 - RNA, 13 nt, Human
caaagaaauuaug

SEQ ID NO: 1610562 - RNA, 21 nt, Human
caaagagguuuuaaaaaaauc

SEQ ID NO: 1610563 - RNA, 14 nt, Human
caaagagguuuuaa

SEQ ID NO: 1610564 - RNA, 13 nt, Human
caaagcccagcuu

SEQ ID NO: 1610565 - RNA, 19 nt, Human
auuuuaauaauguuucaaa

SEQ ID NO: 1610566 - RNA, 18 nt, Human
auuuuaauaauguuucaa

SEQ ID NO: 1610567 - RNA, 17 nt, Human
auuuuaacaacagcugg

SEQ ID NO: 1610568 - RNA, 14 nt, Human
caaaggagauugga

SEQ ID NO: 1610569 - RNA, 18 nt, Human
caaagcccuuccaugucg

SEQ ID NO: 1610570 - RNA, 20 nt, Human
caaaggagauuggaaggaac

SEQ ID NO: 1610571 - RNA, 17 nt, Human
caaaguggugagaggca

SEQ ID NO: 1610572 - RNA, 16 nt, Human
caaaguggugagaggc

SEQ ID NO: 1610573 - RNA, 23 nt, Human
caaaggguaucaggugcugccau

SEQ ID NO: 1610574 - RNA, 21 nt, Human
caaaggguaucaggugcugcc

SEQ ID NO: 1610575 - RNA, 20 nt, Human
caaaggguaucaggugcugc

SEQ ID NO: 1610576 - RNA, 19 nt, Human
caaaguggugagaggcauc

SEQ ID NO: 1610577 - RNA, 22 nt, Human
caaaguucccuacuuccuguga

SEQ ID NO: 1610578 - RNA, 14 nt, Human
caaaguugccuaaa

SEQ ID NO: 1610579 - RNA, 17 nt, Human
caaaguugccuaaaucc

SEQ ID NO: 1610580 - RNA, 15 nt, Human
caaaguugccuaaau

SEQ ID NO: 1610581 - RNA, 17 nt, Human
caaauuguaagcaugca

SEQ ID NO: 1610582 - RNA, 20 nt, Human
caacaggcugggcuucagug

SEQ ID NO: 1610583 - RNA, 18 nt, Human
caaaguugccuaaaucca

SEQ ID NO: 1610584 - RNA, 23 nt, Human
caaauuuacagagacagaaagca

SEQ ID NO: 1610585 - RNA, 14 nt, Human
caacaggcugggcu

SEQ ID NO: 1610586 - RNA, 17 nt, Human
caaauuuacagagacag

SEQ ID NO: 1610587 - RNA, 17 nt, Human
caacaggcugggcuuca

SEQ ID NO: 1610588 - RNA, 15 nt, Human
caacauacucccauc

SEQ ID NO: 1610589 - RNA, 14 nt, Human
caacauacucccau

SEQ ID NO: 1610590 - RNA, 16 nt, Human
caacauacucccaucu

SEQ ID NO: 1610591 - RNA, 23 nt, Human
caacugcaucaagaugugacaug

SEQ ID NO: 1610592 - RNA, 20 nt, Human
caacugcaucaagaugugac

SEQ ID NO: 1610593 - RNA, 17 nt, Human
caacugcaucaagaugu

SEQ ID NO: 1610594 - RNA, 16 nt, Human
caacugcauuggcuuu

SEQ ID NO: 1610595 - RNA, 21 nt, Human
caaccugauugugucucuugg

SEQ ID NO: 1610596 - RNA, 19 nt, Human
caaccugauugugucucuu

SEQ ID NO: 1610597 - RNA, 17 nt, Human
caaccugauugugucuc

SEQ ID NO: 1610598 - RNA, 16 nt, Human
caagcauaccaacacg

SEQ ID NO: 1610599 - RNA, 21 nt, Human
caagcauaccaacacgagcag

SEQ ID NO: 1610600 - RNA, 19 nt, Human
caagcauuuagauguauag

SEQ ID NO: 1610601 - RNA, 16 nt, Human
caagcauuuagaugua

SEQ ID NO: 1610602 - RNA, 21 nt, Human
caaggcugucaauuacaggaa

SEQ ID NO: 1610603 - RNA, 14 nt, Human
caaggcugucaauu

SEQ ID NO: 1610604 - RNA, 13 nt, Human
caaggcugucaau

SEQ ID NO: 1610605 - RNA, 21 nt, Human
caaggcugggggaagaagcuc

SEQ ID NO: 1610606 - RNA, 17 nt, Human
caaggauccugagccag

SEQ ID NO: 1610607 - RNA, 16 nt, Human
caaggauccugagcca

SEQ ID NO: 1610608 - RNA, 15 nt, Human
caaggauccugagcc

SEQ ID NO: 1610609 - RNA, 14 nt, Human
caaggauccugagc

SEQ ID NO: 1610610 - RNA, 21 nt, Human
caaggacuaggguccugggga

SEQ ID NO: 1610611 - RNA, 20 nt, Human
caaggacuaggguccugggg

SEQ ID NO: 1610612 - RNA, 19 nt, Human
caaggacuaggguccuggg

SEQ ID NO: 1610613 - RNA, 18 nt, Human
caaggacuaggguccugg

SEQ ID NO: 1610614 - RNA, 16 nt, Human
caaggacuaggguccu

SEQ ID NO: 1610615 - RNA, 13 nt, Human
caagaaaugaaag

SEQ ID NO: 1610616 - RNA, 15 nt, Human
caagaaaugaaagca

SEQ ID NO: 1610617 - RNA, 13 nt, Human
caagaccuucucc

SEQ ID NO: 1610618 - RNA, 20 nt, Human
caagacgcugugcugcccug

SEQ ID NO: 1610619 - RNA, 22 nt, Human
caagacgcugugcugcccugcc

SEQ ID NO: 1610620 - RNA, 21 nt, Human
caagacgcugugcugcccugc

SEQ ID NO: 1610621 - RNA, 23 nt, Human
caagacgcugugcugcccugccc

SEQ ID NO: 1610622 - RNA, 17 nt, Human
caagagggucugaggaa

SEQ ID NO: 1610623 - RNA, 16 nt, Human
caagagggucugagga

SEQ ID NO: 1610624 - RNA, 12 nt, Human
caagagggucug

SEQ ID NO: 1610625 - RNA, 20 nt, Human
caagagggcacugguggccc

SEQ ID NO: 1610626 - RNA, 19 nt, Human
caagagggcacugguggcc

SEQ ID NO: 1610627 - RNA, 18 nt, Human
caagagggcacugguggc

SEQ ID NO: 1610628 - RNA, 16 nt, Human
caagggccuggccuga

SEQ ID NO: 1610629 - RNA, 21 nt, Human
caaggggaauguuugccucug

SEQ ID NO: 1610630 - RNA, 15 nt, Human
caagggccuggccug

SEQ ID NO: 1610631 - RNA, 14 nt, Human
caagggccuggccu

SEQ ID NO: 1610632 - RNA, 13 nt, Human
caagggccuggcc

SEQ ID NO: 1610633 - RNA, 13 nt, Human
caaggucauuuuu

SEQ ID NO: 1610634 - RNA, 17 nt, Human
caaggggcccaaauucu

SEQ ID NO: 1610635 - RNA, 23 nt, Human
caaggggaauguuugccucugcc

SEQ ID NO: 1610636 - RNA, 19 nt, Human
caagugauucuccugccuc

SEQ ID NO: 1610637 - RNA, 19 nt, Human
caagugagacccugucuca

SEQ ID NO: 1610638 - RNA, 15 nt, Human
caagugagacccugu

SEQ ID NO: 1610639 - RNA, 20 nt, Human
caagugauucuccugccuca

SEQ ID NO: 1610640 - RNA, 21 nt, Human
caagugauucuccugccucag

SEQ ID NO: 1610641 - RNA, 14 nt, Human
caagugagacccug

SEQ ID NO: 1610642 - RNA, 23 nt, Human
caagugaaaaaggaggaagagaa

SEQ ID NO: 1610643 - RNA, 22 nt, Human
caagugaaaaaggaggaagaga

SEQ ID NO: 1610644 - RNA, 23 nt, Human
ccaaauuucauaccuaucaucuu

SEQ ID NO: 1610645 - RNA, 20 nt, Human
ccaaaguacacuguuucaaa

SEQ ID NO: 1610646 - RNA, 15 nt, Human
ccaaaguacacuguu

SEQ ID NO: 1610647 - RNA, 18 nt, Human
ccaaaguacacuguuuca

SEQ ID NO: 1610648 - RNA, 20 nt, Human
ccaacauacucccaucugug

SEQ ID NO: 1610649 - RNA, 19 nt, Human
ccaacauacucccaucugu

SEQ ID NO: 1610650 - RNA, 18 nt, Human
ccaacauacucccaucug

SEQ ID NO: 1610651 - RNA, 17 nt, Human
ccaacauacucccaucu

SEQ ID NO: 1610652 - RNA, 22 nt, Human
ccaacauacucccaucugugaa

SEQ ID NO: 1610653 - RNA, 21 nt, Human
ccaacauacucccaucuguga

SEQ ID NO: 1610654 - RNA, 13 nt, Human
ccaacaucaacau

SEQ ID NO: 1610655 - RNA, 20 nt, Human
ccaaccaaguggcucccaca

SEQ ID NO: 1610656 - RNA, 23 nt, Human
ccaaaggaagcacaugccucucu

SEQ ID NO: 1610657 - RNA, 15 nt, Human
ccaaaggaagcacau

SEQ ID NO: 1610658 - RNA, 15 nt, Human
ccaaagcuaggccug

SEQ ID NO: 1610659 - RNA, 17 nt, Human
ccaaagcuaggccuggc

SEQ ID NO: 1610660 - RNA, 16 nt, Human
ccaaagcuaggccugg

SEQ ID NO: 1610661 - RNA, 21 nt, Human
ccaaagcuaggccuggccaga

SEQ ID NO: 1610662 - RNA, 22 nt, Human
ccaaacugacucuuaagaagac

SEQ ID NO: 1610663 - RNA, 19 nt, Human
ccaaagccaaagcuaggcc

SEQ ID NO: 1610664 - RNA, 23 nt, Human
ccaaagcagugcaugcugucccu

SEQ ID NO: 1610665 - RNA, 22 nt, Human
ccaaagccuccuccagccgcca

SEQ ID NO: 1610666 - RNA, 17 nt, Human
ccaaagccuccuccagc

SEQ ID NO: 1610667 - RNA, 20 nt, Human
ccaaacucaccugccccuca

SEQ ID NO: 1610668 - RNA, 23 nt, Human
ccaagcagagguugggaggccau

SEQ ID NO: 1610669 - RNA, 20 nt, Human
ccaagaagcccaggaaaggc

SEQ ID NO: 1610670 - RNA, 19 nt, Human
ccaagaagcccaggaaagg

SEQ ID NO: 1610671 - RNA, 19 nt, Human
ccaagaauagaugcugacu

SEQ ID NO: 1610672 - RNA, 20 nt, Human
ccaagaauagaugcugacug

SEQ ID NO: 1610673 - RNA, 12 nt, Human
ccaacccucauc

SEQ ID NO: 1610674 - RNA, 15 nt, Human
ccaagaagcccagga

SEQ ID NO: 1610675 - RNA, 15 nt, Human
ccaacccucagagcc

SEQ ID NO: 1610676 - RNA, 14 nt, Human
ccaacccucagagc

SEQ ID NO: 1610677 - RNA, 22 nt, Human
ccaagcauaccaacacgagcag

SEQ ID NO: 1610678 - RNA, 17 nt, Human
ccaagcauuuagaugua

SEQ ID NO: 1610679 - RNA, 17 nt, Human
ccaaggccaaaggaagc

SEQ ID NO: 1610680 - RNA, 22 nt, Human
ccaagcucccaggcauucccca

SEQ ID NO: 1610681 - RNA, 16 nt, Human
ccaagcucccaggcau

SEQ ID NO: 1610682 - RNA, 15 nt, Human
ccaagcucccaggca

SEQ ID NO: 1610683 - RNA, 14 nt, Human
ccaagcucccaggc

SEQ ID NO: 1610684 - RNA, 22 nt, Human
ccaagccuacuuuugccauuga

SEQ ID NO: 1610685 - RNA, 13 nt, Human
ccaagccguggcu

SEQ ID NO: 1610686 - RNA, 15 nt, Human
ccaagccuggcaagg

SEQ ID NO: 1610687 - RNA, 14 nt, Human
ccaagccguggcuu

SEQ ID NO: 1610688 - RNA, 21 nt, Human
ccaaggccaaaggaagcacau

SEQ ID NO: 1610689 - RNA, 18 nt, Human
ccaaggccaaaggaagca

SEQ ID NO: 1610690 - RNA, 15 nt, Human
ccaagggccuggccu

SEQ ID NO: 1610691 - RNA, 18 nt, Human
ccaagggccuggccugag

SEQ ID NO: 1610692 - RNA, 16 nt, Human
ccaagggccuggccug

SEQ ID NO: 1610693 - RNA, 19 nt, Human
ccaagggccuggccugagc

SEQ ID NO: 1610694 - RNA, 22 nt, Human
ccaaggggaauguuugccucug

SEQ ID NO: 1610695 - RNA, 23 nt, Human
ccaagguuuggggaagaacgaag

SEQ ID NO: 1610696 - RNA, 13 nt, Human
ccaaggugggagg

SEQ ID NO: 1610697 - RNA, 18 nt, Human
ccaaggugggaggauugc

SEQ ID NO: 1610698 - RNA, 20 nt, Human
ccaagucaagugaaaaagga

SEQ ID NO: 1610699 - RNA, 22 nt, Human
ccaauaguuguugauuggcagg

SEQ ID NO: 1610700 - RNA, 14 nt, Human
ccaagcaaguauua

SEQ ID NO: 1610701 - RNA, 18 nt, Human
cauuugcucauggaauug

SEQ ID NO: 1610702 - RNA, 13 nt, Human
cauuugcucaugg

SEQ ID NO: 1610703 - RNA, 14 nt, Human
cauuugcuccuuuc

SEQ ID NO: 1610704 - RNA, 13 nt, Human
cauuugcuccuuu

SEQ ID NO: 1610705 - RNA, 17 nt, Human
cauuuguuugaacugau

SEQ ID NO: 1610706 - RNA, 13 nt, Human
cauuugcugaaua

SEQ ID NO: 1610707 - RNA, 20 nt, Human
cauuuguuugaacugauaaa

SEQ ID NO: 1610708 - RNA, 22 nt, Human
cauuuguuugaacugauaaaga

SEQ ID NO: 1610709 - RNA, 18 nt, Human
cauuugagcagggcucag

SEQ ID NO: 1610710 - RNA, 17 nt, Human
cauuugagcagggcuca

SEQ ID NO: 1610711 - RNA, 20 nt, Human
cauuugagcagggcucagcg

SEQ ID NO: 1610712 - RNA, 22 nt, Human
cauuugaaaauuuugauguuuu

SEQ ID NO: 1610713 - RNA, 20 nt, Human
cauuugaaaauuuugauguu

SEQ ID NO: 1610714 - RNA, 23 nt, Human
cauuuuucuuagggaaggauaca

SEQ ID NO: 1610715 - RNA, 20 nt, Human
ccaaacauccuacaagacac

SEQ ID NO: 1610716 - RNA, 19 nt, Human
ccaaacauccuacaagaca

SEQ ID NO: 1610717 - RNA, 19 nt, Human
cauuuuagggguagcauuu

SEQ ID NO: 1610718 - RNA, 17 nt, Human
cauuuaggccaugggac

SEQ ID NO: 1610719 - RNA, 23 nt, Human
cauuuaauaauuauaugcuauuu

SEQ ID NO: 1610720 - RNA, 20 nt, Human
cauuuccugacagaaggacu

SEQ ID NO: 1610721 - RNA, 13 nt, Human
cauuuccugacag

SEQ ID NO: 1610722 - RNA, 21 nt, Human
cauuuaaaagauacaguuacu

SEQ ID NO: 1610723 - RNA, 14 nt, Human
cauuuaauaauuau

SEQ ID NO: 1610724 - RNA, 12 nt, Human
cauuuaauaauu

SEQ ID NO: 1610725 - RNA, 19 nt, Human
cauuuaauaauuauaugcu

SEQ ID NO: 1610726 - RNA, 17 nt, Human
cauuuaauaauuauaug

SEQ ID NO: 1610727 - RNA, 16 nt, Human
cauuuaauaauuauau

SEQ ID NO: 1610728 - RNA, 15 nt, Human
cauuuaauaauuaua

SEQ ID NO: 1610729 - RNA, 12 nt, Human
cauuuaaaagau

SEQ ID NO: 1610730 - RNA, 15 nt, Human
cauuuaaaagauaca

SEQ ID NO: 1610731 - RNA, 16 nt, Human
cauuuaaaagauacag

SEQ ID NO: 1610732 - RNA, 13 nt, Human
cauuuccuguguc

SEQ ID NO: 1610733 - RNA, 12 nt, Human
cauuuccugugu

SEQ ID NO: 1610734 - RNA, 15 nt, Human
cacccaagggccugg

SEQ ID NO: 1610735 - RNA, 14 nt, Human
cacccaagggccug

SEQ ID NO: 1610736 - RNA, 21 nt, Human
cauuguagagcuucuggcacu

SEQ ID NO: 1610737 - RNA, 19 nt, Human
cauuguagagcuucuggca

SEQ ID NO: 1610738 - RNA, 17 nt, Human
cauuguagagcuucugg

SEQ ID NO: 1610739 - RNA, 16 nt, Human
cauuguagagcuucug

SEQ ID NO: 1610740 - RNA, 15 nt, Human
cauuguagagcuucu

SEQ ID NO: 1610741 - RNA, 18 nt, Human
cauuguuggccaaagcca

SEQ ID NO: 1610742 - RNA, 17 nt, Human
cauuguuggccaaagcc

SEQ ID NO: 1610743 - RNA, 13 nt, Human
cauugugggaagg

SEQ ID NO: 1610744 - RNA, 23 nt, Human
cauuguauucagaguugaugguu

SEQ ID NO: 1610745 - RNA, 20 nt, Human
ccacaggaaccacaagacug

SEQ ID NO: 1610746 - RNA, 12 nt, Human
ccacacuccagc

SEQ ID NO: 1610747 - RNA, 16 nt, Human
ccacaggaucagucug

SEQ ID NO: 1610748 - RNA, 16 nt, Human
ccacaggcccuuccuc

SEQ ID NO: 1610749 - RNA, 15 nt, Human
ccacaggcccuuccu

SEQ ID NO: 1610750 - RNA, 23 nt, Human
ccacaggcccuuccucuccacug

SEQ ID NO: 1610751 - RNA, 22 nt, Human
ccacaggcccuuccucuccacu

SEQ ID NO: 1610752 - RNA, 19 nt, Human
ccacaggcccuuccucucc

SEQ ID NO: 1610753 - RNA, 18 nt, Human
ccacaggcccuuccucuc

SEQ ID NO: 1610754 - RNA, 17 nt, Human
ccacaggcccuuccucu

SEQ ID NO: 1610755 - RNA, 22 nt, Human
ccacacccagcccacuucugcc

SEQ ID NO: 1610756 - RNA, 21 nt, Human
ccacacccagcccacuucugc

SEQ ID NO: 1610757 - RNA, 20 nt, Human
ccacacccagcccacuucug

SEQ ID NO: 1610758 - RNA, 21 nt, Human
ccaccaacauacucccaucug

SEQ ID NO: 1610759 - RNA, 15 nt, Human
ccaccaacccucaga

SEQ ID NO: 1610760 - RNA, 16 nt, Human
ccacauuccugaugcu

SEQ ID NO: 1610761 - RNA, 16 nt, Human
ccacaugugcacaugc

SEQ ID NO: 1610762 - RNA, 18 nt, Human
ccacaucuugcucugcug

SEQ ID NO: 1610763 - RNA, 19 nt, Human
ccacaucuugcucugcuga

SEQ ID NO: 1610764 - RNA, 20 nt, Human
ccacaucuugcucugcugac

SEQ ID NO: 1610765 - RNA, 16 nt, Human
ccaauauucauagcag

SEQ ID NO: 1610766 - RNA, 17 nt, Human
ccacccccacccaaggg

SEQ ID NO: 1610767 - RNA, 23 nt, Human
ccacccaggagccccgaggccuu

SEQ ID NO: 1610768 - RNA, 18 nt, Human
ccacugcagaagacagua

SEQ ID NO: 1610769 - RNA, 13 nt, Human
ccacugcagaaga

SEQ ID NO: 1610770 - RNA, 19 nt, Human
ccacuuagaaauugcauuu

SEQ ID NO: 1610771 - RNA, 14 nt, Human
ccacuucagcugac

SEQ ID NO: 1610772 - RNA, 13 nt, Human
ccacuucagcuga

SEQ ID NO: 1610773 - RNA, 21 nt, Human
ccacuuagaaauugcauuucc

SEQ ID NO: 1610774 - RNA, 18 nt, Human
ccagaauuucccaaagca

SEQ ID NO: 1610775 - RNA, 22 nt, Human
ccagaaguuugagaucagccug

SEQ ID NO: 1610776 - RNA, 23 nt, Human
ccagaaguuugagaucagccugg

SEQ ID NO: 1610777 - RNA, 19 nt, Human
ccagaauuucccaaagcag

SEQ ID NO: 1610778 - RNA, 12 nt, Human
ccagaauuuccc

SEQ ID NO: 1610779 - RNA, 13 nt, Human
ccagaauuucaaa

SEQ ID NO: 1610780 - RNA, 23 nt, Human
ccagaauggucuuucuaaugugu

SEQ ID NO: 1610781 - RNA, 16 nt, Human
ccagaaugcuuuagga

SEQ ID NO: 1610782 - RNA, 21 nt, Human
ccagacaccuugacagggcac

SEQ ID NO: 1610783 - RNA, 21 nt, Human
ccagaauuucccaaagcagug

SEQ ID NO: 1610784 - RNA, 14 nt, Human
ccagaccccuggcu

SEQ ID NO: 1610785 - RNA, 18 nt, Human
ccagaccccuggcuuuuc

SEQ ID NO: 1610786 - RNA, 17 nt, Human
ccagaccccuggcuuuu

SEQ ID NO: 1610787 - RNA, 16 nt, Human
ccagaccccuggcuuu

SEQ ID NO: 1610788 - RNA, 15 nt, Human
ccagaccccuggcuu

SEQ ID NO: 1610789 - RNA, 18 nt, Human
ccacucaguccauagcag

SEQ ID NO: 1610790 - RNA, 22 nt, Human
ccacuccagaccccuggcuuuu

SEQ ID NO: 1610791 - RNA, 21 nt, Human
ccacuccagaccccuggcuuu

SEQ ID NO: 1610792 - RNA, 16 nt, Human
ccacuacauucuguua

SEQ ID NO: 1610793 - RNA, 17 nt, Human
ccacuacauucuguuaa

SEQ ID NO: 1610794 - RNA, 17 nt, Human
ccacuagacccacugga

SEQ ID NO: 1610795 - RNA, 15 nt, Human
ccacuagacccacug

SEQ ID NO: 1610796 - RNA, 11 nt, Human
ccacuacauuc

SEQ ID NO: 1610797 - RNA, 15 nt, Human
ccacuacauucuguu

SEQ ID NO: 1610798 - RNA, 14 nt, Human
ccacuacauucugu

SEQ ID NO: 1610799 - RNA, 15 nt, Human
ccaccccacacacgc

SEQ ID NO: 1610800 - RNA, 15 nt, Human
ccacccccacccaag

SEQ ID NO: 1610801 - RNA, 16 nt, Human
ccacgcuggagugcag

SEQ ID NO: 1610802 - RNA, 18 nt, Human
ccacggccaggccagagg

SEQ ID NO: 1610803 - RNA, 16 nt, Human
ccacggccaggccaga

SEQ ID NO: 1610804 - RNA, 19 nt, Human
ccacgcuggagugcaguga

SEQ ID NO: 1610805 - RNA, 18 nt, Human
ccacgcuggagugcagug

SEQ ID NO: 1610806 - RNA, 23 nt, Human
ccacggccaggccagagggagug

SEQ ID NO: 1610807 - RNA, 14 nt, Human
ccacgguguucugu

SEQ ID NO: 1610808 - RNA, 20 nt, Human
ccagugaaaucaguuacucu

SEQ ID NO: 1610809 - RNA, 13 nt, Human
ccaguaucuugaa

SEQ ID NO: 1610810 - RNA, 14 nt, Human
ccagguucagcuug

SEQ ID NO: 1610811 - RNA, 21 nt, Human
ccaggugcuaggaacacuccu

SEQ ID NO: 1610812 - RNA, 15 nt, Human
ccagguucagcuugu

SEQ ID NO: 1610813 - RNA, 17 nt, Human
ccaggugccaguuaugg

SEQ ID NO: 1610814 - RNA, 18 nt, Human
ccaggugcacaagcucca

SEQ ID NO: 1610815 - RNA, 19 nt, Human
ccaggugcuaggaacacuc

SEQ ID NO: 1610816 - RNA, 13 nt, Human
ccaggccccugcc

SEQ ID NO: 1610817 - RNA, 19 nt, Human
ccaggcuggucucaaacuc

SEQ ID NO: 1610818 - RNA, 21 nt, Human
ccaggcuggucucgaacuccu

SEQ ID NO: 1610819 - RNA, 20 nt, Human
ccaggcuguaucccaugagc

SEQ ID NO: 1610820 - RNA, 12 nt, Human
ccagggaagggg

SEQ ID NO: 1610821 - RNA, 19 nt, Human
ccaggcuuuuuuaucaugu

SEQ ID NO: 1610822 - RNA, 16 nt, Human
ccaggagcagccacau

SEQ ID NO: 1610823 - RNA, 15 nt, Human
ccaggagccccgagg

SEQ ID NO: 1610824 - RNA, 19 nt, Human
ccaggagccuccugcccuu

SEQ ID NO: 1610825 - RNA, 16 nt, Human
ccaggagccccgaggc

SEQ ID NO: 1610826 - RNA, 18 nt, Human
ccaggagccuccugcccu

SEQ ID NO: 1610827 - RNA, 14 nt, Human
ccaggagccuccug

SEQ ID NO: 1610828 - RNA, 13 nt, Human
ccaggagccuccu

SEQ ID NO: 1610829 - RNA, 12 nt, Human
ccaggaggccag

SEQ ID NO: 1610830 - RNA, 13 nt, Human
ccaggaggccagc

SEQ ID NO: 1610831 - RNA, 14 nt, Human
ccaggaggccagcc

SEQ ID NO: 1610832 - RNA, 23 nt, Human
ccaggcauuccccaggaggccag

SEQ ID NO: 1610833 - RNA, 24 nt, Human
ccaggcauuccccaggaggccagc

SEQ ID NO: 1610834 - RNA, 21 nt, Human
ccaggccacaagacccuugug

SEQ ID NO: 1610835 - RNA, 14 nt, Human
ccaggcauucccca

SEQ ID NO: 1610836 - RNA, 17 nt, Human
ccaggcauuccccagga

SEQ ID NO: 1610837 - RNA, 13 nt, Human
ccaggcauggugg

SEQ ID NO: 1610838 - RNA, 16 nt, Human
ccagcgagcccuggug

SEQ ID NO: 1610839 - RNA, 15 nt, Human
ccagcgagcccuggu

SEQ ID NO: 1610840 - RNA, 14 nt, Human
ccagcgagcccugg

SEQ ID NO: 1610841 - RNA, 22 nt, Human
ccagccuugaccauucuccacc

SEQ ID NO: 1610842 - RNA, 13 nt, Human
ccagcucuggucc

SEQ ID NO: 1610843 - RNA, 12 nt, Human
ccagcucugguc

SEQ ID NO: 1610844 - RNA, 11 nt, Human
ccagcucuggu

SEQ ID NO: 1610845 - RNA, 21 nt, Human
ccagcgagcccugguggcagu

SEQ ID NO: 1610846 - RNA, 20 nt, Human
ccagccuugaccauucucca

SEQ ID NO: 1610847 - RNA, 19 nt, Human
ccagccuugaccauucucc

SEQ ID NO: 1610848 - RNA, 16 nt, Human
ccagagcccaccuugg

SEQ ID NO: 1610849 - RNA, 22 nt, Human
ccagagcccaccuuggcucaag

SEQ ID NO: 1610850 - RNA, 13 nt, Human
ccagcugcuuggg

SEQ ID NO: 1610851 - RNA, 23 nt, Human
ccagcugcuugggcuucauccuc

SEQ ID NO: 1610852 - RNA, 20 nt, Human
ccagcugcuugggcuucauc

SEQ ID NO: 1610853 - RNA, 22 nt, Human
ccagcucugguccauagagagc

SEQ ID NO: 1610854 - RNA, 21 nt, Human
ccagcucugguccauagagag

SEQ ID NO: 1610855 - RNA, 17 nt, Human
ccagcucugguccauag

SEQ ID NO: 1610856 - RNA, 14 nt, Human
ccagcucuggucca

SEQ ID NO: 1610857 - RNA, 22 nt, Human
ccaggaagccagcaggcucuca

SEQ ID NO: 1610858 - RNA, 20 nt, Human
ccaggaauggagccugcacg

SEQ ID NO: 1610859 - RNA, 23 nt, Human
ccagcuggggccaggcugggucg

SEQ ID NO: 1610860 - RNA, 22 nt, Human
ccagcuggggccaggcuggguc

SEQ ID NO: 1610861 - RNA, 21 nt, Human
ccagcuggggccaggcugggu

SEQ ID NO: 1610862 - RNA, 20 nt, Human
ccagcuggggccaggcuggg

SEQ ID NO: 1610863 - RNA, 19 nt, Human
ccagcuggggccaggcugg

SEQ ID NO: 1610864 - RNA, 18 nt, Human
ccagcuggggccaggcug

SEQ ID NO: 1610865 - RNA, 17 nt, Human
ccagcuggggccaggcu

SEQ ID NO: 1610866 - RNA, 14 nt, Human
ccaugaagauguag

SEQ ID NO: 1610867 - RNA, 16 nt, Human
ccaugauguuuagaaa

SEQ ID NO: 1610868 - RNA, 18 nt, Human
ccaugauguuuuccauga

SEQ ID NO: 1610869 - RNA, 21 nt, Human
ccaugauuaaccacuucagcu

SEQ ID NO: 1610870 - RNA, 19 nt, Human
ccaugauuaaccacuucag

SEQ ID NO: 1610871 - RNA, 13 nt, Human
ccaugcugcccug

SEQ ID NO: 1610872 - RNA, 11 nt, Human
ccaugcugccc

SEQ ID NO: 1610873 - RNA, 13 nt, Human
ccaugcuccuggc

SEQ ID NO: 1610874 - RNA, 14 nt, Human
ccaugcugcccugu

SEQ ID NO: 1610875 - RNA, 15 nt, Human
ccaugcugcccugug

SEQ ID NO: 1610876 - RNA, 18 nt, Human
ccaucaaggguacacugc

SEQ ID NO: 1610877 - RNA, 20 nt, Human
ccaucaauaaaaaauuauga

SEQ ID NO: 1610878 - RNA, 19 nt, Human
ccaucaauaaaaaauuaug

SEQ ID NO: 1610879 - RNA, 13 nt, Human
ccaucaccagaca

SEQ ID NO: 1610880 - RNA, 19 nt, Human
ccagugaggcucugcccuu

SEQ ID NO: 1610881 - RNA, 18 nt, Human
ccagugaggcucugcccu

SEQ ID NO: 1610882 - RNA, 20 nt, Human
ccagugaggcucugcccuug

SEQ ID NO: 1610883 - RNA, 23 nt, Human
ccauacuaauuauacccccugca

SEQ ID NO: 1610884 - RNA, 13 nt, Human
ccauacuaauuau

SEQ ID NO: 1610885 - RNA, 12 nt, Human
ccauacuaauua

SEQ ID NO: 1610886 - RNA, 19 nt, Human
ccauccucuguacagagcc

SEQ ID NO: 1610887 - RNA, 12 nt, Human
ccauccucugua

SEQ ID NO: 1610888 - RNA, 22 nt, Human
ccaucauugaaaucuuuuugcu

SEQ ID NO: 1610889 - RNA, 20 nt, Human
ccauccucuguacagagccc

SEQ ID NO: 1610890 - RNA, 13 nt, Human
cccaaaaggcaga

SEQ ID NO: 1610891 - RNA, 18 nt, Human
cccaaaaggcagaagcaa

SEQ ID NO: 1610892 - RNA, 20 nt, Human
ccauuuugggguacccacug

SEQ ID NO: 1610893 - RNA, 23 nt, Human
ccauuuuggauucuuauggacaa

SEQ ID NO: 1610894 - RNA, 22 nt, Human
ccauuuugggguacccacugcu

SEQ ID NO: 1610895 - RNA, 15 nt, Human
cccaaagaugcagcc

SEQ ID NO: 1610896 - RNA, 12 nt, Human
cccaaagaugca

SEQ ID NO: 1610897 - RNA, 16 nt, Human
cccaaagcagugcaug

SEQ ID NO: 1610898 - RNA, 18 nt, Human
ccauucugccugcccagg

SEQ ID NO: 1610899 - RNA, 17 nt, Human
ccauucugccugcccag

SEQ ID NO: 1610900 - RNA, 18 nt, Human
ccauucuccaccugccag

SEQ ID NO: 1610901 - RNA, 17 nt, Human
ccauucuccaccugcca

SEQ ID NO: 1610902 - RNA, 20 nt, Human
ccauucugccugcccaggcc

SEQ ID NO: 1610903 - RNA, 19 nt, Human
ccauucugccugcccaggc

SEQ ID NO: 1610904 - RNA, 21 nt, Human
ccauucugccugcccaggccc

SEQ ID NO: 1610905 - RNA, 16 nt, Human
ccauucuccaccugcc

SEQ ID NO: 1610906 - RNA, 15 nt, Human
ccauucuccaccugc

SEQ ID NO: 1610907 - RNA, 14 nt, Human
ccauggacuuuguu

SEQ ID NO: 1610908 - RNA, 13 nt, Human
ccauggacuuugu

SEQ ID NO: 1610909 - RNA, 21 nt, Human
cccacaaaggagagcuagcag

SEQ ID NO: 1610910 - RNA, 13 nt, Human
cccaggugccagu

SEQ ID NO: 1610911 - RNA, 22 nt, Human
cccaggugcuaggaacacuccu

SEQ ID NO: 1610912 - RNA, 23 nt, Human
cccaggugcuaggaacacuccuu

SEQ ID NO: 1610913 - RNA, 20 nt, Human
cccagucuggaaugcagugg

SEQ ID NO: 1610914 - RNA, 13 nt, Human
cccagugcccaca

SEQ ID NO: 1610915 - RNA, 18 nt, Human
cccaggccuccuacagcu

SEQ ID NO: 1610916 - RNA, 17 nt, Human
cccaggccuccuacagc

SEQ ID NO: 1610917 - RNA, 15 nt, Human
cccaggcugagccuc

SEQ ID NO: 1610918 - RNA, 14 nt, Human
cccaggcugagccu

SEQ ID NO: 1610919 - RNA, 18 nt, Human
cccaggcgccccuucccc

SEQ ID NO: 1610920 - RNA, 16 nt, Human
cccaggccugccuguu

SEQ ID NO: 1610921 - RNA, 15 nt, Human
cccaggccugccugu

SEQ ID NO: 1610922 - RNA, 22 nt, Human
cccaggaggccagccuugacca

SEQ ID NO: 1610923 - RNA, 13 nt, Human
cccaggaggccag

SEQ ID NO: 1610924 - RNA, 21 nt, Human
cccaggagccccgaggccuuc

SEQ ID NO: 1610925 - RNA, 13 nt, Human
cccaggcaggucu

SEQ ID NO: 1610926 - RNA, 11 nt, Human
cccaggcaggu

SEQ ID NO: 1610927 - RNA, 22 nt, Human
cccaggccccugccacccuggg

SEQ ID NO: 1610928 - RNA, 21 nt, Human
cccaggccccugccacccugg

SEQ ID NO: 1610929 - RNA, 18 nt, Human
cccaggccccugccaccc

SEQ ID NO: 1610930 - RNA, 16 nt, Human
cccaggccccugccac

SEQ ID NO: 1610931 - RNA, 11 nt, Human
cccaggccccu

SEQ ID NO: 1610932 - RNA, 21 nt, Human
cccaggcauuccccaggaggc

SEQ ID NO: 1610933 - RNA, 20 nt, Human
cccaggcauuccccaggagg

SEQ ID NO: 1610934 - RNA, 17 nt, Human
cccaggcaggucuugaa

SEQ ID NO: 1610935 - RNA, 23 nt, Human
cccaggcauuccccaggaggcca

SEQ ID NO: 1610936 - RNA, 22 nt, Human
cccaggcauuccccaggaggcc

SEQ ID NO: 1610937 - RNA, 18 nt, Human
cccagcgagcccuggugg

SEQ ID NO: 1610938 - RNA, 17 nt, Human
cccagcgagcccuggug

SEQ ID NO: 1610939 - RNA, 23 nt, Human
cccagcgagcccugguggcagug

SEQ ID NO: 1610940 - RNA, 19 nt, Human
cccagcgagcccugguggc

SEQ ID NO: 1610941 - RNA, 11 nt, Human
cccagccccuu

SEQ ID NO: 1610942 - RNA, 23 nt, Human
cccagauugcaacaggcugggcu

SEQ ID NO: 1610943 - RNA, 23 nt, Human
cccagcaagugagagcugggugu

SEQ ID NO: 1610944 - RNA, 22 nt, Human
cccagcaagugagagcugggug

SEQ ID NO: 1610945 - RNA, 21 nt, Human
cccagcaagugagagcugggu

SEQ ID NO: 1610946 - RNA, 20 nt, Human
cccagcaagugagagcuggg

SEQ ID NO: 1610947 - RNA, 19 nt, Human
cccagcaagugagagcugg

SEQ ID NO: 1610948 - RNA, 12 nt, Human
cccagccugcua

SEQ ID NO: 1610949 - RNA, 18 nt, Human
cccagccccuucugaccc

SEQ ID NO: 1610950 - RNA, 18 nt, Human
cccagcaagugagagcug

SEQ ID NO: 1610951 - RNA, 16 nt, Human
cccagcaagugagagc

SEQ ID NO: 1610952 - RNA, 22 nt, Human
cccagauugcaacaggcugggc

SEQ ID NO: 1610953 - RNA, 21 nt, Human
cccagauugcaacaggcuggg

SEQ ID NO: 1610954 - RNA, 20 nt, Human
cccagauugcaacaggcugg

SEQ ID NO: 1610955 - RNA, 20 nt, Human
cccagagggccugcaaggga

SEQ ID NO: 1610956 - RNA, 23 nt, Human
cccaagggccuggccugagcugg

SEQ ID NO: 1610957 - RNA, 19 nt, Human
cccaagggccuggccugag

SEQ ID NO: 1610958 - RNA, 18 nt, Human
cccaagggccuggccuga

SEQ ID NO: 1610959 - RNA, 22 nt, Human
ccccucagggucccugguggca

SEQ ID NO: 1610960 - RNA, 17 nt, Human
ccccaggaggccagccu

SEQ ID NO: 1610961 - RNA, 21 nt, Human
ccccacccaagggccuggccu

SEQ ID NO: 1610962 - RNA, 20 nt, Human
ccccacccaagggccuggcc

SEQ ID NO: 1610963 - RNA, 14 nt, Human
ccccacccaagggc

SEQ ID NO: 1610964 - RNA, 14 nt, Human
ccccaagccuggca

SEQ ID NO: 1610965 - RNA, 13 nt, Human
ccccaagccuggc

SEQ ID NO: 1610966 - RNA, 22 nt, Human
ccccaaauggaaaugggcagag

SEQ ID NO: 1610967 - RNA, 13 nt, Human
cccauucugccug

SEQ ID NO: 1610968 - RNA, 18 nt, Human
cccagugccgagaaggaa

SEQ ID NO: 1610969 - RNA, 20 nt, Human
cccagugcccacaggaucag

SEQ ID NO: 1610970 - RNA, 15 nt, Human
cccagugcccacagg

SEQ ID NO: 1610971 - RNA, 16 nt, Human
cccaugcugcccugug

SEQ ID NO: 1610972 - RNA, 15 nt, Human
cccaugcugcccugu

SEQ ID NO: 1610973 - RNA, 18 nt, Human
cccaugcugcccugugag

SEQ ID NO: 1610974 - RNA, 17 nt, Human
cccaugcugcccuguga

SEQ ID NO: 1610975 - RNA, 17 nt, Human
cggccuccauccugagg

SEQ ID NO: 1610976 - RNA, 16 nt, Human
cggccuccauccugag

SEQ ID NO: 1610977 - RNA, 19 nt, Human
cggcuggccuggccccuca

SEQ ID NO: 1610978 - RNA, 18 nt, Human
cggcuggccuggccccuc

SEQ ID NO: 1610979 - RNA, 16 nt, Human
cggcuggccuggcccc

SEQ ID NO: 1610980 - RNA, 15 nt, Human
cggcuggccuggccc

SEQ ID NO: 1610981 - RNA, 15 nt, Human
cggccuuuggcuuca

SEQ ID NO: 1610982 - RNA, 12 nt, Human
cgggcaugacac

SEQ ID NO: 1610983 - RNA, 15 nt, Human
cgggcaugacacgaa

SEQ ID NO: 1610984 - RNA, 17 nt, Human
cgggaggucgaggcagg

SEQ ID NO: 1610985 - RNA, 16 nt, Human
cgggaggucgaggcag

SEQ ID NO: 1610986 - RNA, 20 nt, Human
cgggaggauguucugggaca

SEQ ID NO: 1610987 - RNA, 22 nt, Human
cgggagccugaucaccugcccu

SEQ ID NO: 1610988 - RNA, 21 nt, Human
cgggaggauguucugggacac

SEQ ID NO: 1610989 - RNA, 20 nt, Human
cggacagccacggccaggcc

SEQ ID NO: 1610990 - RNA, 14 nt, Human
cggaugauuucuau

SEQ ID NO: 1610991 - RNA, 13 nt, Human
cggaugauuucua

SEQ ID NO: 1610992 - RNA, 13 nt, Human
cgcuccugugucu

SEQ ID NO: 1610993 - RNA, 17 nt, Human
cgcuauugucaccaggg

SEQ ID NO: 1610994 - RNA, 17 nt, Human
cggaaagcccugugcuc

SEQ ID NO: 1610995 - RNA, 18 nt, Human
cggacagccacggccagg

SEQ ID NO: 1610996 - RNA, 16 nt, Human
cggacagccacggcca

SEQ ID NO: 1610997 - RNA, 15 nt, Human
cggacagccacggcc

SEQ ID NO: 1610998 - RNA, 20 nt, Human
cggaaugaaccacaucuugc

SEQ ID NO: 1610999 - RNA, 11 nt, Human
cgcaaugugac

SEQ ID NO: 1611000 - RNA, 12 nt, Human
cgauuucuguuu

SEQ ID NO: 1611001 - RNA, 19 nt, Human
cgauucuucugcuucagcc

SEQ ID NO: 1611002 - RNA, 13 nt, Human
cgauucuucugcu

SEQ ID NO: 1611003 - RNA, 21 nt, Human
cgauucuucugcuucagccuc

SEQ ID NO: 1611004 - RNA, 19 nt, Human
cgaucuggguucacugcaa

SEQ ID NO: 1611005 - RNA, 19 nt, Human
cgaggccuucucugaagga

SEQ ID NO: 1611006 - RNA, 18 nt, Human
cgaggccuucucugaagg

SEQ ID NO: 1611007 - RNA, 12 nt, Human
cgaggacaggga

SEQ ID NO: 1611008 - RNA, 13 nt, Human
cgaggacagggag

SEQ ID NO: 1611009 - RNA, 14 nt, Human
cgaggacagggagg

SEQ ID NO: 1611010 - RNA, 15 nt, Human
ccuuuguauucucuc

SEQ ID NO: 1611011 - RNA, 18 nt, Human
ccuuuguauucucuccug

SEQ ID NO: 1611012 - RNA, 20 nt, Human
ccuuuguauucucuccugua

SEQ ID NO: 1611013 - RNA, 16 nt, Human
ccuuugcuugaaagaa

SEQ ID NO: 1611014 - RNA, 14 nt, Human
ccuuugacaaaggu

SEQ ID NO: 1611015 - RNA, 14 nt, Human
ccuuuaagagaaau

SEQ ID NO: 1611016 - RNA, 16 nt, Human
ccuuucucuuucguua

SEQ ID NO: 1611017 - RNA, 13 nt, Human
ccuuuaagagaaa

SEQ ID NO: 1611018 - RNA, 19 nt, Human
ccuuguggucccaccccac

SEQ ID NO: 1611019 - RNA, 16 nt, Human
ccuuguggucccaccc

SEQ ID NO: 1611020 - RNA, 20 nt, Human
ccuuguggucccaccccaca

SEQ ID NO: 1611021 - RNA, 14 nt, Human
ccuuggcugcaggg

SEQ ID NO: 1611022 - RNA, 13 nt, Human
ccuuggcugcagg

SEQ ID NO: 1611023 - RNA, 12 nt, Human
ccuuggcugcag

SEQ ID NO: 1611024 - RNA, 17 nt, Human
cgcgacaaugcaaacca

SEQ ID NO: 1611025 - RNA, 16 nt, Human
cgcgacaaugcaaacc

SEQ ID NO: 1611026 - RNA, 15 nt, Human
cgcccccacugguga

SEQ ID NO: 1611027 - RNA, 12 nt, Human
cgcccaggcugg

SEQ ID NO: 1611028 - RNA, 20 nt, Human
cgcccaggcuggagugcaau

SEQ ID NO: 1611029 - RNA, 19 nt, Human
cgcccaggcuggagugcaa

SEQ ID NO: 1611030 - RNA, 14 nt, Human
cgcagacaggacca

SEQ ID NO: 1611031 - RNA, 13 nt, Human
cgcagacaggacc

SEQ ID NO: 1611032 - RNA, 16 nt, Human
cgcuaagagggaggga

SEQ ID NO: 1611033 - RNA, 15 nt, Human
cgcuaagagggaggg

SEQ ID NO: 1611034 - RNA, 14 nt, Human
cgcuaagagggagg

SEQ ID NO: 1611035 - RNA, 21 nt, Human
cgcguugaaauuguaauuaua

SEQ ID NO: 1611036 - RNA, 17 nt, Human
cgcguugaaauuguaau

SEQ ID NO: 1611037 - RNA, 21 nt, Human
cgcuaagagggagggagggcu

SEQ ID NO: 1611038 - RNA, 22 nt, Human
cgcguugaaauuguaauuauau

SEQ ID NO: 1611039 - RNA, 19 nt, Human
cgcgugcacacaccagagc

SEQ ID NO: 1611040 - RNA, 16 nt, Human
cgcgugcacacaccag

SEQ ID NO: 1611041 - RNA, 20 nt, Human
cgcgugcacacaccagagcc

SEQ ID NO: 1611042 - RNA, 13 nt, Human
cgcguugaaauug

SEQ ID NO: 1611043 - RNA, 14 nt, Human
cgucuaccugaggg

SEQ ID NO: 1611044 - RNA, 14 nt, Human
cgucugacaggcaa

SEQ ID NO: 1611045 - RNA, 13 nt, Human
cgucugacaggca

SEQ ID NO: 1611046 - RNA, 14 nt, Human
cguccccugucccc

SEQ ID NO: 1611047 - RNA, 11 nt, Human
cguccccuguc

SEQ ID NO: 1611048 - RNA, 22 nt, Human
cgucccccucuggcuccagcug

SEQ ID NO: 1611049 - RNA, 23 nt, Human
cgugcauaccacuuuuguucuug

SEQ ID NO: 1611050 - RNA, 19 nt, Human
cgugcauaccacuuuuguu

SEQ ID NO: 1611051 - RNA, 22 nt, Human
cgugcacacaccagagcccacc

SEQ ID NO: 1611052 - RNA, 14 nt, Human
cgugcauaccacuu

SEQ ID NO: 1611053 - RNA, 18 nt, Human
cgugcauaccacuuuugu

SEQ ID NO: 1611054 - RNA, 21 nt, Human
cgugcacacaccagagcccac

SEQ ID NO: 1611055 - RNA, 20 nt, Human
cgugcacacaccagagccca

SEQ ID NO: 1611056 - RNA, 12 nt, Human
cgugacaacacu

SEQ ID NO: 1611057 - RNA, 23 nt, Human
cggugcuaucucccccagcccca

SEQ ID NO: 1611058 - RNA, 22 nt, Human
cguauaaaagccuguuuaagag

SEQ ID NO: 1611059 - RNA, 21 nt, Human
cguauaaaagccuguuuaaga

SEQ ID NO: 1611060 - RNA, 17 nt, Human
cguauaaaagccuguuu

SEQ ID NO: 1611061 - RNA, 16 nt, Human
cguauaaaagccuguu

SEQ ID NO: 1611062 - RNA, 20 nt, Human
cgucaacucauauuuucaug

SEQ ID NO: 1611063 - RNA, 16 nt, Human
cgucaacucauauuuu

SEQ ID NO: 1611064 - RNA, 22 nt, Human
cguauaugucucaggucccugc

SEQ ID NO: 1611065 - RNA, 21 nt, Human
cgucccccucuggcuccagcu

SEQ ID NO: 1611066 - RNA, 14 nt, Human
cgucccccucuggc

SEQ ID NO: 1611067 - RNA, 15 nt, Human
cguggcugcuucaag

SEQ ID NO: 1611068 - RNA, 14 nt, Human
cguggcugcuucaa

SEQ ID NO: 1611069 - RNA, 12 nt, Human
cguggcugcuuc

SEQ ID NO: 1611070 - RNA, 17 nt, Human
cguggcugcuucaagga

SEQ ID NO: 1611071 - RNA, 22 nt, Human
cguucauggaacgcguugaaau

SEQ ID NO: 1611072 - RNA, 23 nt, Human
cguucauggaacgcguugaaauu

SEQ ID NO: 1611073 - RNA, 16 nt, Human
cgugccuggccacgcc

SEQ ID NO: 1611074 - RNA, 12 nt, Human
cgugccuggcca

SEQ ID NO: 1611075 - RNA, 18 nt, Human
cgugccuucagcucuaca

SEQ ID NO: 1611076 - RNA, 16 nt, Human
cgugccuucagcucua

SEQ ID NO: 1611077 - RNA, 15 nt, Human
cgugccuucagcucu

SEQ ID NO: 1611078 - RNA, 13 nt, Human
cgugccuucagcu

SEQ ID NO: 1611079 - RNA, 20 nt, Human
cguuucuaugacacaugcaa

SEQ ID NO: 1611080 - RNA, 19 nt, Human
cguuucuaaaggcuaccuu

SEQ ID NO: 1611081 - RNA, 21 nt, Human
cguuucuaaaggcuaccuuug

SEQ ID NO: 1611082 - RNA, 18 nt, Human
cguugaaauuguaauuau

SEQ ID NO: 1611083 - RNA, 13 nt, Human
cguugaaauugua

SEQ ID NO: 1611084 - RNA, 22 nt, Human
cguuccuucaaagcaaaugucu

SEQ ID NO: 1611085 - RNA, 20 nt, Human
ccuugaaaacuuuaugcuaa

SEQ ID NO: 1611086 - RNA, 19 nt, Human
ccuugaacuuugaccucug

SEQ ID NO: 1611087 - RNA, 17 nt, Human
ccuugaaugaugccaug

SEQ ID NO: 1611088 - RNA, 16 nt, Human
ccuugaacuggguacu

SEQ ID NO: 1611089 - RNA, 17 nt, Human
ccuugaacuuugaccuc

SEQ ID NO: 1611090 - RNA, 14 nt, Human
ccuugaacugggua

SEQ ID NO: 1611091 - RNA, 22 nt, Human
ccuugaaaacacuguucucugc

SEQ ID NO: 1611092 - RNA, 21 nt, Human
ccuugaaaacacuguucucug

SEQ ID NO: 1611093 - RNA, 19 nt, Human
ccuugaaaacacuguucuc

SEQ ID NO: 1611094 - RNA, 18 nt, Human
ccuucgcuccugugucuu

SEQ ID NO: 1611095 - RNA, 15 nt, Human
ccuucgcuccugugu

SEQ ID NO: 1611096 - RNA, 14 nt, Human
ccuucgcuccugug

SEQ ID NO: 1611097 - RNA, 13 nt, Human
ccuucgcuccugu

SEQ ID NO: 1611098 - RNA, 15 nt, Human
ccuugaaaacacugu

SEQ ID NO: 1611099 - RNA, 16 nt, Human
ccuucuuuuucuucuu

SEQ ID NO: 1611100 - RNA, 14 nt, Human
ccuucuuuuucuuc

SEQ ID NO: 1611101 - RNA, 14 nt, Human
ccuugaugaagaag

SEQ ID NO: 1611102 - RNA, 23 nt, Human
ccuugaguugauucagcucugca

SEQ ID NO: 1611103 - RNA, 22 nt, Human
ccuugaguugauucagcucugc

SEQ ID NO: 1611104 - RNA, 21 nt, Human
ccuugaccauucuccaccugc

SEQ ID NO: 1611105 - RNA, 22 nt, Human
ccuugaccauucuccaccugcc

SEQ ID NO: 1611106 - RNA, 20 nt, Human
ccuugaccauucuccaccug

SEQ ID NO: 1611107 - RNA, 19 nt, Human
ccuugaccauucuccaccu

SEQ ID NO: 1611108 - RNA, 17 nt, Human
ccuugacagggcacacc

SEQ ID NO: 1611109 - RNA, 15 nt, Human
ccuugacagggcaca

SEQ ID NO: 1611110 - RNA, 14 nt, Human
ccuugacagggcac

SEQ ID NO: 1611111 - RNA, 13 nt, Human
ccuugacagggca

SEQ ID NO: 1611112 - RNA, 11 nt, Human
ccuuuggcuuc

SEQ ID NO: 1611113 - RNA, 19 nt, Human
ccuucagugccuuauggaa

SEQ ID NO: 1611114 - RNA, 17 nt, Human
ccuuagacagucccugc

SEQ ID NO: 1611115 - RNA, 16 nt, Human
ccuuagacagucccug

SEQ ID NO: 1611116 - RNA, 18 nt, Human
ccuuagaaccuuucuuac

SEQ ID NO: 1611117 - RNA, 16 nt, Human
ccuuagaaccuuucuu

SEQ ID NO: 1611118 - RNA, 15 nt, Human
ccuuagaaccuuucu

SEQ ID NO: 1611119 - RNA, 14 nt, Human
ccuuagaaccuuuc

SEQ ID NO: 1611120 - RNA, 19 nt, Human
ccuuagacagucccugcca

SEQ ID NO: 1611121 - RNA, 18 nt, Human
ccuuagacagucccugcc

SEQ ID NO: 1611122 - RNA, 21 nt, Human
ccuuagacagucccugccaau

SEQ ID NO: 1611123 - RNA, 14 nt, Human
ccuucaaccauucc

SEQ ID NO: 1611124 - RNA, 19 nt, Human
ccuucaaagcaaaugucuu

SEQ ID NO: 1611125 - RNA, 15 nt, Human
ccuucaaagcaaaug

SEQ ID NO: 1611126 - RNA, 14 nt, Human
ccuuaccugccagg

SEQ ID NO: 1611127 - RNA, 20 nt, Human
ccuuaccucggugccuuccu

SEQ ID NO: 1611128 - RNA, 16 nt, Human
ccuuaccagcagagca

SEQ ID NO: 1611129 - RNA, 15 nt, Human
ccuuaccagcagagc

SEQ ID NO: 1611130 - RNA, 17 nt, Human
ccuuaccagcagagcac

SEQ ID NO: 1611131 - RNA, 14 nt, Human
ccuuaccagcagag

SEQ ID NO: 1611132 - RNA, 14 nt, Human
ccuuccucuuucca

SEQ ID NO: 1611133 - RNA, 13 nt, Human
ccuucgccaccug

SEQ ID NO: 1611134 - RNA, 23 nt, Human
ccuucgauacaccgggccuggag

SEQ ID NO: 1611135 - RNA, 22 nt, Human
ccuucgauacaccgggccugga

SEQ ID NO: 1611136 - RNA, 20 nt, Human
ccuucgauacaccgggccug

SEQ ID NO: 1611137 - RNA, 22 nt, Human
ccuuccaggggugggacacccu

SEQ ID NO: 1611138 - RNA, 18 nt, Human
ccuuccaggggugggaca

SEQ ID NO: 1611139 - RNA, 23 nt, Human
ccuuccaugucgccucugcauuc

SEQ ID NO: 1611140 - RNA, 21 nt, Human
ccuuccaugucgccucugcau

SEQ ID NO: 1611141 - RNA, 20 nt, Human
ccuuccaugucgccucugca

SEQ ID NO: 1611142 - RNA, 19 nt, Human
ccuuccaugucgccucugc

SEQ ID NO: 1611143 - RNA, 16 nt, Human
ccuuccagggguggga

SEQ ID NO: 1611144 - RNA, 15 nt, Human
ccuuccagggguggg

SEQ ID NO: 1611145 - RNA, 14 nt, Human
ccuucagugccuua

SEQ ID NO: 1611146 - RNA, 13 nt, Human
ccuucagugccuu

SEQ ID NO: 1611147 - RNA, 10 nt, Human
ccuucagugc

SEQ ID NO: 1611148 - RNA, 15 nt, Human
ccuucagugccuuau

SEQ ID NO: 1611149 - RNA, 20 nt, Human
ccuucagugccuuauggaac

SEQ ID NO: 1611150 - RNA, 20 nt, Human
ccugggcagcugccuccccu

SEQ ID NO: 1611151 - RNA, 15 nt, Human
ccuggugcugccaca

SEQ ID NO: 1611152 - RNA, 21 nt, Human
ccuggugcugccacacuucag

SEQ ID NO: 1611153 - RNA, 18 nt, Human
ccuggugcugccacacuu

SEQ ID NO: 1611154 - RNA, 13 nt, Human
ccugguggcagcu

SEQ ID NO: 1611155 - RNA, 12 nt, Human
ccugguggcagc

SEQ ID NO: 1611156 - RNA, 20 nt, Human
ccuguaauccuagcacuuug

SEQ ID NO: 1611157 - RNA, 18 nt, Human
ccugguggcagcucaccu

SEQ ID NO: 1611158 - RNA, 17 nt, Human
ccugguggcagcucacc

SEQ ID NO: 1611159 - RNA, 16 nt, Human
ccugguggcagcucac

SEQ ID NO: 1611160 - RNA, 14 nt, Human
ccugguggcagcuc

SEQ ID NO: 1611161 - RNA, 23 nt, Human
ccuguagagugggagcugagugg

SEQ ID NO: 1611162 - RNA, 21 nt, Human
ccuguagagugggagcugagu

SEQ ID NO: 1611163 - RNA, 22 nt, Human
ccugggcagcugccuccccucc

SEQ ID NO: 1611164 - RNA, 19 nt, Human
ccugugauggggcccugcc

SEQ ID NO: 1611165 - RNA, 18 nt, Human
ccugugauggggcccugc

SEQ ID NO: 1611166 - RNA, 17 nt, Human
ccugugauggggcccug

SEQ ID NO: 1611167 - RNA, 21 nt, Human
ccugugauggggcccugccuc

SEQ ID NO: 1611168 - RNA, 20 nt, Human
ccugugauggggcccugccu

SEQ ID NO: 1611169 - RNA, 22 nt, Human
ccugugauggggcccugccucc

SEQ ID NO: 1611170 - RNA, 17 nt, Human
ccugugccucugggacu

SEQ ID NO: 1611171 - RNA, 15 nt, Human
ccugugccucuggga

SEQ ID NO: 1611172 - RNA, 19 nt, Human
ccugugccucugggacugg

SEQ ID NO: 1611173 - RNA, 18 nt, Human
ccuguccccgcacugggc

SEQ ID NO: 1611174 - RNA, 17 nt, Human
ccugucccccugacaac

SEQ ID NO: 1611175 - RNA, 20 nt, Human
ccugugaguacuacaguccu

SEQ ID NO: 1611176 - RNA, 22 nt, Human
ccugugagcuaggaauuguguu

SEQ ID NO: 1611177 - RNA, 15 nt, Human
ccugggcagcugccu

SEQ ID NO: 1611178 - RNA, 16 nt, Human
ccugggcagcugccuc

SEQ ID NO: 1611179 - RNA, 17 nt, Human
ccugggcagcugccucc

SEQ ID NO: 1611180 - RNA, 18 nt, Human
ccugggcagcugccuccc

SEQ ID NO: 1611181 - RNA, 15 nt, Human
ccugggcagaaggaa

SEQ ID NO: 1611182 - RNA, 14 nt, Human
ccugggcagaagga

SEQ ID NO: 1611183 - RNA, 12 nt, Human
ccugggcagaag

SEQ ID NO: 1611184 - RNA, 20 nt, Human
ccugggaucccucauccuca

SEQ ID NO: 1611185 - RNA, 16 nt, Human
ccugggaucccucauc

SEQ ID NO: 1611186 - RNA, 20 nt, Human
ccugggaggucaaggcugca

SEQ ID NO: 1611187 - RNA, 21 nt, Human
ccugggaggcucuggagccca

SEQ ID NO: 1611188 - RNA, 13 nt, Human
ccugggaggcucu

SEQ ID NO: 1611189 - RNA, 13 nt, Human
ccugggaggcagu

SEQ ID NO: 1611190 - RNA, 23 nt, Human
ccuggcaugggaaugaaugucag

SEQ ID NO: 1611191 - RNA, 18 nt, Human
ccuggcaugggaaugaau

SEQ ID NO: 1611192 - RNA, 16 nt, Human
ccuggccccucagggu

SEQ ID NO: 1611193 - RNA, 14 nt, Human
ccuggccccucagg

SEQ ID NO: 1611194 - RNA, 12 nt, Human
ccuggcggggug

SEQ ID NO: 1611195 - RNA, 17 nt, Human
ccuggcaugggaaugaa

SEQ ID NO: 1611196 - RNA, 16 nt, Human
ccuggcaugggaauga

SEQ ID NO: 1611197 - RNA, 19 nt, Human
ccuggcagccgugccuuca

SEQ ID NO: 1611198 - RNA, 18 nt, Human
ccuggcagccgugccuuc

SEQ ID NO: 1611199 - RNA, 12 nt, Human
ccuggcagccgu

SEQ ID NO: 1611200 - RNA, 21 nt, Human
ccuggcacugcuuccagugag

SEQ ID NO: 1611201 - RNA, 16 nt, Human
ccuggcagccccuguu

SEQ ID NO: 1611202 - RNA, 20 nt, Human
ccuggcacugcuuccaguga

SEQ ID NO: 1611203 - RNA, 14 nt, Human
ccuggacccugugg

SEQ ID NO: 1611204 - RNA, 13 nt, Human
ccuggacccugug

SEQ ID NO: 1611205 - RNA, 20 nt, Human
ccuggacugugugcucagga

SEQ ID NO: 1611206 - RNA, 17 nt, Human
ccuggacugugugcuca

SEQ ID NO: 1611207 - RNA, 14 nt, Human
ccuggacuccugca

SEQ ID NO: 1611208 - RNA, 22 nt, Human
ccugcuccagcuguucagcugg

SEQ ID NO: 1611209 - RNA, 14 nt, Human
ccugcuccagcugu

SEQ ID NO: 1611210 - RNA, 13 nt, Human
ccugcuccagcug

SEQ ID NO: 1611211 - RNA, 12 nt, Human
ccugcuccagcu

SEQ ID NO: 1611212 - RNA, 17 nt, Human
ccugcuaauuccccaga

SEQ ID NO: 1611213 - RNA, 23 nt, Human
ccugcgucucauacucaccucac

SEQ ID NO: 1611214 - RNA, 16 nt, Human
ccugcaaccugauugu

SEQ ID NO: 1611215 - RNA, 19 nt, Human
ccugcaacaccuuguuucc

SEQ ID NO: 1611216 - RNA, 18 nt, Human
ccugcaacaccuuguuuc

SEQ ID NO: 1611217 - RNA, 19 nt, Human
ccugcugguucaggguugg

SEQ ID NO: 1611218 - RNA, 13 nt, Human
ccugcugguucag

SEQ ID NO: 1611219 - RNA, 20 nt, Human
ccugcuuuuuauggccugug

SEQ ID NO: 1611220 - RNA, 19 nt, Human
ccugcuuugggcugcccug

SEQ ID NO: 1611221 - RNA, 18 nt, Human
ccugcuuugggcugcccu

SEQ ID NO: 1611222 - RNA, 17 nt, Human
ccugcuuugggcugccc

SEQ ID NO: 1611223 - RNA, 21 nt, Human
ccugcuuucagauacuggauu

SEQ ID NO: 1611224 - RNA, 16 nt, Human
ccugcuuucagauacu

SEQ ID NO: 1611225 - RNA, 15 nt, Human
ccugcuuucagauac

SEQ ID NO: 1611226 - RNA, 21 nt, Human
ccuggcagccgugccuucagc

SEQ ID NO: 1611227 - RNA, 23 nt, Human
ccugaaagaggaaugaaguacuc

SEQ ID NO: 1611228 - RNA, 18 nt, Human
ccugaaagaggaaugaag

SEQ ID NO: 1611229 - RNA, 22 nt, Human
ccucuuuggucuacacugugcu

SEQ ID NO: 1611230 - RNA, 19 nt, Human
ccucuuccucccucauucc

SEQ ID NO: 1611231 - RNA, 16 nt, Human
ccucuuccucccucau

SEQ ID NO: 1611232 - RNA, 15 nt, Human
ccucuuccucccuca

SEQ ID NO: 1611233 - RNA, 17 nt, Human
ccucuuaugggcugggu

SEQ ID NO: 1611234 - RNA, 20 nt, Human
ccugaagcuaucguaaaauu

SEQ ID NO: 1611235 - RNA, 21 nt, Human
ccugaagacucauucuucugu

SEQ ID NO: 1611236 - RNA, 23 nt, Human
ccugaagcuaucguaaaauuaag

SEQ ID NO: 1611237 - RNA, 22 nt, Human
ccugaagcuaucguaaaauuaa

SEQ ID NO: 1611238 - RNA, 20 nt, Human
ccugaacaggauauucucac

SEQ ID NO: 1611239 - RNA, 17 nt, Human
ccugaagucacacagug

SEQ ID NO: 1611240 - RNA, 16 nt, Human
ccugaagucacacagu

SEQ ID NO: 1611241 - RNA, 15 nt, Human
ccugaagucacacag

SEQ ID NO: 1611242 - RNA, 13 nt, Human
ccugaaggccccg

SEQ ID NO: 1611243 - RNA, 19 nt, Human
ccugaagucacacagugag

SEQ ID NO: 1611244 - RNA, 14 nt, Human
ccugaaggccccgc

SEQ ID NO: 1611245 - RNA, 23 nt, Human
ccucuuagaugcaguucugaaga

SEQ ID NO: 1611246 - RNA, 14 nt, Human
ccucuuaugggcug

SEQ ID NO: 1611247 - RNA, 16 nt, Human
ccucuuaugggcuggg

SEQ ID NO: 1611248 - RNA, 15 nt, Human
ccucuuaugggcugg

SEQ ID NO: 1611249 - RNA, 14 nt, Human
ccucuuagaaaaac

SEQ ID NO: 1611250 - RNA, 21 nt, Human
ccucuguucugcacacagcac

SEQ ID NO: 1611251 - RNA, 23 nt, Human
ccucuguacagagcccacgcccc

SEQ ID NO: 1611252 - RNA, 18 nt, Human
ccucuguacagagcccac

SEQ ID NO: 1611253 - RNA, 17 nt, Human
ccucuguacagagccca

SEQ ID NO: 1611254 - RNA, 16 nt, Human
ccucuguacagagccc

SEQ ID NO: 1611255 - RNA, 15 nt, Human
ccucuguacagagcc

SEQ ID NO: 1611256 - RNA, 14 nt, Human
ccucuguacagagc

SEQ ID NO: 1611257 - RNA, 17 nt, Human
ccucuguccaggcacug

SEQ ID NO: 1611258 - RNA, 20 nt, Human
ccugaggcuccacuuggucu

SEQ ID NO: 1611259 - RNA, 18 nt, Human
ccugaggcuccacuuggu

SEQ ID NO: 1611260 - RNA, 14 nt, Human
ccugaugcuucuuc

SEQ ID NO: 1611261 - RNA, 23 nt, Human
ccugauugugucucuugguccug

SEQ ID NO: 1611262 - RNA, 13 nt, Human
ccugauuaaagaa

SEQ ID NO: 1611263 - RNA, 12 nt, Human
ccugauuaaaga

SEQ ID NO: 1611264 - RNA, 18 nt, Human
ccugaugcuucuucagag

SEQ ID NO: 1611265 - RNA, 17 nt, Human
ccugaugcuucuucaga

SEQ ID NO: 1611266 - RNA, 20 nt, Human
ccugaggcccuucucuccag

SEQ ID NO: 1611267 - RNA, 19 nt, Human
ccugaggcccuucucucca

SEQ ID NO: 1611268 - RNA, 17 nt, Human
ccugaggcccuucucuc

SEQ ID NO: 1611269 - RNA, 16 nt, Human
ccugaggcccuucucu

SEQ ID NO: 1611270 - RNA, 22 nt, Human
ccugaggcccuucucuccagcc

SEQ ID NO: 1611271 - RNA, 21 nt, Human
ccugaggcccuucucuccagc

SEQ ID NO: 1611272 - RNA, 23 nt, Human
ccugaggcccuucucuccagccc

SEQ ID NO: 1611273 - RNA, 16 nt, Human
ccugacaacacucauu

SEQ ID NO: 1611274 - RNA, 15 nt, Human
ccugacaacacucau

SEQ ID NO: 1611275 - RNA, 14 nt, Human
ccugacaacacuca

SEQ ID NO: 1611276 - RNA, 12 nt, Human
ccugacaacacu

SEQ ID NO: 1611277 - RNA, 14 nt, Human
ccugaggcccagag

SEQ ID NO: 1611278 - RNA, 13 nt, Human
ccugaggcccaga

SEQ ID NO: 1611279 - RNA, 12 nt, Human
ccugaggcccag

SEQ ID NO: 1611280 - RNA, 23 nt, Human
ccugacaacacucauugaccuga

SEQ ID NO: 1611281 - RNA, 15 nt, Human
ccuccccuccucugc

SEQ ID NO: 1611282 - RNA, 14 nt, Human
ccucagucucccuc

SEQ ID NO: 1611283 - RNA, 19 nt, Human
ccucagucuggcccuuccu

SEQ ID NO: 1611284 - RNA, 15 nt, Human
ccucagucuggcccu

SEQ ID NO: 1611285 - RNA, 15 nt, Human
ccucagggucccugg

SEQ ID NO: 1611286 - RNA, 21 nt, Human
ccucagguaaucgaccugccu

SEQ ID NO: 1611287 - RNA, 16 nt, Human
ccucaggugagaagca

SEQ ID NO: 1611288 - RNA, 23 nt, Human
ccucagguaaucgaccugccucg

SEQ ID NO: 1611289 - RNA, 22 nt, Human
ccucagguaaucgaccugccuc

SEQ ID NO: 1611290 - RNA, 19 nt, Human
ccucaggugauccacccac

SEQ ID NO: 1611291 - RNA, 17 nt, Human
ccucaggugauccaccc

SEQ ID NO: 1611292 - RNA, 22 nt, Human
ccucaggugauccacccaccuc

SEQ ID NO: 1611293 - RNA, 20 nt, Human
ccucagaaaacaaggaugaa

SEQ ID NO: 1611294 - RNA, 21 nt, Human
ccucacuaucccggcugcccu

SEQ ID NO: 1611295 - RNA, 21 nt, Human
ccucacuaggcuucugguuga

SEQ ID NO: 1611296 - RNA, 22 nt, Human
ccucacuaucccggcugcccuu

SEQ ID NO: 1611297 - RNA, 17 nt, Human
ccucagcauccuggcac

SEQ ID NO: 1611298 - RNA, 16 nt, Human
ccucagcauccuggca

SEQ ID NO: 1611299 - RNA, 14 nt, Human
ccucagggucccug

SEQ ID NO: 1611300 - RNA, 23 nt, Human
ccucaggccugggggcugggcag

SEQ ID NO: 1611301 - RNA, 21 nt, Human
ccucaggccugggggcugggc

SEQ ID NO: 1611302 - RNA, 14 nt, Human
ccucaggccugggg

SEQ ID NO: 1611303 - RNA, 11 nt, Human
ccucaggccug

SEQ ID NO: 1611304 - RNA, 12 nt, Human
ccucccugcaau

SEQ ID NO: 1611305 - RNA, 16 nt, Human
ccucccugcaauaaaa

SEQ ID NO: 1611306 - RNA, 16 nt, Human
ccucccucccucuuuc

SEQ ID NO: 1611307 - RNA, 13 nt, Human
ccucccugccccu

SEQ ID NO: 1611308 - RNA, 17 nt, Human
ccuccccuccucugcuu

SEQ ID NO: 1611309 - RNA, 18 nt, Human
ccuccccuccucugcuug

SEQ ID NO: 1611310 - RNA, 13 nt, Human
ccucccggugccc

SEQ ID NO: 1611311 - RNA, 15 nt, Human
ccucccucccucuuu

SEQ ID NO: 1611312 - RNA, 13 nt, Human
ccucccucccucu

SEQ ID NO: 1611313 - RNA, 16 nt, Human
ccucccggugcccaag

SEQ ID NO: 1611314 - RNA, 11 nt, Human
ccuccucugcu

SEQ ID NO: 1611315 - RNA, 13 nt, Human
ccuccugccucga

SEQ ID NO: 1611316 - RNA, 14 nt, Human
ccuccuccuggacu

SEQ ID NO: 1611317 - RNA, 22 nt, Human
ccuccugugugugcgccuacag

SEQ ID NO: 1611318 - RNA, 15 nt, Human
ccuccugugugugcg

SEQ ID NO: 1611319 - RNA, 13 nt, Human
ccuccugugugug

SEQ ID NO: 1611320 - RNA, 13 nt, Human
ccuccugggcuaa

SEQ ID NO: 1611321 - RNA, 17 nt, Human
ccuccugggaaugaagc

SEQ ID NO: 1611322 - RNA, 13 nt, Human
ccuccuggacucc

SEQ ID NO: 1611323 - RNA, 14 nt, Human
ccucuccugggcag

SEQ ID NO: 1611324 - RNA, 13 nt, Human
ccucucugcccua

SEQ ID NO: 1611325 - RNA, 11 nt, Human
ccucuccuggg

SEQ ID NO: 1611326 - RNA, 12 nt, Human
ccucuccugggc

SEQ ID NO: 1611327 - RNA, 13 nt, Human
ccucuccugggca

SEQ ID NO: 1611328 - RNA, 16 nt, Human
ccucugacacacagcu

SEQ ID NO: 1611329 - RNA, 23 nt, Human
ccucugaaaaccaauguucucuc

SEQ ID NO: 1611330 - RNA, 12 nt, Human
ccucucccauca

SEQ ID NO: 1611331 - RNA, 19 nt, Human
ccucuccacugccuucgau

SEQ ID NO: 1611332 - RNA, 16 nt, Human
ccucuccacugccuuc

SEQ ID NO: 1611333 - RNA, 14 nt, Human
ccucuccacugccu

SEQ ID NO: 1611334 - RNA, 13 nt, Human
ccucuccacugcc

SEQ ID NO: 1611335 - RNA, 12 nt, Human
ccucuccacugc

SEQ ID NO: 1611336 - RNA, 23 nt, Human
ccuccugugugugcgccuacagg

SEQ ID NO: 1611337 - RNA, 20 nt, Human
ccuccuuaucaaaggacacc

SEQ ID NO: 1611338 - RNA, 18 nt, Human
ccuccuuaucaaaggaca

SEQ ID NO: 1611339 - RNA, 20 nt, Human
ccucugcuugccaucccucc

SEQ ID NO: 1611340 - RNA, 21 nt, Human
ccucugcuugccaucccuccc

SEQ ID NO: 1611341 - RNA, 12 nt, Human
ccucugggacug

SEQ ID NO: 1611342 - RNA, 17 nt, Human
ccucuggcuccagcugg

SEQ ID NO: 1611343 - RNA, 16 nt, Human
ccucuggcuccagcug

SEQ ID NO: 1611344 - RNA, 15 nt, Human
ccucugcacaagcug

SEQ ID NO: 1611345 - RNA, 11 nt, Human
ccucugcacaa

SEQ ID NO: 1611346 - RNA, 18 nt, Human
ccucugacacacagcucu

SEQ ID NO: 1611347 - RNA, 17 nt, Human
ccucugacacacagcuc

SEQ ID NO: 1611348 - RNA, 19 nt, Human
ccucugcacaagcugcacc

SEQ ID NO: 1611349 - RNA, 17 nt, Human
ccucugcacaagcugca

SEQ ID NO: 1611350 - RNA, 20 nt, Human
ccucugcacaagcugcaccc

SEQ ID NO: 1611351 - RNA, 21 nt, Human
ccucugcacuccccugcuggg

SEQ ID NO: 1611352 - RNA, 20 nt, Human
ccucugcacuccccugcugg

SEQ ID NO: 1611353 - RNA, 15 nt, Human
ccucugcacuccccu

SEQ ID NO: 1611354 - RNA, 14 nt, Human
ccucugcacucccc

SEQ ID NO: 1611355 - RNA, 22 nt, Human
ccucugcacuccccugcugggu

SEQ ID NO: 1611356 - RNA, 16 nt, Human
cccuugaugaagaagu

SEQ ID NO: 1611357 - RNA, 20 nt, Human
cccuuccucuccacugccuu

SEQ ID NO: 1611358 - RNA, 21 nt, Human
cccuuccucuccacugccuuc

SEQ ID NO: 1611359 - RNA, 17 nt, Human
cccuuccucuccacugc

SEQ ID NO: 1611360 - RNA, 16 nt, Human
cccuuccucuccacug

SEQ ID NO: 1611361 - RNA, 19 nt, Human
cccuuaccucggugccuuc

SEQ ID NO: 1611362 - RNA, 21 nt, Human
cccuuaccacugcucugauga

SEQ ID NO: 1611363 - RNA, 17 nt, Human
cccuuaccacugcucug

SEQ ID NO: 1611364 - RNA, 13 nt, Human
cccuuccucucca

SEQ ID NO: 1611365 - RNA, 18 nt, Human
cccuugccgucuaccuga

SEQ ID NO: 1611366 - RNA, 17 nt, Human
cccuugccgucuaccug

SEQ ID NO: 1611367 - RNA, 22 nt, Human
cccuugccgucuaccugagggg

SEQ ID NO: 1611368 - RNA, 20 nt, Human
cccuuugacgccaucccagc

SEQ ID NO: 1611369 - RNA, 22 nt, Human
cccuuucugggcaccggggccu

SEQ ID NO: 1611370 - RNA, 16 nt, Human
cccuuguggucccacc

SEQ ID NO: 1611371 - RNA, 14 nt, Human
cccuugugguccca

SEQ ID NO: 1611372 - RNA, 18 nt, Human
cccuuggggagcaggcuc

SEQ ID NO: 1611373 - RNA, 18 nt, Human
cccuuguggucccacccc

SEQ ID NO: 1611374 - RNA, 20 nt, Human
cccuuguggucccaccccac

SEQ ID NO: 1611375 - RNA, 18 nt, Human
ccgagaucacgccacugc

SEQ ID NO: 1611376 - RNA, 22 nt, Human
ccgagucucuucuccacuggau

SEQ ID NO: 1611377 - RNA, 13 nt, Human
cccuuuucuguuu

SEQ ID NO: 1611378 - RNA, 11 nt, Human
cccuuuuccuu

SEQ ID NO: 1611379 - RNA, 18 nt, Human
cccuuuuuuggcugcuga

SEQ ID NO: 1611380 - RNA, 17 nt, Human
cccuuuuuuggcugcug

SEQ ID NO: 1611381 - RNA, 22 nt, Human
ccgagauagccaaggccaaagg

SEQ ID NO: 1611382 - RNA, 19 nt, Human
ccgagauagccaaggccaa

SEQ ID NO: 1611383 - RNA, 17 nt, Human
ccgagaaggaagccucc

SEQ ID NO: 1611384 - RNA, 19 nt, Human
cccuuuuuuggcugcugaa

SEQ ID NO: 1611385 - RNA, 23 nt, Human
cccccaaccaaguggcucccaca

SEQ ID NO: 1611386 - RNA, 22 nt, Human
ccccaggaggccagccuugacc

SEQ ID NO: 1611387 - RNA, 21 nt, Human
ccccaggaggccagccuugac

SEQ ID NO: 1611388 - RNA, 15 nt, Human
ccccaggaggccagc

SEQ ID NO: 1611389 - RNA, 14 nt, Human
ccccaggaggccag

SEQ ID NO: 1611390 - RNA, 13 nt, Human
ccccaggaggcca

SEQ ID NO: 1611391 - RNA, 14 nt, Human
ccccacuggugaca

SEQ ID NO: 1611392 - RNA, 13 nt, Human
ccccacuggugac

SEQ ID NO: 1611393 - RNA, 12 nt, Human
ccccacugguga

SEQ ID NO: 1611394 - RNA, 21 nt, Human
cccccgcugucagccauuccu

SEQ ID NO: 1611395 - RNA, 16 nt, Human
cccccucugcccugcg

SEQ ID NO: 1611396 - RNA, 14 nt, Human
cccccucugcccug

SEQ ID NO: 1611397 - RNA, 13 nt, Human
cccccucugcccu

SEQ ID NO: 1611398 - RNA, 21 nt, Human
ccccgucucugguuccucccc

SEQ ID NO: 1611399 - RNA, 20 nt, Human
ccccgucccccucuggcucc

SEQ ID NO: 1611400 - RNA, 16 nt, Human
ccccgucccccucugg

SEQ ID NO: 1611401 - RNA, 12 nt, Human
cccccagcccca

SEQ ID NO: 1611402 - RNA, 16 nt, Human
cccccaucucuucugg

SEQ ID NO: 1611403 - RNA, 16 nt, Human
cccuguuuguuucuga

SEQ ID NO: 1611404 - RNA, 15 nt, Human
cccuguuuguuucug

SEQ ID NO: 1611405 - RNA, 18 nt, Human
cccugugggcccccaaau

SEQ ID NO: 1611406 - RNA, 16 nt, Human
cccugugggcccccaa

SEQ ID NO: 1611407 - RNA, 21 nt, Human
cccuguagagugggagcugag

SEQ ID NO: 1611408 - RNA, 23 nt, Human
cccugguuuccugcccugggagg

SEQ ID NO: 1611409 - RNA, 22 nt, Human
cccugguuuccugcccugggag

SEQ ID NO: 1611410 - RNA, 19 nt, Human
cccugguggcagugggagc

SEQ ID NO: 1611411 - RNA, 16 nt, Human
cccugguggcaguggg

SEQ ID NO: 1611412 - RNA, 21 nt, Human
cccugguggcagugggagcug

SEQ ID NO: 1611413 - RNA, 21 nt, Human
cccugguuuccugcccuggga

SEQ ID NO: 1611414 - RNA, 20 nt, Human
ccccucagggucccuggugg

SEQ ID NO: 1611415 - RNA, 18 nt, Human
ccccucagggucccuggu

SEQ ID NO: 1611416 - RNA, 17 nt, Human
ccccucagggucccugg

SEQ ID NO: 1611417 - RNA, 17 nt, Human
ccucaccuuucccaucu

SEQ ID NO: 1611418 - RNA, 22 nt, Human
ccucacaguccuuaccagcaga

SEQ ID NO: 1611419 - RNA, 20 nt, Human
ccucacaguccuuaccagca

SEQ ID NO: 1611420 - RNA, 12 nt, Human
ccucaccccacu

SEQ ID NO: 1611421 - RNA, 21 nt, Human
ccucacccacccuuuuuuaaa

SEQ ID NO: 1611422 - RNA, 15 nt, Human
ccucaccccacugug

SEQ ID NO: 1611423 - RNA, 17 nt, Human
ccucacaguccuuacca

SEQ ID NO: 1611424 - RNA, 17 nt, Human
ccuaucagaaguuucuc

SEQ ID NO: 1611425 - RNA, 15 nt, Human
ccgggcacucagaag

SEQ ID NO: 1611426 - RNA, 15 nt, Human
ccggcuggccuggcc

SEQ ID NO: 1611427 - RNA, 13 nt, Human
ccggcuggccugg

SEQ ID NO: 1611428 - RNA, 12 nt, Human
ccggcuggccug

SEQ ID NO: 1611429 - RNA, 12 nt, Human
ccggcugcccuu

SEQ ID NO: 1611430 - RNA, 20 nt, Human
ccgggcacucagaagacacu

SEQ ID NO: 1611431 - RNA, 19 nt, Human
ccgggccuggagaacuaga

SEQ ID NO: 1611432 - RNA, 15 nt, Human
ccgugccuucagcuc

SEQ ID NO: 1611433 - RNA, 14 nt, Human
ccgugccuucagcu

SEQ ID NO: 1611434 - RNA, 17 nt, Human
ccgugccuucagcucua

SEQ ID NO: 1611435 - RNA, 16 nt, Human
ccgugccuucagcucu

SEQ ID NO: 1611436 - RNA, 14 nt, Human
ccgugcuaaggacu

SEQ ID NO: 1611437 - RNA, 13 nt, Human
ccgugcuaaggac

SEQ ID NO: 1611438 - RNA, 23 nt, Human
ccguggcuucccgcucagcccuc

SEQ ID NO: 1611439 - RNA, 21 nt, Human
ccguggcuucccgcucagccc

SEQ ID NO: 1611440 - RNA, 15 nt, Human
ccguggcuucccgcu

SEQ ID NO: 1611441 - RNA, 14 nt, Human
ccuaaaguguauuu

SEQ ID NO: 1611442 - RNA, 12 nt, Human
ccuaaagagaua

SEQ ID NO: 1611443 - RNA, 17 nt, Human
ccuaauuccacagcugc

SEQ ID NO: 1611444 - RNA, 16 nt, Human
ccuaauuccacagcug

SEQ ID NO: 1611445 - RNA, 15 nt, Human
ccuaauuccacagcu

SEQ ID NO: 1611446 - RNA, 14 nt, Human
ccuaauuccacagc

SEQ ID NO: 1611447 - RNA, 12 nt, Human
ccuaccugguaa

SEQ ID NO: 1611448 - RNA, 13 nt, Human
cugcacaaagccc

SEQ ID NO: 1611449 - RNA, 21 nt, Human
cugcacaaagcccuuccaugu

SEQ ID NO: 1611450 - RNA, 20 nt, Human
cugcacaaagcccuuccaug

SEQ ID NO: 1611451 - RNA, 18 nt, Human
cugcacaaagcccuucca

SEQ ID NO: 1611452 - RNA, 15 nt, Human
cugauucuucagcaa

SEQ ID NO: 1611453 - RNA, 16 nt, Human
cugcacaagcugcacc

SEQ ID NO: 1611454 - RNA, 15 nt, Human
cugcacaagcugcac

SEQ ID NO: 1611455 - RNA, 14 nt, Human
cugcacaagcugca

SEQ ID NO: 1611456 - RNA, 13 nt, Human
cugcacaagcugc

SEQ ID NO: 1611457 - RNA, 18 nt, Human
cugcacaagcugcacccu

SEQ ID NO: 1611458 - RNA, 18 nt, Human
cugcacagugcaucucag

SEQ ID NO: 1611459 - RNA, 18 nt, Human
cugcacccucaggcaggu

SEQ ID NO: 1611460 - RNA, 17 nt, Human
cugcacccucaggcagg

SEQ ID NO: 1611461 - RNA, 22 nt, Human
cugcacagugcaucucagccca

SEQ ID NO: 1611462 - RNA, 21 nt, Human
cugcacagugcaucucagccc

SEQ ID NO: 1611463 - RNA, 13 nt, Human
cugcagaagacag

SEQ ID NO: 1611464 - RNA, 23 nt, Human
cugcagaagacaguauggcagcu

SEQ ID NO: 1611465 - RNA, 20 nt, Human
cugcagagcaggaaacauga

SEQ ID NO: 1611466 - RNA, 20 nt, Human
cugcaccggcuggccuggcc

SEQ ID NO: 1611467 - RNA, 19 nt, Human
cugcaccggcuggccuggc

SEQ ID NO: 1611468 - RNA, 18 nt, Human
cugcaccggcuggccugg

SEQ ID NO: 1611469 - RNA, 17 nt, Human
cugcaccggcuggccug

SEQ ID NO: 1611470 - RNA, 17 nt, Human
cugcacuugcagacucu

SEQ ID NO: 1611471 - RNA, 16 nt, Human
cugcacuugcagacuc

SEQ ID NO: 1611472 - RNA, 14 nt, Human
cugcacuugcagac

SEQ ID NO: 1611473 - RNA, 11 nt, Human
cugcagccuca

SEQ ID NO: 1611474 - RNA, 20 nt, Human
cugcagccucaaccuccugg

SEQ ID NO: 1611475 - RNA, 19 nt, Human
cugcagccucaaccuccug

SEQ ID NO: 1611476 - RNA, 22 nt, Human
cugcagccucaaccuccugggc

SEQ ID NO: 1611477 - RNA, 22 nt, Human
cugcagggaguccgaaagggac

SEQ ID NO: 1611478 - RNA, 16 nt, Human
cugcagggccaagcac

SEQ ID NO: 1611479 - RNA, 17 nt, Human
cugcagggacugccagu

SEQ ID NO: 1611480 - RNA, 15 nt, Human
cugcagggacugcca

SEQ ID NO: 1611481 - RNA, 21 nt, Human
cugauguuccuagugaaagag

SEQ ID NO: 1611482 - RNA, 20 nt, Human
cugauguuccuagugaaaga

SEQ ID NO: 1611483 - RNA, 18 nt, Human
cugauguuccuagugaaa

SEQ ID NO: 1611484 - RNA, 13 nt, Human
cugauguuccuag

SEQ ID NO: 1611485 - RNA, 18 nt, Human
cugauucccaagcucugc

SEQ ID NO: 1611486 - RNA, 17 nt, Human
cugauucccaagcucug

SEQ ID NO: 1611487 - RNA, 15 nt, Human
cugauucccaagcuc

SEQ ID NO: 1611488 - RNA, 20 nt, Human
cugauucccaagcucugcuc

SEQ ID NO: 1611489 - RNA, 19 nt, Human
cugauucccaagcucugcu

SEQ ID NO: 1611490 - RNA, 22 nt, Human
cugauucccaagcucugcuccu

SEQ ID NO: 1611491 - RNA, 14 nt, Human
cugaucucucguga

SEQ ID NO: 1611492 - RNA, 21 nt, Human
cugauaaagaugagugagcau

SEQ ID NO: 1611493 - RNA, 20 nt, Human
cugauagaggaagccugauu

SEQ ID NO: 1611494 - RNA, 20 nt, Human
cugauccaguuuuguuugga

SEQ ID NO: 1611495 - RNA, 16 nt, Human
cugagucugaaggcug

SEQ ID NO: 1611496 - RNA, 15 nt, Human
cugagucugaaggcu

SEQ ID NO: 1611497 - RNA, 14 nt, Human
cugagucugaaggc

SEQ ID NO: 1611498 - RNA, 13 nt, Human
cugagucugaagg

SEQ ID NO: 1611499 - RNA, 17 nt, Human
cugagucugaaggcugg

SEQ ID NO: 1611500 - RNA, 14 nt, Human
cugagugccuuuug

SEQ ID NO: 1611501 - RNA, 13 nt, Human
cugauaaagauga

SEQ ID NO: 1611502 - RNA, 22 nt, Human
cugagugggggaucacagccuc

SEQ ID NO: 1611503 - RNA, 16 nt, Human
cugagugccuuuuggu

SEQ ID NO: 1611504 - RNA, 15 nt, Human
cugagugccuuuugg

SEQ ID NO: 1611505 - RNA, 12 nt, Human
cugacccacugc

SEQ ID NO: 1611506 - RNA, 15 nt, Human
cugccuaagugcagc

SEQ ID NO: 1611507 - RNA, 21 nt, Human
cugccuaaggacuucuuuaau

SEQ ID NO: 1611508 - RNA, 20 nt, Human
cugccuaaggacuucuuuaa

SEQ ID NO: 1611509 - RNA, 22 nt, Human
cugccuaaggacuucuuuaauu

SEQ ID NO: 1611510 - RNA, 17 nt, Human
cugcccugcccaccugg

SEQ ID NO: 1611511 - RNA, 11 nt, Human
cugcccuggga

SEQ ID NO: 1611512 - RNA, 13 nt, Human
cugcccugggagg

SEQ ID NO: 1611513 - RNA, 12 nt, Human
cugcccugggag

SEQ ID NO: 1611514 - RNA, 22 nt, Human
cugcccugggaggcagugaugg

SEQ ID NO: 1611515 - RNA, 15 nt, Human
cugcccugggaggca

SEQ ID NO: 1611516 - RNA, 13 nt, Human
cugccucagccuc

SEQ ID NO: 1611517 - RNA, 14 nt, Human
cugccucagccucc

SEQ ID NO: 1611518 - RNA, 15 nt, Human
cugccugcccaggcc

SEQ ID NO: 1611519 - RNA, 14 nt, Human
cugccugcccaggc

SEQ ID NO: 1611520 - RNA, 13 nt, Human
cugccugcccagg

SEQ ID NO: 1611521 - RNA, 14 nt, Human
cugccucuucucua

SEQ ID NO: 1611522 - RNA, 13 nt, Human
cugccucuucucu

SEQ ID NO: 1611523 - RNA, 12 nt, Human
cugccucuuccu

SEQ ID NO: 1611524 - RNA, 14 nt, Human
cugccucucugcag

SEQ ID NO: 1611525 - RNA, 13 nt, Human
cugccucucugca

SEQ ID NO: 1611526 - RNA, 12 nt, Human
cugccucucugc

SEQ ID NO: 1611527 - RNA, 18 nt, Human
cugcuccucuccccagca

SEQ ID NO: 1611528 - RNA, 17 nt, Human
cugcuccucuccccagc

SEQ ID NO: 1611529 - RNA, 16 nt, Human
cugcuccucuccccag

SEQ ID NO: 1611530 - RNA, 15 nt, Human
cugcuccagcuguuc

SEQ ID NO: 1611531 - RNA, 14 nt, Human
cugcuccagcuguu

SEQ ID NO: 1611532 - RNA, 16 nt, Human
cugcgguccacccagg

SEQ ID NO: 1611533 - RNA, 17 nt, Human
cugcgguccacccagga

SEQ ID NO: 1611534 - RNA, 21 nt, Human
cugcggaaugaaccacaucuu

SEQ ID NO: 1611535 - RNA, 15 nt, Human
cugcgguccacccag

SEQ ID NO: 1611536 - RNA, 20 nt, Human
cugcggaaugaaccacaucu

SEQ ID NO: 1611537 - RNA, 20 nt, Human
cugccacccuggggagaaag

SEQ ID NO: 1611538 - RNA, 16 nt, Human
cugccacccuggggag

SEQ ID NO: 1611539 - RNA, 15 nt, Human
cugccacccugggga

SEQ ID NO: 1611540 - RNA, 19 nt, Human
cugccaccacgcccggcua

SEQ ID NO: 1611541 - RNA, 22 nt, Human
cugccacacuucaggcucuucu

SEQ ID NO: 1611542 - RNA, 17 nt, Human
cugccacacuucaggcu

SEQ ID NO: 1611543 - RNA, 13 nt, Human
cugccacacuuca

SEQ ID NO: 1611544 - RNA, 19 nt, Human
cugccaggaagccagcagg

SEQ ID NO: 1611545 - RNA, 18 nt, Human
cugccaggaagccagcag

SEQ ID NO: 1611546 - RNA, 16 nt, Human
cugccaggaagccagc

SEQ ID NO: 1611547 - RNA, 15 nt, Human
cugccaggaagccag

SEQ ID NO: 1611548 - RNA, 19 nt, Human
cugccagccgagauagcca

SEQ ID NO: 1611549 - RNA, 19 nt, Human
cugccaugccagcuuaucu

SEQ ID NO: 1611550 - RNA, 17 nt, Human
cugccaugccagcuuau

SEQ ID NO: 1611551 - RNA, 16 nt, Human
cugccauuucugagau

SEQ ID NO: 1611552 - RNA, 17 nt, Human
cugcccaaccugcucuc

SEQ ID NO: 1611553 - RNA, 13 nt, Human
cugcccaggcccc

SEQ ID NO: 1611554 - RNA, 19 nt, Human
cugcccaaccugcucuccu

SEQ ID NO: 1611555 - RNA, 17 nt, Human
cugccccuggcagcccc

SEQ ID NO: 1611556 - RNA, 16 nt, Human
cugccccuggcagccc

SEQ ID NO: 1611557 - RNA, 15 nt, Human
cugccccuggcagcc

SEQ ID NO: 1611558 - RNA, 14 nt, Human
cugccccuggcagc

SEQ ID NO: 1611559 - RNA, 18 nt, Human
cugcccaggccugccugu

SEQ ID NO: 1611560 - RNA, 19 nt, Human
cugcccaggccugccuguu

SEQ ID NO: 1611561 - RNA, 15 nt, Human
cugcccggcugcgga

SEQ ID NO: 1611562 - RNA, 11 nt, Human
cugcccggcug

SEQ ID NO: 1611563 - RNA, 16 nt, Human
cugcccugcccaccug

SEQ ID NO: 1611564 - RNA, 15 nt, Human
cugcccugcccaccu

SEQ ID NO: 1611565 - RNA, 14 nt, Human
cugcccugcccacc

SEQ ID NO: 1611566 - RNA, 13 nt, Human
cugcccugcccac

SEQ ID NO: 1611567 - RNA, 21 nt, Human
cuggucccagccagcaguuca

SEQ ID NO: 1611568 - RNA, 18 nt, Human
cuggucccacucagucca

SEQ ID NO: 1611569 - RNA, 15 nt, Human
cuggucccacucagu

SEQ ID NO: 1611570 - RNA, 21 nt, Human
cugguccauagagagcaagac

SEQ ID NO: 1611571 - RNA, 18 nt, Human
cugguccauagagagcaa

SEQ ID NO: 1611572 - RNA, 17 nt, Human
cugguccauagagagca

SEQ ID NO: 1611573 - RNA, 15 nt, Human
cugguccauagagag

SEQ ID NO: 1611574 - RNA, 13 nt, Human
cuggguuggaggg

SEQ ID NO: 1611575 - RNA, 18 nt, Human
cuggguuggaaaacagua

SEQ ID NO: 1611576 - RNA, 13 nt, Human
cuggguuggaaaa

SEQ ID NO: 1611577 - RNA, 20 nt, Human
cugguggcccgacagccugg

SEQ ID NO: 1611578 - RNA, 23 nt, Human
cugguggcagugggagcugccug

SEQ ID NO: 1611579 - RNA, 19 nt, Human
cugggcucccuucccaccu

SEQ ID NO: 1611580 - RNA, 21 nt, Human
cugggcuuggggaccagagcu

SEQ ID NO: 1611581 - RNA, 20 nt, Human
cugggcuuggggaccagagc

SEQ ID NO: 1611582 - RNA, 17 nt, Human
cugggcuuggggaccag

SEQ ID NO: 1611583 - RNA, 13 nt, Human
cugggcuugggga

SEQ ID NO: 1611584 - RNA, 23 nt, Human
cugggcuucaguggcagcugcuu

SEQ ID NO: 1611585 - RNA, 22 nt, Human
cugggcuucaguggcagcugcu

SEQ ID NO: 1611586 - RNA, 21 nt, Human
cugggcuucaguggcagcugc

SEQ ID NO: 1611587 - RNA, 20 nt, Human
cugggcuucaguggcagcug

SEQ ID NO: 1611588 - RNA, 19 nt, Human
cugggcuucaguggcagcu

SEQ ID NO: 1611589 - RNA, 18 nt, Human
cugggcuucaguggcagc

SEQ ID NO: 1611590 - RNA, 19 nt, Human
cugggccccugccucucug

SEQ ID NO: 1611591 - RNA, 18 nt, Human
cugggggccucagugcca

SEQ ID NO: 1611592 - RNA, 17 nt, Human
cugggggccucagugcc

SEQ ID NO: 1611593 - RNA, 13 nt, Human
cugggggccucag

SEQ ID NO: 1611594 - RNA, 19 nt, Human
cugggguggggaccucagg

SEQ ID NO: 1611595 - RNA, 18 nt, Human
cugggguggggaccucag

SEQ ID NO: 1611596 - RNA, 17 nt, Human
cugggguggggaccuca

SEQ ID NO: 1611597 - RNA, 20 nt, Human
cuggguacuuguggacacag

SEQ ID NO: 1611598 - RNA, 23 nt, Human
cugggguggggaccucaggccug

SEQ ID NO: 1611599 - RNA, 22 nt, Human
cugggguggggaccucaggccu

SEQ ID NO: 1611600 - RNA, 21 nt, Human
cugggguggggaccucaggcc

SEQ ID NO: 1611601 - RNA, 23 nt, Human
cuggguacuuguggacacagcuc

SEQ ID NO: 1611602 - RNA, 21 nt, Human
cuggguacuuguggacacagc

SEQ ID NO: 1611603 - RNA, 22 nt, Human
cugggaacccaaguccaagcau

SEQ ID NO: 1611604 - RNA, 16 nt, Human
cugggagcuuuuguag

SEQ ID NO: 1611605 - RNA, 15 nt, Human
cugggagcucugcag

SEQ ID NO: 1611606 - RNA, 14 nt, Human
cugggagcucugca

SEQ ID NO: 1611607 - RNA, 13 nt, Human
cugggagcucugc

SEQ ID NO: 1611608 - RNA, 18 nt, Human
cugggaggucaaggcugc

SEQ ID NO: 1611609 - RNA, 16 nt, Human
cugggaggcucuggag

SEQ ID NO: 1611610 - RNA, 15 nt, Human
cugggaggcucugga

SEQ ID NO: 1611611 - RNA, 16 nt, Human
cugggaggcagugaug

SEQ ID NO: 1611612 - RNA, 13 nt, Human
cugggagugagcu

SEQ ID NO: 1611613 - RNA, 16 nt, Human
cugggagugagcuggu

SEQ ID NO: 1611614 - RNA, 20 nt, Human
cugggaucacauguggacuu

SEQ ID NO: 1611615 - RNA, 23 nt, Human
cugggauuacaggcuccugccac

SEQ ID NO: 1611616 - RNA, 22 nt, Human
cugggauuacaggcuccugcca

SEQ ID NO: 1611617 - RNA, 21 nt, Human
cugggauuacaggcuccugcc

SEQ ID NO: 1611618 - RNA, 21 nt, Human
cugggauuacaggcgugagcc

SEQ ID NO: 1611619 - RNA, 20 nt, Human
cugggauuacaggcuccugc

SEQ ID NO: 1611620 - RNA, 19 nt, Human
cugggauuacaggcuccug

SEQ ID NO: 1611621 - RNA, 20 nt, Human
cugggcaaugugauaaaacc

SEQ ID NO: 1611622 - RNA, 20 nt, Human
cugggcaccggggccucgga

SEQ ID NO: 1611623 - RNA, 10 nt, Human
cugggccccu

SEQ ID NO: 1611624 - RNA, 17 nt, Human
cugggccccugccucuc

SEQ ID NO: 1611625 - RNA, 16 nt, Human
cugggccccugccucu

SEQ ID NO: 1611626 - RNA, 12 nt, Human
cugggccccugc

SEQ ID NO: 1611627 - RNA, 15 nt, Human
cuggccugagcuggg

SEQ ID NO: 1611628 - RNA, 17 nt, Human
cuggcucuuccaggcug

SEQ ID NO: 1611629 - RNA, 13 nt, Human
cuggccugagcug

SEQ ID NO: 1611630 - RNA, 19 nt, Human
cuggcucuuccaggcuggg

SEQ ID NO: 1611631 - RNA, 18 nt, Human
cuggcucuuccaggcugg

SEQ ID NO: 1611632 - RNA, 20 nt, Human
cuggcucuuccaggcuggga

SEQ ID NO: 1611633 - RNA, 19 nt, Human
cuggcugccuuagaaccuu

SEQ ID NO: 1611634 - RNA, 14 nt, Human
cuggcugccuuaga

SEQ ID NO: 1611635 - RNA, 19 nt, Human
cuggcuguuggcugggggc

SEQ ID NO: 1611636 - RNA, 22 nt, Human
cuggcuggguggcaccagcagc

SEQ ID NO: 1611637 - RNA, 21 nt, Human
cuggcuggguggcaccagcag

SEQ ID NO: 1611638 - RNA, 20 nt, Human
cuggcuguuggcugggggcc

SEQ ID NO: 1611639 - RNA, 14 nt, Human
cuggcuucacagau

SEQ ID NO: 1611640 - RNA, 16 nt, Human
cuggcuuuucacugcu

SEQ ID NO: 1611641 - RNA, 15 nt, Human
cuggcuuuucacugc

SEQ ID NO: 1611642 - RNA, 19 nt, Human
cugggaacaccauagguca

SEQ ID NO: 1611643 - RNA, 22 nt, Human
cuggcuuuucacugcuggcugc

SEQ ID NO: 1611644 - RNA, 20 nt, Human
cuggcuuuucacugcuggcu

SEQ ID NO: 1611645 - RNA, 19 nt, Human
cuggcuuuucacugcuggc

SEQ ID NO: 1611646 - RNA, 17 nt, Human
cuggcuuuucacugcug

SEQ ID NO: 1611647 - RNA, 13 nt, Human
cugcugaaacaac

SEQ ID NO: 1611648 - RNA, 18 nt, Human
cugcugaaacaacaaaua

SEQ ID NO: 1611649 - RNA, 21 nt, Human
cugcuuucagauacuggauug

SEQ ID NO: 1611650 - RNA, 18 nt, Human
cugcuuucagauacugga

SEQ ID NO: 1611651 - RNA, 12 nt, Human
cugcucugauga

SEQ ID NO: 1611652 - RNA, 20 nt, Human
cugcucugaugaagaggagu

SEQ ID NO: 1611653 - RNA, 18 nt, Human
cugcuuugggcugcccug

SEQ ID NO: 1611654 - RNA, 20 nt, Human
cugcuuugggcugcccuggu

SEQ ID NO: 1611655 - RNA, 19 nt, Human
cugcuuugggcugcccugg

SEQ ID NO: 1611656 - RNA, 23 nt, Human
cugcuuugggcugcccuggugcu

SEQ ID NO: 1611657 - RNA, 22 nt, Human
cugcuuugggcugcccuggugc

SEQ ID NO: 1611658 - RNA, 21 nt, Human
cugcuuugggcugcccuggug

SEQ ID NO: 1611659 - RNA, 23 nt, Human
cuggaauaauccuaaacauauga

SEQ ID NO: 1611660 - RNA, 21 nt, Human
cuggaagugcuaauuuugaaa

SEQ ID NO: 1611661 - RNA, 18 nt, Human
cuggaagcacagcuucau

SEQ ID NO: 1611662 - RNA, 15 nt, Human
cuggaagcacagcuu

SEQ ID NO: 1611663 - RNA, 15 nt, Human
cuggaaugcaguggu

SEQ ID NO: 1611664 - RNA, 22 nt, Human
cuggagcuagaauuugauaugu

SEQ ID NO: 1611665 - RNA, 17 nt, Human
cuggagcuagaauuuga

SEQ ID NO: 1611666 - RNA, 16 nt, Human
cuggagcuagaauuug

SEQ ID NO: 1611667 - RNA, 21 nt, Human
cuggagcccacuguacuugcu

SEQ ID NO: 1611668 - RNA, 20 nt, Human
cuggagcccacuguacuugc

SEQ ID NO: 1611669 - RNA, 17 nt, Human
cuggagcccacuguacu

SEQ ID NO: 1611670 - RNA, 16 nt, Human
cuggagcccacuguac

SEQ ID NO: 1611671 - RNA, 15 nt, Human
cuggagcccacugua

SEQ ID NO: 1611672 - RNA, 13 nt, Human
cuggagcccacug

SEQ ID NO: 1611673 - RNA, 16 nt, Human
cuggacucaccucccc

SEQ ID NO: 1611674 - RNA, 16 nt, Human
cuggccaacgggguga

SEQ ID NO: 1611675 - RNA, 16 nt, Human
cuggccagaugcacca

SEQ ID NO: 1611676 - RNA, 18 nt, Human
cuggcacugcuuccagug

SEQ ID NO: 1611677 - RNA, 17 nt, Human
cuggcacugcuuccagu

SEQ ID NO: 1611678 - RNA, 16 nt, Human
cuggcacugcuuccag

SEQ ID NO: 1611679 - RNA, 15 nt, Human
cuggcacugcuucca

SEQ ID NO: 1611680 - RNA, 20 nt, Human
cuggccagaugcaccagccc

SEQ ID NO: 1611681 - RNA, 19 nt, Human
cuggccagaugcaccagcc

SEQ ID NO: 1611682 - RNA, 18 nt, Human
cuggccagaugcaccagc

SEQ ID NO: 1611683 - RNA, 17 nt, Human
cuggccagaugcaccag

SEQ ID NO: 1611684 - RNA, 21 nt, Human
cuggccagaugcaccagcccu

SEQ ID NO: 1611685 - RNA, 22 nt, Human
cuggccagaugcaccagcccuu

SEQ ID NO: 1611686 - RNA, 17 nt, Human
cuggccuagcauacgua

SEQ ID NO: 1611687 - RNA, 13 nt, Human
cuggcccacugca

SEQ ID NO: 1611688 - RNA, 12 nt, Human
cuggcccacugc

SEQ ID NO: 1611689 - RNA, 23 nt, Human
cuggccuagcauacguacacauu

SEQ ID NO: 1611690 - RNA, 22 nt, Human
cuggccucaagugauucuccug

SEQ ID NO: 1611691 - RNA, 20 nt, Human
cuggcacaguuuucugagaa

SEQ ID NO: 1611692 - RNA, 23 nt, Human
cuggcacuauaauguaagcucua

SEQ ID NO: 1611693 - RNA, 14 nt, Human
cuggcacugcuucc

SEQ ID NO: 1611694 - RNA, 13 nt, Human
cuggcacugcuuc

SEQ ID NO: 1611695 - RNA, 19 nt, Human
cuggcacaguuuucugaga

SEQ ID NO: 1611696 - RNA, 18 nt, Human
cuggcacaguuuucugag

SEQ ID NO: 1611697 - RNA, 17 nt, Human
cuggcacagggcagugg

SEQ ID NO: 1611698 - RNA, 20 nt, Human
cuggauuguacuuugugcug

SEQ ID NO: 1611699 - RNA, 19 nt, Human
cuggauuguacuuugugcu

SEQ ID NO: 1611700 - RNA, 15 nt, Human
cuggauggggcugca

SEQ ID NO: 1611701 - RNA, 21 nt, Human
cuggauggaggaaaaccaagc

SEQ ID NO: 1611702 - RNA, 16 nt, Human
cuggauggggcugcac

SEQ ID NO: 1611703 - RNA, 13 nt, Human
cuggauuaaacuu

SEQ ID NO: 1611704 - RNA, 23 nt, Human
cuggauuaaacuuaaucuaaaug

SEQ ID NO: 1611705 - RNA, 17 nt, Human
cuggauuauauuaugaa

SEQ ID NO: 1611706 - RNA, 23 nt, Human
cuggauuauucaaaaugauguau

SEQ ID NO: 1611707 - RNA, 15 nt, Human
cucauacccaccccc

SEQ ID NO: 1611708 - RNA, 19 nt, Human
cucauaguaugguggcugg

SEQ ID NO: 1611709 - RNA, 18 nt, Human
cucauaguaugguggcug

SEQ ID NO: 1611710 - RNA, 20 nt, Human
cucauaguaugguggcuggg

SEQ ID NO: 1611711 - RNA, 14 nt, Human
cucaggugagaagc

SEQ ID NO: 1611712 - RNA, 19 nt, Human
cucaggugucccugcacuu

SEQ ID NO: 1611713 - RNA, 18 nt, Human
cucaggugucccugcacu

SEQ ID NO: 1611714 - RNA, 17 nt, Human
cucaggugucccugcac

SEQ ID NO: 1611715 - RNA, 16 nt, Human
cucaggugucccugca

SEQ ID NO: 1611716 - RNA, 15 nt, Human
cucaggugucccugc

SEQ ID NO: 1611717 - RNA, 23 nt, Human
cucagguggggucacucuggcag

SEQ ID NO: 1611718 - RNA, 22 nt, Human
cucagguggggucacucuggca

SEQ ID NO: 1611719 - RNA, 14 nt, Human
cucagggucccugg

SEQ ID NO: 1611720 - RNA, 18 nt, Human
cucaggucccugcagggc

SEQ ID NO: 1611721 - RNA, 17 nt, Human
cucaggucccugcaggg

SEQ ID NO: 1611722 - RNA, 12 nt, Human
cucagggucccu

SEQ ID NO: 1611723 - RNA, 23 nt, Human
cuaaaagguaugcaaucaaaucu

SEQ ID NO: 1611724 - RNA, 18 nt, Human
cucauuaggauggcuagu

SEQ ID NO: 1611725 - RNA, 17 nt, Human
cucauuaggauggcuag

SEQ ID NO: 1611726 - RNA, 21 nt, Human
cucauuagcauuuugcuaaau

SEQ ID NO: 1611727 - RNA, 17 nt, Human
cucaucuccccaucauu

SEQ ID NO: 1611728 - RNA, 21 nt, Human
cucaucuagguaaauuacagu

SEQ ID NO: 1611729 - RNA, 14 nt, Human
cucauauuuucaug

SEQ ID NO: 1611730 - RNA, 14 nt, Human
cucauucuucugua

SEQ ID NO: 1611731 - RNA, 13 nt, Human
cucauucuucugu

SEQ ID NO: 1611732 - RNA, 18 nt, Human
cucauuccaccuucccau

SEQ ID NO: 1611733 - RNA, 21 nt, Human
cucauuccaccuucccaugcc

SEQ ID NO: 1611734 - RNA, 15 nt, Human
cucauugaccugagg

SEQ ID NO: 1611735 - RNA, 13 nt, Human
cucauugaccuga

SEQ ID NO: 1611736 - RNA, 23 nt, Human
cucauucuucuguacgucugaca

SEQ ID NO: 1611737 - RNA, 16 nt, Human
cucauugaccugaggc

SEQ ID NO: 1611738 - RNA, 17 nt, Human
cucccagucauuuaaua

SEQ ID NO: 1611739 - RNA, 14 nt, Human
cucccaggcgcccc

SEQ ID NO: 1611740 - RNA, 22 nt, Human
cucccaggcauuccccaggagg

SEQ ID NO: 1611741 - RNA, 21 nt, Human
cucccaggcauuccccaggag

SEQ ID NO: 1611742 - RNA, 20 nt, Human
cucccaggcauuccccagga

SEQ ID NO: 1611743 - RNA, 19 nt, Human
cucccaggcauuccccagg

SEQ ID NO: 1611744 - RNA, 17 nt, Human
cucccaggcauucccca

SEQ ID NO: 1611745 - RNA, 22 nt, Human
cucccaaggggcccaaauucuu

SEQ ID NO: 1611746 - RNA, 21 nt, Human
cucccaaggggcccaaauucu

SEQ ID NO: 1611747 - RNA, 14 nt, Human
cuccaucuccacuc

SEQ ID NO: 1611748 - RNA, 21 nt, Human
cuccauccugaggcuccacuu

SEQ ID NO: 1611749 - RNA, 15 nt, Human
cuccaggcuccuuua

SEQ ID NO: 1611750 - RNA, 11 nt, Human
cuccaggcucc

SEQ ID NO: 1611751 - RNA, 23 nt, Human
cuccauccugaggcuccacuugg

SEQ ID NO: 1611752 - RNA, 17 nt, Human
cuccaucuaaacugccc

SEQ ID NO: 1611753 - RNA, 20 nt, Human
cuccaucgcugucaucucag

SEQ ID NO: 1611754 - RNA, 13 nt, Human
cuccaucuccacu

SEQ ID NO: 1611755 - RNA, 18 nt, Human
cuccaucuaaacugcccc

SEQ ID NO: 1611756 - RNA, 19 nt, Human
cuccagcuguucagcuggu

SEQ ID NO: 1611757 - RNA, 18 nt, Human
cuccagcuguucagcugg

SEQ ID NO: 1611758 - RNA, 13 nt, Human
cuccagcuguuca

SEQ ID NO: 1611759 - RNA, 23 nt, Human
cuccaccucccugcaauaaaaug

SEQ ID NO: 1611760 - RNA, 17 nt, Human
cuccaccugccagggac

SEQ ID NO: 1611761 - RNA, 21 nt, Human
cuccaccugccagggacagag

SEQ ID NO: 1611762 - RNA, 18 nt, Human
cuccaccugccagggaca

SEQ ID NO: 1611763 - RNA, 14 nt, Human
cuccaccucccugc

SEQ ID NO: 1611764 - RNA, 15 nt, Human
cuccaccucccugca

SEQ ID NO: 1611765 - RNA, 16 nt, Human
cuccaccucccugcaa

SEQ ID NO: 1611766 - RNA, 17 nt, Human
cuccaccucccugcaau

SEQ ID NO: 1611767 - RNA, 12 nt, Human
cuccacccugcu

SEQ ID NO: 1611768 - RNA, 11 nt, Human
cuccacccugc

SEQ ID NO: 1611769 - RNA, 20 nt, Human
cuccagcucaccagccccag

SEQ ID NO: 1611770 - RNA, 19 nt, Human
cuccagcucaccagcccca

SEQ ID NO: 1611771 - RNA, 11 nt, Human
cuccacugccu

SEQ ID NO: 1611772 - RNA, 21 nt, Human
cuccagaccccuggcuuuuca

SEQ ID NO: 1611773 - RNA, 20 nt, Human
cuccagaccccuggcuuuuc

SEQ ID NO: 1611774 - RNA, 19 nt, Human
cuccagaccccuggcuuuu

SEQ ID NO: 1611775 - RNA, 18 nt, Human
cuccagaccccuggcuuu

SEQ ID NO: 1611776 - RNA, 17 nt, Human
cuccagaccccuggcuu

SEQ ID NO: 1611777 - RNA, 15 nt, Human
cuccagaccccuggc

SEQ ID NO: 1611778 - RNA, 16 nt, Human
cucccuucucuucaca

SEQ ID NO: 1611779 - RNA, 13 nt, Human
cucccuuccucuu

SEQ ID NO: 1611780 - RNA, 14 nt, Human
cucccuuccucuuu

SEQ ID NO: 1611781 - RNA, 13 nt, Human
cucccuuucaaca

SEQ ID NO: 1611782 - RNA, 20 nt, Human
cucccuuggauuguccccga

SEQ ID NO: 1611783 - RNA, 17 nt, Human
cucccuuggauuguccc

SEQ ID NO: 1611784 - RNA, 17 nt, Human
cucccuuucuucccuac

SEQ ID NO: 1611785 - RNA, 10 nt, Human
cucccuuccu

SEQ ID NO: 1611786 - RNA, 20 nt, Human
cucccuucaaccauucccca

SEQ ID NO: 1611787 - RNA, 19 nt, Human
cucccuucaaccauucccc

SEQ ID NO: 1611788 - RNA, 18 nt, Human
cucccuucaaccauuccc

SEQ ID NO: 1611789 - RNA, 12 nt, Human
cucccuucaacc

SEQ ID NO: 1611790 - RNA, 18 nt, Human
cucccaucucacacauga

SEQ ID NO: 1611791 - RNA, 15 nt, Human
cucccaucucacaca

SEQ ID NO: 1611792 - RNA, 21 nt, Human
cucccaucucacacaugagca

SEQ ID NO: 1611793 - RNA, 14 nt, Human
cucccaucucacac

SEQ ID NO: 1611794 - RNA, 14 nt, Human
cucccaucacccgc

SEQ ID NO: 1611795 - RNA, 12 nt, Human
cuccucagaucu

SEQ ID NO: 1611796 - RNA, 22 nt, Human
cuccuaucagaaguuucucagc

SEQ ID NO: 1611797 - RNA, 18 nt, Human
cuccuaucaccugucuug

SEQ ID NO: 1611798 - RNA, 14 nt, Human
cuccucagaucuuc

SEQ ID NO: 1611799 - RNA, 19 nt, Human
cuccucuugccacugccuc

SEQ ID NO: 1611800 - RNA, 14 nt, Human
cuccugcaggcagc

SEQ ID NO: 1611801 - RNA, 13 nt, Human
cuccugcaggcag

SEQ ID NO: 1611802 - RNA, 22 nt, Human
cuccugaguagcugggauuaca

SEQ ID NO: 1611803 - RNA, 17 nt, Human
cuccugaguagcuggga

SEQ ID NO: 1611804 - RNA, 14 nt, Human
cuccugaccuuagg

SEQ ID NO: 1611805 - RNA, 14 nt, Human
cuccugaccucagg

SEQ ID NO: 1611806 - RNA, 20 nt, Human
cucggagaagagcuguucac

SEQ ID NO: 1611807 - RNA, 13 nt, Human
cucggagaagagc

SEQ ID NO: 1611808 - RNA, 12 nt, Human
cucggagaagag

SEQ ID NO: 1611809 - RNA, 19 nt, Human
cucggacuuagcugggaga

SEQ ID NO: 1611810 - RNA, 18 nt, Human
cucggacuuagcugggag

SEQ ID NO: 1611811 - RNA, 21 nt, Human
cucgcuauugucaccagggcu

SEQ ID NO: 1611812 - RNA, 22 nt, Human
cucgcuauugucaccagggcug

SEQ ID NO: 1611813 - RNA, 17 nt, Human
cucuaaauucuuucauu

SEQ ID NO: 1611814 - RNA, 13 nt, Human
cucuaaauucuuu

SEQ ID NO: 1611815 - RNA, 22 nt, Human
cucggccucccaaagugcuggg

SEQ ID NO: 1611816 - RNA, 23 nt, Human
cucggccucccaaagugcuggga

SEQ ID NO: 1611817 - RNA, 20 nt, Human
cucgaguuacagacaaagcg

SEQ ID NO: 1611818 - RNA, 16 nt, Human
cucgaguuacagacaa

SEQ ID NO: 1611819 - RNA, 15 nt, Human
cucgcgacaaugcaa

SEQ ID NO: 1611820 - RNA, 19 nt, Human
cucgcuauugucaccaggg

SEQ ID NO: 1611821 - RNA, 20 nt, Human
cuccuucuguccuacucugu

SEQ ID NO: 1611822 - RNA, 15 nt, Human
cuccuucuguccuac

SEQ ID NO: 1611823 - RNA, 14 nt, Human
cuccuucuguccua

SEQ ID NO: 1611824 - RNA, 21 nt, Human
cuccuugaaaacacuguucuc

SEQ ID NO: 1611825 - RNA, 11 nt, Human
cuccuucuucc

SEQ ID NO: 1611826 - RNA, 11 nt, Human
cuccugugugu

SEQ ID NO: 1611827 - RNA, 23 nt, Human
cuccugugucuugcaauggcagc

SEQ ID NO: 1611828 - RNA, 15 nt, Human
cuccugugucuugca

SEQ ID NO: 1611829 - RNA, 11 nt, Human
cuccugccacc

SEQ ID NO: 1611830 - RNA, 21 nt, Human
cuccugcaggcagccaggcca

SEQ ID NO: 1611831 - RNA, 15 nt, Human
cuccugcaggcagcc

SEQ ID NO: 1611832 - RNA, 22 nt, Human
cuccugcaggcagccaggccac

SEQ ID NO: 1611833 - RNA, 16 nt, Human
cuccugcaggcagcca

SEQ ID NO: 1611834 - RNA, 21 nt, Human
cuccuucaccuuuguccccac

SEQ ID NO: 1611835 - RNA, 19 nt, Human
cuccuucaccuuugucccc

SEQ ID NO: 1611836 - RNA, 16 nt, Human
cuccuucaccuuuguc

SEQ ID NO: 1611837 - RNA, 14 nt, Human
cuccuucaccuuug

SEQ ID NO: 1611838 - RNA, 14 nt, Human
cuccugugugugcg

SEQ ID NO: 1611839 - RNA, 23 nt, Human
cucugcauacucauuaggauggc

SEQ ID NO: 1611840 - RNA, 23 nt, Human
cucugcaggucccuaauaaagcu

SEQ ID NO: 1611841 - RNA, 10 nt, Human
cucugcacaa

SEQ ID NO: 1611842 - RNA, 22 nt, Human
cucugcaagaauugaagcagga

SEQ ID NO: 1611843 - RNA, 17 nt, Human
cucugaugaagaggagu

SEQ ID NO: 1611844 - RNA, 20 nt, Human
cucugagacucgcgacaaug

SEQ ID NO: 1611845 - RNA, 21 nt, Human
cucucugcccuaaugcgcagg

SEQ ID NO: 1611846 - RNA, 13 nt, Human
cucucugcccuaa

SEQ ID NO: 1611847 - RNA, 12 nt, Human
cucucugcccua

SEQ ID NO: 1611848 - RNA, 16 nt, Human
cucugagcaaaugugg

SEQ ID NO: 1611849 - RNA, 15 nt, Human
cucugagccuuggga

SEQ ID NO: 1611850 - RNA, 23 nt, Human
cucugcccuccaagaccuucucc

SEQ ID NO: 1611851 - RNA, 16 nt, Human
cucugcccuccaagac

SEQ ID NO: 1611852 - RNA, 15 nt, Human
cucugcccuccaaga

SEQ ID NO: 1611853 - RNA, 14 nt, Human
cucugcccuccaag

SEQ ID NO: 1611854 - RNA, 12 nt, Human
cucugcccuugg

SEQ ID NO: 1611855 - RNA, 12 nt, Human
cucugcccugcg

SEQ ID NO: 1611856 - RNA, 14 nt, Human
cucugccuccucuu

SEQ ID NO: 1611857 - RNA, 11 nt, Human
cucugcccugc

SEQ ID NO: 1611858 - RNA, 23 nt, Human
cucugcccuaaugcgcaggcugg

SEQ ID NO: 1611859 - RNA, 16 nt, Human
cucugccucugacaca

SEQ ID NO: 1611860 - RNA, 14 nt, Human
cucugccucugaca

SEQ ID NO: 1611861 - RNA, 16 nt, Human
cucugccuccucuuca

SEQ ID NO: 1611862 - RNA, 15 nt, Human
cucugccuccucuuc

SEQ ID NO: 1611863 - RNA, 14 nt, Human
cucuggaauuugaa

SEQ ID NO: 1611864 - RNA, 15 nt, Human
cucugcuuuggaaau

SEQ ID NO: 1611865 - RNA, 14 nt, Human
cucuggacaggcau

SEQ ID NO: 1611866 - RNA, 12 nt, Human
cucuggagccca

SEQ ID NO: 1611867 - RNA, 21 nt, Human
cucuccugggcagcugccucc

SEQ ID NO: 1611868 - RNA, 13 nt, Human
cucuccuguaccu

SEQ ID NO: 1611869 - RNA, 14 nt, Human
cucuccuguaccuc

SEQ ID NO: 1611870 - RNA, 15 nt, Human
cucuccuguaccucu

SEQ ID NO: 1611871 - RNA, 13 nt, Human
cucuccccagcaa

SEQ ID NO: 1611872 - RNA, 22 nt, Human
cucuccuguaccucuugagccu

SEQ ID NO: 1611873 - RNA, 17 nt, Human
cucuccuguaccucuug

SEQ ID NO: 1611874 - RNA, 18 nt, Human
cucuccuguaccucuuga

SEQ ID NO: 1611875 - RNA, 13 nt, Human
cucucucaggcca

SEQ ID NO: 1611876 - RNA, 12 nt, Human
cucucucaggcc

SEQ ID NO: 1611877 - RNA, 16 nt, Human
cucucucacuccuuga

SEQ ID NO: 1611878 - RNA, 15 nt, Human
cucucucacuccuug

SEQ ID NO: 1611879 - RNA, 22 nt, Human
cucucugcaggucccuaauaaa

SEQ ID NO: 1611880 - RNA, 19 nt, Human
cucucugcaggucccuaau

SEQ ID NO: 1611881 - RNA, 17 nt, Human
cucucugcaggucccua

SEQ ID NO: 1611882 - RNA, 16 nt, Human
cucucugcaggucccu

SEQ ID NO: 1611883 - RNA, 14 nt, Human
cucucugcaggucc

SEQ ID NO: 1611884 - RNA, 13 nt, Human
cucucugcagguc

SEQ ID NO: 1611885 - RNA, 12 nt, Human
cucucugcaggu

SEQ ID NO: 1611886 - RNA, 18 nt, Human
cucucccaucacuucccu

SEQ ID NO: 1611887 - RNA, 14 nt, Human
cucucccaucacuu

SEQ ID NO: 1611888 - RNA, 20 nt, Human
cucucccaucacuucccuac

SEQ ID NO: 1611889 - RNA, 13 nt, Human
cucucccaucacu

SEQ ID NO: 1611890 - RNA, 13 nt, Human
cucuccagccccu

SEQ ID NO: 1611891 - RNA, 12 nt, Human
cucuccagcccc

SEQ ID NO: 1611892 - RNA, 13 nt, Human
cucuccauuuaau

SEQ ID NO: 1611893 - RNA, 23 nt, Human
cucucaggccagcugcuugggcu

SEQ ID NO: 1611894 - RNA, 16 nt, Human
cucuccacugccuucg

SEQ ID NO: 1611895 - RNA, 13 nt, Human
cucuuaagaagac

SEQ ID NO: 1611896 - RNA, 23 nt, Human
cucuucaguuaagccuuuggaaa

SEQ ID NO: 1611897 - RNA, 20 nt, Human
cucuucaguuaagccuuugg

SEQ ID NO: 1611898 - RNA, 19 nt, Human
cucuucaguuaagccuuug

SEQ ID NO: 1611899 - RNA, 24 nt, Human
cucuuaaaacccaagugccuuagc

SEQ ID NO: 1611900 - RNA, 13 nt, Human
cucuuaaaaccca

SEQ ID NO: 1611901 - RNA, 19 nt, Human
cucuggcagcucagagagg

SEQ ID NO: 1611902 - RNA, 20 nt, Human
cucuggcagcucagagaggg

SEQ ID NO: 1611903 - RNA, 19 nt, Human
cucuguucugcacacagca

SEQ ID NO: 1611904 - RNA, 21 nt, Human
cucuguucugcacacagcacg

SEQ ID NO: 1611905 - RNA, 20 nt, Human
cucuguucugcacacagcac

SEQ ID NO: 1611906 - RNA, 18 nt, Human
cucuggcagcucagagag

SEQ ID NO: 1611907 - RNA, 17 nt, Human
cucuggcagcucagaga

SEQ ID NO: 1611908 - RNA, 19 nt, Human
cucuggagcccacuguacu

SEQ ID NO: 1611909 - RNA, 15 nt, Human
cucuggagcccacug

SEQ ID NO: 1611910 - RNA, 12 nt, Human
cucuucuccagg

SEQ ID NO: 1611911 - RNA, 13 nt, Human
cucuucuccaggc

SEQ ID NO: 1611912 - RNA, 19 nt, Human
cucuucuccacuggaugga

SEQ ID NO: 1611913 - RNA, 14 nt, Human
cucuucuccacugg

SEQ ID NO: 1611914 - RNA, 17 nt, Human
cucuucuccacuggaug

SEQ ID NO: 1611915 - RNA, 15 nt, Human
cucuucuccacugga

SEQ ID NO: 1611916 - RNA, 21 nt, Human
cucuuccaggcugggagagcc

SEQ ID NO: 1611917 - RNA, 22 nt, Human
cucuuccaggcugggagagccu

SEQ ID NO: 1611918 - RNA, 23 nt, Human
cucuuccaggcugggagagccuu

SEQ ID NO: 1611919 - RNA, 16 nt, Human
cucuucuccuuucaca

SEQ ID NO: 1611920 - RNA, 15 nt, Human
cucuucuccuuucac

SEQ ID NO: 1611921 - RNA, 13 nt, Human
cucuucuccuuuc

SEQ ID NO: 1611922 - RNA, 18 nt, Human
cucuuuggacacucacac

SEQ ID NO: 1611923 - RNA, 15 nt, Human
cucuuuggacacuca

SEQ ID NO: 1611924 - RNA, 13 nt, Human
cucuuucccuccc

SEQ ID NO: 1611925 - RNA, 17 nt, Human
cucuuuccaucuacccu

SEQ ID NO: 1611926 - RNA, 15 nt, Human
cucuugaccucaggu

SEQ ID NO: 1611927 - RNA, 13 nt, Human
cucuugaccucag

SEQ ID NO: 1611928 - RNA, 16 nt, Human
cucuugaccucaggug

SEQ ID NO: 1611929 - RNA, 18 nt, Human
cucuucuggguuccuucc

SEQ ID NO: 1611930 - RNA, 18 nt, Human
cucuugaacuccugaccu

SEQ ID NO: 1611931 - RNA, 13 nt, Human
cucuugagccugg

SEQ ID NO: 1611932 - RNA, 19 nt, Human
cucuugguccugcugcagu

SEQ ID NO: 1611933 - RNA, 18 nt, Human
cucuugguccugcugcag

SEQ ID NO: 1611934 - RNA, 16 nt, Human
cugaauacagaggcaa

SEQ ID NO: 1611935 - RNA, 21 nt, Human
cugaagucagaucugccuaag

SEQ ID NO: 1611936 - RNA, 24 nt, Human
cugaagucuuuguacagacaacaa

SEQ ID NO: 1611937 - RNA, 16 nt, Human
cugaagucagaucugc

SEQ ID NO: 1611938 - RNA, 15 nt, Human
cugaagucagaucug

SEQ ID NO: 1611939 - RNA, 16 nt, Human
cugaagucacugcaca

SEQ ID NO: 1611940 - RNA, 17 nt, Human
cugaagucacugcacag

SEQ ID NO: 1611941 - RNA, 22 nt, Human
cugaagucacugcacagugcau

SEQ ID NO: 1611942 - RNA, 14 nt, Human
cugaagucagaucu

SEQ ID NO: 1611943 - RNA, 15 nt, Human
cugaagucacacagu

SEQ ID NO: 1611944 - RNA, 16 nt, Human
cugaagucacacagug

SEQ ID NO: 1611945 - RNA, 14 nt, Human
cugaagucacacag

SEQ ID NO: 1611946 - RNA, 21 nt, Human
cugaacuuggcgcugccccug

SEQ ID NO: 1611947 - RNA, 16 nt, Human
cugaacuuggcgcugc

SEQ ID NO: 1611948 - RNA, 15 nt, Human
cugaacuuggcgcug

SEQ ID NO: 1611949 - RNA, 21 nt, Human
cugaagacucauucuucugua

SEQ ID NO: 1611950 - RNA, 21 nt, Human
cucuuuggucuacacugugcu

SEQ ID NO: 1611951 - RNA, 19 nt, Human
cucuuuggucuacacugug

SEQ ID NO: 1611952 - RNA, 18 nt, Human
cucuuugggccuggcucc

SEQ ID NO: 1611953 - RNA, 21 nt, Human
cugaaccuggguaacuaggga

SEQ ID NO: 1611954 - RNA, 11 nt, Human
cugacccacug

SEQ ID NO: 1611955 - RNA, 21 nt, Human
cugacauuguuggccaaagcc

SEQ ID NO: 1611956 - RNA, 19 nt, Human
cugacaggcaaugcuggcu

SEQ ID NO: 1611957 - RNA, 18 nt, Human
cugacaggcaaugcuggc

SEQ ID NO: 1611958 - RNA, 17 nt, Human
cugacaggcaaugcugg

SEQ ID NO: 1611959 - RNA, 16 nt, Human
cugacaggcaaugcug

SEQ ID NO: 1611960 - RNA, 20 nt, Human
cugacaggcaaugcuggcug

SEQ ID NO: 1611961 - RNA, 21 nt, Human
cugacaggcaaugcuggcugu

SEQ ID NO: 1611962 - RNA, 17 nt, Human
cugacauuguuggccaa

SEQ ID NO: 1611963 - RNA, 21 nt, Human
cugacagacacaggcccggcu

SEQ ID NO: 1611964 - RNA, 19 nt, Human
cugacagacagcccuccau

SEQ ID NO: 1611965 - RNA, 17 nt, Human
cugacagacagcccucc

SEQ ID NO: 1611966 - RNA, 11 nt, Human
cugacaggcaa

SEQ ID NO: 1611967 - RNA, 19 nt, Human
cugacagacacaggcccgg

SEQ ID NO: 1611968 - RNA, 23 nt, Human
cugaauuuaaauagcuuuuuucu

SEQ ID NO: 1611969 - RNA, 18 nt, Human
cugaauuuaaauagcuuu

SEQ ID NO: 1611970 - RNA, 14 nt, Human
cugaauuuaaauag

SEQ ID NO: 1611971 - RNA, 17 nt, Human
cuguuuucucuugagag

SEQ ID NO: 1611972 - RNA, 19 nt, Human
cuguuuuauaauuuuguga

SEQ ID NO: 1611973 - RNA, 23 nt, Human
cuguuuguuucugaaagggacgc

SEQ ID NO: 1611974 - RNA, 21 nt, Human
cuguuuguuucugaaagggac

SEQ ID NO: 1611975 - RNA, 14 nt, Human
cuguuuucucuuga

SEQ ID NO: 1611976 - RNA, 21 nt, Human
cuguuuuauuuuaauucaguu

SEQ ID NO: 1611977 - RNA, 18 nt, Human
cuguuuguuucugaaagg

SEQ ID NO: 1611978 - RNA, 12 nt, Human
cuguuuagauaa

SEQ ID NO: 1611979 - RNA, 14 nt, Human
cuguuuagauaaua

SEQ ID NO: 1611980 - RNA, 17 nt, Human
cugguugaugccuguga

SEQ ID NO: 1611981 - RNA, 12 nt, Human
cuuaacuucaca

SEQ ID NO: 1611982 - RNA, 14 nt, Human
cuuaacuucacaua

SEQ ID NO: 1611983 - RNA, 15 nt, Human
cuuaacuucacauau

SEQ ID NO: 1611984 - RNA, 16 nt, Human
cuuaacuucacauauu

SEQ ID NO: 1611985 - RNA, 17 nt, Human
cuuaacuucacauauug

SEQ ID NO: 1611986 - RNA, 22 nt, Human
cuuaacuucacauauugauuuc

SEQ ID NO: 1611987 - RNA, 18 nt, Human
cuuaaugccacuaaauug

SEQ ID NO: 1611988 - RNA, 14 nt, Human
cuuaaucuaaaugg

SEQ ID NO: 1611989 - RNA, 16 nt, Human
cuuaaucuaaauggaa

SEQ ID NO: 1611990 - RNA, 16 nt, Human
cuuaaguuuauacucu

SEQ ID NO: 1611991 - RNA, 21 nt, Human
cuuaagaagacugcauuauau

SEQ ID NO: 1611992 - RNA, 15 nt, Human
cuuauuuaaugaaag

SEQ ID NO: 1611993 - RNA, 16 nt, Human
cuuaucaaaggacacc

SEQ ID NO: 1611994 - RNA, 14 nt, Human
cuuaucaaaggaca

SEQ ID NO: 1611995 - RNA, 21 nt, Human
cuuaggguuaugauuaaguaa

SEQ ID NO: 1611996 - RNA, 20 nt, Human
cuuaggugauccacucgccu

SEQ ID NO: 1611997 - RNA, 21 nt, Human
cuuagguuggcaaaaaggcag

SEQ ID NO: 1611998 - RNA, 17 nt, Human
cuuagguuggcaaaaag

SEQ ID NO: 1611999 - RNA, 13 nt, Human
cuuauaauuuaaa

SEQ ID NO: 1612000 - RNA, 14 nt, Human
cuuauaauuuaaaa

SEQ ID NO: 1612001 - RNA, 15 nt, Human
cuuauacauuugaua

SEQ ID NO: 1612002 - RNA, 19 nt, Human
cuuacuaguuucccuugca

SEQ ID NO: 1612003 - RNA, 15 nt, Human
cuuacgugaguccug

SEQ ID NO: 1612004 - RNA, 16 nt, Human
cuuacuguacaugaaa

SEQ ID NO: 1612005 - RNA, 20 nt, Human
cuuagaugcaguucugaaga

SEQ ID NO: 1612006 - RNA, 19 nt, Human
cuuagaugcaguucugaag

SEQ ID NO: 1612007 - RNA, 18 nt, Human
cuuagacagucccugcca

SEQ ID NO: 1612008 - RNA, 17 nt, Human
cuuagacagucccugcc

SEQ ID NO: 1612009 - RNA, 19 nt, Human
cuuagacagucccugccaa

SEQ ID NO: 1612010 - RNA, 16 nt, Human
cuuagacagucccugc

SEQ ID NO: 1612011 - RNA, 15 nt, Human
cuuagacagucccug

SEQ ID NO: 1612012 - RNA, 14 nt, Human
cuuagacagucccu

SEQ ID NO: 1612013 - RNA, 15 nt, Human
cuuagaagucacaca

SEQ ID NO: 1612014 - RNA, 17 nt, Human
cuuagaaauugcauuuc

SEQ ID NO: 1612015 - RNA, 15 nt, Human
cuuagaaccuuucuu

SEQ ID NO: 1612016 - RNA, 19 nt, Human
cuuccagauccuggaaauc

SEQ ID NO: 1612017 - RNA, 24 nt, Human
cuuccaggggugggacacccugug

SEQ ID NO: 1612018 - RNA, 22 nt, Human
cuuccaggggugggacacccug

SEQ ID NO: 1612019 - RNA, 14 nt, Human
cuuccagugaggcu

SEQ ID NO: 1612020 - RNA, 15 nt, Human
cuuccagugaggcuc

SEQ ID NO: 1612021 - RNA, 17 nt, Human
cuuccagugaggcucug

SEQ ID NO: 1612022 - RNA, 18 nt, Human
cuucccgcucagcccucc

SEQ ID NO: 1612023 - RNA, 17 nt, Human
cuucccgcucagcccuc

SEQ ID NO: 1612024 - RNA, 16 nt, Human
cuucccgcucagcccu

SEQ ID NO: 1612025 - RNA, 15 nt, Human
cuucccgcucagccc

SEQ ID NO: 1612026 - RNA, 18 nt, Human
cuucagcgguuuauauaa

SEQ ID NO: 1612027 - RNA, 11 nt, Human
cuucagcugac

SEQ ID NO: 1612028 - RNA, 14 nt, Human
cuucaggcucuucu

SEQ ID NO: 1612029 - RNA, 18 nt, Human
cuucaggcucuucuccuu

SEQ ID NO: 1612030 - RNA, 17 nt, Human
cuucaggcucuucuccu

SEQ ID NO: 1612031 - RNA, 16 nt, Human
cuucaggcucuucucc

SEQ ID NO: 1612032 - RNA, 15 nt, Human
cuucaggcucuucuc

SEQ ID NO: 1612033 - RNA, 12 nt, Human
cuucagugccuu

SEQ ID NO: 1612034 - RNA, 11 nt, Human
cuucagugccu

SEQ ID NO: 1612035 - RNA, 14 nt, Human
cuucagugccuuau

SEQ ID NO: 1612036 - RNA, 13 nt, Human
cuucagugccuua

SEQ ID NO: 1612037 - RNA, 18 nt, Human
cuucauuuccugugucuu

SEQ ID NO: 1612038 - RNA, 23 nt, Human
cuuccacaagagcccaggccucc

SEQ ID NO: 1612039 - RNA, 14 nt, Human
cuucauuuggagau

SEQ ID NO: 1612040 - RNA, 13 nt, Human
cuucauuuggaga

SEQ ID NO: 1612041 - RNA, 17 nt, Human
cuucggccuccauccug

SEQ ID NO: 1612042 - RNA, 16 nt, Human
cuucgcuccugugucu

SEQ ID NO: 1612043 - RNA, 19 nt, Human
cuucggccuccauccugag

SEQ ID NO: 1612044 - RNA, 18 nt, Human
cuucggccuccauccuga

SEQ ID NO: 1612045 - RNA, 21 nt, Human
cuucgggaggucgaggcagga

SEQ ID NO: 1612046 - RNA, 20 nt, Human
cuucgggaggucgaggcagg

SEQ ID NO: 1612047 - RNA, 16 nt, Human
cuucgauacaccgggc

SEQ ID NO: 1612048 - RNA, 19 nt, Human
cuuccuuggacucauuuua

SEQ ID NO: 1612049 - RNA, 20 nt, Human
cuuccuuggacucauuuuaa

SEQ ID NO: 1612050 - RNA, 15 nt, Human
cuucgcuccuguguc

SEQ ID NO: 1612051 - RNA, 14 nt, Human
cuucgcuccugugu

SEQ ID NO: 1612052 - RNA, 13 nt, Human
cuucgcuccugug

SEQ ID NO: 1612053 - RNA, 17 nt, Human
cuucugccauauucugu

SEQ ID NO: 1612054 - RNA, 12 nt, Human
cuucucuccagc

SEQ ID NO: 1612055 - RNA, 20 nt, Human
cuucugccauuucugagauc

SEQ ID NO: 1612056 - RNA, 21 nt, Human
cuucugccauauucuguuggc

SEQ ID NO: 1612057 - RNA, 17 nt, Human
cuucugcuucagccucc

SEQ ID NO: 1612058 - RNA, 16 nt, Human
cuucugcuucagccuc

SEQ ID NO: 1612059 - RNA, 18 nt, Human
cuucugcuucagccuccc

SEQ ID NO: 1612060 - RNA, 22 nt, Human
cuucuccuucaccuuugucccc

SEQ ID NO: 1612061 - RNA, 17 nt, Human
cuucuccuuucacaacc

SEQ ID NO: 1612062 - RNA, 14 nt, Human
cuucuccuuucaca

SEQ ID NO: 1612063 - RNA, 22 nt, Human
cuucuccuuucacaaccuucug

SEQ ID NO: 1612064 - RNA, 20 nt, Human
cuucuccuuucacaaccuuc

SEQ ID NO: 1612065 - RNA, 15 nt, Human
cuucuccacccugcu

SEQ ID NO: 1612066 - RNA, 14 nt, Human
cuucuccacccugc

SEQ ID NO: 1612067 - RNA, 16 nt, Human
cuucuccacccugcuc

SEQ ID NO: 1612068 - RNA, 17 nt, Human
cuucuccaggcuguauc

SEQ ID NO: 1612069 - RNA, 20 nt, Human
gaaaaguauguuagugcaaa

SEQ ID NO: 1612070 - RNA, 14 nt, Human
gaaaaguauguuag

SEQ ID NO: 1612071 - RNA, 19 nt, Human
gaaaauaacaauaaaagac

SEQ ID NO: 1612072 - RNA, 22 nt, Human
gaaaagucaaggguaggguggg

SEQ ID NO: 1612073 - RNA, 14 nt, Human
gaaaacguggcugc

SEQ ID NO: 1612074 - RNA, 19 nt, Human
gaaaacaugcuacacacug

SEQ ID NO: 1612075 - RNA, 22 nt, Human
gaaaacacuguucucugcccuc

SEQ ID NO: 1612076 - RNA, 14 nt, Human
gaaaacaaggauga

SEQ ID NO: 1612077 - RNA, 19 nt, Human
gaaaacacuguucucugcc

SEQ ID NO: 1612078 - RNA, 21 nt, Human
gaaaacacuguucucugcccu

SEQ ID NO: 1612079 - RNA, 20 nt, Human
gaaaacacuguucucugccc

SEQ ID NO: 1612080 - RNA, 18 nt, Human
gaaaacaugcuacacacu

SEQ ID NO: 1612081 - RNA, 16 nt, Human
cuuuuuuagaguugau

SEQ ID NO: 1612082 - RNA, 15 nt, Human
cuuuucuguuugcua

SEQ ID NO: 1612083 - RNA, 18 nt, Human
cuuuucugauccaguuuu

SEQ ID NO: 1612084 - RNA, 16 nt, Human
cuuuucugauccaguu

SEQ ID NO: 1612085 - RNA, 21 nt, Human
cuuuguuuguugucagcugaa

SEQ ID NO: 1612086 - RNA, 17 nt, Human
cuuuguuuuacugucuu

SEQ ID NO: 1612087 - RNA, 11 nt, Human
cuuuucugauc

SEQ ID NO: 1612088 - RNA, 15 nt, Human
cuuuucugauccagu

SEQ ID NO: 1612089 - RNA, 14 nt, Human
cuuuucugauccag

SEQ ID NO: 1612090 - RNA, 22 nt, Human
cuuuuguucuugguuuguaaau

SEQ ID NO: 1612091 - RNA, 15 nt, Human
cuuuuuuaaauaaau

SEQ ID NO: 1612092 - RNA, 21 nt, Human
cuuuuucauuauuuuauuaug

SEQ ID NO: 1612093 - RNA, 14 nt, Human
cuuuuucauuauuu

SEQ ID NO: 1612094 - RNA, 13 nt, Human
cuuuuucauuauu

SEQ ID NO: 1612095 - RNA, 12 nt, Human
cuuuuucauuau

SEQ ID NO: 1612096 - RNA, 12 nt, Human
cuuuggaaagac

SEQ ID NO: 1612097 - RNA, 23 nt, Human
cuuuggaaagacuuuuccaaccc

SEQ ID NO: 1612098 - RNA, 16 nt, Human
cuuuggauaauaagga

SEQ ID NO: 1612099 - RNA, 14 nt, Human
cuuugcuugaaaga

SEQ ID NO: 1612100 - RNA, 13 nt, Human
cuuugaccucugc

SEQ ID NO: 1612101 - RNA, 19 nt, Human
cuuugacaaagguaaauca

SEQ ID NO: 1612102 - RNA, 12 nt, Human
cuuugugauuuu

SEQ ID NO: 1612103 - RNA, 13 nt, Human
cuuuguggcuucc

SEQ ID NO: 1612104 - RNA, 21 nt, Human
cuuuguucuggcucuuccagg

SEQ ID NO: 1612105 - RNA, 16 nt, Human
cuuuguucuggcucuu

SEQ ID NO: 1612106 - RNA, 23 nt, Human
cuuugugaggaagccgcuggggc

SEQ ID NO: 1612107 - RNA, 17 nt, Human
cuuugggccuggcuccc

SEQ ID NO: 1612108 - RNA, 16 nt, Human
cuuuccucuuuggucu

SEQ ID NO: 1612109 - RNA, 13 nt, Human
cuuucugaaauaa

SEQ ID NO: 1612110 - RNA, 17 nt, Human
cuuugacaaagguaaau

SEQ ID NO: 1612111 - RNA, 19 nt, Human
cuuucuuuuuuuuuuuuga

SEQ ID NO: 1612112 - RNA, 16 nt, Human
cuuucuuccucugcug

SEQ ID NO: 1612113 - RNA, 16 nt, Human
cuuggacucauuuuaa

SEQ ID NO: 1612114 - RNA, 22 nt, Human
cuuggagccaauggagacuguc

SEQ ID NO: 1612115 - RNA, 20 nt, Human
cuugggccacugugaagaga

SEQ ID NO: 1612116 - RNA, 18 nt, Human
cuuggggcugaugcaguu

SEQ ID NO: 1612117 - RNA, 16 nt, Human
cuuggggcugaugcag

SEQ ID NO: 1612118 - RNA, 20 nt, Human
cuugguuuguaaauuaacuu

SEQ ID NO: 1612119 - RNA, 14 nt, Human
cuugguuuguaaau

SEQ ID NO: 1612120 - RNA, 15 nt, Human
cuugguuuguaaauu

SEQ ID NO: 1612121 - RNA, 15 nt, Human
cuuguggucccaccc

SEQ ID NO: 1612122 - RNA, 19 nt, Human
cuuguggucccaccccaca

SEQ ID NO: 1612123 - RNA, 16 nt, Human
cuuguggucccacccc

SEQ ID NO: 1612124 - RNA, 16 nt, Human
cuuguuaagauaguua

SEQ ID NO: 1612125 - RNA, 16 nt, Human
cuuguuagaucuaguu

SEQ ID NO: 1612126 - RNA, 13 nt, Human
cuuguuagaucua

SEQ ID NO: 1612127 - RNA, 19 nt, Human
cuuuaccuuuuuuauacau

SEQ ID NO: 1612128 - RNA, 20 nt, Human
cuuuaccuuuuuuauacaua

SEQ ID NO: 1612129 - RNA, 17 nt, Human
cuuuaccuuuuuuauac

SEQ ID NO: 1612130 - RNA, 21 nt, Human
cuuuaaaaagcuccaaaugca

SEQ ID NO: 1612131 - RNA, 22 nt, Human
cuuuaaaaaauuaaucugggcc

SEQ ID NO: 1612132 - RNA, 18 nt, Human
cuugcccuggugccucac

SEQ ID NO: 1612133 - RNA, 14 nt, Human
cuugcccuguuaaa

SEQ ID NO: 1612134 - RNA, 15 nt, Human
cuugccaucccuccc

SEQ ID NO: 1612135 - RNA, 16 nt, Human
cuugccaucccucccu

SEQ ID NO: 1612136 - RNA, 19 nt, Human
cuugccaucccucccucca

SEQ ID NO: 1612137 - RNA, 17 nt, Human
cuugccaucccucccuc

SEQ ID NO: 1612138 - RNA, 14 nt, Human
cuugccaucccucc

SEQ ID NO: 1612139 - RNA, 13 nt, Human
cuugccacugccu

SEQ ID NO: 1612140 - RNA, 14 nt, Human
cuugcaugaggcua

SEQ ID NO: 1612141 - RNA, 13 nt, Human
cuugcaugaggcu

SEQ ID NO: 1612142 - RNA, 17 nt, Human
cuugcaugaggcuagug

SEQ ID NO: 1612143 - RNA, 22 nt, Human
cuugcccuguuaaaagaugaaa

SEQ ID NO: 1612144 - RNA, 22 nt, Human
cuugcucugcugacagacacag

SEQ ID NO: 1612145 - RNA, 19 nt, Human
cuugcucuugaugccuggc

SEQ ID NO: 1612146 - RNA, 18 nt, Human
cuugcucuugaugccugg

SEQ ID NO: 1612147 - RNA, 17 nt, Human
cuugcucuugaugccug

SEQ ID NO: 1612148 - RNA, 20 nt, Human
cuugcuugauuguauggugg

SEQ ID NO: 1612149 - RNA, 20 nt, Human
cuuggaagcuccgcuuucua

SEQ ID NO: 1612150 - RNA, 15 nt, Human
cuugagccugggagg

SEQ ID NO: 1612151 - RNA, 12 nt, Human
cuugagccuggg

SEQ ID NO: 1612152 - RNA, 17 nt, Human
cuugaggguugggcugg

SEQ ID NO: 1612153 - RNA, 15 nt, Human
cuugaggguugggcu

SEQ ID NO: 1612154 - RNA, 16 nt, Human
cuugagccugggaggu

SEQ ID NO: 1612155 - RNA, 17 nt, Human
cuucuggcacuuggaga

SEQ ID NO: 1612156 - RNA, 21 nt, Human
cuugcagacucuacagaggcc

SEQ ID NO: 1612157 - RNA, 18 nt, Human
cuugcaauggcagccuug

SEQ ID NO: 1612158 - RNA, 17 nt, Human
cuugcaauggcagccuu

SEQ ID NO: 1612159 - RNA, 16 nt, Human
cuugcaauggcagccu

SEQ ID NO: 1612160 - RNA, 15 nt, Human
cuugcaauggcagcc

SEQ ID NO: 1612161 - RNA, 19 nt, Human
cuugaguugauucagcucu

SEQ ID NO: 1612162 - RNA, 18 nt, Human
cuugaguugauucagcuc

SEQ ID NO: 1612163 - RNA, 20 nt, Human
cuugaguugauucagcucug

SEQ ID NO: 1612164 - RNA, 21 nt, Human
cuugaguugauucagcucugc

SEQ ID NO: 1612165 - RNA, 16 nt, Human
gacaucaacugcauca

SEQ ID NO: 1612166 - RNA, 23 nt, Human
gacaucaacugcaucaagaugug

SEQ ID NO: 1612167 - RNA, 22 nt, Human
gacaggcauguucucugaggac

SEQ ID NO: 1612168 - RNA, 14 nt, Human
gacagggcauggcc

SEQ ID NO: 1612169 - RNA, 22 nt, Human
gacagggcauggccagguggcc

SEQ ID NO: 1612170 - RNA, 20 nt, Human
gacagggcauggccaggugg

SEQ ID NO: 1612171 - RNA, 15 nt, Human
gacagggcauggcca

SEQ ID NO: 1612172 - RNA, 23 nt, Human
gacaggaugguucccuugaugaa

SEQ ID NO: 1612173 - RNA, 18 nt, Human
gacaggcaagcaccuccu

SEQ ID NO: 1612174 - RNA, 17 nt, Human
gacaggcaagcaccucc

SEQ ID NO: 1612175 - RNA, 13 nt, Human
gacaggcaagcac

SEQ ID NO: 1612176 - RNA, 19 nt, Human
gacaggcaaugcuggcugu

SEQ ID NO: 1612177 - RNA, 21 nt, Human
gacaggcaagcaccuccugcc

SEQ ID NO: 1612178 - RNA, 20 nt, Human
gacaggcaagcaccuccugc

SEQ ID NO: 1612179 - RNA, 21 nt, Human
gacaggcauguucucugagga

SEQ ID NO: 1612180 - RNA, 23 nt, Human
gacaggcaaugcuggcuguuggc

SEQ ID NO: 1612181 - RNA, 24 nt, Human
gacaggcaaugcuggcuguuggcu

SEQ ID NO: 1612182 - RNA, 16 nt, Human
gacagagugagacucu

SEQ ID NO: 1612183 - RNA, 21 nt, Human
gacagagucucacuguugccc

SEQ ID NO: 1612184 - RNA, 19 nt, Human
gacagagugagacucuguc

SEQ ID NO: 1612185 - RNA, 13 nt, Human
gacagagggggug

SEQ ID NO: 1612186 - RNA, 23 nt, Human
gacagaggcagccccauucugcc

SEQ ID NO: 1612187 - RNA, 20 nt, Human
gacagagcuacacaggggaa

SEQ ID NO: 1612188 - RNA, 12 nt, Human
gacagaggcagc

SEQ ID NO: 1612189 - RNA, 16 nt, Human
gacagacagcccucca

SEQ ID NO: 1612190 - RNA, 18 nt, Human
gaauuucccaaagcagug

SEQ ID NO: 1612191 - RNA, 16 nt, Human
gaauuucccaaagcag

SEQ ID NO: 1612192 - RNA, 22 nt, Human
gaauuucccaaagcagugcaug

SEQ ID NO: 1612193 - RNA, 22 nt, Human
gacacgaauauugcugauggug

SEQ ID NO: 1612194 - RNA, 22 nt, Human
gacagacacaggcccggcucca

SEQ ID NO: 1612195 - RNA, 20 nt, Human
gacagacacaggcccggcuc

SEQ ID NO: 1612196 - RNA, 17 nt, Human
gacagacacaggcccgg

SEQ ID NO: 1612197 - RNA, 16 nt, Human
gacacuagaagauuuu

SEQ ID NO: 1612198 - RNA, 18 nt, Human
gaccacugcagaagacag

SEQ ID NO: 1612199 - RNA, 16 nt, Human
gaccacugcagaagac

SEQ ID NO: 1612200 - RNA, 22 nt, Human
gaccagacaccuugacagggca

SEQ ID NO: 1612201 - RNA, 21 nt, Human
gaccagcaccaucucuccucc

SEQ ID NO: 1612202 - RNA, 20 nt, Human
gaccagcaccaucucuccuc

SEQ ID NO: 1612203 - RNA, 24 nt, Human
gaccagacaccuugacagggcaca

SEQ ID NO: 1612204 - RNA, 23 nt, Human
gaccagacaccuugacagggcac

SEQ ID NO: 1612205 - RNA, 21 nt, Human
gaccagagcugccaccugccu

SEQ ID NO: 1612206 - RNA, 18 nt, Human
gaccacaaaacuuuucua

SEQ ID NO: 1612207 - RNA, 22 nt, Human
gaccacacuccagcugggauca

SEQ ID NO: 1612208 - RNA, 16 nt, Human
gaccacacuccagcug

SEQ ID NO: 1612209 - RNA, 14 nt, Human
gaccacacuccagc

SEQ ID NO: 1612210 - RNA, 19 nt, Human
gacccaaaaggcagaagca

SEQ ID NO: 1612211 - RNA, 18 nt, Human
gacccaaaaggcagaagc

SEQ ID NO: 1612212 - RNA, 20 nt, Human
gacccaaaaggcagaagcaa

SEQ ID NO: 1612213 - RNA, 19 nt, Human
gacccacuggacucaccuc

SEQ ID NO: 1612214 - RNA, 20 nt, Human
gacccaugcugcccugugag

SEQ ID NO: 1612215 - RNA, 19 nt, Human
gacccaugcugcccuguga

SEQ ID NO: 1612216 - RNA, 18 nt, Human
gacccaugcugcccugug

SEQ ID NO: 1612217 - RNA, 13 nt, Human
gacccaugcugcc

SEQ ID NO: 1612218 - RNA, 22 nt, Human
gacccugcccugugggccccca

SEQ ID NO: 1612219 - RNA, 20 nt, Human
gacccugcccugugggcccc

SEQ ID NO: 1612220 - RNA, 18 nt, Human
gacccugaggcccagagg

SEQ ID NO: 1612221 - RNA, 16 nt, Human
gacccugaggcccaga

SEQ ID NO: 1612222 - RNA, 12 nt, Human
gacccugaggcc

SEQ ID NO: 1612223 - RNA, 11 nt, Human
gacccugaggc

SEQ ID NO: 1612224 - RNA, 16 nt, Human
gacugaggggagggga

SEQ ID NO: 1612225 - RNA, 18 nt, Human
gacugaguacguugugca

SEQ ID NO: 1612226 - RNA, 13 nt, Human
gacugagaaauuu

SEQ ID NO: 1612227 - RNA, 20 nt, Human
gacugccagucccccugccc

SEQ ID NO: 1612228 - RNA, 24 nt, Human
gacugcauuauauuuauuacugua

SEQ ID NO: 1612229 - RNA, 16 nt, Human
gacugauucuucagca

SEQ ID NO: 1612230 - RNA, 13 nt, Human
gacugauucuuca

SEQ ID NO: 1612231 - RNA, 21 nt, Human
gacuccugcaggcagccaggc

SEQ ID NO: 1612232 - RNA, 20 nt, Human
gacuccugcaggcagccagg

SEQ ID NO: 1612233 - RNA, 19 nt, Human
gacuccugcaggcagccag

SEQ ID NO: 1612234 - RNA, 18 nt, Human
gacuccugcaggcagcca

SEQ ID NO: 1612235 - RNA, 15 nt, Human
gacuacaggcaccca

SEQ ID NO: 1612236 - RNA, 13 nt, Human
gacuacaggcacc

SEQ ID NO: 1612237 - RNA, 18 nt, Human
gacuacaggcacccacca

SEQ ID NO: 1612238 - RNA, 15 nt, Human
gacucuacagaggcc

SEQ ID NO: 1612239 - RNA, 21 nt, Human
gacucuacagaggccaugggc

SEQ ID NO: 1612240 - RNA, 11 nt, Human
gacugagaaau

SEQ ID NO: 1612241 - RNA, 22 nt, Human
gacuggcacaguuuucugagaa

SEQ ID NO: 1612242 - RNA, 18 nt, Human
gacuggcacaguuuucug

SEQ ID NO: 1612243 - RNA, 14 nt, Human
gacuggcacaguuu

SEQ ID NO: 1612244 - RNA, 23 nt, Human
gacuggccaagguuuggggaaga

SEQ ID NO: 1612245 - RNA, 15 nt, Human
gacuuacuguacaug

SEQ ID NO: 1612246 - RNA, 16 nt, Human
gacuuacuguacauga

SEQ ID NO: 1612247 - RNA, 12 nt, Human
gacuuacuguac

SEQ ID NO: 1612248 - RNA, 18 nt, Human
gacuuacuguacaugaaa

SEQ ID NO: 1612249 - RNA, 23 nt, Human
gacuuacuguacaugaaaacaca

SEQ ID NO: 1612250 - RNA, 20 nt, Human
gacuucaucccucuggggcu

SEQ ID NO: 1612251 - RNA, 12 nt, Human
gacuucaucccu

SEQ ID NO: 1612252 - RNA, 14 nt, Human
gacuucagcucugu

SEQ ID NO: 1612253 - RNA, 15 nt, Human
gacuuagcugggaga

SEQ ID NO: 1612254 - RNA, 14 nt, Human
gaccuugaacuggg

SEQ ID NO: 1612255 - RNA, 21 nt, Human
gaccuucuccuucaccuuugu

SEQ ID NO: 1612256 - RNA, 20 nt, Human
gaccuucuccuucaccuuug

SEQ ID NO: 1612257 - RNA, 16 nt, Human
gaccuucuccuucacc

SEQ ID NO: 1612258 - RNA, 15 nt, Human
gaccuucuccuucac

SEQ ID NO: 1612259 - RNA, 14 nt, Human
gaccuucuccuuca

SEQ ID NO: 1612260 - RNA, 15 nt, Human
gacccuugugguccc

SEQ ID NO: 1612261 - RNA, 23 nt, Human
gacccuugccgucuaccugaggg

SEQ ID NO: 1612262 - RNA, 20 nt, Human
gacccuugccgucuaccuga

SEQ ID NO: 1612263 - RNA, 19 nt, Human
gacccuugccgucuaccug

SEQ ID NO: 1612264 - RNA, 14 nt, Human
gacggagucccacc

SEQ ID NO: 1612265 - RNA, 13 nt, Human
gacggagucccac

SEQ ID NO: 1612266 - RNA, 22 nt, Human
gacgcugugcugcccugcccac

SEQ ID NO: 1612267 - RNA, 20 nt, Human
gaccuuucaauaggaaaaac

SEQ ID NO: 1612268 - RNA, 19 nt, Human
gaccuuucaauaggaaaaa

SEQ ID NO: 1612269 - RNA, 11 nt, Human
gaccuuucaau

SEQ ID NO: 1612270 - RNA, 15 nt, Human
gacguguuaugacuc

SEQ ID NO: 1612271 - RNA, 14 nt, Human
gacguguuaugacu

SEQ ID NO: 1612272 - RNA, 11 nt, Human
gacguguuaug

SEQ ID NO: 1612273 - RNA, 23 nt, Human
gacuaacuugucuuuggacccug

SEQ ID NO: 1612274 - RNA, 16 nt, Human
gacuaacuugucuuug

SEQ ID NO: 1612275 - RNA, 18 nt, Human
gaagauguagaggagaaa

SEQ ID NO: 1612276 - RNA, 15 nt, Human
gaagauacugaaaua

SEQ ID NO: 1612277 - RNA, 20 nt, Human
gaagauaauauuaaggaaga

SEQ ID NO: 1612278 - RNA, 20 nt, Human
gaagagguuuuaaagcuucc

SEQ ID NO: 1612279 - RNA, 18 nt, Human
gaagcauuuacuuugugu

SEQ ID NO: 1612280 - RNA, 17 nt, Human
gaagcauuuacuuugug

SEQ ID NO: 1612281 - RNA, 23 nt, Human
gaagcccuucuaccuuccugcaa

SEQ ID NO: 1612282 - RNA, 19 nt, Human
gaagcccaggaaaggcucc

SEQ ID NO: 1612283 - RNA, 16 nt, Human
gaagcccaggaaaggc

SEQ ID NO: 1612284 - RNA, 15 nt, Human
gaagcccaggaaagg

SEQ ID NO: 1612285 - RNA, 13 nt, Human
gaagcccaggaaa

SEQ ID NO: 1612286 - RNA, 22 nt, Human
gaagccagcaggcucucaggcc

SEQ ID NO: 1612287 - RNA, 21 nt, Human
gaagccagcaggcucucaggc

SEQ ID NO: 1612288 - RNA, 20 nt, Human
gaagccagcaggcucucagg

SEQ ID NO: 1612289 - RNA, 19 nt, Human
gaagacugcauuauauuua

SEQ ID NO: 1612290 - RNA, 12 nt, Human
gaagaacugaaa

SEQ ID NO: 1612291 - RNA, 13 nt, Human
gaagacuuuggaa

SEQ ID NO: 1612292 - RNA, 11 nt, Human
gaagacuuugg

SEQ ID NO: 1612293 - RNA, 23 nt, Human
gaacuuugaccucugcagcaaua

SEQ ID NO: 1612294 - RNA, 21 nt, Human
gaacucaucuagguaaauuac

SEQ ID NO: 1612295 - RNA, 20 nt, Human
gaacucaucuagguaaauua

SEQ ID NO: 1612296 - RNA, 22 nt, Human
gaacucaucuagguaaauuaca

SEQ ID NO: 1612297 - RNA, 17 nt, Human
gaagacuuuggaaagag

SEQ ID NO: 1612298 - RNA, 14 nt, Human
gaagacuuuggaaa

SEQ ID NO: 1612299 - RNA, 20 nt, Human
gaagacuuuucuuucagcca

SEQ ID NO: 1612300 - RNA, 19 nt, Human
gaagagaaugcacaaacag

SEQ ID NO: 1612301 - RNA, 14 nt, Human
gaacuacugaggau

SEQ ID NO: 1612302 - RNA, 22 nt, Human
gaaccuuuugagugccuuacac

SEQ ID NO: 1612303 - RNA, 15 nt, Human
gaacgcguugaaauu

SEQ ID NO: 1612304 - RNA, 21 nt, Human
gaaccuuuugagugccuuaca

SEQ ID NO: 1612305 - RNA, 19 nt, Human
gaaccuuuugagugccuua

SEQ ID NO: 1612306 - RNA, 18 nt, Human
gaaccuuuugagugccuu

SEQ ID NO: 1612307 - RNA, 14 nt, Human
gaacaucccuccug

SEQ ID NO: 1612308 - RNA, 18 nt, Human
gaaauuguauuacaaauc

SEQ ID NO: 1612309 - RNA, 17 nt, Human
gaaauuuauaaacuuuu

SEQ ID NO: 1612310 - RNA, 16 nt, Human
gaaauuuauaaacuuu

SEQ ID NO: 1612311 - RNA, 14 nt, Human
gaacacucugagac

SEQ ID NO: 1612312 - RNA, 13 nt, Human
gaacacucugaga

SEQ ID NO: 1612313 - RNA, 16 nt, Human
gaaauuguauuacaaa

SEQ ID NO: 1612314 - RNA, 23 nt, Human
gaaaauaaaucaaugcuauaacu

SEQ ID NO: 1612315 - RNA, 20 nt, Human
gaacagugauuaccagggac

SEQ ID NO: 1612316 - RNA, 16 nt, Human
gaacagugauuaccag

SEQ ID NO: 1612317 - RNA, 15 nt, Human
gaacacucugagacu

SEQ ID NO: 1612318 - RNA, 15 nt, Human
gaacauaaaauacaa

SEQ ID NO: 1612319 - RNA, 16 nt, Human
gaauauuuuaacuucc

SEQ ID NO: 1612320 - RNA, 13 nt, Human
gaauaccuguccc

SEQ ID NO: 1612321 - RNA, 15 nt, Human
gaauaccuguccccc

SEQ ID NO: 1612322 - RNA, 23 nt, Human
gaauagcugggacuacaggugug

SEQ ID NO: 1612323 - RNA, 22 nt, Human
gaauagcugggacuacaggugu

SEQ ID NO: 1612324 - RNA, 20 nt, Human
gaauacucuuauaucuauau

SEQ ID NO: 1612325 - RNA, 21 nt, Human
gaauacagaggcaacugcauu

SEQ ID NO: 1612326 - RNA, 17 nt, Human
gaauaauacaguaucuc

SEQ ID NO: 1612327 - RNA, 19 nt, Human
gaauaacauguaauuaagu

SEQ ID NO: 1612328 - RNA, 18 nt, Human
gaauaacauguaauuaag

SEQ ID NO: 1612329 - RNA, 20 nt, Human
gaaguuugagaucagccugg

SEQ ID NO: 1612330 - RNA, 14 nt, Human
gaaguauccuucag

SEQ ID NO: 1612331 - RNA, 16 nt, Human
gaaguauccuucagcc

SEQ ID NO: 1612332 - RNA, 22 nt, Human
gaaguccaagcauuuagaugua

SEQ ID NO: 1612333 - RNA, 12 nt, Human
gaaguccaagca

SEQ ID NO: 1612334 - RNA, 15 nt, Human
gaagucuuagaugua

SEQ ID NO: 1612335 - RNA, 21 nt, Human
gaaguuucugccgcagcccug

SEQ ID NO: 1612336 - RNA, 18 nt, Human
gaagucuuagauguauau

SEQ ID NO: 1612337 - RNA, 19 nt, Human
gaagggggcugggacaugg

SEQ ID NO: 1612338 - RNA, 16 nt, Human
gaagggggcugggaca

SEQ ID NO: 1612339 - RNA, 22 nt, Human
gaaguaauaugcacacauuuuu

SEQ ID NO: 1612340 - RNA, 18 nt, Human
gaaguacuauaauuuacc

SEQ ID NO: 1612341 - RNA, 15 nt, Human
gaaguacuggagaaa

SEQ ID NO: 1612342 - RNA, 11 nt, Human
gaauucuguau

SEQ ID NO: 1612343 - RNA, 19 nt, Human
gaauucucuaguuugauua

SEQ ID NO: 1612344 - RNA, 14 nt, Human
gaauugaagcagga

SEQ ID NO: 1612345 - RNA, 14 nt, Human
gaauugaaaaacca

SEQ ID NO: 1612346 - RNA, 17 nt, Human
gaauucucagaaucuca

SEQ ID NO: 1612347 - RNA, 17 nt, Human
gaauucucuaguuugau

SEQ ID NO: 1612348 - RNA, 21 nt, Human
gaaugucagugugacugaucu

SEQ ID NO: 1612349 - RNA, 20 nt, Human
gaaugucagugugacugauc

SEQ ID NO: 1612350 - RNA, 15 nt, Human
gaauuucccaaagca

SEQ ID NO: 1612351 - RNA, 22 nt, Human
gaauuuauuggcuuuucugauc

SEQ ID NO: 1612352 - RNA, 21 nt, Human
gaauuuauuggcuuuucugau

SEQ ID NO: 1612353 - RNA, 20 nt, Human
gaauuuauuggcuuuucuga

SEQ ID NO: 1612354 - RNA, 16 nt, Human
gaauuuauuggcuuuu

SEQ ID NO: 1612355 - RNA, 14 nt, Human
gaauuuauuggcuu

SEQ ID NO: 1612356 - RNA, 22 nt, Human
gaauuguaaggaaugauuaauu

SEQ ID NO: 1612357 - RNA, 22 nt, Human
gaauuuaaauagcuuuuuucuc

SEQ ID NO: 1612358 - RNA, 23 nt, Human
gaauuguguuuauaauuuuaaau

SEQ ID NO: 1612359 - RNA, 15 nt, Human
gaauuguguuuauaa

SEQ ID NO: 1612360 - RNA, 14 nt, Human
gaaugucaguguga

SEQ ID NO: 1612361 - RNA, 22 nt, Human
gaaugguuuucaaaauaaaaau

SEQ ID NO: 1612362 - RNA, 23 nt, Human
gaaugguccgugcuaaggacuug

SEQ ID NO: 1612363 - RNA, 22 nt, Human
gaaugguccgugcuaaggacuu

SEQ ID NO: 1612364 - RNA, 20 nt, Human
gaaugguccgugcuaaggac

SEQ ID NO: 1612365 - RNA, 23 nt, Human
gaaugaaccacaucuugcucugc

SEQ ID NO: 1612366 - RNA, 22 nt, Human
gaaugaaccacaucuugcucug

SEQ ID NO: 1612367 - RNA, 19 nt, Human
gaaugaagauacugaaaua

SEQ ID NO: 1612368 - RNA, 21 nt, Human
gaaugaagauacugaaauaaa

SEQ ID NO: 1612369 - RNA, 18 nt, Human
gaaugaagauacugaaau

SEQ ID NO: 1612370 - RNA, 17 nt, Human
gaaugaagauacugaaa

SEQ ID NO: 1612371 - RNA, 14 nt, Human
gaaugcauaaaaug

SEQ ID NO: 1612372 - RNA, 13 nt, Human
gaaugcuuuagga

SEQ ID NO: 1612373 - RNA, 20 nt, Human
gaguucauacccuguuacca

SEQ ID NO: 1612374 - RNA, 12 nt, Human
gaguguugaaac

SEQ ID NO: 1612375 - RNA, 13 nt, Human
gauaaacaguagu

SEQ ID NO: 1612376 - RNA, 13 nt, Human
gaguucugguucc

SEQ ID NO: 1612377 - RNA, 14 nt, Human
gauaauacaccacu

SEQ ID NO: 1612378 - RNA, 22 nt, Human
gauaauaaggaaaaguuuaaua

SEQ ID NO: 1612379 - RNA, 12 nt, Human
gauaauacacca

SEQ ID NO: 1612380 - RNA, 23 nt, Human
gauaauacaccacuacauucugu

SEQ ID NO: 1612381 - RNA, 24 nt, Human
gauaauacaccacuacauucuguu

SEQ ID NO: 1612382 - RNA, 21 nt, Human
gauaauaaggaaaaguuuaau

SEQ ID NO: 1612383 - RNA, 20 nt, Human
gauaauaaggaaaaguuuaa

SEQ ID NO: 1612384 - RNA, 17 nt, Human
gauaggucagugcaaau

SEQ ID NO: 1612385 - RNA, 17 nt, Human
gauacaaaagcauguga

SEQ ID NO: 1612386 - RNA, 16 nt, Human
gauacaaaagcaugug

SEQ ID NO: 1612387 - RNA, 18 nt, Human
gauaauucuagcuuugag

SEQ ID NO: 1612388 - RNA, 20 nt, Human
gauagugucccacggugccu

SEQ ID NO: 1612389 - RNA, 18 nt, Human
gauauaugcucugcaugu

SEQ ID NO: 1612390 - RNA, 23 nt, Human
gaucagcuuauugucuagugaaa

SEQ ID NO: 1612391 - RNA, 23 nt, Human
gaucacggcucacugcagccuca

SEQ ID NO: 1612392 - RNA, 16 nt, Human
gaucacauguggacuu

SEQ ID NO: 1612393 - RNA, 13 nt, Human
gaucuuuaaaaua

SEQ ID NO: 1612394 - RNA, 16 nt, Human
gaugaaauguaaauac

SEQ ID NO: 1612395 - RNA, 21 nt, Human
gaugaaaugaggucagagccu

SEQ ID NO: 1612396 - RNA, 15 nt, Human
gaugaaaugagguca

SEQ ID NO: 1612397 - RNA, 19 nt, Human
gaucuucuuuauaauucua

SEQ ID NO: 1612398 - RNA, 22 nt, Human
gaucuucuguggguuucuaaag

SEQ ID NO: 1612399 - RNA, 23 nt, Human
gaugcaccagcccuuagcaggga

SEQ ID NO: 1612400 - RNA, 15 nt, Human
gaugcaccagcccuu

SEQ ID NO: 1612401 - RNA, 14 nt, Human
gaugagaggaaauc

SEQ ID NO: 1612402 - RNA, 20 nt, Human
gaugaccuugaaugaugcca

SEQ ID NO: 1612403 - RNA, 18 nt, Human
gaugaccuugaaugaugc

SEQ ID NO: 1612404 - RNA, 16 nt, Human
gaugccugguggcagc

SEQ ID NO: 1612405 - RNA, 15 nt, Human
gaugccugguggcag

SEQ ID NO: 1612406 - RNA, 14 nt, Human
gaugcagugcuucc

SEQ ID NO: 1612407 - RNA, 16 nt, Human
gaugagaggaaaucac

SEQ ID NO: 1612408 - RNA, 14 nt, Human
gauccuggaaauca

SEQ ID NO: 1612409 - RNA, 12 nt, Human
gauccugagcca

SEQ ID NO: 1612410 - RNA, 13 nt, Human
gauccugagccag

SEQ ID NO: 1612411 - RNA, 16 nt, Human
gauccucccaggcuuc

SEQ ID NO: 1612412 - RNA, 20 nt, Human
gaucuaggaagacuuuggaa

SEQ ID NO: 1612413 - RNA, 17 nt, Human
gaucuaguucacucucc

SEQ ID NO: 1612414 - RNA, 18 nt, Human
gaucuaggaagacuuugg

SEQ ID NO: 1612415 - RNA, 14 nt, Human
gaucuaggaagacu

SEQ ID NO: 1612416 - RNA, 13 nt, Human
gaucuaggaagac

SEQ ID NO: 1612417 - RNA, 16 nt, Human
gaucauccacugugcc

SEQ ID NO: 1612418 - RNA, 13 nt, Human
gaucauccacugu

SEQ ID NO: 1612419 - RNA, 18 nt, Human
gauccucccaccucagcc

SEQ ID NO: 1612420 - RNA, 17 nt, Human
gauccucccaccucagc

SEQ ID NO: 1612421 - RNA, 16 nt, Human
gauccucccaccucag

SEQ ID NO: 1612422 - RNA, 14 nt, Human
gauccuccaggugc

SEQ ID NO: 1612423 - RNA, 18 nt, Human
gauccuaggcauuugcug

SEQ ID NO: 1612424 - RNA, 23 nt, Human
gauccuaaugaaugcauaaaaug

SEQ ID NO: 1612425 - RNA, 16 nt, Human
gcaagaugugggcagu

SEQ ID NO: 1612426 - RNA, 12 nt, Human
gcaagauguggg

SEQ ID NO: 1612427 - RNA, 22 nt, Human
gcaacuuuguauaaaagggacu

SEQ ID NO: 1612428 - RNA, 20 nt, Human
gcaagcaccuccugccucga

SEQ ID NO: 1612429 - RNA, 18 nt, Human
gcaagcaccuccugccuc

SEQ ID NO: 1612430 - RNA, 16 nt, Human
gcaagcaccuccugcc

SEQ ID NO: 1612431 - RNA, 15 nt, Human
gcaagcaccuccugc

SEQ ID NO: 1612432 - RNA, 18 nt, Human
gcaagcaagaaacacugg

SEQ ID NO: 1612433 - RNA, 18 nt, Human
gcaaggcugucaauuaca

SEQ ID NO: 1612434 - RNA, 14 nt, Human
gcaaggcugucaau

SEQ ID NO: 1612435 - RNA, 21 nt, Human
gcaagggaauuucuucaacuc

SEQ ID NO: 1612436 - RNA, 17 nt, Human
gcaauccugcaagaaca

SEQ ID NO: 1612437 - RNA, 18 nt, Human
gcaacugcauuggcuuug

SEQ ID NO: 1612438 - RNA, 23 nt, Human
gcaaaugugaaucauuuuaccuu

SEQ ID NO: 1612439 - RNA, 12 nt, Human
gcaaaugugaau

SEQ ID NO: 1612440 - RNA, 20 nt, Human
gcaaacuuuauuuuguguuu

SEQ ID NO: 1612441 - RNA, 23 nt, Human
gcaaaguucccuacuuccuguga

SEQ ID NO: 1612442 - RNA, 21 nt, Human
gcaaaccaucauugaaaucuu

SEQ ID NO: 1612443 - RNA, 20 nt, Human
gcaaaccaucauugaaaucu

SEQ ID NO: 1612444 - RNA, 19 nt, Human
gcaaaccaucauugaaauc

SEQ ID NO: 1612445 - RNA, 17 nt, Human
gcaaaccaucauugaaa

SEQ ID NO: 1612446 - RNA, 16 nt, Human
gcaaaccaucauugaa

SEQ ID NO: 1612447 - RNA, 18 nt, Human
gcaaacuuuauuuugugu

SEQ ID NO: 1612448 - RNA, 16 nt, Human
gaugcuagaacucccu

SEQ ID NO: 1612449 - RNA, 20 nt, Human
gaugcgggccagugcuccag

SEQ ID NO: 1612450 - RNA, 17 nt, Human
gaugccugguggcagcu

SEQ ID NO: 1612451 - RNA, 20 nt, Human
gaugccugugaacugaacuc

SEQ ID NO: 1612452 - RNA, 18 nt, Human
gauguucuagcauggcug

SEQ ID NO: 1612453 - RNA, 22 nt, Human
gaugcgggccagugcuccagcc

SEQ ID NO: 1612454 - RNA, 14 nt, Human
gauuaaguaaugau

SEQ ID NO: 1612455 - RNA, 21 nt, Human
gauguuuuaaggaugcuugua

SEQ ID NO: 1612456 - RNA, 22 nt, Human
gauuaaguaaugauaacuggaa

SEQ ID NO: 1612457 - RNA, 14 nt, Human
gauguucugggaca

SEQ ID NO: 1612458 - RNA, 18 nt, Human
gauucagacagcugccug

SEQ ID NO: 1612459 - RNA, 17 nt, Human
gauucagacagcugccu

SEQ ID NO: 1612460 - RNA, 14 nt, Human
gauucagacagcug

SEQ ID NO: 1612461 - RNA, 13 nt, Human
gauucagacagcu

SEQ ID NO: 1612462 - RNA, 21 nt, Human
gauuacaagcgugagccacug

SEQ ID NO: 1612463 - RNA, 13 nt, Human
gauuacaagcgug

SEQ ID NO: 1612464 - RNA, 15 nt, Human
gauucccaagcucug

SEQ ID NO: 1612465 - RNA, 16 nt, Human
gauugcaacaggcugg

SEQ ID NO: 1612466 - RNA, 22 nt, Human
gauucuuuccugaggcugggcu

SEQ ID NO: 1612467 - RNA, 20 nt, Human
gauucuuuccugaggcuggg

SEQ ID NO: 1612468 - RNA, 18 nt, Human
gauucccaagcucugcuc

SEQ ID NO: 1612469 - RNA, 19 nt, Human
gauucuuuccugaggcugg

SEQ ID NO: 1612470 - RNA, 17 nt, Human
gauucccaagcucugcu

SEQ ID NO: 1612471 - RNA, 16 nt, Human
gauucccaagcucugc

SEQ ID NO: 1612472 - RNA, 18 nt, Human
gauugcuugagcucagga

SEQ ID NO: 1612473 - RNA, 18 nt, Human
gauugcaacaggcugggc

SEQ ID NO: 1612474 - RNA, 17 nt, Human
gauugcaacaggcuggg

SEQ ID NO: 1612475 - RNA, 22 nt, Human
gauuucuguuuagauaauacac

SEQ ID NO: 1612476 - RNA, 21 nt, Human
gauuucuguuuagauaauaca

SEQ ID NO: 1612477 - RNA, 12 nt, Human
gauuuaaaucag

SEQ ID NO: 1612478 - RNA, 16 nt, Human
gauugggaauccgccc

SEQ ID NO: 1612479 - RNA, 17 nt, Human
gcagaguugaagacaga

SEQ ID NO: 1612480 - RNA, 16 nt, Human
gcagaguugaagacag

SEQ ID NO: 1612481 - RNA, 19 nt, Human
gcagaguugaagacagagc

SEQ ID NO: 1612482 - RNA, 20 nt, Human
gcagaguugaagacagagcu

SEQ ID NO: 1612483 - RNA, 12 nt, Human
gcagcaauaaag

SEQ ID NO: 1612484 - RNA, 19 nt, Human
gcagagaccaucccugaag

SEQ ID NO: 1612485 - RNA, 17 nt, Human
gcagagaccaucccuga

SEQ ID NO: 1612486 - RNA, 15 nt, Human
gcagagaccaucccu

SEQ ID NO: 1612487 - RNA, 14 nt, Human
gcagagaccauccc

SEQ ID NO: 1612488 - RNA, 15 nt, Human
gcagaguugaagaca

SEQ ID NO: 1612489 - RNA, 21 nt, Human
gcagagaauucucuuauccaa

SEQ ID NO: 1612490 - RNA, 23 nt, Human
gcagagaaugaaagggcccagag

SEQ ID NO: 1612491 - RNA, 22 nt, Human
gcagagaaugaaagggcccaga

SEQ ID NO: 1612492 - RNA, 21 nt, Human
gcagagaaugaaagggcccag

SEQ ID NO: 1612493 - RNA, 20 nt, Human
gcagagaaugaaagggccca

SEQ ID NO: 1612494 - RNA, 19 nt, Human
gcagagaaugaaagggccc

SEQ ID NO: 1612495 - RNA, 18 nt, Human
gcagaaggaagacuucau

SEQ ID NO: 1612496 - RNA, 20 nt, Human
gcaggaggaucacuugaguc

SEQ ID NO: 1612497 - RNA, 21 nt, Human
gcaggaguuucguuuucaaaa

SEQ ID NO: 1612498 - RNA, 20 nt, Human
gcaggaguuucguuuucaaa

SEQ ID NO: 1612499 - RNA, 18 nt, Human
gcagccgugccuucagcu

SEQ ID NO: 1612500 - RNA, 22 nt, Human
gcagccucaaccuccugggcua

SEQ ID NO: 1612501 - RNA, 21 nt, Human
gcagccucaaccuccugggcu

SEQ ID NO: 1612502 - RNA, 14 nt, Human
gcagccuggacccu

SEQ ID NO: 1612503 - RNA, 20 nt, Human
gcagccucaaccuccugggc

SEQ ID NO: 1612504 - RNA, 19 nt, Human
gcagccucaaccuccuggg

SEQ ID NO: 1612505 - RNA, 14 nt, Human
gcagccgugccuuc

SEQ ID NO: 1612506 - RNA, 17 nt, Human
gcagccgugccuucagc

SEQ ID NO: 1612507 - RNA, 15 nt, Human
gcagccgugccuuca

SEQ ID NO: 1612508 - RNA, 20 nt, Human
gcacagccucuuagaugcag

SEQ ID NO: 1612509 - RNA, 15 nt, Human
gcaaugaccuuucaa

SEQ ID NO: 1612510 - RNA, 14 nt, Human
gcaaugaccuuuca

SEQ ID NO: 1612511 - RNA, 13 nt, Human
gcaaugaccuuuc

SEQ ID NO: 1612512 - RNA, 19 nt, Human
gcacagcuaacauggaagu

SEQ ID NO: 1612513 - RNA, 16 nt, Human
gcacagcuucauuucc

SEQ ID NO: 1612514 - RNA, 21 nt, Human
gcacagcuucauuuccugugu

SEQ ID NO: 1612515 - RNA, 20 nt, Human
gcaccacugcacuccagccu

SEQ ID NO: 1612516 - RNA, 19 nt, Human
gcaccacugcacuccagcc

SEQ ID NO: 1612517 - RNA, 15 nt, Human
gcaccuccugccucg

SEQ ID NO: 1612518 - RNA, 14 nt, Human
gcaccuccugccuc

SEQ ID NO: 1612519 - RNA, 17 nt, Human
gcacccggccccugcug

SEQ ID NO: 1612520 - RNA, 15 nt, Human
gcacccggccccugc

SEQ ID NO: 1612521 - RNA, 14 nt, Human
gcacccggccccug

SEQ ID NO: 1612522 - RNA, 14 nt, Human
gcagaagacaguau

SEQ ID NO: 1612523 - RNA, 14 nt, Human
gcagaaggaagacu

SEQ ID NO: 1612524 - RNA, 13 nt, Human
gcagaaggaagac

SEQ ID NO: 1612525 - RNA, 12 nt, Human
gcagaaggaaga

SEQ ID NO: 1612526 - RNA, 15 nt, Human
gcacugucaagauga

SEQ ID NO: 1612527 - RNA, 23 nt, Human
gcacugggcuuggggaccagagc

SEQ ID NO: 1612528 - RNA, 22 nt, Human
gcacugggcuuggggaccagag

SEQ ID NO: 1612529 - RNA, 18 nt, Human
gcacccggccccugcugg

SEQ ID NO: 1612530 - RNA, 17 nt, Human
gcacuaaggugugcucu

SEQ ID NO: 1612531 - RNA, 18 nt, Human
gcacuaaggugugcucug

SEQ ID NO: 1612532 - RNA, 19 nt, Human
gcacuaaggugugcucuga

SEQ ID NO: 1612533 - RNA, 17 nt, Human
gcacugaggaccagcca

SEQ ID NO: 1612534 - RNA, 14 nt, Human
gcaguucugaagaa

SEQ ID NO: 1612535 - RNA, 13 nt, Human
gcaguucugaaga

SEQ ID NO: 1612536 - RNA, 18 nt, Human
gcauagauucccugagca

SEQ ID NO: 1612537 - RNA, 18 nt, Human
gcagugggagcugccugu

SEQ ID NO: 1612538 - RNA, 17 nt, Human
gcagugggagcugccug

SEQ ID NO: 1612539 - RNA, 15 nt, Human
gcauauucaggaagc

SEQ ID NO: 1612540 - RNA, 23 nt, Human
gcauauuauuuuauguugcauag

SEQ ID NO: 1612541 - RNA, 18 nt, Human
gcauauuauuuuauguug

SEQ ID NO: 1612542 - RNA, 20 nt, Human
gcauauauuuuuauauuuac

SEQ ID NO: 1612543 - RNA, 16 nt, Human
gcauauauuuuuauau

SEQ ID NO: 1612544 - RNA, 11 nt, Human
gcauauauuuu

SEQ ID NO: 1612545 - RNA, 15 nt, Human
gcauauauuuuuaua

SEQ ID NO: 1612546 - RNA, 14 nt, Human
gcauauauuuuuau

SEQ ID NO: 1612547 - RNA, 20 nt, Human
gcauauucaggaagcucagg

SEQ ID NO: 1612548 - RNA, 18 nt, Human
gcauauucaggaagcuca

SEQ ID NO: 1612549 - RNA, 17 nt, Human
gcauauucaggaagcuc

SEQ ID NO: 1612550 - RNA, 21 nt, Human
gcaucaagaugugacauguuu

SEQ ID NO: 1612551 - RNA, 19 nt, Human
gcauauuuauaaaaauaaa

SEQ ID NO: 1612552 - RNA, 15 nt, Human
gcaggcuacugucag

SEQ ID NO: 1612553 - RNA, 17 nt, Human
gcagggagggccugggc

SEQ ID NO: 1612554 - RNA, 14 nt, Human
gcagggagggccug

SEQ ID NO: 1612555 - RNA, 20 nt, Human
gcaggauucuuccucccucc

SEQ ID NO: 1612556 - RNA, 12 nt, Human
gcagggcucagc

SEQ ID NO: 1612557 - RNA, 14 nt, Human
gcagggcucagcgg

SEQ ID NO: 1612558 - RNA, 16 nt, Human
gcagggagggcuucug

SEQ ID NO: 1612559 - RNA, 22 nt, Human
gcagggagggccugggccccag

SEQ ID NO: 1612560 - RNA, 18 nt, Human
gcagggagggccugggcc

SEQ ID NO: 1612561 - RNA, 16 nt, Human
gcagugggagcugccu

SEQ ID NO: 1612562 - RNA, 23 nt, Human
gcagugcuuccaaggauggacca

SEQ ID NO: 1612563 - RNA, 11 nt, Human
gcaggucccua

SEQ ID NO: 1612564 - RNA, 10 nt, Human
gcaggucccu

SEQ ID NO: 1612565 - RNA, 13 nt, Human
gcaggucccuaau

SEQ ID NO: 1612566 - RNA, 12 nt, Human
gcaggucccuaa

SEQ ID NO: 1612567 - RNA, 20 nt, Human
gcaugacacgaauauugcug

SEQ ID NO: 1612568 - RNA, 17 nt, Human
gcaugaauuugugaagg

SEQ ID NO: 1612569 - RNA, 22 nt, Human
gcaugccuggauggggcugcac

SEQ ID NO: 1612570 - RNA, 17 nt, Human
gcaugccuggauggggc

SEQ ID NO: 1612571 - RNA, 15 nt, Human
gcaucaggccaggcc

SEQ ID NO: 1612572 - RNA, 17 nt, Human
gcaucaggccaggcccu

SEQ ID NO: 1612573 - RNA, 16 nt, Human
gcaucaggccaggccc

SEQ ID NO: 1612574 - RNA, 15 nt, Human
gcaugaauuugugaa

SEQ ID NO: 1612575 - RNA, 15 nt, Human
gcaugcugucccuua

SEQ ID NO: 1612576 - RNA, 17 nt, Human
gcauguuugugauugac

SEQ ID NO: 1612577 - RNA, 20 nt, Human
gcauuagauuucucauuugc

SEQ ID NO: 1612578 - RNA, 22 nt, Human
gcauuuugcuaaaugugaauga

SEQ ID NO: 1612579 - RNA, 20 nt, Human
gccaaaggaagcacaugccu

SEQ ID NO: 1612580 - RNA, 16 nt, Human
gccaaaggaagcacau

SEQ ID NO: 1612581 - RNA, 14 nt, Human
gccaaaggaagcac

SEQ ID NO: 1612582 - RNA, 21 nt, Human
gccaaacucaccugccccuca

SEQ ID NO: 1612583 - RNA, 12 nt, Human
gcauuccccacu

SEQ ID NO: 1612584 - RNA, 12 nt, Human
gcauuccccagg

SEQ ID NO: 1612585 - RNA, 15 nt, Human
gcauucucacuccua

SEQ ID NO: 1612586 - RNA, 13 nt, Human
gcauucucacucc

SEQ ID NO: 1612587 - RNA, 18 nt, Human
gcauucucacuccuaccu

SEQ ID NO: 1612588 - RNA, 21 nt, Human
gcauuuggugguuucagaaau

SEQ ID NO: 1612589 - RNA, 23 nt, Human
gcauuugcugaauacagaggcaa

SEQ ID NO: 1612590 - RNA, 17 nt, Human
gcauuuuacuguacaga

SEQ ID NO: 1612591 - RNA, 16 nt, Human
gcauuuuacuguacag

SEQ ID NO: 1612592 - RNA, 19 nt, Human
gcccuucuuuccacagaag

SEQ ID NO: 1612593 - RNA, 13 nt, Human
gcccuucucucca

SEQ ID NO: 1612594 - RNA, 22 nt, Human
gcccuuccucuccacugccuuc

SEQ ID NO: 1612595 - RNA, 16 nt, Human
gccgagauagccaagg

SEQ ID NO: 1612596 - RNA, 19 nt, Human
gccgcagcccugcagaggg

SEQ ID NO: 1612597 - RNA, 17 nt, Human
gccgcagcccugcagag

SEQ ID NO: 1612598 - RNA, 16 nt, Human
gccgcagcccugcaga

SEQ ID NO: 1612599 - RNA, 15 nt, Human
gccgcagcccugcag

SEQ ID NO: 1612600 - RNA, 19 nt, Human
gccgagauagccaaggcca

SEQ ID NO: 1612601 - RNA, 17 nt, Human
gccgagauagccaaggc

SEQ ID NO: 1612602 - RNA, 23 nt, Human
gccgucuaccugaggggccucuu

SEQ ID NO: 1612603 - RNA, 22 nt, Human
gccgucuaccugaggggccucu

SEQ ID NO: 1612604 - RNA, 20 nt, Human
gccgucuaccugaggggccu

SEQ ID NO: 1612605 - RNA, 18 nt, Human
gccgucuaccugaggggc

SEQ ID NO: 1612606 - RNA, 11 nt, Human
gccuaaaucca

SEQ ID NO: 1612607 - RNA, 15 nt, Human
gccguggcuucccgc

SEQ ID NO: 1612608 - RNA, 13 nt, Human
gccguggcuuccc

SEQ ID NO: 1612609 - RNA, 12 nt, Human
gccguggcuucc

SEQ ID NO: 1612610 - RNA, 11 nt, Human
gccguggcuuc

SEQ ID NO: 1612611 - RNA, 21 nt, Human
gccucagcauccuggcacccg

SEQ ID NO: 1612612 - RNA, 18 nt, Human
gccucagcauccuggcac

SEQ ID NO: 1612613 - RNA, 24 nt, Human
gccucaagugauucuccugccuca

SEQ ID NO: 1612614 - RNA, 22 nt, Human
gccucaagugauucuccugccu

SEQ ID NO: 1612615 - RNA, 17 nt, Human
gccuauuuuaauaaaca

SEQ ID NO: 1612616 - RNA, 13 nt, Human
gccuaaggacuuc

SEQ ID NO: 1612617 - RNA, 12 nt, Human
gccuaaggacuu

SEQ ID NO: 1612618 - RNA, 14 nt, Human
gccuaaggcugaac

SEQ ID NO: 1612619 - RNA, 18 nt, Human
gccuaaggacuucuuuaa

SEQ ID NO: 1612620 - RNA, 15 nt, Human
gccuaaggacuucuu

SEQ ID NO: 1612621 - RNA, 14 nt, Human
gccuaaggacuucu

SEQ ID NO: 1612622 - RNA, 16 nt, Human
gccuccccuccucugc

SEQ ID NO: 1612623 - RNA, 21 nt, Human
gccucccgaauagcugggacu

SEQ ID NO: 1612624 - RNA, 20 nt, Human
gccucccgaauagcugggac

SEQ ID NO: 1612625 - RNA, 23 nt, Human
gccucccgaguagcugggacuac

SEQ ID NO: 1612626 - RNA, 21 nt, Human
gccucccgaguagcugggacu

SEQ ID NO: 1612627 - RNA, 11 nt, Human
gccuccccucc

SEQ ID NO: 1612628 - RNA, 12 nt, Human
gccuccccuccu

SEQ ID NO: 1612629 - RNA, 13 nt, Human
gccuccccuccuc

SEQ ID NO: 1612630 - RNA, 14 nt, Human
gccuccccuccucu

SEQ ID NO: 1612631 - RNA, 19 nt, Human
gccucccgaauagcuggga

SEQ ID NO: 1612632 - RNA, 18 nt, Human
gccucccgaauagcuggg

SEQ ID NO: 1612633 - RNA, 22 nt, Human
gccucagccucccaaagugcug

SEQ ID NO: 1612634 - RNA, 14 nt, Human
gccucagccuccca

SEQ ID NO: 1612635 - RNA, 12 nt, Human
gccucagccucc

SEQ ID NO: 1612636 - RNA, 15 nt, Human
gccucucccaucacu

SEQ ID NO: 1612637 - RNA, 18 nt, Human
gccucucugcaggucccu

SEQ ID NO: 1612638 - RNA, 17 nt, Human
gccucucugcagguccc

SEQ ID NO: 1612639 - RNA, 16 nt, Human
gccucucugcaggucc

SEQ ID NO: 1612640 - RNA, 14 nt, Human
gccucucugcaggu

SEQ ID NO: 1612641 - RNA, 10 nt, Human
gccucucugc

SEQ ID NO: 1612642 - RNA, 12 nt, Human
gccugcccaggc

SEQ ID NO: 1612643 - RNA, 11 nt, Human
gccugcccagg

SEQ ID NO: 1612644 - RNA, 14 nt, Human
gccuggacccugug

SEQ ID NO: 1612645 - RNA, 20 nt, Human
gccucugcacuccccugcug

SEQ ID NO: 1612646 - RNA, 19 nt, Human
gccucugcacuccccugcu

SEQ ID NO: 1612647 - RNA, 18 nt, Human
gccucugcacuccccugc

SEQ ID NO: 1612648 - RNA, 17 nt, Human
gccucugcacuccccug

SEQ ID NO: 1612649 - RNA, 16 nt, Human
gccucugcacuccccu

SEQ ID NO: 1612650 - RNA, 16 nt, Human
gccucugacacacagc

SEQ ID NO: 1612651 - RNA, 15 nt, Human
gccucugacacacag

SEQ ID NO: 1612652 - RNA, 15 nt, Human
gccugaagucacaca

SEQ ID NO: 1612653 - RNA, 21 nt, Human
gccucugcacuccccugcugg

SEQ ID NO: 1612654 - RNA, 12 nt, Human
gccucugcauuc

SEQ ID NO: 1612655 - RNA, 15 nt, Human
gccucugcauucagg

SEQ ID NO: 1612656 - RNA, 18 nt, Human
gccuguaaucacagcuac

SEQ ID NO: 1612657 - RNA, 17 nt, Human
gccugguggcagcugcg

SEQ ID NO: 1612658 - RNA, 16 nt, Human
gccugguggcagcugc

SEQ ID NO: 1612659 - RNA, 15 nt, Human
gccugguggcagcug

SEQ ID NO: 1612660 - RNA, 22 nt, Human
gccuuauggaacacucugagac

SEQ ID NO: 1612661 - RNA, 21 nt, Human
gccuuauggaacacucugaga

SEQ ID NO: 1612662 - RNA, 23 nt, Human
gccuuauggaacacucugagacu

SEQ ID NO: 1612663 - RNA, 17 nt, Human
gccuuagaaccuuucuu

SEQ ID NO: 1612664 - RNA, 20 nt, Human
gccuuagaagucacacagua

SEQ ID NO: 1612665 - RNA, 16 nt, Human
gccuuagaaccuuucu

SEQ ID NO: 1612666 - RNA, 18 nt, Human
gccuucggccuccauccu

SEQ ID NO: 1612667 - RNA, 13 nt, Human
gccuucagcucua

SEQ ID NO: 1612668 - RNA, 16 nt, Human
gccuucagcucuacag

SEQ ID NO: 1612669 - RNA, 19 nt, Human
gccuucggccuccauccug

SEQ ID NO: 1612670 - RNA, 18 nt, Human
gccuuggggcugaugcag

SEQ ID NO: 1612671 - RNA, 23 nt, Human
gccuuuuucauuauuuuauuaug

SEQ ID NO: 1612672 - RNA, 22 nt, Human
gccuuuuucauuauuuuauuau

SEQ ID NO: 1612673 - RNA, 20 nt, Human
gccuuuuucauuauuuuauu

SEQ ID NO: 1612674 - RNA, 16 nt, Human
gccuuuuucauuauuu

SEQ ID NO: 1612675 - RNA, 12 nt, Human
gccuuuuucauu

SEQ ID NO: 1612676 - RNA, 23 nt, Human
gcgguccacccaggagccccgag

SEQ ID NO: 1612677 - RNA, 23 nt, Human
gcggggacagcuccuucuguccu

SEQ ID NO: 1612678 - RNA, 19 nt, Human
gcggggacagcuccuucug

SEQ ID NO: 1612679 - RNA, 23 nt, Human
gcggacagccacggccaggccag

SEQ ID NO: 1612680 - RNA, 19 nt, Human
gcggacagccacggccagg

SEQ ID NO: 1612681 - RNA, 19 nt, Human
gcggaaugaaccacaucuu

SEQ ID NO: 1612682 - RNA, 17 nt, Human
gcgcugccccuggcagc

SEQ ID NO: 1612683 - RNA, 14 nt, Human
gcgcugccccuggc

SEQ ID NO: 1612684 - RNA, 21 nt, Human
gcgccuacaggagugagcacu

SEQ ID NO: 1612685 - RNA, 20 nt, Human
gcgccuacaggagugagcac

SEQ ID NO: 1612686 - RNA, 22 nt, Human
gcuagacgagcaggcuucuucc

SEQ ID NO: 1612687 - RNA, 21 nt, Human
gcuagacgagcaggcuucuuc

SEQ ID NO: 1612688 - RNA, 22 nt, Human
gcuagacuggugacugauucuu

SEQ ID NO: 1612689 - RNA, 20 nt, Human
gcuagacuggugacugauuc

SEQ ID NO: 1612690 - RNA, 19 nt, Human
gcuagacuggugacugauu

SEQ ID NO: 1612691 - RNA, 16 nt, Human
gcuagacuggugacug

SEQ ID NO: 1612692 - RNA, 15 nt, Human
gcuagacuggugacu

SEQ ID NO: 1612693 - RNA, 13 nt, Human
gcuagacugguga

SEQ ID NO: 1612694 - RNA, 18 nt, Human
gcuaacauggaaguacua

SEQ ID NO: 1612695 - RNA, 17 nt, Human
gcuaacauggaaguacu

SEQ ID NO: 1612696 - RNA, 15 nt, Human
gcgugagccacugca

SEQ ID NO: 1612697 - RNA, 16 nt, Human
gcgugagccacugcac

SEQ ID NO: 1612698 - RNA, 16 nt, Human
gcgugagaccugcccc

SEQ ID NO: 1612699 - RNA, 14 nt, Human
gcgugagccacugc

SEQ ID NO: 1612700 - RNA, 22 nt, Human
gccacguucuuacuaguuuccc

SEQ ID NO: 1612701 - RNA, 16 nt, Human
gccacggccaggccag

SEQ ID NO: 1612702 - RNA, 17 nt, Human
gccacggccaggccaga

SEQ ID NO: 1612703 - RNA, 21 nt, Human
gccacuauuguuagucucuug

SEQ ID NO: 1612704 - RNA, 15 nt, Human
gccacggccaggcca

SEQ ID NO: 1612705 - RNA, 14 nt, Human
gccacggccaggcc

SEQ ID NO: 1612706 - RNA, 13 nt, Human
gccaaagccaaag

SEQ ID NO: 1612707 - RNA, 18 nt, Human
gccacugcaccgggccac

SEQ ID NO: 1612708 - RNA, 17 nt, Human
gccacugcaccgggcca

SEQ ID NO: 1612709 - RNA, 19 nt, Human
gccacugcaccgggccaca

SEQ ID NO: 1612710 - RNA, 19 nt, Human
gccacuccagaccccuggc

SEQ ID NO: 1612711 - RNA, 18 nt, Human
gccacuccagaccccugg

SEQ ID NO: 1612712 - RNA, 16 nt, Human
gccacuccagaccccu

SEQ ID NO: 1612713 - RNA, 18 nt, Human
gccagagggagugacaga

SEQ ID NO: 1612714 - RNA, 15 nt, Human
gccagagacacaagc

SEQ ID NO: 1612715 - RNA, 12 nt, Human
gccagagacaca

SEQ ID NO: 1612716 - RNA, 15 nt, Human
gccagcugcuugggc

SEQ ID NO: 1612717 - RNA, 16 nt, Human
gccagcugcuugggcu

SEQ ID NO: 1612718 - RNA, 14 nt, Human
gccagcugcuuggg

SEQ ID NO: 1612719 - RNA, 22 nt, Human
gccagccuugaccauucuccac

SEQ ID NO: 1612720 - RNA, 21 nt, Human
gccagccuugaccauucucca

SEQ ID NO: 1612721 - RNA, 20 nt, Human
gccagccuugaccauucucc

SEQ ID NO: 1612722 - RNA, 14 nt, Human
gccagccuugacca

SEQ ID NO: 1612723 - RNA, 12 nt, Human
gccagccuugac

SEQ ID NO: 1612724 - RNA, 20 nt, Human
gccagccgagauagccaagg

SEQ ID NO: 1612725 - RNA, 21 nt, Human
gccagccgagauagccaaggc

SEQ ID NO: 1612726 - RNA, 16 nt, Human
gccagauucuuuccug

SEQ ID NO: 1612727 - RNA, 20 nt, Human
gccagagggagugacagagg

SEQ ID NO: 1612728 - RNA, 19 nt, Human
gccagagggagugacagag

SEQ ID NO: 1612729 - RNA, 19 nt, Human
gccagauucuuuccugagg

SEQ ID NO: 1612730 - RNA, 17 nt, Human
gccagauucuuuccuga

SEQ ID NO: 1612731 - RNA, 11 nt, Human
gccaucccucc

SEQ ID NO: 1612732 - RNA, 13 nt, Human
gccaucccucccu

SEQ ID NO: 1612733 - RNA, 14 nt, Human
gccaucccucccuc

SEQ ID NO: 1612734 - RNA, 17 nt, Human
gccaucccagccccaau

SEQ ID NO: 1612735 - RNA, 16 nt, Human
gccaucccagccccaa

SEQ ID NO: 1612736 - RNA, 15 nt, Human
gccaucccagcccca

SEQ ID NO: 1612737 - RNA, 14 nt, Human
gccaucccagcccc

SEQ ID NO: 1612738 - RNA, 13 nt, Human
gccaucccagccc

SEQ ID NO: 1612739 - RNA, 20 nt, Human
gccauccagguucagcuugu

SEQ ID NO: 1612740 - RNA, 19 nt, Human
gccauccagguucagcuug

SEQ ID NO: 1612741 - RNA, 18 nt, Human
gccagguggccacuccag

SEQ ID NO: 1612742 - RNA, 22 nt, Human
gccaggggaaaaucagccugcu

SEQ ID NO: 1612743 - RNA, 21 nt, Human
gccaggggaaaaucagccugc

SEQ ID NO: 1612744 - RNA, 17 nt, Human
gccaggggaaaaucagc

SEQ ID NO: 1612745 - RNA, 23 nt, Human
gccaggggaaaaucagccugcuc

SEQ ID NO: 1612746 - RNA, 18 nt, Human
gccaggaagccagcaggc

SEQ ID NO: 1612747 - RNA, 17 nt, Human
gccaggaagccagcagg

SEQ ID NO: 1612748 - RNA, 11 nt, Human
gccaggaagcc

SEQ ID NO: 1612749 - RNA, 19 nt, Human
gccaggaagccagcaggcu

SEQ ID NO: 1612750 - RNA, 20 nt, Human
gccaggaagccagcaggcuc

SEQ ID NO: 1612751 - RNA, 19 nt, Human
gccaugggacagggaggac

SEQ ID NO: 1612752 - RNA, 14 nt, Human
gccaugggacaggg

SEQ ID NO: 1612753 - RNA, 15 nt, Human
gccaucccucccucc

SEQ ID NO: 1612754 - RNA, 16 nt, Human
gccaucccucccucca

SEQ ID NO: 1612755 - RNA, 22 nt, Human
gccauuuaaagcuuauuaaaac

SEQ ID NO: 1612756 - RNA, 22 nt, Human
gccaugggacagggaggacgcu

SEQ ID NO: 1612757 - RNA, 17 nt, Human
gccauuucuuccacaag

SEQ ID NO: 1612758 - RNA, 22 nt, Human
gccauuucuuccacaagagccc

SEQ ID NO: 1612759 - RNA, 20 nt, Human
gccauuucuuccacaagagc

SEQ ID NO: 1612760 - RNA, 16 nt, Human
gcccacagcuguauga

SEQ ID NO: 1612761 - RNA, 16 nt, Human
gcccaaagaugcagcc

SEQ ID NO: 1612762 - RNA, 16 nt, Human
gccauuuguguuuaua

SEQ ID NO: 1612763 - RNA, 15 nt, Human
gcccaccccucaaca

SEQ ID NO: 1612764 - RNA, 18 nt, Human
gcccacaggaucagucug

SEQ ID NO: 1612765 - RNA, 13 nt, Human
gcccacaggauca

SEQ ID NO: 1612766 - RNA, 19 nt, Human
gcccacaggaucagucuga

SEQ ID NO: 1612767 - RNA, 18 nt, Human
gcccucuccugggcagcu

SEQ ID NO: 1612768 - RNA, 19 nt, Human
gcccucuccugggcagcug

SEQ ID NO: 1612769 - RNA, 21 nt, Human
gcccucuccugggcagcugcc

SEQ ID NO: 1612770 - RNA, 22 nt, Human
gcccucugcccacucccugcaa

SEQ ID NO: 1612771 - RNA, 15 nt, Human
gcccucuccugggca

SEQ ID NO: 1612772 - RNA, 16 nt, Human
gcccucuccugggcag

SEQ ID NO: 1612773 - RNA, 20 nt, Human
gcccgggcucugccucccau

SEQ ID NO: 1612774 - RNA, 19 nt, Human
gcccgggcucugccuccca

SEQ ID NO: 1612775 - RNA, 21 nt, Human
gcccgggcucugccucccauc

SEQ ID NO: 1612776 - RNA, 15 nt, Human
gcccucccugccccu

SEQ ID NO: 1612777 - RNA, 18 nt, Human
gcccgggcucugccuccc

SEQ ID NO: 1612778 - RNA, 15 nt, Human
gcccgggcucugccu

SEQ ID NO: 1612779 - RNA, 14 nt, Human
gcccgggcucugcc

SEQ ID NO: 1612780 - RNA, 13 nt, Human
gcccgggcucugc

SEQ ID NO: 1612781 - RNA, 15 nt, Human
gcccggcuccaggcu

SEQ ID NO: 1612782 - RNA, 14 nt, Human
gcccggcuccaggc

SEQ ID NO: 1612783 - RNA, 13 nt, Human
gcccggcuccagg

SEQ ID NO: 1612784 - RNA, 20 nt, Human
gccccuucugacccaugcug

SEQ ID NO: 1612785 - RNA, 19 nt, Human
gccccuucugacccaugcu

SEQ ID NO: 1612786 - RNA, 19 nt, Human
gccccugcacuccagccug

SEQ ID NO: 1612787 - RNA, 23 nt, Human
gccccuggcagccccuguucugg

SEQ ID NO: 1612788 - RNA, 13 nt, Human
gccccugcacaaa

SEQ ID NO: 1612789 - RNA, 17 nt, Human
gccccuucccccuccaa

SEQ ID NO: 1612790 - RNA, 21 nt, Human
gccccucagggucccuggugg

SEQ ID NO: 1612791 - RNA, 19 nt, Human
gccccucagggucccuggu

SEQ ID NO: 1612792 - RNA, 23 nt, Human
gccccucaacucuccuccagagu

SEQ ID NO: 1612793 - RNA, 17 nt, Human
gccccgugggguuccuc

SEQ ID NO: 1612794 - RNA, 21 nt, Human
gccccgucccccucuggcucc

SEQ ID NO: 1612795 - RNA, 17 nt, Human
gccccgucccccucugg

SEQ ID NO: 1612796 - RNA, 23 nt, Human
gccccgaggccuucucugaagga

SEQ ID NO: 1612797 - RNA, 23 nt, Human
gccccauucugccugcccaggcc

SEQ ID NO: 1612798 - RNA, 22 nt, Human
gccccauucugccugcccaggc

SEQ ID NO: 1612799 - RNA, 14 nt, Human
gccccgcccaggcu

SEQ ID NO: 1612800 - RNA, 18 nt, Human
gcccaggccuccuacagc

SEQ ID NO: 1612801 - RNA, 16 nt, Human
gcccaggaaaggcucc

SEQ ID NO: 1612802 - RNA, 15 nt, Human
gcccaggaaaggcuc

SEQ ID NO: 1612803 - RNA, 12 nt, Human
gcccaggaaagg

SEQ ID NO: 1612804 - RNA, 11 nt, Human
gcccaggcugg

SEQ ID NO: 1612805 - RNA, 17 nt, Human
gcccaggccugccuguu

SEQ ID NO: 1612806 - RNA, 15 nt, Human
gcccaggcuggcgug

SEQ ID NO: 1612807 - RNA, 14 nt, Human
gcccaggcuggcgu

SEQ ID NO: 1612808 - RNA, 16 nt, Human
gcccaggcuggcgugc

SEQ ID NO: 1612809 - RNA, 22 nt, Human
gcccagucuggaaugcaguggu

SEQ ID NO: 1612810 - RNA, 15 nt, Human
gcccaguugggugga

SEQ ID NO: 1612811 - RNA, 21 nt, Human
gccccauucugccugcccagg

SEQ ID NO: 1612812 - RNA, 20 nt, Human
gccccauucugccugcccag

SEQ ID NO: 1612813 - RNA, 18 nt, Human
gccccauucugccugccc

SEQ ID NO: 1612814 - RNA, 17 nt, Human
gccccauucugccugcc

SEQ ID NO: 1612815 - RNA, 23 nt, Human
gccccauccucuguacagagccc

SEQ ID NO: 1612816 - RNA, 21 nt, Human
gccccagugcccacaggauca

SEQ ID NO: 1612817 - RNA, 17 nt, Human
gccccagugcccacagg

SEQ ID NO: 1612818 - RNA, 16 nt, Human
gccccagugcccacag

SEQ ID NO: 1612819 - RNA, 22 nt, Human
gcccaucugggggccucuucug

SEQ ID NO: 1612820 - RNA, 23 nt, Human
ggugcuacaaaaacacagcaagg

SEQ ID NO: 1612821 - RNA, 15 nt, Human
ggugcgaucuggguu

SEQ ID NO: 1612822 - RNA, 20 nt, Human
ggugcuaucucccccagccc

SEQ ID NO: 1612823 - RNA, 19 nt, Human
ggugcuaucucccccagcc

SEQ ID NO: 1612824 - RNA, 17 nt, Human
ggugcuaucucccccag

SEQ ID NO: 1612825 - RNA, 16 nt, Human
ggugcuaucuccccca

SEQ ID NO: 1612826 - RNA, 16 nt, Human
ggugagaggggaacag

SEQ ID NO: 1612827 - RNA, 15 nt, Human
ggugagaagcagagg

SEQ ID NO: 1612828 - RNA, 22 nt, Human
gguggccucccaacucacccca

SEQ ID NO: 1612829 - RNA, 23 nt, Human
gguggccacuccagaccccuggc

SEQ ID NO: 1612830 - RNA, 22 nt, Human
gguggccacuccagaccccugg

SEQ ID NO: 1612831 - RNA, 21 nt, Human
gguggccacuccagaccccug

SEQ ID NO: 1612832 - RNA, 20 nt, Human
gguggccacuccagaccccu

SEQ ID NO: 1612833 - RNA, 23 nt, Human
gguggccucccaacucaccccag

SEQ ID NO: 1612834 - RNA, 22 nt, Human
gguggcagugggagcugccugu

SEQ ID NO: 1612835 - RNA, 19 nt, Human
gguggcagugggagcugcc

SEQ ID NO: 1612836 - RNA, 21 nt, Human
ggugcugccauccagguucag

SEQ ID NO: 1612837 - RNA, 21 nt, Human
ggugcuaucucccccagcccc

SEQ ID NO: 1612838 - RNA, 15 nt, Human
ggugcugccauccag

SEQ ID NO: 1612839 - RNA, 14 nt, Human
ggucugacccacug

SEQ ID NO: 1612840 - RNA, 22 nt, Human
ggugaccagcaccaucucuccu

SEQ ID NO: 1612841 - RNA, 21 nt, Human
ggugacuuuggauaauaagga

SEQ ID NO: 1612842 - RNA, 20 nt, Human
ggugacuuuggauaauaagg

SEQ ID NO: 1612843 - RNA, 19 nt, Human
ggugacuuuggauaauaag

SEQ ID NO: 1612844 - RNA, 18 nt, Human
ggugacuuuggauaauaa

SEQ ID NO: 1612845 - RNA, 14 nt, Human
ggugacuuuggaua

SEQ ID NO: 1612846 - RNA, 23 nt, Human
ggucucacucugucgcccagucu

SEQ ID NO: 1612847 - RNA, 22 nt, Human
ggucucacucugucgcccaguc

SEQ ID NO: 1612848 - RNA, 21 nt, Human
ggucucacuauguugcccagg

SEQ ID NO: 1612849 - RNA, 17 nt, Human
ggucccaccccacacac

SEQ ID NO: 1612850 - RNA, 15 nt, Human
ggugguuuucuguuc

SEQ ID NO: 1612851 - RNA, 18 nt, Human
ggugguuuucuguucuuu

SEQ ID NO: 1612852 - RNA, 21 nt, Human
ggugguuauggagaggguguc

SEQ ID NO: 1612853 - RNA, 17 nt, Human
ggugguuucagaaaugu

SEQ ID NO: 1612854 - RNA, 18 nt, Human
ggugguuucagaaaugug

SEQ ID NO: 1612855 - RNA, 19 nt, Human
ggugucaccugaagacuca

SEQ ID NO: 1612856 - RNA, 19 nt, Human
ggugucaagagggucugag

SEQ ID NO: 1612857 - RNA, 17 nt, Human
ggugucaagagggucug

SEQ ID NO: 1612858 - RNA, 16 nt, Human
gguguaugugugaagu

SEQ ID NO: 1612859 - RNA, 12 nt, Human
gguggcuggguu

SEQ ID NO: 1612860 - RNA, 15 nt, Human
gguggugaccucugc

SEQ ID NO: 1612861 - RNA, 14 nt, Human
gguggugaccucug

SEQ ID NO: 1612862 - RNA, 16 nt, Human
gguggugaccucugcc

SEQ ID NO: 1612863 - RNA, 21 nt, Human
gguucaaagauauuuugcuuu

SEQ ID NO: 1612864 - RNA, 13 nt, Human
gguucaaagauau

SEQ ID NO: 1612865 - RNA, 13 nt, Human
gguugagguuuca

SEQ ID NO: 1612866 - RNA, 17 nt, Human
gguucuuucuuccucug

SEQ ID NO: 1612867 - RNA, 16 nt, Human
gguucuuucuuccucu

SEQ ID NO: 1612868 - RNA, 14 nt, Human
gguucuuucuuccu

SEQ ID NO: 1612869 - RNA, 21 nt, Human
gguuacccaguuagcucucaa

SEQ ID NO: 1612870 - RNA, 13 nt, Human
gguuauggagagg

SEQ ID NO: 1612871 - RNA, 20 nt, Human
gguuaucugaagucagaucu

SEQ ID NO: 1612872 - RNA, 22 nt, Human
gguuaguggauggaaggggcug

SEQ ID NO: 1612873 - RNA, 21 nt, Human
gguuaguggauggaaggggcu

SEQ ID NO: 1612874 - RNA, 17 nt, Human
gguuaggcauuguggga

SEQ ID NO: 1612875 - RNA, 17 nt, Human
gggggaucacagccucu

SEQ ID NO: 1612876 - RNA, 12 nt, Human
gggguggccucc

SEQ ID NO: 1612877 - RNA, 18 nt, Human
ggggugcugggccccugc

SEQ ID NO: 1612878 - RNA, 17 nt, Human
gggguggggaccucagg

SEQ ID NO: 1612879 - RNA, 20 nt, Human
gggguggggggggugcuggg

SEQ ID NO: 1612880 - RNA, 22 nt, Human
ggggcugcaccggcuggccugg

SEQ ID NO: 1612881 - RNA, 21 nt, Human
ggggcugcaccggcuggccug

SEQ ID NO: 1612882 - RNA, 12 nt, Human
ggggcugcaccg

SEQ ID NO: 1612883 - RNA, 19 nt, Human
ggggcugaggugggaggau

SEQ ID NO: 1612884 - RNA, 23 nt, Human
ggggcugcaccggcuggccuggc

SEQ ID NO: 1612885 - RNA, 22 nt, Human
gggggaggugggauccuccagg

SEQ ID NO: 1612886 - RNA, 21 nt, Human
gggucugaggaauccagaccc

SEQ ID NO: 1612887 - RNA, 12 nt, Human
gggucugaggaa

SEQ ID NO: 1612888 - RNA, 14 nt, Human
gggucucacucugu

SEQ ID NO: 1612889 - RNA, 17 nt, Human
ggguaagugagagaggg

SEQ ID NO: 1612890 - RNA, 24 nt, Human
ggggaaaaucagccugcuccagcu

SEQ ID NO: 1612891 - RNA, 21 nt, Human
ggggaaaaucagccugcucca

SEQ ID NO: 1612892 - RNA, 18 nt, Human
ggggaggggcugugggcg

SEQ ID NO: 1612893 - RNA, 15 nt, Human
ggggauucuuaaagu

SEQ ID NO: 1612894 - RNA, 11 nt, Human
ggggauucuua

SEQ ID NO: 1612895 - RNA, 19 nt, Human
ggggaaaaucagccugcuc

SEQ ID NO: 1612896 - RNA, 17 nt, Human
ggggaaaaucagccugc

SEQ ID NO: 1612897 - RNA, 16 nt, Human
ggggaaaaucagccug

SEQ ID NO: 1612898 - RNA, 11 nt, Human
gggccugggcc

SEQ ID NO: 1612899 - RNA, 16 nt, Human
ggggcaacccugguga

SEQ ID NO: 1612900 - RNA, 17 nt, Human
ggggcugaggugggagg

SEQ ID NO: 1612901 - RNA, 19 nt, Human
gggugacagagcaagugag

SEQ ID NO: 1612902 - RNA, 17 nt, Human
gggugaagugaagacaa

SEQ ID NO: 1612903 - RNA, 12 nt, Human
ggguucuaccca

SEQ ID NO: 1612904 - RNA, 21 nt, Human
ggguuccuuccucugagccuu

SEQ ID NO: 1612905 - RNA, 20 nt, Human
ggguuccuuccucugagccu

SEQ ID NO: 1612906 - RNA, 19 nt, Human
ggguuccuuccucugagcc

SEQ ID NO: 1612907 - RNA, 17 nt, Human
ggguucuacccaggugc

SEQ ID NO: 1612908 - RNA, 17 nt, Human
ggguucuuucuuccucu

SEQ ID NO: 1612909 - RNA, 19 nt, Human
ggguucuuucuuccucugc

SEQ ID NO: 1612910 - RNA, 16 nt, Human
ggguuggccccugccc

SEQ ID NO: 1612911 - RNA, 23 nt, Human
ggguucaagcgauucuucugcuu

SEQ ID NO: 1612912 - RNA, 22 nt, Human
ggguucaagcgauucuucugcu

SEQ ID NO: 1612913 - RNA, 18 nt, Human
gggugcugggccccugcc

SEQ ID NO: 1612914 - RNA, 17 nt, Human
gggugcugggccccugc

SEQ ID NO: 1612915 - RNA, 12 nt, Human
ggucacucuggc

SEQ ID NO: 1612916 - RNA, 18 nt, Human
ggucacaggacucugccu

SEQ ID NO: 1612917 - RNA, 16 nt, Human
ggucacaggacucugc

SEQ ID NO: 1612918 - RNA, 11 nt, Human
ggucagagccu

SEQ ID NO: 1612919 - RNA, 16 nt, Human
ggucccaccccacaca

SEQ ID NO: 1612920 - RNA, 15 nt, Human
ggucccaccccacac

SEQ ID NO: 1612921 - RNA, 17 nt, Human
gguacuuguggacacag

SEQ ID NO: 1612922 - RNA, 16 nt, Human
gguacuuguggacaca

SEQ ID NO: 1612923 - RNA, 22 nt, Human
gguagaaauaucugaaaaugua

SEQ ID NO: 1612924 - RNA, 20 nt, Human
gguacuuguggacacagcuc

SEQ ID NO: 1612925 - RNA, 13 nt, Human
gguacccacugcu

SEQ ID NO: 1612926 - RNA, 16 nt, Human
gguacccacugcucug

SEQ ID NO: 1612927 - RNA, 11 nt, Human
gguacccacug

SEQ ID NO: 1612928 - RNA, 22 nt, Human
gguagaagcccuucuaccuucc

SEQ ID NO: 1612929 - RNA, 23 nt, Human
gguagaaauaucugaaaauguau

SEQ ID NO: 1612930 - RNA, 18 nt, Human
gguagcauuuguguugaa

SEQ ID NO: 1612931 - RNA, 22 nt, Human
ggcuugaguuuaaauuguaaua

SEQ ID NO: 1612932 - RNA, 21 nt, Human
ggcuuggggaccagagcugcc

SEQ ID NO: 1612933 - RNA, 10 nt, Human
ggcuuuugug

SEQ ID NO: 1612934 - RNA, 16 nt, Human
ggcuuuucugauccag

SEQ ID NO: 1612935 - RNA, 13 nt, Human
ggcuuuucugauc

SEQ ID NO: 1612936 - RNA, 22 nt, Human
ggcuuuucacugcuggcugccu

SEQ ID NO: 1612937 - RNA, 19 nt, Human
ggcuuuucacugcuggcug

SEQ ID NO: 1612938 - RNA, 12 nt, Human
ggcuuuucugau

SEQ ID NO: 1612939 - RNA, 17 nt, Human
ggcuuuucacugcuggc

SEQ ID NO: 1612940 - RNA, 15 nt, Human
ggcuuuucacugcug

SEQ ID NO: 1612941 - RNA, 14 nt, Human
ggcuuuucacugcu

SEQ ID NO: 1612942 - RNA, 21 nt, Human
ggcuuagucacugagacagcc

SEQ ID NO: 1612943 - RNA, 12 nt, Human
ggcugggcuuca

SEQ ID NO: 1612944 - RNA, 18 nt, Human
ggcugggcucccuuccca

SEQ ID NO: 1612945 - RNA, 17 nt, Human
ggcugggcucccuuccc

SEQ ID NO: 1612946 - RNA, 17 nt, Human
ggcugggcuucaguggc

SEQ ID NO: 1612947 - RNA, 13 nt, Human
ggcugggcuucag

SEQ ID NO: 1612948 - RNA, 18 nt, Human
ggcugggcuucaguggca

SEQ ID NO: 1612949 - RNA, 15 nt, Human
gggaccucaggccug

SEQ ID NO: 1612950 - RNA, 13 nt, Human
gggaccucaggcc

SEQ ID NO: 1612951 - RNA, 12 nt, Human
gggaccucaggc

SEQ ID NO: 1612952 - RNA, 16 nt, Human
gggacucaaugcacug

SEQ ID NO: 1612953 - RNA, 17 nt, Human
gggacuacaggcaccca

SEQ ID NO: 1612954 - RNA, 14 nt, Human
gggaccccugagcu

SEQ ID NO: 1612955 - RNA, 17 nt, Human
gggaauuucuucaacuc

SEQ ID NO: 1612956 - RNA, 23 nt, Human
gggacaaggacuaggguccuggg

SEQ ID NO: 1612957 - RNA, 14 nt, Human
ggcuuuugugcauu

SEQ ID NO: 1612958 - RNA, 17 nt, Human
ggcuuuucugauccagu

SEQ ID NO: 1612959 - RNA, 21 nt, Human
gggaaggauacaaaagcaugu

SEQ ID NO: 1612960 - RNA, 23 nt, Human
gggaaggauacaaaagcauguga

SEQ ID NO: 1612961 - RNA, 22 nt, Human
gggaaggcagggagggccuggg

SEQ ID NO: 1612962 - RNA, 16 nt, Human
gggaagggggcuggga

SEQ ID NO: 1612963 - RNA, 14 nt, Human
gggaagggggcugg

SEQ ID NO: 1612964 - RNA, 17 nt, Human
gggaagggggcugggac

SEQ ID NO: 1612965 - RNA, 13 nt, Human
gggaaugaagaua

SEQ ID NO: 1612966 - RNA, 15 nt, Human
ggcugaggugggagg

SEQ ID NO: 1612967 - RNA, 13 nt, Human
ggcugagguggga

SEQ ID NO: 1612968 - RNA, 17 nt, Human
ggccccugcccggcugc

SEQ ID NO: 1612969 - RNA, 16 nt, Human
ggccccugcccggcug

SEQ ID NO: 1612970 - RNA, 20 nt, Human
ggccccugcccggcugcgga

SEQ ID NO: 1612971 - RNA, 14 nt, Human
ggcucuggagccca

SEQ ID NO: 1612972 - RNA, 13 nt, Human
ggcucuggagccc

SEQ ID NO: 1612973 - RNA, 23 nt, Human
ggcugcaaaggguaucaggugcu

SEQ ID NO: 1612974 - RNA, 22 nt, Human
ggcugcaaaggguaucaggugc

SEQ ID NO: 1612975 - RNA, 18 nt, Human
ggcugcaaaggguaucag

SEQ ID NO: 1612976 - RNA, 19 nt, Human
ggcugcaccggcuggccug

SEQ ID NO: 1612977 - RNA, 18 nt, Human
ggcugcaccggcuggccu

SEQ ID NO: 1612978 - RNA, 17 nt, Human
ggcugcaccggcuggcc

SEQ ID NO: 1612979 - RNA, 24 nt, Human
ggcugcaaaggguaucaggugcug

SEQ ID NO: 1612980 - RNA, 23 nt, Human
ggcugcuucaaggauccugagcc

SEQ ID NO: 1612981 - RNA, 19 nt, Human
ggcugggagagccuuccag

SEQ ID NO: 1612982 - RNA, 23 nt, Human
ggcugggagagccuuccaggggu

SEQ ID NO: 1612983 - RNA, 20 nt, Human
ggcugggagagccuuccagg

SEQ ID NO: 1612984 - RNA, 14 nt, Human
ggcugggcagagga

SEQ ID NO: 1612985 - RNA, 13 nt, Human
ggcugggcagagg

SEQ ID NO: 1612986 - RNA, 19 nt, Human
ggcugggcagaggaaagca

SEQ ID NO: 1612987 - RNA, 15 nt, Human
ggcugggcagaggaa

SEQ ID NO: 1612988 - RNA, 17 nt, Human
ggcugcugaaggcucga

SEQ ID NO: 1612989 - RNA, 15 nt, Human
ggcugcugaaggcuc

SEQ ID NO: 1612990 - RNA, 18 nt, Human
ggcugcugaaggcucgag

SEQ ID NO: 1612991 - RNA, 14 nt, Human
ggcugcugaaggcu

SEQ ID NO: 1612992 - RNA, 13 nt, Human
ggcugcagggagu

SEQ ID NO: 1612993 - RNA, 12 nt, Human
ggcugcagggag

SEQ ID NO: 1612994 - RNA, 22 nt, Human
ggcugcuucaaggauccugagc

SEQ ID NO: 1612995 - RNA, 14 nt, Human
ggcugcuucaagga

SEQ ID NO: 1612996 - RNA, 12 nt, Human
ggcugcuucaag

SEQ ID NO: 1612997 - RNA, 11 nt, Human
ggcugcuucaa

SEQ ID NO: 1612998 - RNA, 21 nt, Human
gggcacagaaaauggaagaca

SEQ ID NO: 1612999 - RNA, 20 nt, Human
gggcacagaaaauggaagac

SEQ ID NO: 1613000 - RNA, 18 nt, Human
gggcacagaaaauggaag

SEQ ID NO: 1613001 - RNA, 23 nt, Human
gggcacaccgggcacucagaaga

SEQ ID NO: 1613002 - RNA, 16 nt, Human
gggcacagggucucua

SEQ ID NO: 1613003 - RNA, 13 nt, Human
gggcacagggucu

SEQ ID NO: 1613004 - RNA, 19 nt, Human
gggcacucagaagacacug

SEQ ID NO: 1613005 - RNA, 16 nt, Human
gggcacucagaagaca

SEQ ID NO: 1613006 - RNA, 14 nt, Human
gggcaccggggccu

SEQ ID NO: 1613007 - RNA, 18 nt, Human
gggcagaaggaagacuuc

SEQ ID NO: 1613008 - RNA, 14 nt, Human
gggcagaaggaaga

SEQ ID NO: 1613009 - RNA, 20 nt, Human
gggcacucagaagacacuga

SEQ ID NO: 1613010 - RNA, 16 nt, Human
gggcacugguggcccg

SEQ ID NO: 1613011 - RNA, 13 nt, Human
gggcacugguggc

SEQ ID NO: 1613012 - RNA, 12 nt, Human
gggcagagcaga

SEQ ID NO: 1613013 - RNA, 11 nt, Human
gggcagagcag

SEQ ID NO: 1613014 - RNA, 17 nt, Human
gggcagguugguggggg

SEQ ID NO: 1613015 - RNA, 14 nt, Human
gggagugagcuggu

SEQ ID NO: 1613016 - RNA, 11 nt, Human
gggagugagcu

SEQ ID NO: 1613017 - RNA, 18 nt, Human
gggagugacagaggcagc

SEQ ID NO: 1613018 - RNA, 16 nt, Human
gggaggugaccccagg

SEQ ID NO: 1613019 - RNA, 17 nt, Human
gggaggugggauccucc

SEQ ID NO: 1613020 - RNA, 13 nt, Human
gggacugagaaau

SEQ ID NO: 1613021 - RNA, 13 nt, Human
gggauagagagag

SEQ ID NO: 1613022 - RNA, 21 nt, Human
gggauaugauuuaaaucagcc

SEQ ID NO: 1613023 - RNA, 16 nt, Human
gggauccuccaggugc

SEQ ID NO: 1613024 - RNA, 15 nt, Human
gggauccuccaggug

SEQ ID NO: 1613025 - RNA, 18 nt, Human
gggcaacccuggugacca

SEQ ID NO: 1613026 - RNA, 23 nt, Human
gggauccuggaguucugguuccu

SEQ ID NO: 1613027 - RNA, 17 nt, Human
gggcccagagagggugg

SEQ ID NO: 1613028 - RNA, 16 nt, Human
gggccacagagaaagu

SEQ ID NO: 1613029 - RNA, 23 nt, Human
gggccacagagaaaguacuucuc

SEQ ID NO: 1613030 - RNA, 12 nt, Human
gggcaugacacg

SEQ ID NO: 1613031 - RNA, 20 nt, Human
gggcauggccagguggccac

SEQ ID NO: 1613032 - RNA, 17 nt, Human
gggcauggccagguggc

SEQ ID NO: 1613033 - RNA, 15 nt, Human
gggcauggccaggug

SEQ ID NO: 1613034 - RNA, 13 nt, Human
gggccuggcuccc

SEQ ID NO: 1613035 - RNA, 17 nt, Human
gggccuggcucaggugg

SEQ ID NO: 1613036 - RNA, 18 nt, Human
gggccuggccugagcugg

SEQ ID NO: 1613037 - RNA, 14 nt, Human
gggccuggccugag

SEQ ID NO: 1613038 - RNA, 19 nt, Human
gggccuggccugagcuggg

SEQ ID NO: 1613039 - RNA, 13 nt, Human
gggccuggccuga

SEQ ID NO: 1613040 - RNA, 13 nt, Human
gggcccugccucc

SEQ ID NO: 1613041 - RNA, 22 nt, Human
gggccccugccucucugcaggu

SEQ ID NO: 1613042 - RNA, 21 nt, Human
gggccccugccucucugcagg

SEQ ID NO: 1613043 - RNA, 19 nt, Human
gggccccugccucucugca

SEQ ID NO: 1613044 - RNA, 18 nt, Human
gggccccugccucucugc

SEQ ID NO: 1613045 - RNA, 17 nt, Human
gggccccugccucucug

SEQ ID NO: 1613046 - RNA, 15 nt, Human
gggccccugccucuc

SEQ ID NO: 1613047 - RNA, 13 nt, Human
gggccccugccuc

SEQ ID NO: 1613048 - RNA, 14 nt, Human
gggccccagaggcu

SEQ ID NO: 1613049 - RNA, 19 nt, Human
ggaggacgcucucuggccu

SEQ ID NO: 1613050 - RNA, 21 nt, Human
ggaggacgcucucuggccuuc

SEQ ID NO: 1613051 - RNA, 20 nt, Human
ggaggacgcucucuggccuu

SEQ ID NO: 1613052 - RNA, 21 nt, Human
ggaggaucucuugagccuggg

SEQ ID NO: 1613053 - RNA, 17 nt, Human
ggaggaucucuugagcc

SEQ ID NO: 1613054 - RNA, 23 nt, Human
ggaggaucacuugaguccagaag

SEQ ID NO: 1613055 - RNA, 15 nt, Human
ggaggauguucuggg

SEQ ID NO: 1613056 - RNA, 12 nt, Human
ggagggagggcu

SEQ ID NO: 1613057 - RNA, 13 nt, Human
ggagggcuccaga

SEQ ID NO: 1613058 - RNA, 12 nt, Human
ggagggcuccag

SEQ ID NO: 1613059 - RNA, 21 nt, Human
ggagugaguugauagcacaga

SEQ ID NO: 1613060 - RNA, 14 nt, Human
ggagugagcugguu

SEQ ID NO: 1613061 - RNA, 12 nt, Human
ggagugagcugg

SEQ ID NO: 1613062 - RNA, 21 nt, Human
ggagugacagaggcagcccca

SEQ ID NO: 1613063 - RNA, 19 nt, Human
ggagugacagaggcagccc

SEQ ID NO: 1613064 - RNA, 18 nt, Human
ggagugacagaggcagcc

SEQ ID NO: 1613065 - RNA, 17 nt, Human
ggagugacagaggcagc

SEQ ID NO: 1613066 - RNA, 23 nt, Human
ggagugaguugauagcacagacc

SEQ ID NO: 1613067 - RNA, 16 nt, Human
ggaucacagccucuga

SEQ ID NO: 1613068 - RNA, 15 nt, Human
ggagggcuccagaca

SEQ ID NO: 1613069 - RNA, 14 nt, Human
ggagggcuccagac

SEQ ID NO: 1613070 - RNA, 17 nt, Human
ggagggcuccagacaca

SEQ ID NO: 1613071 - RNA, 21 nt, Human
ggagucccaccuuggcugcag

SEQ ID NO: 1613072 - RNA, 20 nt, Human
ggagucccaccuuggcugca

SEQ ID NO: 1613073 - RNA, 16 nt, Human
ggagugacagaggcag

SEQ ID NO: 1613074 - RNA, 11 nt, Human
ggagugacaga

SEQ ID NO: 1613075 - RNA, 20 nt, Human
ggaagccagcaggcucucag

SEQ ID NO: 1613076 - RNA, 12 nt, Human
ggacuccucugu

SEQ ID NO: 1613077 - RNA, 14 nt, Human
ggacuccucugucc

SEQ ID NO: 1613078 - RNA, 15 nt, Human
ggacuccucugucca

SEQ ID NO: 1613079 - RNA, 11 nt, Human
ggacucugccu

SEQ ID NO: 1613080 - RNA, 21 nt, Human
ggagagcuagcagcagggagg

SEQ ID NO: 1613081 - RNA, 17 nt, Human
ggagagcuagcagcagg

SEQ ID NO: 1613082 - RNA, 21 nt, Human
ggacugccagucccccugccc

SEQ ID NO: 1613083 - RNA, 21 nt, Human
ggagaccccuuggggagcagg

SEQ ID NO: 1613084 - RNA, 15 nt, Human
ggagaggggcacagg

SEQ ID NO: 1613085 - RNA, 20 nt, Human
ggagauuuacaacuggggga

SEQ ID NO: 1613086 - RNA, 20 nt, Human
ggagcaaaaucgaugcagug

SEQ ID NO: 1613087 - RNA, 13 nt, Human
ggagcccugggag

SEQ ID NO: 1613088 - RNA, 12 nt, Human
ggagcccuggga

SEQ ID NO: 1613089 - RNA, 18 nt, Human
ggcagcugccuccccucc

SEQ ID NO: 1613090 - RNA, 21 nt, Human
ggcagcugccuccccuccucu

SEQ ID NO: 1613091 - RNA, 19 nt, Human
ggcagcugcgguccaccca

SEQ ID NO: 1613092 - RNA, 22 nt, Human
ggcagcugccuccccuccucug

SEQ ID NO: 1613093 - RNA, 21 nt, Human
ggcagcugcgguccacccagg

SEQ ID NO: 1613094 - RNA, 21 nt, Human
ggcagcuugaggguugggcug

SEQ ID NO: 1613095 - RNA, 21 nt, Human
ggcagcucaccucucccuugg

SEQ ID NO: 1613096 - RNA, 18 nt, Human
ggcagcucaccucucccu

SEQ ID NO: 1613097 - RNA, 22 nt, Human
ggcagcucaccucucccuugga

SEQ ID NO: 1613098 - RNA, 13 nt, Human
ggcagcucagaga

SEQ ID NO: 1613099 - RNA, 23 nt, Human
ggcaggucuugaacuccuggccu

SEQ ID NO: 1613100 - RNA, 13 nt, Human
ggcagguccaggg

SEQ ID NO: 1613101 - RNA, 14 nt, Human
ggcaggaaggcuga

SEQ ID NO: 1613102 - RNA, 23 nt, Human
ggcagauacaggaaaagcugcug

SEQ ID NO: 1613103 - RNA, 23 nt, Human
ggcagaguugaagacagagcuac

SEQ ID NO: 1613104 - RNA, 17 nt, Human
ggcagaggaaagcaaag

SEQ ID NO: 1613105 - RNA, 16 nt, Human
ggcagagcagagacca

SEQ ID NO: 1613106 - RNA, 15 nt, Human
ggcagagcagagacc

SEQ ID NO: 1613107 - RNA, 20 nt, Human
ggcagagcagagaccauccc

SEQ ID NO: 1613108 - RNA, 22 nt, Human
ggcagagcagagaccaucccug

SEQ ID NO: 1613109 - RNA, 16 nt, Human
ggcacccggccccugc

SEQ ID NO: 1613110 - RNA, 15 nt, Human
ggcacccggccccug

SEQ ID NO: 1613111 - RNA, 17 nt, Human
ggcacccggccccugcu

SEQ ID NO: 1613112 - RNA, 16 nt, Human
ggcaaggcugucaauu

SEQ ID NO: 1613113 - RNA, 19 nt, Human
ggcaacugcauuggcuuug

SEQ ID NO: 1613114 - RNA, 23 nt, Human
ggcaacuugggaacuagacuccc

SEQ ID NO: 1613115 - RNA, 18 nt, Human
ggcaacuugggaacuaga

SEQ ID NO: 1613116 - RNA, 18 nt, Human
ggcaacugcauuggcuuu

SEQ ID NO: 1613117 - RNA, 21 nt, Human
ggaucagucugauucccaagc

SEQ ID NO: 1613118 - RNA, 22 nt, Human
ggccaugggacagggaggacgc

SEQ ID NO: 1613119 - RNA, 13 nt, Human
ggccaugggccuc

SEQ ID NO: 1613120 - RNA, 12 nt, Human
ggccaggcuggu

SEQ ID NO: 1613121 - RNA, 12 nt, Human
ggccccugccac

SEQ ID NO: 1613122 - RNA, 16 nt, Human
ggccccugccacccug

SEQ ID NO: 1613123 - RNA, 13 nt, Human
ggccccugccacc

SEQ ID NO: 1613124 - RNA, 13 nt, Human
ggccccugcccgg

SEQ ID NO: 1613125 - RNA, 18 nt, Human
ggccccugccacccuggg

SEQ ID NO: 1613126 - RNA, 17 nt, Human
ggccccugccacccugg

SEQ ID NO: 1613127 - RNA, 21 nt, Human
ggccccucagggucccuggug

SEQ ID NO: 1613128 - RNA, 20 nt, Human
ggccccucagggucccuggu

SEQ ID NO: 1613129 - RNA, 19 nt, Human
ggccccucagggucccugg

SEQ ID NO: 1613130 - RNA, 16 nt, Human
ggccccucaggguccc

SEQ ID NO: 1613131 - RNA, 17 nt, Human
ggccacaagacccuugu

SEQ ID NO: 1613132 - RNA, 16 nt, Human
ggccacaagacccuug

SEQ ID NO: 1613133 - RNA, 15 nt, Human
ggcauuccccaggag

SEQ ID NO: 1613134 - RNA, 16 nt, Human
ggcauuccccaggagg

SEQ ID NO: 1613135 - RNA, 22 nt, Human
ggccaccugcggugcuaucucc

SEQ ID NO: 1613136 - RNA, 16 nt, Human
ggccaccugcggugcu

SEQ ID NO: 1613137 - RNA, 23 nt, Human
ggcauguucucugaggacacuaa

SEQ ID NO: 1613138 - RNA, 15 nt, Human
ggcagguuggugggg

SEQ ID NO: 1613139 - RNA, 17 nt, Human
ggcagguuggugggggc

SEQ ID NO: 1613140 - RNA, 11 nt, Human
ggccacuguga

SEQ ID NO: 1613141 - RNA, 14 nt, Human
ggccaggagccucc

SEQ ID NO: 1613142 - RNA, 16 nt, Human
ggccacugugaagaga

SEQ ID NO: 1613143 - RNA, 16 nt, Human
ggccaggagccuccug

SEQ ID NO: 1613144 - RNA, 11 nt, Human
ggccaggcugg

SEQ ID NO: 1613145 - RNA, 22 nt, Human
ggccaggcugggucgcccugga

SEQ ID NO: 1613146 - RNA, 18 nt, Human
ggccaggcugggucgccc

SEQ ID NO: 1613147 - RNA, 16 nt, Human
ggccaggccagaggga

SEQ ID NO: 1613148 - RNA, 14 nt, Human
ggccaggccagagg

SEQ ID NO: 1613149 - RNA, 18 nt, Human
gcuagauguauguacuuc

SEQ ID NO: 1613150 - RNA, 22 nt, Human
gcuagcagcagggagggcuucu

SEQ ID NO: 1613151 - RNA, 19 nt, Human
gcugcccuggugcugccac

SEQ ID NO: 1613152 - RNA, 18 nt, Human
gcugcccuggugcugcca

SEQ ID NO: 1613153 - RNA, 11 nt, Human
gcugcccugug

SEQ ID NO: 1613154 - RNA, 22 nt, Human
gcugcccuggugcugccacacu

SEQ ID NO: 1613155 - RNA, 20 nt, Human
gcugcccuggugcugccaca

SEQ ID NO: 1613156 - RNA, 14 nt, Human
gcugcccugugagu

SEQ ID NO: 1613157 - RNA, 12 nt, Human
gcugcccuguga

SEQ ID NO: 1613158 - RNA, 23 nt, Human
gcugcccuggugcugccacacuu

SEQ ID NO: 1613159 - RNA, 17 nt, Human
gcugcccuuucugggca

SEQ ID NO: 1613160 - RNA, 16 nt, Human
gcugcuugggcuucau

SEQ ID NO: 1613161 - RNA, 22 nt, Human
gcugcuucaaggauccugagcc

SEQ ID NO: 1613162 - RNA, 21 nt, Human
gcugcuucaaggauccugagc

SEQ ID NO: 1613163 - RNA, 23 nt, Human
gcugcuucaaggauccugagcca

SEQ ID NO: 1613164 - RNA, 18 nt, Human
gcugcgguccacccagga

SEQ ID NO: 1613165 - RNA, 17 nt, Human
gcugcgguccacccagg

SEQ ID NO: 1613166 - RNA, 19 nt, Human
gcugcgguccacccaggag

SEQ ID NO: 1613167 - RNA, 13 nt, Human
gcugcuucaagga

SEQ ID NO: 1613168 - RNA, 22 nt, Human
gcuggaccuugaacuggguacu

SEQ ID NO: 1613169 - RNA, 21 nt, Human
gcuggaccuugaacuggguac

SEQ ID NO: 1613170 - RNA, 22 nt, Human
gcugcuugggcuucauccuccu

SEQ ID NO: 1613171 - RNA, 17 nt, Human
gcugcuugggcuucauc

SEQ ID NO: 1613172 - RNA, 18 nt, Human
gcuggaccuugaacuggg

SEQ ID NO: 1613173 - RNA, 20 nt, Human
gcugggacuacaggcaccca

SEQ ID NO: 1613174 - RNA, 19 nt, Human
gcugggacuacaggcaccc

SEQ ID NO: 1613175 - RNA, 18 nt, Human
gcugggacuacaggcacc

SEQ ID NO: 1613176 - RNA, 13 nt, Human
gcugggacuacag

SEQ ID NO: 1613177 - RNA, 19 nt, Human
gcugggacuacagguguga

SEQ ID NO: 1613178 - RNA, 20 nt, Human
gcugggacaugggaaagggg

SEQ ID NO: 1613179 - RNA, 12 nt, Human
gcuggccuggcc

SEQ ID NO: 1613180 - RNA, 17 nt, Human
gcuggccgggagccuga

SEQ ID NO: 1613181 - RNA, 13 nt, Human
gcuggcccugccc

SEQ ID NO: 1613182 - RNA, 12 nt, Human
gcuggcccugcc

SEQ ID NO: 1613183 - RNA, 22 nt, Human
gcuguauuuuaaaagaaugauu

SEQ ID NO: 1613184 - RNA, 22 nt, Human
gcugguucaggguuggccccug

SEQ ID NO: 1613185 - RNA, 16 nt, Human
gcugucaauuacagga

SEQ ID NO: 1613186 - RNA, 15 nt, Human
gcugguucaggguug

SEQ ID NO: 1613187 - RNA, 21 nt, Human
gcugguuagagguucccuuug

SEQ ID NO: 1613188 - RNA, 18 nt, Human
gcuggugucaccugaaga

SEQ ID NO: 1613189 - RNA, 20 nt, Human
gcuggucccacucaguccau

SEQ ID NO: 1613190 - RNA, 22 nt, Human
gcuggugcccugcuuucagaua

SEQ ID NO: 1613191 - RNA, 24 nt, Human
gcuggugcccugcuuucagauacu

SEQ ID NO: 1613192 - RNA, 23 nt, Human
gcugucaauuacaggaaguacug

SEQ ID NO: 1613193 - RNA, 22 nt, Human
gcugucaauuacaggaaguacu

SEQ ID NO: 1613194 - RNA, 19 nt, Human
gcugucaauuacaggaagu

SEQ ID NO: 1613195 - RNA, 17 nt, Human
gcugucaauuacaggaa

SEQ ID NO: 1613196 - RNA, 21 nt, Human
gcugucccuuacgugaguccu

SEQ ID NO: 1613197 - RNA, 22 nt, Human
gcugucccuuacgugaguccug

SEQ ID NO: 1613198 - RNA, 19 nt, Human
gcugucccuuacgugaguc

SEQ ID NO: 1613199 - RNA, 18 nt, Human
gcugggagagccuuccag

SEQ ID NO: 1613200 - RNA, 17 nt, Human
gcugggagagccuucca

SEQ ID NO: 1613201 - RNA, 13 nt, Human
gcugggagagccu

SEQ ID NO: 1613202 - RNA, 12 nt, Human
gcugggagagcc

SEQ ID NO: 1613203 - RNA, 22 nt, Human
gcugggagagccuuccaggggu

SEQ ID NO: 1613204 - RNA, 19 nt, Human
gcugggagagccuuccagg

SEQ ID NO: 1613205 - RNA, 17 nt, Human
gcugggcuucaguggca

SEQ ID NO: 1613206 - RNA, 21 nt, Human
gcugggauuacaggcuccugc

SEQ ID NO: 1613207 - RNA, 20 nt, Human
gcugggauuacaggcuccug

SEQ ID NO: 1613208 - RNA, 19 nt, Human
gcugggauuacaggcuccu

SEQ ID NO: 1613209 - RNA, 18 nt, Human
gcugggauuacaggcgug

SEQ ID NO: 1613210 - RNA, 17 nt, Human
gcugggauuacaggcgu

SEQ ID NO: 1613211 - RNA, 15 nt, Human
gcugggagcucugca

SEQ ID NO: 1613212 - RNA, 16 nt, Human
gcugggagcucugcag

SEQ ID NO: 1613213 - RNA, 20 nt, Human
gcugggggccucagugccac

SEQ ID NO: 1613214 - RNA, 19 nt, Human
gcugggggccucagugcca

SEQ ID NO: 1613215 - RNA, 19 nt, Human
gcuggucccacucagucca

SEQ ID NO: 1613216 - RNA, 15 nt, Human
gcuggucccacucag

SEQ ID NO: 1613217 - RNA, 13 nt, Human
gcugggggccuca

SEQ ID NO: 1613218 - RNA, 23 nt, Human
gcugggggaagaagcucucuccu

SEQ ID NO: 1613219 - RNA, 12 nt, Human
gcuggggccagu

SEQ ID NO: 1613220 - RNA, 19 nt, Human
gcugggcuucaguggcagc

SEQ ID NO: 1613221 - RNA, 18 nt, Human
gcugggcuucaguggcag

SEQ ID NO: 1613222 - RNA, 19 nt, Human
gcuggggccaggcuggguc

SEQ ID NO: 1613223 - RNA, 16 nt, Human
gcuggggccaggcugg

SEQ ID NO: 1613224 - RNA, 19 nt, Human
gcuugcccuggugccucac

SEQ ID NO: 1613225 - RNA, 17 nt, Human
gcuugcccuggugccuc

SEQ ID NO: 1613226 - RNA, 18 nt, Human
gcuugccaucccucccuc

SEQ ID NO: 1613227 - RNA, 21 nt, Human
gcuugccaucccucccuccac

SEQ ID NO: 1613228 - RNA, 18 nt, Human
gcuugcccuguuaaaaga

SEQ ID NO: 1613229 - RNA, 13 nt, Human
gcuuggaggaagg

SEQ ID NO: 1613230 - RNA, 15 nt, Human
gcuuggaggaaggaa

SEQ ID NO: 1613231 - RNA, 14 nt, Human
gcuuggaggaagga

SEQ ID NO: 1613232 - RNA, 16 nt, Human
gcuugccaucccuccc

SEQ ID NO: 1613233 - RNA, 22 nt, Human
gcuugcagagaugaggccgcca

SEQ ID NO: 1613234 - RNA, 16 nt, Human
gcuucuguugcugccu

SEQ ID NO: 1613235 - RNA, 16 nt, Human
gcuguucacagccaga

SEQ ID NO: 1613236 - RNA, 15 nt, Human
gcuguucacagccag

SEQ ID NO: 1613237 - RNA, 23 nt, Human
gcuguucacagccagacuggcac

SEQ ID NO: 1613238 - RNA, 13 nt, Human
gcuguucagcugg

SEQ ID NO: 1613239 - RNA, 20 nt, Human
gcuuccagugaggcucugcc

SEQ ID NO: 1613240 - RNA, 19 nt, Human
gcuuccagugaggcucugc

SEQ ID NO: 1613241 - RNA, 21 nt, Human
gcuuccagugaggcucugccc

SEQ ID NO: 1613242 - RNA, 17 nt, Human
gcuucucacugccaugc

SEQ ID NO: 1613243 - RNA, 22 nt, Human
gcuuccagugaggcucugcccu

SEQ ID NO: 1613244 - RNA, 20 nt, Human
ggaaaaaauaacaaugaaag

SEQ ID NO: 1613245 - RNA, 14 nt, Human
gcuuuuacuuaaac

SEQ ID NO: 1613246 - RNA, 17 nt, Human
gcuuuuaaaaaaaaaua

SEQ ID NO: 1613247 - RNA, 16 nt, Human
gcuuugggcugcccug

SEQ ID NO: 1613248 - RNA, 15 nt, Human
gcuuugggcugcccu

SEQ ID NO: 1613249 - RNA, 18 nt, Human
gcuuugggcugcccuggu

SEQ ID NO: 1613250 - RNA, 15 nt, Human
ggaaaaauagccugc

SEQ ID NO: 1613251 - RNA, 22 nt, Human
ggaaaaccaagccguggcuucc

SEQ ID NO: 1613252 - RNA, 14 nt, Human
ggaaaaacugauuu

SEQ ID NO: 1613253 - RNA, 13 nt, Human
ggaaaaauagccu

SEQ ID NO: 1613254 - RNA, 14 nt, Human
gcuuugggcugccc

SEQ ID NO: 1613255 - RNA, 16 nt, Human
ggaaaucaaauaugca

SEQ ID NO: 1613256 - RNA, 20 nt, Human
ggaacagacuggaagcacag

SEQ ID NO: 1613257 - RNA, 19 nt, Human
ggaacagacuggaagcaca

SEQ ID NO: 1613258 - RNA, 17 nt, Human
ggaacgcguugaaauug

SEQ ID NO: 1613259 - RNA, 21 nt, Human
ggaacgcguugaaauuguaau

SEQ ID NO: 1613260 - RNA, 23 nt, Human
ggaacuagacucccaagcuggac

SEQ ID NO: 1613261 - RNA, 18 nt, Human
ggaaauauuuauuuuaau

SEQ ID NO: 1613262 - RNA, 17 nt, Human
ggaaauauuuauuuuaa

SEQ ID NO: 1613263 - RNA, 15 nt, Human
ggaaauauuuauuuu

SEQ ID NO: 1613264 - RNA, 13 nt, Human
ggaaauauuuauu

SEQ ID NO: 1613265 - RNA, 12 nt, Human
ggaaauauuuau

SEQ ID NO: 1613266 - RNA, 14 nt, Human
ggaaaauaaauuau

SEQ ID NO: 1613267 - RNA, 19 nt, Human
ggaaaaguuuaauauuaaa

SEQ ID NO: 1613268 - RNA, 15 nt, Human
ggaaaaucagccugc

SEQ ID NO: 1613269 - RNA, 22 nt, Human
ggaagcacaugccucucucagg

SEQ ID NO: 1613270 - RNA, 21 nt, Human
ggaagcacaugccucucucag

SEQ ID NO: 1613271 - RNA, 23 nt, Human
ggaagcacaugccucucucaggc

SEQ ID NO: 1613272 - RNA, 13 nt, Human
ggaagcagcuuuc

SEQ ID NO: 1613273 - RNA, 18 nt, Human
ggaagccagcaggcucuc

SEQ ID NO: 1613274 - RNA, 17 nt, Human
ggaagccagcaggcucu

SEQ ID NO: 1613275 - RNA, 16 nt, Human
ggaagccagcaggcuc

SEQ ID NO: 1613276 - RNA, 15 nt, Human
ggaagccagcaggcu

SEQ ID NO: 1613277 - RNA, 14 nt, Human
ggaagccagcaggc

SEQ ID NO: 1613278 - RNA, 13 nt, Human
ggaagccagcagg

SEQ ID NO: 1613279 - RNA, 17 nt, Human
ggaagcacaugccucuc

SEQ ID NO: 1613280 - RNA, 15 nt, Human
ggaagcacaugccuc

SEQ ID NO: 1613281 - RNA, 14 nt, Human
ggaagcacaugccu

SEQ ID NO: 1613282 - RNA, 13 nt, Human
ggaagcacaugcc

SEQ ID NO: 1613283 - RNA, 17 nt, Human
ggaagcacagcuucauu

SEQ ID NO: 1613284 - RNA, 13 nt, Human
ggaagagccuugc

SEQ ID NO: 1613285 - RNA, 17 nt, Human
uauacccccugcaaagc

SEQ ID NO: 1613286 - RNA, 20 nt, Human
uauacucuuauagacaacau

SEQ ID NO: 1613287 - RNA, 17 nt, Human
uauaauucuacuuugag

SEQ ID NO: 1613288 - RNA, 20 nt, Human
uauaauguaagcucuacuga

SEQ ID NO: 1613289 - RNA, 19 nt, Human
uauaauguaagcucuacug

SEQ ID NO: 1613290 - RNA, 14 nt, Human
uauaauguaagcuc

SEQ ID NO: 1613291 - RNA, 18 nt, Human
uauaacaaugcuguauuu

SEQ ID NO: 1613292 - RNA, 18 nt, Human
uauaaugaaugaaacauu

SEQ ID NO: 1613293 - RNA, 20 nt, Human
uauaaugaaugaaacauuuu

SEQ ID NO: 1613294 - RNA, 15 nt, Human
uaguuuuauaugcuu

SEQ ID NO: 1613295 - RNA, 21 nt, Human
uaguuguaccgcaaugugacu

SEQ ID NO: 1613296 - RNA, 12 nt, Human
uaguuugcaguu

SEQ ID NO: 1613297 - RNA, 23 nt, Human
uaguuugauuaaauucuugcaaa

SEQ ID NO: 1613298 - RNA, 13 nt, Human
uaguuucuccaag

SEQ ID NO: 1613299 - RNA, 15 nt, Human
uaguggauguucuga

SEQ ID NO: 1613300 - RNA, 15 nt, Human
uaguggauggaaggg

SEQ ID NO: 1613301 - RNA, 18 nt, Human
uaguggauggaaggggcu

SEQ ID NO: 1613302 - RNA, 18 nt, Human
uagucaaauugugugaaa

SEQ ID NO: 1613303 - RNA, 18 nt, Human
uagugaugguuccccugu

SEQ ID NO: 1613304 - RNA, 14 nt, Human
uagugaugguuccc

SEQ ID NO: 1613305 - RNA, 19 nt, Human
uauauuuuuuguuaaauga

SEQ ID NO: 1613306 - RNA, 19 nt, Human
uauauuuuuauauuuacua

SEQ ID NO: 1613307 - RNA, 17 nt, Human
uaucaggugcugccauc

SEQ ID NO: 1613308 - RNA, 17 nt, Human
uaucaugacaaagacug

SEQ ID NO: 1613309 - RNA, 16 nt, Human
uaucaugucaaacgug

SEQ ID NO: 1613310 - RNA, 16 nt, Human
uaucaugacaaagacu

SEQ ID NO: 1613311 - RNA, 22 nt, Human
uaucaugugaaaucauucauuu

SEQ ID NO: 1613312 - RNA, 17 nt, Human
uaucaugugaaaucauu

SEQ ID NO: 1613313 - RNA, 21 nt, Human
uaucaugucaaacgugaaaau

SEQ ID NO: 1613314 - RNA, 19 nt, Human
uaucgucacugcuuaacuu

SEQ ID NO: 1613315 - RNA, 15 nt, Human
uaucuaaauguugaa

SEQ ID NO: 1613316 - RNA, 16 nt, Human
uaucuaaauguugaaa

SEQ ID NO: 1613317 - RNA, 23 nt, Human
uauauuuauuacuguaagaaaau

SEQ ID NO: 1613318 - RNA, 20 nt, Human
uauauuuauuacuguaagaa

SEQ ID NO: 1613319 - RNA, 14 nt, Human
uauauuugaaauau

SEQ ID NO: 1613320 - RNA, 13 nt, Human
uauauuugaaaua

SEQ ID NO: 1613321 - RNA, 18 nt, Human
uauauuuuuauauuuacu

SEQ ID NO: 1613322 - RNA, 14 nt, Human
uauauuuuaagacg

SEQ ID NO: 1613323 - RNA, 13 nt, Human
uauauuuuaagac

SEQ ID NO: 1613324 - RNA, 20 nt, Human
uauaugcucugcauguuaca

SEQ ID NO: 1613325 - RNA, 18 nt, Human
uauaugcuauuucuauau

SEQ ID NO: 1613326 - RNA, 16 nt, Human
uauaugcuauuucuau

SEQ ID NO: 1613327 - RNA, 16 nt, Human
uaggccaugggacagg

SEQ ID NO: 1613328 - RNA, 13 nt, Human
uaggccaugggac

SEQ ID NO: 1613329 - RNA, 13 nt, Human
uaggccuggccag

SEQ ID NO: 1613330 - RNA, 14 nt, Human
uaggccuggccaga

SEQ ID NO: 1613331 - RNA, 20 nt, Human
uaggaauugacccacaagaa

SEQ ID NO: 1613332 - RNA, 23 nt, Human
uaggaauugacccacaagaaaug

SEQ ID NO: 1613333 - RNA, 16 nt, Human
uaggaauuguguuuau

SEQ ID NO: 1613334 - RNA, 14 nt, Human
uaggaauuguguuu

SEQ ID NO: 1613335 - RNA, 15 nt, Human
uaggaagguuaaugu

SEQ ID NO: 1613336 - RNA, 17 nt, Human
uaggaagacuuuggaaa

SEQ ID NO: 1613337 - RNA, 16 nt, Human
uaggaagacuuuggaa

SEQ ID NO: 1613338 - RNA, 15 nt, Human
uaggaagacuuugga

SEQ ID NO: 1613339 - RNA, 14 nt, Human
uaggaagacuuugg

SEQ ID NO: 1613340 - RNA, 13 nt, Human
uaggaagacuuug

SEQ ID NO: 1613341 - RNA, 17 nt, Human
uaggaacacuccuucac

SEQ ID NO: 1613342 - RNA, 21 nt, Human
uaggaacuuaaauaaugugaa

SEQ ID NO: 1613343 - RNA, 14 nt, Human
uaggaacacuccuu

SEQ ID NO: 1613344 - RNA, 13 nt, Human
uaggaacacuccu

SEQ ID NO: 1613345 - RNA, 17 nt, Human
uagccugccucuucucu

SEQ ID NO: 1613346 - RNA, 22 nt, Human
uagcucauucuccuuguguuac

SEQ ID NO: 1613347 - RNA, 21 nt, Human
uagcucuaggagggcuggcaa

SEQ ID NO: 1613348 - RNA, 20 nt, Human
uagcugggacuacaggcacc

SEQ ID NO: 1613349 - RNA, 12 nt, Human
uagcugggacua

SEQ ID NO: 1613350 - RNA, 18 nt, Human
uagcugggacuacaggug

SEQ ID NO: 1613351 - RNA, 22 nt, Human
uagcugggagaaagagagagcu

SEQ ID NO: 1613352 - RNA, 11 nt, Human
uagcugggacu

SEQ ID NO: 1613353 - RNA, 14 nt, Human
uagcccaaaaccaa

SEQ ID NO: 1613354 - RNA, 18 nt, Human
uagcccucacccuggggc

SEQ ID NO: 1613355 - RNA, 13 nt, Human
uagccccauaauu

SEQ ID NO: 1613356 - RNA, 18 nt, Human
uagaguuuagcuggaaaa

SEQ ID NO: 1613357 - RNA, 17 nt, Human
uagaguuuagcuggaaa

SEQ ID NO: 1613358 - RNA, 19 nt, Human
uagagguucaaagauauuu

SEQ ID NO: 1613359 - RNA, 16 nt, Human
uagagguucaaagaua

SEQ ID NO: 1613360 - RNA, 21 nt, Human
uagagguucaaagauauuuug

SEQ ID NO: 1613361 - RNA, 16 nt, Human
uagagagagaccacuu

SEQ ID NO: 1613362 - RNA, 14 nt, Human
uagagaguguugaa

SEQ ID NO: 1613363 - RNA, 15 nt, Human
uagagaguguugaaa

SEQ ID NO: 1613364 - RNA, 23 nt, Human
uagaaccaggcaacuugggaacu

SEQ ID NO: 1613365 - RNA, 12 nt, Human
uagaaccaggca

SEQ ID NO: 1613366 - RNA, 18 nt, Human
uagacuggugacugauuc

SEQ ID NO: 1613367 - RNA, 17 nt, Human
uagacuggugacugauu

SEQ ID NO: 1613368 - RNA, 14 nt, Human
uagacuggugacug

SEQ ID NO: 1613369 - RNA, 13 nt, Human
uagacuggugacu

SEQ ID NO: 1613370 - RNA, 20 nt, Human
uagcagggcauggcugggaa

SEQ ID NO: 1613371 - RNA, 23 nt, Human
uagcagagaaugaaagggcccag

SEQ ID NO: 1613372 - RNA, 19 nt, Human
uagcagagaaugaaagggc

SEQ ID NO: 1613373 - RNA, 16 nt, Human
uagcacuuugggaggc

SEQ ID NO: 1613374 - RNA, 20 nt, Human
uagauguauguacuucaugc

SEQ ID NO: 1613375 - RNA, 16 nt, Human
uagauguauguacuuc

SEQ ID NO: 1613376 - RNA, 12 nt, Human
uagauguauaua

SEQ ID NO: 1613377 - RNA, 18 nt, Human
uagauaauacaccacuac

SEQ ID NO: 1613378 - RNA, 23 nt, Human
uaccuuuguucccaaauuucaua

SEQ ID NO: 1613379 - RNA, 22 nt, Human
uaccuuuuuuauacauaaacaa

SEQ ID NO: 1613380 - RNA, 19 nt, Human
uacuaaccagcagaaaugc

SEQ ID NO: 1613381 - RNA, 18 nt, Human
uacuaaccagcagaaaug

SEQ ID NO: 1613382 - RNA, 17 nt, Human
uacuacaguccucccau

SEQ ID NO: 1613383 - RNA, 12 nt, Human
uacuacaguccu

SEQ ID NO: 1613384 - RNA, 20 nt, Human
uacuaauagacaauuuauua

SEQ ID NO: 1613385 - RNA, 13 nt, Human
uacuaacuuuccu

SEQ ID NO: 1613386 - RNA, 15 nt, Human
uacuaauagacaauu

SEQ ID NO: 1613387 - RNA, 17 nt, Human
uacuaauagacaauuua

SEQ ID NO: 1613388 - RNA, 22 nt, Human
uacccaucccauaugccugggc

SEQ ID NO: 1613389 - RNA, 18 nt, Human
uaccuuuuuuauacauaa

SEQ ID NO: 1613390 - RNA, 19 nt, Human
uaccuuuuuuauacauaaa

SEQ ID NO: 1613391 - RNA, 20 nt, Human
uaccuuuuuuauacauaaac

SEQ ID NO: 1613392 - RNA, 20 nt, Human
uaccuuuguauucucuccug

SEQ ID NO: 1613393 - RNA, 19 nt, Human
uaccuuugacaaagguaaa

SEQ ID NO: 1613394 - RNA, 23 nt, Human
uacugauguuccuagugaaagag

SEQ ID NO: 1613395 - RNA, 15 nt, Human
uacugaggugcuaug

SEQ ID NO: 1613396 - RNA, 17 nt, Human
uacucccaucugugaaa

SEQ ID NO: 1613397 - RNA, 16 nt, Human
uacucccaucugugaa

SEQ ID NO: 1613398 - RNA, 14 nt, Human
uacucccaucugug

SEQ ID NO: 1613399 - RNA, 20 nt, Human
uacuacaguccucccaucuc

SEQ ID NO: 1613400 - RNA, 12 nt, Human
uacucaccucac

SEQ ID NO: 1613401 - RNA, 13 nt, Human
uacuacuccugua

SEQ ID NO: 1613402 - RNA, 14 nt, Human
uacucaccucaccc

SEQ ID NO: 1613403 - RNA, 16 nt, Human
uacucagaauucucua

SEQ ID NO: 1613404 - RNA, 22 nt, Human
uacucagaauucucuaguuuga

SEQ ID NO: 1613405 - RNA, 23 nt, Human
uagaaauaucugaaaauguaugu

SEQ ID NO: 1613406 - RNA, 21 nt, Human
uagaaauaucugaaaauguau

SEQ ID NO: 1613407 - RNA, 20 nt, Human
uagaaauaucugaaaaugua

SEQ ID NO: 1613408 - RNA, 15 nt, Human
uagaaauauaauuga

SEQ ID NO: 1613409 - RNA, 21 nt, Human
uacuugcucuugaugccuggc

SEQ ID NO: 1613410 - RNA, 18 nt, Human
uacuuguggacacagcuc

SEQ ID NO: 1613411 - RNA, 15 nt, Human
uacuuguggacacag

SEQ ID NO: 1613412 - RNA, 19 nt, Human
uacuuguggacacagcucu

SEQ ID NO: 1613413 - RNA, 21 nt, Human
uacuguaucaugacaaagacu

SEQ ID NO: 1613414 - RNA, 17 nt, Human
uacugcauaugaaagga

SEQ ID NO: 1613415 - RNA, 16 nt, Human
uacauuuguauaaaau

SEQ ID NO: 1613416 - RNA, 11 nt, Human
uacauuugugu

SEQ ID NO: 1613417 - RNA, 17 nt, Human
uacauuuguauaaaaua

SEQ ID NO: 1613418 - RNA, 22 nt, Human
uacaugagguacugagagugaa

SEQ ID NO: 1613419 - RNA, 21 nt, Human
uacaugagguacugagaguga

SEQ ID NO: 1613420 - RNA, 16 nt, Human
uaccaacacgagcagg

SEQ ID NO: 1613421 - RNA, 22 nt, Human
uacauaagauaaaugugcugaa

SEQ ID NO: 1613422 - RNA, 19 nt, Human
uacaguuacucagaauucu

SEQ ID NO: 1613423 - RNA, 23 nt, Human
uacaguuacucagaauucucuag

SEQ ID NO: 1613424 - RNA, 19 nt, Human
uacauaagauaaaugugcu

SEQ ID NO: 1613425 - RNA, 18 nt, Human
uacauaagauaaaugugc

SEQ ID NO: 1613426 - RNA, 18 nt, Human
uacaguuccuagguauaa

SEQ ID NO: 1613427 - RNA, 18 nt, Human
uaccaccagucugacugu

SEQ ID NO: 1613428 - RNA, 23 nt, Human
uaccacaggaaccacaagacugc

SEQ ID NO: 1613429 - RNA, 15 nt, Human
uaccaccacgcccgg

SEQ ID NO: 1613430 - RNA, 23 nt, Human
uaccauuuugggguacccacugc

SEQ ID NO: 1613431 - RNA, 13 nt, Human
uaccacagacaua

SEQ ID NO: 1613432 - RNA, 22 nt, Human
uacccaggugcuaggaacacuc

SEQ ID NO: 1613433 - RNA, 18 nt, Human
uacccagcgagcccuggu

SEQ ID NO: 1613434 - RNA, 15 nt, Human
uacccacugcucugg

SEQ ID NO: 1613435 - RNA, 14 nt, Human
uacccacugcucug

SEQ ID NO: 1613436 - RNA, 13 nt, Human
uacccacugcucu

SEQ ID NO: 1613437 - RNA, 12 nt, Human
uacccacugcuc

SEQ ID NO: 1613438 - RNA, 11 nt, Human
uacccacugcu

SEQ ID NO: 1613439 - RNA, 19 nt, Human
uacccacccccacccaagg

SEQ ID NO: 1613440 - RNA, 17 nt, Human
uacccacccccacccaa

SEQ ID NO: 1613441 - RNA, 23 nt, Human
uacccacccccacccaagggccu

SEQ ID NO: 1613442 - RNA, 15 nt, Human
uacccacccccaccc

SEQ ID NO: 1613443 - RNA, 12 nt, Human
uacccaccccca

SEQ ID NO: 1613444 - RNA, 15 nt, Human
uacccaaauuaagag

SEQ ID NO: 1613445 - RNA, 13 nt, Human
uacagaauuuuau

SEQ ID NO: 1613446 - RNA, 24 nt, Human
uacagcaaggagauuuacaacugg

SEQ ID NO: 1613447 - RNA, 17 nt, Human
uacacuguuucaaacuu

SEQ ID NO: 1613448 - RNA, 18 nt, Human
uacacuguuucaaacuuu

SEQ ID NO: 1613449 - RNA, 19 nt, Human
uacacuguuucaaacuuua

SEQ ID NO: 1613450 - RNA, 13 nt, Human
uacacuuuaugca

SEQ ID NO: 1613451 - RNA, 22 nt, Human
uacagaaaaguugaauuuuaca

SEQ ID NO: 1613452 - RNA, 18 nt, Human
uacagaaaaguugaauuu

SEQ ID NO: 1613453 - RNA, 22 nt, Human
uacagcuugaccgugaggccag

SEQ ID NO: 1613454 - RNA, 18 nt, Human
uacaggaaaagcugcuga

SEQ ID NO: 1613455 - RNA, 17 nt, Human
uacaggaaaagcugcug

SEQ ID NO: 1613456 - RNA, 23 nt, Human
uacagcuugaccgugaggccaga

SEQ ID NO: 1613457 - RNA, 16 nt, Human
uacaggcacccaccau

SEQ ID NO: 1613458 - RNA, 19 nt, Human
uacaggaaaagcugcugac

SEQ ID NO: 1613459 - RNA, 15 nt, Human
uacaggcauagaguu

SEQ ID NO: 1613460 - RNA, 13 nt, Human
uaauuuuggaauu

SEQ ID NO: 1613461 - RNA, 12 nt, Human
uaauuuuggaau

SEQ ID NO: 1613462 - RNA, 17 nt, Human
uaauuuugaaaaacugc

SEQ ID NO: 1613463 - RNA, 13 nt, Human
uaauuuugaaaaa

SEQ ID NO: 1613464 - RNA, 15 nt, Human
uacaagacacaguga

SEQ ID NO: 1613465 - RNA, 18 nt, Human
uacaauuuuguuucugua

SEQ ID NO: 1613466 - RNA, 19 nt, Human
uacaagagcuuaacagugu

SEQ ID NO: 1613467 - RNA, 21 nt, Human
uacaauuuuguuucuguacuu

SEQ ID NO: 1613468 - RNA, 19 nt, Human
uacaauuuuguuucuguac

SEQ ID NO: 1613469 - RNA, 22 nt, Human
uacacacugcauguuugugauu

SEQ ID NO: 1613470 - RNA, 16 nt, Human
uacacugugcugaguc

SEQ ID NO: 1613471 - RNA, 14 nt, Human
uacacuguuucaaa

SEQ ID NO: 1613472 - RNA, 15 nt, Human
uacacacacauacac

SEQ ID NO: 1613473 - RNA, 21 nt, Human
uacacacacacgcgugcacac

SEQ ID NO: 1613474 - RNA, 23 nt, Human
uacacaaugguuuucuugugugu

SEQ ID NO: 1613475 - RNA, 21 nt, Human
uacacaaugguuuucuugugu

SEQ ID NO: 1613476 - RNA, 17 nt, Human
uacacaaugguuuucuu

SEQ ID NO: 1613477 - RNA, 20 nt, Human
uaauuaaaagaauauuuuaa

SEQ ID NO: 1613478 - RNA, 17 nt, Human
uaauuaaaacacaacau

SEQ ID NO: 1613479 - RNA, 20 nt, Human
uaauuaacauguuaaaccau

SEQ ID NO: 1613480 - RNA, 19 nt, Human
uaauuaacauguuaaacca

SEQ ID NO: 1613481 - RNA, 18 nt, Human
uaauuaacauguuaaacc

SEQ ID NO: 1613482 - RNA, 17 nt, Human
uaauuaacauguuaaac

SEQ ID NO: 1613483 - RNA, 15 nt, Human
uaauuaacauguuaa

SEQ ID NO: 1613484 - RNA, 14 nt, Human
uaauuaacauguua

SEQ ID NO: 1613485 - RNA, 12 nt, Human
uaauuaacaugu

SEQ ID NO: 1613486 - RNA, 15 nt, Human
uaauguuucaaacau

SEQ ID NO: 1613487 - RNA, 14 nt, Human
uaauguuucaaaca

SEQ ID NO: 1613488 - RNA, 23 nt, Human
uaaugcgcaggcuggcccugccc

SEQ ID NO: 1613489 - RNA, 14 nt, Human
uaaugcgugcauac

SEQ ID NO: 1613490 - RNA, 22 nt, Human
uaaugcgcaggcuggcccugcc

SEQ ID NO: 1613491 - RNA, 19 nt, Human
uaaugcgcaggcuggcccu

SEQ ID NO: 1613492 - RNA, 20 nt, Human
uaauugacaggauuauugga

SEQ ID NO: 1613493 - RNA, 22 nt, Human
uaauugacaggauuauuggaaa

SEQ ID NO: 1613494 - RNA, 18 nt, Human
uaauucuuagcucauucu

SEQ ID NO: 1613495 - RNA, 19 nt, Human
uaauuugugauacaaugcu

SEQ ID NO: 1613496 - RNA, 22 nt, Human
uaauuugugauacaaugcugug

SEQ ID NO: 1613497 - RNA, 23 nt, Human
uaauuuguaguguuggagaagaa

SEQ ID NO: 1613498 - RNA, 14 nt, Human
uaauuugugauaca

SEQ ID NO: 1613499 - RNA, 15 nt, Human
uaauuugugauacaa

SEQ ID NO: 1613500 - RNA, 18 nt, Human
uaauuugugauacaaugc

SEQ ID NO: 1613501 - RNA, 20 nt, Human
uaauuuguaguguuggagaa

SEQ ID NO: 1613502 - RNA, 18 nt, Human
uaauuugguuuucacauu

SEQ ID NO: 1613503 - RNA, 17 nt, Human
uaauuugguuuucacau

SEQ ID NO: 1613504 - RNA, 15 nt, Human
uaauuugguuuucac

SEQ ID NO: 1613505 - RNA, 22 nt, Human
uaauuggaaaggcagcucuaaa

SEQ ID NO: 1613506 - RNA, 20 nt, Human
uaauaaggaaaaguuuaaua

SEQ ID NO: 1613507 - RNA, 11 nt, Human
uaauaaagcug

SEQ ID NO: 1613508 - RNA, 20 nt, Human
uaagugguacuaacuuuccu

SEQ ID NO: 1613509 - RNA, 15 nt, Human
uaauaauguuucaaa

SEQ ID NO: 1613510 - RNA, 23 nt, Human
uaauaauuauaugcuauuucuau

SEQ ID NO: 1613511 - RNA, 22 nt, Human
uaauaauuauaugcuauuucua

SEQ ID NO: 1613512 - RNA, 20 nt, Human
uaauaauuauaugcuauuuc

SEQ ID NO: 1613513 - RNA, 19 nt, Human
uaauaauuauaugcuauuu

SEQ ID NO: 1613514 - RNA, 16 nt, Human
uaauaauuauaugcua

SEQ ID NO: 1613515 - RNA, 15 nt, Human
uaauaauuauaugcu

SEQ ID NO: 1613516 - RNA, 21 nt, Human
uaauaguucagguaacaggca

SEQ ID NO: 1613517 - RNA, 14 nt, Human
uaauacaccacuac

SEQ ID NO: 1613518 - RNA, 16 nt, Human
uaaucguguccccuau

SEQ ID NO: 1613519 - RNA, 16 nt, Human
uaaucgaccugccucg

SEQ ID NO: 1613520 - RNA, 14 nt, Human
uaaucgaccugccu

SEQ ID NO: 1613521 - RNA, 13 nt, Human
uaaucgaccugcc

SEQ ID NO: 1613522 - RNA, 15 nt, Human
uaauauuaaagccau

SEQ ID NO: 1613523 - RNA, 14 nt, Human
uaauauuaaagcca

SEQ ID NO: 1613524 - RNA, 13 nt, Human
uaauauuaaagcc

SEQ ID NO: 1613525 - RNA, 12 nt, Human
uaauauuaaagc

SEQ ID NO: 1613526 - RNA, 19 nt, Human
uaaugccacuaaauugaca

SEQ ID NO: 1613527 - RNA, 23 nt, Human
uaaugaugucguuugaaucacag

SEQ ID NO: 1613528 - RNA, 17 nt, Human
uaaugaugucguuugaa

SEQ ID NO: 1613529 - RNA, 11 nt, Human
uaaucuaaaug

SEQ ID NO: 1613530 - RNA, 12 nt, Human
uaaucuaaaugg

SEQ ID NO: 1613531 - RNA, 21 nt, Human
uaacuuuuauaaacuuuaccu

SEQ ID NO: 1613532 - RNA, 22 nt, Human
uaacuuuuauaaacuuuaccuu

SEQ ID NO: 1613533 - RNA, 22 nt, Human
uaagaaccuuuugagugccuua

SEQ ID NO: 1613534 - RNA, 17 nt, Human
uaagagagucuauuuac

SEQ ID NO: 1613535 - RNA, 23 nt, Human
uaagagggauuagggagagaaga

SEQ ID NO: 1613536 - RNA, 23 nt, Human
uaagagggagggagggcuccaga

SEQ ID NO: 1613537 - RNA, 22 nt, Human
uaagagggagggagggcuccag

SEQ ID NO: 1613538 - RNA, 12 nt, Human
uaagagggaggg

SEQ ID NO: 1613539 - RNA, 14 nt, Human
uaagauaaaugugc

SEQ ID NO: 1613540 - RNA, 17 nt, Human
uaagauaaaugugcuga

SEQ ID NO: 1613541 - RNA, 16 nt, Human
uaagauaaaugugcug

SEQ ID NO: 1613542 - RNA, 21 nt, Human
uaagccagacaucaacagaua

SEQ ID NO: 1613543 - RNA, 20 nt, Human
uaagccagacaucaacagau

SEQ ID NO: 1613544 - RNA, 19 nt, Human
uaaggaugcuuguacauaa

SEQ ID NO: 1613545 - RNA, 21 nt, Human
uaagccuuuggaaacagcucg

SEQ ID NO: 1613546 - RNA, 17 nt, Human
uaagccuuuggaaacag

SEQ ID NO: 1613547 - RNA, 14 nt, Human
uaagccuuuggaaa

SEQ ID NO: 1613548 - RNA, 20 nt, Human
uaaggaugcuuguacauaau

SEQ ID NO: 1613549 - RNA, 21 nt, Human
uaaggaugcuuguacauaaug

SEQ ID NO: 1613550 - RNA, 22 nt, Human
uaaggaugcuuguacauaaugc

SEQ ID NO: 1613551 - RNA, 23 nt, Human
uaaggaugcuuguacauaaugcg

SEQ ID NO: 1613552 - RNA, 16 nt, Human
uaaggauguucuagca

SEQ ID NO: 1613553 - RNA, 15 nt, Human
uaaggcaaucauggu

SEQ ID NO: 1613554 - RNA, 13 nt, Human
uaagccagacauc

SEQ ID NO: 1613555 - RNA, 20 nt, Human
uaagcauuccaacuaucuca

SEQ ID NO: 1613556 - RNA, 18 nt, Human
uaagcauuccaacuaucu

SEQ ID NO: 1613557 - RNA, 16 nt, Human
uaagcauuccaacuau

SEQ ID NO: 1613558 - RNA, 15 nt, Human
uaagcaugcacaaau

SEQ ID NO: 1613559 - RNA, 23 nt, Human
uaagcauauauuuuuauauuuac

SEQ ID NO: 1613560 - RNA, 19 nt, Human
uaagcauauauuuuuauau

SEQ ID NO: 1613561 - RNA, 22 nt, Human
uaagcauauauuuuuauauuua

SEQ ID NO: 1613562 - RNA, 21 nt, Human
uaagcauauauuuuuauauuu

SEQ ID NO: 1613563 - RNA, 20 nt, Human
uaacuuuuauaaacuuuacc

SEQ ID NO: 1613564 - RNA, 17 nt, Human
uaacugagugccuuuug

SEQ ID NO: 1613565 - RNA, 16 nt, Human
uaacugagugccuuuu

SEQ ID NO: 1613566 - RNA, 19 nt, Human
uaacaggcagauacaggaa

SEQ ID NO: 1613567 - RNA, 17 nt, Human
uaacauguuaaaccaug

SEQ ID NO: 1613568 - RNA, 18 nt, Human
uaacauguuaaaccaugg

SEQ ID NO: 1613569 - RNA, 14 nt, Human
uaaccagcagaaau

SEQ ID NO: 1613570 - RNA, 16 nt, Human
uaaccagcagaaaugc

SEQ ID NO: 1613571 - RNA, 19 nt, Human
uaaccagcagaaaugccuu

SEQ ID NO: 1613572 - RNA, 14 nt, Human
uaacagaaauguac

SEQ ID NO: 1613573 - RNA, 15 nt, Human
uaacagaaauguaca

SEQ ID NO: 1613574 - RNA, 13 nt, Human
uaacagaaaugua

SEQ ID NO: 1613575 - RNA, 14 nt, Human
uaaauuuaguauuu

SEQ ID NO: 1613576 - RNA, 15 nt, Human
uaaauugcuccuuga

SEQ ID NO: 1613577 - RNA, 19 nt, Human
uaaaucccauuauucaaag

SEQ ID NO: 1613578 - RNA, 17 nt, Human
uaaaucccauuauucaa

SEQ ID NO: 1613579 - RNA, 16 nt, Human
uaaaucccauuauuca

SEQ ID NO: 1613580 - RNA, 23 nt, Human
uaaauccauuuggaaaucuuuaa

SEQ ID NO: 1613581 - RNA, 22 nt, Human
uaaauccauuuggaaaucuuua

SEQ ID NO: 1613582 - RNA, 19 nt, Human
uaaauccauuuggaaaucu

SEQ ID NO: 1613583 - RNA, 18 nt, Human
uaaauccauuuggaaauc

SEQ ID NO: 1613584 - RNA, 18 nt, Human
uaaauauaugcuaagucu

SEQ ID NO: 1613585 - RNA, 22 nt, Human
uaaauauauuuuaagacgaaac

SEQ ID NO: 1613586 - RNA, 16 nt, Human
uaaauauauuuuaaga

SEQ ID NO: 1613587 - RNA, 19 nt, Human
uaaaucagccguguaacca

SEQ ID NO: 1613588 - RNA, 20 nt, Human
uaaaucagacuaugaaguuu

SEQ ID NO: 1613589 - RNA, 19 nt, Human
uaaaucaaguuggcuucua

SEQ ID NO: 1613590 - RNA, 14 nt, Human
uaaauccauuugga

SEQ ID NO: 1613591 - RNA, 16 nt, Human
uaaauccauuuggaaa

SEQ ID NO: 1613592 - RNA, 15 nt, Human
uaaauccauuuggaa

SEQ ID NO: 1613593 - RNA, 17 nt, Human
uaaauaaaaauaauccu

SEQ ID NO: 1613594 - RNA, 13 nt, Human
uaaaguuucuguu

SEQ ID NO: 1613595 - RNA, 14 nt, Human
uaaaguuuguugaa

SEQ ID NO: 1613596 - RNA, 22 nt, Human
uaaaguguauuuuuuuacuaau

SEQ ID NO: 1613597 - RNA, 23 nt, Human
uaaaguguauuuuuuuacuaaua

SEQ ID NO: 1613598 - RNA, 21 nt, Human
uaaaguguauuuuuuuacuaa

SEQ ID NO: 1613599 - RNA, 23 nt, Human
uaaaguugaauuuauuggcuuuu

SEQ ID NO: 1613600 - RNA, 21 nt, Human
uaaaguugaauuuauuggcuu

SEQ ID NO: 1613601 - RNA, 19 nt, Human
uaaaguugaauuuauuggc

SEQ ID NO: 1613602 - RNA, 17 nt, Human
uaaaguugaauuuauug

SEQ ID NO: 1613603 - RNA, 15 nt, Human
uaaaguugaauuuau

SEQ ID NO: 1613604 - RNA, 14 nt, Human
uaaaguugaauuua

SEQ ID NO: 1613605 - RNA, 13 nt, Human
uaaaguugaauuu

SEQ ID NO: 1613606 - RNA, 20 nt, Human
uaaacuuuuuucuuacuguc

SEQ ID NO: 1613607 - RNA, 15 nt, Human
uaaacuuuucugaua

SEQ ID NO: 1613608 - RNA, 14 nt, Human
uaaacuuuucugau

SEQ ID NO: 1613609 - RNA, 13 nt, Human
uaaacuuuucuga

SEQ ID NO: 1613610 - RNA, 17 nt, Human
uaaaauggguuuuacug

SEQ ID NO: 1613611 - RNA, 18 nt, Human
uaaacaagaccacguuuc

SEQ ID NO: 1613612 - RNA, 23 nt, Human
uaaacaagaccacguuucuaaag

SEQ ID NO: 1613613 - RNA, 19 nt, Human
uaaacaagaccacguuucu

SEQ ID NO: 1613614 - RNA, 21 nt, Human
uaaacacucuugaaaaaugca

SEQ ID NO: 1613615 - RNA, 22 nt, Human
uaaacuuuaccuuuuuuauaca

SEQ ID NO: 1613616 - RNA, 16 nt, Human
uaaacuuuaccuuuuu

SEQ ID NO: 1613617 - RNA, 14 nt, Human
uaaacuuaaucuaa

SEQ ID NO: 1613618 - RNA, 18 nt, Human
uaaacuuaaucuaaaugg

SEQ ID NO: 1613619 - RNA, 19 nt, Human
uaaacuuaaucuaaaugga

SEQ ID NO: 1613620 - RNA, 23 nt, Human
uaaacugcccccucugcccugcg

SEQ ID NO: 1613621 - RNA, 22 nt, Human
uaaacugcccccucugcccugc

SEQ ID NO: 1613622 - RNA, 21 nt, Human
uaaacugcccccucugcccug

SEQ ID NO: 1613623 - RNA, 20 nt, Human
uaaacugcccccucugcccu

SEQ ID NO: 1613624 - RNA, 14 nt, Human
uaaaagaugaaaau

SEQ ID NO: 1613625 - RNA, 15 nt, Human
uaaaaaugguuuaaa

SEQ ID NO: 1613626 - RNA, 21 nt, Human
uaaaagggacugagaaauuua

SEQ ID NO: 1613627 - RNA, 20 nt, Human
uaaaagggacugagaaauuu

SEQ ID NO: 1613628 - RNA, 19 nt, Human
uaaaagggacugagaaauu

SEQ ID NO: 1613629 - RNA, 17 nt, Human
uaaaagggacugagaaa

SEQ ID NO: 1613630 - RNA, 18 nt, Human
uaaaauccauacauuugu

SEQ ID NO: 1613631 - RNA, 19 nt, Human
uaaaauccauacauuugug

SEQ ID NO: 1613632 - RNA, 16 nt, Human
uaaaaugagaaaucua

SEQ ID NO: 1613633 - RNA, 15 nt, Human
uaaaaugagaaaucu

SEQ ID NO: 1613634 - RNA, 13 nt, Human
uaaaaugagaaau

SEQ ID NO: 1613635 - RNA, 16 nt, Human
guuuaguaaucauauu

SEQ ID NO: 1613636 - RNA, 18 nt, Human
guuuagucuugucucaga

SEQ ID NO: 1613637 - RNA, 14 nt, Human
guuuagucuugucu

SEQ ID NO: 1613638 - RNA, 17 nt, Human
guuuagaaagcuugccc

SEQ ID NO: 1613639 - RNA, 13 nt, Human
guuuagaaagcuu

SEQ ID NO: 1613640 - RNA, 21 nt, Human
gguuggccccugcccggcugc

SEQ ID NO: 1613641 - RNA, 14 nt, Human
guuucagaaaugug

SEQ ID NO: 1613642 - RNA, 18 nt, Human
guuucagaaauguguuau

SEQ ID NO: 1613643 - RNA, 20 nt, Human
guuuccuggcacugcuucca

SEQ ID NO: 1613644 - RNA, 16 nt, Human
guuuccuggcacugcu

SEQ ID NO: 1613645 - RNA, 17 nt, Human
guuuccugcccugggag

SEQ ID NO: 1613646 - RNA, 13 nt, Human
guuuccugcccug

SEQ ID NO: 1613647 - RNA, 22 nt, Human
guuuccuggcacugcuuccagu

SEQ ID NO: 1613648 - RNA, 21 nt, Human
guuuccuggcacugcuuccag

SEQ ID NO: 1613649 - RNA, 16 nt, Human
guuuccuuauauuaug

SEQ ID NO: 1613650 - RNA, 22 nt, Human
guuuccugcccugggaggcagu

SEQ ID NO: 1613651 - RNA, 17 nt, Human
guuuguaaauuaacuuu

SEQ ID NO: 1613652 - RNA, 19 nt, Human
guuuguaaauuaacuuuua

SEQ ID NO: 1613653 - RNA, 20 nt, Human
guuuguaaauuaacuuuuau

SEQ ID NO: 1613654 - RNA, 23 nt, Human
guuugugcugguguaugugugaa

SEQ ID NO: 1613655 - RNA, 19 nt, Human
guuuguggaaaaugaaaau

SEQ ID NO: 1613656 - RNA, 18 nt, Human
guuuguuccccaagacau

SEQ ID NO: 1613657 - RNA, 17 nt, Human
guuugauuaaauucuug

SEQ ID NO: 1613658 - RNA, 19 nt, Human
guuugauuaaauucuugca

SEQ ID NO: 1613659 - RNA, 22 nt, Human
guuugauuaaauucuugcaaag

SEQ ID NO: 1613660 - RNA, 15 nt, Human
guuucuaaagcugcc

SEQ ID NO: 1613661 - RNA, 14 nt, Human
guuucuaaagcugc

SEQ ID NO: 1613662 - RNA, 16 nt, Human
guuucuaaagcugcca

SEQ ID NO: 1613663 - RNA, 20 nt, Human
guuucuaaagcugccagccg

SEQ ID NO: 1613664 - RNA, 16 nt, Human
guuugaaccaagaacu

SEQ ID NO: 1613665 - RNA, 17 nt, Human
guuucuuuguaaugaaa

SEQ ID NO: 1613666 - RNA, 14 nt, Human
guuucuuuguaaug

SEQ ID NO: 1613667 - RNA, 16 nt, Human
guuuucauuaucucaa

SEQ ID NO: 1613668 - RNA, 20 nt, Human
guuuuccagguuuaagcugu

SEQ ID NO: 1613669 - RNA, 18 nt, Human
guuuucaggcuagaugua

SEQ ID NO: 1613670 - RNA, 16 nt, Human
guuuucaguguacaug

SEQ ID NO: 1613671 - RNA, 17 nt, Human
guuuucaguguacaugg

SEQ ID NO: 1613672 - RNA, 18 nt, Human
guuuguuucugaaaggga

SEQ ID NO: 1613673 - RNA, 16 nt, Human
guuuguugugaggauu

SEQ ID NO: 1613674 - RNA, 12 nt, Human
guuuguuuaguc

SEQ ID NO: 1613675 - RNA, 15 nt, Human
guuuucugagaaaga

SEQ ID NO: 1613676 - RNA, 19 nt, Human
guuuucucuugagagggug

SEQ ID NO: 1613677 - RNA, 12 nt, Human
guuuucucuuga

SEQ ID NO: 1613678 - RNA, 19 nt, Human
guuuuuauggcuuuugugc

SEQ ID NO: 1613679 - RNA, 22 nt, Human
guuuuuauggcuuuugugcauu

SEQ ID NO: 1613680 - RNA, 23 nt, Human
guuuuuauggcuuuugugcauua

SEQ ID NO: 1613681 - RNA, 16 nt, Human
uaaaaaagaaacauuu

SEQ ID NO: 1613682 - RNA, 23 nt, Human
uaaaaaacugcugacuguuuucu

SEQ ID NO: 1613683 - RNA, 20 nt, Human
uaaaaaacugcugacuguuu

SEQ ID NO: 1613684 - RNA, 12 nt, Human
uaaaaaacacug

SEQ ID NO: 1613685 - RNA, 17 nt, Human
uaaaaacaaagaaauua

SEQ ID NO: 1613686 - RNA, 11 nt, Human
uaaaaaacacu

SEQ ID NO: 1613687 - RNA, 15 nt, Human
ucaguuacucuucag

SEQ ID NO: 1613688 - RNA, 17 nt, Human
ucaguuguuaguguguc

SEQ ID NO: 1613689 - RNA, 15 nt, Human
ucauaauuauuauuu

SEQ ID NO: 1613690 - RNA, 13 nt, Human
ucauacccacccc

SEQ ID NO: 1613691 - RNA, 17 nt, Human
ucagugugacugaucuc

SEQ ID NO: 1613692 - RNA, 13 nt, Human
ucagugugacuga

SEQ ID NO: 1613693 - RNA, 11 nt, Human
ucaguguacau

SEQ ID NO: 1613694 - RNA, 23 nt, Human
ucagugguuggcaauuguuucaa

SEQ ID NO: 1613695 - RNA, 15 nt, Human
ucagucuggcccuuc

SEQ ID NO: 1613696 - RNA, 24 nt, Human
ucagucugauucccaagcucugcu

SEQ ID NO: 1613697 - RNA, 18 nt, Human
ucauuaggugugacugaa

SEQ ID NO: 1613698 - RNA, 21 nt, Human
ucauuaggugugacugaauuu

SEQ ID NO: 1613699 - RNA, 22 nt, Human
ucauuaggugugacugaauuuc

SEQ ID NO: 1613700 - RNA, 13 nt, Human
ucauuauuuuauu

SEQ ID NO: 1613701 - RNA, 15 nt, Human
ucauuauuuuauuau

SEQ ID NO: 1613702 - RNA, 14 nt, Human
ucauuauuuuauua

SEQ ID NO: 1613703 - RNA, 22 nt, Human
ucauuauuuuauuaugaaacuu

SEQ ID NO: 1613704 - RNA, 19 nt, Human
ucauuauuuuauuaugaaa

SEQ ID NO: 1613705 - RNA, 18 nt, Human
ucauuauuuuauuaugaa

SEQ ID NO: 1613706 - RNA, 16 nt, Human
ucauuauuuuauuaug

SEQ ID NO: 1613707 - RNA, 16 nt, Human
ucauuaggugugacug

SEQ ID NO: 1613708 - RNA, 15 nt, Human
ucauacccaccccca

SEQ ID NO: 1613709 - RNA, 14 nt, Human
ucauacccaccccc

SEQ ID NO: 1613710 - RNA, 20 nt, Human
ucauacccacccccacccaa

SEQ ID NO: 1613711 - RNA, 21 nt, Human
ucauacccacccccacccaag

SEQ ID NO: 1613712 - RNA, 20 nt, Human
uccaagcauuuagauguaua

SEQ ID NO: 1613713 - RNA, 14 nt, Human
uccacaacacacag

SEQ ID NO: 1613714 - RNA, 14 nt, Human
uccacaagagccca

SEQ ID NO: 1613715 - RNA, 15 nt, Human
uccacaagagcccag

SEQ ID NO: 1613716 - RNA, 23 nt, Human
uccaccucccugcaauaaaaugg

SEQ ID NO: 1613717 - RNA, 12 nt, Human
uccaccugccag

SEQ ID NO: 1613718 - RNA, 12 nt, Human
uccaccucccug

SEQ ID NO: 1613719 - RNA, 14 nt, Human
uccaccuacaugag

SEQ ID NO: 1613720 - RNA, 13 nt, Human
uccacuuggucug

SEQ ID NO: 1613721 - RNA, 12 nt, Human
uccacuuggucu

SEQ ID NO: 1613722 - RNA, 13 nt, Human
uccaccugccagg

SEQ ID NO: 1613723 - RNA, 14 nt, Human
uccacuuggucugu

SEQ ID NO: 1613724 - RNA, 14 nt, Human
uccagauccuggaa

SEQ ID NO: 1613725 - RNA, 17 nt, Human
uccagauccuggaaauc

SEQ ID NO: 1613726 - RNA, 16 nt, Human
uccagauccuggaaau

SEQ ID NO: 1613727 - RNA, 23 nt, Human
uccagccaaagccuccuccagcc

SEQ ID NO: 1613728 - RNA, 22 nt, Human
uccagcagauuauucacugauu

SEQ ID NO: 1613729 - RNA, 20 nt, Human
uccagcagauuauucacuga

SEQ ID NO: 1613730 - RNA, 23 nt, Human
uccaagcauaccaacacgagcag

SEQ ID NO: 1613731 - RNA, 17 nt, Human
uccaagcauuuagaugu

SEQ ID NO: 1613732 - RNA, 13 nt, Human
uccaagcaaaugu

SEQ ID NO: 1613733 - RNA, 19 nt, Human
uccaagaccuucuccuuca

SEQ ID NO: 1613734 - RNA, 20 nt, Human
uccaagaagcccaggaaagg

SEQ ID NO: 1613735 - RNA, 22 nt, Human
uccaagaagcccaggaaaggcu

SEQ ID NO: 1613736 - RNA, 14 nt, Human
uccaagaauuucua

SEQ ID NO: 1613737 - RNA, 12 nt, Human
uccaaagaaaug

SEQ ID NO: 1613738 - RNA, 23 nt, Human
uccaaacugacucuuaagaagac

SEQ ID NO: 1613739 - RNA, 16 nt, Human
uccaaaauaaaacuuu

SEQ ID NO: 1613740 - RNA, 17 nt, Human
uccaaaauaaaacuuuu

SEQ ID NO: 1613741 - RNA, 19 nt, Human
uccaaacuaccuuccaguu

SEQ ID NO: 1613742 - RNA, 22 nt, Human
ucauuucugcaucagcugcuga

SEQ ID NO: 1613743 - RNA, 16 nt, Human
ucauuucugcaucagc

SEQ ID NO: 1613744 - RNA, 14 nt, Human
ucauuucuuugagu

SEQ ID NO: 1613745 - RNA, 22 nt, Human
ucauucagauaugauucaaaug

SEQ ID NO: 1613746 - RNA, 16 nt, Human
ucccaaauuucauacc

SEQ ID NO: 1613747 - RNA, 13 nt, Human
ucccaacucaccc

SEQ ID NO: 1613748 - RNA, 15 nt, Human
ucccaacucacccca

SEQ ID NO: 1613749 - RNA, 14 nt, Human
ucccaacucacccc

SEQ ID NO: 1613750 - RNA, 16 nt, Human
ucccaacucaccccag

SEQ ID NO: 1613751 - RNA, 15 nt, Human
ucccaagcucugcuc

SEQ ID NO: 1613752 - RNA, 14 nt, Human
ucccaagcucugcu

SEQ ID NO: 1613753 - RNA, 13 nt, Human
ucccaagcucugc

SEQ ID NO: 1613754 - RNA, 12 nt, Human
ucccaagcucug

SEQ ID NO: 1613755 - RNA, 17 nt, Human
ucccaagcucugcuccu

SEQ ID NO: 1613756 - RNA, 18 nt, Human
ucccaaggcucugagcaa

SEQ ID NO: 1613757 - RNA, 23 nt, Human
uccagcucaccagccccagugcc

SEQ ID NO: 1613758 - RNA, 16 nt, Human
uccauccaggccauuc

SEQ ID NO: 1613759 - RNA, 15 nt, Human
uccauggacuuuguu

SEQ ID NO: 1613760 - RNA, 14 nt, Human
uccauggacuuugu

SEQ ID NO: 1613761 - RNA, 23 nt, Human
ucccaucucacacaugagcauca

SEQ ID NO: 1613762 - RNA, 20 nt, Human
ucccaucucacacaugagca

SEQ ID NO: 1613763 - RNA, 18 nt, Human
ucccaggcugagccucag

SEQ ID NO: 1613764 - RNA, 16 nt, Human
ucccaggcugagccuc

SEQ ID NO: 1613765 - RNA, 21 nt, Human
ucccaucugugaaaggaaaga

SEQ ID NO: 1613766 - RNA, 22 nt, Human
ucccaggcauuccccaggaggc

SEQ ID NO: 1613767 - RNA, 23 nt, Human
ucccaggcauuccccaggaggcc

SEQ ID NO: 1613768 - RNA, 16 nt, Human
ucccaggauguacaag

SEQ ID NO: 1613769 - RNA, 15 nt, Human
ucccaggcugagccu

SEQ ID NO: 1613770 - RNA, 21 nt, Human
ucccaggcgccccuucccccu

SEQ ID NO: 1613771 - RNA, 18 nt, Human
ucccaggcgccccuuccc

SEQ ID NO: 1613772 - RNA, 20 nt, Human
ucccaggcgccccuuccccc

SEQ ID NO: 1613773 - RNA, 21 nt, Human
ucccaggcauuccccaggagg

SEQ ID NO: 1613774 - RNA, 20 nt, Human
ucccaggcauuccccaggag

SEQ ID NO: 1613775 - RNA, 15 nt, Human
ucccaccucagccuc

SEQ ID NO: 1613776 - RNA, 14 nt, Human
ucccaccucagccu

SEQ ID NO: 1613777 - RNA, 13 nt, Human
ucccaccucagcc

SEQ ID NO: 1613778 - RNA, 22 nt, Human
ucccaaggcucugagcaaaugu

SEQ ID NO: 1613779 - RNA, 21 nt, Human
ucccccuuccauggacuuugu

SEQ ID NO: 1613780 - RNA, 20 nt, Human
uccccgcacugggcuugggg

SEQ ID NO: 1613781 - RNA, 13 nt, Human
uccccaggaggcc

SEQ ID NO: 1613782 - RNA, 13 nt, Human
ucccccucuggcu

SEQ ID NO: 1613783 - RNA, 13 nt, Human
ucccccugcccca

SEQ ID NO: 1613784 - RNA, 17 nt, Human
ucccccaucucuucugg

SEQ ID NO: 1613785 - RNA, 21 nt, Human
uccccugcuggguguggcgca

SEQ ID NO: 1613786 - RNA, 20 nt, Human
uccccugcuggguguggcgc

SEQ ID NO: 1613787 - RNA, 15 nt, Human
uccccugcugggugu

SEQ ID NO: 1613788 - RNA, 14 nt, Human
uccccugcugggug

SEQ ID NO: 1613789 - RNA, 23 nt, Human
uccccuguccccgcacugggcuu

SEQ ID NO: 1613790 - RNA, 22 nt, Human
uccccuguagagugggagcuga

SEQ ID NO: 1613791 - RNA, 15 nt, Human
uccccuguucacucu

SEQ ID NO: 1613792 - RNA, 19 nt, Human
uccccuguagagugggagc

SEQ ID NO: 1613793 - RNA, 24 nt, Human
uccccugcuggguguggcgcagca

SEQ ID NO: 1613794 - RNA, 18 nt, Human
uccccuguuuguuucuga

SEQ ID NO: 1613795 - RNA, 22 nt, Human
uccccuuccuaauuccacagcu

SEQ ID NO: 1613796 - RNA, 21 nt, Human
uccccuuccuaauuccacagc

SEQ ID NO: 1613797 - RNA, 12 nt, Human
ucccuaauaaag

SEQ ID NO: 1613798 - RNA, 11 nt, Human
ucccuaauaaa

SEQ ID NO: 1613799 - RNA, 15 nt, Human
ucccucccucuuucc

SEQ ID NO: 1613800 - RNA, 16 nt, Human
ucccuacuuccuguga

SEQ ID NO: 1613801 - RNA, 15 nt, Human
ucccuacuuccugug

SEQ ID NO: 1613802 - RNA, 17 nt, Human
ucccucccucuuucccu

SEQ ID NO: 1613803 - RNA, 15 nt, Human
ucccuacuguaauuu

SEQ ID NO: 1613804 - RNA, 14 nt, Human
ucccuaauaaagcu

SEQ ID NO: 1613805 - RNA, 13 nt, Human
ucccuaauaaagc

SEQ ID NO: 1613806 - RNA, 22 nt, Human
ucacuuuuauuuagcaccaggg

SEQ ID NO: 1613807 - RNA, 12 nt, Human
ucacuuuuauuu

SEQ ID NO: 1613808 - RNA, 17 nt, Human
ucacuugucaauaaaau

SEQ ID NO: 1613809 - RNA, 15 nt, Human
ucacugcuuaacuuc

SEQ ID NO: 1613810 - RNA, 17 nt, Human
ucacugcuuaacuucac

SEQ ID NO: 1613811 - RNA, 18 nt, Human
ucacugcuuaacuucaca

SEQ ID NO: 1613812 - RNA, 20 nt, Human
ucacugcuuaacuucacaua

SEQ ID NO: 1613813 - RNA, 16 nt, Human
ucacucugucgcccag

SEQ ID NO: 1613814 - RNA, 12 nt, Human
ucacucugucgc

SEQ ID NO: 1613815 - RNA, 19 nt, Human
ucacucugucgcccagucu

SEQ ID NO: 1613816 - RNA, 22 nt, Human
ucacucugucgcccagucugga

SEQ ID NO: 1613817 - RNA, 19 nt, Human
ucagacauagaauuaacac

SEQ ID NO: 1613818 - RNA, 20 nt, Human
ucagacagcugccugggauc

SEQ ID NO: 1613819 - RNA, 19 nt, Human
ucagacagcugccugggau

SEQ ID NO: 1613820 - RNA, 18 nt, Human
ucagacagcugccuggga

SEQ ID NO: 1613821 - RNA, 17 nt, Human
ucagacagcugccuggg

SEQ ID NO: 1613822 - RNA, 16 nt, Human
ucagacagcugccugg

SEQ ID NO: 1613823 - RNA, 15 nt, Human
ucagacagcugccug

SEQ ID NO: 1613824 - RNA, 22 nt, Human
ucagacauagaauuaacacaug

SEQ ID NO: 1613825 - RNA, 19 nt, Human
ucagcacgauuucuguuua

SEQ ID NO: 1613826 - RNA, 22 nt, Human
ucagaguugaugguuguacaua

SEQ ID NO: 1613827 - RNA, 21 nt, Human
ucagaggggaauaaacuguug

SEQ ID NO: 1613828 - RNA, 22 nt, Human
ucacucuggcagcucagagagg

SEQ ID NO: 1613829 - RNA, 20 nt, Human
ucacucuggcagcucagaga

SEQ ID NO: 1613830 - RNA, 19 nt, Human
ucacucuggcagcucagag

SEQ ID NO: 1613831 - RNA, 18 nt, Human
ucacucuggcagcucaga

SEQ ID NO: 1613832 - RNA, 17 nt, Human
ucacucuggcagcucag

SEQ ID NO: 1613833 - RNA, 16 nt, Human
ucacucuggcagcuca

SEQ ID NO: 1613834 - RNA, 15 nt, Human
ucacucuggcagcuc

SEQ ID NO: 1613835 - RNA, 14 nt, Human
ucacucuggcagcu

SEQ ID NO: 1613836 - RNA, 14 nt, Human
ucacucuccuuggu

SEQ ID NO: 1613837 - RNA, 12 nt, Human
ucacucuccuug

SEQ ID NO: 1613838 - RNA, 18 nt, Human
ucacucuccauuuaauaa

SEQ ID NO: 1613839 - RNA, 20 nt, Human
ucacucuacuuagcaugucc

SEQ ID NO: 1613840 - RNA, 19 nt, Human
ucacucuacuuagcauguc

SEQ ID NO: 1613841 - RNA, 13 nt, Human
ucacucuggcagc

SEQ ID NO: 1613842 - RNA, 12 nt, Human
ucacucuggcag

SEQ ID NO: 1613843 - RNA, 23 nt, Human
ucacucuccuuggugucgggcau

SEQ ID NO: 1613844 - RNA, 13 nt, Human
ucacuccuugaaa

SEQ ID NO: 1613845 - RNA, 18 nt, Human
ucacuccuaccugguaau

SEQ ID NO: 1613846 - RNA, 17 nt, Human
ucacggaagagccuugc

SEQ ID NO: 1613847 - RNA, 16 nt, Human
ucacggaagagccuug

SEQ ID NO: 1613848 - RNA, 14 nt, Human
ucacggaagagccu

SEQ ID NO: 1613849 - RNA, 20 nt, Human
ucacggcucacugcagccuc

SEQ ID NO: 1613850 - RNA, 15 nt, Human
ucacggcucacugca

SEQ ID NO: 1613851 - RNA, 13 nt, Human
ucacggcucacug

SEQ ID NO: 1613852 - RNA, 12 nt, Human
ucaccuuugucc

SEQ ID NO: 1613853 - RNA, 14 nt, Human
ucaccuuucccauc

SEQ ID NO: 1613854 - RNA, 13 nt, Human
ucaccuuuauucu

SEQ ID NO: 1613855 - RNA, 15 nt, Human
ucacaggcaggucca

SEQ ID NO: 1613856 - RNA, 12 nt, Human
ucacaggcaggu

SEQ ID NO: 1613857 - RNA, 16 nt, Human
ucacaggacucugccu

SEQ ID NO: 1613858 - RNA, 22 nt, Human
ucaccuuuguccccaccgcaga

SEQ ID NO: 1613859 - RNA, 18 nt, Human
ucaccuuuguccccaccg

SEQ ID NO: 1613860 - RNA, 17 nt, Human
ucaccuuuguccccacc

SEQ ID NO: 1613861 - RNA, 15 nt, Human
ucaccuuugucccca

SEQ ID NO: 1613862 - RNA, 14 nt, Human
ucaccuuugucccc

SEQ ID NO: 1613863 - RNA, 20 nt, Human
ucacgccuguaauccuagca

SEQ ID NO: 1613864 - RNA, 19 nt, Human
ucacgccuguaauccuagc

SEQ ID NO: 1613865 - RNA, 14 nt, Human
ucacgccacugcac

SEQ ID NO: 1613866 - RNA, 13 nt, Human
ucacgccacugca

SEQ ID NO: 1613867 - RNA, 16 nt, Human
ucacgccacugcacua

SEQ ID NO: 1613868 - RNA, 21 nt, Human
uauuucuaugaaauauuaugu

SEQ ID NO: 1613869 - RNA, 22 nt, Human
uauuucuaugaaauauuauguu

SEQ ID NO: 1613870 - RNA, 13 nt, Human
uauuuauuacugu

SEQ ID NO: 1613871 - RNA, 20 nt, Human
uaucugaaaauguaugugua

SEQ ID NO: 1613872 - RNA, 15 nt, Human
uaucugaaaauguau

SEQ ID NO: 1613873 - RNA, 14 nt, Human
uaucugaaaaugua

SEQ ID NO: 1613874 - RNA, 23 nt, Human
uauuuauuaaaugcccagccccu

SEQ ID NO: 1613875 - RNA, 16 nt, Human
uaucugaggaauucug

SEQ ID NO: 1613876 - RNA, 15 nt, Human
uaucugaggaauucu

SEQ ID NO: 1613877 - RNA, 18 nt, Human
uaucugaagucagaucug

SEQ ID NO: 1613878 - RNA, 17 nt, Human
uaucugaagucagaucu

SEQ ID NO: 1613879 - RNA, 13 nt, Human
ucaaaacugcacu

SEQ ID NO: 1613880 - RNA, 23 nt, Human
ucaaacggccucacuaggcuucu

SEQ ID NO: 1613881 - RNA, 22 nt, Human
ucaaaacgguuuuacugcagcu

SEQ ID NO: 1613882 - RNA, 14 nt, Human
ucaaacucuuaaaa

SEQ ID NO: 1613883 - RNA, 16 nt, Human
ucaaacgugaaaaugc

SEQ ID NO: 1613884 - RNA, 15 nt, Human
ucaaacgugaaaaug

SEQ ID NO: 1613885 - RNA, 15 nt, Human
uauuuuuuuacuaau

SEQ ID NO: 1613886 - RNA, 17 nt, Human
uauuuuuuucugaaauu

SEQ ID NO: 1613887 - RNA, 16 nt, Human
uauuuuuuucugaaau

SEQ ID NO: 1613888 - RNA, 22 nt, Human
uauuuuuuucugaauuauuuuc

SEQ ID NO: 1613889 - RNA, 12 nt, Human
uauuuuaugauc

SEQ ID NO: 1613890 - RNA, 16 nt, Human
uauuuuauguugcaua

SEQ ID NO: 1613891 - RNA, 15 nt, Human
uauuuuauguugcau

SEQ ID NO: 1613892 - RNA, 21 nt, Human
uauuuucaacgcagcccugcu

SEQ ID NO: 1613893 - RNA, 13 nt, Human
ucaaugcagcccc

SEQ ID NO: 1613894 - RNA, 17 nt, Human
ucaaugcuauaacuaug

SEQ ID NO: 1613895 - RNA, 18 nt, Human
ucaaugcacugacauugu

SEQ ID NO: 1613896 - RNA, 18 nt, Human
ucaauuacaggaaguacu

SEQ ID NO: 1613897 - RNA, 13 nt, Human
ucaauuacaggaa

SEQ ID NO: 1613898 - RNA, 14 nt, Human
ucaaugcacugaca

SEQ ID NO: 1613899 - RNA, 14 nt, Human
ucaauaggaaaaac

SEQ ID NO: 1613900 - RNA, 17 nt, Human
ucaauaggaaaaacuga

SEQ ID NO: 1613901 - RNA, 13 nt, Human
ucaauaggaaaaa

SEQ ID NO: 1613902 - RNA, 19 nt, Human
ucacaggaaguagaggagg

SEQ ID NO: 1613903 - RNA, 23 nt, Human
ucacaggacagcccuucuuucca

SEQ ID NO: 1613904 - RNA, 11 nt, Human
ucacaggcagg

SEQ ID NO: 1613905 - RNA, 23 nt, Human
ucacacagugagucgaggacagg

SEQ ID NO: 1613906 - RNA, 22 nt, Human
ucacacagugagucgaggacag

SEQ ID NO: 1613907 - RNA, 21 nt, Human
ucacacaugagcaucaggcca

SEQ ID NO: 1613908 - RNA, 13 nt, Human
ucacacagugagu

SEQ ID NO: 1613909 - RNA, 22 nt, Human
ucacacaguauuacuucugcua

SEQ ID NO: 1613910 - RNA, 21 nt, Human
ucacacaguauuacuucugcu

SEQ ID NO: 1613911 - RNA, 20 nt, Human
ucaauuacaggaaguacugg

SEQ ID NO: 1613912 - RNA, 19 nt, Human
ucaauuacaggaaguacug

SEQ ID NO: 1613913 - RNA, 19 nt, Human
ucaacuccaaacugacucu

SEQ ID NO: 1613914 - RNA, 14 nt, Human
ucaaccuccugggc

SEQ ID NO: 1613915 - RNA, 13 nt, Human
ucaaccuccuggg

SEQ ID NO: 1613916 - RNA, 15 nt, Human
ucaaacuuuacuaug

SEQ ID NO: 1613917 - RNA, 13 nt, Human
ucaaacuuuacua

SEQ ID NO: 1613918 - RNA, 22 nt, Human
ucaaacucuugaccucagguga

SEQ ID NO: 1613919 - RNA, 16 nt, Human
ucaaacuuuacuaugg

SEQ ID NO: 1613920 - RNA, 22 nt, Human
ucaagugauucuccugccucag

SEQ ID NO: 1613921 - RNA, 20 nt, Human
ucaaggauccugagccagau

SEQ ID NO: 1613922 - RNA, 23 nt, Human
ucaaggauccugagccagauuuc

SEQ ID NO: 1613923 - RNA, 19 nt, Human
ucaaggauccugagccaga

SEQ ID NO: 1613924 - RNA, 18 nt, Human
ucaaggauccugagccag

SEQ ID NO: 1613925 - RNA, 17 nt, Human
ucaagcgauucuucugc

SEQ ID NO: 1613926 - RNA, 16 nt, Human
ucaagcgauucuucug

SEQ ID NO: 1613927 - RNA, 16 nt, Human
ucuaaauucuuucauu

SEQ ID NO: 1613928 - RNA, 18 nt, Human
ucggacuuagcugggaga

SEQ ID NO: 1613929 - RNA, 21 nt, Human
ucuacacuaagagagaaugag

SEQ ID NO: 1613930 - RNA, 22 nt, Human
ucuaacuucaccauauuaccac

SEQ ID NO: 1613931 - RNA, 15 nt, Human
ucuaacuucaccaua

SEQ ID NO: 1613932 - RNA, 16 nt, Human
ucuaacuucaccauau

SEQ ID NO: 1613933 - RNA, 17 nt, Human
ucuacacuccagugaga

SEQ ID NO: 1613934 - RNA, 14 nt, Human
ucuacacugugcug

SEQ ID NO: 1613935 - RNA, 12 nt, Human
ucuacacugugc

SEQ ID NO: 1613936 - RNA, 19 nt, Human
ucuacugaggugcuauguu

SEQ ID NO: 1613937 - RNA, 18 nt, Human
ucuacugaggugcuaugu

SEQ ID NO: 1613938 - RNA, 15 nt, Human
ucuacacugugcuga

SEQ ID NO: 1613939 - RNA, 21 nt, Human
ucuacacugugcugagucuga

SEQ ID NO: 1613940 - RNA, 22 nt, Human
ucuagggaaaaaccagcgugug

SEQ ID NO: 1613941 - RNA, 22 nt, Human
ucuacugaggugcuauguucuu

SEQ ID NO: 1613942 - RNA, 21 nt, Human
ucucaaacucuugaccucagg

SEQ ID NO: 1613943 - RNA, 13 nt, Human
ucucaaacucuug

SEQ ID NO: 1613944 - RNA, 22 nt, Human
ucucaaacucuugaccucaggu

SEQ ID NO: 1613945 - RNA, 17 nt, Human
ucucacucugucgccca

SEQ ID NO: 1613946 - RNA, 22 nt, Human
ucucacucugucgcccagucug

SEQ ID NO: 1613947 - RNA, 18 nt, Human
ucucacucugucgcccag

SEQ ID NO: 1613948 - RNA, 21 nt, Human
ucucacuguugcccaggcugg

SEQ ID NO: 1613949 - RNA, 20 nt, Human
ucucacuguugcccaggcug

SEQ ID NO: 1613950 - RNA, 19 nt, Human
ucucacuguugcccaggcu

SEQ ID NO: 1613951 - RNA, 18 nt, Human
ucucacuguugcccaggc

SEQ ID NO: 1613952 - RNA, 21 nt, Human
ucucagaaucucaaauaacua

SEQ ID NO: 1613953 - RNA, 17 nt, Human
ucucagaaucucaaaua

SEQ ID NO: 1613954 - RNA, 19 nt, Human
uccuucuguccuacucugu

SEQ ID NO: 1613955 - RNA, 12 nt, Human
uccuucuguccu

SEQ ID NO: 1613956 - RNA, 15 nt, Human
uccuugcaucaauuu

SEQ ID NO: 1613957 - RNA, 14 nt, Human
uccuuaccagcaga

SEQ ID NO: 1613958 - RNA, 16 nt, Human
uccuucaaagcaaaug

SEQ ID NO: 1613959 - RNA, 17 nt, Human
uccuggcccacugcauc

SEQ ID NO: 1613960 - RNA, 22 nt, Human
uccuggcaugggaaugaauguc

SEQ ID NO: 1613961 - RNA, 10 nt, Human
ucccucccuu

SEQ ID NO: 1613962 - RNA, 15 nt, Human
uccugguguggaaga

SEQ ID NO: 1613963 - RNA, 17 nt, Human
ucgaguuacagacaaag

SEQ ID NO: 1613964 - RNA, 15 nt, Human
ucgaguuacagacaa

SEQ ID NO: 1613965 - RNA, 23 nt, Human
uccuuuuggagucagacagaugu

SEQ ID NO: 1613966 - RNA, 14 nt, Human
uccuuuuggaguca

SEQ ID NO: 1613967 - RNA, 14 nt, Human
ucgcccaggcugga

SEQ ID NO: 1613968 - RNA, 12 nt, Human
ucgcccaggcug

SEQ ID NO: 1613969 - RNA, 19 nt, Human
ucgcccaggcuggagugca

SEQ ID NO: 1613970 - RNA, 17 nt, Human
ucgcaauguaagacucg

SEQ ID NO: 1613971 - RNA, 18 nt, Human
ucucuucacagucacauu

SEQ ID NO: 1613972 - RNA, 11 nt, Human
ucucugcaggu

SEQ ID NO: 1613973 - RNA, 11 nt, Human
ucucuucucca

SEQ ID NO: 1613974 - RNA, 16 nt, Human
ucucuucuccacugga

SEQ ID NO: 1613975 - RNA, 15 nt, Human
ucucuucuccacugg

SEQ ID NO: 1613976 - RNA, 14 nt, Human
ucucuucuccacug

SEQ ID NO: 1613977 - RNA, 13 nt, Human
ucucuucuccacu

SEQ ID NO: 1613978 - RNA, 16 nt, Human
ucugaaaauguaugug

SEQ ID NO: 1613979 - RNA, 16 nt, Human
ucucuuuucaaaacau

SEQ ID NO: 1613980 - RNA, 15 nt, Human
ucucuuuucaaaaca

SEQ ID NO: 1613981 - RNA, 13 nt, Human
ucugaaagggacg

SEQ ID NO: 1613982 - RNA, 23 nt, Human
ucugaaaauguauguguaaguau

SEQ ID NO: 1613983 - RNA, 14 nt, Human
ucugaaauuuccug

SEQ ID NO: 1613984 - RNA, 17 nt, Human
ucugaggaauccagacc

SEQ ID NO: 1613985 - RNA, 16 nt, Human
ucugaggaauccagac

SEQ ID NO: 1613986 - RNA, 22 nt, Human
ucugagcauuagauuucucauu

SEQ ID NO: 1613987 - RNA, 23 nt, Human
ucugaggacacuaaccacgcugg

SEQ ID NO: 1613988 - RNA, 20 nt, Human
ucugaggacacuaaccacgc

SEQ ID NO: 1613989 - RNA, 20 nt, Human
ucugaggaauucuguauaga

SEQ ID NO: 1613990 - RNA, 14 nt, Human
ucugcacaagcugc

SEQ ID NO: 1613991 - RNA, 19 nt, Human
ucugcacaagcugcacccu

SEQ ID NO: 1613992 - RNA, 23 nt, Human
ucugauucccaagcucugcuccu

SEQ ID NO: 1613993 - RNA, 18 nt, Human
ucugacccaugcugcccu

SEQ ID NO: 1613994 - RNA, 17 nt, Human
ucugacccaugcugccc

SEQ ID NO: 1613995 - RNA, 16 nt, Human
ucugacccaugcugcc

SEQ ID NO: 1613996 - RNA, 15 nt, Human
ucugacccaugcugc

SEQ ID NO: 1613997 - RNA, 19 nt, Human
ucugacccaugcugcccug

SEQ ID NO: 1613998 - RNA, 20 nt, Human
ucugagcauuagauuucuca

SEQ ID NO: 1613999 - RNA, 20 nt, Human
ucugaacuuggcgcugcccc

SEQ ID NO: 1614000 - RNA, 21 nt, Human
ucugaacuuggcgcugccccu

SEQ ID NO: 1614001 - RNA, 14 nt, Human
ucugacccaugcug

SEQ ID NO: 1614002 - RNA, 19 nt, Human
ucuccugggcagcugccuc

SEQ ID NO: 1614003 - RNA, 20 nt, Human
ucuccugggcagcugccucc

SEQ ID NO: 1614004 - RNA, 21 nt, Human
ucuccugggcagcugccuccc

SEQ ID NO: 1614005 - RNA, 15 nt, Human
ucucuacaaaaagca

SEQ ID NO: 1614006 - RNA, 13 nt, Human
ucuccuguaccuc

SEQ ID NO: 1614007 - RNA, 19 nt, Human
ucucuaggaaauauuuauu

SEQ ID NO: 1614008 - RNA, 13 nt, Human
ucucuaggaaaua

SEQ ID NO: 1614009 - RNA, 18 nt, Human
ucucuaguuugauuaaau

SEQ ID NO: 1614010 - RNA, 19 nt, Human
ucucuaguuugauuaaauu

SEQ ID NO: 1614011 - RNA, 13 nt, Human
ucucugaggacac

SEQ ID NO: 1614012 - RNA, 14 nt, Human
ucucugaggacacu

SEQ ID NO: 1614013 - RNA, 15 nt, Human
ucucucgugaguaua

SEQ ID NO: 1614014 - RNA, 13 nt, Human
ucuccugggcagc

SEQ ID NO: 1614015 - RNA, 14 nt, Human
ucuccugggcagcu

SEQ ID NO: 1614016 - RNA, 15 nt, Human
ucuccugggcagcug

SEQ ID NO: 1614017 - RNA, 16 nt, Human
ucuccugggcagcugc

SEQ ID NO: 1614018 - RNA, 17 nt, Human
ucuccugggcagcugcc

SEQ ID NO: 1614019 - RNA, 18 nt, Human
ucuccugggcagcugccu

SEQ ID NO: 1614020 - RNA, 22 nt, Human
ucuccugccucagccucccaaa

SEQ ID NO: 1614021 - RNA, 21 nt, Human
ucucagugucaaugcagcccc

SEQ ID NO: 1614022 - RNA, 15 nt, Human
ucucaggucccugca

SEQ ID NO: 1614023 - RNA, 17 nt, Human
ucucccccagccccauc

SEQ ID NO: 1614024 - RNA, 15 nt, Human
ucucccccagcccca

SEQ ID NO: 1614025 - RNA, 14 nt, Human
ucucccccagcccc

SEQ ID NO: 1614026 - RNA, 20 nt, Human
ucucccccagccccauccuc

SEQ ID NO: 1614027 - RNA, 18 nt, Human
ucucccccagccccaucc

SEQ ID NO: 1614028 - RNA, 22 nt, Human
ucucccccagccccauccucug

SEQ ID NO: 1614029 - RNA, 22 nt, Human
ugaacuuguaaaggaauuuaaa

SEQ ID NO: 1614030 - RNA, 16 nt, Human
ugaagacagagcuaca

SEQ ID NO: 1614031 - RNA, 14 nt, Human
ugaagacagagcua

SEQ ID NO: 1614032 - RNA, 12 nt, Human
ugaacuugguuc

SEQ ID NO: 1614033 - RNA, 14 nt, Human
ugaacuuggcgcug

SEQ ID NO: 1614034 - RNA, 19 nt, Human
ugaacuggguacuugugga

SEQ ID NO: 1614035 - RNA, 23 nt, Human
ugaacuggguacuuguggacaca

SEQ ID NO: 1614036 - RNA, 14 nt, Human
ugaagacuuuucuu

SEQ ID NO: 1614037 - RNA, 22 nt, Human
ugaagacuuuucuuucagccaa

SEQ ID NO: 1614038 - RNA, 17 nt, Human
ugaagacuuuucuuuca

SEQ ID NO: 1614039 - RNA, 22 nt, Human
ugaaguccaagcauuuagaugu

SEQ ID NO: 1614040 - RNA, 21 nt, Human
ugaaguccaagcauuuagaug

SEQ ID NO: 1614041 - RNA, 21 nt, Human
ugaaggcucgagcaugccugg

SEQ ID NO: 1614042 - RNA, 20 nt, Human
ugaaggcucgagcaugccug

SEQ ID NO: 1614043 - RNA, 17 nt, Human
ugaagauguagaggaga

SEQ ID NO: 1614044 - RNA, 14 nt, Human
ugaacacaucagcu

SEQ ID NO: 1614045 - RNA, 19 nt, Human
ugaaauggacuuuuguaca

SEQ ID NO: 1614046 - RNA, 15 nt, Human
ugaacucuucaaucu

SEQ ID NO: 1614047 - RNA, 22 nt, Human
ugaaccacaucuugcucugcug

SEQ ID NO: 1614048 - RNA, 21 nt, Human
ugaaccacaucuugcucugcu

SEQ ID NO: 1614049 - RNA, 20 nt, Human
ugaaccacaucuugcucugc

SEQ ID NO: 1614050 - RNA, 18 nt, Human
ugaacucuucaaucucuu

SEQ ID NO: 1614051 - RNA, 14 nt, Human
ugaacugaacucug

SEQ ID NO: 1614052 - RNA, 15 nt, Human
ugaacugauaaagau

SEQ ID NO: 1614053 - RNA, 13 nt, Human
ugaacugauaaag

SEQ ID NO: 1614054 - RNA, 19 nt, Human
ugaacugaacucugacaac

SEQ ID NO: 1614055 - RNA, 17 nt, Human
ugaacugaacucugaca

SEQ ID NO: 1614056 - RNA, 22 nt, Human
ugaaaagacuccaaagaaaugu

SEQ ID NO: 1614057 - RNA, 18 nt, Human
ugaaacccugucucuacu

SEQ ID NO: 1614058 - RNA, 16 nt, Human
ugaaacgcaaccacca

SEQ ID NO: 1614059 - RNA, 21 nt, Human
ugaaagauggcugugccucug

SEQ ID NO: 1614060 - RNA, 23 nt, Human
ugaaagauggcugugccucugcc

SEQ ID NO: 1614061 - RNA, 22 nt, Human
ugaaagauggcugugccucugc

SEQ ID NO: 1614062 - RNA, 23 nt, Human
ugaaagcagggacuugaacccau

SEQ ID NO: 1614063 - RNA, 19 nt, Human
ugaaagcagggacuugaac

SEQ ID NO: 1614064 - RNA, 18 nt, Human
ugaaagcagggacuugaa

SEQ ID NO: 1614065 - RNA, 17 nt, Human
ugaaaggaaagaggcuc

SEQ ID NO: 1614066 - RNA, 12 nt, Human
ugaaaggaaaga

SEQ ID NO: 1614067 - RNA, 13 nt, Human
ugaaagauucaau

SEQ ID NO: 1614068 - RNA, 18 nt, Human
ugaaagggcccagagagg

SEQ ID NO: 1614069 - RNA, 17 nt, Human
ugaaagggcccagagag

SEQ ID NO: 1614070 - RNA, 16 nt, Human
ugaaagggcccagaga

SEQ ID NO: 1614071 - RNA, 17 nt, Human
ugaaaucuuuuugcuuu

SEQ ID NO: 1614072 - RNA, 20 nt, Human
ugaaaugaggucagagccug

SEQ ID NO: 1614073 - RNA, 19 nt, Human
ugaaaugaggucagagccu

SEQ ID NO: 1614074 - RNA, 22 nt, Human
ugaaaugaggucagagccugca

SEQ ID NO: 1614075 - RNA, 21 nt, Human
ugaaaugaggucagagccugc

SEQ ID NO: 1614076 - RNA, 23 nt, Human
ugaaaugaggucagagccugcag

SEQ ID NO: 1614077 - RNA, 19 nt, Human
ugaaaagacuccaaagaaa

SEQ ID NO: 1614078 - RNA, 17 nt, Human
ugaaaagacuccaaaga

SEQ ID NO: 1614079 - RNA, 16 nt, Human
ugaaaagacuccaaag

SEQ ID NO: 1614080 - RNA, 15 nt, Human
ugaaaagacuccaaa

SEQ ID NO: 1614081 - RNA, 19 nt, Human
ugaaaacuuuaugcuaagu

SEQ ID NO: 1614082 - RNA, 15 nt, Human
ugaaaagaaaaauga

SEQ ID NO: 1614083 - RNA, 16 nt, Human
ucuuuuugcuuugcuu

SEQ ID NO: 1614084 - RNA, 17 nt, Human
ucuuucacauuuaaaua

SEQ ID NO: 1614085 - RNA, 21 nt, Human
ucuuuucucccuuuuaauccu

SEQ ID NO: 1614086 - RNA, 17 nt, Human
ucuuuugccguuauuaa

SEQ ID NO: 1614087 - RNA, 19 nt, Human
ucuuuugccguuauuaaaa

SEQ ID NO: 1614088 - RNA, 22 nt, Human
ucuguuuuauaauuuugugaag

SEQ ID NO: 1614089 - RNA, 18 nt, Human
ucuuaaaaaguggaaaaa

SEQ ID NO: 1614090 - RNA, 23 nt, Human
ucuguggguuucuaaagcugcca

SEQ ID NO: 1614091 - RNA, 18 nt, Human
ucuguacgucugacaggc

SEQ ID NO: 1614092 - RNA, 17 nt, Human
ucuguacgucugacagg

SEQ ID NO: 1614093 - RNA, 19 nt, Human
ucuguccgagcuuugaaaa

SEQ ID NO: 1614094 - RNA, 22 nt, Human
ucuguggguuucuaaagcugcc

SEQ ID NO: 1614095 - RNA, 14 nt, Human
ucuguccuacucug

SEQ ID NO: 1614096 - RNA, 18 nt, Human
ucuggagguacgaaaaga

SEQ ID NO: 1614097 - RNA, 14 nt, Human
ucuggcuaugcauu

SEQ ID NO: 1614098 - RNA, 17 nt, Human
ucuggcuaugcauuuga

SEQ ID NO: 1614099 - RNA, 23 nt, Human
ucuggagcccacuguacuugcuc

SEQ ID NO: 1614100 - RNA, 12 nt, Human
ucugggacacag

SEQ ID NO: 1614101 - RNA, 13 nt, Human
ucugggacacagu

SEQ ID NO: 1614102 - RNA, 16 nt, Human
ucuggcucuuccaggc

SEQ ID NO: 1614103 - RNA, 15 nt, Human
ucuggcucuuccagg

SEQ ID NO: 1614104 - RNA, 17 nt, Human
ucuggcucuuccaggcu

SEQ ID NO: 1614105 - RNA, 21 nt, Human
ucuucuccacuuucuagccag

SEQ ID NO: 1614106 - RNA, 19 nt, Human
ucuucuccacuuucuagcc

SEQ ID NO: 1614107 - RNA, 13 nt, Human
ucuucuccacugg

SEQ ID NO: 1614108 - RNA, 16 nt, Human
ucuucaguaagccgug

SEQ ID NO: 1614109 - RNA, 21 nt, Human
ucuuccacaagagcccaggcc

SEQ ID NO: 1614110 - RNA, 14 nt, Human
ucuuccaggcuggg

SEQ ID NO: 1614111 - RNA, 15 nt, Human
ucuucaguaagccgu

SEQ ID NO: 1614112 - RNA, 13 nt, Human
ucuuaugggcugg

SEQ ID NO: 1614113 - RNA, 15 nt, Human
ucuuauacauuugau

SEQ ID NO: 1614114 - RNA, 16 nt, Human
ucuuaguggauguucu

SEQ ID NO: 1614115 - RNA, 14 nt, Human
ucuuagugugugca

SEQ ID NO: 1614116 - RNA, 18 nt, Human
ucuugaacuccuggccuc

SEQ ID NO: 1614117 - RNA, 17 nt, Human
ucuugaacuccuggccu

SEQ ID NO: 1614118 - RNA, 16 nt, Human
ucuugaacuccuggcc

SEQ ID NO: 1614119 - RNA, 15 nt, Human
ucuucuccaggcugu

SEQ ID NO: 1614120 - RNA, 14 nt, Human
ucuucuccaggcug

SEQ ID NO: 1614121 - RNA, 13 nt, Human
ucuucuccaggcu

SEQ ID NO: 1614122 - RNA, 12 nt, Human
ucuucuccaggc

SEQ ID NO: 1614123 - RNA, 16 nt, Human
ucuucuccacuggaug

SEQ ID NO: 1614124 - RNA, 21 nt, Human
ucuugaauuguaaggaaugau

SEQ ID NO: 1614125 - RNA, 13 nt, Human
ucuugcucugcug

SEQ ID NO: 1614126 - RNA, 12 nt, Human
ucuugcucugcu

SEQ ID NO: 1614127 - RNA, 11 nt, Human
ucuugcucugc

SEQ ID NO: 1614128 - RNA, 15 nt, Human
ucuugccuuuuucau

SEQ ID NO: 1614129 - RNA, 19 nt, Human
ucuuuaaaaaaaaaauugg

SEQ ID NO: 1614130 - RNA, 18 nt, Human
ucuuguuuuuuuuuucca

SEQ ID NO: 1614131 - RNA, 21 nt, Human
ucuuguuuuuuuuuuccacuu

SEQ ID NO: 1614132 - RNA, 18 nt, Human
ucuuuaaaaaaaaaauug

SEQ ID NO: 1614133 - RNA, 19 nt, Human
ucuugucucagauuuuauu

SEQ ID NO: 1614134 - RNA, 20 nt, Human
ugcuaggaacacuccuucac

SEQ ID NO: 1614135 - RNA, 14 nt, Human
ugcucaggagcccu

SEQ ID NO: 1614136 - RNA, 11 nt, Human
ugcucauggaa

SEQ ID NO: 1614137 - RNA, 19 nt, Human
ugcuccucuccccagcaag

SEQ ID NO: 1614138 - RNA, 21 nt, Human
ugcuagaacucccuuucaaca

SEQ ID NO: 1614139 - RNA, 20 nt, Human
ugcuagaacucccuuucaac

SEQ ID NO: 1614140 - RNA, 19 nt, Human
ugcuaggaacacuccuuca

SEQ ID NO: 1614141 - RNA, 17 nt, Human
ugcuaggaacacuccuu

SEQ ID NO: 1614142 - RNA, 16 nt, Human
ugcuaggaacacuccu

SEQ ID NO: 1614143 - RNA, 19 nt, Human
ugcuagaacucccuuucaa

SEQ ID NO: 1614144 - RNA, 15 nt, Human
ugcgugcauaccacu

SEQ ID NO: 1614145 - RNA, 17 nt, Human
ugcugaaacaacaaaua

SEQ ID NO: 1614146 - RNA, 23 nt, Human
ugcugaauacagaggcaacugca

SEQ ID NO: 1614147 - RNA, 18 nt, Human
ugcugaauacagaggcaa

SEQ ID NO: 1614148 - RNA, 22 nt, Human
ugcugaaugguuuucaaaauaa

SEQ ID NO: 1614149 - RNA, 18 nt, Human
ugcugaaugguuuucaaa

SEQ ID NO: 1614150 - RNA, 17 nt, Human
ugcugaaugguuuucaa

SEQ ID NO: 1614151 - RNA, 19 nt, Human
ugcuccuggcccacugcau

SEQ ID NO: 1614152 - RNA, 19 nt, Human
ugcugacagacacaggccc

SEQ ID NO: 1614153 - RNA, 16 nt, Human
ugcugacagacacagg

SEQ ID NO: 1614154 - RNA, 15 nt, Human
ugcugacagacacag

SEQ ID NO: 1614155 - RNA, 17 nt, Human
ugcugaguuugugcugg

SEQ ID NO: 1614156 - RNA, 15 nt, Human
ugcugaguuugugcu

SEQ ID NO: 1614157 - RNA, 16 nt, Human
ugcugcaguugccagu

SEQ ID NO: 1614158 - RNA, 15 nt, Human
ugcugcaguugccag

SEQ ID NO: 1614159 - RNA, 23 nt, Human
ugcugauggugcaaugaccuuuc

SEQ ID NO: 1614160 - RNA, 20 nt, Human
ugcugauggugcaaugaccu

SEQ ID NO: 1614161 - RNA, 18 nt, Human
ugccuccccuccucugcu

SEQ ID NO: 1614162 - RNA, 23 nt, Human
ugccuccccuccucugcuugcca

SEQ ID NO: 1614163 - RNA, 19 nt, Human
ugccuccccuccucugcuu

SEQ ID NO: 1614164 - RNA, 22 nt, Human
ugccuccccuccucugcuugcc

SEQ ID NO: 1614165 - RNA, 23 nt, Human
ugcccaggcuggcgugcaguggu

SEQ ID NO: 1614166 - RNA, 12 nt, Human
ugcccagccccu

SEQ ID NO: 1614167 - RNA, 11 nt, Human
ugcccagcccc

SEQ ID NO: 1614168 - RNA, 19 nt, Human
ugccuaaggcugaacuugu

SEQ ID NO: 1614169 - RNA, 23 nt, Human
ugccuaaggacuucuuuaauuuu

SEQ ID NO: 1614170 - RNA, 18 nt, Human
ugccuccuuugugaggaa

SEQ ID NO: 1614171 - RNA, 17 nt, Human
ugccuccuuugugagga

SEQ ID NO: 1614172 - RNA, 16 nt, Human
ugccuccuuugugagg

SEQ ID NO: 1614173 - RNA, 18 nt, Human
ugccugaagucacacagu

SEQ ID NO: 1614174 - RNA, 22 nt, Human
ugccugaagucacacagugagu

SEQ ID NO: 1614175 - RNA, 22 nt, Human
ugccuucucaacuccaaacuga

SEQ ID NO: 1614176 - RNA, 23 nt, Human
ugcggugcuaucucccccagccc

SEQ ID NO: 1614177 - RNA, 13 nt, Human
ugcgccuacagga

SEQ ID NO: 1614178 - RNA, 19 nt, Human
ugcgcaggcuggcccugcc

SEQ ID NO: 1614179 - RNA, 17 nt, Human
ugcgcaggcuggcccug

SEQ ID NO: 1614180 - RNA, 16 nt, Human
ugcgcaggcuggcccu

SEQ ID NO: 1614181 - RNA, 13 nt, Human
ugcgcaggcuggc

SEQ ID NO: 1614182 - RNA, 22 nt, Human
ugccuuauggaacacucugaga

SEQ ID NO: 1614183 - RNA, 21 nt, Human
ugccuuauggaacacucugag

SEQ ID NO: 1614184 - RNA, 20 nt, Human
ugccuuauggaacacucuga

SEQ ID NO: 1614185 - RNA, 18 nt, Human
ugccuuauggaacacucu

SEQ ID NO: 1614186 - RNA, 15 nt, Human
ugccuggcggggugg

SEQ ID NO: 1614187 - RNA, 18 nt, Human
ugccuucagcucuacagc

SEQ ID NO: 1614188 - RNA, 17 nt, Human
ugccuucagcucuacag

SEQ ID NO: 1614189 - RNA, 13 nt, Human
ugccuucagcucu

SEQ ID NO: 1614190 - RNA, 15 nt, Human
ugccaucccucccuc

SEQ ID NO: 1614191 - RNA, 19 nt, Human
ugccaucccucccuccacc

SEQ ID NO: 1614192 - RNA, 20 nt, Human
ugccaucccucccuccaccu

SEQ ID NO: 1614193 - RNA, 21 nt, Human
ugccaucccucccuccaccuc

SEQ ID NO: 1614194 - RNA, 22 nt, Human
ugccaucccucccuccaccucc

SEQ ID NO: 1614195 - RNA, 14 nt, Human
ugccagucaccccg

SEQ ID NO: 1614196 - RNA, 22 nt, Human
ugccagggacagaggggguggc

SEQ ID NO: 1614197 - RNA, 11 nt, Human
ugccagggaca

SEQ ID NO: 1614198 - RNA, 10 nt, Human
ugcccagccc

SEQ ID NO: 1614199 - RNA, 19 nt, Human
ugcccaccuggccucugca

SEQ ID NO: 1614200 - RNA, 18 nt, Human
ugcccaccuggccucugc

SEQ ID NO: 1614201 - RNA, 17 nt, Human
ugcccaccuggccucug

SEQ ID NO: 1614202 - RNA, 15 nt, Human
ugcccaccuggccuc

SEQ ID NO: 1614203 - RNA, 23 nt, Human
ugccaucucaccuccugcugggc

SEQ ID NO: 1614204 - RNA, 22 nt, Human
ugccaucucaccuccugcuggg

SEQ ID NO: 1614205 - RNA, 21 nt, Human
ugccaucucaccuccugcugg

SEQ ID NO: 1614206 - RNA, 20 nt, Human
ugccaucucaccuccugcug

SEQ ID NO: 1614207 - RNA, 22 nt, Human
ugcaucagcugcugaaacaaca

SEQ ID NO: 1614208 - RNA, 19 nt, Human
ugcaggcagccaggccaca

SEQ ID NO: 1614209 - RNA, 18 nt, Human
ugcaggcagccaggccac

SEQ ID NO: 1614210 - RNA, 17 nt, Human
ugcaggcagccaggcca

SEQ ID NO: 1614211 - RNA, 16 nt, Human
ugcaggcagccaggcc

SEQ ID NO: 1614212 - RNA, 15 nt, Human
ugcaucguuucaucu

SEQ ID NO: 1614213 - RNA, 17 nt, Human
ugcaucguuucaucuuc

SEQ ID NO: 1614214 - RNA, 21 nt, Human
ugcauccuccgccucccgggu

SEQ ID NO: 1614215 - RNA, 18 nt, Human
ugcauccuccgccucccg

SEQ ID NO: 1614216 - RNA, 21 nt, Human
ugcauuauauuuauuacugua

SEQ ID NO: 1614217 - RNA, 20 nt, Human
ugcauuauauuuauuacugu

SEQ ID NO: 1614218 - RNA, 15 nt, Human
ugcauuauauuuauu

SEQ ID NO: 1614219 - RNA, 19 nt, Human
ugcauguuacauaagauaa

SEQ ID NO: 1614220 - RNA, 17 nt, Human
ugcagauaaacaguagu

SEQ ID NO: 1614221 - RNA, 16 nt, Human
ugcagauaaacaguag

SEQ ID NO: 1614222 - RNA, 20 nt, Human
ugcacuuuguucuggcucuu

SEQ ID NO: 1614223 - RNA, 19 nt, Human
ugcacuuuguucuggcucu

SEQ ID NO: 1614224 - RNA, 18 nt, Human
ugcacuuuguucuggcuc

SEQ ID NO: 1614225 - RNA, 15 nt, Human
ugcacuuuguucugg

SEQ ID NO: 1614226 - RNA, 16 nt, Human
ugcacguacacacaca

SEQ ID NO: 1614227 - RNA, 19 nt, Human
ugcacguacacacacauac

SEQ ID NO: 1614228 - RNA, 23 nt, Human
ugcacggugaauggcuuuguaua

SEQ ID NO: 1614229 - RNA, 22 nt, Human
ugcacggugaauggcuuuguau

SEQ ID NO: 1614230 - RNA, 21 nt, Human
ugcacuugcagacucuacaga

SEQ ID NO: 1614231 - RNA, 14 nt, Human
ugcaggaccucagg

SEQ ID NO: 1614232 - RNA, 22 nt, Human
ugcagcuuuaaaaaauuaaucu

SEQ ID NO: 1614233 - RNA, 16 nt, Human
ugcaggaccucaggug

SEQ ID NO: 1614234 - RNA, 15 nt, Human
ugcaggaccucaggu

SEQ ID NO: 1614235 - RNA, 18 nt, Human
ugcaggaccucaggugag

SEQ ID NO: 1614236 - RNA, 14 nt, Human
ugcagcaauaaagc

SEQ ID NO: 1614237 - RNA, 15 nt, Human
ugcagcaauaaagca

SEQ ID NO: 1614238 - RNA, 16 nt, Human
ugcagcaauaaagcag

SEQ ID NO: 1614239 - RNA, 20 nt, Human
ugcagcaauaaagcagcguu

SEQ ID NO: 1614240 - RNA, 13 nt, Human
ugcagcuuuaaaa

SEQ ID NO: 1614241 - RNA, 15 nt, Human
ugcacaucaaaauau

SEQ ID NO: 1614242 - RNA, 20 nt, Human
ugcacagcuaacauggaagu

SEQ ID NO: 1614243 - RNA, 18 nt, Human
ugcacagcuaacauggaa

SEQ ID NO: 1614244 - RNA, 23 nt, Human
ugcacagcuaacauggaaguacu

SEQ ID NO: 1614245 - RNA, 18 nt, Human
ugcacagugcaucucagc

SEQ ID NO: 1614246 - RNA, 20 nt, Human
ugcacagugcaucucagccc

SEQ ID NO: 1614247 - RNA, 19 nt, Human
ugcacagugcaucucagcc

SEQ ID NO: 1614248 - RNA, 20 nt, Human
ugaagucuuuguacagacaa

SEQ ID NO: 1614249 - RNA, 17 nt, Human
ugaagucuuuguacaga

SEQ ID NO: 1614250 - RNA, 16 nt, Human
ugaaggcuggguucug

SEQ ID NO: 1614251 - RNA, 22 nt, Human
ugaagucuuuguacagacaaca

SEQ ID NO: 1614252 - RNA, 21 nt, Human
ugcacagaguuguuacauuuu

SEQ ID NO: 1614253 - RNA, 22 nt, Human
ugcacagaguuguuacauuuuu

SEQ ID NO: 1614254 - RNA, 23 nt, Human
ugcacagaguuguuacauuuuua

SEQ ID NO: 1614255 - RNA, 17 nt, Human
ugcacagcuaacaugga

SEQ ID NO: 1614256 - RNA, 22 nt, Human
uggaggcaugugaugagaggaa

SEQ ID NO: 1614257 - RNA, 17 nt, Human
uggacaggcauguucuc

SEQ ID NO: 1614258 - RNA, 16 nt, Human
uggacaggcauguucu

SEQ ID NO: 1614259 - RNA, 12 nt, Human
uggacaggcaug

SEQ ID NO: 1614260 - RNA, 13 nt, Human
uggagauguuuag

SEQ ID NO: 1614261 - RNA, 20 nt, Human
uggagaggcccggccucuca

SEQ ID NO: 1614262 - RNA, 15 nt, Human
uggaugccugguggc

SEQ ID NO: 1614263 - RNA, 14 nt, Human
uggaugccuggugg

SEQ ID NO: 1614264 - RNA, 18 nt, Human
uggcacugcuuccaguga

SEQ ID NO: 1614265 - RNA, 16 nt, Human
uggcacugcuuccagu

SEQ ID NO: 1614266 - RNA, 14 nt, Human
uggcacugcuucca

SEQ ID NO: 1614267 - RNA, 22 nt, Human
uggcagcugcgguccacccagg

SEQ ID NO: 1614268 - RNA, 21 nt, Human
uggcagcugcgguccacccag

SEQ ID NO: 1614269 - RNA, 23 nt, Human
uggcagcugcgguccacccagga

SEQ ID NO: 1614270 - RNA, 20 nt, Human
uggcagugggagcugccugu

SEQ ID NO: 1614271 - RNA, 22 nt, Human
uggccacuccagaccccuggcu

SEQ ID NO: 1614272 - RNA, 17 nt, Human
uggcauaacauaaaucu

SEQ ID NO: 1614273 - RNA, 15 nt, Human
uggcauaacauaaau

SEQ ID NO: 1614274 - RNA, 19 nt, Human
uggcagugggagcugccug

SEQ ID NO: 1614275 - RNA, 16 nt, Human
uggcagugggagcugc

SEQ ID NO: 1614276 - RNA, 15 nt, Human
uggcagugggagcug

SEQ ID NO: 1614277 - RNA, 14 nt, Human
uggcagugggagcu

SEQ ID NO: 1614278 - RNA, 14 nt, Human
ugcuucuguuuuau

SEQ ID NO: 1614279 - RNA, 16 nt, Human
ugcuucuucagagacu

SEQ ID NO: 1614280 - RNA, 12 nt, Human
ugcuucucacug

SEQ ID NO: 1614281 - RNA, 18 nt, Human
ugcuuccagugaggcucu

SEQ ID NO: 1614282 - RNA, 14 nt, Human
ugcugccuccagaa

SEQ ID NO: 1614283 - RNA, 13 nt, Human
ugcugccucaugc

SEQ ID NO: 1614284 - RNA, 20 nt, Human
ugcuuccagugaggcucugc

SEQ ID NO: 1614285 - RNA, 19 nt, Human
ugcuuccagugaggcucug

SEQ ID NO: 1614286 - RNA, 21 nt, Human
ugcuuccagugaggcucugcc

SEQ ID NO: 1614287 - RNA, 12 nt, Human
ugcuuucagaua

SEQ ID NO: 1614288 - RNA, 21 nt, Human
ugcuuucagauacuggauugu

SEQ ID NO: 1614289 - RNA, 20 nt, Human
ugcuuucagauacuggauug

SEQ ID NO: 1614290 - RNA, 17 nt, Human
ugcuuucagauacugga

SEQ ID NO: 1614291 - RNA, 16 nt, Human
ugcuuucagauacugg

SEQ ID NO: 1614292 - RNA, 18 nt, Human
ugcuuguuaacugagugc

SEQ ID NO: 1614293 - RNA, 14 nt, Human
uggaacucucgagc

SEQ ID NO: 1614294 - RNA, 12 nt, Human
uggaagacagcu

SEQ ID NO: 1614295 - RNA, 11 nt, Human
uggaagacagc

SEQ ID NO: 1614296 - RNA, 17 nt, Human
uggaaaaauagccugcc

SEQ ID NO: 1614297 - RNA, 15 nt, Human
uggaaaauaaaucaa

SEQ ID NO: 1614298 - RNA, 11 nt, Human
uggaaaauaaa

SEQ ID NO: 1614299 - RNA, 16 nt, Human
uggaaaauaaauuauu

SEQ ID NO: 1614300 - RNA, 15 nt, Human
uggaaaauaaauuau

SEQ ID NO: 1614301 - RNA, 15 nt, Human
uggaagacagcucuu

SEQ ID NO: 1614302 - RNA, 14 nt, Human
uggaagacagcucu

SEQ ID NO: 1614303 - RNA, 21 nt, Human
uggaagugugugaucuguggg

SEQ ID NO: 1614304 - RNA, 16 nt, Human
uggaauacucuuauau

SEQ ID NO: 1614305 - RNA, 16 nt, Human
uggguagacacacaug

SEQ ID NO: 1614306 - RNA, 17 nt, Human
uggguagacacacauga

SEQ ID NO: 1614307 - RNA, 22 nt, Human
ugggguggggggggugcugggc

SEQ ID NO: 1614308 - RNA, 21 nt, Human
ugggguggggggggugcuggg

SEQ ID NO: 1614309 - RNA, 17 nt, Human
ugggguggggaccucag

SEQ ID NO: 1614310 - RNA, 19 nt, Human
ugggguggggggggugcug

SEQ ID NO: 1614311 - RNA, 17 nt, Human
uggguuggaaaacagua

SEQ ID NO: 1614312 - RNA, 21 nt, Human
uggguuccagcaauucuccug

SEQ ID NO: 1614313 - RNA, 22 nt, Human
uggguuccuuccucugagccuu

SEQ ID NO: 1614314 - RNA, 21 nt, Human
uggguuccuuccucugagccu

SEQ ID NO: 1614315 - RNA, 16 nt, Human
uggguucacugcaacc

SEQ ID NO: 1614316 - RNA, 23 nt, Human
uggguucaagcgauucuucugcu

SEQ ID NO: 1614317 - RNA, 14 nt, Human
uggguguggcgcag

SEQ ID NO: 1614318 - RNA, 23 nt, Human
ugggugucaagagggucugagga

SEQ ID NO: 1614319 - RNA, 21 nt, Human
ugggugucaagagggucugag

SEQ ID NO: 1614320 - RNA, 22 nt, Human
ugggcuuggggaccagagcugc

SEQ ID NO: 1614321 - RNA, 21 nt, Human
ugggcuuggggaccagagcug

SEQ ID NO: 1614322 - RNA, 16 nt, Human
uggggcagcuugaggg

SEQ ID NO: 1614323 - RNA, 20 nt, Human
ugggcuucaguggcagcugc

SEQ ID NO: 1614324 - RNA, 21 nt, Human
ugggcuucaguggcagcugcu

SEQ ID NO: 1614325 - RNA, 19 nt, Human
ugggcuuggggaccagagc

SEQ ID NO: 1614326 - RNA, 19 nt, Human
ugggcuucaguggcagcug

SEQ ID NO: 1614327 - RNA, 18 nt, Human
ugggcuucaguggcagcu

SEQ ID NO: 1614328 - RNA, 19 nt, Human
ugggcgugagaccugcccc

SEQ ID NO: 1614329 - RNA, 18 nt, Human
ugggcgugagaccugccc

SEQ ID NO: 1614330 - RNA, 17 nt, Human
ugggcgugagaccugcc

SEQ ID NO: 1614331 - RNA, 24 nt, Human
ugggagcugccuguucagcuccag

SEQ ID NO: 1614332 - RNA, 16 nt, Human
ugggagcuuuuguaga

SEQ ID NO: 1614333 - RNA, 22 nt, Human
ugggccuccugugugugcgccu

SEQ ID NO: 1614334 - RNA, 16 nt, Human
ugggccuccugugugu

SEQ ID NO: 1614335 - RNA, 18 nt, Human
ugggccuucagggaguga

SEQ ID NO: 1614336 - RNA, 14 nt, Human
ugggccuccugugu

SEQ ID NO: 1614337 - RNA, 18 nt, Human
uggccuucggccuccauc

SEQ ID NO: 1614338 - RNA, 17 nt, Human
uggccuucggccuccau

SEQ ID NO: 1614339 - RNA, 15 nt, Human
uggccagaugcacca

SEQ ID NO: 1614340 - RNA, 20 nt, Human
uggccuucggccuccauccu

SEQ ID NO: 1614341 - RNA, 22 nt, Human
uggcgugcaguggugcgaucug

SEQ ID NO: 1614342 - RNA, 14 nt, Human
uggcgcugccccug

SEQ ID NO: 1614343 - RNA, 15 nt, Human
uggcgcugccccugg

SEQ ID NO: 1614344 - RNA, 20 nt, Human
uggcucagguggggucacuc

SEQ ID NO: 1614345 - RNA, 22 nt, Human
uggcucagguggggucacucug

SEQ ID NO: 1614346 - RNA, 14 nt, Human
uggcuaaauucaug

SEQ ID NO: 1614347 - RNA, 15 nt, Human
uggcucuuccaggcu

SEQ ID NO: 1614348 - RNA, 13 nt, Human
uggcucuuccagg

SEQ ID NO: 1614349 - RNA, 12 nt, Human
uggcugggggcc

SEQ ID NO: 1614350 - RNA, 16 nt, Human
uggcucuuccaggcug

SEQ ID NO: 1614351 - RNA, 19 nt, Human
uggcucuuccaggcuggga

SEQ ID NO: 1614352 - RNA, 21 nt, Human
ugggacagucaccucauggaa

SEQ ID NO: 1614353 - RNA, 20 nt, Human
ugggacagucaccucaugga

SEQ ID NO: 1614354 - RNA, 18 nt, Human
ugggacagucaccucaug

SEQ ID NO: 1614355 - RNA, 22 nt, Human
ugggaaugaaugucagugugac

SEQ ID NO: 1614356 - RNA, 15 nt, Human
uggcuuuucacugcu

SEQ ID NO: 1614357 - RNA, 14 nt, Human
uggcuuuucacugc

SEQ ID NO: 1614358 - RNA, 22 nt, Human
uggcugguuagagguucccuuu

SEQ ID NO: 1614359 - RNA, 14 nt, Human
uggcugggggccuc

SEQ ID NO: 1614360 - RNA, 15 nt, Human
uggcugggggccuca

SEQ ID NO: 1614361 - RNA, 15 nt, Human
uggcuguacccagga

SEQ ID NO: 1614362 - RNA, 22 nt, Human
uggcuuuguauagaaccucuuu

SEQ ID NO: 1614363 - RNA, 14 nt, Human
uggcuuuguauaga

SEQ ID NO: 1614364 - RNA, 20 nt, Human
ugggacauuugcucauggaa

SEQ ID NO: 1614365 - RNA, 19 nt, Human
ugggacauuugcucaugga

SEQ ID NO: 1614366 - RNA, 16 nt, Human
ugggacaugggaaagg

SEQ ID NO: 1614367 - RNA, 16 nt, Human
ugggacagggcauggc

SEQ ID NO: 1614368 - RNA, 21 nt, Human
uguuuguuuagucuugucuca

SEQ ID NO: 1614369 - RNA, 18 nt, Human
uguuuuaaaaugagaaau

SEQ ID NO: 1614370 - RNA, 17 nt, Human
uguuuguugucagcuga

SEQ ID NO: 1614371 - RNA, 12 nt, Human
uguuuguuuagu

SEQ ID NO: 1614372 - RNA, 22 nt, Human
uguuuccuggcacugcuuccag

SEQ ID NO: 1614373 - RNA, 21 nt, Human
uguuuccuggcacugcuucca

SEQ ID NO: 1614374 - RNA, 20 nt, Human
uguuuccuggcacugcuucc

SEQ ID NO: 1614375 - RNA, 23 nt, Human
uguuuccuggcacugcuuccagu

SEQ ID NO: 1614376 - RNA, 13 nt, Human
uguuuuugucuua

SEQ ID NO: 1614377 - RNA, 23 nt, Human
uguuuuaaaaugagaaaucuaaa

SEQ ID NO: 1614378 - RNA, 20 nt, Human
uuaaagcuuauuaaaacuca

SEQ ID NO: 1614379 - RNA, 20 nt, Human
uuaaacuuaaucuaaaugga

SEQ ID NO: 1614380 - RNA, 22 nt, Human
uuaaacuuaaucuaaauggaac

SEQ ID NO: 1614381 - RNA, 19 nt, Human
uuaaaagaaugauuaugaa

SEQ ID NO: 1614382 - RNA, 16 nt, Human
uuaaacuuaaucuaaa

SEQ ID NO: 1614383 - RNA, 18 nt, Human
uuaaacuuaaucuaaaug

SEQ ID NO: 1614384 - RNA, 18 nt, Human
uuaaaugcccagccccuu

SEQ ID NO: 1614385 - RNA, 13 nt, Human
uuaaaugcccagc

SEQ ID NO: 1614386 - RNA, 12 nt, Human
uuaaaugcugcu

SEQ ID NO: 1614387 - RNA, 19 nt, Human
uuaacauguuaaaccaugg

SEQ ID NO: 1614388 - RNA, 18 nt, Human
uuaacauguuaaaccaug

SEQ ID NO: 1614389 - RNA, 12 nt, Human
uuaacauguuaa

SEQ ID NO: 1614390 - RNA, 16 nt, Human
uuaaaugcaccuggaa

SEQ ID NO: 1614391 - RNA, 17 nt, Human
uuaaaugcaccuggaau

SEQ ID NO: 1614392 - RNA, 18 nt, Human
uuaaaugcaccuggaaua

SEQ ID NO: 1614393 - RNA, 19 nt, Human
uuaaauagcuuuuuucucu

SEQ ID NO: 1614394 - RNA, 20 nt, Human
uuaaagcuuccauuguuguc

SEQ ID NO: 1614395 - RNA, 15 nt, Human
uuaaagcuuccauug

SEQ ID NO: 1614396 - RNA, 18 nt, Human
uuaaauaguaaaaauaaa

SEQ ID NO: 1614397 - RNA, 18 nt, Human
uuaauaauguuucaaaca

SEQ ID NO: 1614398 - RNA, 18 nt, Human
uuaauaauuauaugcuau

SEQ ID NO: 1614399 - RNA, 16 nt, Human
uuaauagguuuggaca

SEQ ID NO: 1614400 - RNA, 23 nt, Human
uuaauaauuauaugcuauuucua

SEQ ID NO: 1614401 - RNA, 20 nt, Human
uuaauaauuauaugcuauuu

SEQ ID NO: 1614402 - RNA, 22 nt, Human
uuaaggaugcuuguacauaaug

SEQ ID NO: 1614403 - RNA, 17 nt, Human
uuaaggaugcuuguaca

SEQ ID NO: 1614404 - RNA, 18 nt, Human
uuaaggaugcuuguacau

SEQ ID NO: 1614405 - RNA, 19 nt, Human
uuaaggaugcuuguacaua

SEQ ID NO: 1614406 - RNA, 20 nt, Human
uuaaggaugcuuguacauaa

SEQ ID NO: 1614407 - RNA, 21 nt, Human
uuaaggaagacaaugugaaaa

SEQ ID NO: 1614408 - RNA, 17 nt, Human
uuaaugucacaggcagg

SEQ ID NO: 1614409 - RNA, 14 nt, Human
uuaauggaaauguu

SEQ ID NO: 1614410 - RNA, 18 nt, Human
uuaaugucacaggcaggu

SEQ ID NO: 1614411 - RNA, 21 nt, Human
uuaauagguuuggacaaaaug

SEQ ID NO: 1614412 - RNA, 21 nt, Human
uuaccacuuguguuuugcaag

SEQ ID NO: 1614413 - RNA, 14 nt, Human
uuaccagcagagca

SEQ ID NO: 1614414 - RNA, 20 nt, Human
uuacauuuuuaagugcugca

SEQ ID NO: 1614415 - RNA, 21 nt, Human
uuacauuuuuaagugcugcau

SEQ ID NO: 1614416 - RNA, 22 nt, Human
uuacauuuuuaagugcugcauu

SEQ ID NO: 1614417 - RNA, 23 nt, Human
uuacauuuuuaagugcugcauuu

SEQ ID NO: 1614418 - RNA, 19 nt, Human
uuaccuuuuuuauacauaa

SEQ ID NO: 1614419 - RNA, 20 nt, Human
uuaccuuuuuuauacauaaa

SEQ ID NO: 1614420 - RNA, 22 nt, Human
uuaccuuuuuuauacauaaaca

SEQ ID NO: 1614421 - RNA, 20 nt, Human
uuacgguuuuccagguuuaa

SEQ ID NO: 1614422 - RNA, 16 nt, Human
uuacggaacucaaaua

SEQ ID NO: 1614423 - RNA, 15 nt, Human
uuacauuuguauaaa

SEQ ID NO: 1614424 - RNA, 14 nt, Human
uuacauuuguauaa

SEQ ID NO: 1614425 - RNA, 14 nt, Human
uuacauuuccuaaa

SEQ ID NO: 1614426 - RNA, 23 nt, Human
uuacauggcuggagcuagaauuu

SEQ ID NO: 1614427 - RNA, 22 nt, Human
uuacauggcuggagcuagaauu

SEQ ID NO: 1614428 - RNA, 23 nt, Human
uuacaauaaaaucuugaaaaugc

SEQ ID NO: 1614429 - RNA, 13 nt, Human
uguuuaaaaucau

SEQ ID NO: 1614430 - RNA, 14 nt, Human
uguuuaaaaucauu

SEQ ID NO: 1614431 - RNA, 17 nt, Human
uguuuacagauccccaa

SEQ ID NO: 1614432 - RNA, 14 nt, Human
uguuguuuguuuag

SEQ ID NO: 1614433 - RNA, 14 nt, Human
uguuggccaggcug

SEQ ID NO: 1614434 - RNA, 18 nt, Human
uguuggccaggcugcucu

SEQ ID NO: 1614435 - RNA, 13 nt, Human
uguuggccaggcu

SEQ ID NO: 1614436 - RNA, 21 nt, Human
uguuggagaagaacugaaauc

SEQ ID NO: 1614437 - RNA, 14 nt, Human
uguugcugccucau

SEQ ID NO: 1614438 - RNA, 11 nt, Human
uguuggccagg

SEQ ID NO: 1614439 - RNA, 19 nt, Human
uguugaagagguuuuaaag

SEQ ID NO: 1614440 - RNA, 13 nt, Human
uguugcugccuca

SEQ ID NO: 1614441 - RNA, 11 nt, Human
uguugaaagau

SEQ ID NO: 1614442 - RNA, 23 nt, Human
uguugaaacggaugauuucuaug

SEQ ID NO: 1614443 - RNA, 22 nt, Human
uguugaaacggaugauuucuau

SEQ ID NO: 1614444 - RNA, 21 nt, Human
uguugaaacggaugauuucua

SEQ ID NO: 1614445 - RNA, 20 nt, Human
uguucuuucuggcuaugcau

SEQ ID NO: 1614446 - RNA, 22 nt, Human
uguucuuucuggcuaugcauuu

SEQ ID NO: 1614447 - RNA, 20 nt, Human
uguugaaacggaugauuucu

SEQ ID NO: 1614448 - RNA, 15 nt, Human
uguucugacccugcu

SEQ ID NO: 1614449 - RNA, 19 nt, Human
uguucucugcccuccaaga

SEQ ID NO: 1614450 - RNA, 14 nt, Human
uguucuuucuggcu

SEQ ID NO: 1614451 - RNA, 17 nt, Human
uguucugcacacagcac

SEQ ID NO: 1614452 - RNA, 18 nt, Human
uguucugacccugcuuca

SEQ ID NO: 1614453 - RNA, 12 nt, Human
uguucucugccc

SEQ ID NO: 1614454 - RNA, 18 nt, Human
uguucucugaggacacua

SEQ ID NO: 1614455 - RNA, 16 nt, Human
uguucucugaggacac

SEQ ID NO: 1614456 - RNA, 12 nt, Human
uguucuauagcu

SEQ ID NO: 1614457 - RNA, 20 nt, Human
uguucaugaaagauucaaug

SEQ ID NO: 1614458 - RNA, 13 nt, Human
uguucauaaauaa

SEQ ID NO: 1614459 - RNA, 16 nt, Human
uguucacagccagacu

SEQ ID NO: 1614460 - RNA, 14 nt, Human
uguucagcuccagc

SEQ ID NO: 1614461 - RNA, 11 nt, Human
uguucagcugg

SEQ ID NO: 1614462 - RNA, 18 nt, Human
uguucagcuccagcucac

SEQ ID NO: 1614463 - RNA, 16 nt, Human
uguucagcuccagcuc

SEQ ID NO: 1614464 - RNA, 15 nt, Human
uguucagcuccagcu

SEQ ID NO: 1614465 - RNA, 12 nt, Human
uguuauaaucuu

SEQ ID NO: 1614466 - RNA, 16 nt, Human
uguuagaucuaguuca

SEQ ID NO: 1614467 - RNA, 16 nt, Human
uguuacugucuucagu

SEQ ID NO: 1614468 - RNA, 15 nt, Human
uguuacugucuucag

SEQ ID NO: 1614469 - RNA, 22 nt, Human
uguuacauuuuuaagugcugca

SEQ ID NO: 1614470 - RNA, 13 nt, Human
uguuacauuuuua

SEQ ID NO: 1614471 - RNA, 23 nt, Human
uguuaaaccaugggauaaaugcc

SEQ ID NO: 1614472 - RNA, 21 nt, Human
uguuaaaccaugggauaaaug

SEQ ID NO: 1614473 - RNA, 20 nt, Human
uguuaaaccaugggauaaau

SEQ ID NO: 1614474 - RNA, 18 nt, Human
uguuaaaccaugggauaa

SEQ ID NO: 1614475 - RNA, 19 nt, Human
ugugucagcauagaaguaa

SEQ ID NO: 1614476 - RNA, 17 nt, Human
ugugugaagugagugag

SEQ ID NO: 1614477 - RNA, 13 nt, Human
uguguuuauuguc

SEQ ID NO: 1614478 - RNA, 22 nt, Human
uguguuuaggaacuacugagga

SEQ ID NO: 1614479 - RNA, 23 nt, Human
uguaucccaugagccucagcauc

SEQ ID NO: 1614480 - RNA, 19 nt, Human
uguaucccaugagccucag

SEQ ID NO: 1614481 - RNA, 16 nt, Human
uguauagaaccucuuu

SEQ ID NO: 1614482 - RNA, 14 nt, Human
uguaugcacuuugu

SEQ ID NO: 1614483 - RNA, 20 nt, Human
ugucagugugacugaucucu

SEQ ID NO: 1614484 - RNA, 12 nt, Human
ugucagugugac

SEQ ID NO: 1614485 - RNA, 23 nt, Human
ugucccaaaaagaaaggagggga

SEQ ID NO: 1614486 - RNA, 13 nt, Human
uguaaauuaacuu

SEQ ID NO: 1614487 - RNA, 14 nt, Human
uguaaauuaacuuu

SEQ ID NO: 1614488 - RNA, 15 nt, Human
uguaaauuaacuuuu

SEQ ID NO: 1614489 - RNA, 16 nt, Human
uguaaauuaacuuuua

SEQ ID NO: 1614490 - RNA, 17 nt, Human
uguaaauuaacuuuuau

SEQ ID NO: 1614491 - RNA, 15 nt, Human
uguaaucacagcuac

SEQ ID NO: 1614492 - RNA, 15 nt, Human
uguaccgcaauguga

SEQ ID NO: 1614493 - RNA, 23 nt, Human
uguaccucuugagccuugaacuu

SEQ ID NO: 1614494 - RNA, 22 nt, Human
uguaccucuugagccuugaacu

SEQ ID NO: 1614495 - RNA, 14 nt, Human
uguaccucuugagc

SEQ ID NO: 1614496 - RNA, 17 nt, Human
uguagauaauacaguuc

SEQ ID NO: 1614497 - RNA, 19 nt, Human
uguacugcauaugaaagga

SEQ ID NO: 1614498 - RNA, 13 nt, Human
uguacucaauuuu

SEQ ID NO: 1614499 - RNA, 13 nt, Human
uguacuccuccca

SEQ ID NO: 1614500 - RNA, 12 nt, Human
uguacuccuccc

SEQ ID NO: 1614501 - RNA, 17 nt, Human
uguacgucugacaggca

SEQ ID NO: 1614502 - RNA, 14 nt, Human
ugugaaaggaaaga

SEQ ID NO: 1614503 - RNA, 13 nt, Human
ugugaaaggaaag

SEQ ID NO: 1614504 - RNA, 13 nt, Human
ugugaaacauguu

SEQ ID NO: 1614505 - RNA, 18 nt, Human
ugucuuuggacccugagg

SEQ ID NO: 1614506 - RNA, 22 nt, Human
ugucuuuggacccugaggccca

SEQ ID NO: 1614507 - RNA, 19 nt, Human
ugucuuuggacccugaggc

SEQ ID NO: 1614508 - RNA, 14 nt, Human
ugucuuuuuucuaa

SEQ ID NO: 1614509 - RNA, 22 nt, Human
ugucucaguccaugaagaugua

SEQ ID NO: 1614510 - RNA, 21 nt, Human
ugucucaguccaugaagaugu

SEQ ID NO: 1614511 - RNA, 13 nt, Human
uguccccaccgca

SEQ ID NO: 1614512 - RNA, 23 nt, Human
ugucucaagagggcacugguggc

SEQ ID NO: 1614513 - RNA, 21 nt, Human
ugucucaagagggcacuggug

SEQ ID NO: 1614514 - RNA, 20 nt, Human
ugucucaagagggcacuggu

SEQ ID NO: 1614515 - RNA, 17 nt, Human
ugucucaggucccugca

SEQ ID NO: 1614516 - RNA, 16 nt, Human
ugucucaggucccugc

SEQ ID NO: 1614517 - RNA, 22 nt, Human
ugugaccacugcagaagacagu

SEQ ID NO: 1614518 - RNA, 15 nt, Human
ugugacauguuuuau

SEQ ID NO: 1614519 - RNA, 21 nt, Human
ugugacaaggauugcuacugu

SEQ ID NO: 1614520 - RNA, 16 nt, Human
ugugaaucauuuuacc

SEQ ID NO: 1614521 - RNA, 23 nt, Human
ugugaguacuacaguccucccau

SEQ ID NO: 1614522 - RNA, 20 nt, Human
ugugaguacuacaguccucc

SEQ ID NO: 1614523 - RNA, 19 nt, Human
ugugaguacuacaguccuc

SEQ ID NO: 1614524 - RNA, 18 nt, Human
ugugaguacuacaguccu

SEQ ID NO: 1614525 - RNA, 15 nt, Human
ugugagucaccaagc

SEQ ID NO: 1614526 - RNA, 21 nt, Human
ugugauacaaugcugugcccu

SEQ ID NO: 1614527 - RNA, 13 nt, Human
ugugauauaagug

SEQ ID NO: 1614528 - RNA, 12 nt, Human
ugugggaagggg

SEQ ID NO: 1614529 - RNA, 14 nt, Human
uguggacacagcuc

SEQ ID NO: 1614530 - RNA, 17 nt, Human
uguggaaaaugaaaauu

SEQ ID NO: 1614531 - RNA, 21 nt, Human
uguggagaagcggcuggcagc

SEQ ID NO: 1614532 - RNA, 12 nt, Human
uguggagaagcg

SEQ ID NO: 1614533 - RNA, 21 nt, Human
uguggcuccuggggguucuuu

SEQ ID NO: 1614534 - RNA, 16 nt, Human
uguggacacagcucuu

SEQ ID NO: 1614535 - RNA, 15 nt, Human
uguggacacagcucu

SEQ ID NO: 1614536 - RNA, 20 nt, Human
ugugcgugcauguguguuca

SEQ ID NO: 1614537 - RNA, 23 nt, Human
ugugcgcuaaacuuuucugauag

SEQ ID NO: 1614538 - RNA, 22 nt, Human
ugugcgcuaaacuuuucugaua

SEQ ID NO: 1614539 - RNA, 19 nt, Human
ugugcgcuaaacuuuucug

SEQ ID NO: 1614540 - RNA, 17 nt, Human
ugugccucugggacugg

SEQ ID NO: 1614541 - RNA, 15 nt, Human
ugugccucugccugu

SEQ ID NO: 1614542 - RNA, 14 nt, Human
ugugcgcuaaacuu

SEQ ID NO: 1614543 - RNA, 22 nt, Human
ugugcuuauguaugagguacaa

SEQ ID NO: 1614544 - RNA, 16 nt, Human
ugugccucugggacug

SEQ ID NO: 1614545 - RNA, 15 nt, Human
ugugccucugggacu

SEQ ID NO: 1614546 - RNA, 13 nt, Human
ugugccucuggga

SEQ ID NO: 1614547 - RNA, 14 nt, Human
ugugccucugccug

SEQ ID NO: 1614548 - RNA, 22 nt, Human
ugugcacaugcacgugugugca

SEQ ID NO: 1614549 - RNA, 14 nt, Human
ugugcacguacaca

SEQ ID NO: 1614550 - RNA, 17 nt, Human
uugaagacagagcuaca

SEQ ID NO: 1614551 - RNA, 19 nt, Human
uugaagacuuuucuuucag

SEQ ID NO: 1614552 - RNA, 22 nt, Human
uugaacuuugaccucugcagca

SEQ ID NO: 1614553 - RNA, 16 nt, Human
uugaacugauaaagau

SEQ ID NO: 1614554 - RNA, 19 nt, Human
uugaacucuucaaucucuu

SEQ ID NO: 1614555 - RNA, 23 nt, Human
uugaaaagacuccaaagaaaugu

SEQ ID NO: 1614556 - RNA, 22 nt, Human
uugaaaagacuccaaagaaaug

SEQ ID NO: 1614557 - RNA, 18 nt, Human
uugaaaagacuccaaaga

SEQ ID NO: 1614558 - RNA, 23 nt, Human
uugaaacugagaugugaacacau

SEQ ID NO: 1614559 - RNA, 22 nt, Human
uugaaaacacuguucucugccc

SEQ ID NO: 1614560 - RNA, 21 nt, Human
uugaaacggaugauuucuaug

SEQ ID NO: 1614561 - RNA, 22 nt, Human
uugaaacggaugauuucuaugc

SEQ ID NO: 1614562 - RNA, 21 nt, Human
uugaaaacacuguucucugcc

SEQ ID NO: 1614563 - RNA, 19 nt, Human
uugaaaacacuguucucug

SEQ ID NO: 1614564 - RNA, 18 nt, Human
uucuuuauaauucuacuu

SEQ ID NO: 1614565 - RNA, 15 nt, Human
uucuuauuucauuuc

SEQ ID NO: 1614566 - RNA, 14 nt, Human
uucuucaacucccu

SEQ ID NO: 1614567 - RNA, 23 nt, Human
uucuuauuuaaugaaagacugua

SEQ ID NO: 1614568 - RNA, 19 nt, Human
uucuuauuuaaugaaagac

SEQ ID NO: 1614569 - RNA, 11 nt, Human
uucuguucuuu

SEQ ID NO: 1614570 - RNA, 23 nt, Human
uucuugguuuguaaauuaacuuu

SEQ ID NO: 1614571 - RNA, 17 nt, Human
uucuugguuuguaaauu

SEQ ID NO: 1614572 - RNA, 18 nt, Human
uucuugguuuguaaauua

SEQ ID NO: 1614573 - RNA, 13 nt, Human
uucuugguuugua

SEQ ID NO: 1614574 - RNA, 16 nt, Human
uucuugguuuguaaau

SEQ ID NO: 1614575 - RNA, 15 nt, Human
uucugagaaagacua

SEQ ID NO: 1614576 - RNA, 14 nt, Human
uucugagcauuuaa

SEQ ID NO: 1614577 - RNA, 21 nt, Human
uucuguccgagcuuugaaaau

SEQ ID NO: 1614578 - RNA, 17 nt, Human
uucuguccgagcuuuga

SEQ ID NO: 1614579 - RNA, 23 nt, Human
uucuguggguuucuaaagcugcc

SEQ ID NO: 1614580 - RNA, 16 nt, Human
uucuguggcucacaga

SEQ ID NO: 1614581 - RNA, 12 nt, Human
uucuguggcuca

SEQ ID NO: 1614582 - RNA, 17 nt, Human
uucuguccuacucugug

SEQ ID NO: 1614583 - RNA, 19 nt, Human
uucuguccuacucuguguc

SEQ ID NO: 1614584 - RNA, 18 nt, Human
uugcauagauucccugag

SEQ ID NO: 1614585 - RNA, 15 nt, Human
uugccacugccucuu

SEQ ID NO: 1614586 - RNA, 14 nt, Human
uugccacugccucu

SEQ ID NO: 1614587 - RNA, 14 nt, Human
uugcauagaauaaa

SEQ ID NO: 1614588 - RNA, 22 nt, Human
uugcagacaggcaagcaccucc

SEQ ID NO: 1614589 - RNA, 16 nt, Human
uugcagacaggcaagc

SEQ ID NO: 1614590 - RNA, 12 nt, Human
uugaugaagaag

SEQ ID NO: 1614591 - RNA, 23 nt, Human
uugauagcacagacccugcccug

SEQ ID NO: 1614592 - RNA, 21 nt, Human
uugauagcacagacccugccc

SEQ ID NO: 1614593 - RNA, 17 nt, Human
uugcaacaggcugggcu

SEQ ID NO: 1614594 - RNA, 14 nt, Human
uugcaacaggcugg

SEQ ID NO: 1614595 - RNA, 18 nt, Human
uugauuuccguuaaaaua

SEQ ID NO: 1614596 - RNA, 15 nt, Human
uugaggacacugaua

SEQ ID NO: 1614597 - RNA, 14 nt, Human
uugaggacacugau

SEQ ID NO: 1614598 - RNA, 20 nt, Human
uugauagcacagacccugcc

SEQ ID NO: 1614599 - RNA, 19 nt, Human
uugauagcacagacccugc

SEQ ID NO: 1614600 - RNA, 21 nt, Human
uugaccucaggugauccaccc

SEQ ID NO: 1614601 - RNA, 15 nt, Human
uugaccucaggugau

SEQ ID NO: 1614602 - RNA, 21 nt, Human
uugaccgugaggccagagaca

SEQ ID NO: 1614603 - RNA, 20 nt, Human
uugaccgugaggccagagac

SEQ ID NO: 1614604 - RNA, 19 nt, Human
uugaccugaggcccuucuc

SEQ ID NO: 1614605 - RNA, 12 nt, Human
uugaccugaggc

SEQ ID NO: 1614606 - RNA, 22 nt, Human
uugaccugaggcccuucucucc

SEQ ID NO: 1614607 - RNA, 22 nt, Human
uugacgccaucccagccccaau

SEQ ID NO: 1614608 - RNA, 15 nt, Human
uugacgccaucccag

SEQ ID NO: 1614609 - RNA, 14 nt, Human
uugacgccauccca

SEQ ID NO: 1614610 - RNA, 19 nt, Human
uuguaucacaaaucuuaac

SEQ ID NO: 1614611 - RNA, 15 nt, Human
uuguagagccagggu

SEQ ID NO: 1614612 - RNA, 14 nt, Human
uuguagagccaggg

SEQ ID NO: 1614613 - RNA, 14 nt, Human
uuguacauaaugcg

SEQ ID NO: 1614614 - RNA, 21 nt, Human
uuguauucucuccuguaccuc

SEQ ID NO: 1614615 - RNA, 14 nt, Human
uuguauucagaguu

SEQ ID NO: 1614616 - RNA, 18 nt, Human
uuguaaaugugcuuuuaa

SEQ ID NO: 1614617 - RNA, 14 nt, Human
uuguaaaugugcuu

SEQ ID NO: 1614618 - RNA, 11 nt, Human
uuguaaaugug

SEQ ID NO: 1614619 - RNA, 13 nt, Human
uuguacagacaac

SEQ ID NO: 1614620 - RNA, 12 nt, Human
uuguacagacaa

SEQ ID NO: 1614621 - RNA, 16 nt, Human
uuguaaaggaauuuaa

SEQ ID NO: 1614622 - RNA, 13 nt, Human
uugguccugcugc

SEQ ID NO: 1614623 - RNA, 12 nt, Human
uugguccugcug

SEQ ID NO: 1614624 - RNA, 22 nt, Human
uuggucccccuuccauggacuu

SEQ ID NO: 1614625 - RNA, 12 nt, Human
uugggaggcuga

SEQ ID NO: 1614626 - RNA, 16 nt, Human
uugggaggccauuugu

SEQ ID NO: 1614627 - RNA, 22 nt, Human
uuggcuuuggguugcaggaccu

SEQ ID NO: 1614628 - RNA, 15 nt, Human
uuggcuuuucugauc

SEQ ID NO: 1614629 - RNA, 22 nt, Human
uuggcuuuucugauccaguuuu

SEQ ID NO: 1614630 - RNA, 19 nt, Human
uuggcuuuucugauccagu

SEQ ID NO: 1614631 - RNA, 16 nt, Human
uuggguggaugccugg

SEQ ID NO: 1614632 - RNA, 14 nt, Human
uugguaaaccuuuu

SEQ ID NO: 1614633 - RNA, 12 nt, Human
uugguaaaccuu

SEQ ID NO: 1614634 - RNA, 22 nt, Human
uuggcugggggccucagugcca

SEQ ID NO: 1614635 - RNA, 21 nt, Human
uuggcugggggccucagugcc

SEQ ID NO: 1614636 - RNA, 18 nt, Human
uuggcugggggccucagu

SEQ ID NO: 1614637 - RNA, 24 nt, Human
uuggccaaagccaaagcuaggccu

SEQ ID NO: 1614638 - RNA, 14 nt, Human
uuggccaggcuggu

SEQ ID NO: 1614639 - RNA, 13 nt, Human
uuggcauucccca

SEQ ID NO: 1614640 - RNA, 17 nt, Human
uuggcaaaaaggcagga

SEQ ID NO: 1614641 - RNA, 14 nt, Human
uuggauuguccccg

SEQ ID NO: 1614642 - RNA, 19 nt, Human
uuggaaggaacguccccug

SEQ ID NO: 1614643 - RNA, 11 nt, Human
uuggaaggaac

SEQ ID NO: 1614644 - RNA, 21 nt, Human
uuggaccaaaaaccaguauug

SEQ ID NO: 1614645 - RNA, 20 nt, Human
uugcuggggccgaaagaaca

SEQ ID NO: 1614646 - RNA, 15 nt, Human
uuggaaaucuuuaaa

SEQ ID NO: 1614647 - RNA, 12 nt, Human
uuggaaaucuuu

SEQ ID NO: 1614648 - RNA, 11 nt, Human
uugcccaggca

SEQ ID NO: 1614649 - RNA, 23 nt, Human
uugcccacgcuggagugcaguga

SEQ ID NO: 1614650 - RNA, 18 nt, Human
uugccagucaccccggcc

SEQ ID NO: 1614651 - RNA, 18 nt, Human
uugccacugccucuuccu

SEQ ID NO: 1614652 - RNA, 14 nt, Human
uugccucugccucu

SEQ ID NO: 1614653 - RNA, 11 nt, Human
uugccucugcc

SEQ ID NO: 1614654 - RNA, 18 nt, Human
uugccucugccucugaca

SEQ ID NO: 1614655 - RNA, 16 nt, Human
uugccucugccucuga

SEQ ID NO: 1614656 - RNA, 22 nt, Human
uugcugauggugcaaugaccuu

SEQ ID NO: 1614657 - RNA, 20 nt, Human
uugcugauggugcaaugacc

SEQ ID NO: 1614658 - RNA, 11 nt, Human
uugcugccuca

SEQ ID NO: 1614659 - RNA, 15 nt, Human
uugcugccucaugcu

SEQ ID NO: 1614660 - RNA, 12 nt, Human
uugcugccucau

SEQ ID NO: 1614661 - RNA, 19 nt, Human
uuccacuuauaggaauuga

SEQ ID NO: 1614662 - RNA, 21 nt, Human
uuccacuuagaaauugcauuu

SEQ ID NO: 1614663 - RNA, 17 nt, Human
uuccaugaguccccugu

SEQ ID NO: 1614664 - RNA, 19 nt, Human
uuccaugucgccucugcau

SEQ ID NO: 1614665 - RNA, 18 nt, Human
uuccaugucgccucugca

SEQ ID NO: 1614666 - RNA, 17 nt, Human
uuccaugucgccucugc

SEQ ID NO: 1614667 - RNA, 14 nt, Human
uuccccaagacauu

SEQ ID NO: 1614668 - RNA, 21 nt, Human
uuccaugucgccucugcauuc

SEQ ID NO: 1614669 - RNA, 20 nt, Human
uuccaugucgccucugcauu

SEQ ID NO: 1614670 - RNA, 17 nt, Human
uucaucuugaauuguaa

SEQ ID NO: 1614671 - RNA, 12 nt, Human
uucaucuugaau

SEQ ID NO: 1614672 - RNA, 18 nt, Human
uucaugaaagauucaaug

SEQ ID NO: 1614673 - RNA, 11 nt, Human
uucaucuugaa

SEQ ID NO: 1614674 - RNA, 20 nt, Human
uucaucuuccaacucaaacu

SEQ ID NO: 1614675 - RNA, 19 nt, Human
uucauuuaggugaggaagc

SEQ ID NO: 1614676 - RNA, 13 nt, Human
uucaguggcagcu

SEQ ID NO: 1614677 - RNA, 21 nt, Human
uucagugccuuauggaacacu

SEQ ID NO: 1614678 - RNA, 19 nt, Human
uucagugccuuauggaaca

SEQ ID NO: 1614679 - RNA, 16 nt, Human
uucaggcucuucuccu

SEQ ID NO: 1614680 - RNA, 23 nt, Human
uucauaaugacuuaagcacacuu

SEQ ID NO: 1614681 - RNA, 13 nt, Human
uucauaaugacuu

SEQ ID NO: 1614682 - RNA, 15 nt, Human
uucaucuaggauuuu

SEQ ID NO: 1614683 - RNA, 21 nt, Human
uucagagcugcccucuccugg

SEQ ID NO: 1614684 - RNA, 19 nt, Human
uucagagacuccugcaggc

SEQ ID NO: 1614685 - RNA, 22 nt, Human
uucagagcugcccucuccuggg

SEQ ID NO: 1614686 - RNA, 23 nt, Human
uucagagcugcccucuccugggc

SEQ ID NO: 1614687 - RNA, 15 nt, Human
uucagagacuccugc

SEQ ID NO: 1614688 - RNA, 11 nt, Human
uucacugauuu

SEQ ID NO: 1614689 - RNA, 14 nt, Human
uucacucuccuugg

SEQ ID NO: 1614690 - RNA, 19 nt, Human
uucaggaagcucagggccu

SEQ ID NO: 1614691 - RNA, 17 nt, Human
uucaggaagcucagggc

SEQ ID NO: 1614692 - RNA, 20 nt, Human
uucaggaagcucagggccug

SEQ ID NO: 1614693 - RNA, 15 nt, Human
uucaggcucuucucc

SEQ ID NO: 1614694 - RNA, 17 nt, Human
uucagcugacuuuucug

SEQ ID NO: 1614695 - RNA, 18 nt, Human
uucagcugcauacaguuu

SEQ ID NO: 1614696 - RNA, 16 nt, Human
uucaggaagcucaggg

SEQ ID NO: 1614697 - RNA, 21 nt, Human
uucagcugguugagguuucaa

SEQ ID NO: 1614698 - RNA, 24 nt, Human
uucagcucugcaagaauugaagca

SEQ ID NO: 1614699 - RNA, 17 nt, Human
uucagcucugcaagaau

SEQ ID NO: 1614700 - RNA, 23 nt, Human
uucagcuccagcucaccagcccc

SEQ ID NO: 1614701 - RNA, 13 nt, Human
uucaaagauauuu

SEQ ID NO: 1614702 - RNA, 15 nt, Human
uucaaagcaaauguc

SEQ ID NO: 1614703 - RNA, 23 nt, Human
uucaaauuguaagcaugcacaaa

SEQ ID NO: 1614704 - RNA, 14 nt, Human
uuacgugaguccug

SEQ ID NO: 1614705 - RNA, 13 nt, Human
uuacgugaguccu

SEQ ID NO: 1614706 - RNA, 15 nt, Human
uuacuaaaauggacu

SEQ ID NO: 1614707 - RNA, 18 nt, Human
uuacuaaaauggacugug

SEQ ID NO: 1614708 - RNA, 17 nt, Human
uuacuaaaauggacugu

SEQ ID NO: 1614709 - RNA, 16 nt, Human
uuacuaaaauggacug

SEQ ID NO: 1614710 - RNA, 21 nt, Human
uucaacagguuuuccugaaga

SEQ ID NO: 1614711 - RNA, 13 nt, Human
uucaacgcagccc

SEQ ID NO: 1614712 - RNA, 20 nt, Human
uucaaccauuccccauggga

SEQ ID NO: 1614713 - RNA, 17 nt, Human
uucaaccauuccccaug

SEQ ID NO: 1614714 - RNA, 16 nt, Human
uucaaucccaggaugu

SEQ ID NO: 1614715 - RNA, 15 nt, Human
uucaacgcagcccug

SEQ ID NO: 1614716 - RNA, 14 nt, Human
uucaacgcagcccu

SEQ ID NO: 1614717 - RNA, 18 nt, Human
uucaauucucauuuguca

SEQ ID NO: 1614718 - RNA, 19 nt, Human
uucaaugccccugaauuua

SEQ ID NO: 1614719 - RNA, 17 nt, Human
uuccuuccucugagccu

SEQ ID NO: 1614720 - RNA, 13 nt, Human
uuccuuccucuga

SEQ ID NO: 1614721 - RNA, 19 nt, Human
uuccuucauucaacccacc

SEQ ID NO: 1614722 - RNA, 23 nt, Human
uuccuucagugccuuauggaaca

SEQ ID NO: 1614723 - RNA, 19 nt, Human
uuccuucagugccuuaugg

SEQ ID NO: 1614724 - RNA, 16 nt, Human
uuccuucagugccuua

SEQ ID NO: 1614725 - RNA, 11 nt, Human
uuccugcccug

SEQ ID NO: 1614726 - RNA, 22 nt, Human
uuccugcccugggaggcaguga

SEQ ID NO: 1614727 - RNA, 16 nt, Human
uuccugcccugggagg

SEQ ID NO: 1614728 - RNA, 13 nt, Human
uuccugcccuggg

SEQ ID NO: 1614729 - RNA, 19 nt, Human
uucggccuccauccugagg

SEQ ID NO: 1614730 - RNA, 18 nt, Human
uucggccuccauccugag

SEQ ID NO: 1614731 - RNA, 22 nt, Human
uucggccuccauccugaggcuc

SEQ ID NO: 1614732 - RNA, 19 nt, Human
uucuaaaggcuaccuuugu

SEQ ID NO: 1614733 - RNA, 17 nt, Human
uucuaaaggcuaccuuu

SEQ ID NO: 1614734 - RNA, 18 nt, Human
uucuaaaggcuaccuuug

SEQ ID NO: 1614735 - RNA, 16 nt, Human
uucuaaaggcuaccuu

SEQ ID NO: 1614736 - RNA, 12 nt, Human
uuccuagugaaa

SEQ ID NO: 1614737 - RNA, 20 nt, Human
uuccuagguauaauucacau

SEQ ID NO: 1614738 - RNA, 23 nt, Human
uuccucauaguaugguggcuggg

SEQ ID NO: 1614739 - RNA, 21 nt, Human
uuccucccucccucuuucccu

SEQ ID NO: 1614740 - RNA, 19 nt, Human
uuccucccucccucuuucc

SEQ ID NO: 1614741 - RNA, 12 nt, Human
uuccucccuccc

SEQ ID NO: 1614742 - RNA, 22 nt, Human
uuccucccucccucuuucccuc

SEQ ID NO: 1614743 - RNA, 22 nt, Human
uuccccacuugagaauuacccu

SEQ ID NO: 1614744 - RNA, 19 nt, Human
uucccuuugacgccauccc

SEQ ID NO: 1614745 - RNA, 23 nt, Human
uucucuccucuccccaugauguu

SEQ ID NO: 1614746 - RNA, 18 nt, Human
uucucuccagccccugga

SEQ ID NO: 1614747 - RNA, 13 nt, Human
uucuccacccugc

SEQ ID NO: 1614748 - RNA, 16 nt, Human
uucuccaagcaggaca

SEQ ID NO: 1614749 - RNA, 11 nt, Human
uucuccaggcu

SEQ ID NO: 1614750 - RNA, 16 nt, Human
uucuccacccugcucu

SEQ ID NO: 1614751 - RNA, 20 nt, Human
uucugacccaugcugcccug

SEQ ID NO: 1614752 - RNA, 18 nt, Human
uucugacccaugcugccc

SEQ ID NO: 1614753 - RNA, 21 nt, Human
uucugacccaugcugcccugu

SEQ ID NO: 1614754 - RNA, 17 nt, Human
uucucugauacagaaaa

SEQ ID NO: 1614755 - RNA, 16 nt, Human
uucucugauacagaaa

SEQ ID NO: 1614756 - RNA, 15 nt, Human
uucucugauacagaa

SEQ ID NO: 1614757 - RNA, 14 nt, Human
uucucugauacaga

SEQ ID NO: 1614758 - RNA, 16 nt, Human
uucuaugacacaugca

SEQ ID NO: 1614759 - RNA, 17 nt, Human
uucuaugacacaugcaa

SEQ ID NO: 1614760 - RNA, 21 nt, Human
uucuauauuuucauucuccua

SEQ ID NO: 1614761 - RNA, 18 nt, Human
uucuauauuuucauucuc

SEQ ID NO: 1614762 - RNA, 16 nt, Human
uucuauauuuucauuc

SEQ ID NO: 1614763 - RNA, 15 nt, Human
uucuauauuuucauu

SEQ ID NO: 1614764 - RNA, 14 nt, Human
uucuauauuuucau

SEQ ID NO: 1614765 - RNA, 11 nt, Human
uucuauauuuu

SEQ ID NO: 1614766 - RNA, 17 nt, Human
uucuaugcugaguuugu

SEQ ID NO: 1614767 - RNA, 14 nt, Human
uucuauuguuucuu

SEQ ID NO: 1614768 - RNA, 12 nt, Human
uucucaugccuc

SEQ ID NO: 1614769 - RNA, 11 nt, Human
uucucaugccu

SEQ ID NO: 1614770 - RNA, 21 nt, Human
uucucaugccucagccuccug

SEQ ID NO: 1614771 - RNA, 14 nt, Human
uucucaugccucag

SEQ ID NO: 1614772 - RNA, 22 nt, Human
uuuacauggcuggagcuagaau

SEQ ID NO: 1614773 - RNA, 15 nt, Human
uuuacuuuguguuca

SEQ ID NO: 1614774 - RNA, 12 nt, Human
uuuagaaacaca

SEQ ID NO: 1614775 - RNA, 20 nt, Human
uuuagaaacacaacuauauu

SEQ ID NO: 1614776 - RNA, 20 nt, Human
uuguauuuuacuaauaaaau

SEQ ID NO: 1614777 - RNA, 15 nt, Human
uuguauuuauuuagu

SEQ ID NO: 1614778 - RNA, 17 nt, Human
uuuacauggcuggagcu

SEQ ID NO: 1614779 - RNA, 22 nt, Human
uuuauuguuuaaaaucauuucu

SEQ ID NO: 1614780 - RNA, 16 nt, Human
uuuauugucaaagugg

SEQ ID NO: 1614781 - RNA, 14 nt, Human
uuuauugucaaagu

SEQ ID NO: 1614782 - RNA, 21 nt, Human
uuuauuggcuuuucugaucca

SEQ ID NO: 1614783 - RNA, 17 nt, Human
uuuauuggcuuuucuga

SEQ ID NO: 1614784 - RNA, 14 nt, Human
uuuaugcauauuau

SEQ ID NO: 1614785 - RNA, 14 nt, Human
uuuauaaacuuuac

SEQ ID NO: 1614786 - RNA, 16 nt, Human
uuuaucgucacugcuu

SEQ ID NO: 1614787 - RNA, 16 nt, Human
uuuauaaacuuuaccu

SEQ ID NO: 1614788 - RNA, 21 nt, Human
uuuaucgucacugcuuaacuu

SEQ ID NO: 1614789 - RNA, 18 nt, Human
uuuauaaacuuuaccuuu

SEQ ID NO: 1614790 - RNA, 13 nt, Human
uuuaugauccagc

SEQ ID NO: 1614791 - RNA, 12 nt, Human
uuuccaaaguac

SEQ ID NO: 1614792 - RNA, 15 nt, Human
uuuccaaaguacacu

SEQ ID NO: 1614793 - RNA, 13 nt, Human
uuuccaggaaggc

SEQ ID NO: 1614794 - RNA, 22 nt, Human
uuucauugcugggcuugucugu

SEQ ID NO: 1614795 - RNA, 16 nt, Human
uuucagccaagaauuc

SEQ ID NO: 1614796 - RNA, 15 nt, Human
uuucagccaagaauu

SEQ ID NO: 1614797 - RNA, 21 nt, Human
uuucagauaaucacaauacau

SEQ ID NO: 1614798 - RNA, 15 nt, Human
uuucagcagcugcag

SEQ ID NO: 1614799 - RNA, 15 nt, Human
uuucagauaaucaca

SEQ ID NO: 1614800 - RNA, 22 nt, Human
uuucaauaggaaaaacugauuu

SEQ ID NO: 1614801 - RNA, 20 nt, Human
uuucaauaggaaaaacugau

SEQ ID NO: 1614802 - RNA, 13 nt, Human
uuuauuuccagug

SEQ ID NO: 1614803 - RNA, 22 nt, Human
uuuccucaaaacuucagacaua

SEQ ID NO: 1614804 - RNA, 21 nt, Human
uuuccucuuuggucuacacug

SEQ ID NO: 1614805 - RNA, 23 nt, Human
uuuccugacagaaggacucaggu

SEQ ID NO: 1614806 - RNA, 17 nt, Human
uuucuaaagcugccagc

SEQ ID NO: 1614807 - RNA, 14 nt, Human
uuucuaaagcugcc

SEQ ID NO: 1614808 - RNA, 14 nt, Human
uuucuaaaggcuac

SEQ ID NO: 1614809 - RNA, 18 nt, Human
uuucuaaaggcuaccuuu

SEQ ID NO: 1614810 - RNA, 22 nt, Human
uuucugagaaagacuauucaaa

SEQ ID NO: 1614811 - RNA, 14 nt, Human
uuucucuuucguua

SEQ ID NO: 1614812 - RNA, 15 nt, Human
uuucuagccagagga

SEQ ID NO: 1614813 - RNA, 15 nt, Human
uuucuaaugugugaa

SEQ ID NO: 1614814 - RNA, 16 nt, Human
uuucuaggacugaauu

SEQ ID NO: 1614815 - RNA, 19 nt, Human
uuuuccaugaguccccugu

SEQ ID NO: 1614816 - RNA, 18 nt, Human
uuuuccaugaguccccug

SEQ ID NO: 1614817 - RNA, 13 nt, Human
uuuuccugaaaac

SEQ ID NO: 1614818 - RNA, 17 nt, Human
uuuucuugcaugaggcu

SEQ ID NO: 1614819 - RNA, 15 nt, Human
uuuuccuucagugcc

SEQ ID NO: 1614820 - RNA, 20 nt, Human
uuuucacugcuggcugccuu

SEQ ID NO: 1614821 - RNA, 19 nt, Human
uuuucacugcuggcugccu

SEQ ID NO: 1614822 - RNA, 15 nt, Human
uuuucacaguucucu

SEQ ID NO: 1614823 - RNA, 13 nt, Human
uuuuaugauccag

SEQ ID NO: 1614824 - RNA, 15 nt, Human
uuuuaugauccagca

SEQ ID NO: 1614825 - RNA, 22 nt, Human
uuuucaacgcagcccugcuuug

SEQ ID NO: 1614826 - RNA, 21 nt, Human
uuuucaacgcagcccugcuuu

SEQ ID NO: 1614827 - RNA, 17 nt, Human
uuuucaacgcagcccug

SEQ ID NO: 1614828 - RNA, 10 nt, Human
uuuuauauuu

SEQ ID NO: 1614829 - RNA, 19 nt, Human
uuuuaucgucacugcuuaa

SEQ ID NO: 1614830 - RNA, 18 nt, Human
uuuuaucgucacugcuua

SEQ ID NO: 1614831 - RNA, 20 nt, Human
uuuuaugauacuugaaaauu

SEQ ID NO: 1614832 - RNA, 16 nt, Human
uuuuaugauacuugaa

SEQ ID NO: 1614833 - RNA, 20 nt, Human
uuuuauaucaauuuaaaaaa

SEQ ID NO: 1614834 - RNA, 20 nt, Human
uuuuauaugcuucuguuuua

SEQ ID NO: 1614835 - RNA, 15 nt, Human
uuuuauaugcuucug

SEQ ID NO: 1614836 - RNA, 14 nt, Human
uuuuacuguacaga

SEQ ID NO: 1614837 - RNA, 21 nt, Human
uuuuaauuugguuuucacauu

SEQ ID NO: 1614838 - RNA, 17 nt, Human
uuuuaauuugguuuuca

SEQ ID NO: 1614839 - RNA, 22 nt, Human
uuuuacauaaauuuaguauuuu

SEQ ID NO: 1614840 - RNA, 16 nt, Human
uuuuacagcugccugc

SEQ ID NO: 1614841 - RNA, 22 nt, Human
uuuuaaaaugagaaaucuaaaa

SEQ ID NO: 1614842 - RNA, 15 nt, Human
uuuuaaaaugagaaa

SEQ ID NO: 1614843 - RNA, 19 nt, Human
uuuguuguuuguuuagucu

SEQ ID NO: 1614844 - RNA, 14 nt, Human
uuuguuguuuguuu

SEQ ID NO: 1614845 - RNA, 12 nt, Human
uuuguuguuugu

SEQ ID NO: 1614846 - RNA, 21 nt, Human
uuuguccccaccgcagacagg

SEQ ID NO: 1614847 - RNA, 13 nt, Human
uuuguccccaccg

SEQ ID NO: 1614848 - RNA, 12 nt, Human
uuuguguuagag

SEQ ID NO: 1614849 - RNA, 21 nt, Human
uuuguauaaaauaauuuuuau

SEQ ID NO: 1614850 - RNA, 22 nt, Human
uuuguaaauuaacuuuuauaaa

SEQ ID NO: 1614851 - RNA, 11 nt, Human
uuuguauagaa

SEQ ID NO: 1614852 - RNA, 15 nt, Human
uuuguaaauuaacuu

SEQ ID NO: 1614853 - RNA, 16 nt, Human
uuuguaaauuaacuuu

SEQ ID NO: 1614854 - RNA, 17 nt, Human
uuuguaaauuaacuuuu

SEQ ID NO: 1614855 - RNA, 18 nt, Human
uuugccauguuggccagg

SEQ ID NO: 1614856 - RNA, 22 nt, Human
uuugccauguuggccaggcugg

SEQ ID NO: 1614857 - RNA, 16 nt, Human
uuuggaaaucuuuaaa

SEQ ID NO: 1614858 - RNA, 21 nt, Human
uuugcauagauucccugagca

SEQ ID NO: 1614859 - RNA, 16 nt, Human
uuugccagugggaacu

SEQ ID NO: 1614860 - RNA, 15 nt, Human
uuugccagugggaac

SEQ ID NO: 1614861 - RNA, 14 nt, Human
uuugcagacaggca

SEQ ID NO: 1614862 - RNA, 23 nt, Human
uuugcauaacguauaaaagccug

SEQ ID NO: 1614863 - RNA, 19 nt, Human
uuugcauaacguauaaaag

SEQ ID NO: 1614864 - RNA, 17 nt, Human
uuugaggucuguucuuu

SEQ ID NO: 1614865 - RNA, 22 nt, Human
uuugaggucuguucuuuccaaa

SEQ ID NO: 1614866 - RNA, 14 nt, Human
uuugagcucagccc

SEQ ID NO: 1614867 - RNA, 13 nt, Human
uuugagugccuua

SEQ ID NO: 1614868 - RNA, 15 nt, Human
uuugagcagggcuca

SEQ ID NO: 1614869 - RNA, 22 nt, Human
uuucuuacugucuuuuuucuaa

SEQ ID NO: 1614870 - RNA, 12 nt, Human
uuuuuucugaaa

SEQ ID NO: 1614871 - RNA, 20 nt, Human
uuuuuuauacaggaugauga

SEQ ID NO: 1614872 - RNA, 12 nt, Human
uuuuuuacuaau

SEQ ID NO: 1614873 - RNA, 13 nt, Human
uuuugaaaaacug

SEQ ID NO: 1614874 - RNA, 13 nt, Human
uuuuuucuuacug

SEQ ID NO: 1614875 - RNA, 17 nt, Human
auguguaagacaaaaag

SEQ ID NO: 1614876 - RNA, 19 nt, Human
auguguaagacaaaaagcu

SEQ ID NO: 1614877 - RNA, 16 nt, Human
auguuccuagugaaag

SEQ ID NO: 1614878 - RNA, 15 nt, Human
auguuccuagugaaa

SEQ ID NO: 1614879 - RNA, 13 nt, Human
auguguaaguauu

SEQ ID NO: 1614880 - RNA, 17 nt, Human
auguuccuagugaaaga

SEQ ID NO: 1614881 - RNA, 13 nt, Human
auguucucugagg

SEQ ID NO: 1614882 - RNA, 17 nt, Human
auguucucucuucucca

SEQ ID NO: 1614883 - RNA, 14 nt, Human
auguucugggacac

SEQ ID NO: 1614884 - RNA, 17 nt, Human
auguucucugaggacac

SEQ ID NO: 1614885 - RNA, 15 nt, Human
auguucugggacaca

SEQ ID NO: 1614886 - RNA, 17 nt, Human
auguuugccucugccuc

SEQ ID NO: 1614887 - RNA, 15 nt, Human
auguuugccucugcc

SEQ ID NO: 1614888 - RNA, 14 nt, Human
auguucuuaauucu

SEQ ID NO: 1614889 - RNA, 21 nt, Human
augucaaucagccuaguugau

SEQ ID NO: 1614890 - RNA, 13 nt, Human
augucacaggcag

SEQ ID NO: 1614891 - RNA, 19 nt, Human
augguccgugcuaaggacu

SEQ ID NO: 1614892 - RNA, 18 nt, Human
augguccgugcuaaggac

SEQ ID NO: 1614893 - RNA, 15 nt, Human
augguccgugcuaag

SEQ ID NO: 1614894 - RNA, 15 nt, Human
augugaacacaucag

SEQ ID NO: 1614895 - RNA, 18 nt, Human
augugaaaucauucauuu

SEQ ID NO: 1614896 - RNA, 17 nt, Human
augugaaaucauucauu

SEQ ID NO: 1614897 - RNA, 19 nt, Human
augucacaggcagguccag

SEQ ID NO: 1614898 - RNA, 14 nt, Human
augucacaggcagg

SEQ ID NO: 1614899 - RNA, 14 nt, Human
augugaaacauguu

SEQ ID NO: 1614900 - RNA, 23 nt, Human
augggugcuuggaggaaggaaac

SEQ ID NO: 1614901 - RNA, 21 nt, Human
augggugcuuggaggaaggaa

SEQ ID NO: 1614902 - RNA, 16 nt, Human
augaucuuuaaaauac

SEQ ID NO: 1614903 - RNA, 17 nt, Human
augaucuuugcagacag

SEQ ID NO: 1614904 - RNA, 21 nt, Human
augaucuuugcagacaggcaa

SEQ ID NO: 1614905 - RNA, 19 nt, Human
augaucuuugcagacaggc

SEQ ID NO: 1614906 - RNA, 18 nt, Human
augaucuuugcagacagg

SEQ ID NO: 1614907 - RNA, 21 nt, Human
augaugaucuuuaaaauacac

SEQ ID NO: 1614908 - RNA, 18 nt, Human
augaugaucuuuaaaaua

SEQ ID NO: 1614909 - RNA, 15 nt, Human
augaugauccuaggc

SEQ ID NO: 1614910 - RNA, 18 nt, Human
augaugaaaugaggucag

SEQ ID NO: 1614911 - RNA, 23 nt, Human
augaugaaaugaggucagagccu

SEQ ID NO: 1614912 - RNA, 18 nt, Human
augcacaaacagaggccg

SEQ ID NO: 1614913 - RNA, 22 nt, Human
augcacaaauucugucucugga

SEQ ID NO: 1614914 - RNA, 15 nt, Human
augcacaaauucugu

SEQ ID NO: 1614915 - RNA, 23 nt, Human
augcacaaauucugucucuggau

SEQ ID NO: 1614916 - RNA, 13 nt, Human
augcacacauuuu

SEQ ID NO: 1614917 - RNA, 14 nt, Human
augcacacauuuuu

SEQ ID NO: 1614918 - RNA, 15 nt, Human
augcacacauuuuuu

SEQ ID NO: 1614919 - RNA, 19 nt, Human
augcacagaguuguuacau

SEQ ID NO: 1614920 - RNA, 21 nt, Human
augcacagaguuguuacauuu

SEQ ID NO: 1614921 - RNA, 22 nt, Human
augcacagaguuguuacauuuu

SEQ ID NO: 1614922 - RNA, 23 nt, Human
augcacagaguuguuacauuuuu

SEQ ID NO: 1614923 - RNA, 20 nt, Human
augccuggauggggcugcac

SEQ ID NO: 1614924 - RNA, 19 nt, Human
augccuggauggggcugca

SEQ ID NO: 1614925 - RNA, 15 nt, Human
augcugcccugugag

SEQ ID NO: 1614926 - RNA, 14 nt, Human
augcugcccuguga

SEQ ID NO: 1614927 - RNA, 13 nt, Human
augcugcccugug

SEQ ID NO: 1614928 - RNA, 16 nt, Human
augcugcccugugagu

SEQ ID NO: 1614929 - RNA, 15 nt, Human
augcugccuccagaa

SEQ ID NO: 1614930 - RNA, 12 nt, Human
augcugccucca

SEQ ID NO: 1614931 - RNA, 20 nt, Human
augcugaguuugugcuggug

SEQ ID NO: 1614932 - RNA, 19 nt, Human
augcugacuguacuccucc

SEQ ID NO: 1614933 - RNA, 21 nt, Human
augcugacuguacuccuccca

SEQ ID NO: 1614934 - RNA, 20 nt, Human
augcugacuguacuccuccc

SEQ ID NO: 1614935 - RNA, 16 nt, Human
auggcuuuugugcauu

SEQ ID NO: 1614936 - RNA, 17 nt, Human
auggcuuuugugcauua

SEQ ID NO: 1614937 - RNA, 18 nt, Human
auggcuuuugugcauuau

SEQ ID NO: 1614938 - RNA, 19 nt, Human
auggcuuuguauagaaccu

SEQ ID NO: 1614939 - RNA, 16 nt, Human
augcuuguacauaaug

SEQ ID NO: 1614940 - RNA, 15 nt, Human
augcuuguacauaau

SEQ ID NO: 1614941 - RNA, 18 nt, Human
augcuuuaggauguacag

SEQ ID NO: 1614942 - RNA, 21 nt, Human
augcuuuaggauguacaguua

SEQ ID NO: 1614943 - RNA, 17 nt, Human
auggauaggcacaggaa

SEQ ID NO: 1614944 - RNA, 18 nt, Human
auggauaggcacaggaaa

SEQ ID NO: 1614945 - RNA, 18 nt, Human
auggcugugccucugccu

SEQ ID NO: 1614946 - RNA, 17 nt, Human
auggcugugccucugcc

SEQ ID NO: 1614947 - RNA, 16 nt, Human
auggcugugccucugc

SEQ ID NO: 1614948 - RNA, 15 nt, Human
auggcugugccucug

SEQ ID NO: 1614949 - RNA, 20 nt, Human
aucuccgucaacucauauuu

SEQ ID NO: 1614950 - RNA, 17 nt, Human
aucuggguucacugcaa

SEQ ID NO: 1614951 - RNA, 18 nt, Human
aucugggggccucuucug

SEQ ID NO: 1614952 - RNA, 16 nt, Human
aucucugcuuuggaaa

SEQ ID NO: 1614953 - RNA, 21 nt, Human
augaaguacucauacauguua

SEQ ID NO: 1614954 - RNA, 23 nt, Human
augaaguccaagcauuuagaugu

SEQ ID NO: 1614955 - RNA, 20 nt, Human
augaaguccaagcauuuaga

SEQ ID NO: 1614956 - RNA, 15 nt, Human
augaccacacuccag

SEQ ID NO: 1614957 - RNA, 18 nt, Human
augaccacacuccagcug

SEQ ID NO: 1614958 - RNA, 13 nt, Human
augaggcauuugu

SEQ ID NO: 1614959 - RNA, 14 nt, Human
augaggcauuuguu

SEQ ID NO: 1614960 - RNA, 21 nt, Human
augaggcauuuguuugaacug

SEQ ID NO: 1614961 - RNA, 22 nt, Human
augaggcauuuguuugaacuga

SEQ ID NO: 1614962 - RNA, 16 nt, Human
augaaaacacauuuuu

SEQ ID NO: 1614963 - RNA, 14 nt, Human
augaaaacacauuu

SEQ ID NO: 1614964 - RNA, 15 nt, Human
augaaaacacauuuu

SEQ ID NO: 1614965 - RNA, 17 nt, Human
aucaugaauuaguuuua

SEQ ID NO: 1614966 - RNA, 14 nt, Human
aucaugucuggcua

SEQ ID NO: 1614967 - RNA, 12 nt, Human
aucaugugaaau

SEQ ID NO: 1614968 - RNA, 14 nt, Human
aucaugugaaauca

SEQ ID NO: 1614969 - RNA, 22 nt, Human
aucagcuugcccuguuaaaaga

SEQ ID NO: 1614970 - RNA, 13 nt, Human
aucagcuuauugu

SEQ ID NO: 1614971 - RNA, 14 nt, Human
aucaaauaugcaaa

SEQ ID NO: 1614972 - RNA, 22 nt, Human
aucaaauauauucagccuggcu

SEQ ID NO: 1614973 - RNA, 13 nt, Human
aucacagccucug

SEQ ID NO: 1614974 - RNA, 13 nt, Human
aucaccagacagg

SEQ ID NO: 1614975 - RNA, 23 nt, Human
aucacccgcuaagagggagggag

SEQ ID NO: 1614976 - RNA, 23 nt, Human
aucaaagagguuuuaaaaaaauc

SEQ ID NO: 1614977 - RNA, 20 nt, Human
aucaaagagguuuuaaaaaa

SEQ ID NO: 1614978 - RNA, 14 nt, Human
aucaaauauauuca

SEQ ID NO: 1614979 - RNA, 19 nt, Human
auccucaguuuuugugaaa

SEQ ID NO: 1614980 - RNA, 15 nt, Human
aucccggcugcccuu

SEQ ID NO: 1614981 - RNA, 19 nt, Human
aucccaugagccucagcau

SEQ ID NO: 1614982 - RNA, 18 nt, Human
auccccaagccuggcaag

SEQ ID NO: 1614983 - RNA, 20 nt, Human
aucccauuauucaaaguugc

SEQ ID NO: 1614984 - RNA, 15 nt, Human
aucccauuauucaaa

SEQ ID NO: 1614985 - RNA, 14 nt, Human
aucccauuauucaa

SEQ ID NO: 1614986 - RNA, 19 nt, Human
auccagacccggcugcgug

SEQ ID NO: 1614987 - RNA, 13 nt, Human
auccacucgccuu

SEQ ID NO: 1614988 - RNA, 17 nt, Human
auccucauacccacccc

SEQ ID NO: 1614989 - RNA, 13 nt, Human
auauuauguuaaa

SEQ ID NO: 1614990 - RNA, 20 nt, Human
auaugcucugcauguuacau

SEQ ID NO: 1614991 - RNA, 17 nt, Human
auaugcucugcauguua

SEQ ID NO: 1614992 - RNA, 16 nt, Human
auaugcucugcauguu

SEQ ID NO: 1614993 - RNA, 16 nt, Human
auauuauguuaaaacu

SEQ ID NO: 1614994 - RNA, 14 nt, Human
auauuauguuaaaa

SEQ ID NO: 1614995 - RNA, 22 nt, Human
auauuauuuuauguugcauaga

SEQ ID NO: 1614996 - RNA, 15 nt, Human
auauuauuuuauguu

SEQ ID NO: 1614997 - RNA, 19 nt, Human
auauucaggaagcucaggg

SEQ ID NO: 1614998 - RNA, 18 nt, Human
auauauuuuuuucugaaa

SEQ ID NO: 1614999 - RNA, 19 nt, Human
auauauuuuuauauuuacu

SEQ ID NO: 1615000 - RNA, 18 nt, Human
auauauuuuuauauuuac

SEQ ID NO: 1615001 - RNA, 20 nt, Human
auauauuuuuauauuuacua

SEQ ID NO: 1615002 - RNA, 15 nt, Human
auagcagcuuauuca

SEQ ID NO: 1615003 - RNA, 18 nt, Human
auagcagcuuauucacaa

SEQ ID NO: 1615004 - RNA, 18 nt, Human
auagcacagacccugccc

SEQ ID NO: 1615005 - RNA, 17 nt, Human
auagcacagacccugcc

SEQ ID NO: 1615006 - RNA, 17 nt, Human
auagccuaggugacaga

SEQ ID NO: 1615007 - RNA, 15 nt, Human
auagccuaggugaca

SEQ ID NO: 1615008 - RNA, 24 nt, Human
auagguuuggacaaaauggaauac

SEQ ID NO: 1615009 - RNA, 14 nt, Human
auaguaaaaauaaa

SEQ ID NO: 1615010 - RNA, 13 nt, Human
auaguaaaaauaa

SEQ ID NO: 1615011 - RNA, 13 nt, Human
auacagaaaaguu

SEQ ID NO: 1615012 - RNA, 17 nt, Human
auacccacccccaccca

SEQ ID NO: 1615013 - RNA, 19 nt, Human
auacccccugcaaagccca

SEQ ID NO: 1615014 - RNA, 17 nt, Human
auacccccugcaaagcc

SEQ ID NO: 1615015 - RNA, 16 nt, Human
auacccacccccaccc

SEQ ID NO: 1615016 - RNA, 14 nt, Human
auacccacccccac

SEQ ID NO: 1615017 - RNA, 13 nt, Human
auacccaccccca

SEQ ID NO: 1615018 - RNA, 18 nt, Human
auaauguuucaaacauau

SEQ ID NO: 1615019 - RNA, 22 nt, Human
auacacuuacacuuuaugcaca

SEQ ID NO: 1615020 - RNA, 13 nt, Human
auacacuuacacu

SEQ ID NO: 1615021 - RNA, 14 nt, Human
auacaaugcugugc

SEQ ID NO: 1615022 - RNA, 17 nt, Human
auacaaugcugugcccu

SEQ ID NO: 1615023 - RNA, 17 nt, Human
auaccugucccccugac

SEQ ID NO: 1615024 - RNA, 20 nt, Human
auacccccugcaaagcccag

SEQ ID NO: 1615025 - RNA, 16 nt, Human
auaccugucccccuga

SEQ ID NO: 1615026 - RNA, 15 nt, Human
auaccugucccccug

SEQ ID NO: 1615027 - RNA, 14 nt, Human
auaccugucccccu

SEQ ID NO: 1615028 - RNA, 21 nt, Human
auacccccugcaaagcccagc

SEQ ID NO: 1615029 - RNA, 22 nt, Human
auaagccagacaucaacagaua

SEQ ID NO: 1615030 - RNA, 21 nt, Human
auaagccagacaucaacagau

SEQ ID NO: 1615031 - RNA, 13 nt, Human
auaauguuucaaa

SEQ ID NO: 1615032 - RNA, 14 nt, Human
auaauguaagcucu

SEQ ID NO: 1615033 - RNA, 15 nt, Human
auaauguaaauaaag

SEQ ID NO: 1615034 - RNA, 18 nt, Human
auaaggguaucuggugac

SEQ ID NO: 1615035 - RNA, 13 nt, Human
auaauggucagag

SEQ ID NO: 1615036 - RNA, 23 nt, Human
aguuugauuaaauucuugcaaag

SEQ ID NO: 1615037 - RNA, 19 nt, Human
aguuugagaucagccuggg

SEQ ID NO: 1615038 - RNA, 18 nt, Human
aguuugagaucagccugg

SEQ ID NO: 1615039 - RNA, 20 nt, Human
aguuugagaucagccugggc

SEQ ID NO: 1615040 - RNA, 17 nt, Human
aguuugauuaaauucuu

SEQ ID NO: 1615041 - RNA, 18 nt, Human
aguuugauuaaauucuug

SEQ ID NO: 1615042 - RNA, 20 nt, Human
aguuugauuaaauucuugca

SEQ ID NO: 1615043 - RNA, 22 nt, Human
aguuugauuaaauucuugcaaa

SEQ ID NO: 1615044 - RNA, 20 nt, Human
aguuguuacauuuuuaagug

SEQ ID NO: 1615045 - RNA, 22 nt, Human
aguuguuacauuuuuaagugcu

SEQ ID NO: 1615046 - RNA, 21 nt, Human
auaacaaugcuguauuuuaaa

SEQ ID NO: 1615047 - RNA, 20 nt, Human
auaacaaugcuguauuuuaa

SEQ ID NO: 1615048 - RNA, 19 nt, Human
auaacaaugcuguauuuua

SEQ ID NO: 1615049 - RNA, 17 nt, Human
auaacaaugcuguauuu

SEQ ID NO: 1615050 - RNA, 15 nt, Human
auaacaaugcuguau

SEQ ID NO: 1615051 - RNA, 14 nt, Human
auaacaaugaaagu

SEQ ID NO: 1615052 - RNA, 20 nt, Human
auaacauguaauuaaguacu

SEQ ID NO: 1615053 - RNA, 18 nt, Human
auaacauguaauuaagua

SEQ ID NO: 1615054 - RNA, 13 nt, Human
auaacauguaauu

SEQ ID NO: 1615055 - RNA, 12 nt, Human
auaacauguaau

SEQ ID NO: 1615056 - RNA, 17 nt, Human
agugaccucagcuuuga

SEQ ID NO: 1615057 - RNA, 18 nt, Human
agugaccucagcuuugau

SEQ ID NO: 1615058 - RNA, 11 nt, Human
aguccaagcau

SEQ ID NO: 1615059 - RNA, 19 nt, Human
aguccucuuuucugagagg

SEQ ID NO: 1615060 - RNA, 20 nt, Human
aguccuuaccagcagagcac

SEQ ID NO: 1615061 - RNA, 22 nt, Human
aguccucuuuucugagaggacu

SEQ ID NO: 1615062 - RNA, 19 nt, Human
agucaugcguuuaaucaca

SEQ ID NO: 1615063 - RNA, 17 nt, Human
aguauuuuguuucagug

SEQ ID NO: 1615064 - RNA, 23 nt, Human
aguaugaggcauuuguuugaacu

SEQ ID NO: 1615065 - RNA, 14 nt, Human
aguauuuuguuuca

SEQ ID NO: 1615066 - RNA, 15 nt, Human
aguaucucagggccu

SEQ ID NO: 1615067 - RNA, 20 nt, Human
aguaugaggcauuuguuuga

SEQ ID NO: 1615068 - RNA, 21 nt, Human
aguaugaggcauuuguuugaa

SEQ ID NO: 1615069 - RNA, 22 nt, Human
agucacacaguauuacuucugc

SEQ ID NO: 1615070 - RNA, 23 nt, Human
agucacacaguauuacuucugcu

SEQ ID NO: 1615071 - RNA, 18 nt, Human
aguaaaugggggugcauu

SEQ ID NO: 1615072 - RNA, 13 nt, Human
aggucuguucuuu

SEQ ID NO: 1615073 - RNA, 15 nt, Human
aggucuguucuuucc

SEQ ID NO: 1615074 - RNA, 16 nt, Human
aggucuguucuuucca

SEQ ID NO: 1615075 - RNA, 15 nt, Human
aguacguugugcauu

SEQ ID NO: 1615076 - RNA, 14 nt, Human
aguacguugugcau

SEQ ID NO: 1615077 - RNA, 13 nt, Human
aguacucauacau

SEQ ID NO: 1615078 - RNA, 14 nt, Human
aguacuauguauca

SEQ ID NO: 1615079 - RNA, 12 nt, Human
aguacuauguau

SEQ ID NO: 1615080 - RNA, 12 nt, Human
aguacuucuuuu

SEQ ID NO: 1615081 - RNA, 19 nt, Human
aguacuucuccacccugcu

SEQ ID NO: 1615082 - RNA, 17 nt, Human
aguacuucuccacccug

SEQ ID NO: 1615083 - RNA, 16 nt, Human
aguacguugugcauuu

SEQ ID NO: 1615084 - RNA, 17 nt, Human
aguacguugugcauuug

SEQ ID NO: 1615085 - RNA, 18 nt, Human
aguacguugugcauuugg

SEQ ID NO: 1615086 - RNA, 22 nt, Human
aguacuacaguccucccaucuc

SEQ ID NO: 1615087 - RNA, 19 nt, Human
aguacuacaguccucccau

SEQ ID NO: 1615088 - RNA, 14 nt, Human
aguacuauaauuua

SEQ ID NO: 1615089 - RNA, 20 nt, Human
aguaagccgugauuuucauu

SEQ ID NO: 1615090 - RNA, 19 nt, Human
agugucaaugcagccccca

SEQ ID NO: 1615091 - RNA, 22 nt, Human
agugggcccaaugcacuuuguu

SEQ ID NO: 1615092 - RNA, 21 nt, Human
agugggacagggcauggccag

SEQ ID NO: 1615093 - RNA, 19 nt, Human
agugggacagggcauggcc

SEQ ID NO: 1615094 - RNA, 24 nt, Human
agugauccucccaccucagccucc

SEQ ID NO: 1615095 - RNA, 19 nt, Human
agugauccucccaccucag

SEQ ID NO: 1615096 - RNA, 18 nt, Human
agugauccucccaccuca

SEQ ID NO: 1615097 - RNA, 15 nt, Human
agugauccucccacc

SEQ ID NO: 1615098 - RNA, 14 nt, Human
agugauccucccac

SEQ ID NO: 1615099 - RNA, 18 nt, Human
agugccuuacacaauggu

SEQ ID NO: 1615100 - RNA, 17 nt, Human
agugauucuccugccuc

SEQ ID NO: 1615101 - RNA, 15 nt, Human
agugauucuccugcc

SEQ ID NO: 1615102 - RNA, 14 nt, Human
agugauucuccugc

SEQ ID NO: 1615103 - RNA, 21 nt, Human
agugauucucaugccucagcc

SEQ ID NO: 1615104 - RNA, 20 nt, Human
agugauggguuaguggaugg

SEQ ID NO: 1615105 - RNA, 15 nt, Human
agugccuuauggaac

SEQ ID NO: 1615106 - RNA, 14 nt, Human
agugccuuauggaa

SEQ ID NO: 1615107 - RNA, 13 nt, Human
agugccuuaugga

SEQ ID NO: 1615108 - RNA, 10 nt, Human
agugccuuau

SEQ ID NO: 1615109 - RNA, 18 nt, Human
agugccuuauggaacacu

SEQ ID NO: 1615110 - RNA, 16 nt, Human
agugccuuauggaaca

SEQ ID NO: 1615111 - RNA, 15 nt, Human
agugcuaauuuugaa

SEQ ID NO: 1615112 - RNA, 20 nt, Human
agugcuaauuuugaaaaacu

SEQ ID NO: 1615113 - RNA, 18 nt, Human
agugcuaauuuugaaaaa

SEQ ID NO: 1615114 - RNA, 20 nt, Human
aguugaaaagacuccaaaga

SEQ ID NO: 1615115 - RNA, 19 nt, Human
aguugaaaagacuccaaag

SEQ ID NO: 1615116 - RNA, 18 nt, Human
aguugaaaagacuccaaa

SEQ ID NO: 1615117 - RNA, 22 nt, Human
aguucaucuugaauuguaagga

SEQ ID NO: 1615118 - RNA, 21 nt, Human
aguugaaaagacuccaaagaa

SEQ ID NO: 1615119 - RNA, 16 nt, Human
aguugauacuacaguu

SEQ ID NO: 1615120 - RNA, 14 nt, Human
aguugauagcacag

SEQ ID NO: 1615121 - RNA, 23 nt, Human
aguucagagcugcccucuccugg

SEQ ID NO: 1615122 - RNA, 21 nt, Human
aguucagagcugcccucuccu

SEQ ID NO: 1615123 - RNA, 22 nt, Human
aguucagagcugcccucuccug

SEQ ID NO: 1615124 - RNA, 20 nt, Human
aguucagagcugcccucucc

SEQ ID NO: 1615125 - RNA, 19 nt, Human
aguucaucuugaauuguaa

SEQ ID NO: 1615126 - RNA, 15 nt, Human
aguucaucuugaauu

SEQ ID NO: 1615127 - RNA, 13 nt, Human
aguucaucuugaa

SEQ ID NO: 1615128 - RNA, 18 nt, Human
aguucagguaacaggcag

SEQ ID NO: 1615129 - RNA, 19 nt, Human
agaugaugaugaucuuuaa

SEQ ID NO: 1615130 - RNA, 14 nt, Human
agaugagugagcau

SEQ ID NO: 1615131 - RNA, 19 nt, Human
agauguagaggagaaacug

SEQ ID NO: 1615132 - RNA, 16 nt, Human
agauguagaggagaaa

SEQ ID NO: 1615133 - RNA, 21 nt, Human
agauguagccccucuccugga

SEQ ID NO: 1615134 - RNA, 23 nt, Human
agaggggguggccucccaacuca

SEQ ID NO: 1615135 - RNA, 19 nt, Human
agaucugccuaaggacuuc

SEQ ID NO: 1615136 - RNA, 20 nt, Human
agcaaaggagauuggaagga

SEQ ID NO: 1615137 - RNA, 16 nt, Human
agcaaauguggcuccu

SEQ ID NO: 1615138 - RNA, 20 nt, Human
agcaaaugucuuccuggauu

SEQ ID NO: 1615139 - RNA, 17 nt, Human
agcaaaugucuuccugg

SEQ ID NO: 1615140 - RNA, 24 nt, Human
agcaaaauuuuuucucuaggaaau

SEQ ID NO: 1615141 - RNA, 18 nt, Human
agcaaaagaugcuucuca

SEQ ID NO: 1615142 - RNA, 21 nt, Human
agauugcaacaggcugggcuu

SEQ ID NO: 1615143 - RNA, 20 nt, Human
agauugcaacaggcugggcu

SEQ ID NO: 1615144 - RNA, 23 nt, Human
agauugcaacaggcugggcuuca

SEQ ID NO: 1615145 - RNA, 21 nt, Human
agauucuuuccugaggcuggg

SEQ ID NO: 1615146 - RNA, 19 nt, Human
agauucuuuccugaggcug

SEQ ID NO: 1615147 - RNA, 16 nt, Human
agcacagacccugccc

SEQ ID NO: 1615148 - RNA, 17 nt, Human
agcacgauuucuguuua

SEQ ID NO: 1615149 - RNA, 19 nt, Human
agcacgauuucuguuuaga

SEQ ID NO: 1615150 - RNA, 21 nt, Human
agcacgauuucuguuuagaua

SEQ ID NO: 1615151 - RNA, 15 nt, Human
agcacagacccugcc

SEQ ID NO: 1615152 - RNA, 14 nt, Human
agcacagacccugc

SEQ ID NO: 1615153 - RNA, 21 nt, Human
agcccgggcucugccucccau

SEQ ID NO: 1615154 - RNA, 20 nt, Human
agcccgggcucugccuccca

SEQ ID NO: 1615155 - RNA, 18 nt, Human
agcccgggcucugccucc

SEQ ID NO: 1615156 - RNA, 17 nt, Human
agcccgggcucugccuc

SEQ ID NO: 1615157 - RNA, 20 nt, Human
agccccauucugccugccca

SEQ ID NO: 1615158 - RNA, 21 nt, Human
agcccuccaucuaaacugccc

SEQ ID NO: 1615159 - RNA, 23 nt, Human
agcccuccaucuaaacugccccc

SEQ ID NO: 1615160 - RNA, 13 nt, Human
agcccucccugcc

SEQ ID NO: 1615161 - RNA, 12 nt, Human
agcccucccugc

SEQ ID NO: 1615162 - RNA, 23 nt, Human
agccccauccucuguacagagcc

SEQ ID NO: 1615163 - RNA, 17 nt, Human
agccccauccucuguac

SEQ ID NO: 1615164 - RNA, 15 nt, Human
agccccauccucugu

SEQ ID NO: 1615165 - RNA, 19 nt, Human
agccccauucugccugccc

SEQ ID NO: 1615166 - RNA, 18 nt, Human
agccccauucugccugcc

SEQ ID NO: 1615167 - RNA, 17 nt, Human
agccccauucugccugc

SEQ ID NO: 1615168 - RNA, 13 nt, Human
agcauccuggcac

SEQ ID NO: 1615169 - RNA, 15 nt, Human
agcccacgcccccac

SEQ ID NO: 1615170 - RNA, 14 nt, Human
agcccacgccccca

SEQ ID NO: 1615171 - RNA, 23 nt, Human
agcccacgcccccacuggugaca

SEQ ID NO: 1615172 - RNA, 17 nt, Human
agccagcaggcucucag

SEQ ID NO: 1615173 - RNA, 16 nt, Human
agccagcaggcucuca

SEQ ID NO: 1615174 - RNA, 16 nt, Human
agcccaccuuggcuca

SEQ ID NO: 1615175 - RNA, 15 nt, Human
agcccaccccucaac

SEQ ID NO: 1615176 - RNA, 18 nt, Human
agccaaagcuaggccugg

SEQ ID NO: 1615177 - RNA, 16 nt, Human
agccaaagcuaggccu

SEQ ID NO: 1615178 - RNA, 17 nt, Human
agcauccuggcacccgg

SEQ ID NO: 1615179 - RNA, 14 nt, Human
agcauccuggcacc

SEQ ID NO: 1615180 - RNA, 18 nt, Human
agcauccuggcacccggc

SEQ ID NO: 1615181 - RNA, 15 nt, Human
agccagaggagagag

SEQ ID NO: 1615182 - RNA, 13 nt, Human
agccagaggagag

SEQ ID NO: 1615183 - RNA, 20 nt, Human
agccaaggccaaaggaagca

SEQ ID NO: 1615184 - RNA, 18 nt, Human
agccagaggagagaggac

SEQ ID NO: 1615185 - RNA, 17 nt, Human
agccagaggagagagga

SEQ ID NO: 1615186 - RNA, 14 nt, Human
agccagcaggcucu

SEQ ID NO: 1615187 - RNA, 19 nt, Human
agacccaaaaggcagaagc

SEQ ID NO: 1615188 - RNA, 21 nt, Human
agacagagucucacuguugcc

SEQ ID NO: 1615189 - RNA, 23 nt, Human
agacagagucucacuguugccca

SEQ ID NO: 1615190 - RNA, 22 nt, Human
agacagccaacuauggccugug

SEQ ID NO: 1615191 - RNA, 20 nt, Human
agacagagucucacuguugc

SEQ ID NO: 1615192 - RNA, 19 nt, Human
agacagagucucacuguug

SEQ ID NO: 1615193 - RNA, 11 nt, Human
agacagagucu

SEQ ID NO: 1615194 - RNA, 21 nt, Human
agacaaugacuuacuguacau

SEQ ID NO: 1615195 - RNA, 22 nt, Human
agacaaugacuuacuguacaug

SEQ ID NO: 1615196 - RNA, 15 nt, Human
agacagagcuacaca

SEQ ID NO: 1615197 - RNA, 23 nt, Human
agacaaugacuuacuguacauga

SEQ ID NO: 1615198 - RNA, 20 nt, Human
agacaaugacuuacuguaca

SEQ ID NO: 1615199 - RNA, 17 nt, Human
agaaugauuaugaauua

SEQ ID NO: 1615200 - RNA, 22 nt, Human
agaaugcacaaacagaggccgc

SEQ ID NO: 1615201 - RNA, 19 nt, Human
agaaugcacaaacagaggc

SEQ ID NO: 1615202 - RNA, 22 nt, Human
agaaugagagacacacugaaga

SEQ ID NO: 1615203 - RNA, 17 nt, Human
agaaugagagacacacu

SEQ ID NO: 1615204 - RNA, 21 nt, Human
agaagugaaaaucuacacucc

SEQ ID NO: 1615205 - RNA, 22 nt, Human
agaagucacauuccugaacagg

SEQ ID NO: 1615206 - RNA, 18 nt, Human
agaaugaaagggcccaga

SEQ ID NO: 1615207 - RNA, 22 nt, Human
agaagagcuguucacagccaga

SEQ ID NO: 1615208 - RNA, 21 nt, Human
agaagagauugugguuucauu

SEQ ID NO: 1615209 - RNA, 18 nt, Human
agaagacugcauuauauu

SEQ ID NO: 1615210 - RNA, 21 nt, Human
acuuuccucuuuggucuacac

SEQ ID NO: 1615211 - RNA, 21 nt, Human
acuuuccucuuagucgagcca

SEQ ID NO: 1615212 - RNA, 21 nt, Human
agaagacacugaugggcaacc

SEQ ID NO: 1615213 - RNA, 13 nt, Human
agaagacacugau

SEQ ID NO: 1615214 - RNA, 13 nt, Human
agaagauagcagg

SEQ ID NO: 1615215 - RNA, 14 nt, Human
agaaguaacuuacu

SEQ ID NO: 1615216 - RNA, 18 nt, Human
agaagguuucagaaagaa

SEQ ID NO: 1615217 - RNA, 21 nt, Human
agaagucacauuccugaacag

SEQ ID NO: 1615218 - RNA, 20 nt, Human
agaagucacauuccugaaca

SEQ ID NO: 1615219 - RNA, 18 nt, Human
agaagucacauuccugaa

SEQ ID NO: 1615220 - RNA, 18 nt, Human
agacucugucucagucca

SEQ ID NO: 1615221 - RNA, 20 nt, Human
agacugaguacguugugcau

SEQ ID NO: 1615222 - RNA, 22 nt, Human
agacugaguacguugugcauuu

SEQ ID NO: 1615223 - RNA, 23 nt, Human
agacugaguacguugugcauuug

SEQ ID NO: 1615224 - RNA, 18 nt, Human
agacucugucucaaaaaa

SEQ ID NO: 1615225 - RNA, 16 nt, Human
agacgcugugcugccc

SEQ ID NO: 1615226 - RNA, 16 nt, Human
agagagaccacuuuuc

SEQ ID NO: 1615227 - RNA, 16 nt, Human
agacuggaagcacagc

SEQ ID NO: 1615228 - RNA, 13 nt, Human
agagccagggucu

SEQ ID NO: 1615229 - RNA, 13 nt, Human
agagcccaccuug

SEQ ID NO: 1615230 - RNA, 13 nt, Human
agaggaaugaagu

SEQ ID NO: 1615231 - RNA, 19 nt, Human
agaggggguggccucccaa

SEQ ID NO: 1615232 - RNA, 17 nt, Human
agaggggguggccuccc

SEQ ID NO: 1615233 - RNA, 16 nt, Human
agagggccugcaaggg

SEQ ID NO: 1615234 - RNA, 13 nt, Human
agagggccugcaa

SEQ ID NO: 1615235 - RNA, 23 nt, Human
agaggacuuuucuuuguggcuuc

SEQ ID NO: 1615236 - RNA, 23 nt, Human
agaggagggagcaucagugcccu

SEQ ID NO: 1615237 - RNA, 22 nt, Human
agaggacuuuucuuuguggcuu

SEQ ID NO: 1615238 - RNA, 21 nt, Human
agaggacuuuucuuuguggcu

SEQ ID NO: 1615239 - RNA, 12 nt, Human
agcuacaaaugc

SEQ ID NO: 1615240 - RNA, 16 nt, Human
agcucaccagccccag

SEQ ID NO: 1615241 - RNA, 16 nt, Human
agcuaaucagcauucu

SEQ ID NO: 1615242 - RNA, 21 nt, Human
agcuaaucagcauucucacuc

SEQ ID NO: 1615243 - RNA, 19 nt, Human
agcucaccucucccuugga

SEQ ID NO: 1615244 - RNA, 18 nt, Human
agcucaccucucccuugg

SEQ ID NO: 1615245 - RNA, 15 nt, Human
agcucaccucucccu

SEQ ID NO: 1615246 - RNA, 20 nt, Human
agcucaccagccccagugcc

SEQ ID NO: 1615247 - RNA, 19 nt, Human
agcucaccagccccagugc

SEQ ID NO: 1615248 - RNA, 12 nt, Human
agcucaccucuc

SEQ ID NO: 1615249 - RNA, 14 nt, Human
agcucagagagggu

SEQ ID NO: 1615250 - RNA, 18 nt, Human
agcucagagaggguggga

SEQ ID NO: 1615251 - RNA, 12 nt, Human
agcucagagagg

SEQ ID NO: 1615252 - RNA, 19 nt, Human
agcgagcccugguggcagu

SEQ ID NO: 1615253 - RNA, 13 nt, Human
agcgagcccuggu

SEQ ID NO: 1615254 - RNA, 15 nt, Human
agccuuuggaaacag

SEQ ID NO: 1615255 - RNA, 20 nt, Human
agccugggaggucaaggcug

SEQ ID NO: 1615256 - RNA, 12 nt, Human
agccugggaggu

SEQ ID NO: 1615257 - RNA, 18 nt, Human
agccuggcuucaaauugu

SEQ ID NO: 1615258 - RNA, 17 nt, Human
agccuggcuucaaauug

SEQ ID NO: 1615259 - RNA, 23 nt, Human
agcccucccugccccucccuuca

SEQ ID NO: 1615260 - RNA, 22 nt, Human
agcccucccugccccucccuuc

SEQ ID NO: 1615261 - RNA, 19 nt, Human
agcccucccugccccuccc

SEQ ID NO: 1615262 - RNA, 17 nt, Human
agcccucccugccccuc

SEQ ID NO: 1615263 - RNA, 16 nt, Human
agcccucccugccccu

SEQ ID NO: 1615264 - RNA, 15 nt, Human
agcccucccugcccc

SEQ ID NO: 1615265 - RNA, 19 nt, Human
agcuccccucggagaagag

SEQ ID NO: 1615266 - RNA, 17 nt, Human
agcuccccucggagaag

SEQ ID NO: 1615267 - RNA, 20 nt, Human
agcuccccucggagaagagc

SEQ ID NO: 1615268 - RNA, 15 nt, Human
agcugaaccugggua

SEQ ID NO: 1615269 - RNA, 18 nt, Human
agcugcgguccacccagg

SEQ ID NO: 1615270 - RNA, 17 nt, Human
agcugcgguccacccag

SEQ ID NO: 1615271 - RNA, 16 nt, Human
agcugcgguccaccca

SEQ ID NO: 1615272 - RNA, 13 nt, Human
agcugcgguccac

SEQ ID NO: 1615273 - RNA, 20 nt, Human
agcugcgguccacccaggag

SEQ ID NO: 1615274 - RNA, 19 nt, Human
agcugcgguccacccagga

SEQ ID NO: 1615275 - RNA, 12 nt, Human
agcugcugacag

SEQ ID NO: 1615276 - RNA, 21 nt, Human
agcugcgguccacccaggagc

SEQ ID NO: 1615277 - RNA, 17 nt, Human
agcuggucccacucagu

SEQ ID NO: 1615278 - RNA, 14 nt, Human
agcugcugacagug

SEQ ID NO: 1615279 - RNA, 13 nt, Human
agcugcugacagu

SEQ ID NO: 1615280 - RNA, 19 nt, Human
agcuggucccacucagucc

SEQ ID NO: 1615281 - RNA, 18 nt, Human
agcuggucccacucaguc

SEQ ID NO: 1615282 - RNA, 22 nt, Human
agcugguuuuuagcggagacgg

SEQ ID NO: 1615283 - RNA, 18 nt, Human
agcuucacuguaaaauaa

SEQ ID NO: 1615284 - RNA, 18 nt, Human
agcuucauuuccuguguc

SEQ ID NO: 1615285 - RNA, 19 nt, Human
agcuucauuuccugugucu

SEQ ID NO: 1615286 - RNA, 23 nt, Human
agcuuuguuuguugucagcugaa

SEQ ID NO: 1615287 - RNA, 16 nt, Human
agcuuuuaaacccuau

SEQ ID NO: 1615288 - RNA, 23 nt, Human
aggaacuuaaauaaugugaaacu

SEQ ID NO: 1615289 - RNA, 22 nt, Human
aggaaggcugagaggagagaga

SEQ ID NO: 1615290 - RNA, 18 nt, Human
aggaauaccugucccccu

SEQ ID NO: 1615291 - RNA, 15 nt, Human
aggaauaccuguccc

SEQ ID NO: 1615292 - RNA, 22 nt, Human
aggaauaccugucccccugaca

SEQ ID NO: 1615293 - RNA, 20 nt, Human
aggaauaaauugcuccuuga

SEQ ID NO: 1615294 - RNA, 19 nt, Human
aggaauaaauugcuccuug

SEQ ID NO: 1615295 - RNA, 23 nt, Human
aggaacaaggcaaggcugucaau

SEQ ID NO: 1615296 - RNA, 20 nt, Human
aggaacaaggcaaggcuguc

SEQ ID NO: 1615297 - RNA, 21 nt, Human
aggaacuuaaauaaugugaaa

SEQ ID NO: 1615298 - RNA, 19 nt, Human
aggaacaaggcaaggcugu

SEQ ID NO: 1615299 - RNA, 17 nt, Human
aggaacaaggcaaggcu

SEQ ID NO: 1615300 - RNA, 16 nt, Human
aggaacaaggcaaggc

SEQ ID NO: 1615301 - RNA, 13 nt, Human
aggaacaaggcaa

SEQ ID NO: 1615302 - RNA, 12 nt, Human
aggaacaaggca

SEQ ID NO: 1615303 - RNA, 21 nt, Human
agcuuuuaugugaaacauguu

SEQ ID NO: 1615304 - RNA, 15 nt, Human
agcuuuuaugugaaa

SEQ ID NO: 1615305 - RNA, 22 nt, Human
aggacccggaggggccuggcag

SEQ ID NO: 1615306 - RNA, 21 nt, Human
aggacccggaggggccuggca

SEQ ID NO: 1615307 - RNA, 20 nt, Human
aggacccggaggggccuggc

SEQ ID NO: 1615308 - RNA, 18 nt, Human
aggacccggaggggccug

SEQ ID NO: 1615309 - RNA, 15 nt, Human
agggacugaggggag

SEQ ID NO: 1615310 - RNA, 23 nt, Human
agggacugccagucccccugccc

SEQ ID NO: 1615311 - RNA, 15 nt, Human
agggacccuccacca

SEQ ID NO: 1615312 - RNA, 21 nt, Human
aggcuuagucacugagacagc

SEQ ID NO: 1615313 - RNA, 18 nt, Human
aggcuuagucacugagac

SEQ ID NO: 1615314 - RNA, 17 nt, Human
aggcuuagucacugaga

SEQ ID NO: 1615315 - RNA, 23 nt, Human
aggcuguaucccaugagccucag

SEQ ID NO: 1615316 - RNA, 22 nt, Human
aggcuguaucccaugagccuca

SEQ ID NO: 1615317 - RNA, 21 nt, Human
aggcuguaucccaugagccuc

SEQ ID NO: 1615318 - RNA, 20 nt, Human
aggcuguaucccaugagccu

SEQ ID NO: 1615319 - RNA, 23 nt, Human
aggcuggucucgaacuccugacc

SEQ ID NO: 1615320 - RNA, 18 nt, Human
aggcuggguucugauccu

SEQ ID NO: 1615321 - RNA, 15 nt, Human
aggcuaccuuuguau

SEQ ID NO: 1615322 - RNA, 13 nt, Human
aggcuaccuuugu

SEQ ID NO: 1615323 - RNA, 14 nt, Human
aggcuaccuuugua

SEQ ID NO: 1615324 - RNA, 23 nt, Human
aggccaugggcacuguggguaga

SEQ ID NO: 1615325 - RNA, 21 nt, Human
aggccaugggcacugugggua

SEQ ID NO: 1615326 - RNA, 23 nt, Human
aggcccucugcccacucccugca

SEQ ID NO: 1615327 - RNA, 22 nt, Human
aggcccucugcccacucccugc

SEQ ID NO: 1615328 - RNA, 19 nt, Human
aggcccuucucuccagccc

SEQ ID NO: 1615329 - RNA, 15 nt, Human
aggcccuucucucca

SEQ ID NO: 1615330 - RNA, 12 nt, Human
aggcccuucucu

SEQ ID NO: 1615331 - RNA, 22 nt, Human
aggcccuuccucuccacugccu

SEQ ID NO: 1615332 - RNA, 15 nt, Human
aggccaggcccucug

SEQ ID NO: 1615333 - RNA, 16 nt, Human
aggccaggcccucugc

SEQ ID NO: 1615334 - RNA, 14 nt, Human
aggccaggcccucu

SEQ ID NO: 1615335 - RNA, 13 nt, Human
aggccaggcccuc

SEQ ID NO: 1615336 - RNA, 20 nt, Human
aggcauuccccaggaggcca

SEQ ID NO: 1615337 - RNA, 19 nt, Human
aggcauuccccaggaggcc

SEQ ID NO: 1615338 - RNA, 18 nt, Human
aggcauuccccaggaggc

SEQ ID NO: 1615339 - RNA, 19 nt, Human
aggcauguucucugaggac

SEQ ID NO: 1615340 - RNA, 18 nt, Human
aggcauguucucugagga

SEQ ID NO: 1615341 - RNA, 17 nt, Human
aggcauguucucugagg

SEQ ID NO: 1615342 - RNA, 21 nt, Human
aggcaugugaugagaggaaau

SEQ ID NO: 1615343 - RNA, 20 nt, Human
aggcaugugaugagaggaaa

SEQ ID NO: 1615344 - RNA, 19 nt, Human
aggcaugugaugagaggaa

SEQ ID NO: 1615345 - RNA, 15 nt, Human
aggcaugguggccca

SEQ ID NO: 1615346 - RNA, 17 nt, Human
aggcaugugaugagagg

SEQ ID NO: 1615347 - RNA, 14 nt, Human
aggagaggggcaca

SEQ ID NO: 1615348 - RNA, 15 nt, Human
agggauuagggagag

SEQ ID NO: 1615349 - RNA, 20 nt, Human
agggauuagggagagaagau

SEQ ID NO: 1615350 - RNA, 14 nt, Human
agggccugcaaggg

SEQ ID NO: 1615351 - RNA, 13 nt, Human
agggccuggccug

SEQ ID NO: 1615352 - RNA, 12 nt, Human
agggccuggccu

SEQ ID NO: 1615353 - RNA, 15 nt, Human
agggccugcaaggga

SEQ ID NO: 1615354 - RNA, 22 nt, Human
agggucccugguggcagcucac

SEQ ID NO: 1615355 - RNA, 20 nt, Human
agggucccugguggcagcuc

SEQ ID NO: 1615356 - RNA, 17 nt, Human
agggucccugguggcag

SEQ ID NO: 1615357 - RNA, 16 nt, Human
agggucccugguggca

SEQ ID NO: 1615358 - RNA, 13 nt, Human
aggguauuccaga

SEQ ID NO: 1615359 - RNA, 21 nt, Human
aggguaucuggugacuuuccu

SEQ ID NO: 1615360 - RNA, 12 nt, Human
aggggccuggca

SEQ ID NO: 1615361 - RNA, 15 nt, Human
aggggccuggcagcc

SEQ ID NO: 1615362 - RNA, 13 nt, Human
aggggccuggcag

SEQ ID NO: 1615363 - RNA, 14 nt, Human
agggucccuggugg

SEQ ID NO: 1615364 - RNA, 12 nt, Human
agggucccuggu

SEQ ID NO: 1615365 - RNA, 22 nt, Human
aggggcccaaauucuuucagug

SEQ ID NO: 1615366 - RNA, 14 nt, Human
agggccuggccuga

SEQ ID NO: 1615367 - RNA, 20 nt, Human
agggucucacuauguugccc

SEQ ID NO: 1615368 - RNA, 14 nt, Human
agguaacaggcaga

SEQ ID NO: 1615369 - RNA, 13 nt, Human
agguaacaggcag

SEQ ID NO: 1615370 - RNA, 16 nt, Human
agguaacaggcagaua

SEQ ID NO: 1615371 - RNA, 14 nt, Human
agguacucuccugg

SEQ ID NO: 1615372 - RNA, 13 nt, Human
agguacucuccug

SEQ ID NO: 1615373 - RNA, 23 nt, Human
aggguuuugccauguuggccagg

SEQ ID NO: 1615374 - RNA, 22 nt, Human
aggguuuugccauguuggccag

SEQ ID NO: 1615375 - RNA, 16 nt, Human
aaauaaacgucuuaaa

SEQ ID NO: 1615376 - RNA, 15 nt, Human
aaauaaacgucuuaa

SEQ ID NO: 1615377 - RNA, 11 nt, Human
aaauaaauuau

SEQ ID NO: 1615378 - RNA, 17 nt, Human
aaauaaacgucuuaaau

SEQ ID NO: 1615379 - RNA, 20 nt, Human
aaagcauuguaaaugugcuu

SEQ ID NO: 1615380 - RNA, 19 nt, Human
aaagcauuguaaaugugcu

SEQ ID NO: 1615381 - RNA, 15 nt, Human
aaagccaaagcuagg

SEQ ID NO: 1615382 - RNA, 17 nt, Human
aaaggcuaccuuuguau

SEQ ID NO: 1615383 - RNA, 14 nt, Human
aaaggcuaccuuug

SEQ ID NO: 1615384 - RNA, 14 nt, Human
aaaggcuccaggag

SEQ ID NO: 1615385 - RNA, 22 nt, Human
aaaggcuccaggagcagccaca

SEQ ID NO: 1615386 - RNA, 21 nt, Human
aaaggcuccaggagcagccac

SEQ ID NO: 1615387 - RNA, 19 nt, Human
aaaggcagaagcaacccaa

SEQ ID NO: 1615388 - RNA, 17 nt, Human
aaacucuugaccucagg

SEQ ID NO: 1615389 - RNA, 19 nt, Human
aaacccuugccaugugcua

SEQ ID NO: 1615390 - RNA, 14 nt, Human
aaacccuucagugc

SEQ ID NO: 1615391 - RNA, 21 nt, Human
aaacccugucucuacuaaaaa

SEQ ID NO: 1615392 - RNA, 17 nt, Human
aaaccccaucucuacaa

SEQ ID NO: 1615393 - RNA, 13 nt, Human
aaagaaacauuug

SEQ ID NO: 1615394 - RNA, 19 nt, Human
aaacugauuuuuuuuuccu

SEQ ID NO: 1615395 - RNA, 13 nt, Human
aaacugauuuuuu

SEQ ID NO: 1615396 - RNA, 20 nt, Human
aaacugauuuuuuuuuccuu

SEQ ID NO: 1615397 - RNA, 22 nt, Human
aaacugauuuuuuuuuccuuca

SEQ ID NO: 1615398 - RNA, 11 nt, Human
aaagagguuuu

SEQ ID NO: 1615399 - RNA, 15 nt, Human
aaagauacaguuacu

SEQ ID NO: 1615400 - RNA, 15 nt, Human
aaacagccugugucu

SEQ ID NO: 1615401 - RNA, 17 nt, Human
aaacagcuaaugggaca

SEQ ID NO: 1615402 - RNA, 19 nt, Human
aaaauccauacauuugugu

SEQ ID NO: 1615403 - RNA, 12 nt, Human
aaaauuaagaaa

SEQ ID NO: 1615404 - RNA, 22 nt, Human
aaaauuaacaugaauauuuagu

SEQ ID NO: 1615405 - RNA, 22 nt, Human
aaaaucccuuaccucggugccu

SEQ ID NO: 1615406 - RNA, 23 nt, Human
aaaauuaaucugggccagaauuu

SEQ ID NO: 1615407 - RNA, 20 nt, Human
aaaauuaagaaaggauaaag

SEQ ID NO: 1615408 - RNA, 13 nt, Human
aaaauuaagaaag

SEQ ID NO: 1615409 - RNA, 15 nt, Human
aaaauuagccaagug

SEQ ID NO: 1615410 - RNA, 19 nt, Human
aaaauuaggauuucaugau

SEQ ID NO: 1615411 - RNA, 15 nt, Human
aaaauaaaaaacacu

SEQ ID NO: 1615412 - RNA, 22 nt, Human
aaaaguuuaauauuaaagccau

SEQ ID NO: 1615413 - RNA, 21 nt, Human
aaaaguuuaauauuaaagcca

SEQ ID NO: 1615414 - RNA, 23 nt, Human
aaaaguuuaauauuaaagccaug

SEQ ID NO: 1615415 - RNA, 21 nt, Human
aaaauccacuuuaucuugaau

SEQ ID NO: 1615416 - RNA, 23 nt, Human
aacugagaugugaacacaucagc

SEQ ID NO: 1615417 - RNA, 18 nt, Human
aacucauauuuucaugcu

SEQ ID NO: 1615418 - RNA, 16 nt, Human
aacucauauuuucaug

SEQ ID NO: 1615419 - RNA, 15 nt, Human
aacucauauuuucau

SEQ ID NO: 1615420 - RNA, 22 nt, Human
aacucaucuagguaaauuacag

SEQ ID NO: 1615421 - RNA, 18 nt, Human
aacucaccccagccccaa

SEQ ID NO: 1615422 - RNA, 17 nt, Human
aacucaccccagcccca

SEQ ID NO: 1615423 - RNA, 16 nt, Human
aacucaccccagcccc

SEQ ID NO: 1615424 - RNA, 17 nt, Human
aacucaaacucuuaaaa

SEQ ID NO: 1615425 - RNA, 13 nt, Human
aacgucugugcca

SEQ ID NO: 1615426 - RNA, 15 nt, Human
aacguauaaaagccu

SEQ ID NO: 1615427 - RNA, 17 nt, Human
aacgcguugaaauugua

SEQ ID NO: 1615428 - RNA, 15 nt, Human
aacgcguugaaauug

SEQ ID NO: 1615429 - RNA, 14 nt, Human
aacgcguugaaauu

SEQ ID NO: 1615430 - RNA, 13 nt, Human
aacgcguugaaau

SEQ ID NO: 1615431 - RNA, 19 nt, Human
aaccaguguuguggauuua

SEQ ID NO: 1615432 - RNA, 15 nt, Human
aaccaguauuguaca

SEQ ID NO: 1615433 - RNA, 14 nt, Human
aaccaguauuguac

SEQ ID NO: 1615434 - RNA, 13 nt, Human
aaccaguauugua

SEQ ID NO: 1615435 - RNA, 11 nt, Human
aaccaguauug

SEQ ID NO: 1615436 - RNA, 13 nt, Human
aacccuucagugc

SEQ ID NO: 1615437 - RNA, 15 nt, Human
aacauggaaguacua

SEQ ID NO: 1615438 - RNA, 16 nt, Human
aacagcuaaugggaca

SEQ ID NO: 1615439 - RNA, 22 nt, Human
aacauccuacaagacacaguga

SEQ ID NO: 1615440 - RNA, 15 nt, Human
aacauccuacaagac

SEQ ID NO: 1615441 - RNA, 18 nt, Human
aaauugaugggauuuggu

SEQ ID NO: 1615442 - RNA, 22 nt, Human
aaauuggggauucuuaaaguug

SEQ ID NO: 1615443 - RNA, 20 nt, Human
aaauuggggauucuuaaagu

SEQ ID NO: 1615444 - RNA, 19 nt, Human
aaauuggggauucuuaaag

SEQ ID NO: 1615445 - RNA, 18 nt, Human
aaauuggggauucuuaaa

SEQ ID NO: 1615446 - RNA, 23 nt, Human
aaauuggggauucuuaaaguuga

SEQ ID NO: 1615447 - RNA, 13 nt, Human
aaauuaacuuuua

SEQ ID NO: 1615448 - RNA, 14 nt, Human
aaauuaacuuuuau

SEQ ID NO: 1615449 - RNA, 19 nt, Human
aaauuaacuuuuauaaacu

SEQ ID NO: 1615450 - RNA, 12 nt, Human
aaauuaacuuuu

SEQ ID NO: 1615451 - RNA, 22 nt, Human
aaauguuuuuuuuuaaagacuu

SEQ ID NO: 1615452 - RNA, 12 nt, Human
aacacaucagcu

SEQ ID NO: 1615453 - RNA, 19 nt, Human
aacaccucugcacaagcug

SEQ ID NO: 1615454 - RNA, 17 nt, Human
aacacuaacaugauuug

SEQ ID NO: 1615455 - RNA, 21 nt, Human
aacacauacaggaagguagaa

SEQ ID NO: 1615456 - RNA, 22 nt, Human
aacaaaccuguuucugcagcca

SEQ ID NO: 1615457 - RNA, 20 nt, Human
aaauguucaucaaugaauga

SEQ ID NO: 1615458 - RNA, 21 nt, Human
aaauguuuuuuuuuaaagacu

SEQ ID NO: 1615459 - RNA, 18 nt, Human
aaauguuuuuuuuuaaag

SEQ ID NO: 1615460 - RNA, 14 nt, Human
aaaucuuaacuuga

SEQ ID NO: 1615461 - RNA, 18 nt, Human
aaaucugcuuuuuaaaga

SEQ ID NO: 1615462 - RNA, 21 nt, Human
aaaucugugaacuugaaauuu

SEQ ID NO: 1615463 - RNA, 20 nt, Human
aaaucugugaacuugaaauu

SEQ ID NO: 1615464 - RNA, 22 nt, Human
aaaucuccaaaauaaaacuuuu

SEQ ID NO: 1615465 - RNA, 17 nt, Human
aaauggacguguuauga

SEQ ID NO: 1615466 - RNA, 15 nt, Human
aaauggacguguuau

SEQ ID NO: 1615467 - RNA, 17 nt, Human
aaauggaauacucuuau

SEQ ID NO: 1615468 - RNA, 14 nt, Human
aaauggacguguua

SEQ ID NO: 1615469 - RNA, 10 nt, Human
aauaaaccau

SEQ ID NO: 1615470 - RNA, 12 nt, Human
aauaaaauuuuu

SEQ ID NO: 1615471 - RNA, 18 nt, Human
aaguugauggugaugaaa

SEQ ID NO: 1615472 - RNA, 15 nt, Human
aauaaacgucuuaaa

SEQ ID NO: 1615473 - RNA, 19 nt, Human
aauaaagcuguguggcagu

SEQ ID NO: 1615474 - RNA, 11 nt, Human
aauaaagcugu

SEQ ID NO: 1615475 - RNA, 22 nt, Human
aaguugauaugccuuuucccaa

SEQ ID NO: 1615476 - RNA, 15 nt, Human
aaguggggacagagc

SEQ ID NO: 1615477 - RNA, 14 nt, Human
aagugcugcauuua

SEQ ID NO: 1615478 - RNA, 13 nt, Human
aagugcugcauuu

SEQ ID NO: 1615479 - RNA, 12 nt, Human
aauaauguuuca

SEQ ID NO: 1615480 - RNA, 19 nt, Human
aauaauguuucaaacauau

SEQ ID NO: 1615481 - RNA, 14 nt, Human
aauaauguuucaaa

SEQ ID NO: 1615482 - RNA, 16 nt, Human
aauauaggaacuuaaa

SEQ ID NO: 1615483 - RNA, 20 nt, Human
aauauuaaagccauguuuau

SEQ ID NO: 1615484 - RNA, 19 nt, Human
aauauuaaagccauguuua

SEQ ID NO: 1615485 - RNA, 18 nt, Human
aauauuaaagccauguuu

SEQ ID NO: 1615486 - RNA, 16 nt, Human
aauauuaaagccaugu

SEQ ID NO: 1615487 - RNA, 15 nt, Human
aauauuaaagccaug

SEQ ID NO: 1615488 - RNA, 14 nt, Human
aauauuaaagccau

SEQ ID NO: 1615489 - RNA, 13 nt, Human
aauauuaaagcca

SEQ ID NO: 1615490 - RNA, 20 nt, Human
aauacgugggcauucaaaug

SEQ ID NO: 1615491 - RNA, 19 nt, Human
aauacgugggcauucaaau

SEQ ID NO: 1615492 - RNA, 16 nt, Human
aaucaaauaugcaaag

SEQ ID NO: 1615493 - RNA, 15 nt, Human
aaucaaauaugcaaa

SEQ ID NO: 1615494 - RNA, 22 nt, Human
aaucaaauaugcaaagcacuga

SEQ ID NO: 1615495 - RNA, 22 nt, Human
aauauuaaagccauguuuauua

SEQ ID NO: 1615496 - RNA, 22 nt, Human
aaucauuucugcaucagcugcu

SEQ ID NO: 1615497 - RNA, 16 nt, Human
aaugauaacuggaaac

SEQ ID NO: 1615498 - RNA, 15 nt, Human
aaugauaacuggaaa

SEQ ID NO: 1615499 - RNA, 14 nt, Human
aaugauaacuggaa

SEQ ID NO: 1615500 - RNA, 13 nt, Human
aaugauuaauuaa

SEQ ID NO: 1615501 - RNA, 12 nt, Human
aaugauuaauua

SEQ ID NO: 1615502 - RNA, 16 nt, Human
aaugauuaauuaaaac

SEQ ID NO: 1615503 - RNA, 15 nt, Human
aaugauagcuacugu

SEQ ID NO: 1615504 - RNA, 23 nt, Human
aaugauguauguugaagccuuug

SEQ ID NO: 1615505 - RNA, 17 nt, Human
aauccauacauuugugu

SEQ ID NO: 1615506 - RNA, 17 nt, Human
aauccagacccggcugc

SEQ ID NO: 1615507 - RNA, 16 nt, Human
aauccauacauuugug

SEQ ID NO: 1615508 - RNA, 23 nt, Human
aaucucgcucugucgcccaggcu

SEQ ID NO: 1615509 - RNA, 18 nt, Human
aaucucggcucacugcau

SEQ ID NO: 1615510 - RNA, 20 nt, Human
aaucuggacuccucugucca

SEQ ID NO: 1615511 - RNA, 18 nt, Human
aaucuggacuccucuguc

SEQ ID NO: 1615512 - RNA, 17 nt, Human
aaucuggacuccucugu

SEQ ID NO: 1615513 - RNA, 16 nt, Human
aaucuggacuccucug

SEQ ID NO: 1615514 - RNA, 15 nt, Human
aaucuggacuccucu

SEQ ID NO: 1615515 - RNA, 21 nt, Human
aaugcgugcauaccacuuuug

SEQ ID NO: 1615516 - RNA, 23 nt, Human
aaugcgugcauaccacuuuuguu

SEQ ID NO: 1615517 - RNA, 21 nt, Human
aaugcgcaggcuggcccugcc

SEQ ID NO: 1615518 - RNA, 14 nt, Human
aaugcgcaggcugg

SEQ ID NO: 1615519 - RNA, 15 nt, Human
aaugcgcaggcuggc

SEQ ID NO: 1615520 - RNA, 20 nt, Human
aaugcgcaggcuggcccugc

SEQ ID NO: 1615521 - RNA, 19 nt, Human
aaugcgcaggcuggcccug

SEQ ID NO: 1615522 - RNA, 18 nt, Human
aaugcgcaggcuggcccu

SEQ ID NO: 1615523 - RNA, 17 nt, Human
aaugcgcaggcuggccc

SEQ ID NO: 1615524 - RNA, 14 nt, Human
aaugggagcucaug

SEQ ID NO: 1615525 - RNA, 13 nt, Human
aaugggacacuaa

SEQ ID NO: 1615526 - RNA, 23 nt, Human
aaugcucuuuacuucauggacuu

SEQ ID NO: 1615527 - RNA, 15 nt, Human
aaugggggugcauuu

SEQ ID NO: 1615528 - RNA, 17 nt, Human
aaugggggugcauuuga

SEQ ID NO: 1615529 - RNA, 22 nt, Human
aaugguccgugcuaaggacuug

SEQ ID NO: 1615530 - RNA, 20 nt, Human
aaugguccgugcuaaggacu

SEQ ID NO: 1615531 - RNA, 19 nt, Human
aagauuuugaaauuuuuau

SEQ ID NO: 1615532 - RNA, 15 nt, Human
aagcagggacuugaa

SEQ ID NO: 1615533 - RNA, 19 nt, Human
aagccaccaacauacuccc

SEQ ID NO: 1615534 - RNA, 14 nt, Human
aagauagcagggca

SEQ ID NO: 1615535 - RNA, 17 nt, Human
aagauucaaucccagga

SEQ ID NO: 1615536 - RNA, 20 nt, Human
aagauacugaaauaaacguc

SEQ ID NO: 1615537 - RNA, 16 nt, Human
aagauacugaaauaaa

SEQ ID NO: 1615538 - RNA, 14 nt, Human
aagauacugaaaua

SEQ ID NO: 1615539 - RNA, 20 nt, Human
aagauucauauuuacuucuu

SEQ ID NO: 1615540 - RNA, 21 nt, Human
aagauucaaugccccugaauu

SEQ ID NO: 1615541 - RNA, 20 nt, Human
aagauucaaugccccugaau

SEQ ID NO: 1615542 - RNA, 16 nt, Human
aagacuuuggaaagag

SEQ ID NO: 1615543 - RNA, 23 nt, Human
aagacagugaaagaaaauaacaa

SEQ ID NO: 1615544 - RNA, 15 nt, Human
aagagaacuuccaga

SEQ ID NO: 1615545 - RNA, 17 nt, Human
aagacuuuuccaacccu

SEQ ID NO: 1615546 - RNA, 15 nt, Human
aagacuuuuaugaua

SEQ ID NO: 1615547 - RNA, 19 nt, Human
aagccagauuuuccugaaa

SEQ ID NO: 1615548 - RNA, 21 nt, Human
aagccaccaacauacucccau

SEQ ID NO: 1615549 - RNA, 18 nt, Human
aagccagcaggcucucag

SEQ ID NO: 1615550 - RNA, 19 nt, Human
aagccagcaggcucucagg

SEQ ID NO: 1615551 - RNA, 15 nt, Human
aagccagcaggcucu

SEQ ID NO: 1615552 - RNA, 17 nt, Human
aagcgauucuucugcuu

SEQ ID NO: 1615553 - RNA, 16 nt, Human
aagcgauucuucugcu

SEQ ID NO: 1615554 - RNA, 14 nt, Human
aagcgauucuucug

SEQ ID NO: 1615555 - RNA, 15 nt, Human
aagcgauucuucugc

SEQ ID NO: 1615556 - RNA, 13 nt, Human
aaggacacuagaa

SEQ ID NO: 1615557 - RNA, 13 nt, Human
aaggacuaggguc

SEQ ID NO: 1615558 - RNA, 15 nt, Human
aaggacuaggguccu

SEQ ID NO: 1615559 - RNA, 12 nt, Human
aaggaauuuuau

SEQ ID NO: 1615560 - RNA, 22 nt, Human
aaggacccggaggggccuggca

SEQ ID NO: 1615561 - RNA, 22 nt, Human
aagcugccagccgagauagcca

SEQ ID NO: 1615562 - RNA, 14 nt, Human
aagcugcugacagu

SEQ ID NO: 1615563 - RNA, 12 nt, Human
aagcugccagcc

SEQ ID NO: 1615564 - RNA, 11 nt, Human
aagcugccagc

SEQ ID NO: 1615565 - RNA, 20 nt, Human
aagcgugagccacugcaccg

SEQ ID NO: 1615566 - RNA, 17 nt, Human
aagcgugagccacugca

SEQ ID NO: 1615567 - RNA, 21 nt, Human
aagcgugagccacugcaccgg

SEQ ID NO: 1615568 - RNA, 23 nt, Human
aaggaaugauuaauuaaaacaca

SEQ ID NO: 1615569 - RNA, 16 nt, Human
aagcugcugacagugu

SEQ ID NO: 1615570 - RNA, 17 nt, Human
aagggauggcaagaugu

SEQ ID NO: 1615571 - RNA, 14 nt, Human
aagggauggcaaga

SEQ ID NO: 1615572 - RNA, 20 nt, Human
aagggacuuggaagcuccgc

SEQ ID NO: 1615573 - RNA, 17 nt, Human
aagggacugagaaauuu

SEQ ID NO: 1615574 - RNA, 15 nt, Human
aagggacugagaaau

SEQ ID NO: 1615575 - RNA, 12 nt, Human
aaguagaggagg

SEQ ID NO: 1615576 - RNA, 20 nt, Human
acauaauucaggaagcagcu

SEQ ID NO: 1615577 - RNA, 16 nt, Human
acauaagauaaaugug

SEQ ID NO: 1615578 - RNA, 18 nt, Human
acaugccucucucaggcc

SEQ ID NO: 1615579 - RNA, 17 nt, Human
acaugccucucucaggc

SEQ ID NO: 1615580 - RNA, 16 nt, Human
acaugccucucucagg

SEQ ID NO: 1615581 - RNA, 15 nt, Human
acaugccucucucag

SEQ ID NO: 1615582 - RNA, 18 nt, Human
acaugcaaggucauuuuu

SEQ ID NO: 1615583 - RNA, 17 nt, Human
acaugcaaggucauuuu

SEQ ID NO: 1615584 - RNA, 16 nt, Human
acaugcaaggucauuu

SEQ ID NO: 1615585 - RNA, 15 nt, Human
acauccuacaagaca

SEQ ID NO: 1615586 - RNA, 21 nt, Human
acagugauuaccagggacuga

SEQ ID NO: 1615587 - RNA, 23 nt, Human
acagugagucgaggacagggagg

SEQ ID NO: 1615588 - RNA, 19 nt, Human
acaguggggaaugaagaua

SEQ ID NO: 1615589 - RNA, 15 nt, Human
acaguggggaaugaa

SEQ ID NO: 1615590 - RNA, 13 nt, Human
acagugcaucuca

SEQ ID NO: 1615591 - RNA, 14 nt, Human
acaggcaaugcugg

SEQ ID NO: 1615592 - RNA, 23 nt, Human
acaggugugagucaccaagccca

SEQ ID NO: 1615593 - RNA, 22 nt, Human
acaggugugagucaccaagccc

SEQ ID NO: 1615594 - RNA, 19 nt, Human
acaggugugaaccaccaca

SEQ ID NO: 1615595 - RNA, 22 nt, Human
acagugagucgaggacagggag

SEQ ID NO: 1615596 - RNA, 14 nt, Human
acagcucuguccug

SEQ ID NO: 1615597 - RNA, 23 nt, Human
acagcuccuucuguccuacucug

SEQ ID NO: 1615598 - RNA, 18 nt, Human
acagcuccuucuguccua

SEQ ID NO: 1615599 - RNA, 16 nt, Human
acagcuccuucugucc

SEQ ID NO: 1615600 - RNA, 21 nt, Human
acagaggggguggccucccaa

SEQ ID NO: 1615601 - RNA, 19 nt, Human
acagaggggguggccuccc

SEQ ID NO: 1615602 - RNA, 18 nt, Human
acagaggggguggccucc

SEQ ID NO: 1615603 - RNA, 17 nt, Human
acagaggggguggccuc

SEQ ID NO: 1615604 - RNA, 17 nt, Human
acagcucuguccuggga

SEQ ID NO: 1615605 - RNA, 16 nt, Human
acagcucuguccuggg

SEQ ID NO: 1615606 - RNA, 23 nt, Human
acaggcaagcaccuccugccucg

SEQ ID NO: 1615607 - RNA, 20 nt, Human
acaggcaagcaccuccugcc

SEQ ID NO: 1615608 - RNA, 13 nt, Human
acagcugccuggg

SEQ ID NO: 1615609 - RNA, 16 nt, Human
acagcugccugcagua

SEQ ID NO: 1615610 - RNA, 12 nt, Human
acagcugccugc

SEQ ID NO: 1615611 - RNA, 20 nt, Human
accaaggcugauuaaaccaa

SEQ ID NO: 1615612 - RNA, 12 nt, Human
accaccugccca

SEQ ID NO: 1615613 - RNA, 19 nt, Human
accaaggcugauuaaacca

SEQ ID NO: 1615614 - RNA, 20 nt, Human
accagccccagugcccacag

SEQ ID NO: 1615615 - RNA, 19 nt, Human
accagccccagugcccaca

SEQ ID NO: 1615616 - RNA, 18 nt, Human
accagccccagugcccac

SEQ ID NO: 1615617 - RNA, 17 nt, Human
accagccccagugccca

SEQ ID NO: 1615618 - RNA, 16 nt, Human
accagccccagugccc

SEQ ID NO: 1615619 - RNA, 13 nt, Human
accagcagccugg

SEQ ID NO: 1615620 - RNA, 13 nt, Human
accagcagagcac

SEQ ID NO: 1615621 - RNA, 12 nt, Human
accagcagagca

SEQ ID NO: 1615622 - RNA, 14 nt, Human
accagcagaaaugc

SEQ ID NO: 1615623 - RNA, 20 nt, Human
acaugccucucucaggccaa

SEQ ID NO: 1615624 - RNA, 19 nt, Human
acaugccucucucaggcca

SEQ ID NO: 1615625 - RNA, 23 nt, Human
acaugucuuuucuugcaugaggc

SEQ ID NO: 1615626 - RNA, 14 nt, Human
acauuuauucugcu

SEQ ID NO: 1615627 - RNA, 17 nt, Human
acauuuccuaaauauau

SEQ ID NO: 1615628 - RNA, 16 nt, Human
acauuuccuaaauaua

SEQ ID NO: 1615629 - RNA, 23 nt, Human
accaucauugaaaucuuuuugcu

SEQ ID NO: 1615630 - RNA, 16 nt, Human
accaucccugaaggcc

SEQ ID NO: 1615631 - RNA, 15 nt, Human
accaucaagccacca

SEQ ID NO: 1615632 - RNA, 15 nt, Human
accaucauugaaauc

SEQ ID NO: 1615633 - RNA, 14 nt, Human
accaucaagccacc

SEQ ID NO: 1615634 - RNA, 17 nt, Human
accauaggucaccuuua

SEQ ID NO: 1615635 - RNA, 21 nt, Human
accauacuaauuauacccccu

SEQ ID NO: 1615636 - RNA, 16 nt, Human
accauacuaauuauac

SEQ ID NO: 1615637 - RNA, 13 nt, Human
accauacuaauua

SEQ ID NO: 1615638 - RNA, 15 nt, Human
acccacccuccuuuc

SEQ ID NO: 1615639 - RNA, 13 nt, Human
acccaugcugccc

SEQ ID NO: 1615640 - RNA, 15 nt, Human
acccacccccaccca

SEQ ID NO: 1615641 - RNA, 17 nt, Human
acccacccccacccaag

SEQ ID NO: 1615642 - RNA, 16 nt, Human
acagaagcuccaggua

SEQ ID NO: 1615643 - RNA, 14 nt, Human
acagacaaagcgug

SEQ ID NO: 1615644 - RNA, 23 nt, Human
acagaggccaugggccuccugug

SEQ ID NO: 1615645 - RNA, 21 nt, Human
acagaggccaugggccuccug

SEQ ID NO: 1615646 - RNA, 17 nt, Human
acagaggccaugggccu

SEQ ID NO: 1615647 - RNA, 14 nt, Human
acagaggcagcccc

SEQ ID NO: 1615648 - RNA, 13 nt, Human
acagaggcagccc

SEQ ID NO: 1615649 - RNA, 22 nt, Human
acacugugcugagucugaaggc

SEQ ID NO: 1615650 - RNA, 20 nt, Human
acacugggagaaaugaaaaa

SEQ ID NO: 1615651 - RNA, 16 nt, Human
acaaggauugcuacug

SEQ ID NO: 1615652 - RNA, 20 nt, Human
acaaggaugaucuaggaaga

SEQ ID NO: 1615653 - RNA, 14 nt, Human
acaauuuauuaugg

SEQ ID NO: 1615654 - RNA, 20 nt, Human
acaauuuuguuucuguacuu

SEQ ID NO: 1615655 - RNA, 13 nt, Human
acaauuuauuaug

SEQ ID NO: 1615656 - RNA, 21 nt, Human
acacgaauauugcugauggug

SEQ ID NO: 1615657 - RNA, 15 nt, Human
acacgaauauugcug

SEQ ID NO: 1615658 - RNA, 21 nt, Human
acaccacuacauucuguuaau

SEQ ID NO: 1615659 - RNA, 16 nt, Human
acacauuuuuuaaaug

SEQ ID NO: 1615660 - RNA, 18 nt, Human
acacauuuuuuaaaugca

SEQ ID NO: 1615661 - RNA, 19 nt, Human
acacauuuuuuaaaugcac

SEQ ID NO: 1615662 - RNA, 15 nt, Human
acaccacuacauucu

SEQ ID NO: 1615663 - RNA, 14 nt, Human
acacgaauauugcu

SEQ ID NO: 1615664 - RNA, 17 nt, Human
acaccacuacauucugu

SEQ ID NO: 1615665 - RNA, 20 nt, Human
acaccacuacauucuguuaa

SEQ ID NO: 1615666 - RNA, 21 nt, Human
acacagcucuucuccaggcug

SEQ ID NO: 1615667 - RNA, 20 nt, Human
acacagcucuucuccaggcu

SEQ ID NO: 1615668 - RNA, 22 nt, Human
acacagcucuucuccaggcugu

SEQ ID NO: 1615669 - RNA, 14 nt, Human
acacauuuuuuaaa

SEQ ID NO: 1615670 - RNA, 19 nt, Human
acacaaaaguuucucuuuu

SEQ ID NO: 1615671 - RNA, 18 nt, Human
aauuuugugaagcaaaau

SEQ ID NO: 1615672 - RNA, 16 nt, Human
aauuuugugcccccau

SEQ ID NO: 1615673 - RNA, 17 nt, Human
aauuuugugaagcaaaa

SEQ ID NO: 1615674 - RNA, 14 nt, Human
aauuuugauguuuu

SEQ ID NO: 1615675 - RNA, 11 nt, Human
aauuuuggaau

SEQ ID NO: 1615676 - RNA, 12 nt, Human
aauuuuggaauu

SEQ ID NO: 1615677 - RNA, 18 nt, Human
aauuuucaucuaggauuu

SEQ ID NO: 1615678 - RNA, 16 nt, Human
acaagaaaugaaagca

SEQ ID NO: 1615679 - RNA, 15 nt, Human
acaagaaaugaaagc

SEQ ID NO: 1615680 - RNA, 22 nt, Human
acaagaaaugaaagcagggacu

SEQ ID NO: 1615681 - RNA, 21 nt, Human
acaaggaugaauuaaguuuuu

SEQ ID NO: 1615682 - RNA, 18 nt, Human
acaaccuucuguggcuca

SEQ ID NO: 1615683 - RNA, 22 nt, Human
acaaaaugaaacgcaaccacca

SEQ ID NO: 1615684 - RNA, 13 nt, Human
acaaaaugaaacg

SEQ ID NO: 1615685 - RNA, 14 nt, Human
acaaaauggaauac

SEQ ID NO: 1615686 - RNA, 13 nt, Human
acaaaauggaaua

SEQ ID NO: 1615687 - RNA, 16 nt, Human
acaaagaaauuaugug

SEQ ID NO: 1615688 - RNA, 14 nt, Human
acaaagaaauuaug

SEQ ID NO: 1615689 - RNA, 12 nt, Human
acaaagaaauua

SEQ ID NO: 1615690 - RNA, 22 nt, Human
aauuucauaccuaucaucuuaa

SEQ ID NO: 1615691 - RNA, 21 nt, Human
aauuuccugggagcuuuugua

SEQ ID NO: 1615692 - RNA, 18 nt, Human
aauuuccugggagcuuuu

SEQ ID NO: 1615693 - RNA, 20 nt, Human
aauuuauuuaugggauccug

SEQ ID NO: 1615694 - RNA, 23 nt, Human
aauuuauuggcuuuucugaucca

SEQ ID NO: 1615695 - RNA, 21 nt, Human
aauuuauuggcuuuucugauc

SEQ ID NO: 1615696 - RNA, 20 nt, Human
aauuuauuggcuuuucugau

SEQ ID NO: 1615697 - RNA, 19 nt, Human
aauuuauuggcuuuucuga

SEQ ID NO: 1615698 - RNA, 17 nt, Human
aauuuauuggcuuuucu

SEQ ID NO: 1615699 - RNA, 19 nt, Human
aaugucacaggcaggucca

SEQ ID NO: 1615700 - RNA, 16 nt, Human
aaugucacaggcaggu

SEQ ID NO: 1615701 - RNA, 16 nt, Human
aauuggggauucuuaa

SEQ ID NO: 1615702 - RNA, 21 nt, Human
aaugguccgugcuaaggacuu

SEQ ID NO: 1615703 - RNA, 20 nt, Human
aauuggggauucuuaaaguu

SEQ ID NO: 1615704 - RNA, 17 nt, Human
aauuggggauucuuaaa

SEQ ID NO: 1615705 - RNA, 16 nt, Human
aauuguaaggaaugau

SEQ ID NO: 1615706 - RNA, 12 nt, Human
aauuguaaggaa

SEQ ID NO: 1615707 - RNA, 17 nt, Human
acucugucucaguccau

SEQ ID NO: 1615708 - RNA, 15 nt, Human
acucugucucagucc

SEQ ID NO: 1615709 - RNA, 21 nt, Human
acucugugucagguggggcag

SEQ ID NO: 1615710 - RNA, 19 nt, Human
acucugucucaaaaaaaca

SEQ ID NO: 1615711 - RNA, 20 nt, Human
acucuacuuagcaugucccu

SEQ ID NO: 1615712 - RNA, 21 nt, Human
acucuacuuagcaugucccua

SEQ ID NO: 1615713 - RNA, 20 nt, Human
acucuuaagaagacugcauu

SEQ ID NO: 1615714 - RNA, 15 nt, Human
acucuuaagaagacu

SEQ ID NO: 1615715 - RNA, 14 nt, Human
acucuuaagaagac

SEQ ID NO: 1615716 - RNA, 22 nt, Human
acugaugggcaacccccagccu

SEQ ID NO: 1615717 - RNA, 12 nt, Human
acugaugggcaa

SEQ ID NO: 1615718 - RNA, 22 nt, Human
acugauggcuaauguacugcau

SEQ ID NO: 1615719 - RNA, 13 nt, Human
acugaucucucgu

SEQ ID NO: 1615720 - RNA, 23 nt, Human
acugaccagccuccaugcugccu

SEQ ID NO: 1615721 - RNA, 23 nt, Human
acugacauuguuggccaaagcca

SEQ ID NO: 1615722 - RNA, 13 nt, Human
acugaccagccuc

SEQ ID NO: 1615723 - RNA, 20 nt, Human
acugaccagccuccaugcug

SEQ ID NO: 1615724 - RNA, 15 nt, Human
acugaccagccucca

SEQ ID NO: 1615725 - RNA, 22 nt, Human
acugauuuuuuuuuccuucagu

SEQ ID NO: 1615726 - RNA, 21 nt, Human
acugauuuuuuuuuccuucag

SEQ ID NO: 1615727 - RNA, 23 nt, Human
acugauuuuuuuuuccuucagug

SEQ ID NO: 1615728 - RNA, 23 nt, Human
acugaugggcaacccccagccug

SEQ ID NO: 1615729 - RNA, 13 nt, Human
acugauucuucag

SEQ ID NO: 1615730 - RNA, 12 nt, Human
acugauucuuca

SEQ ID NO: 1615731 - RNA, 22 nt, Human
acugauucuucagcaaaaauau

SEQ ID NO: 1615732 - RNA, 15 nt, Human
acugauucuucagca

SEQ ID NO: 1615733 - RNA, 15 nt, Human
acugcuuuuggucug

SEQ ID NO: 1615734 - RNA, 22 nt, Human
acugcccggcaggguccuagaa

SEQ ID NO: 1615735 - RNA, 20 nt, Human
acugcuuuuggucuguguga

SEQ ID NO: 1615736 - RNA, 16 nt, Human
acugcuuuuggucugu

SEQ ID NO: 1615737 - RNA, 15 nt, Human
acugcccggcagggu

SEQ ID NO: 1615738 - RNA, 18 nt, Human
acugccagucccccugcc

SEQ ID NO: 1615739 - RNA, 19 nt, Human
acugccagucccccugccc

SEQ ID NO: 1615740 - RNA, 22 nt, Human
acuugggaggcugagaugggag

SEQ ID NO: 1615741 - RNA, 17 nt, Human
acuuuaugcuaagugaa

SEQ ID NO: 1615742 - RNA, 12 nt, Human
acuuuaugcuaa

SEQ ID NO: 1615743 - RNA, 15 nt, Human
acuuuauuuuguguu

SEQ ID NO: 1615744 - RNA, 22 nt, Human
acuuucaggccacauggcuaaa

SEQ ID NO: 1615745 - RNA, 14 nt, Human
acuuaaaaaugguu

SEQ ID NO: 1615746 - RNA, 13 nt, Human
acuuaaaaauggu

SEQ ID NO: 1615747 - RNA, 21 nt, Human
acuuaaaaaugguuuaaaugg

SEQ ID NO: 1615748 - RNA, 14 nt, Human
acuuaaauaaugug

SEQ ID NO: 1615749 - RNA, 15 nt, Human
acuuaaauaauguga

SEQ ID NO: 1615750 - RNA, 22 nt, Human
acuuaaaauauuccugcauuug

SEQ ID NO: 1615751 - RNA, 19 nt, Human
acuucagcgguuuauauaa

SEQ ID NO: 1615752 - RNA, 20 nt, Human
acuucugccauauucuguug

SEQ ID NO: 1615753 - RNA, 13 nt, Human
acuucagcucugu

SEQ ID NO: 1615754 - RNA, 18 nt, Human
acuucagcgguuuauaua

SEQ ID NO: 1615755 - RNA, 20 nt, Human
acuucaaauccuugaagauu

SEQ ID NO: 1615756 - RNA, 18 nt, Human
acuucuuauacauuugau

SEQ ID NO: 1615757 - RNA, 17 nt, Human
acuucuuauacauuuga

SEQ ID NO: 1615758 - RNA, 20 nt, Human
accucugccucagaaaacaa

SEQ ID NO: 1615759 - RNA, 11 nt, Human
accugccaggg

SEQ ID NO: 1615760 - RNA, 13 nt, Human
accugccagggac

SEQ ID NO: 1615761 - RNA, 12 nt, Human
accugccaggga

SEQ ID NO: 1615762 - RNA, 18 nt, Human
accugccagggacagagg

SEQ ID NO: 1615763 - RNA, 16 nt, Human
accugccagggacaga

SEQ ID NO: 1615764 - RNA, 15 nt, Human
accugccagggacag

SEQ ID NO: 1615765 - RNA, 22 nt, Human
accugucuugccuuuuucauua

SEQ ID NO: 1615766 - RNA, 21 nt, Human
accugucuugccuuuuucauu

SEQ ID NO: 1615767 - RNA, 19 nt, Human
accugucuugccuuuuuca

SEQ ID NO: 1615768 - RNA, 23 nt, Human
accugccccuccucucugcccua

SEQ ID NO: 1615769 - RNA, 13 nt, Human
accugcccaaccu

SEQ ID NO: 1615770 - RNA, 18 nt, Human
accucugccucagaaaac

SEQ ID NO: 1615771 - RNA, 17 nt, Human
accucugccucagaaaa

SEQ ID NO: 1615772 - RNA, 17 nt, Human
accucuugagccuugaa

SEQ ID NO: 1615773 - RNA, 19 nt, Human
accucuugagccuugaacu

SEQ ID NO: 1615774 - RNA, 20 nt, Human
accucuugagccuugaacuu

SEQ ID NO: 1615775 - RNA, 21 nt, Human
accucuugagccuugaacuuu

SEQ ID NO: 1615776 - RNA, 13 nt, Human
accucaggccugg

SEQ ID NO: 1615777 - RNA, 12 nt, Human
accucaggccug

SEQ ID NO: 1615778 - RNA, 17 nt, Human
accgugaggccagagac

SEQ ID NO: 1615779 - RNA, 16 nt, Human
accgugaggccagaga

SEQ ID NO: 1615780 - RNA, 22 nt, Human
accucaggccugggggcugggc

SEQ ID NO: 1615781 - RNA, 14 nt, Human
accucaggccuggg

SEQ ID NO: 1615782 - RNA, 22 nt, Human
accucagguaaucgaccugccu

SEQ ID NO: 1615783 - RNA, 18 nt, Human
accucaggugagaagcag

SEQ ID NO: 1615784 - RNA, 23 nt, Human
accucagguaaucgaccugccuc

SEQ ID NO: 1615785 - RNA, 16 nt, Human
accccacacacgccag

SEQ ID NO: 1615786 - RNA, 22 nt, Human
acccugugauggggcccugccu

SEQ ID NO: 1615787 - RNA, 15 nt, Human
acccaugcugcccug

SEQ ID NO: 1615788 - RNA, 14 nt, Human
acccaugcugcccu

SEQ ID NO: 1615789 - RNA, 16 nt, Human
acccaugcugcccugu

SEQ ID NO: 1615790 - RNA, 17 nt, Human
acccuguuaccauuuug

SEQ ID NO: 1615791 - RNA, 14 nt, Human
accgugaggccaga

SEQ ID NO: 1615792 - RNA, 19 nt, Human
accgggccacagagaaagu

SEQ ID NO: 1615793 - RNA, 15 nt, Human
accgggccacagaga

SEQ ID NO: 1615794 - RNA, 20 nt, Human
accgggccacagagaaagua

SEQ ID NO: 1615795 - RNA, 19 nt, Human
accggcuggccuggccccu

SEQ ID NO: 1615796 - RNA, 20 nt, Human
accgggcacucagaagacac

SEQ ID NO: 1615797 - RNA, 18 nt, Human
accggcuggccuggcccc

SEQ ID NO: 1615798 - RNA, 17 nt, Human
accggcuggccuggccc

SEQ ID NO: 1615799 - RNA, 15 nt, Human
accggcuggccuggc

SEQ ID NO: 1615800 - RNA, 14 nt, Human
accggcuggccugg

SEQ ID NO: 1615801 - RNA, 19 nt, Human
acggacgaaccuugaaaac

SEQ ID NO: 1615802 - RNA, 15 nt, Human
acggaauaguuggcu

SEQ ID NO: 1615803 - RNA, 16 nt, Human
acggaagagccuugcg

SEQ ID NO: 1615804 - RNA, 15 nt, Human
acggaagagccuugc

SEQ ID NO: 1615805 - RNA, 19 nt, Human
acgcuggagugcagugagc

SEQ ID NO: 1615806 - RNA, 11 nt, Human
acguggcugcu

SEQ ID NO: 1615807 - RNA, 15 nt, Human
acuaauagacaauuu

SEQ ID NO: 1615808 - RNA, 12 nt, Human
acgucugugcca

SEQ ID NO: 1615809 - RNA, 23 nt, Human
acgucugacaggcaaugcuggcu

SEQ ID NO: 1615810 - RNA, 11 nt, Human
accugugucuc

SEQ ID NO: 1615811 - RNA, 18 nt, Human
acuaguauuucuaugaaa

SEQ ID NO: 1615812 - RNA, 19 nt, Human
acuaguauuucuaugaaau

SEQ ID NO: 1615813 - RNA, 16 nt, Human
acuauuguuagucucu

SEQ ID NO: 1615814 - RNA, 17 nt, Human
acuagggaagauaauau

SEQ ID NO: 1615815 - RNA, 19 nt, Human
cugagacucgcgacaaugc

SEQ ID NO: 1615816 - RNA, 17 nt, Human
cugagacucgcgacaau

SEQ ID NO: 1615817 - RNA, 20 nt, Human
cugagacucgcgacaaugca

SEQ ID NO: 1615818 - RNA, 13 nt, Human
cugcauguuacau

SEQ ID NO: 1615819 - RNA, 15 nt, Human
cugcauguuugugau

SEQ ID NO: 1615820 - RNA, 20 nt, Human
cugcauuuaaaagauacagu

SEQ ID NO: 1615821 - RNA, 22 nt, Human
cugcauuuaaaagauacaguua

SEQ ID NO: 1615822 - RNA, 13 nt, Human
cugcauuugugaa

SEQ ID NO: 1615823 - RNA, 20 nt, Human
cugcauucaggaucaaaccc

SEQ ID NO: 1615824 - RNA, 17 nt, Human
cugccaaugggagcuca

SEQ ID NO: 1615825 - RNA, 15 nt, Human
cugccaaugggagcu

SEQ ID NO: 1615826 - RNA, 22 nt, Human
cugcauuugugaaaugauggug

SEQ ID NO: 1615827 - RNA, 17 nt, Human
cugcauuugugaaauga

SEQ ID NO: 1615828 - RNA, 15 nt, Human
cugcauuugugaaau

SEQ ID NO: 1615829 - RNA, 14 nt, Human
cugcauuugugaaa

SEQ ID NO: 1615830 - RNA, 23 nt, Human
cugccauauucuguuggccagug

SEQ ID NO: 1615831 - RNA, 22 nt, Human
cugccauauucuguuggccagu

SEQ ID NO: 1615832 - RNA, 21 nt, Human
cugccauauucuguuggccag

SEQ ID NO: 1615833 - RNA, 20 nt, Human
cugccauauucuguuggcca

SEQ ID NO: 1615834 - RNA, 15 nt, Human
cugccagggacagag

SEQ ID NO: 1615835 - RNA, 12 nt, Human
cugccagggaca

SEQ ID NO: 1615836 - RNA, 11 nt, Human
cugccagggac

SEQ ID NO: 1615837 - RNA, 12 nt, Human
cugccauccagg

SEQ ID NO: 1615838 - RNA, 19 nt, Human
cugccccagggcucccggc

SEQ ID NO: 1615839 - RNA, 15 nt, Human
cugcccccucugccc

SEQ ID NO: 1615840 - RNA, 14 nt, Human
cugcccccucugcc

SEQ ID NO: 1615841 - RNA, 18 nt, Human
cugcccugugggccccca

SEQ ID NO: 1615842 - RNA, 16 nt, Human
cugcccugugggcccc

SEQ ID NO: 1615843 - RNA, 15 nt, Human
cugcccugugggccc

SEQ ID NO: 1615844 - RNA, 13 nt, Human
cugcccugugagu

SEQ ID NO: 1615845 - RNA, 12 nt, Human
cugcccugugag

SEQ ID NO: 1615846 - RNA, 23 nt, Human
cugcccugguuuccugcccuggg

SEQ ID NO: 1615847 - RNA, 22 nt, Human
cugcccugguuuccugcccugg

SEQ ID NO: 1615848 - RNA, 21 nt, Human
cugcccuggugcugccacacu

SEQ ID NO: 1615849 - RNA, 20 nt, Human
cugcccuggugcugccacac

SEQ ID NO: 1615850 - RNA, 22 nt, Human
cugccccucaacucuccuccag

SEQ ID NO: 1615851 - RNA, 14 nt, Human
cugccccucaacuc

SEQ ID NO: 1615852 - RNA, 19 nt, Human
cugcccccucugcccugcg

SEQ ID NO: 1615853 - RNA, 18 nt, Human
cugcccccucugcccugc

SEQ ID NO: 1615854 - RNA, 17 nt, Human
cugcccccucugcccug

SEQ ID NO: 1615855 - RNA, 16 nt, Human
cugcccccucugcccu

SEQ ID NO: 1615856 - RNA, 19 nt, Human
cugcccuggugcugccaca

SEQ ID NO: 1615857 - RNA, 18 nt, Human
cugcccuggugcugccac

SEQ ID NO: 1615858 - RNA, 17 nt, Human
cugcccuggugcugcca

SEQ ID NO: 1615859 - RNA, 19 nt, Human
cugcccugugggcccccaa

SEQ ID NO: 1615860 - RNA, 19 nt, Human
cugccucgaacuggcugca

SEQ ID NO: 1615861 - RNA, 18 nt, Human
cugccucgaacuggcugc

SEQ ID NO: 1615862 - RNA, 17 nt, Human
cugccucgaacuggcug

SEQ ID NO: 1615863 - RNA, 15 nt, Human
cugccucgaacuggc

SEQ ID NO: 1615864 - RNA, 23 nt, Human
cugccugggaucccucauccuca

SEQ ID NO: 1615865 - RNA, 15 nt, Human
cugccuguucagcuc

SEQ ID NO: 1615866 - RNA, 14 nt, Human
cugccuguucagcu

SEQ ID NO: 1615867 - RNA, 19 nt, Human
cugccuguugggccaggag

SEQ ID NO: 1615868 - RNA, 18 nt, Human
cugccuguugggccagga

SEQ ID NO: 1615869 - RNA, 16 nt, Human
cugccuguugggccag

SEQ ID NO: 1615870 - RNA, 16 nt, Human
cugcuaauuccccaga

SEQ ID NO: 1615871 - RNA, 15 nt, Human
cugcuacagagcaga

SEQ ID NO: 1615872 - RNA, 11 nt, Human
cugcugacagu

SEQ ID NO: 1615873 - RNA, 23 nt, Human
cugcugacagacacaggcccggc

SEQ ID NO: 1615874 - RNA, 21 nt, Human
cugcugacagacacaggcccg

SEQ ID NO: 1615875 - RNA, 20 nt, Human
cugcugacagacacaggccc

SEQ ID NO: 1615876 - RNA, 19 nt, Human
cugcugacagacacaggcc

SEQ ID NO: 1615877 - RNA, 18 nt, Human
cugcugacagacacaggc

SEQ ID NO: 1615878 - RNA, 15 nt, Human
cugcugacagacaca

SEQ ID NO: 1615879 - RNA, 21 nt, Human
cuggaaaucaggguuaguauu

SEQ ID NO: 1615880 - RNA, 16 nt, Human
cuggaaauauuaagaa

SEQ ID NO: 1615881 - RNA, 23 nt, Human
cugcuucagccucccgaguagcu

SEQ ID NO: 1615882 - RNA, 18 nt, Human
cugcuuuuuauggccugu

SEQ ID NO: 1615883 - RNA, 17 nt, Human
cuggaacacuaaugagg

SEQ ID NO: 1615884 - RNA, 13 nt, Human
cuggacugugugc

SEQ ID NO: 1615885 - RNA, 13 nt, Human
cugcuuaacuuca

SEQ ID NO: 1615886 - RNA, 13 nt, Human
cugcuucagccuc

SEQ ID NO: 1615887 - RNA, 20 nt, Human
cugcuuaacuucacauauug

SEQ ID NO: 1615888 - RNA, 15 nt, Human
cugcuuaacuucaca

SEQ ID NO: 1615889 - RNA, 17 nt, Human
cugcuuaacuucacaua

SEQ ID NO: 1615890 - RNA, 16 nt, Human
cugcuucagccucccg

SEQ ID NO: 1615891 - RNA, 14 nt, Human
cugcuucagccucc

SEQ ID NO: 1615892 - RNA, 22 nt, Human
cugcuuuuuaaagaaugcucuu

SEQ ID NO: 1615893 - RNA, 17 nt, Human
cugcuuuuuauggccug

SEQ ID NO: 1615894 - RNA, 10 nt, Human
cugggacagg

SEQ ID NO: 1615895 - RNA, 18 nt, Human
cuggcucccacaggcccu

SEQ ID NO: 1615896 - RNA, 13 nt, Human
cugggacacaguu

SEQ ID NO: 1615897 - RNA, 12 nt, Human
cugggacacagu

SEQ ID NO: 1615898 - RNA, 20 nt, Human
cuggcuccagcuggccggga

SEQ ID NO: 1615899 - RNA, 18 nt, Human
cuggcuccagcuggccgg

SEQ ID NO: 1615900 - RNA, 14 nt, Human
cuggcuccagcugg

SEQ ID NO: 1615901 - RNA, 13 nt, Human
cuggcuccagcug

SEQ ID NO: 1615902 - RNA, 15 nt, Human
cuggcucccacaggc

SEQ ID NO: 1615903 - RNA, 21 nt, Human
cuggccccucagggucccugg

SEQ ID NO: 1615904 - RNA, 20 nt, Human
cuggccccucagggucccug

SEQ ID NO: 1615905 - RNA, 18 nt, Human
cuggccccucaggguccc

SEQ ID NO: 1615906 - RNA, 17 nt, Human
cuggccccucagggucc

SEQ ID NO: 1615907 - RNA, 15 nt, Human
cuggcagcucagaga

SEQ ID NO: 1615908 - RNA, 13 nt, Human
cuggccccucagg

SEQ ID NO: 1615909 - RNA, 14 nt, Human
cuggcagcucagag

SEQ ID NO: 1615910 - RNA, 13 nt, Human
cuggcagcucaga

SEQ ID NO: 1615911 - RNA, 12 nt, Human
cuggcagcucag

SEQ ID NO: 1615912 - RNA, 16 nt, Human
cuggacugugugcuca

SEQ ID NO: 1615913 - RNA, 17 nt, Human
cugggcagaaggaagac

SEQ ID NO: 1615914 - RNA, 22 nt, Human
cugggcagcugccuccccuccu

SEQ ID NO: 1615915 - RNA, 20 nt, Human
cugggcagcugccuccccuc

SEQ ID NO: 1615916 - RNA, 21 nt, Human
cugggcagcugccuccccucc

SEQ ID NO: 1615917 - RNA, 17 nt, Human
cuggggaaccugacccc

SEQ ID NO: 1615918 - RNA, 16 nt, Human
cuggggaaccugaccc

SEQ ID NO: 1615919 - RNA, 15 nt, Human
cuggggaaccugacc

SEQ ID NO: 1615920 - RNA, 19 nt, Human
cugggcagcugccuccccu

SEQ ID NO: 1615921 - RNA, 18 nt, Human
cugggcagaaggaagacu

SEQ ID NO: 1615922 - RNA, 16 nt, Human
cuggggccgaaagaac

SEQ ID NO: 1615923 - RNA, 18 nt, Human
cuggggccaggcuggguc

SEQ ID NO: 1615924 - RNA, 23 nt, Human
cuggugacuuuccucuuuggucu

SEQ ID NO: 1615925 - RNA, 17 nt, Human
cuggguguggcgcagca

SEQ ID NO: 1615926 - RNA, 16 nt, Human
cuggguguggcgcagc

SEQ ID NO: 1615927 - RNA, 23 nt, Human
cuggguggcaccagcagccugga

SEQ ID NO: 1615928 - RNA, 14 nt, Human
cuggguucacugca

SEQ ID NO: 1615929 - RNA, 15 nt, Human
cuggguucacugcaa

SEQ ID NO: 1615930 - RNA, 22 nt, Human
cuggguuccagcaauucuccug

SEQ ID NO: 1615931 - RNA, 22 nt, Human
cuggguuccuuccucugagccu

SEQ ID NO: 1615932 - RNA, 18 nt, Human
cuggguuccuuccucuga

SEQ ID NO: 1615933 - RNA, 21 nt, Human
cuggugacuuuccucuuuggu

SEQ ID NO: 1615934 - RNA, 20 nt, Human
cuggugacuuuccucuuugg

SEQ ID NO: 1615935 - RNA, 15 nt, Human
cuggugacuuuccuc

SEQ ID NO: 1615936 - RNA, 14 nt, Human
cuggguucuaccca

SEQ ID NO: 1615937 - RNA, 23 nt, Human
cuggguuccuuccucugagccuu

SEQ ID NO: 1615938 - RNA, 21 nt, Human
cugguuuccugcccugggagg

SEQ ID NO: 1615939 - RNA, 18 nt, Human
cugguuuccugcccuggg

SEQ ID NO: 1615940 - RNA, 22 nt, Human
cugguuuccugcccugggaggc

SEQ ID NO: 1615941 - RNA, 21 nt, Human
cugucagcuccccucggagaa

SEQ ID NO: 1615942 - RNA, 18 nt, Human
cugucagccauuccuguu

SEQ ID NO: 1615943 - RNA, 23 nt, Human
cugucagcuccccucggagaaga

SEQ ID NO: 1615944 - RNA, 18 nt, Human
cugucauuugagcagggc

SEQ ID NO: 1615945 - RNA, 17 nt, Human
cugucauuugagcaggg

SEQ ID NO: 1615946 - RNA, 20 nt, Human
cugucauuugagcagggcuc

SEQ ID NO: 1615947 - RNA, 12 nt, Human
cuguccugccua

SEQ ID NO: 1615948 - RNA, 21 nt, Human
cuguaggaagguuaauguuca

SEQ ID NO: 1615949 - RNA, 15 nt, Human
cuguacuuuuuggca

SEQ ID NO: 1615950 - RNA, 14 nt, Human
cuguacuuuuuggc

SEQ ID NO: 1615951 - RNA, 23 nt, Human
cuguacuugcucuugaugccugg

SEQ ID NO: 1615952 - RNA, 22 nt, Human
cuguacuugcucuugaugccug

SEQ ID NO: 1615953 - RNA, 15 nt, Human
cugucgcccagucug

SEQ ID NO: 1615954 - RNA, 13 nt, Human
cugucgcccaguc

SEQ ID NO: 1615955 - RNA, 16 nt, Human
cugucgcccaggcugg

SEQ ID NO: 1615956 - RNA, 19 nt, Human
cugucgagaaacagccugu

SEQ ID NO: 1615957 - RNA, 15 nt, Human
cugugaagagaacca

SEQ ID NO: 1615958 - RNA, 21 nt, Human
cugugagaugcuagaacuccc

SEQ ID NO: 1615959 - RNA, 16 nt, Human
cugugagaugcuagaa

SEQ ID NO: 1615960 - RNA, 15 nt, Human
cugugcucuggacag

SEQ ID NO: 1615961 - RNA, 14 nt, Human
cugugcucuggaca

SEQ ID NO: 1615962 - RNA, 19 nt, Human
cugugcuccauggcugcca

SEQ ID NO: 1615963 - RNA, 18 nt, Human
cuuuuaugugaaacaugu

SEQ ID NO: 1615964 - RNA, 14 nt, Human
cuuuuaugugaaac

SEQ ID NO: 1615965 - RNA, 13 nt, Human
cuuuuauaaacuu

SEQ ID NO: 1615966 - RNA, 14 nt, Human
cuuuuauaaacuuu

SEQ ID NO: 1615967 - RNA, 20 nt, Human
cuuuguauagaaccucuuug

SEQ ID NO: 1615968 - RNA, 11 nt, Human
cuuuguauaga

SEQ ID NO: 1615969 - RNA, 16 nt, Human
cuuucuagccagagga

SEQ ID NO: 1615970 - RNA, 22 nt, Human
cuuugauauuuucaacgcagcc

SEQ ID NO: 1615971 - RNA, 15 nt, Human
cuuucuagccagagg

SEQ ID NO: 1615972 - RNA, 13 nt, Human
cuuuguaaugaaa

SEQ ID NO: 1615973 - RNA, 15 nt, Human
cuuuguaaauuguca

SEQ ID NO: 1615974 - RNA, 21 nt, Human
cuuugggcugcccuggugcug

SEQ ID NO: 1615975 - RNA, 20 nt, Human
cuuugggcugcccuggugcu

SEQ ID NO: 1615976 - RNA, 19 nt, Human
cuuugggcugcccuggugc

SEQ ID NO: 1615977 - RNA, 15 nt, Human
cuuugggcugcccug

SEQ ID NO: 1615978 - RNA, 14 nt, Human
cuuugggcugcccu

SEQ ID NO: 1615979 - RNA, 22 nt, Human
cuuuccugaggcugggcucccu

SEQ ID NO: 1615980 - RNA, 20 nt, Human
cuuucagccaagaauucuua

SEQ ID NO: 1615981 - RNA, 23 nt, Human
cuuucagccaagaauucuuaaau

SEQ ID NO: 1615982 - RNA, 16 nt, Human
cuuucacaaccuucug

SEQ ID NO: 1615983 - RNA, 14 nt, Human
cuuucacaaccuuc

SEQ ID NO: 1615984 - RNA, 13 nt, Human
cuuuugccauuga

SEQ ID NO: 1615985 - RNA, 23 nt, Human
cuuuugcccacacuugggagcaa

SEQ ID NO: 1615986 - RNA, 16 nt, Human
cuuuugccguuauuaa

SEQ ID NO: 1615987 - RNA, 18 nt, Human
cuuuuggaagguauuuaa

SEQ ID NO: 1615988 - RNA, 13 nt, Human
cuuuuggagucag

SEQ ID NO: 1615989 - RNA, 18 nt, Human
cuuuugucuaugggacuc

SEQ ID NO: 1615990 - RNA, 19 nt, Human
cuuuuguagaagucacauu

SEQ ID NO: 1615991 - RNA, 15 nt, Human
cuuuuggcauuuuac

SEQ ID NO: 1615992 - RNA, 23 nt, Human
cuuuuuuggcugcugaaggcucg

SEQ ID NO: 1615993 - RNA, 12 nt, Human
cuuuugugcauu

SEQ ID NO: 1615994 - RNA, 13 nt, Human
cuuuugugcauua

SEQ ID NO: 1615995 - RNA, 20 nt, Human
cuuuuuuuuuuuugagacag

SEQ ID NO: 1615996 - RNA, 21 nt, Human
cuuuuuuuuuuuugagacaga

SEQ ID NO: 1615997 - RNA, 14 nt, Human
gaaaauuuuaaaaa

SEQ ID NO: 1615998 - RNA, 14 nt, Human
gaaaaacugauuuu

SEQ ID NO: 1615999 - RNA, 21 nt, Human
gaaaauggaagacagcucuua

SEQ ID NO: 1616000 - RNA, 23 nt, Human
gaaaaugcuguauuagucacaga

SEQ ID NO: 1616001 - RNA, 18 nt, Human
gaaaagaaaaaugagccu

SEQ ID NO: 1616002 - RNA, 23 nt, Human
gaaaauggacguguuaugacucc

SEQ ID NO: 1616003 - RNA, 19 nt, Human
gaaaauggacguguuauga

SEQ ID NO: 1616004 - RNA, 15 nt, Human
gaaaauguaugugua

SEQ ID NO: 1616005 - RNA, 17 nt, Human
gaaauauuuauuuuaau

SEQ ID NO: 1616006 - RNA, 19 nt, Human
gaaagggacuuggaagcuc

SEQ ID NO: 1616007 - RNA, 20 nt, Human
gaaagggacgcuacccggga

SEQ ID NO: 1616008 - RNA, 22 nt, Human
gaaagggacuuggaagcuccgc

SEQ ID NO: 1616009 - RNA, 20 nt, Human
gaaaucaaauaugcaaagca

SEQ ID NO: 1616010 - RNA, 19 nt, Human
gaaaucaaauaugcaaagc

SEQ ID NO: 1616011 - RNA, 21 nt, Human
gaaaucaaauaugcaaagcac

SEQ ID NO: 1616012 - RNA, 18 nt, Human
gaaaucaaauaugcaaag

SEQ ID NO: 1616013 - RNA, 22 nt, Human
gaaauauuuauuuuaauaaugu

SEQ ID NO: 1616014 - RNA, 18 nt, Human
gaaauauuuauuuuaaua

SEQ ID NO: 1616015 - RNA, 17 nt, Human
gaaagacuauucaaaca

SEQ ID NO: 1616016 - RNA, 21 nt, Human
gaaaggcuccaggagcagcca

SEQ ID NO: 1616017 - RNA, 22 nt, Human
gaaaggcuccaggagcagccac

SEQ ID NO: 1616018 - RNA, 15 nt, Human
gaaagacuauucaaa

SEQ ID NO: 1616019 - RNA, 14 nt, Human
gaaagacuauucaa

SEQ ID NO: 1616020 - RNA, 20 nt, Human
gaaagacuaucuaaauguug

SEQ ID NO: 1616021 - RNA, 21 nt, Human
gaaagaaaauaccaaggaaca

SEQ ID NO: 1616022 - RNA, 15 nt, Human
gaaacuuuuggaagg

SEQ ID NO: 1616023 - RNA, 13 nt, Human
gaaacuuuuggaa

SEQ ID NO: 1616024 - RNA, 23 nt, Human
cuucugacccaugcugcccugug

SEQ ID NO: 1616025 - RNA, 22 nt, Human
cuucugacccaugcugcccugu

SEQ ID NO: 1616026 - RNA, 21 nt, Human
cuucugacccaugcugcccug

SEQ ID NO: 1616027 - RNA, 20 nt, Human
cuucugacccaugcugcccu

SEQ ID NO: 1616028 - RNA, 15 nt, Human
cuucugccauauucu

SEQ ID NO: 1616029 - RNA, 21 nt, Human
cuucuguugcugccucaugcu

SEQ ID NO: 1616030 - RNA, 23 nt, Human
cuucuucagagacuccugcaggc

SEQ ID NO: 1616031 - RNA, 20 nt, Human
cuucuguugcugccucaugc

SEQ ID NO: 1616032 - RNA, 19 nt, Human
cuucuguugcugccucaug

SEQ ID NO: 1616033 - RNA, 18 nt, Human
cuucuguugcugccucau

SEQ ID NO: 1616034 - RNA, 17 nt, Human
cuucuguugcugccuca

SEQ ID NO: 1616035 - RNA, 23 nt, Human
cuucuaaguaaaaccacagcagu

SEQ ID NO: 1616036 - RNA, 22 nt, Human
cuucuaaguaaaaccacagcag

SEQ ID NO: 1616037 - RNA, 17 nt, Human
cuuccugcaacaccuug

SEQ ID NO: 1616038 - RNA, 13 nt, Human
cuucuagaaccag

SEQ ID NO: 1616039 - RNA, 17 nt, Human
cuucuagaaccaggcaa

SEQ ID NO: 1616040 - RNA, 20 nt, Human
cuuggcgcugccccuggcag

SEQ ID NO: 1616041 - RNA, 17 nt, Human
cuuggcgcugccccugg

SEQ ID NO: 1616042 - RNA, 14 nt, Human
cuuggcgcugcccc

SEQ ID NO: 1616043 - RNA, 12 nt, Human
cuuggcgcugcc

SEQ ID NO: 1616044 - RNA, 13 nt, Human
cuugaugaagaag

SEQ ID NO: 1616045 - RNA, 12 nt, Human
cuugaugccugg

SEQ ID NO: 1616046 - RNA, 13 nt, Human
cuugaugccuggc

SEQ ID NO: 1616047 - RNA, 15 nt, Human
cuugccuuuuucauu

SEQ ID NO: 1616048 - RNA, 14 nt, Human
cuugccuuuuucau

SEQ ID NO: 1616049 - RNA, 23 nt, Human
cuugccuuuuucauuauuuuauu

SEQ ID NO: 1616050 - RNA, 22 nt, Human
cuugccuuuuucauuauuuuau

SEQ ID NO: 1616051 - RNA, 20 nt, Human
cuugccuuuuucauuauuuu

SEQ ID NO: 1616052 - RNA, 12 nt, Human
cuugaugaagaa

SEQ ID NO: 1616053 - RNA, 20 nt, Human
cuugacagggcacaccgggc

SEQ ID NO: 1616054 - RNA, 13 nt, Human
cuugacagggcac

SEQ ID NO: 1616055 - RNA, 15 nt, Human
cuugacagggcacac

SEQ ID NO: 1616056 - RNA, 14 nt, Human
cuugacagggcaca

SEQ ID NO: 1616057 - RNA, 19 nt, Human
cuugaauuguaaggaauga

SEQ ID NO: 1616058 - RNA, 16 nt, Human
cuuauggaacacucug

SEQ ID NO: 1616059 - RNA, 13 nt, Human
cuuauggaacacu

SEQ ID NO: 1616060 - RNA, 21 nt, Human
cuuauggaacacucugagacu

SEQ ID NO: 1616061 - RNA, 20 nt, Human
cuuauggaacacucugagac

SEQ ID NO: 1616062 - RNA, 19 nt, Human
cuuauggaacacucugaga

SEQ ID NO: 1616063 - RNA, 17 nt, Human
cuuauggaacacucuga

SEQ ID NO: 1616064 - RNA, 19 nt, Human
cuucacggaagagccuugc

SEQ ID NO: 1616065 - RNA, 15 nt, Human
cuucacggaagagcc

SEQ ID NO: 1616066 - RNA, 22 nt, Human
cuucaccuuuguccccaccgca

SEQ ID NO: 1616067 - RNA, 20 nt, Human
cuuauuguagcauccuggaa

SEQ ID NO: 1616068 - RNA, 21 nt, Human
cuucaccuuuguccccaccgc

SEQ ID NO: 1616069 - RNA, 23 nt, Human
cuuauuguagcauccuggaauau

SEQ ID NO: 1616070 - RNA, 19 nt, Human
cugugcugagucugaaggc

SEQ ID NO: 1616071 - RNA, 14 nt, Human
cugugcugagucug

SEQ ID NO: 1616072 - RNA, 12 nt, Human
cugugcugaguc

SEQ ID NO: 1616073 - RNA, 23 nt, Human
cuucccaccucucucacuccuug

SEQ ID NO: 1616074 - RNA, 21 nt, Human
cuucccaccucucucacuccu

SEQ ID NO: 1616075 - RNA, 11 nt, Human
cuucccaccuc

SEQ ID NO: 1616076 - RNA, 21 nt, Human
cuuccauaaucuggacuccuc

SEQ ID NO: 1616077 - RNA, 11 nt, Human
cuuccauaauc

SEQ ID NO: 1616078 - RNA, 21 nt, Human
cuuccagugaggcucugcccu

SEQ ID NO: 1616079 - RNA, 23 nt, Human
cuuccagugaggcucugcccuug

SEQ ID NO: 1616080 - RNA, 22 nt, Human
cuuccagugaggcucugcccuu

SEQ ID NO: 1616081 - RNA, 15 nt, Human
cuucacuguaaaaua

SEQ ID NO: 1616082 - RNA, 17 nt, Human
cuucagagacuccugca

SEQ ID NO: 1616083 - RNA, 19 nt, Human
cuucagagacuccugcagg

SEQ ID NO: 1616084 - RNA, 18 nt, Human
cuucagagacuccugcag

SEQ ID NO: 1616085 - RNA, 20 nt, Human
cuucagagacuccugcaggc

SEQ ID NO: 1616086 - RNA, 21 nt, Human
gaugaucuuugcagacaggca

SEQ ID NO: 1616087 - RNA, 20 nt, Human
gaugaucuuugcagacaggc

SEQ ID NO: 1616088 - RNA, 21 nt, Human
gaugaugaaaugaggucagag

SEQ ID NO: 1616089 - RNA, 16 nt, Human
gaucucuugagccugg

SEQ ID NO: 1616090 - RNA, 12 nt, Human
gaucucuugagc

SEQ ID NO: 1616091 - RNA, 17 nt, Human
gaucucuugagccuggg

SEQ ID NO: 1616092 - RNA, 18 nt, Human
gaucucuugagccuggga

SEQ ID NO: 1616093 - RNA, 15 nt, Human
gaucucuaacuucac

SEQ ID NO: 1616094 - RNA, 22 nt, Human
gauccaguuuuguuuggaccaa

SEQ ID NO: 1616095 - RNA, 17 nt, Human
gauccaguuuuguuugg

SEQ ID NO: 1616096 - RNA, 11 nt, Human
gauccaguuuu

SEQ ID NO: 1616097 - RNA, 16 nt, Human
gauauuuugcuuugug

SEQ ID NO: 1616098 - RNA, 15 nt, Human
gauauuuuuuucuuu

SEQ ID NO: 1616099 - RNA, 17 nt, Human
gauauuuuuuucuuuuc

SEQ ID NO: 1616100 - RNA, 17 nt, Human
gauuagggagagaagau

SEQ ID NO: 1616101 - RNA, 18 nt, Human
gauuagagaguguugaaa

SEQ ID NO: 1616102 - RNA, 14 nt, Human
gauuagagaguguu

SEQ ID NO: 1616103 - RNA, 21 nt, Human
gauuauucacugauuugacau

SEQ ID NO: 1616104 - RNA, 16 nt, Human
gauuauucacugauuu

SEQ ID NO: 1616105 - RNA, 15 nt, Human
gauuauucacugauu

SEQ ID NO: 1616106 - RNA, 13 nt, Human
gauuauucacuga

SEQ ID NO: 1616107 - RNA, 14 nt, Human
gauuaccagggacu

SEQ ID NO: 1616108 - RNA, 18 nt, Human
gauuacugccuauuuuaa

SEQ ID NO: 1616109 - RNA, 23 nt, Human
gauuagaauucuguauagauuag

SEQ ID NO: 1616110 - RNA, 15 nt, Human
gauuagaauucugua

SEQ ID NO: 1616111 - RNA, 14 nt, Human
gauuagaauucugu

SEQ ID NO: 1616112 - RNA, 16 nt, Human
gaugugaacacaucag

SEQ ID NO: 1616113 - RNA, 14 nt, Human
gaugugaacacauc

SEQ ID NO: 1616114 - RNA, 20 nt, Human
gauuacaggugugagccacc

SEQ ID NO: 1616115 - RNA, 20 nt, Human
gauuacaggugugaaccacc

SEQ ID NO: 1616116 - RNA, 16 nt, Human
gaguuuagcuggaaaa

SEQ ID NO: 1616117 - RNA, 16 nt, Human
gaguuguuacauuuuu

SEQ ID NO: 1616118 - RNA, 20 nt, Human
gaguuguuacauuuuuaagu

SEQ ID NO: 1616119 - RNA, 13 nt, Human
gagugcagugagc

SEQ ID NO: 1616120 - RNA, 20 nt, Human
gaguuugggguaugggagag

SEQ ID NO: 1616121 - RNA, 13 nt, Human
gaggucuguucuu

SEQ ID NO: 1616122 - RNA, 14 nt, Human
gaggucuguucuuu

SEQ ID NO: 1616123 - RNA, 11 nt, Human
gaggugggagg

SEQ ID NO: 1616124 - RNA, 12 nt, Human
gaggugggaucc

SEQ ID NO: 1616125 - RNA, 13 nt, Human
gaggugggauccu

SEQ ID NO: 1616126 - RNA, 12 nt, Human
gagugagcuggu

SEQ ID NO: 1616127 - RNA, 21 nt, Human
gagucccaccuuggcugcagg

SEQ ID NO: 1616128 - RNA, 12 nt, Human
gagugcagugag

SEQ ID NO: 1616129 - RNA, 11 nt, Human
gagugcaguga

SEQ ID NO: 1616130 - RNA, 14 nt, Human
gagucaccaagccc

SEQ ID NO: 1616131 - RNA, 13 nt, Human
gagucaccaagcc

SEQ ID NO: 1616132 - RNA, 15 nt, Human
gagucaccaagccca

SEQ ID NO: 1616133 - RNA, 20 nt, Human
gagucccaccuuggcugcag

SEQ ID NO: 1616134 - RNA, 16 nt, Human
gagucccaccuuggcu

SEQ ID NO: 1616135 - RNA, 20 nt, Human
gauauguaccuaacgaagua

SEQ ID NO: 1616136 - RNA, 14 nt, Human
gauaugugaacagu

SEQ ID NO: 1616137 - RNA, 13 nt, Human
gauaugugaacag

SEQ ID NO: 1616138 - RNA, 17 nt, Human
gauacuugaaaauuaac

SEQ ID NO: 1616139 - RNA, 16 nt, Human
gauacuugaaaauuaa

SEQ ID NO: 1616140 - RNA, 14 nt, Human
gauacccaucccau

SEQ ID NO: 1616141 - RNA, 13 nt, Human
gauacccauccca

SEQ ID NO: 1616142 - RNA, 16 nt, Human
gauacuacaguuuguu

SEQ ID NO: 1616143 - RNA, 11 nt, Human
gauacuacagu

SEQ ID NO: 1616144 - RNA, 14 nt, Human
gcagccaggccaca

SEQ ID NO: 1616145 - RNA, 13 nt, Human
gcagccaggccac

SEQ ID NO: 1616146 - RNA, 16 nt, Human
gcagccaggccacaag

SEQ ID NO: 1616147 - RNA, 12 nt, Human
gcagccaggcca

SEQ ID NO: 1616148 - RNA, 14 nt, Human
gcagccacuauugu

SEQ ID NO: 1616149 - RNA, 16 nt, Human
gcagccacauuccuga

SEQ ID NO: 1616150 - RNA, 14 nt, Human
gcauacguacacau

SEQ ID NO: 1616151 - RNA, 17 nt, Human
gcauaccacuuuuguuc

SEQ ID NO: 1616152 - RNA, 20 nt, Human
gcauaccacuuuuguucuug

SEQ ID NO: 1616153 - RNA, 22 nt, Human
gcauaacguauaaaagccuguu

SEQ ID NO: 1616154 - RNA, 23 nt, Human
gcauaacauaaaucugugaacuu

SEQ ID NO: 1616155 - RNA, 21 nt, Human
gcauaacauaaaucugugaac

SEQ ID NO: 1616156 - RNA, 12 nt, Human
gcagcugccucc

SEQ ID NO: 1616157 - RNA, 13 nt, Human
gcagcugccuccc

SEQ ID NO: 1616158 - RNA, 15 nt, Human
gcagcugccuccccu

SEQ ID NO: 1616159 - RNA, 16 nt, Human
gcagcugccuccccuc

SEQ ID NO: 1616160 - RNA, 17 nt, Human
gcagcugccuccccucc

SEQ ID NO: 1616161 - RNA, 18 nt, Human
gcagcugccuccccuccu

SEQ ID NO: 1616162 - RNA, 22 nt, Human
gcagcugccuccccuccucugc

SEQ ID NO: 1616163 - RNA, 22 nt, Human
gcaggcucucaggccagcugcu

SEQ ID NO: 1616164 - RNA, 20 nt, Human
gcaggcucucaggccagcug

SEQ ID NO: 1616165 - RNA, 19 nt, Human
gcagcugcgguccacccag

SEQ ID NO: 1616166 - RNA, 17 nt, Human
gcagcugcgguccaccc

SEQ ID NO: 1616167 - RNA, 23 nt, Human
gcaggcucucaggccagcugcuu

SEQ ID NO: 1616168 - RNA, 14 nt, Human
gcaggcuggcccug

SEQ ID NO: 1616169 - RNA, 18 nt, Human
gcaggcuggcccugcccu

SEQ ID NO: 1616170 - RNA, 17 nt, Human
gcaggcuggcccugccc

SEQ ID NO: 1616171 - RNA, 16 nt, Human
gcaggcuggcccugcc

SEQ ID NO: 1616172 - RNA, 15 nt, Human
gcaggcuggcccugc

SEQ ID NO: 1616173 - RNA, 21 nt, Human
gcaggcuggcccugcccuggu

SEQ ID NO: 1616174 - RNA, 20 nt, Human
gcaggcuggcccugcccugg

SEQ ID NO: 1616175 - RNA, 19 nt, Human
gcaggcuggcccugcccug

SEQ ID NO: 1616176 - RNA, 19 nt, Human
gcagggacuugaacccaua

SEQ ID NO: 1616177 - RNA, 13 nt, Human
gcagggaaacagc

SEQ ID NO: 1616178 - RNA, 13 nt, Human
gcagggagggccu

SEQ ID NO: 1616179 - RNA, 10 nt, Human
gcagggaggg

SEQ ID NO: 1616180 - RNA, 13 nt, Human
gcaagugagagcu

SEQ ID NO: 1616181 - RNA, 14 nt, Human
gcacaagcugcacc

SEQ ID NO: 1616182 - RNA, 23 nt, Human
gcacaagcuccaagcucccaggc

SEQ ID NO: 1616183 - RNA, 22 nt, Human
gcacaagcuccaagcucccagg

SEQ ID NO: 1616184 - RNA, 23 nt, Human
gcaauaaggggagaguaacccug

SEQ ID NO: 1616185 - RNA, 15 nt, Human
gcaagugagagcugg

SEQ ID NO: 1616186 - RNA, 17 nt, Human
gcacaguuuucugagaa

SEQ ID NO: 1616187 - RNA, 14 nt, Human
gcacaguuuucuga

SEQ ID NO: 1616188 - RNA, 18 nt, Human
gcacaguuuucugagaaa

SEQ ID NO: 1616189 - RNA, 21 nt, Human
gcacaaucucggcucacugca

SEQ ID NO: 1616190 - RNA, 22 nt, Human
gcacaaucucggcucacugcau

SEQ ID NO: 1616191 - RNA, 13 nt, Human
gcacaugccucuc

SEQ ID NO: 1616192 - RNA, 19 nt, Human
gcacaucagcacgauuucu

SEQ ID NO: 1616193 - RNA, 20 nt, Human
gcacaucagcacgauuucug

SEQ ID NO: 1616194 - RNA, 21 nt, Human
gcacaucagcacgauuucugu

SEQ ID NO: 1616195 - RNA, 22 nt, Human
gcacaugccucucucaggccaa

SEQ ID NO: 1616196 - RNA, 21 nt, Human
gcacaugccucucucaggcca

SEQ ID NO: 1616197 - RNA, 20 nt, Human
gcacaugccucucucaggcc

SEQ ID NO: 1616198 - RNA, 19 nt, Human
gcacaugccucucucaggc

SEQ ID NO: 1616199 - RNA, 18 nt, Human
gcacaugccucucucagg

SEQ ID NO: 1616200 - RNA, 17 nt, Human
gcacaugccucucucag

SEQ ID NO: 1616201 - RNA, 14 nt, Human
gcacaugccucucu

SEQ ID NO: 1616202 - RNA, 19 nt, Human
gcaccggcuggccuggccc

SEQ ID NO: 1616203 - RNA, 23 nt, Human
gcaccggcuggccuggccccuca

SEQ ID NO: 1616204 - RNA, 21 nt, Human
gcaccggcuggccuggccccu

SEQ ID NO: 1616205 - RNA, 12 nt, Human
gcacugacauug

SEQ ID NO: 1616206 - RNA, 23 nt, Human
gcagagcaccuuagacagucccu

SEQ ID NO: 1616207 - RNA, 22 nt, Human
gcagagcaccuuagacaguccc

SEQ ID NO: 1616208 - RNA, 19 nt, Human
gcagagcaccuuagacagu

SEQ ID NO: 1616209 - RNA, 15 nt, Human
gcagagcagagacca

SEQ ID NO: 1616210 - RNA, 14 nt, Human
gcagagcagagacc

SEQ ID NO: 1616211 - RNA, 12 nt, Human
gcagagcagaga

SEQ ID NO: 1616212 - RNA, 24 nt, Human
gcagagcaccuuagacagucccug

SEQ ID NO: 1616213 - RNA, 20 nt, Human
gcagagcagagaccaucccu

SEQ ID NO: 1616214 - RNA, 19 nt, Human
gcagagcagagaccauccc

SEQ ID NO: 1616215 - RNA, 15 nt, Human
gaagcucagggccug

SEQ ID NO: 1616216 - RNA, 14 nt, Human
gaagcucagggccu

SEQ ID NO: 1616217 - RNA, 19 nt, Human
gaagcucagggccuggcuc

SEQ ID NO: 1616218 - RNA, 18 nt, Human
gaagcucagggccuggcu

SEQ ID NO: 1616219 - RNA, 17 nt, Human
gaagcucagggccuggc

SEQ ID NO: 1616220 - RNA, 16 nt, Human
gaagcucagggccugg

SEQ ID NO: 1616221 - RNA, 21 nt, Human
gaagcucagggccuggcucag

SEQ ID NO: 1616222 - RNA, 20 nt, Human
gaagcucagggccuggcuca

SEQ ID NO: 1616223 - RNA, 23 nt, Human
gaagcucagggccuggcucaggu

SEQ ID NO: 1616224 - RNA, 18 nt, Human
gaaauccagggugguggu

SEQ ID NO: 1616225 - RNA, 13 nt, Human
gaaauccagggug

SEQ ID NO: 1616226 - RNA, 17 nt, Human
gaaggcucgagcaugcc

SEQ ID NO: 1616227 - RNA, 16 nt, Human
gaaggcucgagcaugc

SEQ ID NO: 1616228 - RNA, 19 nt, Human
gaaggcucgagcaugccug

SEQ ID NO: 1616229 - RNA, 18 nt, Human
gaagucuuuguacagaca

SEQ ID NO: 1616230 - RNA, 20 nt, Human
gaagucuuuguacagacaac

SEQ ID NO: 1616231 - RNA, 19 nt, Human
gaagucuuuguacagacaa

SEQ ID NO: 1616232 - RNA, 15 nt, Human
gaaguggggacagag

SEQ ID NO: 1616233 - RNA, 20 nt, Human
gaaugagagacacacugaag

SEQ ID NO: 1616234 - RNA, 23 nt, Human
gaaugagagacacacugaagaag

SEQ ID NO: 1616235 - RNA, 22 nt, Human
gaaugagagacacacugaagaa

SEQ ID NO: 1616236 - RNA, 22 nt, Human
gaaugaaugucagugugacuga

SEQ ID NO: 1616237 - RNA, 18 nt, Human
gaaugaaugucaguguga

SEQ ID NO: 1616238 - RNA, 14 nt, Human
gaaugaaugucagu

SEQ ID NO: 1616239 - RNA, 11 nt, Human
gaaugaauguc

SEQ ID NO: 1616240 - RNA, 14 nt, Human
gacacacugaagaa

SEQ ID NO: 1616241 - RNA, 12 nt, Human
gacacacaugaa

SEQ ID NO: 1616242 - RNA, 21 nt, Human
gacacacagcucuguccuggg

SEQ ID NO: 1616243 - RNA, 13 nt, Human
gacacacugaaga

SEQ ID NO: 1616244 - RNA, 11 nt, Human
gaauuaguuuu

SEQ ID NO: 1616245 - RNA, 12 nt, Human
gaauuaugaaac

SEQ ID NO: 1616246 - RNA, 19 nt, Human
gaauuuuggcugugucucc

SEQ ID NO: 1616247 - RNA, 21 nt, Human
gaauuuuauuuuuugggaaaa

SEQ ID NO: 1616248 - RNA, 20 nt, Human
gaauuuugugcccccaugua

SEQ ID NO: 1616249 - RNA, 23 nt, Human
gaauuuuggcugugucucccuuc

SEQ ID NO: 1616250 - RNA, 21 nt, Human
gaauuuugugcccccauguaa

SEQ ID NO: 1616251 - RNA, 13 nt, Human
gaauuuuguguua

SEQ ID NO: 1616252 - RNA, 22 nt, Human
gaauuuuguguuagagauuuuu

SEQ ID NO: 1616253 - RNA, 16 nt, Human
gaauuuuguguuagag

SEQ ID NO: 1616254 - RNA, 19 nt, Human
gacacacagcucuguccug

SEQ ID NO: 1616255 - RNA, 18 nt, Human
gacacacagcucuguccu

SEQ ID NO: 1616256 - RNA, 17 nt, Human
gacacacagcucugucc

SEQ ID NO: 1616257 - RNA, 15 nt, Human
gacacacagcucugu

SEQ ID NO: 1616258 - RNA, 14 nt, Human
gacacacagcucug

SEQ ID NO: 1616259 - RNA, 15 nt, Human
gacaaaauggaauac

SEQ ID NO: 1616260 - RNA, 17 nt, Human
gacagucaccucaugga

SEQ ID NO: 1616261 - RNA, 14 nt, Human
gacagugaaagaaa

SEQ ID NO: 1616262 - RNA, 11 nt, Human
gacagcuccuu

SEQ ID NO: 1616263 - RNA, 19 nt, Human
gacagccuggcacagggca

SEQ ID NO: 1616264 - RNA, 13 nt, Human
gacagccuggcac

SEQ ID NO: 1616265 - RNA, 13 nt, Human
gacagcccuccau

SEQ ID NO: 1616266 - RNA, 22 nt, Human
gacaggguuuugccauguuggc

SEQ ID NO: 1616267 - RNA, 20 nt, Human
gacaggguuuugccauguug

SEQ ID NO: 1616268 - RNA, 23 nt, Human
gacagcccgggcucugccuccca

SEQ ID NO: 1616269 - RNA, 22 nt, Human
gacagcccgggcucugccuccc

SEQ ID NO: 1616270 - RNA, 21 nt, Human
gacagcccgggcucugccucc

SEQ ID NO: 1616271 - RNA, 12 nt, Human
gacagacacagg

SEQ ID NO: 1616272 - RNA, 16 nt, Human
gacacuuaaaaauggu

SEQ ID NO: 1616273 - RNA, 15 nt, Human
gacacugaugggcaa

SEQ ID NO: 1616274 - RNA, 13 nt, Human
gacacugaugggc

SEQ ID NO: 1616275 - RNA, 13 nt, Human
gagauuuacaacu

SEQ ID NO: 1616276 - RNA, 18 nt, Human
gagauugcaccacugcac

SEQ ID NO: 1616277 - RNA, 21 nt, Human
gagauugcaccacugcacucc

SEQ ID NO: 1616278 - RNA, 14 nt, Human
gagauguagccccu

SEQ ID NO: 1616279 - RNA, 16 nt, Human
gagacuccugcaggca

SEQ ID NO: 1616280 - RNA, 15 nt, Human
gagacuccugcaggc

SEQ ID NO: 1616281 - RNA, 18 nt, Human
gagacuccugcaggcagc

SEQ ID NO: 1616282 - RNA, 17 nt, Human
gagacuccugcaggcag

SEQ ID NO: 1616283 - RNA, 14 nt, Human
gagaggcauccagu

SEQ ID NO: 1616284 - RNA, 22 nt, Human
gagaggcauccaguaucuugaa

SEQ ID NO: 1616285 - RNA, 21 nt, Human
gagaugaugccaugggcccuc

SEQ ID NO: 1616286 - RNA, 21 nt, Human
gagcggagaaaggaagggcug

SEQ ID NO: 1616287 - RNA, 18 nt, Human
gagcggagaaaggaaggg

SEQ ID NO: 1616288 - RNA, 22 nt, Human
gagcugccuguucagcuccagc

SEQ ID NO: 1616289 - RNA, 21 nt, Human
gagcugccuguucagcuccag

SEQ ID NO: 1616290 - RNA, 17 nt, Human
gagccuuccaggggugg

SEQ ID NO: 1616291 - RNA, 16 nt, Human
gagccuuccaggggug

SEQ ID NO: 1616292 - RNA, 15 nt, Human
gagccuuccaggggu

SEQ ID NO: 1616293 - RNA, 14 nt, Human
gagccuuccagggg

SEQ ID NO: 1616294 - RNA, 13 nt, Human
gagccccgaggcc

SEQ ID NO: 1616295 - RNA, 22 nt, Human
gagccuugaacuuugaccucug

SEQ ID NO: 1616296 - RNA, 18 nt, Human
gagcugggugucaagagg

SEQ ID NO: 1616297 - RNA, 14 nt, Human
gagcagggcucagc

SEQ ID NO: 1616298 - RNA, 21 nt, Human
gagcagggcucagcggggaca

SEQ ID NO: 1616299 - RNA, 12 nt, Human
gagcaucaggcc

SEQ ID NO: 1616300 - RNA, 22 nt, Human
gagcaugccuggauggggcugc

SEQ ID NO: 1616301 - RNA, 13 nt, Human
gagcaucaggcca

SEQ ID NO: 1616302 - RNA, 21 nt, Human
gacuuuucuuuguggcuuccu

SEQ ID NO: 1616303 - RNA, 23 nt, Human
gacuuuucuuucagccaagaauu

SEQ ID NO: 1616304 - RNA, 12 nt, Human
gacuggugacug

SEQ ID NO: 1616305 - RNA, 18 nt, Human
gacuggugacugauucuu

SEQ ID NO: 1616306 - RNA, 15 nt, Human
gacuggugacugauu

SEQ ID NO: 1616307 - RNA, 11 nt, Human
gacuuuccucu

SEQ ID NO: 1616308 - RNA, 15 nt, Human
gagaagcggcuggca

SEQ ID NO: 1616309 - RNA, 13 nt, Human
gagaagcggcugg

SEQ ID NO: 1616310 - RNA, 16 nt, Human
gagaagcggcuggcag

SEQ ID NO: 1616311 - RNA, 12 nt, Human
gagaaggaagcc

SEQ ID NO: 1616312 - RNA, 20 nt, Human
gagaaggacccggaggggcc

SEQ ID NO: 1616313 - RNA, 23 nt, Human
gagaaggacccggaggggccugg

SEQ ID NO: 1616314 - RNA, 22 nt, Human
gagaaggacccggaggggccug

SEQ ID NO: 1616315 - RNA, 13 nt, Human
gagaccugccccu

SEQ ID NO: 1616316 - RNA, 12 nt, Human
gagaccugcccc

SEQ ID NO: 1616317 - RNA, 11 nt, Human
gagaccugccc

SEQ ID NO: 1616318 - RNA, 21 nt, Human
gagacccugucucaaaaaaag

SEQ ID NO: 1616319 - RNA, 14 nt, Human
gagaaucacuugaa

SEQ ID NO: 1616320 - RNA, 15 nt, Human
gagaaucacuugaac

SEQ ID NO: 1616321 - RNA, 16 nt, Human
gacucuuaagaagacu

SEQ ID NO: 1616322 - RNA, 19 nt, Human
gacucugucucaaaaaaac

SEQ ID NO: 1616323 - RNA, 18 nt, Human
gacucuuaagaagacugc

SEQ ID NO: 1616324 - RNA, 17 nt, Human
gacucuuaagaagacug

SEQ ID NO: 1616325 - RNA, 12 nt, Human
gacucugucuca

SEQ ID NO: 1616326 - RNA, 22 nt, Human
gacuaucuaaauguugaaagau

SEQ ID NO: 1616327 - RNA, 18 nt, Human
gacuaggguccuggggaa

SEQ ID NO: 1616328 - RNA, 16 nt, Human
gacuaggguccugggg

SEQ ID NO: 1616329 - RNA, 15 nt, Human
gacuaggguccuggg

SEQ ID NO: 1616330 - RNA, 22 nt, Human
gccaguuauggcuauaggugcu

SEQ ID NO: 1616331 - RNA, 13 nt, Human
gccaguugguccc

SEQ ID NO: 1616332 - RNA, 13 nt, Human
gccagugugacaa

SEQ ID NO: 1616333 - RNA, 15 nt, Human
gccagugcuccagcc

SEQ ID NO: 1616334 - RNA, 16 nt, Human
gccauaugaaaaggcu

SEQ ID NO: 1616335 - RNA, 21 nt, Human
gccaguuggucccccuuccau

SEQ ID NO: 1616336 - RNA, 20 nt, Human
gccaguuggucccccuucca

SEQ ID NO: 1616337 - RNA, 18 nt, Human
gccaguuggucccccuuc

SEQ ID NO: 1616338 - RNA, 16 nt, Human
gccaguuggucccccu

SEQ ID NO: 1616339 - RNA, 23 nt, Human
gccaguuggucccccuuccaugg

SEQ ID NO: 1616340 - RNA, 22 nt, Human
gccaguuggucccccuuccaug

SEQ ID NO: 1616341 - RNA, 13 nt, Human
gccagcaguucag

SEQ ID NO: 1616342 - RNA, 14 nt, Human
gccagcaguucaga

SEQ ID NO: 1616343 - RNA, 19 nt, Human
gccagcaguucagagcugc

SEQ ID NO: 1616344 - RNA, 20 nt, Human
gccagcaguucagagcugcc

SEQ ID NO: 1616345 - RNA, 21 nt, Human
gccagcaguucagagcugccc

SEQ ID NO: 1616346 - RNA, 15 nt, Human
gccaggcccucugcc

SEQ ID NO: 1616347 - RNA, 14 nt, Human
gccaggcccucugc

SEQ ID NO: 1616348 - RNA, 13 nt, Human
gccaggcccucug

SEQ ID NO: 1616349 - RNA, 23 nt, Human
gccaggccacaagacccuugugg

SEQ ID NO: 1616350 - RNA, 22 nt, Human
gccaggccagagggagugacag

SEQ ID NO: 1616351 - RNA, 15 nt, Human
gccaggccagaggga

SEQ ID NO: 1616352 - RNA, 21 nt, Human
gccaggccacaagacccuugu

SEQ ID NO: 1616353 - RNA, 18 nt, Human
gccaggccacaagacccu

SEQ ID NO: 1616354 - RNA, 13 nt, Human
gccaggccacaag

SEQ ID NO: 1616355 - RNA, 22 nt, Human
gccaugugcuaguaauuggaaa

SEQ ID NO: 1616356 - RNA, 14 nt, Human
gccaugugccaggu

SEQ ID NO: 1616357 - RNA, 24 nt, Human
gccaucaauaaaaaauuaugacau

SEQ ID NO: 1616358 - RNA, 13 nt, Human
gcccaggccccug

SEQ ID NO: 1616359 - RNA, 15 nt, Human
gcccaggccccugcc

SEQ ID NO: 1616360 - RNA, 16 nt, Human
gcccaggcaggucuug

SEQ ID NO: 1616361 - RNA, 14 nt, Human
gcccaggcaggucu

SEQ ID NO: 1616362 - RNA, 13 nt, Human
gcccaggcagguc

SEQ ID NO: 1616363 - RNA, 18 nt, Human
gcccaggccccugccacc

SEQ ID NO: 1616364 - RNA, 17 nt, Human
gcccaggccccugccac

SEQ ID NO: 1616365 - RNA, 15 nt, Human
gccccuggaugcagc

SEQ ID NO: 1616366 - RNA, 16 nt, Human
gcccucacccuggggc

SEQ ID NO: 1616367 - RNA, 17 nt, Human
gcccucacccuggggcu

SEQ ID NO: 1616368 - RNA, 22 nt, Human
gccccugcugguucaggguugg

SEQ ID NO: 1616369 - RNA, 18 nt, Human
gccccugccucucugcag

SEQ ID NO: 1616370 - RNA, 17 nt, Human
gccccugccucucugca

SEQ ID NO: 1616371 - RNA, 16 nt, Human
gccccugccucucugc

SEQ ID NO: 1616372 - RNA, 15 nt, Human
gccccugccucucug

SEQ ID NO: 1616373 - RNA, 14 nt, Human
gcgauucuucugcu

SEQ ID NO: 1616374 - RNA, 17 nt, Human
gcgauucuucugcuuca

SEQ ID NO: 1616375 - RNA, 15 nt, Human
gcgagcccugguggc

SEQ ID NO: 1616376 - RNA, 13 nt, Human
gcgauucuucugc

SEQ ID NO: 1616377 - RNA, 16 nt, Human
gcggccuuuggcuuca

SEQ ID NO: 1616378 - RNA, 20 nt, Human
gcgugguggacaugcacagc

SEQ ID NO: 1616379 - RNA, 14 nt, Human
gcgugcacacacca

SEQ ID NO: 1616380 - RNA, 18 nt, Human
gcgugcacacaccagagc

SEQ ID NO: 1616381 - RNA, 19 nt, Human
gcgugcacacaccagagcc

SEQ ID NO: 1616382 - RNA, 17 nt, Human
gcuacuugggaggcuga

SEQ ID NO: 1616383 - RNA, 15 nt, Human
gcuacugucagcucc

SEQ ID NO: 1616384 - RNA, 19 nt, Human
gcuacuguaaggcaaucau

SEQ ID NO: 1616385 - RNA, 18 nt, Human
gcuacuguaaggcaauca

SEQ ID NO: 1616386 - RNA, 20 nt, Human
gcuacuguccuacccacccu

SEQ ID NO: 1616387 - RNA, 19 nt, Human
gcuacuguccuacccaccc

SEQ ID NO: 1616388 - RNA, 19 nt, Human
gcuacaaaaacacagcaag

SEQ ID NO: 1616389 - RNA, 18 nt, Human
gcuacaaaaacacagcaa

SEQ ID NO: 1616390 - RNA, 17 nt, Human
gcuacaaaaacacagca

SEQ ID NO: 1616391 - RNA, 17 nt, Human
gcguuucuaugacacau

SEQ ID NO: 1616392 - RNA, 24 nt, Human
gcguugaaauuguaauuauaucug

SEQ ID NO: 1616393 - RNA, 23 nt, Human
gcguugaaauuguaauuauaucu

SEQ ID NO: 1616394 - RNA, 16 nt, Human
gcuaauuuuucauuuu

SEQ ID NO: 1616395 - RNA, 18 nt, Human
gcuaauuuugaaaaacug

SEQ ID NO: 1616396 - RNA, 13 nt, Human
gccugcuccagcu

SEQ ID NO: 1616397 - RNA, 23 nt, Human
gccugcuaauuccccagauugca

SEQ ID NO: 1616398 - RNA, 17 nt, Human
gccugcuaauuccccag

SEQ ID NO: 1616399 - RNA, 13 nt, Human
gccucggacuuag

SEQ ID NO: 1616400 - RNA, 20 nt, Human
gccuccauccugaggcucca

SEQ ID NO: 1616401 - RNA, 16 nt, Human
gccuccauccugaggc

SEQ ID NO: 1616402 - RNA, 21 nt, Human
gccuccuuugugaggaagccg

SEQ ID NO: 1616403 - RNA, 20 nt, Human
gccuccuuugugaggaagcc

SEQ ID NO: 1616404 - RNA, 19 nt, Human
gccuccuuugugaggaagc

SEQ ID NO: 1616405 - RNA, 11 nt, Human
gccuccaugcu

SEQ ID NO: 1616406 - RNA, 17 nt, Human
gccuccaagcuccaucu

SEQ ID NO: 1616407 - RNA, 12 nt, Human
ggaagacuuugg

SEQ ID NO: 1616408 - RNA, 20 nt, Human
ggaagacuucaucccucugg

SEQ ID NO: 1616409 - RNA, 17 nt, Human
ggaagacuucaucccuc

SEQ ID NO: 1616410 - RNA, 22 nt, Human
ggaagacaaugugaaaagaaaa

SEQ ID NO: 1616411 - RNA, 21 nt, Human
ggaacaaggcaaggcugucaa

SEQ ID NO: 1616412 - RNA, 17 nt, Human
ggaacaaggcaaggcug

SEQ ID NO: 1616413 - RNA, 15 nt, Human
ggaacaaggcaaggc

SEQ ID NO: 1616414 - RNA, 17 nt, Human
ggaaaugucaacaagua

SEQ ID NO: 1616415 - RNA, 22 nt, Human
ggaaaugggcagagcagagacc

SEQ ID NO: 1616416 - RNA, 18 nt, Human
ggaaaugggcagagcaga

SEQ ID NO: 1616417 - RNA, 17 nt, Human
ggaaaugggcagagcag

SEQ ID NO: 1616418 - RNA, 16 nt, Human
ggaaaugggcagagca

SEQ ID NO: 1616419 - RNA, 14 nt, Human
ggaaaugggcagag

SEQ ID NO: 1616420 - RNA, 21 nt, Human
ggaaacuaggugcauauuuau

SEQ ID NO: 1616421 - RNA, 19 nt, Human
ggaacacuccuucacagau

SEQ ID NO: 1616422 - RNA, 15 nt, Human
ggaacacuccuucac

SEQ ID NO: 1616423 - RNA, 23 nt, Human
ggaacaaggcaaggcugucaauu

SEQ ID NO: 1616424 - RNA, 13 nt, Human
ggaacaccuccuc

SEQ ID NO: 1616425 - RNA, 17 nt, Human
ggaacaccauaggucac

SEQ ID NO: 1616426 - RNA, 16 nt, Human
ggaagacaaugugaaa

SEQ ID NO: 1616427 - RNA, 14 nt, Human
ggaagacaauguga

SEQ ID NO: 1616428 - RNA, 11 nt, Human
gcuuuucugau

SEQ ID NO: 1616429 - RNA, 18 nt, Human
gcuuuugucuaugggacu

SEQ ID NO: 1616430 - RNA, 15 nt, Human
gcuuuuggucugugu

SEQ ID NO: 1616431 - RNA, 16 nt, Human
gcuuuucugauccagu

SEQ ID NO: 1616432 - RNA, 15 nt, Human
gcuuuucugauccag

SEQ ID NO: 1616433 - RNA, 12 nt, Human
gcuuuucugauc

SEQ ID NO: 1616434 - RNA, 12 nt, Human
gcuuuugugcau

SEQ ID NO: 1616435 - RNA, 20 nt, Human
gcuuuuuuaucaugugaaau

SEQ ID NO: 1616436 - RNA, 18 nt, Human
gcuuuuuuaucaugugaa

SEQ ID NO: 1616437 - RNA, 15 nt, Human
gcuuuuuuaucaugu

SEQ ID NO: 1616438 - RNA, 16 nt, Human
ggaaacccagcucugg

SEQ ID NO: 1616439 - RNA, 18 nt, Human
ggaaaauuuuaaaaauac

SEQ ID NO: 1616440 - RNA, 22 nt, Human
gcuuuuuucucugauacagaaa

SEQ ID NO: 1616441 - RNA, 17 nt, Human
gcuuugaucccuucuua

SEQ ID NO: 1616442 - RNA, 14 nt, Human
gcuuugaucccuuc

SEQ ID NO: 1616443 - RNA, 19 nt, Human
gcuuccuggcaauagucaa

SEQ ID NO: 1616444 - RNA, 23 nt, Human
gcuuccagugaggcucugcccuu

SEQ ID NO: 1616445 - RNA, 12 nt, Human
gcuucuucagag

SEQ ID NO: 1616446 - RNA, 15 nt, Human
gcuucuucagagacu

SEQ ID NO: 1616447 - RNA, 17 nt, Human
gcuuguaaauagcucag

SEQ ID NO: 1616448 - RNA, 22 nt, Human
gcuugaccuuuaagagaaauga

SEQ ID NO: 1616449 - RNA, 16 nt, Human
gcuugaccgugaggcc

SEQ ID NO: 1616450 - RNA, 18 nt, Human
gcuugaccuuuaagagaa

SEQ ID NO: 1616451 - RNA, 23 nt, Human
gcuugaccgugaggccagagaca

SEQ ID NO: 1616452 - RNA, 19 nt, Human
gcuuguaaauagcucaggu

SEQ ID NO: 1616453 - RNA, 18 nt, Human
gcuuguaaauagcucagg

SEQ ID NO: 1616454 - RNA, 21 nt, Human
gcuuuccccaugucucgacuc

SEQ ID NO: 1616455 - RNA, 22 nt, Human
gcuuuccccaugucucgacuca

SEQ ID NO: 1616456 - RNA, 16 nt, Human
gcuuuccucuuccuga

SEQ ID NO: 1616457 - RNA, 13 nt, Human
gcuguauuuuaaa

SEQ ID NO: 1616458 - RNA, 12 nt, Human
gcuguauuuuaa

SEQ ID NO: 1616459 - RNA, 19 nt, Human
gcuguauuagucacagaga

SEQ ID NO: 1616460 - RNA, 23 nt, Human
gcugguucaggguuggccccugc

SEQ ID NO: 1616461 - RNA, 15 nt, Human
gcuucaguggcagcu

SEQ ID NO: 1616462 - RNA, 14 nt, Human
gcuucaguggcagc

SEQ ID NO: 1616463 - RNA, 14 nt, Human
gcuucaaggauccu

SEQ ID NO: 1616464 - RNA, 18 nt, Human
gcuucaaggauccugagc

SEQ ID NO: 1616465 - RNA, 16 nt, Human
gcuucaaauuguaagc

SEQ ID NO: 1616466 - RNA, 12 nt, Human
gcugugccucug

SEQ ID NO: 1616467 - RNA, 14 nt, Human
gcuguuggcugggg

SEQ ID NO: 1616468 - RNA, 13 nt, Human
gcuguuggcuggg

SEQ ID NO: 1616469 - RNA, 15 nt, Human
gcugcacccucaggc

SEQ ID NO: 1616470 - RNA, 13 nt, Human
gcugcacccucag

SEQ ID NO: 1616471 - RNA, 16 nt, Human
gcugcacccucaggca

SEQ ID NO: 1616472 - RNA, 13 nt, Human
gcugccauccagg

SEQ ID NO: 1616473 - RNA, 12 nt, Human
gcugccauccag

SEQ ID NO: 1616474 - RNA, 12 nt, Human
gcugcugacagu

SEQ ID NO: 1616475 - RNA, 16 nt, Human
gcugccccuggcagcc

SEQ ID NO: 1616476 - RNA, 15 nt, Human
gcugccccuggcagc

SEQ ID NO: 1616477 - RNA, 13 nt, Human
gcugccccuggca

SEQ ID NO: 1616478 - RNA, 17 nt, Human
gcugccauccagguuca

SEQ ID NO: 1616479 - RNA, 17 nt, Human
gcugccccuggcagccc

SEQ ID NO: 1616480 - RNA, 16 nt, Human
gcugaaacaacaaaua

SEQ ID NO: 1616481 - RNA, 14 nt, Human
gcucuguccuggga

SEQ ID NO: 1616482 - RNA, 17 nt, Human
gcucuggagcccacugu

SEQ ID NO: 1616483 - RNA, 13 nt, Human
gcugacagacaca

SEQ ID NO: 1616484 - RNA, 16 nt, Human
gcugagccucagucuc

SEQ ID NO: 1616485 - RNA, 12 nt, Human
gcugagccucag

SEQ ID NO: 1616486 - RNA, 22 nt, Human
gcugaauacagaggcaacugca

SEQ ID NO: 1616487 - RNA, 17 nt, Human
gcugaauacagaggcaa

SEQ ID NO: 1616488 - RNA, 20 nt, Human
gcugaacuuguuuucuggga

SEQ ID NO: 1616489 - RNA, 15 nt, Human
gcucugcccauccug

SEQ ID NO: 1616490 - RNA, 23 nt, Human
gcucugaucauccacugugccau

SEQ ID NO: 1616491 - RNA, 22 nt, Human
gcucugaucauccacugugcca

SEQ ID NO: 1616492 - RNA, 21 nt, Human
gcucugaucauccacugugcc

SEQ ID NO: 1616493 - RNA, 21 nt, Human
gcucugcccauccugccccug

SEQ ID NO: 1616494 - RNA, 16 nt, Human
gcucuggagcccacug

SEQ ID NO: 1616495 - RNA, 15 nt, Human
gcucuggagcccacu

SEQ ID NO: 1616496 - RNA, 20 nt, Human
gcucugaucauccacugugc

SEQ ID NO: 1616497 - RNA, 20 nt, Human
gcuccacuuggucugugaga

SEQ ID NO: 1616498 - RNA, 9 nt, Human
gcuccagac

SEQ ID NO: 1616499 - RNA, 23 nt, Human
gcuccagacacauguccaagaag

SEQ ID NO: 1616500 - RNA, 21 nt, Human
gcuccagacacauguccaaga

SEQ ID NO: 1616501 - RNA, 18 nt, Human
gcuccagacacaugucca

SEQ ID NO: 1616502 - RNA, 14 nt, Human
gcuccagcucacca

SEQ ID NO: 1616503 - RNA, 13 nt, Human
gcuccagcucacc

SEQ ID NO: 1616504 - RNA, 17 nt, Human
gcuccagcucaccagcc

SEQ ID NO: 1616505 - RNA, 15 nt, Human
gcuccucuccccagc

SEQ ID NO: 1616506 - RNA, 19 nt, Human
gcuccucccggugcccaag

SEQ ID NO: 1616507 - RNA, 20 nt, Human
gcucucaggccagcugcuug

SEQ ID NO: 1616508 - RNA, 19 nt, Human
gcucucaggccagcugcuu

SEQ ID NO: 1616509 - RNA, 18 nt, Human
gcucucaggccagcugcu

SEQ ID NO: 1616510 - RNA, 17 nt, Human
gcucucaggccagcugc

SEQ ID NO: 1616511 - RNA, 19 nt, Human
gcuccucuccccagcaagu

SEQ ID NO: 1616512 - RNA, 16 nt, Human
gcuccucuccccagca

SEQ ID NO: 1616513 - RNA, 19 nt, Human
gcucuacugaggugcuaug

SEQ ID NO: 1616514 - RNA, 18 nt, Human
gcucucaaguuaucaggg

SEQ ID NO: 1616515 - RNA, 16 nt, Human
ggagcaucagugcccu

SEQ ID NO: 1616516 - RNA, 20 nt, Human
ggaggucaaggcugcaguga

SEQ ID NO: 1616517 - RNA, 14 nt, Human
ggaggugaccccag

SEQ ID NO: 1616518 - RNA, 14 nt, Human
ggaggucgaggcag

SEQ ID NO: 1616519 - RNA, 16 nt, Human
ggaggggggagguggg

SEQ ID NO: 1616520 - RNA, 21 nt, Human
ggagcugccuguucagcucca

SEQ ID NO: 1616521 - RNA, 12 nt, Human
ggagcugccugu

SEQ ID NO: 1616522 - RNA, 22 nt, Human
ggagccccgaggccuucucuga

SEQ ID NO: 1616523 - RNA, 16 nt, Human
ggagccccgaggccuu

SEQ ID NO: 1616524 - RNA, 16 nt, Human
ggagccaauggagacu

SEQ ID NO: 1616525 - RNA, 19 nt, Human
ggaggaaggaaacccagcu

SEQ ID NO: 1616526 - RNA, 23 nt, Human
ggaggaaggaaacccagcucugg

SEQ ID NO: 1616527 - RNA, 20 nt, Human
ggaggaaggaaacccagcuc

SEQ ID NO: 1616528 - RNA, 11 nt, Human
ggaggccagcc

SEQ ID NO: 1616529 - RNA, 12 nt, Human
ggaggccagccu

SEQ ID NO: 1616530 - RNA, 22 nt, Human
ggauguugaaaaaguucugcag

SEQ ID NO: 1616531 - RNA, 16 nt, Human
ggauguucugggacac

SEQ ID NO: 1616532 - RNA, 15 nt, Human
ggauguucugggaca

SEQ ID NO: 1616533 - RNA, 24 nt, Human
ggcacagaaaauggaagacagcuc

SEQ ID NO: 1616534 - RNA, 22 nt, Human
ggcacaaucucggcucacugca

SEQ ID NO: 1616535 - RNA, 16 nt, Human
ggcacagggcaguggg

SEQ ID NO: 1616536 - RNA, 14 nt, Human
ggauccugagccag

SEQ ID NO: 1616537 - RNA, 13 nt, Human
ggauccugagcca

SEQ ID NO: 1616538 - RNA, 14 nt, Human
ggauccuccaggug

SEQ ID NO: 1616539 - RNA, 15 nt, Human
ggauccuccaggugc

SEQ ID NO: 1616540 - RNA, 12 nt, Human
ggauggcaagau

SEQ ID NO: 1616541 - RNA, 18 nt, Human
ggauggauuuccagccaa

SEQ ID NO: 1616542 - RNA, 16 nt, Human
ggauggggcugcaccg

SEQ ID NO: 1616543 - RNA, 21 nt, Human
ggauguacaaggacagccccu

SEQ ID NO: 1616544 - RNA, 14 nt, Human
ggaguggccacaga

SEQ ID NO: 1616545 - RNA, 15 nt, Human
ggaguucugguuccu

SEQ ID NO: 1616546 - RNA, 21 nt, Human
ggaguuggaagugugugaucu

SEQ ID NO: 1616547 - RNA, 22 nt, Human
ggauaauaaggaaaaguuuaau

SEQ ID NO: 1616548 - RNA, 12 nt, Human
ggauaaaugcca

SEQ ID NO: 1616549 - RNA, 18 nt, Human
ggcccuucucuccagccc

SEQ ID NO: 1616550 - RNA, 19 nt, Human
ggcccuucucuccagcccc

SEQ ID NO: 1616551 - RNA, 17 nt, Human
ggcccuuccucuccacu

SEQ ID NO: 1616552 - RNA, 17 nt, Human
ggcccuucucuccagcc

SEQ ID NO: 1616553 - RNA, 16 nt, Human
ggcccuucucuccagc

SEQ ID NO: 1616554 - RNA, 18 nt, Human
ggcccuuccucuccacug

SEQ ID NO: 1616555 - RNA, 15 nt, Human
ggcccuuccucucca

SEQ ID NO: 1616556 - RNA, 13 nt, Human
ggcccuuccucuc

SEQ ID NO: 1616557 - RNA, 15 nt, Human
ggcccgacagccugg

SEQ ID NO: 1616558 - RNA, 19 nt, Human
ggcagugggagcugccugu

SEQ ID NO: 1616559 - RNA, 18 nt, Human
ggcagugggagcugccug

SEQ ID NO: 1616560 - RNA, 18 nt, Human
ggcauccaguaucuugaa

SEQ ID NO: 1616561 - RNA, 17 nt, Human
ggcagugggagcugccu

SEQ ID NO: 1616562 - RNA, 24 nt, Human
ggcacugcuuccagugaggcucug

SEQ ID NO: 1616563 - RNA, 16 nt, Human
ggcaccagcagccugg

SEQ ID NO: 1616564 - RNA, 15 nt, Human
ggcaccagcagccug

SEQ ID NO: 1616565 - RNA, 15 nt, Human
ggccagugcuccagc

SEQ ID NO: 1616566 - RNA, 13 nt, Human
ggccagugcucca

SEQ ID NO: 1616567 - RNA, 16 nt, Human
ggccagugugacaagg

SEQ ID NO: 1616568 - RNA, 17 nt, Human
ggccaaacucaccugcc

SEQ ID NO: 1616569 - RNA, 21 nt, Human
ggccaaacucaccugccccuc

SEQ ID NO: 1616570 - RNA, 14 nt, Human
ggccaggcuggucu

SEQ ID NO: 1616571 - RNA, 18 nt, Human
ggccaggcuggucucaaa

SEQ ID NO: 1616572 - RNA, 16 nt, Human
ggccaggcuggucuca

SEQ ID NO: 1616573 - RNA, 23 nt, Human
ggcucagcggggacagcuccuuc

SEQ ID NO: 1616574 - RNA, 22 nt, Human
ggcucagcggggacagcuccuu

SEQ ID NO: 1616575 - RNA, 21 nt, Human
ggcucagcggggacagcuccu

SEQ ID NO: 1616576 - RNA, 23 nt, Human
ggcucagcaaaagaugcuucuca

SEQ ID NO: 1616577 - RNA, 19 nt, Human
ggcgugcaguggugcgauc

SEQ ID NO: 1616578 - RNA, 16 nt, Human
ggcucacugcagccuc

SEQ ID NO: 1616579 - RNA, 17 nt, Human
ggcucacugcagccuca

SEQ ID NO: 1616580 - RNA, 19 nt, Human
ggcucacugcauccuccgc

SEQ ID NO: 1616581 - RNA, 16 nt, Human
ggcucacugcauccuc

SEQ ID NO: 1616582 - RNA, 13 nt, Human
ggccuccauccug

SEQ ID NO: 1616583 - RNA, 15 nt, Human
ggccugagcugggau

SEQ ID NO: 1616584 - RNA, 23 nt, Human
ggccuucggccuccauccugagg

SEQ ID NO: 1616585 - RNA, 12 nt, Human
ggccuucucuga

SEQ ID NO: 1616586 - RNA, 21 nt, Human
ggccugugucuaguuguuuga

SEQ ID NO: 1616587 - RNA, 20 nt, Human
ggccuguggaucaaauccag

SEQ ID NO: 1616588 - RNA, 21 nt, Human
ggccuggccagaugcaccagc

SEQ ID NO: 1616589 - RNA, 14 nt, Human
ggccuuuggcuuca

SEQ ID NO: 1616590 - RNA, 13 nt, Human
ggccuuuggcuuc

SEQ ID NO: 1616591 - RNA, 16 nt, Human
ggccuucucugaagga

SEQ ID NO: 1616592 - RNA, 15 nt, Human
ggccuucucugaagg

SEQ ID NO: 1616593 - RNA, 23 nt, Human
gggacagaggggguggccuccca

SEQ ID NO: 1616594 - RNA, 22 nt, Human
gggacagaggggguggccuccc

SEQ ID NO: 1616595 - RNA, 13 nt, Human
gggacagaggggg

SEQ ID NO: 1616596 - RNA, 13 nt, Human
gggaaggauacaa

SEQ ID NO: 1616597 - RNA, 16 nt, Human
gggaaggauacaaaag

SEQ ID NO: 1616598 - RNA, 23 nt, Human
aaaaauaugaccacacuccagcu

SEQ ID NO: 1616599 - RNA, 21 nt, Human
aaaaauaugaccacacuccag

SEQ ID NO: 1616600 - RNA, 14 nt, Human
aaaaauauuuuaug

SEQ ID NO: 1616601 - RNA, 21 nt, Human
gggacauuugcucauggaauu

SEQ ID NO: 1616602 - RNA, 20 nt, Human
gggacauuugcucauggaau

SEQ ID NO: 1616603 - RNA, 21 nt, Human
gggacagcuccuucuguccua

SEQ ID NO: 1616604 - RNA, 22 nt, Human
aaaaauggaacauaaaauacaa

SEQ ID NO: 1616605 - RNA, 14 nt, Human
aaaaaucucaaauu

SEQ ID NO: 1616606 - RNA, 17 nt, Human
aaaaaucucaaauuucu

SEQ ID NO: 1616607 - RNA, 12 nt, Human
aaaaccacagca

SEQ ID NO: 1616608 - RNA, 15 nt, Human
aaaacaugcuacaca

SEQ ID NO: 1616609 - RNA, 17 nt, Human
aaaagaugaaaauauuu

SEQ ID NO: 1616610 - RNA, 13 nt, Human
aaaagaugcuucu

SEQ ID NO: 1616611 - RNA, 23 nt, Human
aaaacugcugacuguuuucucuu

SEQ ID NO: 1616612 - RNA, 13 nt, Human
aaaacucauuuuu

SEQ ID NO: 1616613 - RNA, 22 nt, Human
aaaacugcugacuguuuucucu

SEQ ID NO: 1616614 - RNA, 13 nt, Human
aaaaccacagcag

SEQ ID NO: 1616615 - RNA, 14 nt, Human
aaaaccacagcagu

SEQ ID NO: 1616616 - RNA, 15 nt, Human
aaaacccagauaaag

SEQ ID NO: 1616617 - RNA, 17 nt, Human
gggauuguaaaauggug

SEQ ID NO: 1616618 - RNA, 16 nt, Human
gggauuguaaaauggu

SEQ ID NO: 1616619 - RNA, 15 nt, Human
gggauuacaggugug

SEQ ID NO: 1616620 - RNA, 12 nt, Human
gggauuacaggu

SEQ ID NO: 1616621 - RNA, 21 nt, Human
gggauuacaggcuccugccac

SEQ ID NO: 1616622 - RNA, 16 nt, Human
gggauuacaggcuccu

SEQ ID NO: 1616623 - RNA, 13 nt, Human
gggauuacaggcu

SEQ ID NO: 1616624 - RNA, 14 nt, Human
gggauuacaggcgu

SEQ ID NO: 1616625 - RNA, 16 nt, Human
gggcagagcagagacc

SEQ ID NO: 1616626 - RNA, 20 nt, Human
gggcaacccccagccugcua

SEQ ID NO: 1616627 - RNA, 18 nt, Human
gggcaacccccagccugc

SEQ ID NO: 1616628 - RNA, 16 nt, Human
gggcaacccccagccu

SEQ ID NO: 1616629 - RNA, 22 nt, Human
gggcagagcagagaccaucccu

SEQ ID NO: 1616630 - RNA, 17 nt, Human
gggcagagcagagacca

SEQ ID NO: 1616631 - RNA, 23 nt, Human
gggcagagcagagaccaucccug

SEQ ID NO: 1616632 - RNA, 12 nt, Human
gggcagcugccu

SEQ ID NO: 1616633 - RNA, 19 nt, Human
aaaagguaugcaaucaaau

SEQ ID NO: 1616634 - RNA, 19 nt, Human
gggaggucgaggcaggagg

SEQ ID NO: 1616635 - RNA, 18 nt, Human
gggaggucgaggcaggag

SEQ ID NO: 1616636 - RNA, 17 nt, Human
gggaggucgaggcagga

SEQ ID NO: 1616637 - RNA, 18 nt, Human
gggagggcuccagacaca

SEQ ID NO: 1616638 - RNA, 17 nt, Human
gggagggcuccagacac

SEQ ID NO: 1616639 - RNA, 15 nt, Human
gggagggcuccagac

SEQ ID NO: 1616640 - RNA, 14 nt, Human
gggagggcuccaga

SEQ ID NO: 1616641 - RNA, 22 nt, Human
gggaggcucuggagcccacugu

SEQ ID NO: 1616642 - RNA, 15 nt, Human
aaaaugugauaugua

SEQ ID NO: 1616643 - RNA, 22 nt, Human
gggcuggguucuacccaggugc

SEQ ID NO: 1616644 - RNA, 22 nt, Human
aaaauuuuuucucuaggaaaua

SEQ ID NO: 1616645 - RNA, 12 nt, Human
aaaaugugugug

SEQ ID NO: 1616646 - RNA, 18 nt, Human
gggcugcaugcgggcuuc

SEQ ID NO: 1616647 - RNA, 21 nt, Human
gggcugcaugcgggcuuccuc

SEQ ID NO: 1616648 - RNA, 18 nt, Human
gggcucagcaaaagaugc

SEQ ID NO: 1616649 - RNA, 22 nt, Human
gggcugcaccggcuggccuggc

SEQ ID NO: 1616650 - RNA, 10 nt, Human
gggcucagca

SEQ ID NO: 1616651 - RNA, 20 nt, Human
gggcuggguucuacccaggu

SEQ ID NO: 1616652 - RNA, 12 nt, Human
gggcugggcaga

SEQ ID NO: 1616653 - RNA, 18 nt, Human
gggcugggagcucugcag

SEQ ID NO: 1616654 - RNA, 16 nt, Human
gggcugggagcucugc

SEQ ID NO: 1616655 - RNA, 21 nt, Human
gggcugcccuggugcugccac

SEQ ID NO: 1616656 - RNA, 15 nt, Human
gggcugcccuggugc

SEQ ID NO: 1616657 - RNA, 14 nt, Human
gggcugcccuggug

SEQ ID NO: 1616658 - RNA, 13 nt, Human
gggcugcccuggu

SEQ ID NO: 1616659 - RNA, 20 nt, Human
aaacagucucaggaaaucaa

SEQ ID NO: 1616660 - RNA, 20 nt, Human
aaacaagcacuaaacaaaga

SEQ ID NO: 1616661 - RNA, 16 nt, Human
aaacacauuuuucuua

SEQ ID NO: 1616662 - RNA, 20 nt, Human
aaacaagaccacguuucuaa

SEQ ID NO: 1616663 - RNA, 20 nt, Human
ggggacagcuccuucugucc

SEQ ID NO: 1616664 - RNA, 14 nt, Human
ggggacagcuccuu

SEQ ID NO: 1616665 - RNA, 12 nt, Human
ggggacagcucc

SEQ ID NO: 1616666 - RNA, 18 nt, Human
aaacauccuacaagacac

SEQ ID NO: 1616667 - RNA, 22 nt, Human
aaacauccuacaagacacagug

SEQ ID NO: 1616668 - RNA, 19 nt, Human
aaaaguauguuagugcaaa

SEQ ID NO: 1616669 - RNA, 21 nt, Human
aaaaugagccuggcaagaaug

SEQ ID NO: 1616670 - RNA, 14 nt, Human
aaaaugagccuggc

SEQ ID NO: 1616671 - RNA, 11 nt, Human
gggccaggagc

SEQ ID NO: 1616672 - RNA, 13 nt, Human
gggccaggcuggg

SEQ ID NO: 1616673 - RNA, 21 nt, Human
aaaaugcuguauuagucacag

SEQ ID NO: 1616674 - RNA, 12 nt, Human
gggccaggagcc

SEQ ID NO: 1616675 - RNA, 21 nt, Human
gggccaggcugggucgcccug

SEQ ID NO: 1616676 - RNA, 15 nt, Human
gggccaggcuggguc

SEQ ID NO: 1616677 - RNA, 14 nt, Human
gggccaggcugggu

SEQ ID NO: 1616678 - RNA, 14 nt, Human
gggccagugcucca

SEQ ID NO: 1616679 - RNA, 18 nt, Human
gggccagugcuccagcca

SEQ ID NO: 1616680 - RNA, 23 nt, Human
gggccaguuggucccccuuccau

SEQ ID NO: 1616681 - RNA, 22 nt, Human
gggccaguuggucccccuucca

SEQ ID NO: 1616682 - RNA, 18 nt, Human
gggccaguuggucccccu

SEQ ID NO: 1616683 - RNA, 14 nt, Human
gggccaguuggucc

SEQ ID NO: 1616684 - RNA, 20 nt, Human
gggccucuuaugggcugggu

SEQ ID NO: 1616685 - RNA, 13 nt, Human
gggccuccugugu

SEQ ID NO: 1616686 - RNA, 15 nt, Human
gggccuccugugugu

SEQ ID NO: 1616687 - RNA, 22 nt, Human
gggccucggacuuagcugggag

SEQ ID NO: 1616688 - RNA, 15 nt, Human
gggcgggaggauguu

SEQ ID NO: 1616689 - RNA, 23 nt, Human
gggcuacaccuuagccugcccuc

SEQ ID NO: 1616690 - RNA, 14 nt, Human
aaauaaugugaaac

SEQ ID NO: 1616691 - RNA, 20 nt, Human
aaauaauuuuuauauuugaa

SEQ ID NO: 1616692 - RNA, 18 nt, Human
aaauaauuuuuauauuug

SEQ ID NO: 1616693 - RNA, 15 nt, Human
aaauaauuuuuauau

SEQ ID NO: 1616694 - RNA, 13 nt, Human
aaauaaugugaaa

SEQ ID NO: 1616695 - RNA, 12 nt, Human
aaauaaugugaa

SEQ ID NO: 1616696 - RNA, 21 nt, Human
aaaguucccuacuuccuguga

SEQ ID NO: 1616697 - RNA, 20 nt, Human
gguuuggacaaaauggaaua

SEQ ID NO: 1616698 - RNA, 23 nt, Human
aaaguuucucuuuucaaaacauu

SEQ ID NO: 1616699 - RNA, 21 nt, Human
aaaguuucucuuuucaaaaca

SEQ ID NO: 1616700 - RNA, 16 nt, Human
aaaguuuguugaaaca

SEQ ID NO: 1616701 - RNA, 16 nt, Human
aaaguugaauuuuaca

SEQ ID NO: 1616702 - RNA, 22 nt, Human
aaaguugaauuuauuggcuuuu

SEQ ID NO: 1616703 - RNA, 16 nt, Human
aaaguugaauuuauug

SEQ ID NO: 1616704 - RNA, 23 nt, Human
aaaguucccuacuuccugugacu

SEQ ID NO: 1616705 - RNA, 13 nt, Human
aaaguugaauuua

SEQ ID NO: 1616706 - RNA, 19 nt, Human
aaaguuuaauauuaaagcc

SEQ ID NO: 1616707 - RNA, 16 nt, Human
aaaguuuaauauuaaa

SEQ ID NO: 1616708 - RNA, 22 nt, Human
aaaguuuaauauuaaagccaug

SEQ ID NO: 1616709 - RNA, 21 nt, Human
aaaguuuaauauuaaagccau

SEQ ID NO: 1616710 - RNA, 20 nt, Human
aaaguuuaauauuaaagcca

SEQ ID NO: 1616711 - RNA, 16 nt, Human
ggugugaccacugcag

SEQ ID NO: 1616712 - RNA, 16 nt, Human
ggugugacugaauuuc

SEQ ID NO: 1616713 - RNA, 18 nt, Human
ggugugagucaccaagcc

SEQ ID NO: 1616714 - RNA, 16 nt, Human
ggugucgggcaugaca

SEQ ID NO: 1616715 - RNA, 13 nt, Human
ggugucgggcaug

SEQ ID NO: 1616716 - RNA, 23 nt, Human
gguggggucacucuggcagcuca

SEQ ID NO: 1616717 - RNA, 15 nt, Human
gguggggucacucug

SEQ ID NO: 1616718 - RNA, 17 nt, Human
gguggggggggugcugg

SEQ ID NO: 1616719 - RNA, 17 nt, Human
gguggggcagcuugagg

SEQ ID NO: 1616720 - RNA, 13 nt, Human
gguggggcagcuu

SEQ ID NO: 1616721 - RNA, 19 nt, Human
ggugggauccuccaggugc

SEQ ID NO: 1616722 - RNA, 15 nt, Human
ggugggauccuccag

SEQ ID NO: 1616723 - RNA, 14 nt, Human
ggugggauccucca

SEQ ID NO: 1616724 - RNA, 20 nt, Human
ggugggaggauugcuugagc

SEQ ID NO: 1616725 - RNA, 18 nt, Human
aaagccuguuuaagagac

SEQ ID NO: 1616726 - RNA, 16 nt, Human
aaagccuguuuaagag

SEQ ID NO: 1616727 - RNA, 16 nt, Human
gguuuagaaagcuugc

SEQ ID NO: 1616728 - RNA, 20 nt, Human
gguuccuuccucugagccuu

SEQ ID NO: 1616729 - RNA, 19 nt, Human
gguuccuuccucugagccu

SEQ ID NO: 1616730 - RNA, 14 nt, Human
gguuucagaaaugu

SEQ ID NO: 1616731 - RNA, 15 nt, Human
gguuucagaaaugug

SEQ ID NO: 1616732 - RNA, 12 nt, Human
gguuucagaaau

SEQ ID NO: 1616733 - RNA, 13 nt, Human
gguuucagaaaug

SEQ ID NO: 1616734 - RNA, 21 nt, Human
gguucccuuugacgccauccc

SEQ ID NO: 1616735 - RNA, 22 nt, Human
gguucccuuugacgccauccca

SEQ ID NO: 1616736 - RNA, 16 nt, Human
gguuccuccccuccuc

SEQ ID NO: 1616737 - RNA, 24 nt, Human
gguuccagcaauucuccugccuca

SEQ ID NO: 1616738 - RNA, 15 nt, Human
gguuccccuguucac

SEQ ID NO: 1616739 - RNA, 23 nt, Human
gguuccagcaauucuccugccuc

SEQ ID NO: 1616740 - RNA, 21 nt, Human
gguucaggguuggccccugcc

SEQ ID NO: 1616741 - RNA, 18 nt, Human
gguucaggguuggccccu

SEQ ID NO: 1616742 - RNA, 22 nt, Human
gguucaggguuggccccugccc

SEQ ID NO: 1616743 - RNA, 13 nt, Human
ggugugcucugau

SEQ ID NO: 1616744 - RNA, 21 nt, Human
ggugugcggccuuuggcuuca

SEQ ID NO: 1616745 - RNA, 12 nt, Human
gguguggaagag

SEQ ID NO: 1616746 - RNA, 12 nt, Human
gguguggagaag

SEQ ID NO: 1616747 - RNA, 13 nt, Human
aaagcaaaggaga

SEQ ID NO: 1616748 - RNA, 15 nt, Human
aaagacuauucaaac

SEQ ID NO: 1616749 - RNA, 17 nt, Human
aaagacuauucaaacag

SEQ ID NO: 1616750 - RNA, 23 nt, Human
gguccugcugcaguugccaguca

SEQ ID NO: 1616751 - RNA, 21 nt, Human
gguccugcugcaguugccagu

SEQ ID NO: 1616752 - RNA, 13 nt, Human
aaagcaaaugucu

SEQ ID NO: 1616753 - RNA, 13 nt, Human
ggucggaaaacau

SEQ ID NO: 1616754 - RNA, 17 nt, Human
ggucuacacugugcuga

SEQ ID NO: 1616755 - RNA, 14 nt, Human
ggucggaaaacaug

SEQ ID NO: 1616756 - RNA, 17 nt, Human
aaagcagggacuugaac

SEQ ID NO: 1616757 - RNA, 19 nt, Human
aaagcaggcagaacucauc

SEQ ID NO: 1616758 - RNA, 17 nt, Human
aaagcaggcagaacuca

SEQ ID NO: 1616759 - RNA, 16 nt, Human
aaagcagcguuucuau

SEQ ID NO: 1616760 - RNA, 18 nt, Human
aaagcagcguuucuauga

SEQ ID NO: 1616761 - RNA, 22 nt, Human
aaagcagcguuucuaugacaca

SEQ ID NO: 1616762 - RNA, 21 nt, Human
gguggaugccugguggcagcu

SEQ ID NO: 1616763 - RNA, 14 nt, Human
gguggaugccuggu

SEQ ID NO: 1616764 - RNA, 15 nt, Human
ggugccaguuauggc

SEQ ID NO: 1616765 - RNA, 20 nt, Human
ggugcugggccccugccucu

SEQ ID NO: 1616766 - RNA, 20 nt, Human
ggugcaaugaccuuucaaua

SEQ ID NO: 1616767 - RNA, 19 nt, Human
ggugcaaugaccuuucaau

SEQ ID NO: 1616768 - RNA, 18 nt, Human
ggugcaaugaccuuucaa

SEQ ID NO: 1616769 - RNA, 20 nt, Human
ggguuuuauuguuuaaaauc

SEQ ID NO: 1616770 - RNA, 17 nt, Human
ggguuucuaaagcugcc

SEQ ID NO: 1616771 - RNA, 20 nt, Human
gguaacaggcagauacagga

SEQ ID NO: 1616772 - RNA, 14 nt, Human
gguaacaggcagau

SEQ ID NO: 1616773 - RNA, 18 nt, Human
gguaacuagggaagauaa

SEQ ID NO: 1616774 - RNA, 23 nt, Human
gguacaaccuguucugcuuuccu

SEQ ID NO: 1616775 - RNA, 24 nt, Human
gguacaaccuguucugcuuuccuc

SEQ ID NO: 1616776 - RNA, 18 nt, Human
gguaaucgaccugccucg

SEQ ID NO: 1616777 - RNA, 17 nt, Human
gguaaucgaccugccuc

SEQ ID NO: 1616778 - RNA, 14 nt, Human
gguaaucgaccugc

SEQ ID NO: 1616779 - RNA, 15 nt, Human
ggguggcaccagcag

SEQ ID NO: 1616780 - RNA, 17 nt, Human
ggguggaugccuggugg

SEQ ID NO: 1616781 - RNA, 13 nt, Human
ggguggaugccug

SEQ ID NO: 1616782 - RNA, 12 nt, Human
ggggccuggcag

SEQ ID NO: 1616783 - RNA, 11 nt, Human
ggggccuggca

SEQ ID NO: 1616784 - RNA, 20 nt, Human
ggguggggaccucaggccug

SEQ ID NO: 1616785 - RNA, 19 nt, Human
ggguggcaccagcagccug

SEQ ID NO: 1616786 - RNA, 17 nt, Human
ggguguggcgcagcaua

SEQ ID NO: 1616787 - RNA, 12 nt, Human
ggguggugaccu

SEQ ID NO: 1616788 - RNA, 18 nt, Human
ggguggggggggugcugg

SEQ ID NO: 1616789 - RNA, 14 nt, Human
aaagacuauucaaa

SEQ ID NO: 1616790 - RNA, 17 nt, Human
aaagacuaucuaaaugu

SEQ ID NO: 1616791 - RNA, 19 nt, Human
aaagacaccuacugagugg

SEQ ID NO: 1616792 - RNA, 13 nt, Human
aaagacaccuacu

SEQ ID NO: 1616793 - RNA, 15 nt, Human
gguccauagagagca

SEQ ID NO: 1616794 - RNA, 17 nt, Human
aaacuuuaccuuuuuua

SEQ ID NO: 1616795 - RNA, 22 nt, Human
aaacuuuaccuuuuuuauacau

SEQ ID NO: 1616796 - RNA, 18 nt, Human
aaacuuuacuauggcccu

SEQ ID NO: 1616797 - RNA, 12 nt, Human
aaacuuuacuau

SEQ ID NO: 1616798 - RNA, 18 nt, Human
aaagaaguggggacagag

SEQ ID NO: 1616799 - RNA, 16 nt, Human
gguccacccaggagcc

SEQ ID NO: 1616800 - RNA, 15 nt, Human
gguccacccaggagc

SEQ ID NO: 1616801 - RNA, 13 nt, Human
gguccacccagga

SEQ ID NO: 1616802 - RNA, 12 nt, Human
gguccacccagg

SEQ ID NO: 1616803 - RNA, 17 nt, Human
gguccacccaggagccc

SEQ ID NO: 1616804 - RNA, 19 nt, Human
gguccacccaggagccccg

SEQ ID NO: 1616805 - RNA, 14 nt, Human
gguaugcaaucaaa

SEQ ID NO: 1616806 - RNA, 22 nt, Human
gguaugaucacggcucacugca

SEQ ID NO: 1616807 - RNA, 16 nt, Human
gguccacaacacacag

SEQ ID NO: 1616808 - RNA, 14 nt, Human
gguagcuuuucccu

SEQ ID NO: 1616809 - RNA, 14 nt, Human
auucuucugcuuca

SEQ ID NO: 1616810 - RNA, 11 nt, Human
auucuuuccug

SEQ ID NO: 1616811 - RNA, 12 nt, Human
auucuucugcuu

SEQ ID NO: 1616812 - RNA, 11 nt, Human
auucuucugcu

SEQ ID NO: 1616813 - RNA, 13 nt, Human
auucuuuccugag

SEQ ID NO: 1616814 - RNA, 21 nt, Human
auugauaagaaccuuuugagu

SEQ ID NO: 1616815 - RNA, 15 nt, Human
auugcuacuguccua

SEQ ID NO: 1616816 - RNA, 17 nt, Human
auugauaugcuuauaca

SEQ ID NO: 1616817 - RNA, 22 nt, Human
auugcuacuguccuacccaccc

SEQ ID NO: 1616818 - RNA, 20 nt, Human
auugcuacuguccuacccac

SEQ ID NO: 1616819 - RNA, 13 nt, Human
auuguaauuauau

SEQ ID NO: 1616820 - RNA, 14 nt, Human
auuguaaaauggug

SEQ ID NO: 1616821 - RNA, 18 nt, Human
auugcuugagcucaggag

SEQ ID NO: 1616822 - RNA, 23 nt, Human
auugugucucuugguccugcugc

SEQ ID NO: 1616823 - RNA, 21 nt, Human
auugugucucuugguccugcu

SEQ ID NO: 1616824 - RNA, 14 nt, Human
auuguaauuauauc

SEQ ID NO: 1616825 - RNA, 16 nt, Human
auuguuagucucuuga

SEQ ID NO: 1616826 - RNA, 14 nt, Human
auugcuugagcuca

SEQ ID NO: 1616827 - RNA, 12 nt, Human
auugcugcuuga

SEQ ID NO: 1616828 - RNA, 23 nt, Human
auugcugauggugcaaugaccuu

SEQ ID NO: 1616829 - RNA, 19 nt, Human
auugcugauggugcaauga

SEQ ID NO: 1616830 - RNA, 18 nt, Human
auugcugauggugcaaug

SEQ ID NO: 1616831 - RNA, 16 nt, Human
auugcugauggugcaa

SEQ ID NO: 1616832 - RNA, 15 nt, Human
auugcugauggugca

SEQ ID NO: 1616833 - RNA, 12 nt, Human
auugcuccuuga

SEQ ID NO: 1616834 - RNA, 22 nt, Human
auucauagcagcuuauucacaa

SEQ ID NO: 1616835 - RNA, 19 nt, Human
auucauagcagcuuauuca

SEQ ID NO: 1616836 - RNA, 19 nt, Human
auucauaaugacuuaagca

SEQ ID NO: 1616837 - RNA, 21 nt, Human
auucauaauuauuauuuggcc

SEQ ID NO: 1616838 - RNA, 15 nt, Human
auucauaaugacuua

SEQ ID NO: 1616839 - RNA, 14 nt, Human
auucauaaugacuu

SEQ ID NO: 1616840 - RNA, 16 nt, Human
auuagggagagaagau

SEQ ID NO: 1616841 - RNA, 16 nt, Human
auuaggugugacugaa

SEQ ID NO: 1616842 - RNA, 18 nt, Human
auuaggugugacugaauu

SEQ ID NO: 1616843 - RNA, 17 nt, Human
auuaugaauuacauuug

SEQ ID NO: 1616844 - RNA, 14 nt, Human
auuaugaauuacau

SEQ ID NO: 1616845 - RNA, 18 nt, Human
auuaugaaacuuuuggaa

SEQ ID NO: 1616846 - RNA, 21 nt, Human
auuaugaaacuuguguaaaua

SEQ ID NO: 1616847 - RNA, 20 nt, Human
auuaugaaacuuguguaaau

SEQ ID NO: 1616848 - RNA, 18 nt, Human
auuaugaaacuuguguaa

SEQ ID NO: 1616849 - RNA, 21 nt, Human
auuaggugugacugaauuucu

SEQ ID NO: 1616850 - RNA, 15 nt, Human
auuaugaaacuugug

SEQ ID NO: 1616851 - RNA, 14 nt, Human
auuaugaaacuugu

SEQ ID NO: 1616852 - RNA, 18 nt, Human
auuaugaauuacauuugu

SEQ ID NO: 1616853 - RNA, 23 nt, Human
auuaugcaugaaguaauaugcac

SEQ ID NO: 1616854 - RNA, 17 nt, Human
auucaaaguugccuaaa

SEQ ID NO: 1616855 - RNA, 22 nt, Human
auucaaaguugccuaaauccau

SEQ ID NO: 1616856 - RNA, 21 nt, Human
auucaaaguugccuaaaucca

SEQ ID NO: 1616857 - RNA, 20 nt, Human
auucaaaguugccuaaaucc

SEQ ID NO: 1616858 - RNA, 18 nt, Human
auucaaaguugccuaaau

SEQ ID NO: 1616859 - RNA, 19 nt, Human
auucacaagacccaaaagg

SEQ ID NO: 1616860 - RNA, 20 nt, Human
auucaaugccccugaauuua

SEQ ID NO: 1616861 - RNA, 18 nt, Human
auucaaugccccugaauu

SEQ ID NO: 1616862 - RNA, 18 nt, Human
auucaaauguauuacagu

SEQ ID NO: 1616863 - RNA, 16 nt, Human
auucaaauguauuaca

SEQ ID NO: 1616864 - RNA, 18 nt, Human
auguuugccucugccucu

SEQ ID NO: 1616865 - RNA, 23 nt, Human
auguuugggagacugcugaguca

SEQ ID NO: 1616866 - RNA, 22 nt, Human
auuacaagcgugagccacugca

SEQ ID NO: 1616867 - RNA, 17 nt, Human
auuacaggaaguacugg

SEQ ID NO: 1616868 - RNA, 19 nt, Human
auuacaguggggaaugaag

SEQ ID NO: 1616869 - RNA, 16 nt, Human
auuacaguauaauuaa

SEQ ID NO: 1616870 - RNA, 15 nt, Human
auuacaguauaauua

SEQ ID NO: 1616871 - RNA, 14 nt, Human
auuacaguauaauu

SEQ ID NO: 1616872 - RNA, 12 nt, Human
auuacaguauaa

SEQ ID NO: 1616873 - RNA, 17 nt, Human
auuagcaguuugcuuug

SEQ ID NO: 1616874 - RNA, 23 nt, Human
auuagauuucucauuugccaaua

SEQ ID NO: 1616875 - RNA, 22 nt, Human
caaagcacugacuucuaaguaa

SEQ ID NO: 1616876 - RNA, 20 nt, Human
caaagcacugacuucuaagu

SEQ ID NO: 1616877 - RNA, 22 nt, Human
caaagauauuuugcuuugugau

SEQ ID NO: 1616878 - RNA, 23 nt, Human
caaagauauuuugcuuugugauu

SEQ ID NO: 1616879 - RNA, 17 nt, Human
caaagcagugcaugcug

SEQ ID NO: 1616880 - RNA, 15 nt, Human
caaagcagugcaugc

SEQ ID NO: 1616881 - RNA, 22 nt, Human
caaaguacacuguuucaaacuu

SEQ ID NO: 1616882 - RNA, 13 nt, Human
caaagugcuggga

SEQ ID NO: 1616883 - RNA, 21 nt, Human
caaaguagaagucuuagaugu

SEQ ID NO: 1616884 - RNA, 14 nt, Human
caaaguagaagucu

SEQ ID NO: 1616885 - RNA, 21 nt, Human
caaagucucuggaauuugaaa

SEQ ID NO: 1616886 - RNA, 15 nt, Human
caaauccuugaagau

SEQ ID NO: 1616887 - RNA, 20 nt, Human
caaauggaaaugggcagagc

SEQ ID NO: 1616888 - RNA, 22 nt, Human
caaauggaaaugggcagagcag

SEQ ID NO: 1616889 - RNA, 21 nt, Human
caaauggaaaugggcagagca

SEQ ID NO: 1616890 - RNA, 23 nt, Human
caacacgagcaggcuacugucag

SEQ ID NO: 1616891 - RNA, 20 nt, Human
caacaccucugcacaagcug

SEQ ID NO: 1616892 - RNA, 22 nt, Human
caacacucacauuuauucugcu

SEQ ID NO: 1616893 - RNA, 14 nt, Human
caacacuaacauga

SEQ ID NO: 1616894 - RNA, 20 nt, Human
caaaaaaaaaaaaaaauuag

SEQ ID NO: 1616895 - RNA, 16 nt, Human
caaaagaugcuucuca

SEQ ID NO: 1616896 - RNA, 15 nt, Human
caaaaggcagaagca

SEQ ID NO: 1616897 - RNA, 18 nt, Human
caaaagaugcuucucacu

SEQ ID NO: 1616898 - RNA, 15 nt, Human
caaacagucucagga

SEQ ID NO: 1616899 - RNA, 19 nt, Human
caaaccaucauugaaaucu

SEQ ID NO: 1616900 - RNA, 21 nt, Human
caaaccaucauugaaaucuuu

SEQ ID NO: 1616901 - RNA, 20 nt, Human
caaagauauuuugcuuugug

SEQ ID NO: 1616902 - RNA, 17 nt, Human
auuugcucauggaauug

SEQ ID NO: 1616903 - RNA, 14 nt, Human
auuugcucauggaa

SEQ ID NO: 1616904 - RNA, 13 nt, Human
auuugcuccuuuc

SEQ ID NO: 1616905 - RNA, 12 nt, Human
auuuggaaaaua

SEQ ID NO: 1616906 - RNA, 13 nt, Human
auuuggaaaauaa

SEQ ID NO: 1616907 - RNA, 17 nt, Human
auuugugauacaaugcu

SEQ ID NO: 1616908 - RNA, 17 nt, Human
auuuggaaaucuuuaaa

SEQ ID NO: 1616909 - RNA, 12 nt, Human
auuuggaaaucu

SEQ ID NO: 1616910 - RNA, 11 nt, Human
auuuggaaauc

SEQ ID NO: 1616911 - RNA, 20 nt, Human
auuugugauacaaugcugug

SEQ ID NO: 1616912 - RNA, 13 nt, Human
auuuggaaaucuu

SEQ ID NO: 1616913 - RNA, 14 nt, Human
auuugugccagaau

SEQ ID NO: 1616914 - RNA, 19 nt, Human
auuuuauagcuacuaauuu

SEQ ID NO: 1616915 - RNA, 16 nt, Human
auuuuaugauccagca

SEQ ID NO: 1616916 - RNA, 15 nt, Human
auuuuaugauccagc

SEQ ID NO: 1616917 - RNA, 14 nt, Human
auuuuaugauccag

SEQ ID NO: 1616918 - RNA, 22 nt, Human
auuuguuugaacugauaaagau

SEQ ID NO: 1616919 - RNA, 23 nt, Human
auuuguuugaacugauaaagaug

SEQ ID NO: 1616920 - RNA, 15 nt, Human
auuugccaauaauaa

SEQ ID NO: 1616921 - RNA, 16 nt, Human
auuugccaauaauaau

SEQ ID NO: 1616922 - RNA, 15 nt, Human
cacuccccugcuggg

SEQ ID NO: 1616923 - RNA, 14 nt, Human
cacuccccugcugg

SEQ ID NO: 1616924 - RNA, 13 nt, Human
cacuccccugcug

SEQ ID NO: 1616925 - RNA, 12 nt, Human
cacuccccugcu

SEQ ID NO: 1616926 - RNA, 21 nt, Human
cacuagggcagggacaggaua

SEQ ID NO: 1616927 - RNA, 20 nt, Human
cacuagggcagggacaggau

SEQ ID NO: 1616928 - RNA, 14 nt, Human
cacuaggcuucugg

SEQ ID NO: 1616929 - RNA, 16 nt, Human
cacuccagugagacag

SEQ ID NO: 1616930 - RNA, 15 nt, Human
cacuccagcugggau

SEQ ID NO: 1616931 - RNA, 12 nt, Human
cacuccagcugg

SEQ ID NO: 1616932 - RNA, 11 nt, Human
cacuccagcug

SEQ ID NO: 1616933 - RNA, 16 nt, Human
cacuccagccugggug

SEQ ID NO: 1616934 - RNA, 22 nt, Human
cacugguucuucuuggucucag

SEQ ID NO: 1616935 - RNA, 23 nt, Human
cacugguggcccgacagccuggc

SEQ ID NO: 1616936 - RNA, 18 nt, Human
cacuuacacuuuaugcac

SEQ ID NO: 1616937 - RNA, 16 nt, Human
cacuuacacuuuaugc

SEQ ID NO: 1616938 - RNA, 19 nt, Human
cacuuguguuuugcaagcc

SEQ ID NO: 1616939 - RNA, 16 nt, Human
cacuugucaauaaaau

SEQ ID NO: 1616940 - RNA, 24 nt, Human
cacuuagaaauugcauuuccugac

SEQ ID NO: 1616941 - RNA, 23 nt, Human
cacuuaggaacguaaucgugucc

SEQ ID NO: 1616942 - RNA, 22 nt, Human
cacuuguguuuugcaagccaga

SEQ ID NO: 1616943 - RNA, 21 nt, Human
cacugcagaagacaguauggc

SEQ ID NO: 1616944 - RNA, 12 nt, Human
cacugcagccuc

SEQ ID NO: 1616945 - RNA, 20 nt, Human
cacugcacuccagccugggu

SEQ ID NO: 1616946 - RNA, 19 nt, Human
cacugcacuccagccuggg

SEQ ID NO: 1616947 - RNA, 18 nt, Human
cacugcacuccagccugg

SEQ ID NO: 1616948 - RNA, 16 nt, Human
cacugcacuccagccu

SEQ ID NO: 1616949 - RNA, 15 nt, Human
cacugcacuccagcc

SEQ ID NO: 1616950 - RNA, 13 nt, Human
cacugcagccuca

SEQ ID NO: 1616951 - RNA, 16 nt, Human
cacugcauguuuguga

SEQ ID NO: 1616952 - RNA, 16 nt, Human
cacugcauccuccgcc

SEQ ID NO: 1616953 - RNA, 14 nt, Human
cacugcauccuccg

SEQ ID NO: 1616954 - RNA, 18 nt, Human
cacugcauccuccgccuc

SEQ ID NO: 1616955 - RNA, 18 nt, Human
cacugggagaaaugaaaa

SEQ ID NO: 1616956 - RNA, 11 nt, Human
caccccagccc

SEQ ID NO: 1616957 - RNA, 12 nt, Human
caccccagcccc

SEQ ID NO: 1616958 - RNA, 13 nt, Human
caccuuggcugca

SEQ ID NO: 1616959 - RNA, 15 nt, Human
caccuuggcucaagu

SEQ ID NO: 1616960 - RNA, 14 nt, Human
caccuuggcugcag

SEQ ID NO: 1616961 - RNA, 24 nt, Human
caccugccuguugggccaggagcc

SEQ ID NO: 1616962 - RNA, 19 nt, Human
caccugccuguugggccag

SEQ ID NO: 1616963 - RNA, 17 nt, Human
caccugccuguugggcc

SEQ ID NO: 1616964 - RNA, 14 nt, Human
cacccucaggcagg

SEQ ID NO: 1616965 - RNA, 16 nt, Human
cacccuggggagaaag

SEQ ID NO: 1616966 - RNA, 15 nt, Human
cacccuggggagaaa

SEQ ID NO: 1616967 - RNA, 17 nt, Human
cacccugaaagcccuga

SEQ ID NO: 1616968 - RNA, 13 nt, Human
caccucagccucc

SEQ ID NO: 1616969 - RNA, 14 nt, Human
caccucagccuccc

SEQ ID NO: 1616970 - RNA, 17 nt, Human
cacccuggggagaaagu

SEQ ID NO: 1616971 - RNA, 16 nt, Human
caccugccccucaacu

SEQ ID NO: 1616972 - RNA, 15 nt, Human
caccugccccucaac

SEQ ID NO: 1616973 - RNA, 14 nt, Human
caccugccccucaa

SEQ ID NO: 1616974 - RNA, 14 nt, Human
caaguccaagcaua

SEQ ID NO: 1616975 - RNA, 17 nt, Human
caagucaagugaaaaag

SEQ ID NO: 1616976 - RNA, 13 nt, Human
caagucaagugaa

SEQ ID NO: 1616977 - RNA, 21 nt, Human
caaguaugaauaaagacaccu

SEQ ID NO: 1616978 - RNA, 19 nt, Human
caaguaugaauaaagacac

SEQ ID NO: 1616979 - RNA, 16 nt, Human
caaggccaaaggaagc

SEQ ID NO: 1616980 - RNA, 15 nt, Human
caaggccaaaggaag

SEQ ID NO: 1616981 - RNA, 18 nt, Human
caaggccaaaggaagcac

SEQ ID NO: 1616982 - RNA, 17 nt, Human
caaggccaaaggaagca

SEQ ID NO: 1616983 - RNA, 16 nt, Human
caaguaugaauaaaga

SEQ ID NO: 1616984 - RNA, 18 nt, Human
caagcugcacccucaggc

SEQ ID NO: 1616985 - RNA, 14 nt, Human
caagcugcacccuc

SEQ ID NO: 1616986 - RNA, 14 nt, Human
caagcucugcuccu

SEQ ID NO: 1616987 - RNA, 20 nt, Human
caagcugcacccucaggcag

SEQ ID NO: 1616988 - RNA, 12 nt, Human
caagcuccaagc

SEQ ID NO: 1616989 - RNA, 17 nt, Human
caagcuccaagcuccca

SEQ ID NO: 1616990 - RNA, 13 nt, Human
caagcucugcucc

SEQ ID NO: 1616991 - RNA, 19 nt, Human
caagcucuaucaccaagga

SEQ ID NO: 1616992 - RNA, 19 nt, Human
caauaaagcagcguuucua

SEQ ID NO: 1616993 - RNA, 18 nt, Human
cacaagacugcacaucaa

SEQ ID NO: 1616994 - RNA, 14 nt, Human
cacaagagcccagg

SEQ ID NO: 1616995 - RNA, 13 nt, Human
caauuuauuaugg

SEQ ID NO: 1616996 - RNA, 15 nt, Human
cacaagcuccaagcu

SEQ ID NO: 1616997 - RNA, 14 nt, Human
cacaagcuccaagc

SEQ ID NO: 1616998 - RNA, 13 nt, Human
cacaagcuccaag

SEQ ID NO: 1616999 - RNA, 16 nt, Human
cacaagagcccaggcc

SEQ ID NO: 1617000 - RNA, 23 nt, Human
cacaagcugcacccucaggcagg

SEQ ID NO: 1617001 - RNA, 17 nt, Human
cacaagcugcacccuca

SEQ ID NO: 1617002 - RNA, 23 nt, Human
cacaagcuccaagcucccaggca

SEQ ID NO: 1617003 - RNA, 17 nt, Human
cacaagcuccaagcucc

SEQ ID NO: 1617004 - RNA, 17 nt, Human
cacaagagcccaggccu

SEQ ID NO: 1617005 - RNA, 15 nt, Human
caauucuugccaaau

SEQ ID NO: 1617006 - RNA, 12 nt, Human
caauggcagccu

SEQ ID NO: 1617007 - RNA, 11 nt, Human
caauggcagcc

SEQ ID NO: 1617008 - RNA, 17 nt, Human
caaugcuguauuuuaaa

SEQ ID NO: 1617009 - RNA, 16 nt, Human
caaugcuguauuuuaa

SEQ ID NO: 1617010 - RNA, 20 nt, Human
caauggagacugucucaaga

SEQ ID NO: 1617011 - RNA, 15 nt, Human
caaugcuguauuuua

SEQ ID NO: 1617012 - RNA, 20 nt, Human
cacacagcucuguccuggga

SEQ ID NO: 1617013 - RNA, 17 nt, Human
cacacagcucuguccug

SEQ ID NO: 1617014 - RNA, 21 nt, Human
cacagccucuuagaugcaguu

SEQ ID NO: 1617015 - RNA, 17 nt, Human
cacagccucuuagaugc

SEQ ID NO: 1617016 - RNA, 23 nt, Human
cacaggcccuuccucuccacugc

SEQ ID NO: 1617017 - RNA, 18 nt, Human
cacaggggaaaagaggag

SEQ ID NO: 1617018 - RNA, 17 nt, Human
cacaggggaaaagagga

SEQ ID NO: 1617019 - RNA, 19 nt, Human
cacaggggaaaagaggagu

SEQ ID NO: 1617020 - RNA, 21 nt, Human
cacaguauuacuucugcuaca

SEQ ID NO: 1617021 - RNA, 20 nt, Human
cacaguauuacuucugcuac

SEQ ID NO: 1617022 - RNA, 22 nt, Human
cacacaugaaguccaagcauuu

SEQ ID NO: 1617023 - RNA, 20 nt, Human
cacacaugagcaucaggcca

SEQ ID NO: 1617024 - RNA, 17 nt, Human
cacacaugaaguccaag

SEQ ID NO: 1617025 - RNA, 23 nt, Human
cacacagugagucgaggacaggg

SEQ ID NO: 1617026 - RNA, 21 nt, Human
cacacagugagucgaggacag

SEQ ID NO: 1617027 - RNA, 15 nt, Human
cacacauacacacac

SEQ ID NO: 1617028 - RNA, 23 nt, Human
cacacaguauuacuucugcuaca

SEQ ID NO: 1617029 - RNA, 20 nt, Human
cacacaguauuacuucugcu

SEQ ID NO: 1617030 - RNA, 18 nt, Human
cacacagugagucgagga

SEQ ID NO: 1617031 - RNA, 22 nt, Human
cacagaaaauggaagacagcuc

SEQ ID NO: 1617032 - RNA, 20 nt, Human
cacagaaaauggaagacagc

SEQ ID NO: 1617033 - RNA, 19 nt, Human
cacagaaaauggaagacag

SEQ ID NO: 1617034 - RNA, 18 nt, Human
cacagaaaauggaagaca

SEQ ID NO: 1617035 - RNA, 22 nt, Human
cacacaugagcaucaggccagg

SEQ ID NO: 1617036 - RNA, 21 nt, Human
cacacaugagcaucaggccag

SEQ ID NO: 1617037 - RNA, 19 nt, Human
cacagaaaauucuucucca

SEQ ID NO: 1617038 - RNA, 23 nt, Human
cacagaaaauggaagacagcucu

SEQ ID NO: 1617039 - RNA, 13 nt, Human
cacagacccugcc

SEQ ID NO: 1617040 - RNA, 11 nt, Human
cacagccucug

SEQ ID NO: 1617041 - RNA, 19 nt, Human
cacagacauacuaaccagc

SEQ ID NO: 1617042 - RNA, 21 nt, Human
cacagacauacuaaccagcag

SEQ ID NO: 1617043 - RNA, 17 nt, Human
ccaaaacucuccucugc

SEQ ID NO: 1617044 - RNA, 20 nt, Human
ccaaaaaccaguauuguaca

SEQ ID NO: 1617045 - RNA, 19 nt, Human
ccaaaaaccaguauuguac

SEQ ID NO: 1617046 - RNA, 16 nt, Human
ccaaaaaccaguauug

SEQ ID NO: 1617047 - RNA, 12 nt, Human
cauuuccaagca

SEQ ID NO: 1617048 - RNA, 22 nt, Human
cauuuggugguuucagaaaugu

SEQ ID NO: 1617049 - RNA, 23 nt, Human
cauuuggugguuucagaaaugug

SEQ ID NO: 1617050 - RNA, 20 nt, Human
cauuuuugaauacaggcaua

SEQ ID NO: 1617051 - RNA, 18 nt, Human
cauuuuugaauacaggca

SEQ ID NO: 1617052 - RNA, 16 nt, Human
cauuuauucugcucac

SEQ ID NO: 1617053 - RNA, 18 nt, Human
cauuucauuugugccaga

SEQ ID NO: 1617054 - RNA, 21 nt, Human
cauugcggacagccacggcca

SEQ ID NO: 1617055 - RNA, 17 nt, Human
cauugcggacagccacg

SEQ ID NO: 1617056 - RNA, 15 nt, Human
cauugcggacagcca

SEQ ID NO: 1617057 - RNA, 14 nt, Human
cauugcggacagcc

SEQ ID NO: 1617058 - RNA, 18 nt, Human
cauugcugggcuugucug

SEQ ID NO: 1617059 - RNA, 15 nt, Human
cauuaggauggcuag

SEQ ID NO: 1617060 - RNA, 12 nt, Human
cauuaucuagau

SEQ ID NO: 1617061 - RNA, 16 nt, Human
cauuaucuagauacug

SEQ ID NO: 1617062 - RNA, 17 nt, Human
cauuaucuagauacugu

SEQ ID NO: 1617063 - RNA, 15 nt, Human
cauguucucugagga

SEQ ID NO: 1617064 - RNA, 22 nt, Human
cauggcugccaaugggagcuca

SEQ ID NO: 1617065 - RNA, 22 nt, Human
cauggcuggagcuagaauuuga

SEQ ID NO: 1617066 - RNA, 18 nt, Human
cauuaucuagauacugua

SEQ ID NO: 1617067 - RNA, 13 nt, Human
cauuaugaugugu

SEQ ID NO: 1617068 - RNA, 16 nt, Human
cauucucacuccuacc

SEQ ID NO: 1617069 - RNA, 17 nt, Human
cauucucacuccuaccu

SEQ ID NO: 1617070 - RNA, 16 nt, Human
cauucuccuuguguua

SEQ ID NO: 1617071 - RNA, 20 nt, Human
cauucuccuuguguuacuaa

SEQ ID NO: 1617072 - RNA, 21 nt, Human
cauucuccuaucaccugucuu

SEQ ID NO: 1617073 - RNA, 20 nt, Human
ccaauguucucucuucucca

SEQ ID NO: 1617074 - RNA, 22 nt, Human
ccaaugcacuuuguucuggcuc

SEQ ID NO: 1617075 - RNA, 20 nt, Human
ccaaugcacuuuguucuggc

SEQ ID NO: 1617076 - RNA, 23 nt, Human
ccaaugcacuuuguucuggcucu

SEQ ID NO: 1617077 - RNA, 20 nt, Human
ccaaaacucuccucugcugc

SEQ ID NO: 1617078 - RNA, 22 nt, Human
ccaaagugcugggauuacaggc

SEQ ID NO: 1617079 - RNA, 19 nt, Human
ccaaagugcugggauuaca

SEQ ID NO: 1617080 - RNA, 12 nt, Human
ccaaauuaagag

SEQ ID NO: 1617081 - RNA, 12 nt, Human
ccaaaugcagcu

SEQ ID NO: 1617082 - RNA, 22 nt, Human
ccaaagugcugggauuacaggu

SEQ ID NO: 1617083 - RNA, 11 nt, Human
ccaacuuguaa

SEQ ID NO: 1617084 - RNA, 17 nt, Human
ccaccaucaagccacca

SEQ ID NO: 1617085 - RNA, 16 nt, Human
ccaccaucaagccacc

SEQ ID NO: 1617086 - RNA, 23 nt, Human
ccacagaaaagaaaguucaugcu

SEQ ID NO: 1617087 - RNA, 22 nt, Human
ccacacuucaggcucuucuccu

SEQ ID NO: 1617088 - RNA, 17 nt, Human
ccaccgcagacaggacc

SEQ ID NO: 1617089 - RNA, 14 nt, Human
ccaccgcagacagg

SEQ ID NO: 1617090 - RNA, 20 nt, Human
ccaccaucaagccaccaaca

SEQ ID NO: 1617091 - RNA, 18 nt, Human
ccaccaucaccagacagg

SEQ ID NO: 1617092 - RNA, 13 nt, Human
ccacccugcucuc

SEQ ID NO: 1617093 - RNA, 15 nt, Human
ccaccuuggcucaag

SEQ ID NO: 1617094 - RNA, 14 nt, Human
ccaccuuggcucaa

SEQ ID NO: 1617095 - RNA, 18 nt, Human
ccaccgcagacaggacca

SEQ ID NO: 1617096 - RNA, 19 nt, Human
ccaccgcagacaggaccag

SEQ ID NO: 1617097 - RNA, 23 nt, Human
ccaccgggcugggagcucugcag

SEQ ID NO: 1617098 - RNA, 18 nt, Human
cauagauucccugagcag

SEQ ID NO: 1617099 - RNA, 17 nt, Human
cauagauucccugagca

SEQ ID NO: 1617100 - RNA, 15 nt, Human
cauacaauuccaaac

SEQ ID NO: 1617101 - RNA, 21 nt, Human
cauaaugcgugcauaccacuu

SEQ ID NO: 1617102 - RNA, 12 nt, Human
cauagcccucac

SEQ ID NO: 1617103 - RNA, 19 nt, Human
cauagcccucacccugggg

SEQ ID NO: 1617104 - RNA, 15 nt, Human
cauagcccucacccu

SEQ ID NO: 1617105 - RNA, 17 nt, Human
cauauuaccacagacau

SEQ ID NO: 1617106 - RNA, 20 nt, Human
cauauuaccacagacauacu

SEQ ID NO: 1617107 - RNA, 21 nt, Human
cauauuaccacagacauacua

SEQ ID NO: 1617108 - RNA, 22 nt, Human
cauauuaccacagacauacuaa

SEQ ID NO: 1617109 - RNA, 21 nt, Human
caguuuguuaguaugaggcau

SEQ ID NO: 1617110 - RNA, 20 nt, Human
cauaaucuggacuccucugu

SEQ ID NO: 1617111 - RNA, 22 nt, Human
cauaaucuggacuccucugucc

SEQ ID NO: 1617112 - RNA, 21 nt, Human
cauaaucuggacuccucuguc

SEQ ID NO: 1617113 - RNA, 14 nt, Human
cauaaugcgugcau

SEQ ID NO: 1617114 - RNA, 17 nt, Human
cauaaugcgugcauacc

SEQ ID NO: 1617115 - RNA, 23 nt, Human
cauaaucuggacuccucugucca

SEQ ID NO: 1617116 - RNA, 12 nt, Human
caguuugcuuug

SEQ ID NO: 1617117 - RNA, 21 nt, Human
caguuugcuuuguaugcacuu

SEQ ID NO: 1617118 - RNA, 14 nt, Human
caguuugcuuugua

SEQ ID NO: 1617119 - RNA, 18 nt, Human
cagucaccccggccaccu

SEQ ID NO: 1617120 - RNA, 16 nt, Human
caugaauuaguuuuau

SEQ ID NO: 1617121 - RNA, 14 nt, Human
caugacacgaauau

SEQ ID NO: 1617122 - RNA, 14 nt, Human
caugaauuugugaa

SEQ ID NO: 1617123 - RNA, 18 nt, Human
caugacacgaauauugcu

SEQ ID NO: 1617124 - RNA, 17 nt, Human
caugacacgaauauugc

SEQ ID NO: 1617125 - RNA, 18 nt, Human
caugcugcccugugagua

SEQ ID NO: 1617126 - RNA, 16 nt, Human
caugcugcccugugag

SEQ ID NO: 1617127 - RNA, 19 nt, Human
cauggccuuugcuugaaag

SEQ ID NO: 1617128 - RNA, 22 nt, Human
cauggccuuugcuugaaagaaa

SEQ ID NO: 1617129 - RNA, 14 nt, Human
caugcugccuccag

SEQ ID NO: 1617130 - RNA, 12 nt, Human
caugcugccucc

SEQ ID NO: 1617131 - RNA, 17 nt, Human
caugcaaggucauuuuu

SEQ ID NO: 1617132 - RNA, 18 nt, Human
caugcaaggucauuuuuu

SEQ ID NO: 1617133 - RNA, 22 nt, Human
caugcaaggucauuuuuuuuaa

SEQ ID NO: 1617134 - RNA, 18 nt, Human
caucagcugcugaaacaa

SEQ ID NO: 1617135 - RNA, 17 nt, Human
caucagcugcugaaaca

SEQ ID NO: 1617136 - RNA, 15 nt, Human
caucagcugcugaaa

SEQ ID NO: 1617137 - RNA, 19 nt, Human
caucagcacgauuucuguu

SEQ ID NO: 1617138 - RNA, 20 nt, Human
caucagcuugcccuguuaaa

SEQ ID NO: 1617139 - RNA, 13 nt, Human
caucaggccaggc

SEQ ID NO: 1617140 - RNA, 17 nt, Human
caucagcacgauuucug

SEQ ID NO: 1617141 - RNA, 18 nt, Human
caucagcacgauuucugu

SEQ ID NO: 1617142 - RNA, 23 nt, Human
caucaggccaggcccucugccca

SEQ ID NO: 1617143 - RNA, 22 nt, Human
caucaggccaggcccucugccc

SEQ ID NO: 1617144 - RNA, 21 nt, Human
caucaggccaggcccucugcc

SEQ ID NO: 1617145 - RNA, 14 nt, Human
caucaggccaggcc

SEQ ID NO: 1617146 - RNA, 14 nt, Human
caucccagccccaa

SEQ ID NO: 1617147 - RNA, 13 nt, Human
caucccagcccca

SEQ ID NO: 1617148 - RNA, 16 nt, Human
caucccagccccaaug

SEQ ID NO: 1617149 - RNA, 17 nt, Human
caucccagccccaauga

SEQ ID NO: 1617150 - RNA, 22 nt, Human
caucuuagguuggcaaaaaggc

SEQ ID NO: 1617151 - RNA, 21 nt, Human
caucuuagguuggcaaaaagg

SEQ ID NO: 1617152 - RNA, 19 nt, Human
caucugugaaaggaaagag

SEQ ID NO: 1617153 - RNA, 18 nt, Human
caucugugaaaggaaaga

SEQ ID NO: 1617154 - RNA, 12 nt, Human
caucgcaaugua

SEQ ID NO: 1617155 - RNA, 23 nt, Human
cagccugagcgacagugagacuc

SEQ ID NO: 1617156 - RNA, 17 nt, Human
cagccucugaaaaccaa

SEQ ID NO: 1617157 - RNA, 23 nt, Human
cagccgccaugcuccuggcccac

SEQ ID NO: 1617158 - RNA, 15 nt, Human
cagcccuuagcaggg

SEQ ID NO: 1617159 - RNA, 13 nt, Human
cagcccuuagcag

SEQ ID NO: 1617160 - RNA, 14 nt, Human
cagcggggacagcu

SEQ ID NO: 1617161 - RNA, 19 nt, Human
cagcguuucuaugacacau

SEQ ID NO: 1617162 - RNA, 16 nt, Human
cagcguuucuaugaca

SEQ ID NO: 1617163 - RNA, 14 nt, Human
cagcguuucuauga

SEQ ID NO: 1617164 - RNA, 19 nt, Human
cagccccgugggguuccuc

SEQ ID NO: 1617165 - RNA, 13 nt, Human
cagccccugcaca

SEQ ID NO: 1617166 - RNA, 22 nt, Human
cagccccauucugccugcccag

SEQ ID NO: 1617167 - RNA, 20 nt, Human
cagccccauucugccugccc

SEQ ID NO: 1617168 - RNA, 19 nt, Human
cagccccauucugccugcc

SEQ ID NO: 1617169 - RNA, 24 nt, Human
cagccccauucugccugcccaggc

SEQ ID NO: 1617170 - RNA, 23 nt, Human
cagccccauucugccugcccagg

SEQ ID NO: 1617171 - RNA, 19 nt, Human
cagcaguucagagcugccc

SEQ ID NO: 1617172 - RNA, 20 nt, Human
cagcaguucagagcugcccu

SEQ ID NO: 1617173 - RNA, 18 nt, Human
cagcaguucagagcugcc

SEQ ID NO: 1617174 - RNA, 21 nt, Human
cagcaguucagagcugcccuc

SEQ ID NO: 1617175 - RNA, 22 nt, Human
cagcaguucagagcugcccucu

SEQ ID NO: 1617176 - RNA, 18 nt, Human
cagcauauucaggaagcu

SEQ ID NO: 1617177 - RNA, 17 nt, Human
cagcauauucaggaagc

SEQ ID NO: 1617178 - RNA, 16 nt, Human
cagcauauucaggaag

SEQ ID NO: 1617179 - RNA, 19 nt, Human
cagauuucacucuccuugg

SEQ ID NO: 1617180 - RNA, 18 nt, Human
cagauuucacucuccuug

SEQ ID NO: 1617181 - RNA, 16 nt, Human
cagauuucacucuccu

SEQ ID NO: 1617182 - RNA, 15 nt, Human
cagauuucacucucc

SEQ ID NO: 1617183 - RNA, 14 nt, Human
cagauuugagcuca

SEQ ID NO: 1617184 - RNA, 13 nt, Human
cagauuugagcuc

SEQ ID NO: 1617185 - RNA, 16 nt, Human
cagauuugagcucagc

SEQ ID NO: 1617186 - RNA, 16 nt, Human
cagagguugcagugag

SEQ ID NO: 1617187 - RNA, 23 nt, Human
cagauacaggaaaagcugcugac

SEQ ID NO: 1617188 - RNA, 16 nt, Human
cagaucauugugaaau

SEQ ID NO: 1617189 - RNA, 13 nt, Human
cagauacuggauu

SEQ ID NO: 1617190 - RNA, 22 nt, Human
cagaucauugugaaauuauuca

SEQ ID NO: 1617191 - RNA, 20 nt, Human
cagagacuccugcaggcagc

SEQ ID NO: 1617192 - RNA, 22 nt, Human
cagagacuccugcaggcagcca

SEQ ID NO: 1617193 - RNA, 21 nt, Human
cagagacuccugcaggcagcc

SEQ ID NO: 1617194 - RNA, 23 nt, Human
cagagacuccugcaggcagccag

SEQ ID NO: 1617195 - RNA, 22 nt, Human
cagagagggugggagugggccc

SEQ ID NO: 1617196 - RNA, 20 nt, Human
cagagagggugggagugggc

SEQ ID NO: 1617197 - RNA, 14 nt, Human
cagagccugcaguu

SEQ ID NO: 1617198 - RNA, 23 nt, Human
cagagagggugggagugggccca

SEQ ID NO: 1617199 - RNA, 16 nt, Human
cagagagggugggagu

SEQ ID NO: 1617200 - RNA, 22 nt, Human
cagagcuacacaggggaaaaga

SEQ ID NO: 1617201 - RNA, 17 nt, Human
cagagcuacacagggga

SEQ ID NO: 1617202 - RNA, 19 nt, Human
caggaaaucaaauaugcaa

SEQ ID NO: 1617203 - RNA, 21 nt, Human
caggaaaucaaauaugcaaag

SEQ ID NO: 1617204 - RNA, 22 nt, Human
caggaaaucaaauaugcaaagc

SEQ ID NO: 1617205 - RNA, 17 nt, Human
cagcuuauucacaagac

SEQ ID NO: 1617206 - RNA, 16 nt, Human
cagcuuauucacaaga

SEQ ID NO: 1617207 - RNA, 19 nt, Human
cagcuguucagcugguuga

SEQ ID NO: 1617208 - RNA, 16 nt, Human
cagcuguucagcuggu

SEQ ID NO: 1617209 - RNA, 15 nt, Human
cagcuguucagcugg

SEQ ID NO: 1617210 - RNA, 20 nt, Human
caggaaaagcugcugacagu

SEQ ID NO: 1617211 - RNA, 19 nt, Human
caggaaaagcugcugacag

SEQ ID NO: 1617212 - RNA, 22 nt, Human
caggaaaggcuccaggagcagc

SEQ ID NO: 1617213 - RNA, 21 nt, Human
caggaaaggcuccaggagcag

SEQ ID NO: 1617214 - RNA, 23 nt, Human
caggaaaggcuccaggagcagcc

SEQ ID NO: 1617215 - RNA, 24 nt, Human
caggacagcccuucuuuccacaga

SEQ ID NO: 1617216 - RNA, 23 nt, Human
caggacagcccuucuuuccacag

SEQ ID NO: 1617217 - RNA, 13 nt, Human
caggaccucaggu

SEQ ID NO: 1617218 - RNA, 21 nt, Human
caggaccagggauuuccauga

SEQ ID NO: 1617219 - RNA, 13 nt, Human
caggaccagggau

SEQ ID NO: 1617220 - RNA, 16 nt, Human
caggccaggcccucug

SEQ ID NO: 1617221 - RNA, 15 nt, Human
caggccaggcccucu

SEQ ID NO: 1617222 - RNA, 14 nt, Human
caggccaggcccuc

SEQ ID NO: 1617223 - RNA, 13 nt, Human
caggccaggcccu

SEQ ID NO: 1617224 - RNA, 15 nt, Human
caggccagcugcuug

SEQ ID NO: 1617225 - RNA, 13 nt, Human
caggccagcugcu

SEQ ID NO: 1617226 - RNA, 23 nt, Human
caggcacugcugcccagccucca

SEQ ID NO: 1617227 - RNA, 20 nt, Human
caggcaaugcuggcuguugg

SEQ ID NO: 1617228 - RNA, 19 nt, Human
caggcaaugcuggcuguug

SEQ ID NO: 1617229 - RNA, 13 nt, Human
caggaggccagcc

SEQ ID NO: 1617230 - RNA, 12 nt, Human
caggaggccagc

SEQ ID NO: 1617231 - RNA, 14 nt, Human
caggaggccagccu

SEQ ID NO: 1617232 - RNA, 21 nt, Human
caggcaaugcuggcuguuggc

SEQ ID NO: 1617233 - RNA, 17 nt, Human
caggcacugcugcccag

SEQ ID NO: 1617234 - RNA, 16 nt, Human
caggcacugcugccca

SEQ ID NO: 1617235 - RNA, 22 nt, Human
cagggaggacgcucucuggccu

SEQ ID NO: 1617236 - RNA, 15 nt, Human
caggcugggcuucag

SEQ ID NO: 1617237 - RNA, 14 nt, Human
caggcugggcuuca

SEQ ID NO: 1617238 - RNA, 15 nt, Human
cagggcucagcgggg

SEQ ID NO: 1617239 - RNA, 12 nt, Human
cagggcucagcg

SEQ ID NO: 1617240 - RNA, 20 nt, Human
cagggcucagcggggacagc

SEQ ID NO: 1617241 - RNA, 16 nt, Human
cagggagggcuucugc

SEQ ID NO: 1617242 - RNA, 18 nt, Human
cagggagggccugggccc

SEQ ID NO: 1617243 - RNA, 20 nt, Human
caggcugggagagccuucca

SEQ ID NO: 1617244 - RNA, 19 nt, Human
caggcugggagagccuucc

SEQ ID NO: 1617245 - RNA, 18 nt, Human
caggcugggagagccuuc

SEQ ID NO: 1617246 - RNA, 16 nt, Human
caggcugggagagccu

SEQ ID NO: 1617247 - RNA, 19 nt, Human
caggcuggcgugcaguggu

SEQ ID NO: 1617248 - RNA, 18 nt, Human
caggcuggcgugcagugg

SEQ ID NO: 1617249 - RNA, 17 nt, Human
caggcuggcgugcagug

SEQ ID NO: 1617250 - RNA, 23 nt, Human
caggccugggggcugggcagagg

SEQ ID NO: 1617251 - RNA, 22 nt, Human
caggccugggggcugggcagag

SEQ ID NO: 1617252 - RNA, 20 nt, Human
caggccugggggcugggcag

SEQ ID NO: 1617253 - RNA, 17 nt, Human
cagucaccccggccacc

SEQ ID NO: 1617254 - RNA, 16 nt, Human
cagucaccccggccac

SEQ ID NO: 1617255 - RNA, 22 nt, Human
caguauuguacaaaguauuaag

SEQ ID NO: 1617256 - RNA, 19 nt, Human
caguaaaugggggugcauu

SEQ ID NO: 1617257 - RNA, 20 nt, Human
caguaaaugggggugcauuu

SEQ ID NO: 1617258 - RNA, 18 nt, Human
caguaaaugggggugcau

SEQ ID NO: 1617259 - RNA, 21 nt, Human
caggguuggccccugcccggc

SEQ ID NO: 1617260 - RNA, 17 nt, Human
caggguuggccccugcc

SEQ ID NO: 1617261 - RNA, 14 nt, Human
caggugcugccauc

SEQ ID NO: 1617262 - RNA, 13 nt, Human
caggugcugccau

SEQ ID NO: 1617263 - RNA, 23 nt, Human
cagguuuuuggucugacccacug

SEQ ID NO: 1617264 - RNA, 23 nt, Human
cagggucucacucugucgcccag

SEQ ID NO: 1617265 - RNA, 21 nt, Human
cagggucucuaccauccccug

SEQ ID NO: 1617266 - RNA, 16 nt, Human
caggguuggccccugc

SEQ ID NO: 1617267 - RNA, 15 nt, Human
caggguuggccccug

SEQ ID NO: 1617268 - RNA, 15 nt, Human
ccagauccuggaaau

SEQ ID NO: 1617269 - RNA, 19 nt, Human
ccagagggccugcaaggga

SEQ ID NO: 1617270 - RNA, 18 nt, Human
ccagagggccugcaaggg

SEQ ID NO: 1617271 - RNA, 17 nt, Human
ccagagggccugcaagg

SEQ ID NO: 1617272 - RNA, 16 nt, Human
ccaccuuggcucaagu

SEQ ID NO: 1617273 - RNA, 20 nt, Human
ccagagggccugcaagggag

SEQ ID NO: 1617274 - RNA, 15 nt, Human
ccagaugcaccagcc

SEQ ID NO: 1617275 - RNA, 17 nt, Human
ccagaugcaccagcccu

SEQ ID NO: 1617276 - RNA, 18 nt, Human
ccagaugcaccagcccuu

SEQ ID NO: 1617277 - RNA, 23 nt, Human
ccagaugcaccagcccuuagcag

SEQ ID NO: 1617278 - RNA, 15 nt, Human
ccagcaggcucucag

SEQ ID NO: 1617279 - RNA, 13 nt, Human
ccagcaggcucuc

SEQ ID NO: 1617280 - RNA, 22 nt, Human
ccagcagauuauucacugauuu

SEQ ID NO: 1617281 - RNA, 21 nt, Human
ccagcagauuauucacugauu

SEQ ID NO: 1617282 - RNA, 22 nt, Human
ccagcucaccagccccagugcc

SEQ ID NO: 1617283 - RNA, 16 nt, Human
ccagcucaccagcccc

SEQ ID NO: 1617284 - RNA, 15 nt, Human
ccagcucaccagccc

SEQ ID NO: 1617285 - RNA, 19 nt, Human
ccagcuuaaaggggcuaga

SEQ ID NO: 1617286 - RNA, 16 nt, Human
ccagcuuaucucaggg

SEQ ID NO: 1617287 - RNA, 17 nt, Human
ccagcuguucagcuggu

SEQ ID NO: 1617288 - RNA, 12 nt, Human
ccagccccugga

SEQ ID NO: 1617289 - RNA, 11 nt, Human
ccagccccugg

SEQ ID NO: 1617290 - RNA, 13 nt, Human
ccaggaagccagc

SEQ ID NO: 1617291 - RNA, 14 nt, Human
ccaggaagccagca

SEQ ID NO: 1617292 - RNA, 12 nt, Human
ccaggaagccag

SEQ ID NO: 1617293 - RNA, 15 nt, Human
ccaggaaaggcucca

SEQ ID NO: 1617294 - RNA, 14 nt, Human
ccaggaaaggcucc

SEQ ID NO: 1617295 - RNA, 16 nt, Human
ccaggaaaggcuccag

SEQ ID NO: 1617296 - RNA, 20 nt, Human
ccauggucggaaaacaugcu

SEQ ID NO: 1617297 - RNA, 23 nt, Human
ccaugagccucagcauccuggca

SEQ ID NO: 1617298 - RNA, 21 nt, Human
ccaugagccucagcauccugg

SEQ ID NO: 1617299 - RNA, 20 nt, Human
ccaucccugaaggccccgcc

SEQ ID NO: 1617300 - RNA, 17 nt, Human
ccaucccugaaggcccc

SEQ ID NO: 1617301 - RNA, 15 nt, Human
ccaucccugaaggcc

SEQ ID NO: 1617302 - RNA, 14 nt, Human
ccaucccugaaggc

SEQ ID NO: 1617303 - RNA, 15 nt, Human
ccaucccagccccaa

SEQ ID NO: 1617304 - RNA, 14 nt, Human
ccaucccagcccca

SEQ ID NO: 1617305 - RNA, 23 nt, Human
ccaguuggucccccuuccaugga

SEQ ID NO: 1617306 - RNA, 23 nt, Human
ccaguuggguggaugccuggugg

SEQ ID NO: 1617307 - RNA, 20 nt, Human
ccaguuggguggaugccugg

SEQ ID NO: 1617308 - RNA, 19 nt, Human
ccaguuggguggaugccug

SEQ ID NO: 1617309 - RNA, 17 nt, Human
ccaguuggguggaugcc

SEQ ID NO: 1617310 - RNA, 17 nt, Human
ccaggggugggacaccc

SEQ ID NO: 1617311 - RNA, 14 nt, Human
ccaggggugggaca

SEQ ID NO: 1617312 - RNA, 19 nt, Human
ccaggggugggacacccug

SEQ ID NO: 1617313 - RNA, 13 nt, Human
ccaggggugggac

SEQ ID NO: 1617314 - RNA, 20 nt, Human
ccaggggaaaaucagccugc

SEQ ID NO: 1617315 - RNA, 19 nt, Human
ccaggggaaaaucagccug

SEQ ID NO: 1617316 - RNA, 18 nt, Human
ccaggcuggcgugcagug

SEQ ID NO: 1617317 - RNA, 17 nt, Human
ccaggcuggcgugcagu

SEQ ID NO: 1617318 - RNA, 19 nt, Human
ccaggcuggcgugcagugg

SEQ ID NO: 1617319 - RNA, 21 nt, Human
ccaggcuccuuuagcgcccag

SEQ ID NO: 1617320 - RNA, 20 nt, Human
ccaggcuccuuuagcgccca

SEQ ID NO: 1617321 - RNA, 18 nt, Human
ccaggcacugcugcccag

SEQ ID NO: 1617322 - RNA, 16 nt, Human
ccaggcacugcugccc

SEQ ID NO: 1617323 - RNA, 23 nt, Human
cccgggaggcagagguugcagug

SEQ ID NO: 1617324 - RNA, 18 nt, Human
cccuauuagagaagagau

SEQ ID NO: 1617325 - RNA, 17 nt, Human
cccuauugguaaagaau

SEQ ID NO: 1617326 - RNA, 17 nt, Human
cccggccaccugcggug

SEQ ID NO: 1617327 - RNA, 16 nt, Human
cccggcuccaggcucc

SEQ ID NO: 1617328 - RNA, 15 nt, Human
cccggcuccaggcuc

SEQ ID NO: 1617329 - RNA, 14 nt, Human
cccggcuccaggcu

SEQ ID NO: 1617330 - RNA, 13 nt, Human
cccggcuccaggc

SEQ ID NO: 1617331 - RNA, 12 nt, Human
cccggcuccagg

SEQ ID NO: 1617332 - RNA, 14 nt, Human
cccggccaccugcg

SEQ ID NO: 1617333 - RNA, 13 nt, Human
cccggccaccugc

SEQ ID NO: 1617334 - RNA, 14 nt, Human
cccgaauagcuggg

SEQ ID NO: 1617335 - RNA, 19 nt, Human
ccccucuggcuccagcugg

SEQ ID NO: 1617336 - RNA, 23 nt, Human
cccauuguggucacaggaaguag

SEQ ID NO: 1617337 - RNA, 22 nt, Human
ccccaaaacucuccucugcugc

SEQ ID NO: 1617338 - RNA, 22 nt, Human
cccauuguggucacaggaagua

SEQ ID NO: 1617339 - RNA, 23 nt, Human
ccccaaaacucuccucugcugcu

SEQ ID NO: 1617340 - RNA, 22 nt, Human
ccccagcaagugagagcugggu

SEQ ID NO: 1617341 - RNA, 13 nt, Human
ccccagaggcugg

SEQ ID NO: 1617342 - RNA, 22 nt, Human
cccccaaauggaaaugggcaga

SEQ ID NO: 1617343 - RNA, 23 nt, Human
ccccgacccuugccgucuaccug

SEQ ID NO: 1617344 - RNA, 13 nt, Human
ccccggccaccug

SEQ ID NO: 1617345 - RNA, 23 nt, Human
ccccgaggccuucucugaaggac

SEQ ID NO: 1617346 - RNA, 17 nt, Human
cccagccagcaguucag

SEQ ID NO: 1617347 - RNA, 20 nt, Human
cccagccagcaguucagagc

SEQ ID NO: 1617348 - RNA, 23 nt, Human
cccagcucugguccauagagagc

SEQ ID NO: 1617349 - RNA, 16 nt, Human
cccagccagcaguuca

SEQ ID NO: 1617350 - RNA, 24 nt, Human
cccagccagcaguucagagcugcc

SEQ ID NO: 1617351 - RNA, 20 nt, Human
cccauauuuguacaccaaua

SEQ ID NO: 1617352 - RNA, 17 nt, Human
cccaggcuggcgugcag

SEQ ID NO: 1617353 - RNA, 13 nt, Human
cccaggcuggcgu

SEQ ID NO: 1617354 - RNA, 15 nt, Human
cccaggaaaggcucc

SEQ ID NO: 1617355 - RNA, 15 nt, Human
cccagcuugaaaccu

SEQ ID NO: 1617356 - RNA, 13 nt, Human
cccauccucugua

SEQ ID NO: 1617357 - RNA, 12 nt, Human
cccacucccugc

SEQ ID NO: 1617358 - RNA, 18 nt, Human
cccacuagacccacugga

SEQ ID NO: 1617359 - RNA, 13 nt, Human
cccacugcucugg

SEQ ID NO: 1617360 - RNA, 12 nt, Human
cccacugcucug

SEQ ID NO: 1617361 - RNA, 19 nt, Human
cccacugcuuuuggucugu

SEQ ID NO: 1617362 - RNA, 22 nt, Human
cccacugcuuuuggucugugug

SEQ ID NO: 1617363 - RNA, 22 nt, Human
cccacccaagggccuggccuga

SEQ ID NO: 1617364 - RNA, 21 nt, Human
cccacccaagggccuggccug

SEQ ID NO: 1617365 - RNA, 20 nt, Human
cccacccaagggccuggccu

SEQ ID NO: 1617366 - RNA, 15 nt, Human
cccacccccacccaa

SEQ ID NO: 1617367 - RNA, 17 nt, Human
cccacccccacccaagg

SEQ ID NO: 1617368 - RNA, 18 nt, Human
cccacccugaaagcccug

SEQ ID NO: 1617369 - RNA, 17 nt, Human
ccucugcuugccauccc

SEQ ID NO: 1617370 - RNA, 13 nt, Human
ccucugcuugcca

SEQ ID NO: 1617371 - RNA, 18 nt, Human
ccucugcugcuggcuggu

SEQ ID NO: 1617372 - RNA, 17 nt, Human
ccucugcugcuggcugg

SEQ ID NO: 1617373 - RNA, 16 nt, Human
ccucugcugcuggcug

SEQ ID NO: 1617374 - RNA, 15 nt, Human
ccucugcugcuggcu

SEQ ID NO: 1617375 - RNA, 14 nt, Human
ccucugcugcuggc

SEQ ID NO: 1617376 - RNA, 13 nt, Human
ccucugcugcugg

SEQ ID NO: 1617377 - RNA, 18 nt, Human
ccucugcugauccuccca

SEQ ID NO: 1617378 - RNA, 15 nt, Human
ccucugcugauccuc

SEQ ID NO: 1617379 - RNA, 22 nt, Human
ccucugccugaagucacacagu

SEQ ID NO: 1617380 - RNA, 12 nt, Human
ccucugccuguc

SEQ ID NO: 1617381 - RNA, 22 nt, Human
ccucucugcaggucccuaauaa

SEQ ID NO: 1617382 - RNA, 21 nt, Human
ccucucugcaggucccuaaua

SEQ ID NO: 1617383 - RNA, 23 nt, Human
ccucucugcaggucccuaauaaa

SEQ ID NO: 1617384 - RNA, 12 nt, Human
ccucucugcccu

SEQ ID NO: 1617385 - RNA, 12 nt, Human
ccucucucaggc

SEQ ID NO: 1617386 - RNA, 17 nt, Human
ccucucucacuccuuga

SEQ ID NO: 1617387 - RNA, 15 nt, Human
ccucucucacuccuu

SEQ ID NO: 1617388 - RNA, 14 nt, Human
ccucucucacuccu

SEQ ID NO: 1617389 - RNA, 13 nt, Human
ccucucucacucc

SEQ ID NO: 1617390 - RNA, 14 nt, Human
ccucucucaggcca

SEQ ID NO: 1617391 - RNA, 15 nt, Human
ccucucugcaggucc

SEQ ID NO: 1617392 - RNA, 13 nt, Human
ccucucugcaggu

SEQ ID NO: 1617393 - RNA, 22 nt, Human
ccugcacuugcagacucuacag

SEQ ID NO: 1617394 - RNA, 13 nt, Human
ccucuugagccuu

SEQ ID NO: 1617395 - RNA, 19 nt, Human
ccucuugagccuugaacuu

SEQ ID NO: 1617396 - RNA, 13 nt, Human
ccucuuggguuca

SEQ ID NO: 1617397 - RNA, 14 nt, Human
ccucuugccacugc

SEQ ID NO: 1617398 - RNA, 15 nt, Human
ccuggccucugcacu

SEQ ID NO: 1617399 - RNA, 14 nt, Human
ccuggccucugcac

SEQ ID NO: 1617400 - RNA, 13 nt, Human
ccuggccugagcu

SEQ ID NO: 1617401 - RNA, 16 nt, Human
ccuggccucugcacuc

SEQ ID NO: 1617402 - RNA, 12 nt, Human
ccuggccucugc

SEQ ID NO: 1617403 - RNA, 18 nt, Human
ccuggcacccggccccug

SEQ ID NO: 1617404 - RNA, 18 nt, Human
ccuggcacagggcagugg

SEQ ID NO: 1617405 - RNA, 17 nt, Human
ccuggcacagggcagug

SEQ ID NO: 1617406 - RNA, 16 nt, Human
ccuggcacagggcagu

SEQ ID NO: 1617407 - RNA, 13 nt, Human
ccuggaugcagcc

SEQ ID NO: 1617408 - RNA, 21 nt, Human
ccuggauccaucaggccacuu

SEQ ID NO: 1617409 - RNA, 17 nt, Human
ccuggaugcagccucac

SEQ ID NO: 1617410 - RNA, 14 nt, Human
ccuggaugcagccu

SEQ ID NO: 1617411 - RNA, 19 nt, Human
ccuggaugcagccucacag

SEQ ID NO: 1617412 - RNA, 17 nt, Human
ccuggaguucugguucc

SEQ ID NO: 1617413 - RNA, 16 nt, Human
ccuggaguucugguuc

SEQ ID NO: 1617414 - RNA, 15 nt, Human
ccuggaguucugguu

SEQ ID NO: 1617415 - RNA, 18 nt, Human
ccugcccaggccccugcc

SEQ ID NO: 1617416 - RNA, 16 nt, Human
ccugcccaggccccug

SEQ ID NO: 1617417 - RNA, 15 nt, Human
ccugcccaggccccu

SEQ ID NO: 1617418 - RNA, 14 nt, Human
ccugcccaggcccc

SEQ ID NO: 1617419 - RNA, 20 nt, Human
ccugcuggguguggcgcagc

SEQ ID NO: 1617420 - RNA, 14 nt, Human
ccugcugggugugg

SEQ ID NO: 1617421 - RNA, 21 nt, Human
ccugcuggguguggcgcagca

SEQ ID NO: 1617422 - RNA, 12 nt, Human
ccugcugggugu

SEQ ID NO: 1617423 - RNA, 20 nt, Human
ccucauguccacugguucuu

SEQ ID NO: 1617424 - RNA, 13 nt, Human
ccucauguucuua

SEQ ID NO: 1617425 - RNA, 15 nt, Human
ccucauguccacugg

SEQ ID NO: 1617426 - RNA, 13 nt, Human
ccucagccuccug

SEQ ID NO: 1617427 - RNA, 22 nt, Human
ccucagccucccgaauagcugg

SEQ ID NO: 1617428 - RNA, 23 nt, Human
ccucagccucccaaagugcuggg

SEQ ID NO: 1617429 - RNA, 18 nt, Human
ccucauuagcauuuugcu

SEQ ID NO: 1617430 - RNA, 22 nt, Human
ccuccaagcuccaucuccacuc

SEQ ID NO: 1617431 - RNA, 21 nt, Human
ccuccaagcuccaucuccacu

SEQ ID NO: 1617432 - RNA, 19 nt, Human
ccucauguucuuaauucuu

SEQ ID NO: 1617433 - RNA, 22 nt, Human
ccucccaaggggcccaaauucu

SEQ ID NO: 1617434 - RNA, 22 nt, Human
ccuccaaucccaccaacccuca

SEQ ID NO: 1617435 - RNA, 20 nt, Human
ccucccaggcgccccuuccc

SEQ ID NO: 1617436 - RNA, 14 nt, Human
ccucccaggcgccc

SEQ ID NO: 1617437 - RNA, 22 nt, Human
ccucagccucccaaagugcugg

SEQ ID NO: 1617438 - RNA, 11 nt, Human
ccucagccucc

SEQ ID NO: 1617439 - RNA, 15 nt, Human
ccucaagagaaggca

SEQ ID NO: 1617440 - RNA, 15 nt, Human
ccucaacucuccucc

SEQ ID NO: 1617441 - RNA, 15 nt, Human
ccuauuuuaauaaac

SEQ ID NO: 1617442 - RNA, 16 nt, Human
ccguagguuauuuuca

SEQ ID NO: 1617443 - RNA, 19 nt, Human
ccggcuaauuuuuguauuu

SEQ ID NO: 1617444 - RNA, 17 nt, Human
ccggcuaugggggcacu

SEQ ID NO: 1617445 - RNA, 23 nt, Human
ccggcuaugggggcacugaggac

SEQ ID NO: 1617446 - RNA, 22 nt, Human
ccggcuaugggggcacugagga

SEQ ID NO: 1617447 - RNA, 12 nt, Human
ccggcuccaggc

SEQ ID NO: 1617448 - RNA, 23 nt, Human
ccuaauaaagcuguguggcaguc

SEQ ID NO: 1617449 - RNA, 14 nt, Human
ccuaauaaagcugu

SEQ ID NO: 1617450 - RNA, 18 nt, Human
ccgucucugguuccuccc

SEQ ID NO: 1617451 - RNA, 17 nt, Human
ccuagcacuuugggagg

SEQ ID NO: 1617452 - RNA, 23 nt, Human
ccuaggcauuugcugaauacaga

SEQ ID NO: 1617453 - RNA, 17 nt, Human
cccuucuuuccacagaa

SEQ ID NO: 1617454 - RNA, 20 nt, Human
ccgaauagcugggacuacag

SEQ ID NO: 1617455 - RNA, 17 nt, Human
ccgccaaggcuggggga

SEQ ID NO: 1617456 - RNA, 16 nt, Human
ccgacccuugccgucu

SEQ ID NO: 1617457 - RNA, 20 nt, Human
ccgcccaggcuuagucacug

SEQ ID NO: 1617458 - RNA, 16 nt, Human
ccgccaugcuccuggc

SEQ ID NO: 1617459 - RNA, 18 nt, Human
cccuucgcuccugugucu

SEQ ID NO: 1617460 - RNA, 16 nt, Human
cccuucgcuccugugu

SEQ ID NO: 1617461 - RNA, 16 nt, Human
cccuucuaccuuccug

SEQ ID NO: 1617462 - RNA, 23 nt, Human
cccuucugacccaugcugcccug

SEQ ID NO: 1617463 - RNA, 22 nt, Human
cccuucugacccaugcugcccu

SEQ ID NO: 1617464 - RNA, 21 nt, Human
cccuucugacccaugcugccc

SEQ ID NO: 1617465 - RNA, 16 nt, Human
cccuggcagccccugu

SEQ ID NO: 1617466 - RNA, 14 nt, Human
cccuggcagccccu

SEQ ID NO: 1617467 - RNA, 19 nt, Human
cccuggcucccacaggccc

SEQ ID NO: 1617468 - RNA, 17 nt, Human
cccuggcucccacaggc

SEQ ID NO: 1617469 - RNA, 17 nt, Human
cccuggcuuuucacugc

SEQ ID NO: 1617470 - RNA, 13 nt, Human
cccuggcuuuuca

SEQ ID NO: 1617471 - RNA, 20 nt, Human
cccugcccugugggccccca

SEQ ID NO: 1617472 - RNA, 16 nt, Human
cccugcccugugggcc

SEQ ID NO: 1617473 - RNA, 15 nt, Human
cccugcccugugggc

SEQ ID NO: 1617474 - RNA, 14 nt, Human
cccugcccuguggg

SEQ ID NO: 1617475 - RNA, 13 nt, Human
cccuggcagcccc

SEQ ID NO: 1617476 - RNA, 12 nt, Human
cccuggcagccc

SEQ ID NO: 1617477 - RNA, 21 nt, Human
cccugcccugugggcccccaa

SEQ ID NO: 1617478 - RNA, 13 nt, Human
cccugcccugugg

SEQ ID NO: 1617479 - RNA, 12 nt, Human
cccugcccugug

SEQ ID NO: 1617480 - RNA, 15 nt, Human
cccucacccuggggc

SEQ ID NO: 1617481 - RNA, 18 nt, Human
cuacauacaauuccaaac

SEQ ID NO: 1617482 - RNA, 15 nt, Human
cuacaugagguacug

SEQ ID NO: 1617483 - RNA, 18 nt, Human
cuacaugagguacugaga

SEQ ID NO: 1617484 - RNA, 19 nt, Human
cuacaguugaaaaacagcu

SEQ ID NO: 1617485 - RNA, 13 nt, Human
cuacaguugaaaa

SEQ ID NO: 1617486 - RNA, 18 nt, Human
cuacaguccucccaucuc

SEQ ID NO: 1617487 - RNA, 17 nt, Human
cuacaguccucccaucu

SEQ ID NO: 1617488 - RNA, 16 nt, Human
cuacaguccucccauc

SEQ ID NO: 1617489 - RNA, 15 nt, Human
cuacaguccucccau

SEQ ID NO: 1617490 - RNA, 15 nt, Human
cuacaaaaacacagc

SEQ ID NO: 1617491 - RNA, 15 nt, Human
cuacaagacacagug

SEQ ID NO: 1617492 - RNA, 22 nt, Human
cuaagugauccucccaccucag

SEQ ID NO: 1617493 - RNA, 20 nt, Human
cuaagugauccucccaccuc

SEQ ID NO: 1617494 - RNA, 18 nt, Human
cuaagugaggaugaaaaa

SEQ ID NO: 1617495 - RNA, 23 nt, Human
cuaagugaaauaagccagacauc

SEQ ID NO: 1617496 - RNA, 20 nt, Human
cuaagugaaauaagccagac

SEQ ID NO: 1617497 - RNA, 20 nt, Human
cuaacgaaguauccuucagc

SEQ ID NO: 1617498 - RNA, 15 nt, Human
cuaacuucaccauau

SEQ ID NO: 1617499 - RNA, 16 nt, Human
cuaacuucaccauauu

SEQ ID NO: 1617500 - RNA, 23 nt, Human
cgugagccaccgugccuggccac

SEQ ID NO: 1617501 - RNA, 16 nt, Human
cgugagaccugccccu

SEQ ID NO: 1617502 - RNA, 14 nt, Human
cgugagaccugccc

SEQ ID NO: 1617503 - RNA, 13 nt, Human
cgugagaccugcc

SEQ ID NO: 1617504 - RNA, 22 nt, Human
cuaaacugcccccucugcccug

SEQ ID NO: 1617505 - RNA, 13 nt, Human
cuaaacuuuucug

SEQ ID NO: 1617506 - RNA, 15 nt, Human
cuaaacuuuucugau

SEQ ID NO: 1617507 - RNA, 23 nt, Human
cuaaacugcccccucugcccugc

SEQ ID NO: 1617508 - RNA, 19 nt, Human
cuagaacucccuuucaaca

SEQ ID NO: 1617509 - RNA, 18 nt, Human
cuagaacucccuuucaac

SEQ ID NO: 1617510 - RNA, 17 nt, Human
cuagaacucccuuucaa

SEQ ID NO: 1617511 - RNA, 16 nt, Human
cuagaacucccuuuca

SEQ ID NO: 1617512 - RNA, 22 nt, Human
cuagcagcagggagggcuucug

SEQ ID NO: 1617513 - RNA, 17 nt, Human
cuagcauggcugccaau

SEQ ID NO: 1617514 - RNA, 23 nt, Human
cuagcagcagggagggcuucugc

SEQ ID NO: 1617515 - RNA, 19 nt, Human
cuagaaauuccccacccug

SEQ ID NO: 1617516 - RNA, 14 nt, Human
cuaccugaggggcc

SEQ ID NO: 1617517 - RNA, 11 nt, Human
cuaccugaggg

SEQ ID NO: 1617518 - RNA, 15 nt, Human
cuaccugaggggccu

SEQ ID NO: 1617519 - RNA, 23 nt, Human
cuaguugaucagcuuauugucua

SEQ ID NO: 1617520 - RNA, 22 nt, Human
cuaguuccaccaucaagccacc

SEQ ID NO: 1617521 - RNA, 20 nt, Human
cuaguuccaccaucaagcca

SEQ ID NO: 1617522 - RNA, 18 nt, Human
cuaguuccaccaucaagc

SEQ ID NO: 1617523 - RNA, 21 nt, Human
cuagggaaaaaccagcgugug

SEQ ID NO: 1617524 - RNA, 19 nt, Human
cuagggaaaaaccagcgug

SEQ ID NO: 1617525 - RNA, 16 nt, Human
cgacagugagacucug

SEQ ID NO: 1617526 - RNA, 15 nt, Human
cgacagugagacucu

SEQ ID NO: 1617527 - RNA, 17 nt, Human
ccuuuuuuauacauaaa

SEQ ID NO: 1617528 - RNA, 18 nt, Human
ccuuuuuuauacauaaac

SEQ ID NO: 1617529 - RNA, 23 nt, Human
cgaccagacaccuugacagggca

SEQ ID NO: 1617530 - RNA, 14 nt, Human
cgaccaccugccca

SEQ ID NO: 1617531 - RNA, 12 nt, Human
cgaccaccugcc

SEQ ID NO: 1617532 - RNA, 19 nt, Human
ccuuuuuuauacauaaaca

SEQ ID NO: 1617533 - RNA, 12 nt, Human
ccuuuuuuauac

SEQ ID NO: 1617534 - RNA, 17 nt, Human
ccuuuuucauuauuuua

SEQ ID NO: 1617535 - RNA, 20 nt, Human
ccuuuagcgcccaguugggu

SEQ ID NO: 1617536 - RNA, 14 nt, Human
ccuuuagcgcccag

SEQ ID NO: 1617537 - RNA, 20 nt, Human
ccuugccgucuaccugaggg

SEQ ID NO: 1617538 - RNA, 20 nt, Human
ccuucugacccaugcugccc

SEQ ID NO: 1617539 - RNA, 17 nt, Human
ccuucugacccaugcug

SEQ ID NO: 1617540 - RNA, 16 nt, Human
ccuucugacccaugcu

SEQ ID NO: 1617541 - RNA, 12 nt, Human
ccuucugaccca

SEQ ID NO: 1617542 - RNA, 15 nt, Human
ccuggccugagcugg

SEQ ID NO: 1617543 - RNA, 14 nt, Human
ccuggccugagcug

SEQ ID NO: 1617544 - RNA, 20 nt, Human
ccuggccugagcugggauga

SEQ ID NO: 1617545 - RNA, 22 nt, Human
ccuucugacccaugcugcccug

SEQ ID NO: 1617546 - RNA, 21 nt, Human
ccuucugacccaugcugcccu

SEQ ID NO: 1617547 - RNA, 23 nt, Human
ccuucugacccaugcugcccugu

SEQ ID NO: 1617548 - RNA, 22 nt, Human
ccuucuggaauaaggagaauga

SEQ ID NO: 1617549 - RNA, 18 nt, Human
cggcucacugcagccuca

SEQ ID NO: 1617550 - RNA, 17 nt, Human
cggcucacugcauccuc

SEQ ID NO: 1617551 - RNA, 19 nt, Human
cggcucacugcagccucaa

SEQ ID NO: 1617552 - RNA, 21 nt, Human
cggcucacugcauccuccgcc

SEQ ID NO: 1617553 - RNA, 14 nt, Human
cggagucccaccuu

SEQ ID NO: 1617554 - RNA, 18 nt, Human
cggaggggccuggcagcc

SEQ ID NO: 1617555 - RNA, 16 nt, Human
cggaggggccuggcag

SEQ ID NO: 1617556 - RNA, 16 nt, Human
cgaguagcugggacua

SEQ ID NO: 1617557 - RNA, 15 nt, Human
cgaguagcugggacu

SEQ ID NO: 1617558 - RNA, 14 nt, Human
cgaguagcugggac

SEQ ID NO: 1617559 - RNA, 18 nt, Human
cgaguuacagacaaagcg

SEQ ID NO: 1617560 - RNA, 17 nt, Human
cgaguuacagacaaagc

SEQ ID NO: 1617561 - RNA, 12 nt, Human
cgccaaggcugg

SEQ ID NO: 1617562 - RNA, 20 nt, Human
cgcaggcuggcccugcccug

SEQ ID NO: 1617563 - RNA, 19 nt, Human
cgcaggcuggcccugcccu

SEQ ID NO: 1617564 - RNA, 18 nt, Human
cgcaggcuggcccugccc

SEQ ID NO: 1617565 - RNA, 17 nt, Human
cgcaggcuggcccugcc

SEQ ID NO: 1617566 - RNA, 15 nt, Human
cgcaggcuggcccug

SEQ ID NO: 1617567 - RNA, 14 nt, Human
cgcaggcuggcccu

SEQ ID NO: 1617568 - RNA, 16 nt, Human
cgccaaggcuggggga

SEQ ID NO: 1617569 - RNA, 13 nt, Human
cgccaaggcuggg

SEQ ID NO: 1617570 - RNA, 23 nt, Human
cgccaaggcugggggaagaagcu

SEQ ID NO: 1617571 - RNA, 21 nt, Human
cgcaggcuggcccugcccugg

SEQ ID NO: 1617572 - RNA, 14 nt, Human
cgccuacaggagug

SEQ ID NO: 1617573 - RNA, 16 nt, Human
cgaccugccucggccu

SEQ ID NO: 1617574 - RNA, 21 nt, Human
cuccagugagacagcucugca

SEQ ID NO: 1617575 - RNA, 13 nt, Human
cucccaccucagc

SEQ ID NO: 1617576 - RNA, 12 nt, Human
cucccaccucag

SEQ ID NO: 1617577 - RNA, 16 nt, Human
cucccugcaauaaaau

SEQ ID NO: 1617578 - RNA, 14 nt, Human
cucccugcaauaaa

SEQ ID NO: 1617579 - RNA, 19 nt, Human
cuccgcuuucuacccagcg

SEQ ID NO: 1617580 - RNA, 19 nt, Human
cuccagacacauguccaag

SEQ ID NO: 1617581 - RNA, 17 nt, Human
cuccagacacaugucca

SEQ ID NO: 1617582 - RNA, 21 nt, Human
cuccagaauuucccaaagcag

SEQ ID NO: 1617583 - RNA, 18 nt, Human
cuccagaauuucccaaag

SEQ ID NO: 1617584 - RNA, 15 nt, Human
cuccagaauuuccca

SEQ ID NO: 1617585 - RNA, 22 nt, Human
cuccacuuucuagccagaggag

SEQ ID NO: 1617586 - RNA, 21 nt, Human
cuccaagaccuucuccuucac

SEQ ID NO: 1617587 - RNA, 18 nt, Human
cuccaagaccuucuccuu

SEQ ID NO: 1617588 - RNA, 17 nt, Human
cuccaagaccuucuccu

SEQ ID NO: 1617589 - RNA, 16 nt, Human
cuccaagaccuucucc

SEQ ID NO: 1617590 - RNA, 14 nt, Human
cuccagaccccugg

SEQ ID NO: 1617591 - RNA, 11 nt, Human
cuccaggugca

SEQ ID NO: 1617592 - RNA, 21 nt, Human
cucaggccugggggcugggca

SEQ ID NO: 1617593 - RNA, 20 nt, Human
cucaggccugggggcugggc

SEQ ID NO: 1617594 - RNA, 14 nt, Human
cucaggccuggggg

SEQ ID NO: 1617595 - RNA, 22 nt, Human
cucaggccagcugcuugggcuu

SEQ ID NO: 1617596 - RNA, 21 nt, Human
cucaggccagcugcuugggcu

SEQ ID NO: 1617597 - RNA, 15 nt, Human
cucaggccagcugcu

SEQ ID NO: 1617598 - RNA, 14 nt, Human
cucaggccagcugc

SEQ ID NO: 1617599 - RNA, 13 nt, Human
cucagcggggaca

SEQ ID NO: 1617600 - RNA, 14 nt, Human
cucagcgaaugaau

SEQ ID NO: 1617601 - RNA, 13 nt, Human
cucaggccagcug

SEQ ID NO: 1617602 - RNA, 13 nt, Human
cucagccuccuga

SEQ ID NO: 1617603 - RNA, 12 nt, Human
cucagccuccug

SEQ ID NO: 1617604 - RNA, 13 nt, Human
cucagccucccaa

SEQ ID NO: 1617605 - RNA, 16 nt, Human
cuaucccggcugcccu

SEQ ID NO: 1617606 - RNA, 15 nt, Human
cuaucccggcugccc

SEQ ID NO: 1617607 - RNA, 16 nt, Human
cucagccucccaaagu

SEQ ID NO: 1617608 - RNA, 14 nt, Human
cucagccucccaaa

SEQ ID NO: 1617609 - RNA, 21 nt, Human
cucagccucccaaagugcugg

SEQ ID NO: 1617610 - RNA, 17 nt, Human
cuaucccggcugcccuu

SEQ ID NO: 1617611 - RNA, 13 nt, Human
cucagccucccga

SEQ ID NO: 1617612 - RNA, 22 nt, Human
cucagccucccaaagugcuggg

SEQ ID NO: 1617613 - RNA, 18 nt, Human
cucagucuggcccuuccu

SEQ ID NO: 1617614 - RNA, 17 nt, Human
cucagucuggcccuucc

SEQ ID NO: 1617615 - RNA, 13 nt, Human
cucagugccacua

SEQ ID NO: 1617616 - RNA, 20 nt, Human
cucagucuggcccuuccuuu

SEQ ID NO: 1617617 - RNA, 12 nt, Human
cucauguucuua

SEQ ID NO: 1617618 - RNA, 14 nt, Human
cucauguucuuaau

SEQ ID NO: 1617619 - RNA, 18 nt, Human
cucauguucuuaauucuu

SEQ ID NO: 1617620 - RNA, 19 nt, Human
cucauguucuuaauucuua

SEQ ID NO: 1617621 - RNA, 20 nt, Human
cucaugccucagccuccuga

SEQ ID NO: 1617622 - RNA, 18 nt, Human
cucaugccucagccuccu

SEQ ID NO: 1617623 - RNA, 16 nt, Human
cuccaaagucucugga

SEQ ID NO: 1617624 - RNA, 11 nt, Human
cucucuggccu

SEQ ID NO: 1617625 - RNA, 12 nt, Human
cucuccuccaga

SEQ ID NO: 1617626 - RNA, 12 nt, Human
cucucuggccuu

SEQ ID NO: 1617627 - RNA, 15 nt, Human
cucugaaggacauug

SEQ ID NO: 1617628 - RNA, 14 nt, Human
cucucacuccuuga

SEQ ID NO: 1617629 - RNA, 12 nt, Human
cucucacuccuu

SEQ ID NO: 1617630 - RNA, 19 nt, Human
cucucagauuguaccauug

SEQ ID NO: 1617631 - RNA, 15 nt, Human
cucucacuccuugaa

SEQ ID NO: 1617632 - RNA, 21 nt, Human
cucucacuuguuuuauuuaac

SEQ ID NO: 1617633 - RNA, 20 nt, Human
cuccgcuuucuacccagcga

SEQ ID NO: 1617634 - RNA, 20 nt, Human
cucgggauuaguacacacuu

SEQ ID NO: 1617635 - RNA, 15 nt, Human
cucuuagaugcaguu

SEQ ID NO: 1617636 - RNA, 21 nt, Human
cucuguacagagcccacgccc

SEQ ID NO: 1617637 - RNA, 17 nt, Human
cucuguacagagcccac

SEQ ID NO: 1617638 - RNA, 20 nt, Human
cucugcugacagacacaggc

SEQ ID NO: 1617639 - RNA, 19 nt, Human
cucugcugacagacacagg

SEQ ID NO: 1617640 - RNA, 18 nt, Human
cucugcugacagacacag

SEQ ID NO: 1617641 - RNA, 17 nt, Human
cucugcugacagacaca

SEQ ID NO: 1617642 - RNA, 18 nt, Human
cucugguccauagagagc

SEQ ID NO: 1617643 - RNA, 16 nt, Human
cucugguccauagaga

SEQ ID NO: 1617644 - RNA, 19 nt, Human
cucugguccauagagagca

SEQ ID NO: 1617645 - RNA, 14 nt, Human
cucugguuccuccc

SEQ ID NO: 1617646 - RNA, 23 nt, Human
cucugcagcaauaaagcagcguu

SEQ ID NO: 1617647 - RNA, 18 nt, Human
cucugcagcaauaaagca

SEQ ID NO: 1617648 - RNA, 19 nt, Human
cucugcagcaauaaagcag

SEQ ID NO: 1617649 - RNA, 14 nt, Human
cucugcacuccccu

SEQ ID NO: 1617650 - RNA, 21 nt, Human
cucuuagaugcaguucugaag

SEQ ID NO: 1617651 - RNA, 20 nt, Human
cucuuagaugcaguucugaa

SEQ ID NO: 1617652 - RNA, 16 nt, Human
cucuugccacugccuc

SEQ ID NO: 1617653 - RNA, 20 nt, Human
cucuugccacugccucuucc

SEQ ID NO: 1617654 - RNA, 19 nt, Human
cucuugccacugccucuuc

SEQ ID NO: 1617655 - RNA, 18 nt, Human
cucuugccacugccucuu

SEQ ID NO: 1617656 - RNA, 17 nt, Human
cucuugccacugccucu

SEQ ID NO: 1617657 - RNA, 22 nt, Human
cucuugccacugccucuuccuc

SEQ ID NO: 1617658 - RNA, 18 nt, Human
cugaaggccccgcccagg

SEQ ID NO: 1617659 - RNA, 17 nt, Human
cugaaggccccgcccag

SEQ ID NO: 1617660 - RNA, 14 nt, Human
cugaaggccccgcc

SEQ ID NO: 1617661 - RNA, 13 nt, Human
cugaaggccccgc

SEQ ID NO: 1617662 - RNA, 21 nt, Human
cugaaggacauugcggacagc

SEQ ID NO: 1617663 - RNA, 20 nt, Human
cugaaggacauugcggacag

SEQ ID NO: 1617664 - RNA, 19 nt, Human
cugaaggacauugcggaca

SEQ ID NO: 1617665 - RNA, 16 nt, Human
cugaaaauguaugugu

SEQ ID NO: 1617666 - RNA, 22 nt, Human
cugaaggaauaaauugcuccuu

SEQ ID NO: 1617667 - RNA, 20 nt, Human
cugacccaugcugcccugug

SEQ ID NO: 1617668 - RNA, 19 nt, Human
cugacccaugcugcccugu

SEQ ID NO: 1617669 - RNA, 17 nt, Human
cugacccaugcugcccu

SEQ ID NO: 1617670 - RNA, 18 nt, Human
cugacccaugcugcccug

SEQ ID NO: 1617671 - RNA, 15 nt, Human
cugacagacacaggc

SEQ ID NO: 1617672 - RNA, 14 nt, Human
cugacagacacagg

SEQ ID NO: 1617673 - RNA, 12 nt, Human
cugacagacaca

SEQ ID NO: 1617674 - RNA, 14 nt, Human
cugacagaaggacu

SEQ ID NO: 1617675 - RNA, 18 nt, Human
aacuuccagauccuggaa

SEQ ID NO: 1617676 - RNA, 13 nt, Human
aacuuccaauuua

SEQ ID NO: 1617677 - RNA, 17 nt, Human
gugaugggaaagcauug

SEQ ID NO: 1617678 - RNA, 22 nt, Human
gugaugcgcaugucacggaggg

SEQ ID NO: 1617679 - RNA, 18 nt, Human
gugauggggcccugccuc

SEQ ID NO: 1617680 - RNA, 17 nt, Human
gugauggggcccugccu

SEQ ID NO: 1617681 - RNA, 16 nt, Human
gugauggggcccugcc

SEQ ID NO: 1617682 - RNA, 14 nt, Human
gugauggggcccug

SEQ ID NO: 1617683 - RNA, 16 nt, Human
gugaugagaggaaauc

SEQ ID NO: 1617684 - RNA, 14 nt, Human
gugaugagaggaaa

SEQ ID NO: 1617685 - RNA, 23 nt, Human
gugcauuaucuagauacuguauc

SEQ ID NO: 1617686 - RNA, 19 nt, Human
gugcauguguguucaugca

SEQ ID NO: 1617687 - RNA, 15 nt, Human
gugcauuaucuagau

SEQ ID NO: 1617688 - RNA, 19 nt, Human
gugcauuaucuagauacug

SEQ ID NO: 1617689 - RNA, 12 nt, Human
gugccucugccu

SEQ ID NO: 1617690 - RNA, 21 nt, Human
gugcacacaccagagcccacc

SEQ ID NO: 1617691 - RNA, 19 nt, Human
gugauggggcccugccucc

SEQ ID NO: 1617692 - RNA, 16 nt, Human
gugaugguuccccugu

SEQ ID NO: 1617693 - RNA, 14 nt, Human
gugaugguuccccu

SEQ ID NO: 1617694 - RNA, 22 nt, Human
gugaugguuccccuguucacuc

SEQ ID NO: 1617695 - RNA, 13 nt, Human
aacugaaaucaua

SEQ ID NO: 1617696 - RNA, 12 nt, Human
aacugaaaucau

SEQ ID NO: 1617697 - RNA, 21 nt, Human
aacucuucaaucucuugcacu

SEQ ID NO: 1617698 - RNA, 22 nt, Human
gugagucgaggacagggaggug

SEQ ID NO: 1617699 - RNA, 20 nt, Human
aacucugacaacagacuucu

SEQ ID NO: 1617700 - RNA, 23 nt, Human
aacucugacaacagacuucugaa

SEQ ID NO: 1617701 - RNA, 22 nt, Human
aacucugacaacagacuucuga

SEQ ID NO: 1617702 - RNA, 21 nt, Human
gugagaugcuagaacucccuu

SEQ ID NO: 1617703 - RNA, 19 nt, Human
gugaacuugggccacugug

SEQ ID NO: 1617704 - RNA, 17 nt, Human
gugaacuugggccacug

SEQ ID NO: 1617705 - RNA, 15 nt, Human
gugaacuugaaauuu

SEQ ID NO: 1617706 - RNA, 14 nt, Human
gugaacuugaaauu

SEQ ID NO: 1617707 - RNA, 22 nt, Human
gugaggccagagacacaagccu

SEQ ID NO: 1617708 - RNA, 17 nt, Human
gugaggccagagacaca

SEQ ID NO: 1617709 - RNA, 15 nt, Human
gugagcaauccugca

SEQ ID NO: 1617710 - RNA, 19 nt, Human
aacugcacugucaagauga

SEQ ID NO: 1617711 - RNA, 15 nt, Human
aacugcugacuguuu

SEQ ID NO: 1617712 - RNA, 21 nt, Human
aacugcugacuguuuucucuu

SEQ ID NO: 1617713 - RNA, 20 nt, Human
aacugcugacuguuuucucu

SEQ ID NO: 1617714 - RNA, 23 nt, Human
aacugcugacuguuuucucuuga

SEQ ID NO: 1617715 - RNA, 19 nt, Human
aacuggacugguucaaaug

SEQ ID NO: 1617716 - RNA, 15 nt, Human
aacuggauuaaacuu

SEQ ID NO: 1617717 - RNA, 16 nt, Human
aacuggauuaaacuua

SEQ ID NO: 1617718 - RNA, 11 nt, Human
aacuggcugca

SEQ ID NO: 1617719 - RNA, 17 nt, Human
aacugggacaggggaga

SEQ ID NO: 1617720 - RNA, 21 nt, Human
aacuggguacuuguggacaca

SEQ ID NO: 1617721 - RNA, 16 nt, Human
aacuggguacuugugg

SEQ ID NO: 1617722 - RNA, 21 nt, Human
aacugggggagggugaaguga

SEQ ID NO: 1617723 - RNA, 22 nt, Human
aacugggggagggugaagugaa

SEQ ID NO: 1617724 - RNA, 18 nt, Human
aaccugagccccaaaagg

SEQ ID NO: 1617725 - RNA, 11 nt, Human
aaccugacccc

SEQ ID NO: 1617726 - RNA, 24 nt, Human
aaccucuaaauucuuucauuuuag

SEQ ID NO: 1617727 - RNA, 12 nt, Human
aaccucuaaauu

SEQ ID NO: 1617728 - RNA, 16 nt, Human
aaccucuuugucuaca

SEQ ID NO: 1617729 - RNA, 16 nt, Human
aacccgggaggcagag

SEQ ID NO: 1617730 - RNA, 10 nt, Human
aacccagcuc

SEQ ID NO: 1617731 - RNA, 14 nt, Human
aacccagauaaagg

SEQ ID NO: 1617732 - RNA, 23 nt, Human
aacccaaauguucaucaaugaau

SEQ ID NO: 1617733 - RNA, 23 nt, Human
aaccauuuugcugucccuuuucc

SEQ ID NO: 1617734 - RNA, 18 nt, Human
aacccaaguccaagcaua

SEQ ID NO: 1617735 - RNA, 13 nt, Human
aacccaauaguug

SEQ ID NO: 1617736 - RNA, 21 nt, Human
aaccaccacacccagcccacu

SEQ ID NO: 1617737 - RNA, 12 nt, Human
aaccaucauuga

SEQ ID NO: 1617738 - RNA, 18 nt, Human
aaccaucauugaaaucuu

SEQ ID NO: 1617739 - RNA, 17 nt, Human
aaccaucauugaaaucu

SEQ ID NO: 1617740 - RNA, 15 nt, Human
aaccaagucaaguga

SEQ ID NO: 1617741 - RNA, 19 nt, Human
aaccaccacacccagccca

SEQ ID NO: 1617742 - RNA, 18 nt, Human
aaccaagccguggcuucc

SEQ ID NO: 1617743 - RNA, 19 nt, Human
gucucgaacuccugaccuu

SEQ ID NO: 1617744 - RNA, 18 nt, Human
gucucgaacuccugaccu

SEQ ID NO: 1617745 - RNA, 13 nt, Human
gucucgaacuccu

SEQ ID NO: 1617746 - RNA, 18 nt, Human
aaccuugaaaacuuuaug

SEQ ID NO: 1617747 - RNA, 12 nt, Human
aaccugugucuc

SEQ ID NO: 1617748 - RNA, 21 nt, Human
aacuagaguuuagcuggaaaa

SEQ ID NO: 1617749 - RNA, 20 nt, Human
aacuagacucccaagcugga

SEQ ID NO: 1617750 - RNA, 23 nt, Human
aacuagacucccaagcuggacua

SEQ ID NO: 1617751 - RNA, 21 nt, Human
aacuaugauuuggaaaauaaa

SEQ ID NO: 1617752 - RNA, 16 nt, Human
aacuaugauuuggaaa

SEQ ID NO: 1617753 - RNA, 23 nt, Human
gugaaccaccacacccagcccac

SEQ ID NO: 1617754 - RNA, 22 nt, Human
gugaaccaccacacccagccca

SEQ ID NO: 1617755 - RNA, 18 nt, Human
aacucuccuccagaguca

SEQ ID NO: 1617756 - RNA, 15 nt, Human
aacucuccuccagag

SEQ ID NO: 1617757 - RNA, 16 nt, Human
aacucuccucugcugc

SEQ ID NO: 1617758 - RNA, 17 nt, Human
aacucuccucugcugcu

SEQ ID NO: 1617759 - RNA, 16 nt, Human
gucuuucacauuuaaa

SEQ ID NO: 1617760 - RNA, 17 nt, Human
gucuuuaaaugcugcuu

SEQ ID NO: 1617761 - RNA, 15 nt, Human
gucuuuaaaugcugc

SEQ ID NO: 1617762 - RNA, 16 nt, Human
gucuuuuuucacuaca

SEQ ID NO: 1617763 - RNA, 20 nt, Human
aaccugagccccaaaaggua

SEQ ID NO: 1617764 - RNA, 14 nt, Human
gucuggcccuuccu

SEQ ID NO: 1617765 - RNA, 16 nt, Human
aacaaggcaaggcugu

SEQ ID NO: 1617766 - RNA, 20 nt, Human
aaauuuuuucucuaggaaau

SEQ ID NO: 1617767 - RNA, 18 nt, Human
aaauuuugauguuuuaag

SEQ ID NO: 1617768 - RNA, 23 nt, Human
aaauuuugauguuuuaaggaugc

SEQ ID NO: 1617769 - RNA, 15 nt, Human
aacaaugcuguauuu

SEQ ID NO: 1617770 - RNA, 14 nt, Human
aacaaugcuguauu

SEQ ID NO: 1617771 - RNA, 12 nt, Human
aacaauaaaaga

SEQ ID NO: 1617772 - RNA, 21 nt, Human
aacaaggcaaggcugucaauu

SEQ ID NO: 1617773 - RNA, 18 nt, Human
aacaaggcaaggcuguca

SEQ ID NO: 1617774 - RNA, 16 nt, Human
aacacaacuauauugu

SEQ ID NO: 1617775 - RNA, 15 nt, Human
aacacaacuauauug

SEQ ID NO: 1617776 - RNA, 22 nt, Human
aacaaugcuguauuuuaaaaga

SEQ ID NO: 1617777 - RNA, 17 nt, Human
aacaaugcuguauuuua

SEQ ID NO: 1617778 - RNA, 22 nt, Human
gucacacaguauuacuucugcu

SEQ ID NO: 1617779 - RNA, 17 nt, Human
gucagaauagaaauuag

SEQ ID NO: 1617780 - RNA, 13 nt, Human
gucagaauagaaa

SEQ ID NO: 1617781 - RNA, 18 nt, Human
aaauuuguuauaaugaau

SEQ ID NO: 1617782 - RNA, 13 nt, Human
guccuacucugug

SEQ ID NO: 1617783 - RNA, 22 nt, Human
aacagugauuaccagggacuga

SEQ ID NO: 1617784 - RNA, 15 nt, Human
aacagugauuaccag

SEQ ID NO: 1617785 - RNA, 18 nt, Human
gucccccuuccauggacu

SEQ ID NO: 1617786 - RNA, 16 nt, Human
gucccccuuccaugga

SEQ ID NO: 1617787 - RNA, 14 nt, Human
gucccccuuccaug

SEQ ID NO: 1617788 - RNA, 12 nt, Human
guccuacucugu

SEQ ID NO: 1617789 - RNA, 16 nt, Human
guccuacccacccucc

SEQ ID NO: 1617790 - RNA, 12 nt, Human
aacagaaaugua

SEQ ID NO: 1617791 - RNA, 13 nt, Human
aacagaaauguac

SEQ ID NO: 1617792 - RNA, 14 nt, Human
aacagaaauguaca

SEQ ID NO: 1617793 - RNA, 15 nt, Human
aacagaaauguacag

SEQ ID NO: 1617794 - RNA, 19 nt, Human
gucauuuuuuuuaagaaaa

SEQ ID NO: 1617795 - RNA, 21 nt, Human
gucauuuuuuuuaagaaaaag

SEQ ID NO: 1617796 - RNA, 15 nt, Human
aacacagcaagggug

SEQ ID NO: 1617797 - RNA, 17 nt, Human
aacacaacuauauuguu

SEQ ID NO: 1617798 - RNA, 18 nt, Human
guccaagaagcccaggaa

SEQ ID NO: 1617799 - RNA, 17 nt, Human
guccaagaagcccagga

SEQ ID NO: 1617800 - RNA, 20 nt, Human
guccaagaagcccaggaaag

SEQ ID NO: 1617801 - RNA, 16 nt, Human
guccaagaagcccagg

SEQ ID NO: 1617802 - RNA, 15 nt, Human
guccaagaagcccag

SEQ ID NO: 1617803 - RNA, 13 nt, Human
guccaagaagccc

SEQ ID NO: 1617804 - RNA, 16 nt, Human
gucccaccuuggcugc

SEQ ID NO: 1617805 - RNA, 15 nt, Human
gucccaccuuggcug

SEQ ID NO: 1617806 - RNA, 14 nt, Human
gucccaccuuggcu

SEQ ID NO: 1617807 - RNA, 21 nt, Human
gucccaccccacacacgccag

SEQ ID NO: 1617808 - RNA, 14 nt, Human
guccauagagagca

SEQ ID NO: 1617809 - RNA, 13 nt, Human
guccauagagagc

SEQ ID NO: 1617810 - RNA, 22 nt, Human
guauuuuguuuuugucuuaaaa

SEQ ID NO: 1617811 - RNA, 18 nt, Human
gucaaaguggugagaggc

SEQ ID NO: 1617812 - RNA, 17 nt, Human
gucaacacuaacaugau

SEQ ID NO: 1617813 - RNA, 21 nt, Human
gucaacaaguaugaauaaaga

SEQ ID NO: 1617814 - RNA, 14 nt, Human
gucaaacgugaaaa

SEQ ID NO: 1617815 - RNA, 17 nt, Human
gucaaacgugaaaaugc

SEQ ID NO: 1617816 - RNA, 15 nt, Human
gucaaacgugaaaau

SEQ ID NO: 1617817 - RNA, 15 nt, Human
aaauuguaauuauau

SEQ ID NO: 1617818 - RNA, 20 nt, Human
aaauuguaagcaugcacaaa

SEQ ID NO: 1617819 - RNA, 14 nt, Human
aaauuguaauuaua

SEQ ID NO: 1617820 - RNA, 18 nt, Human
aaauucugucucuggauu

SEQ ID NO: 1617821 - RNA, 19 nt, Human
aaauuguaagcaugcacaa

SEQ ID NO: 1617822 - RNA, 16 nt, Human
aaauucugucucugga

SEQ ID NO: 1617823 - RNA, 18 nt, Human
guauguacuucaugcugu

SEQ ID NO: 1617824 - RNA, 15 nt, Human
aaauguauuacagug

SEQ ID NO: 1617825 - RNA, 24 nt, Human
aaaugucuaguuguaacaccauga

SEQ ID NO: 1617826 - RNA, 19 nt, Human
aaaugucuaguuguaacac

SEQ ID NO: 1617827 - RNA, 14 nt, Human
aaauuaagaaagga

SEQ ID NO: 1617828 - RNA, 12 nt, Human
aaaugugugugu

SEQ ID NO: 1617829 - RNA, 15 nt, Human
aaauggguuuuacug

SEQ ID NO: 1617830 - RNA, 14 nt, Human
aaauggguuuuacu

SEQ ID NO: 1617831 - RNA, 12 nt, Human
guaacaggcaga

SEQ ID NO: 1617832 - RNA, 22 nt, Human
guaacaggaaaauuuuaaaaau

SEQ ID NO: 1617833 - RNA, 16 nt, Human
aaauguaagggaaacu

SEQ ID NO: 1617834 - RNA, 20 nt, Human
guaguguuggagaagaacug

SEQ ID NO: 1617835 - RNA, 19 nt, Human
guauaaaagggacugagaa

SEQ ID NO: 1617836 - RNA, 16 nt, Human
guauauuuuauaucaa

SEQ ID NO: 1617837 - RNA, 18 nt, Human
guaucaggugcugccauc

SEQ ID NO: 1617838 - RNA, 16 nt, Human
guaucaggugcugcca

SEQ ID NO: 1617839 - RNA, 21 nt, Human
guauaaaauaauuuuuauauu

SEQ ID NO: 1617840 - RNA, 15 nt, Human
guauaaaauaauuuu

SEQ ID NO: 1617841 - RNA, 15 nt, Human
guauaaguggugugu

SEQ ID NO: 1617842 - RNA, 10 nt, Human
guauaauuaa

SEQ ID NO: 1617843 - RNA, 14 nt, Human
guaugguggcuggg

SEQ ID NO: 1617844 - RNA, 16 nt, Human
guaugguggcuggguu

SEQ ID NO: 1617845 - RNA, 15 nt, Human
guaugguggcugggu

SEQ ID NO: 1617846 - RNA, 21 nt, Human
guaucccaugagccucagcau

SEQ ID NO: 1617847 - RNA, 15 nt, Human
guaugcgugugugug

SEQ ID NO: 1617848 - RNA, 22 nt, Human
guaucaggugcugccauccagg

SEQ ID NO: 1617849 - RNA, 19 nt, Human
guaucccaugagccucagc

SEQ ID NO: 1617850 - RNA, 19 nt, Human
aagggugaugggaaagcau

SEQ ID NO: 1617851 - RNA, 14 nt, Human
aagguacuucaaau

SEQ ID NO: 1617852 - RNA, 20 nt, Human
aagguagaaauaucugaaaa

SEQ ID NO: 1617853 - RNA, 22 nt, Human
aaggggcccaaauucuuucagu

SEQ ID NO: 1617854 - RNA, 23 nt, Human
aaggcucugagcaaauguggcuc

SEQ ID NO: 1617855 - RNA, 18 nt, Human
guuucugaaagggacgcu

SEQ ID NO: 1617856 - RNA, 19 nt, Human
guuucuauguguagggcgg

SEQ ID NO: 1617857 - RNA, 12 nt, Human
aaggucauuuuu

SEQ ID NO: 1617858 - RNA, 18 nt, Human
aagguauuuaauagguuu

SEQ ID NO: 1617859 - RNA, 16 nt, Human
aaguaaggaauuuuau

SEQ ID NO: 1617860 - RNA, 13 nt, Human
aaguaagcaaaga

SEQ ID NO: 1617861 - RNA, 17 nt, Human
guuucaaacuuuacuau

SEQ ID NO: 1617862 - RNA, 15 nt, Human
aaggcuccaggagca

SEQ ID NO: 1617863 - RNA, 18 nt, Human
aaggcuccaggagcagcc

SEQ ID NO: 1617864 - RNA, 16 nt, Human
aaggcuccaggagcag

SEQ ID NO: 1617865 - RNA, 14 nt, Human
guuucaaacuuuac

SEQ ID NO: 1617866 - RNA, 16 nt, Human
guuucaaacuuuacua

SEQ ID NO: 1617867 - RNA, 13 nt, Human
guuucaaacuuua

SEQ ID NO: 1617868 - RNA, 18 nt, Human
aaggcucgagcaugccug

SEQ ID NO: 1617869 - RNA, 16 nt, Human
aaggcucgagcaugcc

SEQ ID NO: 1617870 - RNA, 22 nt, Human
aaggcuccaggagcagccacau

SEQ ID NO: 1617871 - RNA, 19 nt, Human
aaggcuccaggagcagcca

SEQ ID NO: 1617872 - RNA, 20 nt, Human
aaggcucgagcaugccugga

SEQ ID NO: 1617873 - RNA, 19 nt, Human
aaggcucgagcaugccugg

SEQ ID NO: 1617874 - RNA, 22 nt, Human
aaggcucgagcaugccuggaug

SEQ ID NO: 1617875 - RNA, 17 nt, Human
guugggccaggagccuc

SEQ ID NO: 1617876 - RNA, 15 nt, Human
guugggccaggagcc

SEQ ID NO: 1617877 - RNA, 13 nt, Human
guugggcuggugu

SEQ ID NO: 1617878 - RNA, 15 nt, Human
guugggcugguguca

SEQ ID NO: 1617879 - RNA, 20 nt, Human
guuuaauauuaaagccaugu

SEQ ID NO: 1617880 - RNA, 13 nt, Human
guuuauugucaaa

SEQ ID NO: 1617881 - RNA, 13 nt, Human
guugcccaggcug

SEQ ID NO: 1617882 - RNA, 12 nt, Human
guugcccaggcu

SEQ ID NO: 1617883 - RNA, 23 nt, Human
guugcccaggcaggucuugaacu

SEQ ID NO: 1617884 - RNA, 14 nt, Human
guugcccaggcugg

SEQ ID NO: 1617885 - RNA, 22 nt, Human
guugccuaaauccauuuggaaa

SEQ ID NO: 1617886 - RNA, 16 nt, Human
aaggccaaaggaagca

SEQ ID NO: 1617887 - RNA, 13 nt, Human
aaggauacaaaag

SEQ ID NO: 1617888 - RNA, 21 nt, Human
aaggauacaaaagcaugugag

SEQ ID NO: 1617889 - RNA, 11 nt, Human
aaggauaaagu

SEQ ID NO: 1617890 - RNA, 17 nt, Human
aaggagauuuacaacug

SEQ ID NO: 1617891 - RNA, 14 nt, Human
aaggagauuuacaa

SEQ ID NO: 1617892 - RNA, 18 nt, Human
aaggaauaccuguccccc

SEQ ID NO: 1617893 - RNA, 11 nt, Human
aaggagagcua

SEQ ID NO: 1617894 - RNA, 18 nt, Human
aaggaggaagagaaaaaa

SEQ ID NO: 1617895 - RNA, 20 nt, Human
aaggaggggauagagagaga

SEQ ID NO: 1617896 - RNA, 13 nt, Human
aaggaagcacaug

SEQ ID NO: 1617897 - RNA, 15 nt, Human
aaggaagacuucauc

SEQ ID NO: 1617898 - RNA, 14 nt, Human
aaggaagacuucau

SEQ ID NO: 1617899 - RNA, 16 nt, Human
aaggaagcacaugccu

SEQ ID NO: 1617900 - RNA, 17 nt, Human
aaggaauaccugucccc

SEQ ID NO: 1617901 - RNA, 21 nt, Human
aaggaauaaauugcuccuuga

SEQ ID NO: 1617902 - RNA, 15 nt, Human
aaggaaagagggagg

SEQ ID NO: 1617903 - RNA, 20 nt, Human
aagcuccaucuccacuccag

SEQ ID NO: 1617904 - RNA, 14 nt, Human
aagcuccaucucca

SEQ ID NO: 1617905 - RNA, 16 nt, Human
aagucuuucacauuua

SEQ ID NO: 1617906 - RNA, 21 nt, Human
aagucaugcguuuaaucacau

SEQ ID NO: 1617907 - RNA, 21 nt, Human
aagugaaaaaggaggaagaga

SEQ ID NO: 1617908 - RNA, 17 nt, Human
aagugaagacaaugacu

SEQ ID NO: 1617909 - RNA, 19 nt, Human
aagugaagacaaugacuua

SEQ ID NO: 1617910 - RNA, 14 nt, Human
aagugagagcuggg

SEQ ID NO: 1617911 - RNA, 12 nt, Human
aagugagagagg

SEQ ID NO: 1617912 - RNA, 15 nt, Human
aagugagagcugggu

SEQ ID NO: 1617913 - RNA, 15 nt, Human
guuuuucauaaagca

SEQ ID NO: 1617914 - RNA, 19 nt, Human
aaguaaugauaacuggaaa

SEQ ID NO: 1617915 - RNA, 14 nt, Human
aaguaaugauaacu

SEQ ID NO: 1617916 - RNA, 13 nt, Human
aaguacacuguuu

SEQ ID NO: 1617917 - RNA, 18 nt, Human
aaguacacuguuucaaac

SEQ ID NO: 1617918 - RNA, 22 nt, Human
guuuugccauguuggccaggcu

SEQ ID NO: 1617919 - RNA, 21 nt, Human
guuuugccauguuggccaggc

SEQ ID NO: 1617920 - RNA, 20 nt, Human
guuuugccauguuggccagg

SEQ ID NO: 1617921 - RNA, 16 nt, Human
guuuugccauguuggc

SEQ ID NO: 1617922 - RNA, 15 nt, Human
guuucugccgcagcc

SEQ ID NO: 1617923 - RNA, 18 nt, Human
guuucugccgcagcccug

SEQ ID NO: 1617924 - RNA, 14 nt, Human
guuucugccgcagc

SEQ ID NO: 1617925 - RNA, 13 nt, Human
aaguauuagaaua

SEQ ID NO: 1617926 - RNA, 17 nt, Human
aaguauuaagcauauau

SEQ ID NO: 1617927 - RNA, 16 nt, Human
aaguauuaagcauaua

SEQ ID NO: 1617928 - RNA, 18 nt, Human
aaguauuaagcauauauu

SEQ ID NO: 1617929 - RNA, 23 nt, Human
aaguacacuguuucaaacuuuac

SEQ ID NO: 1617930 - RNA, 19 nt, Human
aaguacacuguuucaaacu

SEQ ID NO: 1617931 - RNA, 20 nt, Human
aaguacacuguuucaaacuu

SEQ ID NO: 1617932 - RNA, 15 nt, Human
aaguauuaagcauau

SEQ ID NO: 1617933 - RNA, 20 nt, Human
uaaaauaauuuuuauauuug

SEQ ID NO: 1617934 - RNA, 22 nt, Human
uaaaauaccagccaguaaaugg

SEQ ID NO: 1617935 - RNA, 20 nt, Human
uaaaagacagugaaagaaaa

SEQ ID NO: 1617936 - RNA, 18 nt, Human
aagugauucuccugccuc

SEQ ID NO: 1617937 - RNA, 17 nt, Human
aagugauucuccugccu

SEQ ID NO: 1617938 - RNA, 16 nt, Human
aagugauucuccugcc

SEQ ID NO: 1617939 - RNA, 15 nt, Human
aagugauucuccugc

SEQ ID NO: 1617940 - RNA, 19 nt, Human
aagugauucuccugccuca

SEQ ID NO: 1617941 - RNA, 20 nt, Human
aagugauucuccugccucag

SEQ ID NO: 1617942 - RNA, 21 nt, Human
aagugauucucaugccucagc

SEQ ID NO: 1617943 - RNA, 16 nt, Human
aagugaggaugaaaaa

SEQ ID NO: 1617944 - RNA, 20 nt, Human
aagugauucucaugccucag

SEQ ID NO: 1617945 - RNA, 22 nt, Human
uaaaauauuccugcauuuguga

SEQ ID NO: 1617946 - RNA, 13 nt, Human
uaaaauauuccug

SEQ ID NO: 1617947 - RNA, 23 nt, Human
uaaaagaauauuuuaacuuccuu

SEQ ID NO: 1617948 - RNA, 12 nt, Human
uaaaagaaugau

SEQ ID NO: 1617949 - RNA, 22 nt, Human
uaaaacuugauguguuaucucu

SEQ ID NO: 1617950 - RNA, 20 nt, Human
uaaaacuugauguguuaucu

SEQ ID NO: 1617951 - RNA, 19 nt, Human
uaaaaaucucaaauuucua

SEQ ID NO: 1617952 - RNA, 20 nt, Human
uaaaaaucucaaauuucuaa

SEQ ID NO: 1617953 - RNA, 21 nt, Human
uaaaaaucucaaauuucuaaa

SEQ ID NO: 1617954 - RNA, 15 nt, Human
guuuuucuucucccu

SEQ ID NO: 1617955 - RNA, 15 nt, Human
uaaaaaguggaaaaa

SEQ ID NO: 1617956 - RNA, 19 nt, Human
uaaaaauaaaaaacacugg

SEQ ID NO: 1617957 - RNA, 18 nt, Human
uaaaaauaaaaaacacug

SEQ ID NO: 1617958 - RNA, 15 nt, Human
uaaaaaucucaaauu

SEQ ID NO: 1617959 - RNA, 16 nt, Human
uaaaaaucucaaauuu

SEQ ID NO: 1617960 - RNA, 17 nt, Human
uaaaaaucucaaauuuc

SEQ ID NO: 1617961 - RNA, 21 nt, Human
uaaaaauaaaaaacacuggga

SEQ ID NO: 1617962 - RNA, 13 nt, Human
aagacgcugugcu

SEQ ID NO: 1617963 - RNA, 19 nt, Human
aagacgcugugcugcccug

SEQ ID NO: 1617964 - RNA, 18 nt, Human
aagacgcugugcugcccu

SEQ ID NO: 1617965 - RNA, 17 nt, Human
aagacgcugugcugccc

SEQ ID NO: 1617966 - RNA, 15 nt, Human
aagacgcugugcugc

SEQ ID NO: 1617967 - RNA, 11 nt, Human
gugccuuaugg

SEQ ID NO: 1617968 - RNA, 19 nt, Human
aagaccuucuccuucaccu

SEQ ID NO: 1617969 - RNA, 18 nt, Human
aagaccuucuccuucacc

SEQ ID NO: 1617970 - RNA, 15 nt, Human
aagaccuucuccuuc

SEQ ID NO: 1617971 - RNA, 17 nt, Human
aagacugcauuauauuu

SEQ ID NO: 1617972 - RNA, 16 nt, Human
aagacugcacaucaaa

SEQ ID NO: 1617973 - RNA, 23 nt, Human
aagacugaguacguugugcauuu

SEQ ID NO: 1617974 - RNA, 20 nt, Human
aagacgcugugcugcccugc

SEQ ID NO: 1617975 - RNA, 16 nt, Human
aagacuuuggaaagac

SEQ ID NO: 1617976 - RNA, 23 nt, Human
aagaggaaugaaguacucauaca

SEQ ID NO: 1617977 - RNA, 22 nt, Human
guggccucccaacucaccccag

SEQ ID NO: 1617978 - RNA, 21 nt, Human
guggccucccaacucacccca

SEQ ID NO: 1617979 - RNA, 23 nt, Human
gugggaggaucucuugagccugg

SEQ ID NO: 1617980 - RNA, 17 nt, Human
gugggaagggcuacacc

SEQ ID NO: 1617981 - RNA, 18 nt, Human
gugggagcugccuguuca

SEQ ID NO: 1617982 - RNA, 15 nt, Human
gugggagcugccugu

SEQ ID NO: 1617983 - RNA, 15 nt, Human
guggggucacucugg

SEQ ID NO: 1617984 - RNA, 22 nt, Human
guggcgcagcauauucaggaag

SEQ ID NO: 1617985 - RNA, 15 nt, Human
gugggacacccugug

SEQ ID NO: 1617986 - RNA, 14 nt, Human
gugggagcugccug

SEQ ID NO: 1617987 - RNA, 13 nt, Human
gugggacacccug

SEQ ID NO: 1617988 - RNA, 19 nt, Human
aagauguagaggagaaacu

SEQ ID NO: 1617989 - RNA, 13 nt, Human
aagauguagagga

SEQ ID NO: 1617990 - RNA, 20 nt, Human
gugucaagagggucugagga

SEQ ID NO: 1617991 - RNA, 17 nt, Human
guguauuuuuuuacuaa

SEQ ID NO: 1617992 - RNA, 23 nt, Human
guguauuuuuuuacuaauagaca

SEQ ID NO: 1617993 - RNA, 16 nt, Human
gugucagcauagaagu

SEQ ID NO: 1617994 - RNA, 21 nt, Human
gugugaccacugcagaagaca

SEQ ID NO: 1617995 - RNA, 22 nt, Human
gugugacaaggauugcuacugu

SEQ ID NO: 1617996 - RNA, 16 nt, Human
gugugguagagugugc

SEQ ID NO: 1617997 - RNA, 20 nt, Human
gugugugaaaaugugugugu

SEQ ID NO: 1617998 - RNA, 14 nt, Human
aagaugaaaauauu

SEQ ID NO: 1617999 - RNA, 13 nt, Human
aagaugaaaauau

SEQ ID NO: 1618000 - RNA, 14 nt, Human
aagaguaggaagac

SEQ ID NO: 1618001 - RNA, 13 nt, Human
aagaguaggaaga

SEQ ID NO: 1618002 - RNA, 16 nt, Human
aagaugcuucucacug

SEQ ID NO: 1618003 - RNA, 17 nt, Human
aagaugcuucucacugc

SEQ ID NO: 1618004 - RNA, 19 nt, Human
aagaugcuucucacugcca

SEQ ID NO: 1618005 - RNA, 23 nt, Human
aagauggcugugccucugccugu

SEQ ID NO: 1618006 - RNA, 21 nt, Human
aagauggcugugccucugccu

SEQ ID NO: 1618007 - RNA, 20 nt, Human
aagauggcugugccucugcc

SEQ ID NO: 1618008 - RNA, 22 nt, Human
guggggucacucuggcagcuca

SEQ ID NO: 1618009 - RNA, 21 nt, Human
guggggucacucuggcagcuc

SEQ ID NO: 1618010 - RNA, 20 nt, Human
guggggucacucuggcagcu

SEQ ID NO: 1618011 - RNA, 17 nt, Human
guggggucacucuggca

SEQ ID NO: 1618012 - RNA, 23 nt, Human
aagagggagggagggcuccagac

SEQ ID NO: 1618013 - RNA, 22 nt, Human
aagagggucugaggaauccaga

SEQ ID NO: 1618014 - RNA, 12 nt, Human
aagaguaggaag

SEQ ID NO: 1618015 - RNA, 23 nt, Human
guuauuuuuauuuauuuaaauuu

SEQ ID NO: 1618016 - RNA, 20 nt, Human
guucaaagauauuuugcuuu

SEQ ID NO: 1618017 - RNA, 21 nt, Human
guucaaagauauuuugcuuug

SEQ ID NO: 1618018 - RNA, 22 nt, Human
guucaaagauauuuugcuuugu

SEQ ID NO: 1618019 - RNA, 18 nt, Human
guucaagcgauucuucug

SEQ ID NO: 1618020 - RNA, 12 nt, Human
guuaagagaaau

SEQ ID NO: 1618021 - RNA, 11 nt, Human
guuaagagaaa

SEQ ID NO: 1618022 - RNA, 18 nt, Human
guuaagagaaaugagcuu

SEQ ID NO: 1618023 - RNA, 20 nt, Human
guuaggcauugugggaaggg

SEQ ID NO: 1618024 - RNA, 19 nt, Human
guuaggcauugugggaagg

SEQ ID NO: 1618025 - RNA, 20 nt, Human
aagccugaguuugcuuucaa

SEQ ID NO: 1618026 - RNA, 16 nt, Human
aagcuaggccuggcca

SEQ ID NO: 1618027 - RNA, 12 nt, Human
aagcuaggccug

SEQ ID NO: 1618028 - RNA, 13 nt, Human
guucagcuccagc

SEQ ID NO: 1618029 - RNA, 15 nt, Human
guucagcuccagcuc

SEQ ID NO: 1618030 - RNA, 13 nt, Human
guucagccugccu

SEQ ID NO: 1618031 - RNA, 20 nt, Human
aagcucacagaccuuugaac

SEQ ID NO: 1618032 - RNA, 17 nt, Human
aagcucagggccuggcu

SEQ ID NO: 1618033 - RNA, 16 nt, Human
aagcucagggccuggc

SEQ ID NO: 1618034 - RNA, 13 nt, Human
aagcucagggccu

SEQ ID NO: 1618035 - RNA, 12 nt, Human
aagcucagggcc

SEQ ID NO: 1618036 - RNA, 14 nt, Human
aagcuccagguaga

SEQ ID NO: 1618037 - RNA, 13 nt, Human
aagcuccagguag

SEQ ID NO: 1618038 - RNA, 18 nt, Human
aagcuccaagcucccagg

SEQ ID NO: 1618039 - RNA, 17 nt, Human
aagcuccaagcucccag

SEQ ID NO: 1618040 - RNA, 19 nt, Human
aagcucagggccuggcuca

SEQ ID NO: 1618041 - RNA, 18 nt, Human
aagcucagggccuggcuc

SEQ ID NO: 1618042 - RNA, 20 nt, Human
aagcucagggccuggcucag

SEQ ID NO: 1618043 - RNA, 13 nt, Human
aagcauuguaaau

SEQ ID NO: 1618044 - RNA, 18 nt, Human
aagcauuguaaaugugcu

SEQ ID NO: 1618045 - RNA, 16 nt, Human
aagcauuuagauguau

SEQ ID NO: 1618046 - RNA, 21 nt, Human
gugugugcgccuacaggagug

SEQ ID NO: 1618047 - RNA, 12 nt, Human
aagcagugcaug

SEQ ID NO: 1618048 - RNA, 20 nt, Human
aagcagugcaugcugucccu

SEQ ID NO: 1618049 - RNA, 15 nt, Human
aagcagugcaugcug

SEQ ID NO: 1618050 - RNA, 14 nt, Human
aagcagugcaugcu

SEQ ID NO: 1618051 - RNA, 22 nt, Human
aagcccaggaaaggcuccagga

SEQ ID NO: 1618052 - RNA, 19 nt, Human
aagcccaggaaaggcucca

SEQ ID NO: 1618053 - RNA, 17 nt, Human
aagcccaggaaaggcuc

SEQ ID NO: 1618054 - RNA, 14 nt, Human
aagcccaggaaagg

SEQ ID NO: 1618055 - RNA, 22 nt, Human
aagccaaagcuaggccuggcca

SEQ ID NO: 1618056 - RNA, 20 nt, Human
aagccgcuggggccaguugg

SEQ ID NO: 1618057 - RNA, 23 nt, Human
aagcccuuccaugucgccucugc

SEQ ID NO: 1618058 - RNA, 20 nt, Human
aagcccuuccaugucgccuc

SEQ ID NO: 1618059 - RNA, 15 nt, Human
aagcccuuccauguc

SEQ ID NO: 1618060 - RNA, 21 nt, Human
aagcccugugcuccauggcug

SEQ ID NO: 1618061 - RNA, 19 nt, Human
aagcccugagcuuucugcu

SEQ ID NO: 1618062 - RNA, 19 nt, Human
aauagucaaauugugugaa

SEQ ID NO: 1618063 - RNA, 21 nt, Human
aauagcuagacuggugacuga

SEQ ID NO: 1618064 - RNA, 20 nt, Human
aauagcuagacuggugacug

SEQ ID NO: 1618065 - RNA, 14 nt, Human
aauagcuagacugg

SEQ ID NO: 1618066 - RNA, 21 nt, Human
aauauauuuuaagacgaaaca

SEQ ID NO: 1618067 - RNA, 21 nt, Human
aauaguucagguaacaggcag

SEQ ID NO: 1618068 - RNA, 21 nt, Human
aauauauucagccuggcuuca

SEQ ID NO: 1618069 - RNA, 19 nt, Human
uaacauguaauuaaguacu

SEQ ID NO: 1618070 - RNA, 14 nt, Human
uaacaugaauauuu

SEQ ID NO: 1618071 - RNA, 21 nt, Human
uaacaugaauauuuaguguuc

SEQ ID NO: 1618072 - RNA, 20 nt, Human
uaacaugaauauuuaguguu

SEQ ID NO: 1618073 - RNA, 16 nt, Human
uaacauguuaaaccau

SEQ ID NO: 1618074 - RNA, 15 nt, Human
uaacauguuaaacca

SEQ ID NO: 1618075 - RNA, 12 nt, Human
uaacauguuaaa

SEQ ID NO: 1618076 - RNA, 19 nt, Human
uaacaugaauauuuagugu

SEQ ID NO: 1618077 - RNA, 21 nt, Human
uaacuuccuuggacucauuuu

SEQ ID NO: 1618078 - RNA, 20 nt, Human
uaacuugucuuuggacccug

SEQ ID NO: 1618079 - RNA, 16 nt, Human
uaacuugucuuuggac

SEQ ID NO: 1618080 - RNA, 13 nt, Human
uaagaagugaaaa

SEQ ID NO: 1618081 - RNA, 23 nt, Human
uaagacaaaaagcuacuuauugu

SEQ ID NO: 1618082 - RNA, 13 nt, Human
uaagacaaauaug

SEQ ID NO: 1618083 - RNA, 13 nt, Human
uaacuucacauau

SEQ ID NO: 1618084 - RNA, 14 nt, Human
uaacuaaaagguau

SEQ ID NO: 1618085 - RNA, 17 nt, Human
uaacguauaaaagccug

SEQ ID NO: 1618086 - RNA, 13 nt, Human
uaacguauaaaag

SEQ ID NO: 1618087 - RNA, 18 nt, Human
aauaccugucccccugac

SEQ ID NO: 1618088 - RNA, 15 nt, Human
aauaccugucccccu

SEQ ID NO: 1618089 - RNA, 19 nt, Human
aauaccugucccccugaca

SEQ ID NO: 1618090 - RNA, 21 nt, Human
aauaccugucccccugacaac

SEQ ID NO: 1618091 - RNA, 23 nt, Human
aauacaucccuuaccugggaaag

SEQ ID NO: 1618092 - RNA, 18 nt, Human
aauaccaugccauuuaaa

SEQ ID NO: 1618093 - RNA, 19 nt, Human
aauaccagccaguaaaugg

SEQ ID NO: 1618094 - RNA, 17 nt, Human
aauaccagccaguaaau

SEQ ID NO: 1618095 - RNA, 23 nt, Human
aauaccacaggaaccacaagacu

SEQ ID NO: 1618096 - RNA, 12 nt, Human
aauaccaaggaa

SEQ ID NO: 1618097 - RNA, 13 nt, Human
uaacaaugcugua

SEQ ID NO: 1618098 - RNA, 13 nt, Human
aauacagaggcaa

SEQ ID NO: 1618099 - RNA, 21 nt, Human
uaaauuaacuuuuauaaacuu

SEQ ID NO: 1618100 - RNA, 22 nt, Human
uaaauuaacuuuuauaaacuuu

SEQ ID NO: 1618101 - RNA, 18 nt, Human
aaguguauuuuuuuacua

SEQ ID NO: 1618102 - RNA, 21 nt, Human
aaguguauuuuuuuacuaaua

SEQ ID NO: 1618103 - RNA, 18 nt, Human
uaaaugaaaaucgugaca

SEQ ID NO: 1618104 - RNA, 19 nt, Human
uaaauuaacuuuuauaaac

SEQ ID NO: 1618105 - RNA, 20 nt, Human
uaaauuaacuuuuauaaacu

SEQ ID NO: 1618106 - RNA, 13 nt, Human
uaaaugugguaaa

SEQ ID NO: 1618107 - RNA, 17 nt, Human
aaucccauuuaaaaaaa

SEQ ID NO: 1618108 - RNA, 16 nt, Human
aaucccauuauucaaa

SEQ ID NO: 1618109 - RNA, 14 nt, Human
aaucccauuauuca

SEQ ID NO: 1618110 - RNA, 12 nt, Human
aaucccaggaug

SEQ ID NO: 1618111 - RNA, 21 nt, Human
aaucccauuauucaaaguugc

SEQ ID NO: 1618112 - RNA, 12 nt, Human
aaucuaaaugga

SEQ ID NO: 1618113 - RNA, 13 nt, Human
aaucucaaauaac

SEQ ID NO: 1618114 - RNA, 20 nt, Human
uaaguaaugauaacuggaaa

SEQ ID NO: 1618115 - RNA, 19 nt, Human
uaaguaaaaccacagcagu

SEQ ID NO: 1618116 - RNA, 18 nt, Human
uaaguaaaaccacagcag

SEQ ID NO: 1618117 - RNA, 17 nt, Human
uaaguaaaaccacagca

SEQ ID NO: 1618118 - RNA, 16 nt, Human
uaaguaaaaccacagc

SEQ ID NO: 1618119 - RNA, 15 nt, Human
uaaguaaaaccacag

SEQ ID NO: 1618120 - RNA, 13 nt, Human
uaaguaaaaccac

SEQ ID NO: 1618121 - RNA, 18 nt, Human
uaaggaugcuuguacaua

SEQ ID NO: 1618122 - RNA, 18 nt, Human
uaagguuaccuuuguucc

SEQ ID NO: 1618123 - RNA, 19 nt, Human
uaaggacuuguuagaucua

SEQ ID NO: 1618124 - RNA, 16 nt, Human
uaaggacuuguuagau

SEQ ID NO: 1618125 - RNA, 15 nt, Human
uaaggacuuguuaga

SEQ ID NO: 1618126 - RNA, 13 nt, Human
uaaggacuuguua

SEQ ID NO: 1618127 - RNA, 17 nt, Human
uaaguguguguuuuuca

SEQ ID NO: 1618128 - RNA, 14 nt, Human
uaagcaaaauguga

SEQ ID NO: 1618129 - RNA, 14 nt, Human
uaagauucauauuu

SEQ ID NO: 1618130 - RNA, 21 nt, Human
uaagcaaaaugugauauguac

SEQ ID NO: 1618131 - RNA, 15 nt, Human
uaagcaaaaugugau

SEQ ID NO: 1618132 - RNA, 21 nt, Human
uaagcuauucaguaauaacuc

SEQ ID NO: 1618133 - RNA, 16 nt, Human
uaagcauauauuuuua

SEQ ID NO: 1618134 - RNA, 13 nt, Human
uaagcauauauuu

SEQ ID NO: 1618135 - RNA, 9 nt, Human
uaaggaaua

SEQ ID NO: 1618136 - RNA, 13 nt, Human
uaaggaagacaau

SEQ ID NO: 1618137 - RNA, 21 nt, Human
uaaggaaaaguuuaauauuaa

SEQ ID NO: 1618138 - RNA, 19 nt, Human
uaaggaaaaguuuaauauu

SEQ ID NO: 1618139 - RNA, 17 nt, Human
uaaggaaaaguuuaaua

SEQ ID NO: 1618140 - RNA, 18 nt, Human
uaaggaauaccugucccc

SEQ ID NO: 1618141 - RNA, 17 nt, Human
uaaggaauaccuguccc

SEQ ID NO: 1618142 - RNA, 22 nt, Human
uaaggaauuuuauuuuuuucug

SEQ ID NO: 1618143 - RNA, 22 nt, Human
uaaggacuucuuuaauuuugga

SEQ ID NO: 1618144 - RNA, 16 nt, Human
uaaggacuucuuuaau

SEQ ID NO: 1618145 - RNA, 15 nt, Human
uaaggacuucuuuaa

SEQ ID NO: 1618146 - RNA, 14 nt, Human
uaaggacuucuuua

SEQ ID NO: 1618147 - RNA, 16 nt, Human
aaucagccuaguugau

SEQ ID NO: 1618148 - RNA, 11 nt, Human
aaucagccugc

SEQ ID NO: 1618149 - RNA, 19 nt, Human
aaucagcauucucacuccu

SEQ ID NO: 1618150 - RNA, 18 nt, Human
aaucagcauucucacucc

SEQ ID NO: 1618151 - RNA, 18 nt, Human
aaucagccugcuccagcu

SEQ ID NO: 1618152 - RNA, 13 nt, Human
aaucagccugcuc

SEQ ID NO: 1618153 - RNA, 19 nt, Human
aaucagccugcuccagcug

SEQ ID NO: 1618154 - RNA, 15 nt, Human
aauauuuauuuuaau

SEQ ID NO: 1618155 - RNA, 15 nt, Human
aauauuuauagguca

SEQ ID NO: 1618156 - RNA, 18 nt, Human
uaauuuuuauauuugaaa

SEQ ID NO: 1618157 - RNA, 21 nt, Human
uaauuuuuauauuugaaauau

SEQ ID NO: 1618158 - RNA, 19 nt, Human
uaauuuuuauauuugaaau

SEQ ID NO: 1618159 - RNA, 22 nt, Human
uaauuccguagguuauuuucag

SEQ ID NO: 1618160 - RNA, 16 nt, Human
aaugauuucauucaau

SEQ ID NO: 1618161 - RNA, 13 nt, Human
aaugauuuuuaaa

SEQ ID NO: 1618162 - RNA, 11 nt, Human
aaugcaaacca

SEQ ID NO: 1618163 - RNA, 12 nt, Human
aaugcaaaccau

SEQ ID NO: 1618164 - RNA, 14 nt, Human
aaugcaaaccauca

SEQ ID NO: 1618165 - RNA, 13 nt, Human
aaugcaccuggaa

SEQ ID NO: 1618166 - RNA, 23 nt, Human
uaauuauaucugaggaauucugu

SEQ ID NO: 1618167 - RNA, 22 nt, Human
uaauuauaucugaggaauucug

SEQ ID NO: 1618168 - RNA, 21 nt, Human
uaauuauaucugaggaauucu

SEQ ID NO: 1618169 - RNA, 19 nt, Human
uaauuauaucugaggaauu

SEQ ID NO: 1618170 - RNA, 20 nt, Human
uaauuauaugcuauuucuau

SEQ ID NO: 1618171 - RNA, 19 nt, Human
uaauuauaugcuauuucua

SEQ ID NO: 1618172 - RNA, 18 nt, Human
uaauuauaugcuauuucu

SEQ ID NO: 1618173 - RNA, 14 nt, Human
uaauuauaugcuau

SEQ ID NO: 1618174 - RNA, 21 nt, Human
aaugaccuuucaauaggaaaa

SEQ ID NO: 1618175 - RNA, 22 nt, Human
aaugagagacacacugaagaag

SEQ ID NO: 1618176 - RNA, 22 nt, Human
aaugagaaaucuaaaaaacgaa

SEQ ID NO: 1618177 - RNA, 12 nt, Human
aaugagaaaucu

SEQ ID NO: 1618178 - RNA, 11 nt, Human
aaugagccugg

SEQ ID NO: 1618179 - RNA, 13 nt, Human
aaugagccuggca

SEQ ID NO: 1618180 - RNA, 12 nt, Human
aaugagccuggc

SEQ ID NO: 1618181 - RNA, 14 nt, Human
aaugagccuggcaa

SEQ ID NO: 1618182 - RNA, 18 nt, Human
aaugaggucagagccugc

SEQ ID NO: 1618183 - RNA, 16 nt, Human
aaugaggucagagccu

SEQ ID NO: 1618184 - RNA, 24 nt, Human
aaugauuucagcucacugcaaccu

SEQ ID NO: 1618185 - RNA, 21 nt, Human
uacaaaaaaaaaaaaaaauua

SEQ ID NO: 1618186 - RNA, 22 nt, Human
uaauuuuuuuuuuccuuuuaaa

SEQ ID NO: 1618187 - RNA, 18 nt, Human
uaauuuuuuugagacaga

SEQ ID NO: 1618188 - RNA, 15 nt, Human
uaauuuuuguauuuu

SEQ ID NO: 1618189 - RNA, 13 nt, Human
uacaaugcugugc

SEQ ID NO: 1618190 - RNA, 14 nt, Human
uacaaugcugugcc

SEQ ID NO: 1618191 - RNA, 16 nt, Human
uacaaugcugugcccu

SEQ ID NO: 1618192 - RNA, 21 nt, Human
aaugcuguauuuuaaaagaau

SEQ ID NO: 1618193 - RNA, 20 nt, Human
aaugcuguauuuuaaaagaa

SEQ ID NO: 1618194 - RNA, 22 nt, Human
aaugcuggcuguuggcuggggg

SEQ ID NO: 1618195 - RNA, 21 nt, Human
aaugcuggcuguuggcugggg

SEQ ID NO: 1618196 - RNA, 22 nt, Human
aaugcuguauuuuaaaagaaug

SEQ ID NO: 1618197 - RNA, 13 nt, Human
aauggaagacagc

SEQ ID NO: 1618198 - RNA, 20 nt, Human
aauguaagggaaacugccag

SEQ ID NO: 1618199 - RNA, 12 nt, Human
aauguaaauaaa

SEQ ID NO: 1618200 - RNA, 16 nt, Human
aaugguuuucuugugu

SEQ ID NO: 1618201 - RNA, 16 nt, Human
aaugguuuucaaaaua

SEQ ID NO: 1618202 - RNA, 14 nt, Human
aaugguuuucaaaa

SEQ ID NO: 1618203 - RNA, 16 nt, Human
aauggaagacagcucu

SEQ ID NO: 1618204 - RNA, 18 nt, Human
aauggaagacagcucuua

SEQ ID NO: 1618205 - RNA, 17 nt, Human
uacagagacagaaagca

SEQ ID NO: 1618206 - RNA, 19 nt, Human
uacagacaaagcguggugg

SEQ ID NO: 1618207 - RNA, 22 nt, Human
uacagagcccacgcccccacug

SEQ ID NO: 1618208 - RNA, 19 nt, Human
uacagagcccacgccccca

SEQ ID NO: 1618209 - RNA, 23 nt, Human
uacagagcagacaguuaagagaa

SEQ ID NO: 1618210 - RNA, 15 nt, Human
uacagacaaagcgug

SEQ ID NO: 1618211 - RNA, 14 nt, Human
uacagacaaagcgu

SEQ ID NO: 1618212 - RNA, 13 nt, Human
uacagacaaagcg

SEQ ID NO: 1618213 - RNA, 17 nt, Human
uacaccgggccuggaga

SEQ ID NO: 1618214 - RNA, 15 nt, Human
uacaccgggccugga

SEQ ID NO: 1618215 - RNA, 22 nt, Human
aauuauuuauuaaaugcccagc

SEQ ID NO: 1618216 - RNA, 11 nt, Human
aauucaguugu

SEQ ID NO: 1618217 - RNA, 22 nt, Human
aauucaguuguuagugugucuu

SEQ ID NO: 1618218 - RNA, 17 nt, Human
aauucaguuguuagugu

SEQ ID NO: 1618219 - RNA, 22 nt, Human
aauuaugugccagauuuaugca

SEQ ID NO: 1618220 - RNA, 21 nt, Human
aauuauuuauuaaaugcccag

SEQ ID NO: 1618221 - RNA, 14 nt, Human
aauuacauuuguau

SEQ ID NO: 1618222 - RNA, 13 nt, Human
aauuacauuugua

SEQ ID NO: 1618223 - RNA, 20 nt, Human
aauuacaggaaguacuggag

SEQ ID NO: 1618224 - RNA, 19 nt, Human
aauuacaggaaguacugga

SEQ ID NO: 1618225 - RNA, 17 nt, Human
aauuacaggaaguacug

SEQ ID NO: 1618226 - RNA, 16 nt, Human
uaccugaggggccucu

SEQ ID NO: 1618227 - RNA, 16 nt, Human
uaccugccaggaagcc

SEQ ID NO: 1618228 - RNA, 15 nt, Human
uaccugaggggccuc

SEQ ID NO: 1618229 - RNA, 13 nt, Human
uaccugaggggcc

SEQ ID NO: 1618230 - RNA, 16 nt, Human
uaccugaagucuuugu

SEQ ID NO: 1618231 - RNA, 14 nt, Human
uaccugaagucuuu

SEQ ID NO: 1618232 - RNA, 13 nt, Human
uaccugaagucuu

SEQ ID NO: 1618233 - RNA, 23 nt, Human
uaccugaagcuaucguaaaauua

SEQ ID NO: 1618234 - RNA, 15 nt, Human
uacccucauguucuu

SEQ ID NO: 1618235 - RNA, 22 nt, Human
uaccucuugagccuugaacuuu

SEQ ID NO: 1618236 - RNA, 23 nt, Human
uaccucuugagccuugaacuuug

SEQ ID NO: 1618237 - RNA, 23 nt, Human
uacccgggaagggggcugggaca

SEQ ID NO: 1618238 - RNA, 19 nt, Human
uaccagggacugaggggag

SEQ ID NO: 1618239 - RNA, 23 nt, Human
uacccccugcaaagcccagcuug

SEQ ID NO: 1618240 - RNA, 19 nt, Human
uacccccugcaaagcccag

SEQ ID NO: 1618241 - RNA, 15 nt, Human
uacccccugcaaagc

SEQ ID NO: 1618242 - RNA, 12 nt, Human
uaccagcagagc

SEQ ID NO: 1618243 - RNA, 14 nt, Human
uaccagcagagcac

SEQ ID NO: 1618244 - RNA, 13 nt, Human
uaccagcagagca

SEQ ID NO: 1618245 - RNA, 22 nt, Human
uaccagcagagcaccuuagaca

SEQ ID NO: 1618246 - RNA, 18 nt, Human
uaccagccaguaaauggg

SEQ ID NO: 1618247 - RNA, 12 nt, Human
uacauucuguua

SEQ ID NO: 1618248 - RNA, 13 nt, Human
uacauuuccuaaa

SEQ ID NO: 1618249 - RNA, 20 nt, Human
aauguucaucaaugaaugaa

SEQ ID NO: 1618250 - RNA, 16 nt, Human
aauguucaucaaugaa

SEQ ID NO: 1618251 - RNA, 21 nt, Human
aauguucucucuucuccaccu

SEQ ID NO: 1618252 - RNA, 12 nt, Human
aauuaacuuuua

SEQ ID NO: 1618253 - RNA, 13 nt, Human
aauuaacuuuuau

SEQ ID NO: 1618254 - RNA, 17 nt, Human
aauuaaguacuauguau

SEQ ID NO: 1618255 - RNA, 16 nt, Human
aauuaaguacuaugua

SEQ ID NO: 1618256 - RNA, 15 nt, Human
aauuaacuuuuauaa

SEQ ID NO: 1618257 - RNA, 16 nt, Human
aauuaacuuuuauaaa

SEQ ID NO: 1618258 - RNA, 13 nt, Human
aauguucaucaau

SEQ ID NO: 1618259 - RNA, 23 nt, Human
uacagagcccacgcccccacugg

SEQ ID NO: 1618260 - RNA, 21 nt, Human
aaugugcugaaugguuuucaa

SEQ ID NO: 1618261 - RNA, 14 nt, Human
acagaccuuugaac

SEQ ID NO: 1618262 - RNA, 20 nt, Human
uaucacaaaucuuaacuuga

SEQ ID NO: 1618263 - RNA, 16 nt, Human
uaucacaaaucuuaac

SEQ ID NO: 1618264 - RNA, 14 nt, Human
uaucacaaaucuua

SEQ ID NO: 1618265 - RNA, 19 nt, Human
uaucacccagaagaaaaua

SEQ ID NO: 1618266 - RNA, 22 nt, Human
uaucacccagaagaaaauagug

SEQ ID NO: 1618267 - RNA, 17 nt, Human
uaucagaauucucagaa

SEQ ID NO: 1618268 - RNA, 19 nt, Human
uauccaacaucaacaucuu

SEQ ID NO: 1618269 - RNA, 15 nt, Human
uaucccggcugcccu

SEQ ID NO: 1618270 - RNA, 16 nt, Human
acacuuacacuuuaug

SEQ ID NO: 1618271 - RNA, 20 nt, Human
acacuguuucaaacuuuacu

SEQ ID NO: 1618272 - RNA, 23 nt, Human
acacuguuucaaacuuuacuaug

SEQ ID NO: 1618273 - RNA, 19 nt, Human
acacucauugaccugaggc

SEQ ID NO: 1618274 - RNA, 17 nt, Human
acacucauugaccugag

SEQ ID NO: 1618275 - RNA, 17 nt, Human
acacuguuucaaacuuu

SEQ ID NO: 1618276 - RNA, 18 nt, Human
acacuguuucaaacuuua

SEQ ID NO: 1618277 - RNA, 21 nt, Human
acacuuacacuuuaugcacaa

SEQ ID NO: 1618278 - RNA, 18 nt, Human
acacuuacacuuuaugca

SEQ ID NO: 1618279 - RNA, 14 nt, Human
acacuuccauaauc

SEQ ID NO: 1618280 - RNA, 22 nt, Human
acacuucaggcucuucuccuuu

SEQ ID NO: 1618281 - RNA, 19 nt, Human
acacuucaggcucuucucc

SEQ ID NO: 1618282 - RNA, 15 nt, Human
acacuucaggcucuu

SEQ ID NO: 1618283 - RNA, 18 nt, Human
acagacauacuaaccagc

SEQ ID NO: 1618284 - RNA, 19 nt, Human
acagacauacuaaccagca

SEQ ID NO: 1618285 - RNA, 13 nt, Human
acagaaauguaca

SEQ ID NO: 1618286 - RNA, 19 nt, Human
uauauauuuuuuucugaaa

SEQ ID NO: 1618287 - RNA, 16 nt, Human
acacucauugaccuga

SEQ ID NO: 1618288 - RNA, 21 nt, Human
uauaucuauauuuuacauaaa

SEQ ID NO: 1618289 - RNA, 12 nt, Human
uauaggaauuga

SEQ ID NO: 1618290 - RNA, 23 nt, Human
uauaggaacuuaaauaaugugaa

SEQ ID NO: 1618291 - RNA, 16 nt, Human
uauaggugcuacaaaa

SEQ ID NO: 1618292 - RNA, 15 nt, Human
uauaggcaccuacca

SEQ ID NO: 1618293 - RNA, 18 nt, Human
uauagccuaggugacaga

SEQ ID NO: 1618294 - RNA, 19 nt, Human
uauagauuagaauucugua

SEQ ID NO: 1618295 - RNA, 18 nt, Human
uauagauuagaauucugu

SEQ ID NO: 1618296 - RNA, 22 nt, Human
uauacacuuacacuuuaugcac

SEQ ID NO: 1618297 - RNA, 21 nt, Human
uauaauuuaccugaagucuuu

SEQ ID NO: 1618298 - RNA, 18 nt, Human
uauaauuuaccugaaguc

SEQ ID NO: 1618299 - RNA, 17 nt, Human
acacucaaaucaagaaa

SEQ ID NO: 1618300 - RNA, 18 nt, Human
acacucaaaucaagaaac

SEQ ID NO: 1618301 - RNA, 19 nt, Human
uauaagugauugcugguuu

SEQ ID NO: 1618302 - RNA, 13 nt, Human
acacucaaaucaa

SEQ ID NO: 1618303 - RNA, 21 nt, Human
acacucaaaagcugggcaggu

SEQ ID NO: 1618304 - RNA, 22 nt, Human
acacuaaugaggaaacugcacu

SEQ ID NO: 1618305 - RNA, 15 nt, Human
acacuaaugaggaaa

SEQ ID NO: 1618306 - RNA, 20 nt, Human
uagucacugagacagcccgg

SEQ ID NO: 1618307 - RNA, 17 nt, Human
uagucacugagacagcc

SEQ ID NO: 1618308 - RNA, 22 nt, Human
acaggaaccacaagacugcaca

SEQ ID NO: 1618309 - RNA, 20 nt, Human
acaggaaaauuuuaaaaaua

SEQ ID NO: 1618310 - RNA, 15 nt, Human
acaggcagauacagg

SEQ ID NO: 1618311 - RNA, 15 nt, Human
acaggacucugccuc

SEQ ID NO: 1618312 - RNA, 16 nt, Human
acaggacucugccucc

SEQ ID NO: 1618313 - RNA, 17 nt, Human
acaggcccggcuccagg

SEQ ID NO: 1618314 - RNA, 16 nt, Human
acaggcccggcuccag

SEQ ID NO: 1618315 - RNA, 13 nt, Human
acaggcaggucca

SEQ ID NO: 1618316 - RNA, 22 nt, Human
acaggcccggcuccaggcuccu

SEQ ID NO: 1618317 - RNA, 21 nt, Human
acaggcccggcuccaggcucc

SEQ ID NO: 1618318 - RNA, 20 nt, Human
acaggcccggcuccaggcuc

SEQ ID NO: 1618319 - RNA, 18 nt, Human
acaggcccggcuccaggc

SEQ ID NO: 1618320 - RNA, 22 nt, Human
acaggcccuuccucuccacugc

SEQ ID NO: 1618321 - RNA, 15 nt, Human
acaggcccuuccucu

SEQ ID NO: 1618322 - RNA, 13 nt, Human
acaggcccuuccu

SEQ ID NO: 1618323 - RNA, 23 nt, Human
acagcuguaugauucccagccag

SEQ ID NO: 1618324 - RNA, 20 nt, Human
acagcuguaugauucccagc

SEQ ID NO: 1618325 - RNA, 19 nt, Human
acagcuguaugauucccag

SEQ ID NO: 1618326 - RNA, 14 nt, Human
acagcuguaugauu

SEQ ID NO: 1618327 - RNA, 19 nt, Human
acagcuaaugggacacuaa

SEQ ID NO: 1618328 - RNA, 17 nt, Human
acagcuaaugggacacu

SEQ ID NO: 1618329 - RNA, 16 nt, Human
acagcuaaugggacac

SEQ ID NO: 1618330 - RNA, 15 nt, Human
acagcuaaugggaca

SEQ ID NO: 1618331 - RNA, 21 nt, Human
acagcuucauuuccugugucu

SEQ ID NO: 1618332 - RNA, 19 nt, Human
acagcuucauuuccugugu

SEQ ID NO: 1618333 - RNA, 17 nt, Human
acagcuucauuuccugu

SEQ ID NO: 1618334 - RNA, 21 nt, Human
acagcuugaccgugaggccag

SEQ ID NO: 1618335 - RNA, 20 nt, Human
acagcuugaccgugaggcca

SEQ ID NO: 1618336 - RNA, 17 nt, Human
acagcuugaccgugagg

SEQ ID NO: 1618337 - RNA, 21 nt, Human
acaggaaaagcugcugacagu

SEQ ID NO: 1618338 - RNA, 20 nt, Human
acaggaaaagcugcugacag

SEQ ID NO: 1618339 - RNA, 19 nt, Human
acaggaaaagcugcugaca

SEQ ID NO: 1618340 - RNA, 23 nt, Human
acagcuugaccgugaggccagag

SEQ ID NO: 1618341 - RNA, 22 nt, Human
acagcuugaccgugaggccaga

SEQ ID NO: 1618342 - RNA, 19 nt, Human
acagcccuucuuuccacag

SEQ ID NO: 1618343 - RNA, 21 nt, Human
uaugaaacuuguguaaauaca

SEQ ID NO: 1618344 - RNA, 19 nt, Human
uaugaaacuuguguaaaua

SEQ ID NO: 1618345 - RNA, 14 nt, Human
uaugaaacuugugu

SEQ ID NO: 1618346 - RNA, 14 nt, Human
uaugaggcauuugu

SEQ ID NO: 1618347 - RNA, 15 nt, Human
uaugaggcauuuguu

SEQ ID NO: 1618348 - RNA, 21 nt, Human
uaugaggcauuuguuugaacu

SEQ ID NO: 1618349 - RNA, 23 nt, Human
uaugaggcauuuguuugaacuga

SEQ ID NO: 1618350 - RNA, 23 nt, Human
uaugaagcuuuuaugugaaacau

SEQ ID NO: 1618351 - RNA, 22 nt, Human
uaugaagcuuuuaugugaaaca

SEQ ID NO: 1618352 - RNA, 20 nt, Human
uaugaagcuuuuaugugaaa

SEQ ID NO: 1618353 - RNA, 16 nt, Human
acagcccgggcucugc

SEQ ID NO: 1618354 - RNA, 23 nt, Human
acagcccuccaucuaaacugccc

SEQ ID NO: 1618355 - RNA, 15 nt, Human
acagcccgggcucug

SEQ ID NO: 1618356 - RNA, 16 nt, Human
acagccccuccuccau

SEQ ID NO: 1618357 - RNA, 14 nt, Human
acagccccuccucc

SEQ ID NO: 1618358 - RNA, 17 nt, Human
acagcagccccugcaca

SEQ ID NO: 1618359 - RNA, 19 nt, Human
acagcacgggggccaagga

SEQ ID NO: 1618360 - RNA, 15 nt, Human
uaucuauauuuuaca

SEQ ID NO: 1618361 - RNA, 22 nt, Human
acagauuugagcucagcccugg

SEQ ID NO: 1618362 - RNA, 15 nt, Human
uaugccccauucaac

SEQ ID NO: 1618363 - RNA, 14 nt, Human
uaugcucugcaugu

SEQ ID NO: 1618364 - RNA, 23 nt, Human
uaugcuauuucuauauuuucauu

SEQ ID NO: 1618365 - RNA, 22 nt, Human
uaugcuauuucuauauuuucau

SEQ ID NO: 1618366 - RNA, 18 nt, Human
uaugcuauuucuauauuu

SEQ ID NO: 1618367 - RNA, 16 nt, Human
uaugcuauuucuauau

SEQ ID NO: 1618368 - RNA, 15 nt, Human
uaugcuauuucuaua

SEQ ID NO: 1618369 - RNA, 14 nt, Human
uaugcuauuucuau

SEQ ID NO: 1618370 - RNA, 22 nt, Human
uaugcaugaaguaauaugcaca

SEQ ID NO: 1618371 - RNA, 14 nt, Human
uaugaucacggcuc

SEQ ID NO: 1618372 - RNA, 17 nt, Human
uaugauacuugaaaauu

SEQ ID NO: 1618373 - RNA, 10 nt, Human
uaugggagag

SEQ ID NO: 1618374 - RNA, 23 nt, Human
uaugggacucaaugcacugacau

SEQ ID NO: 1618375 - RNA, 16 nt, Human
uaugggacucaaugca

SEQ ID NO: 1618376 - RNA, 20 nt, Human
uauggcccuggccuagcaua

SEQ ID NO: 1618377 - RNA, 21 nt, Human
uauggcccuggccuagcauac

SEQ ID NO: 1618378 - RNA, 22 nt, Human
uauggcccuggccuagcauacg

SEQ ID NO: 1618379 - RNA, 13 nt, Human
uaggauguugaaa

SEQ ID NO: 1618380 - RNA, 17 nt, Human
uaggaaaaacugauuuu

SEQ ID NO: 1618381 - RNA, 16 nt, Human
uaggaaaaacugauuu

SEQ ID NO: 1618382 - RNA, 13 nt, Human
uagggaagauaau

SEQ ID NO: 1618383 - RNA, 21 nt, Human
uagggaaggauacaaaagcau

SEQ ID NO: 1618384 - RNA, 19 nt, Human
uagggauggggcugugggg

SEQ ID NO: 1618385 - RNA, 20 nt, Human
uagccuuagaagucacacag

SEQ ID NO: 1618386 - RNA, 14 nt, Human
uagcgcccaguugg

SEQ ID NO: 1618387 - RNA, 21 nt, Human
uagccuuagaagucacacagu

SEQ ID NO: 1618388 - RNA, 17 nt, Human
uagcgcccaguugggug

SEQ ID NO: 1618389 - RNA, 14 nt, Human
uaggaaaaacugau

SEQ ID NO: 1618390 - RNA, 13 nt, Human
uaggaaaaacuga

SEQ ID NO: 1618391 - RNA, 23 nt, Human
uagcuuuuuucucugauacagaa

SEQ ID NO: 1618392 - RNA, 13 nt, Human
uagcuuuuuucuc

SEQ ID NO: 1618393 - RNA, 13 nt, Human
uagcuuuucccuu

SEQ ID NO: 1618394 - RNA, 13 nt, Human
acacaacuauauu

SEQ ID NO: 1618395 - RNA, 21 nt, Human
acaaugcaaaccaucauugaa

SEQ ID NO: 1618396 - RNA, 19 nt, Human
acaaugcaaaccaucauug

SEQ ID NO: 1618397 - RNA, 23 nt, Human
acaaugcaaaccaucauugaaau

SEQ ID NO: 1618398 - RNA, 15 nt, Human
uaggguuauaauaau

SEQ ID NO: 1618399 - RNA, 15 nt, Human
uagggugggccuuca

SEQ ID NO: 1618400 - RNA, 17 nt, Human
uaggguuauaauaaugu

SEQ ID NO: 1618401 - RNA, 19 nt, Human
uaggguaagugagagaggg

SEQ ID NO: 1618402 - RNA, 13 nt, Human
uaggguccugggg

SEQ ID NO: 1618403 - RNA, 18 nt, Human
acaaugcaaaccaucauu

SEQ ID NO: 1618404 - RNA, 17 nt, Human
acaaugcaaaccaucau

SEQ ID NO: 1618405 - RNA, 16 nt, Human
acaaugcaaaccauca

SEQ ID NO: 1618406 - RNA, 11 nt, Human
acaaugcaaac

SEQ ID NO: 1618407 - RNA, 20 nt, Human
acaaugacuuacuguacaug

SEQ ID NO: 1618408 - RNA, 22 nt, Human
acaaugacuuacuguacaugaa

SEQ ID NO: 1618409 - RNA, 22 nt, Human
acacaggcccggcuccaggcuc

SEQ ID NO: 1618410 - RNA, 21 nt, Human
acacaggcccggcuccaggcu

SEQ ID NO: 1618411 - RNA, 20 nt, Human
acacaggcccggcuccaggc

SEQ ID NO: 1618412 - RNA, 19 nt, Human
acacaggcccggcuccagg

SEQ ID NO: 1618413 - RNA, 24 nt, Human
acacaggcccggcuccaggcuccu

SEQ ID NO: 1618414 - RNA, 23 nt, Human
acacaggcccggcuccaggcucc

SEQ ID NO: 1618415 - RNA, 18 nt, Human
acacaggcccggcuccag

SEQ ID NO: 1618416 - RNA, 17 nt, Human
acacaggcccggcucca

SEQ ID NO: 1618417 - RNA, 16 nt, Human
acacaggcccggcucc

SEQ ID NO: 1618418 - RNA, 23 nt, Human
acacacagauuugagcucagccc

SEQ ID NO: 1618419 - RNA, 16 nt, Human
acacaguauuacuucu

SEQ ID NO: 1618420 - RNA, 16 nt, Human
uaguaaaaauaaaauu

SEQ ID NO: 1618421 - RNA, 13 nt, Human
uaguaaaaauaaa

SEQ ID NO: 1618422 - RNA, 22 nt, Human
uaguagagacaggguuuugcca

SEQ ID NO: 1618423 - RNA, 15 nt, Human
uaguagagacagggu

SEQ ID NO: 1618424 - RNA, 14 nt, Human
uagucacugagaca

SEQ ID NO: 1618425 - RNA, 13 nt, Human
uaguagagacggg

SEQ ID NO: 1618426 - RNA, 12 nt, Human
uaguaaucauau

SEQ ID NO: 1618427 - RNA, 24 nt, Human
uagcacagacccugcccugugggc

SEQ ID NO: 1618428 - RNA, 22 nt, Human
uagcacagacccugcccugugg

SEQ ID NO: 1618429 - RNA, 12 nt, Human
uagccaaggcca

SEQ ID NO: 1618430 - RNA, 13 nt, Human
uagccaaggccaa

SEQ ID NO: 1618431 - RNA, 14 nt, Human
uagccaaggccaaa

SEQ ID NO: 1618432 - RNA, 14 nt, Human
uagaggguguguaa

SEQ ID NO: 1618433 - RNA, 14 nt, Human
uagcacagacccug

SEQ ID NO: 1618434 - RNA, 21 nt, Human
uagcacagacccugcccugug

SEQ ID NO: 1618435 - RNA, 20 nt, Human
uagcacagacccugcccugu

SEQ ID NO: 1618436 - RNA, 15 nt, Human
uagcacagacccugc

SEQ ID NO: 1618437 - RNA, 15 nt, Human
acaaaaacacagcaa

SEQ ID NO: 1618438 - RNA, 14 nt, Human
acaaaaacacagca

SEQ ID NO: 1618439 - RNA, 16 nt, Human
acaaaaacacagcaag

SEQ ID NO: 1618440 - RNA, 16 nt, Human
acaaaaagcuacuuau

SEQ ID NO: 1618441 - RNA, 13 nt, Human
acaaaaacacagc

SEQ ID NO: 1618442 - RNA, 20 nt, Human
aauuuuacauggcuggagcu

SEQ ID NO: 1618443 - RNA, 12 nt, Human
aauuuuacauuu

SEQ ID NO: 1618444 - RNA, 14 nt, Human
uagagccagggucu

SEQ ID NO: 1618445 - RNA, 22 nt, Human
uagagcggagaaaggaagggcu

SEQ ID NO: 1618446 - RNA, 18 nt, Human
acaaaguauuaagcauau

SEQ ID NO: 1618447 - RNA, 13 nt, Human
acaaaguauuaag

SEQ ID NO: 1618448 - RNA, 16 nt, Human
acaaaguauuaagcau

SEQ ID NO: 1618449 - RNA, 15 nt, Human
acaaaguauuaagca

SEQ ID NO: 1618450 - RNA, 18 nt, Human
aauuugggggaaaauuua

SEQ ID NO: 1618451 - RNA, 14 nt, Human
aauuugugauacaa

SEQ ID NO: 1618452 - RNA, 20 nt, Human
aauuugugauacaaugcugu

SEQ ID NO: 1618453 - RNA, 17 nt, Human
aauuugugauacaaugc

SEQ ID NO: 1618454 - RNA, 18 nt, Human
aauuugugauacaaugcu

SEQ ID NO: 1618455 - RNA, 21 nt, Human
uagacagucccugccaaugga

SEQ ID NO: 1618456 - RNA, 17 nt, Human
uagacagucccugccaa

SEQ ID NO: 1618457 - RNA, 21 nt, Human
uagacagagucucacuguugc

SEQ ID NO: 1618458 - RNA, 13 nt, Human
uagacacacauga

SEQ ID NO: 1618459 - RNA, 18 nt, Human
uagacaauuuauuauggc

SEQ ID NO: 1618460 - RNA, 10 nt, Human
uagacagagu

SEQ ID NO: 1618461 - RNA, 16 nt, Human
uagacagucccugcca

SEQ ID NO: 1618462 - RNA, 20 nt, Human
uagaauuugauaugugaaca

SEQ ID NO: 1618463 - RNA, 22 nt, Human
uagaauuugauaugugaacagu

SEQ ID NO: 1618464 - RNA, 14 nt, Human
aauuccacagcugc

SEQ ID NO: 1618465 - RNA, 13 nt, Human
aauuccacagcug

SEQ ID NO: 1618466 - RNA, 12 nt, Human
aauuccacagcu

SEQ ID NO: 1618467 - RNA, 16 nt, Human
uagaacucccuuucaa

SEQ ID NO: 1618468 - RNA, 18 nt, Human
uagaacucccuuucaaca

SEQ ID NO: 1618469 - RNA, 17 nt, Human
uagaacucccuuucaac

SEQ ID NO: 1618470 - RNA, 15 nt, Human
uagaaacacaacuau

SEQ ID NO: 1618471 - RNA, 19 nt, Human
uccaaaugcagcuuuaaaa

SEQ ID NO: 1618472 - RNA, 18 nt, Human
uccaaggguacuaaggaa

SEQ ID NO: 1618473 - RNA, 13 nt, Human
accuggccucugc

SEQ ID NO: 1618474 - RNA, 12 nt, Human
accuggccucug

SEQ ID NO: 1618475 - RNA, 20 nt, Human
uccacccaggagccccgagg

SEQ ID NO: 1618476 - RNA, 17 nt, Human
uccacccaccucagccu

SEQ ID NO: 1618477 - RNA, 13 nt, Human
uccacccaccuca

SEQ ID NO: 1618478 - RNA, 12 nt, Human
uccacccaccuc

SEQ ID NO: 1618479 - RNA, 14 nt, Human
accuuuuuuauaca

SEQ ID NO: 1618480 - RNA, 16 nt, Human
accuuuguccccaccg

SEQ ID NO: 1618481 - RNA, 15 nt, Human
accuuuguccccacc

SEQ ID NO: 1618482 - RNA, 14 nt, Human
accuuuguccccac

SEQ ID NO: 1618483 - RNA, 18 nt, Human
accuuuuuuauacauaaa

SEQ ID NO: 1618484 - RNA, 16 nt, Human
accuuuuuuauacaua

SEQ ID NO: 1618485 - RNA, 17 nt, Human
accuuuuuuauacauaa

SEQ ID NO: 1618486 - RNA, 13 nt, Human
accuuugucccca

SEQ ID NO: 1618487 - RNA, 22 nt, Human
accuucuccuucaccuuugucc

SEQ ID NO: 1618488 - RNA, 21 nt, Human
accuggguaacuagggaagau

SEQ ID NO: 1618489 - RNA, 17 nt, Human
accuucccaugcccugg

SEQ ID NO: 1618490 - RNA, 17 nt, Human
accuucgccaccugggu

SEQ ID NO: 1618491 - RNA, 15 nt, Human
accuucgccaccugg

SEQ ID NO: 1618492 - RNA, 18 nt, Human
ucauuuuuuuuaagaaaa

SEQ ID NO: 1618493 - RNA, 14 nt, Human
ucauuuuugaauac

SEQ ID NO: 1618494 - RNA, 19 nt, Human
ucauuuuuaguagagacag

SEQ ID NO: 1618495 - RNA, 14 nt, Human
ucauuugucacaca

SEQ ID NO: 1618496 - RNA, 16 nt, Human
ucauuugucacacacu

SEQ ID NO: 1618497 - RNA, 20 nt, Human
accuggaauauauaaccagu

SEQ ID NO: 1618498 - RNA, 12 nt, Human
accugcucuccu

SEQ ID NO: 1618499 - RNA, 23 nt, Human
accugccuguugggccaggagcc

SEQ ID NO: 1618500 - RNA, 21 nt, Human
accugcgucucauacucaccu

SEQ ID NO: 1618501 - RNA, 16 nt, Human
accugcggugcuaucu

SEQ ID NO: 1618502 - RNA, 18 nt, Human
accugcggugcuaucucc

SEQ ID NO: 1618503 - RNA, 17 nt, Human
accugagccccaaaagg

SEQ ID NO: 1618504 - RNA, 12 nt, Human
accugagcccca

SEQ ID NO: 1618505 - RNA, 23 nt, Human
accugaggcccuucucuccagcc

SEQ ID NO: 1618506 - RNA, 22 nt, Human
accugaagcuaucguaaaauua

SEQ ID NO: 1618507 - RNA, 17 nt, Human
accugaccccugacccc

SEQ ID NO: 1618508 - RNA, 16 nt, Human
ucauaauaaguugcau

SEQ ID NO: 1618509 - RNA, 12 nt, Human
ucauaaugacuu

SEQ ID NO: 1618510 - RNA, 13 nt, Human
ucauaaugacuua

SEQ ID NO: 1618511 - RNA, 18 nt, Human
accugaagacucauucuu

SEQ ID NO: 1618512 - RNA, 19 nt, Human
accugaauuuuggcugugu

SEQ ID NO: 1618513 - RNA, 14 nt, Human
accugaggggccuc

SEQ ID NO: 1618514 - RNA, 16 nt, Human
accugaggggccucuu

SEQ ID NO: 1618515 - RNA, 14 nt, Human
accugauugugucu

SEQ ID NO: 1618516 - RNA, 17 nt, Human
accugccaggaagccag

SEQ ID NO: 1618517 - RNA, 16 nt, Human
accugccaggaagcca

SEQ ID NO: 1618518 - RNA, 19 nt, Human
accugccaggaagccagca

SEQ ID NO: 1618519 - RNA, 18 nt, Human
accugccaggaagccagc

SEQ ID NO: 1618520 - RNA, 17 nt, Human
accugccucggccuccc

SEQ ID NO: 1618521 - RNA, 14 nt, Human
acgaauauugcuga

SEQ ID NO: 1618522 - RNA, 17 nt, Human
uccaggcugggagagcc

SEQ ID NO: 1618523 - RNA, 14 nt, Human
uccaggcugggaga

SEQ ID NO: 1618524 - RNA, 18 nt, Human
uccaggcugggagagccu

SEQ ID NO: 1618525 - RNA, 18 nt, Human
acgccaggggaaaaucag

SEQ ID NO: 1618526 - RNA, 15 nt, Human
acgacugcccggcag

SEQ ID NO: 1618527 - RNA, 18 nt, Human
acgccaucccagccccaa

SEQ ID NO: 1618528 - RNA, 17 nt, Human
acgccaucccagcccca

SEQ ID NO: 1618529 - RNA, 16 nt, Human
acgccaucccagcccc

SEQ ID NO: 1618530 - RNA, 15 nt, Human
acgccaucccagccc

SEQ ID NO: 1618531 - RNA, 14 nt, Human
acgccaucccagcc

SEQ ID NO: 1618532 - RNA, 11 nt, Human
acgccauccca

SEQ ID NO: 1618533 - RNA, 23 nt, Human
acgccaggggaaaaucagccugc

SEQ ID NO: 1618534 - RNA, 16 nt, Human
acgcucucuggccuuc

SEQ ID NO: 1618535 - RNA, 15 nt, Human
acgcucucuggccuu

SEQ ID NO: 1618536 - RNA, 18 nt, Human
acgcuacccgggaagggg

SEQ ID NO: 1618537 - RNA, 17 nt, Human
acgcuacccgggaaggg

SEQ ID NO: 1618538 - RNA, 13 nt, Human
acgcuacccggga

SEQ ID NO: 1618539 - RNA, 20 nt, Human
acgcguugaaauuguaauua

SEQ ID NO: 1618540 - RNA, 18 nt, Human
acgcguugaaauuguaau

SEQ ID NO: 1618541 - RNA, 14 nt, Human
acgcguugaaauug

SEQ ID NO: 1618542 - RNA, 13 nt, Human
acgcguugaaauu

SEQ ID NO: 1618543 - RNA, 23 nt, Human
acgcgugcacacaccagagccca

SEQ ID NO: 1618544 - RNA, 14 nt, Human
acgcccccacuggu

SEQ ID NO: 1618545 - RNA, 17 nt, Human
acgcucucuggccuucg

SEQ ID NO: 1618546 - RNA, 19 nt, Human
acggagucccaccuuggcu

SEQ ID NO: 1618547 - RNA, 21 nt, Human
acggagucccaccuuggcugc

SEQ ID NO: 1618548 - RNA, 15 nt, Human
acggaugauuucuau

SEQ ID NO: 1618549 - RNA, 16 nt, Human
acggccaggccagagg

SEQ ID NO: 1618550 - RNA, 22 nt, Human
uccaugaagauguagaggagaa

SEQ ID NO: 1618551 - RNA, 11 nt, Human
uccauccugag

SEQ ID NO: 1618552 - RNA, 20 nt, Human
uccaucucuuguuuaaauuc

SEQ ID NO: 1618553 - RNA, 17 nt, Human
uccaugaguccccuguu

SEQ ID NO: 1618554 - RNA, 16 nt, Human
uccaugaguccccugu

SEQ ID NO: 1618555 - RNA, 15 nt, Human
uccaugaguccccug

SEQ ID NO: 1618556 - RNA, 12 nt, Human
uccauuuaauaa

SEQ ID NO: 1618557 - RNA, 14 nt, Human
uccagugagacagc

SEQ ID NO: 1618558 - RNA, 19 nt, Human
uccagugaggcucugcccu

SEQ ID NO: 1618559 - RNA, 18 nt, Human
uccagugaggcucugccc

SEQ ID NO: 1618560 - RNA, 20 nt, Human
uccagugaggcucugcccuu

SEQ ID NO: 1618561 - RNA, 14 nt, Human
acggcucacugcag

SEQ ID NO: 1618562 - RNA, 15 nt, Human
acggcucacugcagc

SEQ ID NO: 1618563 - RNA, 14 nt, Human
ucccaccccacaca

SEQ ID NO: 1618564 - RNA, 11 nt, Human
ucccaccccac

SEQ ID NO: 1618565 - RNA, 19 nt, Human
ucccaccaacccucagagc

SEQ ID NO: 1618566 - RNA, 15 nt, Human
ucccaaagugcuggg

SEQ ID NO: 1618567 - RNA, 16 nt, Human
ucccaaagugcuggga

SEQ ID NO: 1618568 - RNA, 20 nt, Human
ucccaaagugcugggauuac

SEQ ID NO: 1618569 - RNA, 20 nt, Human
uccauuuggaaaucuuuaaa

SEQ ID NO: 1618570 - RNA, 19 nt, Human
uccauuuggaaaucuuuaa

SEQ ID NO: 1618571 - RNA, 12 nt, Human
uccauuuggaaa

SEQ ID NO: 1618572 - RNA, 17 nt, Human
uccauuuaauaauuaua

SEQ ID NO: 1618573 - RNA, 21 nt, Human
ucccaaagugcugggauuaca

SEQ ID NO: 1618574 - RNA, 14 nt, Human
ucccacaaaggaga

SEQ ID NO: 1618575 - RNA, 22 nt, Human
ucccacaggcccuuccucucca

SEQ ID NO: 1618576 - RNA, 21 nt, Human
ucccacaggcccuuccucucc

SEQ ID NO: 1618577 - RNA, 17 nt, Human
ucccacaggcccuuccu

SEQ ID NO: 1618578 - RNA, 15 nt, Human
ucccacaggcccuuc

SEQ ID NO: 1618579 - RNA, 15 nt, Human
uccugaagaauugaa

SEQ ID NO: 1618580 - RNA, 22 nt, Human
uccugaaaacccuugccaugug

SEQ ID NO: 1618581 - RNA, 21 nt, Human
uccugaaaacccuugccaugu

SEQ ID NO: 1618582 - RNA, 12 nt, Human
uccucugcugcu

SEQ ID NO: 1618583 - RNA, 19 nt, Human
uccucuugccacugccucu

SEQ ID NO: 1618584 - RNA, 14 nt, Human
uccucugaggcuga

SEQ ID NO: 1618585 - RNA, 17 nt, Human
uccucuccccaugaugu

SEQ ID NO: 1618586 - RNA, 18 nt, Human
uccucuccacugccuucg

SEQ ID NO: 1618587 - RNA, 17 nt, Human
uccucuccacugccuuc

SEQ ID NO: 1618588 - RNA, 15 nt, Human
uccucucugcccuaa

SEQ ID NO: 1618589 - RNA, 14 nt, Human
uccucucugcccua

SEQ ID NO: 1618590 - RNA, 13 nt, Human
uccucucugcccu

SEQ ID NO: 1618591 - RNA, 12 nt, Human
uccucucugccc

SEQ ID NO: 1618592 - RNA, 12 nt, Human
uccucugagccu

SEQ ID NO: 1618593 - RNA, 17 nt, Human
uccucugagccuuggga

SEQ ID NO: 1618594 - RNA, 13 nt, Human
uccucugagccuu

SEQ ID NO: 1618595 - RNA, 21 nt, Human
uccucccaccucagccucccg

SEQ ID NO: 1618596 - RNA, 20 nt, Human
uccucccaccucagccuccc

SEQ ID NO: 1618597 - RNA, 18 nt, Human
uccucccaccucagccuc

SEQ ID NO: 1618598 - RNA, 16 nt, Human
uccucccaccucagcc

SEQ ID NO: 1618599 - RNA, 15 nt, Human
uccucccaccucagc

SEQ ID NO: 1618600 - RNA, 14 nt, Human
uccucccaccucag

SEQ ID NO: 1618601 - RNA, 21 nt, Human
acucuugaaaaaugcauguug

SEQ ID NO: 1618602 - RNA, 19 nt, Human
acucuugaaaaaugcaugu

SEQ ID NO: 1618603 - RNA, 14 nt, Human
acucuugaaaaaug

SEQ ID NO: 1618604 - RNA, 18 nt, Human
acuccagaaagugacaag

SEQ ID NO: 1618605 - RNA, 14 nt, Human
acuccagaaaguga

SEQ ID NO: 1618606 - RNA, 18 nt, Human
uccgugcuaaggacuugu

SEQ ID NO: 1618607 - RNA, 17 nt, Human
uccgugcuaaggacuug

SEQ ID NO: 1618608 - RNA, 15 nt, Human
uccguuaaaauacca

SEQ ID NO: 1618609 - RNA, 13 nt, Human
uccguuaaaauac

SEQ ID NO: 1618610 - RNA, 23 nt, Human
uccgugcuaaggacuuguuagau

SEQ ID NO: 1618611 - RNA, 21 nt, Human
uccuagccugugccucuggga

SEQ ID NO: 1618612 - RNA, 12 nt, Human
uccuacucugug

SEQ ID NO: 1618613 - RNA, 16 nt, Human
acucgaguuacagaca

SEQ ID NO: 1618614 - RNA, 17 nt, Human
acucuggcagcucagag

SEQ ID NO: 1618615 - RNA, 16 nt, Human
acucuggcagcucaga

SEQ ID NO: 1618616 - RNA, 20 nt, Human
acucuggcagcucagagagg

SEQ ID NO: 1618617 - RNA, 19 nt, Human
acucuggcagcucagagag

SEQ ID NO: 1618618 - RNA, 21 nt, Human
acucuuauugcccacgcugga

SEQ ID NO: 1618619 - RNA, 13 nt, Human
acucuugaaaaau

SEQ ID NO: 1618620 - RNA, 21 nt, Human
acucuucaguuaagccuuugg

SEQ ID NO: 1618621 - RNA, 20 nt, Human
acucuucaguuaagccuuug

SEQ ID NO: 1618622 - RNA, 16 nt, Human
acucgcgacaaugcaa

SEQ ID NO: 1618623 - RNA, 15 nt, Human
acucgcgacaaugca

SEQ ID NO: 1618624 - RNA, 17 nt, Human
acucgcgacaaugcaaa

SEQ ID NO: 1618625 - RNA, 14 nt, Human
acucguauaugucu

SEQ ID NO: 1618626 - RNA, 23 nt, Human
acucugacaacagacuucugaaa

SEQ ID NO: 1618627 - RNA, 22 nt, Human
acucugacaacagacuucugaa

SEQ ID NO: 1618628 - RNA, 20 nt, Human
acucugacaacagacuucug

SEQ ID NO: 1618629 - RNA, 18 nt, Human
acucugacaacagacuuc

SEQ ID NO: 1618630 - RNA, 17 nt, Human
acucugacaacagacuu

SEQ ID NO: 1618631 - RNA, 14 nt, Human
acucagaauucucu

SEQ ID NO: 1618632 - RNA, 21 nt, Human
acucagaauucucuaguuuga

SEQ ID NO: 1618633 - RNA, 22 nt, Human
acucagaauucucuaguuugau

SEQ ID NO: 1618634 - RNA, 18 nt, Human
acucagaagacacugaug

SEQ ID NO: 1618635 - RNA, 17 nt, Human
acucagaagacacugau

SEQ ID NO: 1618636 - RNA, 16 nt, Human
acucagaagacacuga

SEQ ID NO: 1618637 - RNA, 15 nt, Human
acucagaagacacug

SEQ ID NO: 1618638 - RNA, 14 nt, Human
acucagaagacacu

SEQ ID NO: 1618639 - RNA, 19 nt, Human
acucaccugccccucaacu

SEQ ID NO: 1618640 - RNA, 14 nt, Human
acucaccugccccu

SEQ ID NO: 1618641 - RNA, 21 nt, Human
acucaccugccccucaacucu

SEQ ID NO: 1618642 - RNA, 21 nt, Human
acuccaaacugacucuuaaga

SEQ ID NO: 1618643 - RNA, 22 nt, Human
acucauugaccugaggcccuuc

SEQ ID NO: 1618644 - RNA, 18 nt, Human
acucauugaccugaggcc

SEQ ID NO: 1618645 - RNA, 17 nt, Human
acucauugaccugaggc

SEQ ID NO: 1618646 - RNA, 16 nt, Human
acucauugaccugagg

SEQ ID NO: 1618647 - RNA, 12 nt, Human
acucaucuuagg

SEQ ID NO: 1618648 - RNA, 23 nt, Human
acucaucuagguaaauuacaguu

SEQ ID NO: 1618649 - RNA, 14 nt, Human
ucccuccaccuccc

SEQ ID NO: 1618650 - RNA, 15 nt, Human
ucccuccaccucccu

SEQ ID NO: 1618651 - RNA, 17 nt, Human
ucccuccaccucccugc

SEQ ID NO: 1618652 - RNA, 20 nt, Human
ucccucagucuggcccuucc

SEQ ID NO: 1618653 - RNA, 18 nt, Human
ucccucagucuggcccuu

SEQ ID NO: 1618654 - RNA, 19 nt, Human
ucccuccaccucccugcaa

SEQ ID NO: 1618655 - RNA, 13 nt, Human
ucccucuuucccu

SEQ ID NO: 1618656 - RNA, 11 nt, Human
ucccucuuucc

SEQ ID NO: 1618657 - RNA, 22 nt, Human
ucccugaaggccccgcccaggc

SEQ ID NO: 1618658 - RNA, 21 nt, Human
ucccugaaggccccgcccagg

SEQ ID NO: 1618659 - RNA, 18 nt, Human
ucccugaaggccccgccc

SEQ ID NO: 1618660 - RNA, 14 nt, Human
ucccucuuucccuc

SEQ ID NO: 1618661 - RNA, 23 nt, Human
ucccugaaggccccgcccaggcu

SEQ ID NO: 1618662 - RNA, 17 nt, Human
acucaccccagccccaa

SEQ ID NO: 1618663 - RNA, 20 nt, Human
acucaccucccccaucucuu

SEQ ID NO: 1618664 - RNA, 19 nt, Human
acucaccucccccaucucu

SEQ ID NO: 1618665 - RNA, 15 nt, Human
uccccuccucugcuu

SEQ ID NO: 1618666 - RNA, 18 nt, Human
uccccuccucugcuugcc

SEQ ID NO: 1618667 - RNA, 14 nt, Human
uccccuccucugcu

SEQ ID NO: 1618668 - RNA, 24 nt, Human
uccccuccucugcuugccaucccu

SEQ ID NO: 1618669 - RNA, 14 nt, Human
acucaaugcacuga

SEQ ID NO: 1618670 - RNA, 20 nt, Human
acucacauuuauucugcuca

SEQ ID NO: 1618671 - RNA, 19 nt, Human
acucacauuuauucugcuc

SEQ ID NO: 1618672 - RNA, 21 nt, Human
acucacauuuauucugcucac

SEQ ID NO: 1618673 - RNA, 21 nt, Human
acuauaauguaagcucuacug

SEQ ID NO: 1618674 - RNA, 15 nt, Human
acuaugauuuggaaa

SEQ ID NO: 1618675 - RNA, 16 nt, Human
acuaugauuuggaaaa

SEQ ID NO: 1618676 - RNA, 14 nt, Human
acuauaauguaagc

SEQ ID NO: 1618677 - RNA, 13 nt, Human
acuauaauguaag

SEQ ID NO: 1618678 - RNA, 12 nt, Human
acuauaauguaa

SEQ ID NO: 1618679 - RNA, 18 nt, Human
acuauucaaacagucuca

SEQ ID NO: 1618680 - RNA, 16 nt, Human
acuauucaaacagucu

SEQ ID NO: 1618681 - RNA, 14 nt, Human
acuauucaaacagu

SEQ ID NO: 1618682 - RNA, 13 nt, Human
acuauucaaacag

SEQ ID NO: 1618683 - RNA, 12 nt, Human
acuauguaucaa

SEQ ID NO: 1618684 - RNA, 13 nt, Human
acuauguugauaa

SEQ ID NO: 1618685 - RNA, 20 nt, Human
acuagaguuuagcuggaaaa

SEQ ID NO: 1618686 - RNA, 18 nt, Human
acuacggaauaguuggcu

SEQ ID NO: 1618687 - RNA, 14 nt, Human
acuacuagggaaau

SEQ ID NO: 1618688 - RNA, 13 nt, Human
acguacacacaca

SEQ ID NO: 1618689 - RNA, 12 nt, Human
acguacacauuu

SEQ ID NO: 1618690 - RNA, 13 nt, Human
acguacacauuuu

SEQ ID NO: 1618691 - RNA, 14 nt, Human
acguacacauuuua

SEQ ID NO: 1618692 - RNA, 22 nt, Human
uccccacuugagaauuacccuu

SEQ ID NO: 1618693 - RNA, 16 nt, Human
acaucuugcucugcug

SEQ ID NO: 1618694 - RNA, 15 nt, Human
acaucuugcucugcu

SEQ ID NO: 1618695 - RNA, 19 nt, Human
uaugugccagauuuaugca

SEQ ID NO: 1618696 - RNA, 14 nt, Human
uaugugccagauuu

SEQ ID NO: 1618697 - RNA, 17 nt, Human
acaucuugcucugcuga

SEQ ID NO: 1618698 - RNA, 19 nt, Human
acaucuuggucagauuuga

SEQ ID NO: 1618699 - RNA, 18 nt, Human
uauuuuaaaagaaugauu

SEQ ID NO: 1618700 - RNA, 14 nt, Human
uauuuuaaaagaau

SEQ ID NO: 1618701 - RNA, 22 nt, Human
uauuuuaagacgaaacauuugu

SEQ ID NO: 1618702 - RNA, 14 nt, Human
uauuuuaagacgaa

SEQ ID NO: 1618703 - RNA, 15 nt, Human
acaugaaaacacauu

SEQ ID NO: 1618704 - RNA, 16 nt, Human
acaugaaaacacauuu

SEQ ID NO: 1618705 - RNA, 20 nt, Human
uauuuuguguuuaggaacua

SEQ ID NO: 1618706 - RNA, 17 nt, Human
uauuuuguguuuaggaa

SEQ ID NO: 1618707 - RNA, 17 nt, Human
uauuuuuguagagccag

SEQ ID NO: 1618708 - RNA, 22 nt, Human
uauuuuaauaauguuucaaaca

SEQ ID NO: 1618709 - RNA, 13 nt, Human
uauuuuacauaaa

SEQ ID NO: 1618710 - RNA, 19 nt, Human
uauuuuaauaauguuucaa

SEQ ID NO: 1618711 - RNA, 17 nt, Human
uauuuuaauaaacacuc

SEQ ID NO: 1618712 - RNA, 14 nt, Human
uauuuuaauaaaca

SEQ ID NO: 1618713 - RNA, 20 nt, Human
uauuuugcuuugugauuuuu

SEQ ID NO: 1618714 - RNA, 13 nt, Human
uauuuugcuuugu

SEQ ID NO: 1618715 - RNA, 15 nt, Human
uauuuugcuuuguga

SEQ ID NO: 1618716 - RNA, 16 nt, Human
ucaaaagcugggcagg

SEQ ID NO: 1618717 - RNA, 21 nt, Human
ucaaacagucucaggaaauca

SEQ ID NO: 1618718 - RNA, 20 nt, Human
ucaaacagucucaggaaauc

SEQ ID NO: 1618719 - RNA, 13 nt, Human
ucaaacagucuca

SEQ ID NO: 1618720 - RNA, 13 nt, Human
ucaaagauauuuu

SEQ ID NO: 1618721 - RNA, 20 nt, Human
ucaaagauauuuugcuuugu

SEQ ID NO: 1618722 - RNA, 22 nt, Human
ucaaagauauuuugcuuuguga

SEQ ID NO: 1618723 - RNA, 23 nt, Human
ucaaagcaaaugucuuccuggau

SEQ ID NO: 1618724 - RNA, 15 nt, Human
ucaaagcaaaugucu

SEQ ID NO: 1618725 - RNA, 13 nt, Human
acaugagcaucag

SEQ ID NO: 1618726 - RNA, 23 nt, Human
acaugaaaacacauuuuucuuag

SEQ ID NO: 1618727 - RNA, 23 nt, Human
ucaaauacgugggcauucaaaug

SEQ ID NO: 1618728 - RNA, 13 nt, Human
ucaaauauauuca

SEQ ID NO: 1618729 - RNA, 22 nt, Human
ucaaauacgugggcauucaaau

SEQ ID NO: 1618730 - RNA, 21 nt, Human
ucaaauacgugggcauucaaa

SEQ ID NO: 1618731 - RNA, 18 nt, Human
ucaaaguugccuaaaucc

SEQ ID NO: 1618732 - RNA, 15 nt, Human
ucaaaguugccuaaa

SEQ ID NO: 1618733 - RNA, 16 nt, Human
acaugagguacugaga

SEQ ID NO: 1618734 - RNA, 18 nt, Human
acauggaauaacauguaa

SEQ ID NO: 1618735 - RNA, 20 nt, Human
acauggaauaacauguaauu

SEQ ID NO: 1618736 - RNA, 23 nt, Human
acaugagcaucaggccaggcccu

SEQ ID NO: 1618737 - RNA, 19 nt, Human
acauggaguauaugucaag

SEQ ID NO: 1618738 - RNA, 15 nt, Human
acauggaguauaugu

SEQ ID NO: 1618739 - RNA, 14 nt, Human
acauggccuuugcu

SEQ ID NO: 1618740 - RNA, 22 nt, Human
acauggcuggagcuagaauuug

SEQ ID NO: 1618741 - RNA, 21 nt, Human
acaugucuuuucuugcaugag

SEQ ID NO: 1618742 - RNA, 23 nt, Human
acauugguguuguacucaauuuu

SEQ ID NO: 1618743 - RNA, 22 nt, Human
acauugguguuguacucaauuu

SEQ ID NO: 1618744 - RNA, 16 nt, Human
acauugguguuguacu

SEQ ID NO: 1618745 - RNA, 14 nt, Human
acauugguguugua

SEQ ID NO: 1618746 - RNA, 22 nt, Human
acauugcggacagccacggcca

SEQ ID NO: 1618747 - RNA, 21 nt, Human
acauugcggacagccacggcc

SEQ ID NO: 1618748 - RNA, 16 nt, Human
acauuggaaacaaguc

SEQ ID NO: 1618749 - RNA, 13 nt, Human
acauuuuucuuag

SEQ ID NO: 1618750 - RNA, 23 nt, Human
acauuuuucuuagggaaggauac

SEQ ID NO: 1618751 - RNA, 15 nt, Human
acauuuuuaagugcu

SEQ ID NO: 1618752 - RNA, 18 nt, Human
acauuuuuaagugcugca

SEQ ID NO: 1618753 - RNA, 19 nt, Human
acauuuuuaagugcugcau

SEQ ID NO: 1618754 - RNA, 23 nt, Human
ucaauauuucagauaaucacaau

SEQ ID NO: 1618755 - RNA, 22 nt, Human
ucaauaggaaaaacugauuuuu

SEQ ID NO: 1618756 - RNA, 19 nt, Human
ucaauaggaaaaacugauu

SEQ ID NO: 1618757 - RNA, 18 nt, Human
ucaauaggaaaaacugau

SEQ ID NO: 1618758 - RNA, 18 nt, Human
ucaagugauucuccugcc

SEQ ID NO: 1618759 - RNA, 17 nt, Human
ucaagugauucuccugc

SEQ ID NO: 1618760 - RNA, 16 nt, Human
ucaagugauucuccug

SEQ ID NO: 1618761 - RNA, 22 nt, Human
ucaagugauucucaugccucag

SEQ ID NO: 1618762 - RNA, 21 nt, Human
ucaagugauucucaugccuca

SEQ ID NO: 1618763 - RNA, 17 nt, Human
ucaagagggucugagga

SEQ ID NO: 1618764 - RNA, 21 nt, Human
ucaagagggcacugguggccc

SEQ ID NO: 1618765 - RNA, 20 nt, Human
ucaagagggcacugguggcc

SEQ ID NO: 1618766 - RNA, 23 nt, Human
accaaaaaucucaauauuucaga

SEQ ID NO: 1618767 - RNA, 13 nt, Human
accaaaaaccagu

SEQ ID NO: 1618768 - RNA, 12 nt, Human
accaaaaaccag

SEQ ID NO: 1618769 - RNA, 19 nt, Human
accaaaucagcugcuacua

SEQ ID NO: 1618770 - RNA, 16 nt, Human
accaaaucagcugcua

SEQ ID NO: 1618771 - RNA, 19 nt, Human
accaacacgagcaggcuac

SEQ ID NO: 1618772 - RNA, 14 nt, Human
accaacacgagcag

SEQ ID NO: 1618773 - RNA, 16 nt, Human
accaacauacucccau

SEQ ID NO: 1618774 - RNA, 17 nt, Human
accaacauacucccauc

SEQ ID NO: 1618775 - RNA, 20 nt, Human
accaaccacugcgaccacaa

SEQ ID NO: 1618776 - RNA, 16 nt, Human
accacaagacugcaca

SEQ ID NO: 1618777 - RNA, 15 nt, Human
accaacccucagagc

SEQ ID NO: 1618778 - RNA, 23 nt, Human
accacacccagcccacuucugcc

SEQ ID NO: 1618779 - RNA, 21 nt, Human
accacacccagcccacuucug

SEQ ID NO: 1618780 - RNA, 20 nt, Human
accacacccagcccacuucu

SEQ ID NO: 1618781 - RNA, 16 nt, Human
accacacccagcccac

SEQ ID NO: 1618782 - RNA, 15 nt, Human
accacacccagccca

SEQ ID NO: 1618783 - RNA, 17 nt, Human
accacacagaggcugcc

SEQ ID NO: 1618784 - RNA, 14 nt, Human
ucacaggaaguaga

SEQ ID NO: 1618785 - RNA, 16 nt, Human
ucacauauugauuucc

SEQ ID NO: 1618786 - RNA, 18 nt, Human
ucacauauugauuuccgu

SEQ ID NO: 1618787 - RNA, 20 nt, Human
ucacauauugauuuccguua

SEQ ID NO: 1618788 - RNA, 17 nt, Human
ucaccagccccagugcc

SEQ ID NO: 1618789 - RNA, 20 nt, Human
ucacauuccugaacaggaua

SEQ ID NO: 1618790 - RNA, 17 nt, Human
ucacauuccugaacagg

SEQ ID NO: 1618791 - RNA, 13 nt, Human
ucacauuccugaa

SEQ ID NO: 1618792 - RNA, 23 nt, Human
ucacagccagacuggcacaguuu

SEQ ID NO: 1618793 - RNA, 17 nt, Human
ucacagccagacuggca

SEQ ID NO: 1618794 - RNA, 19 nt, Human
ucacagcuccaagaauuuc

SEQ ID NO: 1618795 - RNA, 14 nt, Human
ucacagaugggugc

SEQ ID NO: 1618796 - RNA, 15 nt, Human
ucacagaugggugcu

SEQ ID NO: 1618797 - RNA, 13 nt, Human
ucaauuuaaaaaa

SEQ ID NO: 1618798 - RNA, 21 nt, Human
ucacagaacccuuggagccaa

SEQ ID NO: 1618799 - RNA, 12 nt, Human
ucaauuuaaaaa

SEQ ID NO: 1618800 - RNA, 16 nt, Human
ucacagaccuuugaac

SEQ ID NO: 1618801 - RNA, 18 nt, Human
ucagagcugcccucuccu

SEQ ID NO: 1618802 - RNA, 17 nt, Human
ucagagcugcccucucc

SEQ ID NO: 1618803 - RNA, 15 nt, Human
ucagagcugcccucu

SEQ ID NO: 1618804 - RNA, 16 nt, Human
ucagagcugcccucuc

SEQ ID NO: 1618805 - RNA, 16 nt, Human
ucagaucucuaacuuc

SEQ ID NO: 1618806 - RNA, 13 nt, Human
ucagaucugccua

SEQ ID NO: 1618807 - RNA, 21 nt, Human
ucagaugcugugcaaauguua

SEQ ID NO: 1618808 - RNA, 21 nt, Human
ucagaucugccuaaggacuuc

SEQ ID NO: 1618809 - RNA, 20 nt, Human
ucagaucugccuaaggacuu

SEQ ID NO: 1618810 - RNA, 18 nt, Human
ucagaucugccuaaggac

SEQ ID NO: 1618811 - RNA, 15 nt, Human
ucagaucugccuaag

SEQ ID NO: 1618812 - RNA, 13 nt, Human
ucagagcugcccu

SEQ ID NO: 1618813 - RNA, 14 nt, Human
ucagagcugcccuc

SEQ ID NO: 1618814 - RNA, 21 nt, Human
ucagagccaccccuaaagaga

SEQ ID NO: 1618815 - RNA, 23 nt, Human
ucagagacuccugcaggcagcca

SEQ ID NO: 1618816 - RNA, 16 nt, Human
ucagagacuccugcag

SEQ ID NO: 1618817 - RNA, 12 nt, Human
ucagaauucuca

SEQ ID NO: 1618818 - RNA, 10 nt, Human
ucagaauucu

SEQ ID NO: 1618819 - RNA, 20 nt, Human
ucagaauucucagaaucuca

SEQ ID NO: 1618820 - RNA, 16 nt, Human
ucagaauucucuaguu

SEQ ID NO: 1618821 - RNA, 15 nt, Human
acccagcccacuucu

SEQ ID NO: 1618822 - RNA, 16 nt, Human
ucagaauagaaauuag

SEQ ID NO: 1618823 - RNA, 22 nt, Human
accccagcuggggccaggcugg

SEQ ID NO: 1618824 - RNA, 19 nt, Human
accccagcuggggccaggc

SEQ ID NO: 1618825 - RNA, 23 nt, Human
acccaggugcuaggaacacuccu

SEQ ID NO: 1618826 - RNA, 11 nt, Human
acccaggugcu

SEQ ID NO: 1618827 - RNA, 13 nt, Human
accccagguuucu

SEQ ID NO: 1618828 - RNA, 17 nt, Human
acccagcgagcccuggu

SEQ ID NO: 1618829 - RNA, 16 nt, Human
acccagcgagcccugg

SEQ ID NO: 1618830 - RNA, 13 nt, Human
acccagcgagccc

SEQ ID NO: 1618831 - RNA, 15 nt, Human
acccaggagccccga

SEQ ID NO: 1618832 - RNA, 13 nt, Human
acccaggagcccc

SEQ ID NO: 1618833 - RNA, 20 nt, Human
acccaaauguucaucaauga

SEQ ID NO: 1618834 - RNA, 16 nt, Human
acccaaauguucauca

SEQ ID NO: 1618835 - RNA, 22 nt, Human
accauuuugggguacccacugc

SEQ ID NO: 1618836 - RNA, 20 nt, Human
acccacugcuuuuggucugu

SEQ ID NO: 1618837 - RNA, 17 nt, Human
acccacuggacucaccu

SEQ ID NO: 1618838 - RNA, 14 nt, Human
acccacuggacuca

SEQ ID NO: 1618839 - RNA, 21 nt, Human
acccacuggacucaccucccc

SEQ ID NO: 1618840 - RNA, 21 nt, Human
accauuuugggguacccacug

SEQ ID NO: 1618841 - RNA, 23 nt, Human
accauuuugcugucccuuuuccu

SEQ ID NO: 1618842 - RNA, 22 nt, Human
accauuuugcugucccuuuucc

SEQ ID NO: 1618843 - RNA, 21 nt, Human
accauucuccaccugccaggg

SEQ ID NO: 1618844 - RNA, 20 nt, Human
accauucuccaccugccagg

SEQ ID NO: 1618845 - RNA, 19 nt, Human
accauucuccaccugccag

SEQ ID NO: 1618846 - RNA, 18 nt, Human
accauguuggccaggcug

SEQ ID NO: 1618847 - RNA, 18 nt, Human
accaugggauaaaugcca

SEQ ID NO: 1618848 - RNA, 17 nt, Human
accaugggauaaaugcc

SEQ ID NO: 1618849 - RNA, 16 nt, Human
ucacuguugcccaggc

SEQ ID NO: 1618850 - RNA, 15 nt, Human
ucacuguugcccagg

SEQ ID NO: 1618851 - RNA, 14 nt, Human
ucacuguugcccag

SEQ ID NO: 1618852 - RNA, 15 nt, Human
ucacugcacagugca

SEQ ID NO: 1618853 - RNA, 18 nt, Human
ucacugcaaccuccgccu

SEQ ID NO: 1618854 - RNA, 21 nt, Human
ucacugcaaccuucgccaccu

SEQ ID NO: 1618855 - RNA, 21 nt, Human
ucacuauguugcccaggcagg

SEQ ID NO: 1618856 - RNA, 22 nt, Human
ucaccagccccagugcccacag

SEQ ID NO: 1618857 - RNA, 19 nt, Human
ucacauuccugaacaggau

SEQ ID NO: 1618858 - RNA, 23 nt, Human
ucacugagacagcccgggcucug

SEQ ID NO: 1618859 - RNA, 15 nt, Human
acccgggaggcagag

SEQ ID NO: 1618860 - RNA, 21 nt, Human
acccuccuuucaccacaugug

SEQ ID NO: 1618861 - RNA, 20 nt, Human
acccgggaagggggcuggga

SEQ ID NO: 1618862 - RNA, 19 nt, Human
acccgggaagggggcuggg

SEQ ID NO: 1618863 - RNA, 15 nt, Human
acccggaggggccug

SEQ ID NO: 1618864 - RNA, 22 nt, Human
acccgggaagggggcugggaca

SEQ ID NO: 1618865 - RNA, 14 nt, Human
acccucauguucuu

SEQ ID NO: 1618866 - RNA, 15 nt, Human
acccucauguucuua

SEQ ID NO: 1618867 - RNA, 17 nt, Human
acccucauguucuuaau

SEQ ID NO: 1618868 - RNA, 21 nt, Human
acccugaggcccagagggccu

SEQ ID NO: 1618869 - RNA, 19 nt, Human
acccugaggcccagagggc

SEQ ID NO: 1618870 - RNA, 13 nt, Human
acccugaggccca

SEQ ID NO: 1618871 - RNA, 11 nt, Human
acccugaggcc

SEQ ID NO: 1618872 - RNA, 23 nt, Human
acccugaggcccagagggccugc

SEQ ID NO: 1618873 - RNA, 18 nt, Human
ucaggcaggugggaugga

SEQ ID NO: 1618874 - RNA, 17 nt, Human
ucaggcaggugggaugg

SEQ ID NO: 1618875 - RNA, 13 nt, Human
acccccagccugc

SEQ ID NO: 1618876 - RNA, 14 nt, Human
acccccagccugcu

SEQ ID NO: 1618877 - RNA, 12 nt, Human
acccccagccug

SEQ ID NO: 1618878 - RNA, 16 nt, Human
ucaggccaggcccucu

SEQ ID NO: 1618879 - RNA, 15 nt, Human
ucaggccaggcccuc

SEQ ID NO: 1618880 - RNA, 14 nt, Human
ucaggccaggcccu

SEQ ID NO: 1618881 - RNA, 13 nt, Human
ucaggccaggccc

SEQ ID NO: 1618882 - RNA, 14 nt, Human
ucaggccagcugcu

SEQ ID NO: 1618883 - RNA, 13 nt, Human
ucaggccagcugc

SEQ ID NO: 1618884 - RNA, 13 nt, Human
ucaggccacuuga

SEQ ID NO: 1618885 - RNA, 23 nt, Human
ucaggggugugcggccuuuggcu

SEQ ID NO: 1618886 - RNA, 19 nt, Human
ucaggggugugcggccuuu

SEQ ID NO: 1618887 - RNA, 12 nt, Human
ucaggggugugc

SEQ ID NO: 1618888 - RNA, 18 nt, Human
ucaggccaggcccucugc

SEQ ID NO: 1618889 - RNA, 17 nt, Human
ucaggccaggcccucug

SEQ ID NO: 1618890 - RNA, 19 nt, Human
ucaggccaggcccucugcc

SEQ ID NO: 1618891 - RNA, 20 nt, Human
ucaggccaggcccucugccc

SEQ ID NO: 1618892 - RNA, 19 nt, Human
ucaggguuggccccugccc

SEQ ID NO: 1618893 - RNA, 18 nt, Human
ucaggguuggccccugcc

SEQ ID NO: 1618894 - RNA, 23 nt, Human
ucaggguuggccccugcccggcu

SEQ ID NO: 1618895 - RNA, 18 nt, Human
ucagguaaucgaccugcc

SEQ ID NO: 1618896 - RNA, 20 nt, Human
ucagguaaucgaccugccuc

SEQ ID NO: 1618897 - RNA, 19 nt, Human
ucagguaaucgaccugccu

SEQ ID NO: 1618898 - RNA, 19 nt, Human
acccgcuaagagggaggga

SEQ ID NO: 1618899 - RNA, 21 nt, Human
ucagguaaucgaccugccucg

SEQ ID NO: 1618900 - RNA, 23 nt, Human
ucagugccuuauggaacacucug

SEQ ID NO: 1618901 - RNA, 22 nt, Human
ucagugccuuauggaacacucu

SEQ ID NO: 1618902 - RNA, 20 nt, Human
ucagugccuuauggaacacu

SEQ ID NO: 1618903 - RNA, 19 nt, Human
ucagugccuuauggaacac

SEQ ID NO: 1618904 - RNA, 16 nt, Human
ucaguggcagcugcuu

SEQ ID NO: 1618905 - RNA, 15 nt, Human
ucaguggcagcugcu

SEQ ID NO: 1618906 - RNA, 14 nt, Human
ucaguggcagcugc

SEQ ID NO: 1618907 - RNA, 15 nt, Human
ucagugcuucgcaga

SEQ ID NO: 1618908 - RNA, 19 nt, Human
ucaguuguuagugugucuu

SEQ ID NO: 1618909 - RNA, 18 nt, Human
ucauaaauaaaguuuguu

SEQ ID NO: 1618910 - RNA, 24 nt, Human
ucauaaagcaggcagaacucaucu

SEQ ID NO: 1618911 - RNA, 22 nt, Human
ucaggugucccugcacuugcag

SEQ ID NO: 1618912 - RNA, 22 nt, Human
ucagguugucugaagucacugc

SEQ ID NO: 1618913 - RNA, 13 nt, Human
ucaguaagccgug

SEQ ID NO: 1618914 - RNA, 13 nt, Human
ucaguaauaacuc

SEQ ID NO: 1618915 - RNA, 15 nt, Human
acccuugugguccca

SEQ ID NO: 1618916 - RNA, 20 nt, Human
accgaaaacguggcugcuuc

SEQ ID NO: 1618917 - RNA, 20 nt, Human
acccuugccgucuaccugag

SEQ ID NO: 1618918 - RNA, 18 nt, Human
ucaggugucccugcacuu

SEQ ID NO: 1618919 - RNA, 17 nt, Human
ucaggugucccugcacu

SEQ ID NO: 1618920 - RNA, 15 nt, Human
ucaggugucccugca

SEQ ID NO: 1618921 - RNA, 23 nt, Human
ucagguggggucacucuggcagc

SEQ ID NO: 1618922 - RNA, 22 nt, Human
accgaaaacguggcugcuucaa

SEQ ID NO: 1618923 - RNA, 21 nt, Human
accgaaaacguggcugcuuca

SEQ ID NO: 1618924 - RNA, 22 nt, Human
ucagguggggucacucuggcag

SEQ ID NO: 1618925 - RNA, 21 nt, Human
accgaacugauguaaguaaac

SEQ ID NO: 1618926 - RNA, 24 nt, Human
ucuagauacuguaucaugacaaag

SEQ ID NO: 1618927 - RNA, 13 nt, Human
ucuauaauuuaaa

SEQ ID NO: 1618928 - RNA, 23 nt, Human
ucuaguuugauuaaauucuugca

SEQ ID NO: 1618929 - RNA, 19 nt, Human
ucuaguucacucuccauuu

SEQ ID NO: 1618930 - RNA, 16 nt, Human
ucuaguucacucucca

SEQ ID NO: 1618931 - RNA, 12 nt, Human
ucuaguucacuc

SEQ ID NO: 1618932 - RNA, 20 nt, Human
acuuccagauccuggaaauc

SEQ ID NO: 1618933 - RNA, 17 nt, Human
acuuccauaaucuggac

SEQ ID NO: 1618934 - RNA, 17 nt, Human
acuuccacugccauccu

SEQ ID NO: 1618935 - RNA, 18 nt, Human
acuuccaauuuacauacu

SEQ ID NO: 1618936 - RNA, 20 nt, Human
acuucaggcucuucuccuuu

SEQ ID NO: 1618937 - RNA, 18 nt, Human
acuucaggcucuucuccu

SEQ ID NO: 1618938 - RNA, 17 nt, Human
acuucaggcucuucucc

SEQ ID NO: 1618939 - RNA, 16 nt, Human
acuuacuguacaugaa

SEQ ID NO: 1618940 - RNA, 13 nt, Human
acuuacuguacau

SEQ ID NO: 1618941 - RNA, 14 nt, Human
acuuacuguacaug

SEQ ID NO: 1618942 - RNA, 20 nt, Human
acuuagagguggggagcaga

SEQ ID NO: 1618943 - RNA, 15 nt, Human
acuuacuguacauga

SEQ ID NO: 1618944 - RNA, 19 nt, Human
ucuaccugaggggccucuu

SEQ ID NO: 1618945 - RNA, 12 nt, Human
ucuaccugaggg

SEQ ID NO: 1618946 - RNA, 18 nt, Human
ucucacuccuaccuggua

SEQ ID NO: 1618947 - RNA, 17 nt, Human
ucucacuccuaccuggu

SEQ ID NO: 1618948 - RNA, 16 nt, Human
ucucacuccuaccugg

SEQ ID NO: 1618949 - RNA, 20 nt, Human
acuucgggaggucgaggcag

SEQ ID NO: 1618950 - RNA, 17 nt, Human
acuucgggaggucgagg

SEQ ID NO: 1618951 - RNA, 21 nt, Human
acuucuaaguaaaaccacagc

SEQ ID NO: 1618952 - RNA, 19 nt, Human
acuucuaaguaaaaccaca

SEQ ID NO: 1618953 - RNA, 18 nt, Human
acuucuaaguaaaaccac

SEQ ID NO: 1618954 - RNA, 13 nt, Human
acuucuaaguaaa

SEQ ID NO: 1618955 - RNA, 22 nt, Human
acuucgggaggucgaggcagga

SEQ ID NO: 1618956 - RNA, 17 nt, Human
ucucaaaacugcacugu

SEQ ID NO: 1618957 - RNA, 13 nt, Human
ucucacuccuacc

SEQ ID NO: 1618958 - RNA, 16 nt, Human
ucucaaaaaaagaaaa

SEQ ID NO: 1618959 - RNA, 16 nt, Human
ucuauuguuucuuuca

SEQ ID NO: 1618960 - RNA, 23 nt, Human
acuugaacccgggaggcagaggu

SEQ ID NO: 1618961 - RNA, 16 nt, Human
acuugaaauuugaauu

SEQ ID NO: 1618962 - RNA, 18 nt, Human
acuugaaaauuaacauga

SEQ ID NO: 1618963 - RNA, 17 nt, Human
acuugaaaauuaacaug

SEQ ID NO: 1618964 - RNA, 19 nt, Human
acuugagaauuacccuuuu

SEQ ID NO: 1618965 - RNA, 14 nt, Human
acuuggaagcuccg

SEQ ID NO: 1618966 - RNA, 14 nt, Human
acuugucuuuggac

SEQ ID NO: 1618967 - RNA, 15 nt, Human
acuuguauuaugugu

SEQ ID NO: 1618968 - RNA, 14 nt, Human
acuuguaugaaaga

SEQ ID NO: 1618969 - RNA, 14 nt, Human
acuuguauuaugug

SEQ ID NO: 1618970 - RNA, 13 nt, Human
acuuguauuaugu

SEQ ID NO: 1618971 - RNA, 13 nt, Human
ucuaaaggcuacc

SEQ ID NO: 1618972 - RNA, 16 nt, Human
ucuaaaggcuaccuuu

SEQ ID NO: 1618973 - RNA, 17 nt, Human
ucuaaagcugccagccg

SEQ ID NO: 1618974 - RNA, 23 nt, Human
ucuaaacugcccccucugcccug

SEQ ID NO: 1618975 - RNA, 22 nt, Human
ucuaaacugcccccucugcccu

SEQ ID NO: 1618976 - RNA, 16 nt, Human
ucuaaacugcccccuc

SEQ ID NO: 1618977 - RNA, 13 nt, Human
ucuaaacugcccc

SEQ ID NO: 1618978 - RNA, 17 nt, Human
ucuaccaaaaaucucaa

SEQ ID NO: 1618979 - RNA, 14 nt, Human
ucuacccuggcacu

SEQ ID NO: 1618980 - RNA, 21 nt, Human
ucuacccucuuagaaaaacca

SEQ ID NO: 1618981 - RNA, 13 nt, Human
acuguggguagac

SEQ ID NO: 1618982 - RNA, 21 nt, Human
acuguuaauaguucagguaac

SEQ ID NO: 1618983 - RNA, 17 nt, Human
acuguuaauaguucagg

SEQ ID NO: 1618984 - RNA, 23 nt, Human
ucgucacugcuuaacuucacaua

SEQ ID NO: 1618985 - RNA, 19 nt, Human
ucggggagaggcugaggac

SEQ ID NO: 1618986 - RNA, 22 nt, Human
acugaagaagcaccaaucauga

SEQ ID NO: 1618987 - RNA, 18 nt, Human
ucgcccuggacugugugc

SEQ ID NO: 1618988 - RNA, 23 nt, Human
ucgcugugucagcauagaaguaa

SEQ ID NO: 1618989 - RNA, 15 nt, Human
acuggguacuugugg

SEQ ID NO: 1618990 - RNA, 21 nt, Human
acugggcuuggggaccagagc

SEQ ID NO: 1618991 - RNA, 22 nt, Human
acugggcuuggggaccagagcu

SEQ ID NO: 1618992 - RNA, 23 nt, Human
acugucagcuccccucggagaag

SEQ ID NO: 1618993 - RNA, 16 nt, Human
acuguaucaugacaaa

SEQ ID NO: 1618994 - RNA, 20 nt, Human
acuguaucaugacaaagacu

SEQ ID NO: 1618995 - RNA, 20 nt, Human
acuguacaugaaaacacauu

SEQ ID NO: 1618996 - RNA, 21 nt, Human
acuguacaugaaaacacauuu

SEQ ID NO: 1618997 - RNA, 15 nt, Human
acuguacuugcucuu

SEQ ID NO: 1618998 - RNA, 20 nt, Human
acuguacuccucccaggcgc

SEQ ID NO: 1618999 - RNA, 14 nt, Human
acuguaucaugaca

SEQ ID NO: 1619000 - RNA, 23 nt, Human
acuguacuugcucuugaugccug

SEQ ID NO: 1619001 - RNA, 22 nt, Human
acuguacaaaguagaagucuua

SEQ ID NO: 1619002 - RNA, 16 nt, Human
acuguacaaaguagaa

SEQ ID NO: 1619003 - RNA, 18 nt, Human
acuggguacuuguggaca

SEQ ID NO: 1619004 - RNA, 17 nt, Human
acuggguacuuguggac

SEQ ID NO: 1619005 - RNA, 19 nt, Human
acuguacaugaaaacacau

SEQ ID NO: 1619006 - RNA, 16 nt, Human
acuguacaugaaaaca

SEQ ID NO: 1619007 - RNA, 18 nt, Human
acuguacagacagaaaaa

SEQ ID NO: 1619008 - RNA, 15 nt, Human
agaaacauuugguaa

SEQ ID NO: 1619009 - RNA, 23 nt, Human
agaaacuuaagguuaccuuuguu

SEQ ID NO: 1619010 - RNA, 16 nt, Human
agaaacacaacuauau

SEQ ID NO: 1619011 - RNA, 16 nt, Human
agaaaacaaggaugaa

SEQ ID NO: 1619012 - RNA, 23 nt, Human
agaaaaaauauuuuccugccagg

SEQ ID NO: 1619013 - RNA, 17 nt, Human
agaaaaaauauuuuccu

SEQ ID NO: 1619014 - RNA, 19 nt, Human
agaaaaaauauuuucccua

SEQ ID NO: 1619015 - RNA, 18 nt, Human
agaaaaaugagccuggca

SEQ ID NO: 1619016 - RNA, 18 nt, Human
ucucuugguccugcugca

SEQ ID NO: 1619017 - RNA, 17 nt, Human
ucucuugguccugcugc

SEQ ID NO: 1619018 - RNA, 22 nt, Human
ucucugcaggucccuaauaaag

SEQ ID NO: 1619019 - RNA, 21 nt, Human
ucucugcaggucccuaauaaa

SEQ ID NO: 1619020 - RNA, 20 nt, Human
ucucugcaggucccuaauaa

SEQ ID NO: 1619021 - RNA, 19 nt, Human
ucucugcaggucccuaaua

SEQ ID NO: 1619022 - RNA, 16 nt, Human
agaaagacuauucaaa

SEQ ID NO: 1619023 - RNA, 18 nt, Human
agaaagacuauucaaaca

SEQ ID NO: 1619024 - RNA, 22 nt, Human
agaaagacuaucuaaauguuga

SEQ ID NO: 1619025 - RNA, 20 nt, Human
agaaagacuaucuaaauguu

SEQ ID NO: 1619026 - RNA, 18 nt, Human
agaaagcagaacagugau

SEQ ID NO: 1619027 - RNA, 17 nt, Human
agaaagcagaacaguga

SEQ ID NO: 1619028 - RNA, 20 nt, Human
agaaagcagaacagugauua

SEQ ID NO: 1619029 - RNA, 15 nt, Human
agaaaugccuuaccc

SEQ ID NO: 1619030 - RNA, 18 nt, Human
ucugaaggcuggguucug

SEQ ID NO: 1619031 - RNA, 20 nt, Human
ucugaaggguaauuauauag

SEQ ID NO: 1619032 - RNA, 12 nt, Human
agaaaugaaaaa

SEQ ID NO: 1619033 - RNA, 13 nt, Human
agaaaugaaaaaa

SEQ ID NO: 1619034 - RNA, 16 nt, Human
agaaaugaaaaaauau

SEQ ID NO: 1619035 - RNA, 23 nt, Human
acuuuggaaagaguaggaagacu

SEQ ID NO: 1619036 - RNA, 19 nt, Human
acuuuguauaaaagggacu

SEQ ID NO: 1619037 - RNA, 14 nt, Human
acuuuggaaagagu

SEQ ID NO: 1619038 - RNA, 13 nt, Human
acuuuggaaagag

SEQ ID NO: 1619039 - RNA, 12 nt, Human
acuuuggaaaga

SEQ ID NO: 1619040 - RNA, 14 nt, Human
acuuguggacacag

SEQ ID NO: 1619041 - RNA, 18 nt, Human
acuugucuuuggacccug

SEQ ID NO: 1619042 - RNA, 16 nt, Human
acuuuaaaaggagcca

SEQ ID NO: 1619043 - RNA, 15 nt, Human
acuuguggacacagc

SEQ ID NO: 1619044 - RNA, 22 nt, Human
acuuguuuuauuuaaccucuaa

SEQ ID NO: 1619045 - RNA, 16 nt, Human
acuuguuuucugggaa

SEQ ID NO: 1619046 - RNA, 13 nt, Human
acuuuagggaagu

SEQ ID NO: 1619047 - RNA, 23 nt, Human
ucuccuuggugucgggcaugaca

SEQ ID NO: 1619048 - RNA, 21 nt, Human
ucuccuuggugucgggcauga

SEQ ID NO: 1619049 - RNA, 20 nt, Human
ucuccuuaaagaguguggca

SEQ ID NO: 1619050 - RNA, 18 nt, Human
acuuuguguucaccuugu

SEQ ID NO: 1619051 - RNA, 16 nt, Human
acuuuguguucaccuu

SEQ ID NO: 1619052 - RNA, 22 nt, Human
acuuugugcugggguuaucuga

SEQ ID NO: 1619053 - RNA, 21 nt, Human
ucucucaggccaaacucaccu

SEQ ID NO: 1619054 - RNA, 12 nt, Human
ucucucaggcca

SEQ ID NO: 1619055 - RNA, 22 nt, Human
ucucucacuuguuuuauuuaac

SEQ ID NO: 1619056 - RNA, 15 nt, Human
ucucggcucacugca

SEQ ID NO: 1619057 - RNA, 17 nt, Human
ucucgaacuccugaccu

SEQ ID NO: 1619058 - RNA, 20 nt, Human
ucucgcuauugucaccaggg

SEQ ID NO: 1619059 - RNA, 23 nt, Human
agaagcucccugaaguaagcaaa

SEQ ID NO: 1619060 - RNA, 13 nt, Human
agaaguugauaug

SEQ ID NO: 1619061 - RNA, 22 nt, Human
agaaguuugagaucagccuggg

SEQ ID NO: 1619062 - RNA, 10 nt, Human
ucuggccuuc

SEQ ID NO: 1619063 - RNA, 21 nt, Human
ucuggcagcucagagagggug

SEQ ID NO: 1619064 - RNA, 18 nt, Human
ucuggcagcucagagagg

SEQ ID NO: 1619065 - RNA, 23 nt, Human
ucuggcagaguugaagacagagc

SEQ ID NO: 1619066 - RNA, 20 nt, Human
ucuggcagaguugaagacag

SEQ ID NO: 1619067 - RNA, 17 nt, Human
ucuggcagcucagagag

SEQ ID NO: 1619068 - RNA, 23 nt, Human
ucugcuuuuuaaagaaugcucuu

SEQ ID NO: 1619069 - RNA, 22 nt, Human
ucugcuuugggguuuaucagaa

SEQ ID NO: 1619070 - RNA, 14 nt, Human
ucugccugucuccc

SEQ ID NO: 1619071 - RNA, 12 nt, Human
ucugccugucuc

SEQ ID NO: 1619072 - RNA, 16 nt, Human
agaacucccuuucaac

SEQ ID NO: 1619073 - RNA, 17 nt, Human
agaacucccuuucaaca

SEQ ID NO: 1619074 - RNA, 23 nt, Human
agaaccuuuugagugccuuacac

SEQ ID NO: 1619075 - RNA, 19 nt, Human
agaaccuuuugagugccuu

SEQ ID NO: 1619076 - RNA, 12 nt, Human
agaaauuaugug

SEQ ID NO: 1619077 - RNA, 23 nt, Human
ucugcaggucccuaauaaagcug

SEQ ID NO: 1619078 - RNA, 22 nt, Human
ucugcaggucccuaauaaagcu

SEQ ID NO: 1619079 - RNA, 19 nt, Human
ucugcaggucccuaauaaa

SEQ ID NO: 1619080 - RNA, 21 nt, Human
ucugcaggucccuaauaaagc

SEQ ID NO: 1619081 - RNA, 20 nt, Human
ucugcccauccugccccuga

SEQ ID NO: 1619082 - RNA, 21 nt, Human
agaagccccacccugccucac

SEQ ID NO: 1619083 - RNA, 23 nt, Human
ucugcccuugguuaggcauugug

SEQ ID NO: 1619084 - RNA, 12 nt, Human
ucugcccuuggu

SEQ ID NO: 1619085 - RNA, 22 nt, Human
ucugcccugcgggucacaggag

SEQ ID NO: 1619086 - RNA, 19 nt, Human
agaagcaccaaucaugaau

SEQ ID NO: 1619087 - RNA, 16 nt, Human
agaagcagaggaagga

SEQ ID NO: 1619088 - RNA, 19 nt, Human
ucuugguccugcugcaguu

SEQ ID NO: 1619089 - RNA, 16 nt, Human
ucuuuaaaugcugcuu

SEQ ID NO: 1619090 - RNA, 17 nt, Human
ucuugguccugcugcag

SEQ ID NO: 1619091 - RNA, 15 nt, Human
ucuugguccugcugc

SEQ ID NO: 1619092 - RNA, 17 nt, Human
ucuuuccugaggcuggg

SEQ ID NO: 1619093 - RNA, 19 nt, Human
ucuuucuaaugugugaauc

SEQ ID NO: 1619094 - RNA, 18 nt, Human
ucuuucuaaugugugaau

SEQ ID NO: 1619095 - RNA, 23 nt, Human
ucuugcaauggcagccuuggcaa

SEQ ID NO: 1619096 - RNA, 22 nt, Human
ucuugcaauggcagccuuggca

SEQ ID NO: 1619097 - RNA, 18 nt, Human
ucuugcaauggcagccuu

SEQ ID NO: 1619098 - RNA, 19 nt, Human
ucuugcaauggcagccuug

SEQ ID NO: 1619099 - RNA, 14 nt, Human
ucuugguccugcug

SEQ ID NO: 1619100 - RNA, 17 nt, Human
ucuuggucagauuugaa

SEQ ID NO: 1619101 - RNA, 14 nt, Human
agacuauucaaaca

SEQ ID NO: 1619102 - RNA, 12 nt, Human
agacuauucaaa

SEQ ID NO: 1619103 - RNA, 15 nt, Human
agacuauucaaacag

SEQ ID NO: 1619104 - RNA, 16 nt, Human
agacuauucaaacagu

SEQ ID NO: 1619105 - RNA, 23 nt, Human
agaccuucuccuucaccuuuguc

SEQ ID NO: 1619106 - RNA, 21 nt, Human
agaccuucuccuucaccuuug

SEQ ID NO: 1619107 - RNA, 18 nt, Human
agaccuucuccuucaccu

SEQ ID NO: 1619108 - RNA, 15 nt, Human
agaccuucuccuuca

SEQ ID NO: 1619109 - RNA, 11 nt, Human
agaccuucucc

SEQ ID NO: 1619110 - RNA, 14 nt, Human
agaccccuggcuuu

SEQ ID NO: 1619111 - RNA, 16 nt, Human
ucuugagccugggagg

SEQ ID NO: 1619112 - RNA, 13 nt, Human
ucuugagccuggg

SEQ ID NO: 1619113 - RNA, 16 nt, Human
ucuugagccuugaacu

SEQ ID NO: 1619114 - RNA, 13 nt, Human
ucuugauucauaa

SEQ ID NO: 1619115 - RNA, 21 nt, Human
ucuugaugccuggcggggugg

SEQ ID NO: 1619116 - RNA, 18 nt, Human
agacaucaacagauaaau

SEQ ID NO: 1619117 - RNA, 17 nt, Human
agacaucaacagauaaa

SEQ ID NO: 1619118 - RNA, 21 nt, Human
agacauagaauuaacacauga

SEQ ID NO: 1619119 - RNA, 19 nt, Human
agacauacuaaccagcaga

SEQ ID NO: 1619120 - RNA, 20 nt, Human
ucuucuguacgucugacagg

SEQ ID NO: 1619121 - RNA, 15 nt, Human
ucuucuguacgucug

SEQ ID NO: 1619122 - RNA, 18 nt, Human
ucuucuggguuccuuccu

SEQ ID NO: 1619123 - RNA, 20 nt, Human
ucuucuguggguuucuaaag

SEQ ID NO: 1619124 - RNA, 19 nt, Human
ucuucugcuucagccuccc

SEQ ID NO: 1619125 - RNA, 12 nt, Human
ucuucugcuuca

SEQ ID NO: 1619126 - RNA, 21 nt, Human
ucuucugaacuuggcgcugcc

SEQ ID NO: 1619127 - RNA, 15 nt, Human
ucuucacaacagauu

SEQ ID NO: 1619128 - RNA, 12 nt, Human
ucuucagagacu

SEQ ID NO: 1619129 - RNA, 18 nt, Human
ucuucagagacuccugca

SEQ ID NO: 1619130 - RNA, 17 nt, Human
ucuucagagacuccugc

SEQ ID NO: 1619131 - RNA, 14 nt, Human
agaaucacuugaac

SEQ ID NO: 1619132 - RNA, 15 nt, Human
ucuucaacucccugc

SEQ ID NO: 1619133 - RNA, 19 nt, Human
ucuucaacugaccagccuc

SEQ ID NO: 1619134 - RNA, 16 nt, Human
ucuucaacugaccagc

SEQ ID NO: 1619135 - RNA, 20 nt, Human
ucuuccaggcugggagagcc

SEQ ID NO: 1619136 - RNA, 17 nt, Human
ucuuccaggcugggaga

SEQ ID NO: 1619137 - RNA, 15 nt, Human
ucuuccaggcuggga

SEQ ID NO: 1619138 - RNA, 20 nt, Human
ucuucagagacuccugcagg

SEQ ID NO: 1619139 - RNA, 21 nt, Human
ucuuccaggcugggagagccu

SEQ ID NO: 1619140 - RNA, 22 nt, Human
ucuucccuacaguugaaaaaca

SEQ ID NO: 1619141 - RNA, 19 nt, Human
ucuucccuacaguugaaaa

SEQ ID NO: 1619142 - RNA, 14 nt, Human
ucuuccucccuccc

SEQ ID NO: 1619143 - RNA, 15 nt, Human
ucuuccucccucccu

SEQ ID NO: 1619144 - RNA, 14 nt, Human
ucuuccucugcuga

SEQ ID NO: 1619145 - RNA, 12 nt, Human
ucuuccucugcu

SEQ ID NO: 1619146 - RNA, 11 nt, Human
ucuuccucugc

SEQ ID NO: 1619147 - RNA, 23 nt, Human
agagacuccugcaggcagccagg

SEQ ID NO: 1619148 - RNA, 22 nt, Human
agagaucaaccccuucgcuccu

SEQ ID NO: 1619149 - RNA, 23 nt, Human
agagcaagacgcugugcugcccu

SEQ ID NO: 1619150 - RNA, 19 nt, Human
agagcaagacgcugugcug

SEQ ID NO: 1619151 - RNA, 22 nt, Human
agagacuccugcaggcagccag

SEQ ID NO: 1619152 - RNA, 21 nt, Human
agagacuccugcaggcagcca

SEQ ID NO: 1619153 - RNA, 20 nt, Human
agagacuccugcaggcagcc

SEQ ID NO: 1619154 - RNA, 19 nt, Human
agagacuccugcaggcagc

SEQ ID NO: 1619155 - RNA, 18 nt, Human
agagacuccugcaggcag

SEQ ID NO: 1619156 - RNA, 17 nt, Human
agagacuccugcaggca

SEQ ID NO: 1619157 - RNA, 11 nt, Human
agagacuccug

SEQ ID NO: 1619158 - RNA, 16 nt, Human
agagacuccagcuggg

SEQ ID NO: 1619159 - RNA, 15 nt, Human
ugaaagacuguacaa

SEQ ID NO: 1619160 - RNA, 13 nt, Human
ugaaagacuguac

SEQ ID NO: 1619161 - RNA, 12 nt, Human
ugaaacuuuugg

SEQ ID NO: 1619162 - RNA, 23 nt, Human
agagcaccuuagacagucccugc

SEQ ID NO: 1619163 - RNA, 22 nt, Human
agagcaccuuagacagucccug

SEQ ID NO: 1619164 - RNA, 22 nt, Human
agagccuuccaggggugggaca

SEQ ID NO: 1619165 - RNA, 17 nt, Human
agagccuuccaggggug

SEQ ID NO: 1619166 - RNA, 15 nt, Human
agagccuuccagggg

SEQ ID NO: 1619167 - RNA, 13 nt, Human
agagccuuccagg

SEQ ID NO: 1619168 - RNA, 20 nt, Human
agagcuagcagcagggaggg

SEQ ID NO: 1619169 - RNA, 14 nt, Human
agagcugccaccug

SEQ ID NO: 1619170 - RNA, 16 nt, Human
ugaaaaaggaggaaga

SEQ ID NO: 1619171 - RNA, 23 nt, Human
ugaaaaaauauauaucaaauaua

SEQ ID NO: 1619172 - RNA, 21 nt, Human
ucuuucuggcuaugcauuuga

SEQ ID NO: 1619173 - RNA, 20 nt, Human
ucuuucuggcuaugcauuug

SEQ ID NO: 1619174 - RNA, 22 nt, Human
ucuuuggucuacacugugcuga

SEQ ID NO: 1619175 - RNA, 22 nt, Human
ugaaaaaguucugcagauaaac

SEQ ID NO: 1619176 - RNA, 22 nt, Human
ugaaaaaggaggaagagaaaaa

SEQ ID NO: 1619177 - RNA, 20 nt, Human
ugaaaaaggaggaagagaaa

SEQ ID NO: 1619178 - RNA, 20 nt, Human
ugaaaaucuuauaauuuaaa

SEQ ID NO: 1619179 - RNA, 19 nt, Human
ugaaaaucgugacaacacu

SEQ ID NO: 1619180 - RNA, 17 nt, Human
ugaaaauguauguguaa

SEQ ID NO: 1619181 - RNA, 15 nt, Human
ugaaacggaugauuu

SEQ ID NO: 1619182 - RNA, 22 nt, Human
ugaaacugagaugugaacacau

SEQ ID NO: 1619183 - RNA, 19 nt, Human
ugaaacucguuaauuugua

SEQ ID NO: 1619184 - RNA, 23 nt, Human
ugaaacuuguguaaauacaauuu

SEQ ID NO: 1619185 - RNA, 17 nt, Human
ugaaacuuguguaaaua

SEQ ID NO: 1619186 - RNA, 20 nt, Human
ugaaacggaugauuucuaug

SEQ ID NO: 1619187 - RNA, 19 nt, Human
ugaaacggaugauuucuau

SEQ ID NO: 1619188 - RNA, 18 nt, Human
ugaaacggaugauuucua

SEQ ID NO: 1619189 - RNA, 17 nt, Human
ugaaacggaugauuucu

SEQ ID NO: 1619190 - RNA, 16 nt, Human
agagguggggagcaga

SEQ ID NO: 1619191 - RNA, 15 nt, Human
agagguuaagguggg

SEQ ID NO: 1619192 - RNA, 20 nt, Human
ugaagcuaucguaaaauuaa

SEQ ID NO: 1619193 - RNA, 12 nt, Human
ugaagccuuugu

SEQ ID NO: 1619194 - RNA, 16 nt, Human
agagggagggagggcu

SEQ ID NO: 1619195 - RNA, 20 nt, Human
agagggagggagggcuccag

SEQ ID NO: 1619196 - RNA, 22 nt, Human
ugaauggcuuuguauagaaccu

SEQ ID NO: 1619197 - RNA, 19 nt, Human
ugaauggcuuuguauagaa

SEQ ID NO: 1619198 - RNA, 18 nt, Human
ugaauggcuuuguauaga

SEQ ID NO: 1619199 - RNA, 17 nt, Human
ugaauggcuuuguauag

SEQ ID NO: 1619200 - RNA, 18 nt, Human
ugaauauuuaguguucau

SEQ ID NO: 1619201 - RNA, 15 nt, Human
ugaauggcuuuguau

SEQ ID NO: 1619202 - RNA, 12 nt, Human
ugaauggcuuug

SEQ ID NO: 1619203 - RNA, 15 nt, Human
ugaauacuuuauaaa

SEQ ID NO: 1619204 - RNA, 14 nt, Human
ugaagucacacagu

SEQ ID NO: 1619205 - RNA, 14 nt, Human
ugaagucacugcac

SEQ ID NO: 1619206 - RNA, 22 nt, Human
ugaaggguaauuauauaguuac

SEQ ID NO: 1619207 - RNA, 16 nt, Human
ugaauaaagacaccua

SEQ ID NO: 1619208 - RNA, 21 nt, Human
ugaagucacugcacagugcau

SEQ ID NO: 1619209 - RNA, 16 nt, Human
ugaagucacugcacag

SEQ ID NO: 1619210 - RNA, 15 nt, Human
ugaagucacugcaca

SEQ ID NO: 1619211 - RNA, 15 nt, Human
agagucacuggaaca

SEQ ID NO: 1619212 - RNA, 22 nt, Human
agagucagaaguuucugccgca

SEQ ID NO: 1619213 - RNA, 17 nt, Human
agaguuguuacauuuuu

SEQ ID NO: 1619214 - RNA, 21 nt, Human
agaguuguuacauuuuuaagu

SEQ ID NO: 1619215 - RNA, 19 nt, Human
agaguuguuacauuuuuaa

SEQ ID NO: 1619216 - RNA, 20 nt, Human
agaguuguuacauuuuuaag

SEQ ID NO: 1619217 - RNA, 17 nt, Human
agauaaggguaucuggu

SEQ ID NO: 1619218 - RNA, 22 nt, Human
agauaauauuaaggaagacaau

SEQ ID NO: 1619219 - RNA, 18 nt, Human
agauaauauuaaggaaga

SEQ ID NO: 1619220 - RNA, 20 nt, Human
agauacaggaaaagcugcug

SEQ ID NO: 1619221 - RNA, 13 nt, Human
agauacaguuacu

SEQ ID NO: 1619222 - RNA, 11 nt, Human
agauacuguau

SEQ ID NO: 1619223 - RNA, 17 nt, Human
agauacuggauuguacu

SEQ ID NO: 1619224 - RNA, 22 nt, Human
agauacaguuacucagaauucu

SEQ ID NO: 1619225 - RNA, 20 nt, Human
agauauuuugcuuugugauu

SEQ ID NO: 1619226 - RNA, 21 nt, Human
agauauuuugcuuugugauuu

SEQ ID NO: 1619227 - RNA, 18 nt, Human
agaucaaaagguuaauaa

SEQ ID NO: 1619228 - RNA, 15 nt, Human
agauacuguaucaug

SEQ ID NO: 1619229 - RNA, 16 nt, Human
agauacuguaucauga

SEQ ID NO: 1619230 - RNA, 23 nt, Human
ugaauuucuuuugccguuauuaa

SEQ ID NO: 1619231 - RNA, 21 nt, Human
ugaauuugugaagguggaaau

SEQ ID NO: 1619232 - RNA, 13 nt, Human
ugaauuugugaag

SEQ ID NO: 1619233 - RNA, 23 nt, Human
ugaauuugugaagguggaaauaa

SEQ ID NO: 1619234 - RNA, 21 nt, Human
ugaauuuuguguuagagauuu

SEQ ID NO: 1619235 - RNA, 17 nt, Human
ugaauuuuguguuagag

SEQ ID NO: 1619236 - RNA, 12 nt, Human
ugacacaugcaa

SEQ ID NO: 1619237 - RNA, 20 nt, Human
ugacacaugcaaggucauuu

SEQ ID NO: 1619238 - RNA, 18 nt, Human
ugacacacagcucugucc

SEQ ID NO: 1619239 - RNA, 16 nt, Human
ugacacacagcucugu

SEQ ID NO: 1619240 - RNA, 19 nt, Human
ugacaaagacugaguacgu

SEQ ID NO: 1619241 - RNA, 20 nt, Human
ugacacacagcucuguccug

SEQ ID NO: 1619242 - RNA, 19 nt, Human
ugacacacagcucuguccu

SEQ ID NO: 1619243 - RNA, 15 nt, Human
ugacccaugcugccc

SEQ ID NO: 1619244 - RNA, 14 nt, Human
ugacccaugcugcc

SEQ ID NO: 1619245 - RNA, 21 nt, Human
ugacccaugcugcccugugag

SEQ ID NO: 1619246 - RNA, 16 nt, Human
ugacccaugcugcccu

SEQ ID NO: 1619247 - RNA, 17 nt, Human
ugacccaugcugcccug

SEQ ID NO: 1619248 - RNA, 17 nt, Human
ugacacuuaaaaauggu

SEQ ID NO: 1619249 - RNA, 17 nt, Human
agaugcaguucugaaga

SEQ ID NO: 1619250 - RNA, 16 nt, Human
agaugcaguucugaag

SEQ ID NO: 1619251 - RNA, 16 nt, Human
agaugccgcauuugga

SEQ ID NO: 1619252 - RNA, 23 nt, Human
agaugcugacuguacuccuccca

SEQ ID NO: 1619253 - RNA, 20 nt, Human
agaugcugacuguacuccuc

SEQ ID NO: 1619254 - RNA, 19 nt, Human
ugaccugaggcccuucucu

SEQ ID NO: 1619255 - RNA, 18 nt, Human
ugaccugaggcccuucuc

SEQ ID NO: 1619256 - RNA, 13 nt, Human
ugacuuacuguac

SEQ ID NO: 1619257 - RNA, 15 nt, Human
ugacuuacuguacau

SEQ ID NO: 1619258 - RNA, 16 nt, Human
ugacuuacuguacaug

SEQ ID NO: 1619259 - RNA, 24 nt, Human
ugacuucuaaguaaaaccacagca

SEQ ID NO: 1619260 - RNA, 22 nt, Human
agauucauauuuacuucuuaua

SEQ ID NO: 1619261 - RNA, 18 nt, Human
agauuccagagaguggcu

SEQ ID NO: 1619262 - RNA, 23 nt, Human
ugacuucuaaguaaaaccacagc

SEQ ID NO: 1619263 - RNA, 22 nt, Human
ugacuucuaaguaaaaccacag

SEQ ID NO: 1619264 - RNA, 15 nt, Human
ugacuucuaaguaaa

SEQ ID NO: 1619265 - RNA, 19 nt, Human
ugacuuacuguacaugaaa

SEQ ID NO: 1619266 - RNA, 15 nt, Human
agauucccugagcag

SEQ ID NO: 1619267 - RNA, 19 nt, Human
agauuccagagaguggcuc

SEQ ID NO: 1619268 - RNA, 13 nt, Human
agauuggaaggaa

SEQ ID NO: 1619269 - RNA, 21 nt, Human
agauuuugaaauuuuuauuaa

SEQ ID NO: 1619270 - RNA, 20 nt, Human
agauuuuauuauguaaaucc

SEQ ID NO: 1619271 - RNA, 19 nt, Human
agauuuuauuauguaaauc

SEQ ID NO: 1619272 - RNA, 20 nt, Human
agauuucucauuugccaaua

SEQ ID NO: 1619273 - RNA, 17 nt, Human
agauuugaacucuucaa

SEQ ID NO: 1619274 - RNA, 18 nt, Human
agauuuuauuauguaaau

SEQ ID NO: 1619275 - RNA, 17 nt, Human
agauuuuauuauguaaa

SEQ ID NO: 1619276 - RNA, 16 nt, Human
agauuuuauuauguaa

SEQ ID NO: 1619277 - RNA, 15 nt, Human
agauuuuauuaugua

SEQ ID NO: 1619278 - RNA, 14 nt, Human
agauuuuauuaugu

SEQ ID NO: 1619279 - RNA, 23 nt, Human
agcaacgcaggcccccaggugcc

SEQ ID NO: 1619280 - RNA, 16 nt, Human
agauuuuuuuguuguu

SEQ ID NO: 1619281 - RNA, 15 nt, Human
agauuuuuuuguugu

SEQ ID NO: 1619282 - RNA, 23 nt, Human
agauuuuuuuguuguuuguuuag

SEQ ID NO: 1619283 - RNA, 19 nt, Human
agauuuuuuuguuguuugu

SEQ ID NO: 1619284 - RNA, 18 nt, Human
agauuuuuuuguuguuug

SEQ ID NO: 1619285 - RNA, 16 nt, Human
agcaagacgcugugcu

SEQ ID NO: 1619286 - RNA, 13 nt, Human
agcaagacgcugu

SEQ ID NO: 1619287 - RNA, 20 nt, Human
ugagaagcagaggaaggaga

SEQ ID NO: 1619288 - RNA, 22 nt, Human
agcaagacgcugugcugcccug

SEQ ID NO: 1619289 - RNA, 21 nt, Human
agcaagacgcugugcugcccu

SEQ ID NO: 1619290 - RNA, 20 nt, Human
agcaagacgcugugcugccc

SEQ ID NO: 1619291 - RNA, 17 nt, Human
agcaagacgcugugcug

SEQ ID NO: 1619292 - RNA, 23 nt, Human
agcaagacgcugugcugcccugc

SEQ ID NO: 1619293 - RNA, 20 nt, Human
agcaucaggccaggcccucu

SEQ ID NO: 1619294 - RNA, 19 nt, Human
agcaucaggccaggcccuc

SEQ ID NO: 1619295 - RNA, 18 nt, Human
agcaucaggccaggcccu

SEQ ID NO: 1619296 - RNA, 17 nt, Human
agcaucaggccaggccc

SEQ ID NO: 1619297 - RNA, 16 nt, Human
agcaucaggccaggcc

SEQ ID NO: 1619298 - RNA, 14 nt, Human
agcaucaggccagg

SEQ ID NO: 1619299 - RNA, 17 nt, Human
agcaugucgucaaagcu

SEQ ID NO: 1619300 - RNA, 20 nt, Human
agcaugucgucaaagcugaa

SEQ ID NO: 1619301 - RNA, 12 nt, Human
agcauggcugcc

SEQ ID NO: 1619302 - RNA, 18 nt, Human
agcauuguaaaugugcuu

SEQ ID NO: 1619303 - RNA, 17 nt, Human
agcauuguaaaugugcu

SEQ ID NO: 1619304 - RNA, 20 nt, Human
agcaucacaugaacuuguaa

SEQ ID NO: 1619305 - RNA, 13 nt, Human
agcaucaggccag

SEQ ID NO: 1619306 - RNA, 21 nt, Human
ugaucacggcucacugcagcc

SEQ ID NO: 1619307 - RNA, 20 nt, Human
ugaucacggcucacugcagc

SEQ ID NO: 1619308 - RNA, 22 nt, Human
agcauauucaggaagcucaggg

SEQ ID NO: 1619309 - RNA, 19 nt, Human
ugaucacggcucacugcag

SEQ ID NO: 1619310 - RNA, 12 nt, Human
ugauaugggucu

SEQ ID NO: 1619311 - RNA, 16 nt, Human
ugauaugugaacaguu

SEQ ID NO: 1619312 - RNA, 15 nt, Human
ugauaugugaacagu

SEQ ID NO: 1619313 - RNA, 23 nt, Human
ugauauuuucaacgcagcccugc

SEQ ID NO: 1619314 - RNA, 22 nt, Human
ugauauuuucaacgcagcccug

SEQ ID NO: 1619315 - RNA, 21 nt, Human
ugauauuuucaacgcagcccu

SEQ ID NO: 1619316 - RNA, 19 nt, Human
ugauauuuucaacgcagcc

SEQ ID NO: 1619317 - RNA, 14 nt, Human
ugauacuacaguuu

SEQ ID NO: 1619318 - RNA, 17 nt, Human
ugauacuacaguuuguu

SEQ ID NO: 1619319 - RNA, 20 nt, Human
ugauacaaugcugugcccua

SEQ ID NO: 1619320 - RNA, 21 nt, Human
ugauacaaugcugugcccuaa

SEQ ID NO: 1619321 - RNA, 21 nt, Human
ugauacagaaaaguugaauuu

SEQ ID NO: 1619322 - RNA, 12 nt, Human
ugauacagaaaa

SEQ ID NO: 1619323 - RNA, 17 nt, Human
ugaguucauacccuguu

SEQ ID NO: 1619324 - RNA, 18 nt, Human
ugaguucauacccuguua

SEQ ID NO: 1619325 - RNA, 18 nt, Human
ugagugucuuaauuaaaa

SEQ ID NO: 1619326 - RNA, 21 nt, Human
ugagugggugaauaauacagu

SEQ ID NO: 1619327 - RNA, 20 nt, Human
ugagugccuuacacaauggu

SEQ ID NO: 1619328 - RNA, 17 nt, Human
ugagugccuuacacaau

SEQ ID NO: 1619329 - RNA, 17 nt, Human
ugagucaccaagcccag

SEQ ID NO: 1619330 - RNA, 16 nt, Human
ugagucaccaagccca

SEQ ID NO: 1619331 - RNA, 14 nt, Human
ugagucaccaagcc

SEQ ID NO: 1619332 - RNA, 22 nt, Human
ugaguaacugauuuguaacaag

SEQ ID NO: 1619333 - RNA, 15 nt, Human
ugaguacuacagucc

SEQ ID NO: 1619334 - RNA, 14 nt, Human
agcauauucaggaa

SEQ ID NO: 1619335 - RNA, 16 nt, Human
agcauauucaggaagc

SEQ ID NO: 1619336 - RNA, 13 nt, Human
ugaguagcuggga

SEQ ID NO: 1619337 - RNA, 23 nt, Human
ugaguacuacaguccucccaucu

SEQ ID NO: 1619338 - RNA, 22 nt, Human
ugaguacuacaguccucccauc

SEQ ID NO: 1619339 - RNA, 21 nt, Human
ugaguacuacaguccucccau

SEQ ID NO: 1619340 - RNA, 17 nt, Human
ugaguacuacaguccuc

SEQ ID NO: 1619341 - RNA, 23 nt, Human
agcauaaauguugacaugggaca

SEQ ID NO: 1619342 - RNA, 15 nt, Human
agcauacguacacau

SEQ ID NO: 1619343 - RNA, 21 nt, Human
agcauaauacuugcuuuggaa

SEQ ID NO: 1619344 - RNA, 12 nt, Human
ugagaauuaccc

SEQ ID NO: 1619345 - RNA, 16 nt, Human
agcauacguacacauu

SEQ ID NO: 1619346 - RNA, 17 nt, Human
agcauacguacacauuu

SEQ ID NO: 1619347 - RNA, 18 nt, Human
agcauacguacacauuuu

SEQ ID NO: 1619348 - RNA, 19 nt, Human
agcauacguacacauuuua

SEQ ID NO: 1619349 - RNA, 20 nt, Human
agcauacguacacauuuuau

SEQ ID NO: 1619350 - RNA, 21 nt, Human
agcauacguacacauuuuauu

SEQ ID NO: 1619351 - RNA, 17 nt, Human
ugaugaagaaguugaua

SEQ ID NO: 1619352 - RNA, 14 nt, Human
ugaugaagaggagu

SEQ ID NO: 1619353 - RNA, 13 nt, Human
ugaugaagaggag

SEQ ID NO: 1619354 - RNA, 15 nt, Human
agccacggccaggcc

SEQ ID NO: 1619355 - RNA, 21 nt, Human
ugauccagcagauuauucacu

SEQ ID NO: 1619356 - RNA, 22 nt, Human
ugauccagcagauuauucacug

SEQ ID NO: 1619357 - RNA, 18 nt, Human
ugauccuuuuggagucag

SEQ ID NO: 1619358 - RNA, 22 nt, Human
ugauccaguuuuguuuggacca

SEQ ID NO: 1619359 - RNA, 18 nt, Human
agccacauuccugaugcu

SEQ ID NO: 1619360 - RNA, 14 nt, Human
agccacauuccuga

SEQ ID NO: 1619361 - RNA, 23 nt, Human
agccaccaacauacucccaucug

SEQ ID NO: 1619362 - RNA, 20 nt, Human
agccaccaacauacucccau

SEQ ID NO: 1619363 - RNA, 19 nt, Human
agccaccaacauacuccca

SEQ ID NO: 1619364 - RNA, 14 nt, Human
agccacggccaggc

SEQ ID NO: 1619365 - RNA, 18 nt, Human
agccaccgugccuggcca

SEQ ID NO: 1619366 - RNA, 14 nt, Human
ugauuaccagggac

SEQ ID NO: 1619367 - RNA, 16 nt, Human
ugauuaccagggacug

SEQ ID NO: 1619368 - RNA, 12 nt, Human
ugauuaaaccaa

SEQ ID NO: 1619369 - RNA, 22 nt, Human
agccacugcaccgggccacaga

SEQ ID NO: 1619370 - RNA, 21 nt, Human
agccacugcaccgggccacag

SEQ ID NO: 1619371 - RNA, 16 nt, Human
agccacugcaccgggc

SEQ ID NO: 1619372 - RNA, 13 nt, Human
agccacugcaccg

SEQ ID NO: 1619373 - RNA, 17 nt, Human
ugaugaucuuuaaaaua

SEQ ID NO: 1619374 - RNA, 16 nt, Human
ugauggugcaaugacc

SEQ ID NO: 1619375 - RNA, 23 nt, Human
ugauggugcaaugaccuuucaau

SEQ ID NO: 1619376 - RNA, 17 nt, Human
ugauggugcaaugaccu

SEQ ID NO: 1619377 - RNA, 14 nt, Human
ugaugaucuuuaaa

SEQ ID NO: 1619378 - RNA, 20 nt, Human
ugaugauccuaggcauuugc

SEQ ID NO: 1619379 - RNA, 14 nt, Human
ugaugauccuaggc

SEQ ID NO: 1619380 - RNA, 15 nt, Human
ugauggugguauguu

SEQ ID NO: 1619381 - RNA, 17 nt, Human
ugauguuuuaaggaugc

SEQ ID NO: 1619382 - RNA, 18 nt, Human
ugauguuuuaaggaugcu

SEQ ID NO: 1619383 - RNA, 14 nt, Human
agccagacuggcac

SEQ ID NO: 1619384 - RNA, 19 nt, Human
agccagacuggcacaguuu

SEQ ID NO: 1619385 - RNA, 14 nt, Human
agccaggccacaag

SEQ ID NO: 1619386 - RNA, 12 nt, Human
agccaggccaca

SEQ ID NO: 1619387 - RNA, 22 nt, Human
agccaggccacaagacccuugu

SEQ ID NO: 1619388 - RNA, 21 nt, Human
agccaggccacaagacccuug

SEQ ID NO: 1619389 - RNA, 12 nt, Human
agccagggucuc

SEQ ID NO: 1619390 - RNA, 23 nt, Human
agccaguaaaugggggugcauuu

SEQ ID NO: 1619391 - RNA, 21 nt, Human
agcccaggaaaggcuccagga

SEQ ID NO: 1619392 - RNA, 20 nt, Human
agcccaggaaaggcuccagg

SEQ ID NO: 1619393 - RNA, 19 nt, Human
agcccaggaaaggcuccag

SEQ ID NO: 1619394 - RNA, 14 nt, Human
agccauguuuauua

SEQ ID NO: 1619395 - RNA, 13 nt, Human
agccauguuuauu

SEQ ID NO: 1619396 - RNA, 16 nt, Human
agccauguuuauuaca

SEQ ID NO: 1619397 - RNA, 17 nt, Human
agccauguuuauuacag

SEQ ID NO: 1619398 - RNA, 23 nt, Human
agcccaggaaaggcuccaggagc

SEQ ID NO: 1619399 - RNA, 22 nt, Human
agcccaggaaaggcuccaggag

SEQ ID NO: 1619400 - RNA, 24 nt, Human
agcccaggaaaggcuccaggagca

SEQ ID NO: 1619401 - RNA, 14 nt, Human
ugauucagcucugc

SEQ ID NO: 1619402 - RNA, 13 nt, Human
ugauucagcucug

SEQ ID NO: 1619403 - RNA, 15 nt, Human
ugauucauaaugacu

SEQ ID NO: 1619404 - RNA, 18 nt, Human
ugauucccaagcucugcu

SEQ ID NO: 1619405 - RNA, 16 nt, Human
ugauucccaagcucug

SEQ ID NO: 1619406 - RNA, 15 nt, Human
ugauucccaagcucu

SEQ ID NO: 1619407 - RNA, 21 nt, Human
ugauucccaagcucugcuccu

SEQ ID NO: 1619408 - RNA, 19 nt, Human
ugauucccaagcucugcuc

SEQ ID NO: 1619409 - RNA, 20 nt, Human
agccuuggggcugaugcagu

SEQ ID NO: 1619410 - RNA, 17 nt, Human
agccuuccagggguggg

SEQ ID NO: 1619411 - RNA, 16 nt, Human
agccuuccaggggugg

SEQ ID NO: 1619412 - RNA, 14 nt, Human
agccuuccaggggu

SEQ ID NO: 1619413 - RNA, 11 nt, Human
agccuuccagg

SEQ ID NO: 1619414 - RNA, 18 nt, Human
agcggagacggaguccca

SEQ ID NO: 1619415 - RNA, 20 nt, Human
agcggagaaaggaagggcug

SEQ ID NO: 1619416 - RNA, 20 nt, Human
ugcauuaucuagauacugua

SEQ ID NO: 1619417 - RNA, 16 nt, Human
agcggagaaaggaagg

SEQ ID NO: 1619418 - RNA, 21 nt, Human
ugcauuaucuagauacuguau

SEQ ID NO: 1619419 - RNA, 22 nt, Human
ugcauuaucuagauacuguauc

SEQ ID NO: 1619420 - RNA, 22 nt, Human
ugccaauaauaauaccucccuu

SEQ ID NO: 1619421 - RNA, 21 nt, Human
ugccaauaauaauaccucccu

SEQ ID NO: 1619422 - RNA, 16 nt, Human
ugccacacuucaggcu

SEQ ID NO: 1619423 - RNA, 15 nt, Human
ugccacacuucaggc

SEQ ID NO: 1619424 - RNA, 14 nt, Human
ugccacacuucagg

SEQ ID NO: 1619425 - RNA, 13 nt, Human
ugccacacuucag

SEQ ID NO: 1619426 - RNA, 21 nt, Human
agccugugccucugggacugg

SEQ ID NO: 1619427 - RNA, 13 nt, Human
agccuguuuaaga

SEQ ID NO: 1619428 - RNA, 23 nt, Human
agccugugucuuuaaaugcugcu

SEQ ID NO: 1619429 - RNA, 16 nt, Human
agccugugucuuuaaa

SEQ ID NO: 1619430 - RNA, 12 nt, Human
ugcauaccacuu

SEQ ID NO: 1619431 - RNA, 17 nt, Human
agccugcuccagcuguu

SEQ ID NO: 1619432 - RNA, 16 nt, Human
agccugcuccagcugu

SEQ ID NO: 1619433 - RNA, 15 nt, Human
agccugcuccagcug

SEQ ID NO: 1619434 - RNA, 14 nt, Human
ugcauaccacuuuu

SEQ ID NO: 1619435 - RNA, 22 nt, Human
agccugcuccagcuguucagcu

SEQ ID NO: 1619436 - RNA, 19 nt, Human
agccugcuccagcuguuca

SEQ ID NO: 1619437 - RNA, 22 nt, Human
agccugggugacagagcaagug

SEQ ID NO: 1619438 - RNA, 18 nt, Human
agcuacuugggaggcuga

SEQ ID NO: 1619439 - RNA, 17 nt, Human
agcuacuugggaggcug

SEQ ID NO: 1619440 - RNA, 16 nt, Human
agcuagaauuugauau

SEQ ID NO: 1619441 - RNA, 13 nt, Human
agcuagaauuuga

SEQ ID NO: 1619442 - RNA, 18 nt, Human
agcuagacgagcaggcuu

SEQ ID NO: 1619443 - RNA, 13 nt, Human
agcuagacuggug

SEQ ID NO: 1619444 - RNA, 21 nt, Human
agcuagacuggugacugauuc

SEQ ID NO: 1619445 - RNA, 17 nt, Human
agcuagacuggugacug

SEQ ID NO: 1619446 - RNA, 16 nt, Human
agcuagacuggugacu

SEQ ID NO: 1619447 - RNA, 14 nt, Human
agcuagacugguga

SEQ ID NO: 1619448 - RNA, 19 nt, Human
agcuacuaauuuuaaaaug

SEQ ID NO: 1619449 - RNA, 15 nt, Human
agcgugcauaaguua

SEQ ID NO: 1619450 - RNA, 22 nt, Human
agcgugagccacugcaccgggc

SEQ ID NO: 1619451 - RNA, 19 nt, Human
agcgugagccacugcaccg

SEQ ID NO: 1619452 - RNA, 23 nt, Human
ugccacacuucaggcucuucucc

SEQ ID NO: 1619453 - RNA, 22 nt, Human
ugccacacuucaggcucuucuc

SEQ ID NO: 1619454 - RNA, 20 nt, Human
agcucauucuccuuguguua

SEQ ID NO: 1619455 - RNA, 21 nt, Human
agcucauucuccuuguguuac

SEQ ID NO: 1619456 - RNA, 21 nt, Human
ugcccaagaauagaugcugac

SEQ ID NO: 1619457 - RNA, 23 nt, Human
ugcccaagaauagaugcugacug

SEQ ID NO: 1619458 - RNA, 22 nt, Human
ugcccaagaauagaugcugacu

SEQ ID NO: 1619459 - RNA, 19 nt, Human
ugcccacaggaucagucug

SEQ ID NO: 1619460 - RNA, 20 nt, Human
ugcccacaggaucagucuga

SEQ ID NO: 1619461 - RNA, 21 nt, Human
ugcccagccccuucugaccca

SEQ ID NO: 1619462 - RNA, 21 nt, Human
agcucaggugucccugcacuu

SEQ ID NO: 1619463 - RNA, 20 nt, Human
agcucaggugucccugcacu

SEQ ID NO: 1619464 - RNA, 22 nt, Human
agcucaggugucccugcacuug

SEQ ID NO: 1619465 - RNA, 18 nt, Human
agcucaggugucccugca

SEQ ID NO: 1619466 - RNA, 15 nt, Human
agcuaggccuggcca

SEQ ID NO: 1619467 - RNA, 14 nt, Human
agcuaggccuggcc

SEQ ID NO: 1619468 - RNA, 16 nt, Human
agcuaggccuggccag

SEQ ID NO: 1619469 - RNA, 12 nt, Human
agcuaggccugg

SEQ ID NO: 1619470 - RNA, 18 nt, Human
agcuaggaauuguguuua

SEQ ID NO: 1619471 - RNA, 22 nt, Human
agccugaaagaggaaugaagua

SEQ ID NO: 1619472 - RNA, 17 nt, Human
agccucccaaagugcug

SEQ ID NO: 1619473 - RNA, 15 nt, Human
ugcagccucacaguc

SEQ ID NO: 1619474 - RNA, 13 nt, Human
ugcagccucacag

SEQ ID NO: 1619475 - RNA, 16 nt, Human
ugcagccucacagucc

SEQ ID NO: 1619476 - RNA, 17 nt, Human
ugcagccucacaguccu

SEQ ID NO: 1619477 - RNA, 17 nt, Human
ugcauaaguuaacuucc

SEQ ID NO: 1619478 - RNA, 14 nt, Human
ugcauaaguuaacu

SEQ ID NO: 1619479 - RNA, 23 nt, Human
ugcauaacguauaaaagccuguu

SEQ ID NO: 1619480 - RNA, 16 nt, Human
ugcaggucccuaauaa

SEQ ID NO: 1619481 - RNA, 15 nt, Human
ugcaggucccuaaua

SEQ ID NO: 1619482 - RNA, 14 nt, Human
ugcaggucccuaau

SEQ ID NO: 1619483 - RNA, 12 nt, Human
ugcaggucccua

SEQ ID NO: 1619484 - RNA, 17 nt, Human
ugcaggucccuaauaaa

SEQ ID NO: 1619485 - RNA, 18 nt, Human
ugcaguacuuuaccuccu

SEQ ID NO: 1619486 - RNA, 15 nt, Human
agccucauguccacu

SEQ ID NO: 1619487 - RNA, 23 nt, Human
agccucagcauccuggcacccgg

SEQ ID NO: 1619488 - RNA, 22 nt, Human
agccucagcauccuggcacccg

SEQ ID NO: 1619489 - RNA, 20 nt, Human
agccucauguccacugguuc

SEQ ID NO: 1619490 - RNA, 20 nt, Human
agccuccaugcugccuccag

SEQ ID NO: 1619491 - RNA, 18 nt, Human
agccuccaugcugccucc

SEQ ID NO: 1619492 - RNA, 16 nt, Human
agccucccaaagugcu

SEQ ID NO: 1619493 - RNA, 21 nt, Human
agccucagcauccuggcaccc

SEQ ID NO: 1619494 - RNA, 20 nt, Human
agccucagcauccuggcacc

SEQ ID NO: 1619495 - RNA, 19 nt, Human
agccucagcauccuggcac

SEQ ID NO: 1619496 - RNA, 17 nt, Human
agccucagcauccuggc

SEQ ID NO: 1619497 - RNA, 17 nt, Human
agcccuucuuuccacag

SEQ ID NO: 1619498 - RNA, 20 nt, Human
agccgagauagccaaggcca

SEQ ID NO: 1619499 - RNA, 21 nt, Human
agccguggcuucccgcucagc

SEQ ID NO: 1619500 - RNA, 14 nt, Human
agccguggcuuccc

SEQ ID NO: 1619501 - RNA, 19 nt, Human
agccguuuguuccccaaga

SEQ ID NO: 1619502 - RNA, 23 nt, Human
agccguggcuucccgcucagccc

SEQ ID NO: 1619503 - RNA, 22 nt, Human
agccguggcuucccgcucagcc

SEQ ID NO: 1619504 - RNA, 23 nt, Human
ugcacuauagccuaggugacaga

SEQ ID NO: 1619505 - RNA, 23 nt, Human
agcccuucuaccuuccugcaaca

SEQ ID NO: 1619506 - RNA, 18 nt, Human
agcccauggcacucuaug

SEQ ID NO: 1619507 - RNA, 20 nt, Human
agccccaaaacucuccucug

SEQ ID NO: 1619508 - RNA, 22 nt, Human
agccccaaaacucuccucugcu

SEQ ID NO: 1619509 - RNA, 21 nt, Human
agccccaaaacucuccucugc

SEQ ID NO: 1619510 - RNA, 20 nt, Human
ugauucuccugccucagccu

SEQ ID NO: 1619511 - RNA, 19 nt, Human
ugauucuccugccucagcc

SEQ ID NO: 1619512 - RNA, 15 nt, Human
ugauucuccugccuc

SEQ ID NO: 1619513 - RNA, 22 nt, Human
agccccgaggccuucucugaag

SEQ ID NO: 1619514 - RNA, 17 nt, Human
agccccgaggccuucuc

SEQ ID NO: 1619515 - RNA, 24 nt, Human
agccccaaaacucuccucugcugc

SEQ ID NO: 1619516 - RNA, 18 nt, Human
agccccuggaugcagccu

SEQ ID NO: 1619517 - RNA, 17 nt, Human
agccccuggaugcagcc

SEQ ID NO: 1619518 - RNA, 19 nt, Human
agccccuggaugcagccuc

SEQ ID NO: 1619519 - RNA, 22 nt, Human
agccccuggaugcagccucaca

SEQ ID NO: 1619520 - RNA, 21 nt, Human
ugcacaagcugcacccucagg

SEQ ID NO: 1619521 - RNA, 18 nt, Human
ugcacaagcugcacccuc

SEQ ID NO: 1619522 - RNA, 24 nt, Human
ugcacacagcacgggggccaagga

SEQ ID NO: 1619523 - RNA, 12 nt, Human
ugcacacagcac

SEQ ID NO: 1619524 - RNA, 23 nt, Human
agcccugguggcagugggagcug

SEQ ID NO: 1619525 - RNA, 22 nt, Human
agcccugguggcagugggagcu

SEQ ID NO: 1619526 - RNA, 15 nt, Human
ugcacaagcugcacc

SEQ ID NO: 1619527 - RNA, 24 nt, Human
agccccuucugacccaugcugccc

SEQ ID NO: 1619528 - RNA, 20 nt, Human
agccccuucugacccaugcu

SEQ ID NO: 1619529 - RNA, 21 nt, Human
agcccugcuuugggcugcccu

SEQ ID NO: 1619530 - RNA, 23 nt, Human
agcccugcuuugggcugcccugg

SEQ ID NO: 1619531 - RNA, 22 nt, Human
agcccugcuuugggcugcccug

SEQ ID NO: 1619532 - RNA, 17 nt, Human
ugcacccucaggcaggu

SEQ ID NO: 1619533 - RNA, 16 nt, Human
ugcacccucaggcagg

SEQ ID NO: 1619534 - RNA, 15 nt, Human
ugcacgugugugcac

SEQ ID NO: 1619535 - RNA, 14 nt, Human
ugcacgugugugca

SEQ ID NO: 1619536 - RNA, 10 nt, Human
ugcacacauu

SEQ ID NO: 1619537 - RNA, 20 nt, Human
ugcacacauuuuuuaaaugc

SEQ ID NO: 1619538 - RNA, 19 nt, Human
ugcuaucucccccagcccc

SEQ ID NO: 1619539 - RNA, 20 nt, Human
ugcuaucucccccagcccca

SEQ ID NO: 1619540 - RNA, 14 nt, Human
ugcucauggaauug

SEQ ID NO: 1619541 - RNA, 14 nt, Human
ugcucuggacaggc

SEQ ID NO: 1619542 - RNA, 16 nt, Human
ugcucuggacaggcau

SEQ ID NO: 1619543 - RNA, 15 nt, Human
ugcucuggacaggca

SEQ ID NO: 1619544 - RNA, 17 nt, Human
ugcucuggacaggcaug

SEQ ID NO: 1619545 - RNA, 19 nt, Human
ugcugacuguacuccuccc

SEQ ID NO: 1619546 - RNA, 16 nt, Human
ugcugacuguacuccu

SEQ ID NO: 1619547 - RNA, 12 nt, Human
aggaaauauuua

SEQ ID NO: 1619548 - RNA, 16 nt, Human
aggaaaggcuccagga

SEQ ID NO: 1619549 - RNA, 15 nt, Human
aggaaaggcuccagg

SEQ ID NO: 1619550 - RNA, 14 nt, Human
aggaaaggcuccag

SEQ ID NO: 1619551 - RNA, 13 nt, Human
aggaaaggcucca

SEQ ID NO: 1619552 - RNA, 16 nt, Human
ugcugacuguuuucuc

SEQ ID NO: 1619553 - RNA, 22 nt, Human
ugcugacuguacuccucccagg

SEQ ID NO: 1619554 - RNA, 21 nt, Human
ugcugacuguacuccucccag

SEQ ID NO: 1619555 - RNA, 13 nt, Human
aggaaauauuuau

SEQ ID NO: 1619556 - RNA, 19 nt, Human
aggaaaucaccgaaaacgu

SEQ ID NO: 1619557 - RNA, 15 nt, Human
aggaaaucaccgaaa

SEQ ID NO: 1619558 - RNA, 17 nt, Human
aggaagcacaugccucu

SEQ ID NO: 1619559 - RNA, 16 nt, Human
aggaagcacaugccuc

SEQ ID NO: 1619560 - RNA, 11 nt, Human
aggaagcacau

SEQ ID NO: 1619561 - RNA, 14 nt, Human
aggaaauccagggu

SEQ ID NO: 1619562 - RNA, 22 nt, Human
aggaaggaaacccagcucuggu

SEQ ID NO: 1619563 - RNA, 20 nt, Human
aggaaggaaacccagcucug

SEQ ID NO: 1619564 - RNA, 23 nt, Human
aggaaggaaacccagcucugguc

SEQ ID NO: 1619565 - RNA, 12 nt, Human
aggaagcucagg

SEQ ID NO: 1619566 - RNA, 21 nt, Human
aggaagccugauuaaagaaug

SEQ ID NO: 1619567 - RNA, 18 nt, Human
aggaagccugauuaaaga

SEQ ID NO: 1619568 - RNA, 17 nt, Human
aggaagccugauuaaag

SEQ ID NO: 1619569 - RNA, 23 nt, Human
aggaagccagcaggcucucaggc

SEQ ID NO: 1619570 - RNA, 22 nt, Human
aggaagccagcaggcucucagg

SEQ ID NO: 1619571 - RNA, 21 nt, Human
aggaagccagcaggcucucag

SEQ ID NO: 1619572 - RNA, 22 nt, Human
aggaagcacaugccucucucag

SEQ ID NO: 1619573 - RNA, 15 nt, Human
aggaaauccagggug

SEQ ID NO: 1619574 - RNA, 20 nt, Human
aggaagccgcuggggccagu

SEQ ID NO: 1619575 - RNA, 19 nt, Human
aggaagccgcuggggccag

SEQ ID NO: 1619576 - RNA, 18 nt, Human
aggaagccgcuggggcca

SEQ ID NO: 1619577 - RNA, 23 nt, Human
ugcuguauuuuaaaagaaugauu

SEQ ID NO: 1619578 - RNA, 17 nt, Human
ugcugucccuuacguga

SEQ ID NO: 1619579 - RNA, 15 nt, Human
ugcugucccuuuucc

SEQ ID NO: 1619580 - RNA, 19 nt, Human
ugcugucccuuacgugagu

SEQ ID NO: 1619581 - RNA, 17 nt, Human
ugcugucccuuuuccuu

SEQ ID NO: 1619582 - RNA, 13 nt, Human
ugcugugcaaaug

SEQ ID NO: 1619583 - RNA, 23 nt, Human
ugcuucaaggauccugagccaga

SEQ ID NO: 1619584 - RNA, 21 nt, Human
ugcuucaaggauccugagcca

SEQ ID NO: 1619585 - RNA, 12 nt, Human
ugcuucaaggau

SEQ ID NO: 1619586 - RNA, 19 nt, Human
aggacacuaaccacgcugg

SEQ ID NO: 1619587 - RNA, 17 nt, Human
aggacagccccuccucc

SEQ ID NO: 1619588 - RNA, 18 nt, Human
aggacacuaaccacgcug

SEQ ID NO: 1619589 - RNA, 16 nt, Human
ugcuuccagugaggcu

SEQ ID NO: 1619590 - RNA, 13 nt, Human
ugcuguauuuuaa

SEQ ID NO: 1619591 - RNA, 22 nt, Human
ugcuguauuuuaaaagaaugau

SEQ ID NO: 1619592 - RNA, 21 nt, Human
ugcuguauuuuaaaagaauga

SEQ ID NO: 1619593 - RNA, 17 nt, Human
ugcugggauuacaggug

SEQ ID NO: 1619594 - RNA, 21 nt, Human
ugcugggauuacaagcgugag

SEQ ID NO: 1619595 - RNA, 21 nt, Human
ugcuggcuguuggcugggggc

SEQ ID NO: 1619596 - RNA, 19 nt, Human
ugcuggcuguuggcugggg

SEQ ID NO: 1619597 - RNA, 19 nt, Human
ugcugggauuacaagcgug

SEQ ID NO: 1619598 - RNA, 13 nt, Human
ugcuggcugccuu

SEQ ID NO: 1619599 - RNA, 21 nt, Human
ugcugcccugcccaccuggcc

SEQ ID NO: 1619600 - RNA, 19 nt, Human
ugcugcccugcccaccugg

SEQ ID NO: 1619601 - RNA, 11 nt, Human
ugcugcccugu

SEQ ID NO: 1619602 - RNA, 12 nt, Human
ugcugcccugug

SEQ ID NO: 1619603 - RNA, 18 nt, Human
ugcugcccugcccaccug

SEQ ID NO: 1619604 - RNA, 17 nt, Human
ugcugcccugcccaccu

SEQ ID NO: 1619605 - RNA, 16 nt, Human
ugcugcccugcccacc

SEQ ID NO: 1619606 - RNA, 13 nt, Human
ugcugcccugccc

SEQ ID NO: 1619607 - RNA, 23 nt, Human
aggaauggagccugcacggugaa

SEQ ID NO: 1619608 - RNA, 17 nt, Human
agcuugaaacugagaug

SEQ ID NO: 1619609 - RNA, 19 nt, Human
agcuugaccgugaggccag

SEQ ID NO: 1619610 - RNA, 18 nt, Human
agcuuguaaauagcucag

SEQ ID NO: 1619611 - RNA, 22 nt, Human
agcuugaggguugggcuggugu

SEQ ID NO: 1619612 - RNA, 18 nt, Human
agcuugaggguugggcug

SEQ ID NO: 1619613 - RNA, 14 nt, Human
agcuugaggguugg

SEQ ID NO: 1619614 - RNA, 19 nt, Human
ugcuacaaaaacacagcaa

SEQ ID NO: 1619615 - RNA, 18 nt, Human
ugcuacaaaaacacagca

SEQ ID NO: 1619616 - RNA, 17 nt, Human
ugcuacaaaaacacagc

SEQ ID NO: 1619617 - RNA, 16 nt, Human
ugcuacaaaaacacag

SEQ ID NO: 1619618 - RNA, 22 nt, Human
ugcuaaggacuuguuagaucua

SEQ ID NO: 1619619 - RNA, 18 nt, Human
ugcuaaggacuuguuaga

SEQ ID NO: 1619620 - RNA, 13 nt, Human
ugcuaaggacuug

SEQ ID NO: 1619621 - RNA, 20 nt, Human
ugcuacaaaaacacagcaag

SEQ ID NO: 1619622 - RNA, 11 nt, Human
ugcuacacacu

SEQ ID NO: 1619623 - RNA, 19 nt, Human
ugcggccuuuggcuucacg

SEQ ID NO: 1619624 - RNA, 17 nt, Human
ugcggccuuuggcuuca

SEQ ID NO: 1619625 - RNA, 20 nt, Human
ugcgggcuuccuccuggugu

SEQ ID NO: 1619626 - RNA, 17 nt, Human
ugcggugcuaucucccc

SEQ ID NO: 1619627 - RNA, 21 nt, Human
ugcggugcuaucucccccagc

SEQ ID NO: 1619628 - RNA, 12 nt, Human
ugcuaaggacuu

SEQ ID NO: 1619629 - RNA, 18 nt, Human
ugcgguccacccaggagc

SEQ ID NO: 1619630 - RNA, 16 nt, Human
ugcgggucacaggagg

SEQ ID NO: 1619631 - RNA, 14 nt, Human
ugcgggucacagga

SEQ ID NO: 1619632 - RNA, 17 nt, Human
ugcgggucacaggaggg

SEQ ID NO: 1619633 - RNA, 23 nt, Human
ugcggacagccacggccaggcca

SEQ ID NO: 1619634 - RNA, 22 nt, Human
ugcggacagccacggccaggcc

SEQ ID NO: 1619635 - RNA, 16 nt, Human
agcugccuccccuccu

SEQ ID NO: 1619636 - RNA, 17 nt, Human
agcugccuccccuccuc

SEQ ID NO: 1619637 - RNA, 20 nt, Human
agcugccuguucagcuccag

SEQ ID NO: 1619638 - RNA, 15 nt, Human
agcugccuccccucc

SEQ ID NO: 1619639 - RNA, 22 nt, Human
agcugcccucuccugggcagcu

SEQ ID NO: 1619640 - RNA, 15 nt, Human
ugccuggauggggcu

SEQ ID NO: 1619641 - RNA, 14 nt, Human
ugccuggauggggc

SEQ ID NO: 1619642 - RNA, 22 nt, Human
agcugccuguucagcuccagcu

SEQ ID NO: 1619643 - RNA, 21 nt, Human
agcugccuguucagcuccagc

SEQ ID NO: 1619644 - RNA, 21 nt, Human
agcugcuugggcuucauccuc

SEQ ID NO: 1619645 - RNA, 22 nt, Human
agcugcuuuugucuaugggacu

SEQ ID NO: 1619646 - RNA, 21 nt, Human
agcugcuuuugucuaugggac

SEQ ID NO: 1619647 - RNA, 22 nt, Human
agcuggaucuccauucucucag

SEQ ID NO: 1619648 - RNA, 15 nt, Human
ugccucugccucuga

SEQ ID NO: 1619649 - RNA, 14 nt, Human
ugccucugccucug

SEQ ID NO: 1619650 - RNA, 13 nt, Human
ugccucugccucu

SEQ ID NO: 1619651 - RNA, 14 nt, Human
ugcccaggcagguc

SEQ ID NO: 1619652 - RNA, 13 nt, Human
ugcccaggcaggu

SEQ ID NO: 1619653 - RNA, 12 nt, Human
ugcccaggcagg

SEQ ID NO: 1619654 - RNA, 16 nt, Human
ugccugcccaggcccc

SEQ ID NO: 1619655 - RNA, 15 nt, Human
ugccugcccaggccc

SEQ ID NO: 1619656 - RNA, 14 nt, Human
ugccugcccaggcc

SEQ ID NO: 1619657 - RNA, 15 nt, Human
ugccugcccuauucu

SEQ ID NO: 1619658 - RNA, 19 nt, Human
agcuguucacagccagacu

SEQ ID NO: 1619659 - RNA, 16 nt, Human
agcuguucacagccag

SEQ ID NO: 1619660 - RNA, 14 nt, Human
agcuguuacugucu

SEQ ID NO: 1619661 - RNA, 20 nt, Human
ugccuguucagcuccagcuc

SEQ ID NO: 1619662 - RNA, 18 nt, Human
ugccuguucagcuccagc

SEQ ID NO: 1619663 - RNA, 14 nt, Human
agcuguucagcugg

SEQ ID NO: 1619664 - RNA, 13 nt, Human
agcuguucagcug

SEQ ID NO: 1619665 - RNA, 16 nt, Human
ugccuuauggaacacu

SEQ ID NO: 1619666 - RNA, 15 nt, Human
ugccuuauggaacac

SEQ ID NO: 1619667 - RNA, 21 nt, Human
ugccuguucagcuccagcuca

SEQ ID NO: 1619668 - RNA, 20 nt, Human
ugccuguugggccaggagcc

SEQ ID NO: 1619669 - RNA, 15 nt, Human
agcugggacuacagg

SEQ ID NO: 1619670 - RNA, 20 nt, Human
agcugugcucuggacaggca

SEQ ID NO: 1619671 - RNA, 23 nt, Human
agcugugcucuggacaggcaugu

SEQ ID NO: 1619672 - RNA, 21 nt, Human
agcugugcucuggacaggcau

SEQ ID NO: 1619673 - RNA, 16 nt, Human
agcuguguggcagucu

SEQ ID NO: 1619674 - RNA, 14 nt, Human
agcuguguggcagu

SEQ ID NO: 1619675 - RNA, 22 nt, Human
uggcauaacauaaaucugugaa

SEQ ID NO: 1619676 - RNA, 21 nt, Human
uggcauaacauaaaucuguga

SEQ ID NO: 1619677 - RNA, 17 nt, Human
aggccccgcccaggcuu

SEQ ID NO: 1619678 - RNA, 12 nt, Human
aggccccugcca

SEQ ID NO: 1619679 - RNA, 23 nt, Human
uggccagugugacaaggauugcu

SEQ ID NO: 1619680 - RNA, 19 nt, Human
uggccagguggccacucca

SEQ ID NO: 1619681 - RNA, 17 nt, Human
uggccagguggccacuc

SEQ ID NO: 1619682 - RNA, 16 nt, Human
uggccagguggccacu

SEQ ID NO: 1619683 - RNA, 23 nt, Human
uggccaaagccaaagcuaggccu

SEQ ID NO: 1619684 - RNA, 21 nt, Human
uggccaaagccaaagcuaggc

SEQ ID NO: 1619685 - RNA, 15 nt, Human
uggccagguggccac

SEQ ID NO: 1619686 - RNA, 11 nt, Human
uggccaggugg

SEQ ID NO: 1619687 - RNA, 14 nt, Human
uggccuucggccuc

SEQ ID NO: 1619688 - RNA, 18 nt, Human
aggccugggggcugggca

SEQ ID NO: 1619689 - RNA, 12 nt, Human
aggccuggggac

SEQ ID NO: 1619690 - RNA, 20 nt, Human
aggccugggggcugggcaga

SEQ ID NO: 1619691 - RNA, 21 nt, Human
uggccuggccccucagggucc

SEQ ID NO: 1619692 - RNA, 18 nt, Human
uggccuggccccucaggg

SEQ ID NO: 1619693 - RNA, 18 nt, Human
uggccugagcugggauga

SEQ ID NO: 1619694 - RNA, 13 nt, Human
uggcccacgcacu

SEQ ID NO: 1619695 - RNA, 14 nt, Human
uggcccugcccugg

SEQ ID NO: 1619696 - RNA, 13 nt, Human
uggccucuucaga

SEQ ID NO: 1619697 - RNA, 20 nt, Human
uggcacaguuuucugagaaa

SEQ ID NO: 1619698 - RNA, 19 nt, Human
uggcacaguuuucugagaa

SEQ ID NO: 1619699 - RNA, 18 nt, Human
uggcacaguuuucugaga

SEQ ID NO: 1619700 - RNA, 18 nt, Human
uggcacagggcaguggga

SEQ ID NO: 1619701 - RNA, 14 nt, Human
aggccagagggagu

SEQ ID NO: 1619702 - RNA, 19 nt, Human
aggccacaagacccuugug

SEQ ID NO: 1619703 - RNA, 18 nt, Human
aggccacaagacccuugu

SEQ ID NO: 1619704 - RNA, 17 nt, Human
aggccacaagacccuug

SEQ ID NO: 1619705 - RNA, 19 nt, Human
uggcagcucaccucucccu

SEQ ID NO: 1619706 - RNA, 15 nt, Human
uggcagcucaccucu

SEQ ID NO: 1619707 - RNA, 17 nt, Human
uggcagccuuggcaaac

SEQ ID NO: 1619708 - RNA, 21 nt, Human
aggcccagagggccugcaagg

SEQ ID NO: 1619709 - RNA, 20 nt, Human
aggccagagggagugacaga

SEQ ID NO: 1619710 - RNA, 16 nt, Human
aggccccgcccaggcu

SEQ ID NO: 1619711 - RNA, 20 nt, Human
uggagguacgaaaagagggg

SEQ ID NO: 1619712 - RNA, 18 nt, Human
aggccaaggugggaggau

SEQ ID NO: 1619713 - RNA, 16 nt, Human
aggccaaggugggagg

SEQ ID NO: 1619714 - RNA, 20 nt, Human
aggccaaaggaagcacaugc

SEQ ID NO: 1619715 - RNA, 19 nt, Human
aggccaaaggaagcacaug

SEQ ID NO: 1619716 - RNA, 18 nt, Human
aggccaaaggaagcacau

SEQ ID NO: 1619717 - RNA, 16 nt, Human
aggccaaaggaagcac

SEQ ID NO: 1619718 - RNA, 17 nt, Human
aggcagccccauucugc

SEQ ID NO: 1619719 - RNA, 16 nt, Human
aggcagccccauucug

SEQ ID NO: 1619720 - RNA, 14 nt, Human
uggaguauauguca

SEQ ID NO: 1619721 - RNA, 15 nt, Human
uggauggaaggggcu

SEQ ID NO: 1619722 - RNA, 13 nt, Human
uggauuguccccg

SEQ ID NO: 1619723 - RNA, 21 nt, Human
uggauuguccccgacccuugc

SEQ ID NO: 1619724 - RNA, 17 nt, Human
uggauuauauuaugaag

SEQ ID NO: 1619725 - RNA, 13 nt, Human
uggagaagaacug

SEQ ID NO: 1619726 - RNA, 14 nt, Human
uggagaacuagaga

SEQ ID NO: 1619727 - RNA, 15 nt, Human
uggacugugugcuca

SEQ ID NO: 1619728 - RNA, 14 nt, Human
uggagaagaacuga

SEQ ID NO: 1619729 - RNA, 22 nt, Human
uggagaagcggcuggcagccca

SEQ ID NO: 1619730 - RNA, 13 nt, Human
uggagaagcggcu

SEQ ID NO: 1619731 - RNA, 14 nt, Human
uggagcucguggaa

SEQ ID NO: 1619732 - RNA, 13 nt, Human
aggcaaucauggu

SEQ ID NO: 1619733 - RNA, 22 nt, Human
aggcacccaccaucaugucugg

SEQ ID NO: 1619734 - RNA, 21 nt, Human
aggcacccaccaucaugucug

SEQ ID NO: 1619735 - RNA, 20 nt, Human
aggcacccaccaucaugucu

SEQ ID NO: 1619736 - RNA, 14 nt, Human
aggcaaugcuggcu

SEQ ID NO: 1619737 - RNA, 20 nt, Human
aggcaccuaccaccacgccc

SEQ ID NO: 1619738 - RNA, 18 nt, Human
aggaucucuugagccugg

SEQ ID NO: 1619739 - RNA, 17 nt, Human
aggaucucuugagccug

SEQ ID NO: 1619740 - RNA, 19 nt, Human
aggaucucuugagccuggg

SEQ ID NO: 1619741 - RNA, 14 nt, Human
uggacacagcucuu

SEQ ID NO: 1619742 - RNA, 13 nt, Human
uggacacagcucu

SEQ ID NO: 1619743 - RNA, 22 nt, Human
uggacacagcucuucuccaggc

SEQ ID NO: 1619744 - RNA, 23 nt, Human
uggacccuguggaugauaaaaca

SEQ ID NO: 1619745 - RNA, 21 nt, Human
uggacccugaggcccagaggg

SEQ ID NO: 1619746 - RNA, 20 nt, Human
uggacccugaggcccagagg

SEQ ID NO: 1619747 - RNA, 19 nt, Human
uggacccugaggcccagag

SEQ ID NO: 1619748 - RNA, 18 nt, Human
uggacccugaggcccaga

SEQ ID NO: 1619749 - RNA, 16 nt, Human
uggacccugaggccca

SEQ ID NO: 1619750 - RNA, 23 nt, Human
uggacacagcucuucuccaggcu

SEQ ID NO: 1619751 - RNA, 20 nt, Human
uggaccuugaacuggguacu

SEQ ID NO: 1619752 - RNA, 16 nt, Human
uggacuguggugacuu

SEQ ID NO: 1619753 - RNA, 15 nt, Human
uggacuguggugacu

SEQ ID NO: 1619754 - RNA, 22 nt, Human
uggacuguggugacuuuggaua

SEQ ID NO: 1619755 - RNA, 21 nt, Human
uggacuguggugacuuuggau

SEQ ID NO: 1619756 - RNA, 19 nt, Human
uggacuguggugacuuugg

SEQ ID NO: 1619757 - RNA, 17 nt, Human
uggacuguggugacuuu

SEQ ID NO: 1619758 - RNA, 23 nt, Human
aggacagcccuucuuuccacaga

SEQ ID NO: 1619759 - RNA, 21 nt, Human
ugcuugaggcaacucaucuua

SEQ ID NO: 1619760 - RNA, 16 nt, Human
ugcuuggaggaaggaa

SEQ ID NO: 1619761 - RNA, 15 nt, Human
ugcuuggaggaagga

SEQ ID NO: 1619762 - RNA, 14 nt, Human
ugcuuggaggaagg

SEQ ID NO: 1619763 - RNA, 12 nt, Human
ugcuuguacaua

SEQ ID NO: 1619764 - RNA, 13 nt, Human
ugcuuguacauaa

SEQ ID NO: 1619765 - RNA, 17 nt, Human
ugcuuuuggucugugug

SEQ ID NO: 1619766 - RNA, 14 nt, Human
ugcuuuuggucugu

SEQ ID NO: 1619767 - RNA, 17 nt, Human
ugcuuugugauuuuugu

SEQ ID NO: 1619768 - RNA, 14 nt, Human
ugcuuguacauaau

SEQ ID NO: 1619769 - RNA, 16 nt, Human
ugcuuguacauaaugc

SEQ ID NO: 1619770 - RNA, 22 nt, Human
ugcuuguacauaaugcgugcau

SEQ ID NO: 1619771 - RNA, 12 nt, Human
ugcuuugugauu

SEQ ID NO: 1619772 - RNA, 14 nt, Human
ugcuuugugauuuu

SEQ ID NO: 1619773 - RNA, 16 nt, Human
ugcuuugugauuuuug

SEQ ID NO: 1619774 - RNA, 14 nt, Human
aggauccugagcca

SEQ ID NO: 1619775 - RNA, 13 nt, Human
aggauccugagcc

SEQ ID NO: 1619776 - RNA, 16 nt, Human
uggaagcacagcuuca

SEQ ID NO: 1619777 - RNA, 18 nt, Human
uggaaaugggcagagcag

SEQ ID NO: 1619778 - RNA, 17 nt, Human
uggaaaugggcagagca

SEQ ID NO: 1619779 - RNA, 15 nt, Human
uggaaaucuuuaaaa

SEQ ID NO: 1619780 - RNA, 14 nt, Human
uggaaaucuuuaaa

SEQ ID NO: 1619781 - RNA, 18 nt, Human
uggaaguacuauaauuua

SEQ ID NO: 1619782 - RNA, 17 nt, Human
uggaagguauuuaauag

SEQ ID NO: 1619783 - RNA, 13 nt, Human
uggaagguauuua

SEQ ID NO: 1619784 - RNA, 23 nt, Human
uggaaggggacacgugacagccg

SEQ ID NO: 1619785 - RNA, 12 nt, Human
aggucagagccu

SEQ ID NO: 1619786 - RNA, 17 nt, Human
aggucauuuuuuuuaag

SEQ ID NO: 1619787 - RNA, 20 nt, Human
aggucauuuuuuuuaagaaa

SEQ ID NO: 1619788 - RNA, 18 nt, Human
aggucaccuuuauucugg

SEQ ID NO: 1619789 - RNA, 19 nt, Human
aggucaccuuuauucuggc

SEQ ID NO: 1619790 - RNA, 23 nt, Human
agguacuucaaauccuugaagau

SEQ ID NO: 1619791 - RNA, 19 nt, Human
agguagaaauaucugaaaa

SEQ ID NO: 1619792 - RNA, 17 nt, Human
agguagaaauaucugaa

SEQ ID NO: 1619793 - RNA, 23 nt, Human
aggguuggccccugcccggcugc

SEQ ID NO: 1619794 - RNA, 18 nt, Human
aggguuggccccugcccg

SEQ ID NO: 1619795 - RNA, 13 nt, Human
aggguugggcugg

SEQ ID NO: 1619796 - RNA, 23 nt, Human
agguagaaauaucugaaaaugua

SEQ ID NO: 1619797 - RNA, 21 nt, Human
agguaugcaaucaaaucugcu

SEQ ID NO: 1619798 - RNA, 23 nt, Human
agguauaauucacauuguauuca

SEQ ID NO: 1619799 - RNA, 20 nt, Human
agguauaaguggugugugua

SEQ ID NO: 1619800 - RNA, 19 nt, Human
agguauaaguggugugugu

SEQ ID NO: 1619801 - RNA, 17 nt, Human
aggguuaugauuaagua

SEQ ID NO: 1619802 - RNA, 13 nt, Human
aggguuauaauaa

SEQ ID NO: 1619803 - RNA, 22 nt, Human
aggguguccggucccuguccca

SEQ ID NO: 1619804 - RNA, 18 nt, Human
uggucugacccacugcuu

SEQ ID NO: 1619805 - RNA, 17 nt, Human
uggucugacccacugcu

SEQ ID NO: 1619806 - RNA, 16 nt, Human
uggucugacccacugc

SEQ ID NO: 1619807 - RNA, 15 nt, Human
uggucucgaacuccu

SEQ ID NO: 1619808 - RNA, 20 nt, Human
uggucaccaaaucagcugcu

SEQ ID NO: 1619809 - RNA, 22 nt, Human
uggucagauuugaacucuucaa

SEQ ID NO: 1619810 - RNA, 18 nt, Human
uggucaccaaaucagcug

SEQ ID NO: 1619811 - RNA, 15 nt, Human
uggucccaccccaca

SEQ ID NO: 1619812 - RNA, 14 nt, Human
uggucccaccccac

SEQ ID NO: 1619813 - RNA, 13 nt, Human
uggucccacucag

SEQ ID NO: 1619814 - RNA, 16 nt, Human
uggucccaccccacac

SEQ ID NO: 1619815 - RNA, 16 nt, Human
uggucucaaacucuug

SEQ ID NO: 1619816 - RNA, 19 nt, Human
uggucuaucuuugagcgcc

SEQ ID NO: 1619817 - RNA, 23 nt, Human
uggucucaaacucuugaccucag

SEQ ID NO: 1619818 - RNA, 17 nt, Human
uggucucaaacucuuga

SEQ ID NO: 1619819 - RNA, 20 nt, Human
ugguaaggggaauugaggac

SEQ ID NO: 1619820 - RNA, 16 nt, Human
ugguacuaacuuuccu

SEQ ID NO: 1619821 - RNA, 20 nt, Human
ugguagcuuuucccuucuuu

SEQ ID NO: 1619822 - RNA, 21 nt, Human
ugguagcuuuucccuucuuuu

SEQ ID NO: 1619823 - RNA, 23 nt, Human
uggucacaggacucugccuccuc

SEQ ID NO: 1619824 - RNA, 22 nt, Human
uggucacaggacucugccuccu

SEQ ID NO: 1619825 - RNA, 19 nt, Human
ugggugcuuggaggaagga

SEQ ID NO: 1619826 - RNA, 15 nt, Human
ugggugcuuggagga

SEQ ID NO: 1619827 - RNA, 22 nt, Human
ugggugcuuggaggaaggaaac

SEQ ID NO: 1619828 - RNA, 15 nt, Human
agggugggagugggc

SEQ ID NO: 1619829 - RNA, 21 nt, Human
ugggucgcccuggacugugug

SEQ ID NO: 1619830 - RNA, 22 nt, Human
agggucucacucugucgcccag

SEQ ID NO: 1619831 - RNA, 23 nt, Human
agggucucacuauguugcccagg

SEQ ID NO: 1619832 - RNA, 22 nt, Human
agggucucacuauguugcccag

SEQ ID NO: 1619833 - RNA, 21 nt, Human
agggucucacuauguugccca

SEQ ID NO: 1619834 - RNA, 24 nt, Human
agggguucccuuuuuuggcugcug

SEQ ID NO: 1619835 - RNA, 18 nt, Human
aggggguggccucccaac

SEQ ID NO: 1619836 - RNA, 17 nt, Human
aggggguggccucccaa

SEQ ID NO: 1619837 - RNA, 15 nt, Human
aggggguggccuccc

SEQ ID NO: 1619838 - RNA, 22 nt, Human
aggggugggacacccugugaug

SEQ ID NO: 1619839 - RNA, 20 nt, Human
aggggugggacacccuguga

SEQ ID NO: 1619840 - RNA, 23 nt, Human
aggggagcaaaaucgaugcagug

SEQ ID NO: 1619841 - RNA, 23 nt, Human
aggggccuggcagccgugccuuc

SEQ ID NO: 1619842 - RNA, 18 nt, Human
aggggccuggcagccgug

SEQ ID NO: 1619843 - RNA, 19 nt, Human
uggggucacucuggcagcu

SEQ ID NO: 1619844 - RNA, 20 nt, Human
uggggucacucuggcagcuc

SEQ ID NO: 1619845 - RNA, 17 nt, Human
agggcagggacaggaua

SEQ ID NO: 1619846 - RNA, 23 nt, Human
agggcccagagaggguggugacc

SEQ ID NO: 1619847 - RNA, 15 nt, Human
agggagggcuucugc

SEQ ID NO: 1619848 - RNA, 19 nt, Human
agggagugacagaggcagc

SEQ ID NO: 1619849 - RNA, 20 nt, Human
agggagugacagaggcagcc

SEQ ID NO: 1619850 - RNA, 18 nt, Human
agggagugacagaggcag

SEQ ID NO: 1619851 - RNA, 17 nt, Human
agggagugacagaggca

SEQ ID NO: 1619852 - RNA, 17 nt, Human
agggaggugaccccagg

SEQ ID NO: 1619853 - RNA, 14 nt, Human
ugggaguacaaaag

SEQ ID NO: 1619854 - RNA, 16 nt, Human
ugggcaacccccagcc

SEQ ID NO: 1619855 - RNA, 16 nt, Human
ugggauuuggucaaca

SEQ ID NO: 1619856 - RNA, 23 nt, Human
ugggaggucaaggcugcagugag

SEQ ID NO: 1619857 - RNA, 20 nt, Human
ugggaggucaaggcugcagu

SEQ ID NO: 1619858 - RNA, 19 nt, Human
ugggaggucaaggcugcag

SEQ ID NO: 1619859 - RNA, 18 nt, Human
ugggaggucaaggcugca

SEQ ID NO: 1619860 - RNA, 16 nt, Human
ugggccaggagccucc

SEQ ID NO: 1619861 - RNA, 14 nt, Human
ugggccaggagccu

SEQ ID NO: 1619862 - RNA, 20 nt, Human
ugggcccaaugcacuuuguu

SEQ ID NO: 1619863 - RNA, 13 nt, Human
ugggccaggagcc

SEQ ID NO: 1619864 - RNA, 18 nt, Human
ugggccagaauuucaaac

SEQ ID NO: 1619865 - RNA, 21 nt, Human
ugggcaacccccagccugcua

SEQ ID NO: 1619866 - RNA, 20 nt, Human
ugggcaacccccagccugcu

SEQ ID NO: 1619867 - RNA, 17 nt, Human
ugggcaacccccagccu

SEQ ID NO: 1619868 - RNA, 17 nt, Human
ugggccagaauuucaaa

SEQ ID NO: 1619869 - RNA, 20 nt, Human
uggggcugcaccggcuggcc

SEQ ID NO: 1619870 - RNA, 22 nt, Human
uggggcugcaccggcuggccug

SEQ ID NO: 1619871 - RNA, 14 nt, Human
ugggguacccacug

SEQ ID NO: 1619872 - RNA, 15 nt, Human
ugggguaugggagag

SEQ ID NO: 1619873 - RNA, 18 nt, Human
uggggucacucuggcagc

SEQ ID NO: 1619874 - RNA, 17 nt, Human
uggggucacucuggcag

SEQ ID NO: 1619875 - RNA, 16 nt, Human
ugggguacccacugcu

SEQ ID NO: 1619876 - RNA, 15 nt, Human
ugggguacccacugc

SEQ ID NO: 1619877 - RNA, 18 nt, Human
uggggcggugagagggga

SEQ ID NO: 1619878 - RNA, 23 nt, Human
uggggcuaggaaauccagggugg

SEQ ID NO: 1619879 - RNA, 16 nt, Human
uggggcccugccuccu

SEQ ID NO: 1619880 - RNA, 15 nt, Human
uggggcccugccucc

SEQ ID NO: 1619881 - RNA, 23 nt, Human
uggggaccucaggccugggggcu

SEQ ID NO: 1619882 - RNA, 12 nt, Human
uggggagaaagu

SEQ ID NO: 1619883 - RNA, 14 nt, Human
uggggcccugccuc

SEQ ID NO: 1619884 - RNA, 19 nt, Human
ugggcucccuucccaccuc

SEQ ID NO: 1619885 - RNA, 18 nt, Human
ugggcucccuucccaccu

SEQ ID NO: 1619886 - RNA, 23 nt, Human
agggcuucugccauuucugagau

SEQ ID NO: 1619887 - RNA, 21 nt, Human
ugggcucccuucccaccucuc

SEQ ID NO: 1619888 - RNA, 20 nt, Human
ugggcucccuucccaccucu

SEQ ID NO: 1619889 - RNA, 21 nt, Human
ugggcugcccuggugcugcca

SEQ ID NO: 1619890 - RNA, 20 nt, Human
ugggcugcccuggugcugcc

SEQ ID NO: 1619891 - RNA, 19 nt, Human
ugggcugcccuggugcugc

SEQ ID NO: 1619892 - RNA, 17 nt, Human
ugggcugcccuggugcu

SEQ ID NO: 1619893 - RNA, 15 nt, Human
uggggaccagagcug

SEQ ID NO: 1619894 - RNA, 14 nt, Human
uggggaccagagcu

SEQ ID NO: 1619895 - RNA, 17 nt, Human
uggggacagagcagaac

SEQ ID NO: 1619896 - RNA, 18 nt, Human
uggggaccagagcugcca

SEQ ID NO: 1619897 - RNA, 17 nt, Human
uggggaccagagcugcc

SEQ ID NO: 1619898 - RNA, 13 nt, Human
uggggaccucagg

SEQ ID NO: 1619899 - RNA, 19 nt, Human
ugggcuggguucuacccag

SEQ ID NO: 1619900 - RNA, 18 nt, Human
ugggcuggguucuaccca

SEQ ID NO: 1619901 - RNA, 23 nt, Human
ugggcuggguucuacccaggugc

SEQ ID NO: 1619902 - RNA, 15 nt, Human
uggggaaugaagaua

SEQ ID NO: 1619903 - RNA, 14 nt, Human
uggggaaugaagau

SEQ ID NO: 1619904 - RNA, 12 nt, Human
aguagagacagg

SEQ ID NO: 1619905 - RNA, 17 nt, Human
aguagaagucuuagaug

SEQ ID NO: 1619906 - RNA, 19 nt, Human
aguagauaggccaugggca

SEQ ID NO: 1619907 - RNA, 20 nt, Human
uguaggaagguuaauguuca

SEQ ID NO: 1619908 - RNA, 16 nt, Human
aguacacuguuucaaa

SEQ ID NO: 1619909 - RNA, 20 nt, Human
aguacacuguuucaaacuuu

SEQ ID NO: 1619910 - RNA, 14 nt, Human
aguacacuguuuca

SEQ ID NO: 1619911 - RNA, 19 nt, Human
aguacuuuuggcauuuuac

SEQ ID NO: 1619912 - RNA, 21 nt, Human
aguaauccaagcaaaugugaa

SEQ ID NO: 1619913 - RNA, 15 nt, Human
aguaauccaagcaaa

SEQ ID NO: 1619914 - RNA, 18 nt, Human
uguagaggagaaacugga

SEQ ID NO: 1619915 - RNA, 17 nt, Human
uguacuuuuuggcauaa

SEQ ID NO: 1619916 - RNA, 14 nt, Human
uguagagugggagc

SEQ ID NO: 1619917 - RNA, 13 nt, Human
uguagagugggag

SEQ ID NO: 1619918 - RNA, 16 nt, Human
uguacuuuuuggcaua

SEQ ID NO: 1619919 - RNA, 15 nt, Human
uguacuuuuuggcau

SEQ ID NO: 1619920 - RNA, 12 nt, Human
uguacuuuuugg

SEQ ID NO: 1619921 - RNA, 14 nt, Human
uguaauuugugaua

SEQ ID NO: 1619922 - RNA, 15 nt, Human
aguaaaaccacagca

SEQ ID NO: 1619923 - RNA, 12 nt, Human
aguaaaaauaaa

SEQ ID NO: 1619924 - RNA, 15 nt, Human
aguaaaaauaaaauu

SEQ ID NO: 1619925 - RNA, 11 nt, Human
agguuuuccug

SEQ ID NO: 1619926 - RNA, 18 nt, Human
aguaauaugcacacauuu

SEQ ID NO: 1619927 - RNA, 19 nt, Human
aguaauaugcacacauuuu

SEQ ID NO: 1619928 - RNA, 20 nt, Human
aguaauaugcacacauuuuu

SEQ ID NO: 1619929 - RNA, 23 nt, Human
aguaaggaauuuuauuuuuuucu

SEQ ID NO: 1619930 - RNA, 14 nt, Human
agguugcagugagc

SEQ ID NO: 1619931 - RNA, 17 nt, Human
aggugguuauggagagg

SEQ ID NO: 1619932 - RNA, 17 nt, Human
uguaagaaaauaucacu

SEQ ID NO: 1619933 - RNA, 14 nt, Human
agguuggugggggc

SEQ ID NO: 1619934 - RNA, 17 nt, Human
uguaacuuucugaaaua

SEQ ID NO: 1619935 - RNA, 15 nt, Human
uguaaguaaacgguc

SEQ ID NO: 1619936 - RNA, 13 nt, Human
uguaauuauaucu

SEQ ID NO: 1619937 - RNA, 15 nt, Human
uguaauuauaucuga

SEQ ID NO: 1619938 - RNA, 14 nt, Human
uguaauuauaucug

SEQ ID NO: 1619939 - RNA, 21 nt, Human
aggugcacaagcuccaagcuc

SEQ ID NO: 1619940 - RNA, 14 nt, Human
agguggccacucca

SEQ ID NO: 1619941 - RNA, 17 nt, Human
agguggccacuccagac

SEQ ID NO: 1619942 - RNA, 20 nt, Human
aggugggauccuccaggugc

SEQ ID NO: 1619943 - RNA, 20 nt, Human
aggugcacaagcuccaagcu

SEQ ID NO: 1619944 - RNA, 18 nt, Human
aggugcacaagcuccaag

SEQ ID NO: 1619945 - RNA, 17 nt, Human
aggugcacaagcuccaa

SEQ ID NO: 1619946 - RNA, 16 nt, Human
aggugcacaagcucca

SEQ ID NO: 1619947 - RNA, 15 nt, Human
aggugcacaagcucc

SEQ ID NO: 1619948 - RNA, 22 nt, Human
uguaaaucccauuauucaaagu

SEQ ID NO: 1619949 - RNA, 20 nt, Human
uguaaaucccauuauucaaa

SEQ ID NO: 1619950 - RNA, 19 nt, Human
uguaaaucccauuauucaa

SEQ ID NO: 1619951 - RNA, 23 nt, Human
aggucuugaacuccuggccucaa

SEQ ID NO: 1619952 - RNA, 10 nt, Human
aggucccuaa

SEQ ID NO: 1619953 - RNA, 18 nt, Human
uguaaaucccauuauuca

SEQ ID NO: 1619954 - RNA, 16 nt, Human
uguaaaucccauuauu

SEQ ID NO: 1619955 - RNA, 13 nt, Human
uguaaaucccauu

SEQ ID NO: 1619956 - RNA, 15 nt, Human
aguauuucuaugaaa

SEQ ID NO: 1619957 - RNA, 13 nt, Human
aguauuucuauga

SEQ ID NO: 1619958 - RNA, 22 nt, Human
aguauuucuaugaaauauuaug

SEQ ID NO: 1619959 - RNA, 14 nt, Human
agucaccaagccca

SEQ ID NO: 1619960 - RNA, 13 nt, Human
agucaccaagccc

SEQ ID NO: 1619961 - RNA, 20 nt, Human
agucacauuccugaacagga

SEQ ID NO: 1619962 - RNA, 18 nt, Human
agucacauuccugaacag

SEQ ID NO: 1619963 - RNA, 19 nt, Human
agucacauuccugaacagg

SEQ ID NO: 1619964 - RNA, 23 nt, Human
ugucauuugcuggagcucugccc

SEQ ID NO: 1619965 - RNA, 16 nt, Human
ugucagguggggcagc

SEQ ID NO: 1619966 - RNA, 19 nt, Human
ugucagcugaaccugggua

SEQ ID NO: 1619967 - RNA, 16 nt, Human
ugucagcugaaccugg

SEQ ID NO: 1619968 - RNA, 13 nt, Human
agucacugcacag

SEQ ID NO: 1619969 - RNA, 19 nt, Human
agucacugagacagcccgg

SEQ ID NO: 1619970 - RNA, 21 nt, Human
ugucaauaaaauccauacauu

SEQ ID NO: 1619971 - RNA, 15 nt, Human
ugucaagccauaauu

SEQ ID NO: 1619972 - RNA, 19 nt, Human
ugucaagagggucugagga

SEQ ID NO: 1619973 - RNA, 16 nt, Human
uguauuuuuuuacuaa

SEQ ID NO: 1619974 - RNA, 14 nt, Human
uguauuuuuuuacu

SEQ ID NO: 1619975 - RNA, 20 nt, Human
ugucaaucagccuaguugau

SEQ ID NO: 1619976 - RNA, 16 nt, Human
aguaggaagacuuugg

SEQ ID NO: 1619977 - RNA, 22 nt, Human
aguaggaagacuuuggaaagac

SEQ ID NO: 1619978 - RNA, 19 nt, Human
aguaggaagacuuuggaaa

SEQ ID NO: 1619979 - RNA, 18 nt, Human
aguaggaagacuuuggaa

SEQ ID NO: 1619980 - RNA, 17 nt, Human
aguaggaagacuuugga

SEQ ID NO: 1619981 - RNA, 15 nt, Human
agucaggaaagagaa

SEQ ID NO: 1619982 - RNA, 16 nt, Human
agucaggaaagagaac

SEQ ID NO: 1619983 - RNA, 16 nt, Human
agucagacagaugugg

SEQ ID NO: 1619984 - RNA, 15 nt, Human
ugucgggcaugacac

SEQ ID NO: 1619985 - RNA, 14 nt, Human
ugucgggcaugaca

SEQ ID NO: 1619986 - RNA, 15 nt, Human
ugucgcccagucugg

SEQ ID NO: 1619987 - RNA, 14 nt, Human
ugucgcccagucug

SEQ ID NO: 1619988 - RNA, 12 nt, Human
ugucgggcauga

SEQ ID NO: 1619989 - RNA, 13 nt, Human
ugucgccucugca

SEQ ID NO: 1619990 - RNA, 16 nt, Human
uguccuacccacccuc

SEQ ID NO: 1619991 - RNA, 16 nt, Human
ugucgcccaggcugga

SEQ ID NO: 1619992 - RNA, 15 nt, Human
ugucgcccaggcugg

SEQ ID NO: 1619993 - RNA, 14 nt, Human
uguccgagcuuuga

SEQ ID NO: 1619994 - RNA, 13 nt, Human
uguccgagcuuug

SEQ ID NO: 1619995 - RNA, 23 nt, Human
aguccgaaagggacuuggaagcu

SEQ ID NO: 1619996 - RNA, 17 nt, Human
agucucacuguugccca

SEQ ID NO: 1619997 - RNA, 16 nt, Human
agucucacuguugccc

SEQ ID NO: 1619998 - RNA, 12 nt, Human
agucccugccaa

SEQ ID NO: 1619999 - RNA, 19 nt, Human
agucagggguucccuuuuu

SEQ ID NO: 1620000 - RNA, 17 nt, Human
agucagaucugccuaag

SEQ ID NO: 1620001 - RNA, 22 nt, Human
aguccaggcuuuuuuaucaugu

SEQ ID NO: 1620002 - RNA, 21 nt, Human
uguuaacauggacaugaucuu

SEQ ID NO: 1620003 - RNA, 19 nt, Human
uguuaaugauagcuacugu

SEQ ID NO: 1620004 - RNA, 19 nt, Human
aguggaaaaauagccugcc

SEQ ID NO: 1620005 - RNA, 18 nt, Human
aguggaaaaauagccugc

SEQ ID NO: 1620006 - RNA, 11 nt, Human
aguggaaaaau

SEQ ID NO: 1620007 - RNA, 16 nt, Human
ugugucucuugguccu

SEQ ID NO: 1620008 - RNA, 13 nt, Human
ugugucucuuggu

SEQ ID NO: 1620009 - RNA, 19 nt, Human
ugugucagguggggcagcu

SEQ ID NO: 1620010 - RNA, 17 nt, Human
ugugucagguggggcag

SEQ ID NO: 1620011 - RNA, 20 nt, Human
ugugucagguggggcagcuu

SEQ ID NO: 1620012 - RNA, 14 nt, Human
uguguuaugaagca

SEQ ID NO: 1620013 - RNA, 21 nt, Human
agugccuguaaucacagcuac

SEQ ID NO: 1620014 - RNA, 15 nt, Human
agugccuuacacaau

SEQ ID NO: 1620015 - RNA, 17 nt, Human
agugccuuacacaaugg

SEQ ID NO: 1620016 - RNA, 20 nt, Human
agugcugcauuuaaaagaua

SEQ ID NO: 1620017 - RNA, 19 nt, Human
agugcugggauuacaggug

SEQ ID NO: 1620018 - RNA, 20 nt, Human
agugcugggauuacaggcgu

SEQ ID NO: 1620019 - RNA, 22 nt, Human
agugcugcauuuaaaagauaca

SEQ ID NO: 1620020 - RNA, 20 nt, Human
agugcugggauuacaagcgu

SEQ ID NO: 1620021 - RNA, 16 nt, Human
agugcuuccaaggaug

SEQ ID NO: 1620022 - RNA, 12 nt, Human
ugugguuucauu

SEQ ID NO: 1620023 - RNA, 17 nt, Human
uguggugacuuuggaua

SEQ ID NO: 1620024 - RNA, 16 nt, Human
uguggugacuuuggau

SEQ ID NO: 1620025 - RNA, 21 nt, Human
agugcaaauugucacaggaca

SEQ ID NO: 1620026 - RNA, 18 nt, Human
agugcaaauugucacagg

SEQ ID NO: 1620027 - RNA, 21 nt, Human
agugaguugauagcacagacc

SEQ ID NO: 1620028 - RNA, 22 nt, Human
agugcaaauugucacaggacag

SEQ ID NO: 1620029 - RNA, 24 nt, Human
agugauucuccugccucagccucc

SEQ ID NO: 1620030 - RNA, 22 nt, Human
agugauucuccugccucagccu

SEQ ID NO: 1620031 - RNA, 16 nt, Human
agugagucgaggacag

SEQ ID NO: 1620032 - RNA, 14 nt, Human
agugcccacaggau

SEQ ID NO: 1620033 - RNA, 14 nt, Human
agugcaugcugucc

SEQ ID NO: 1620034 - RNA, 16 nt, Human
agugccaaaaacaaca

SEQ ID NO: 1620035 - RNA, 14 nt, Human
agugcacuaaugug

SEQ ID NO: 1620036 - RNA, 14 nt, Human
agugcaucucagcc

SEQ ID NO: 1620037 - RNA, 15 nt, Human
agugcaucucagccc

SEQ ID NO: 1620038 - RNA, 17 nt, Human
agugcaucucagcccac

SEQ ID NO: 1620039 - RNA, 16 nt, Human
agugcaucucagccca

SEQ ID NO: 1620040 - RNA, 15 nt, Human
ugugcucuggacagg

SEQ ID NO: 1620041 - RNA, 23 nt, Human
ugugcucugaucauccacugugc

SEQ ID NO: 1620042 - RNA, 22 nt, Human
ugugcucugaucauccacugug

SEQ ID NO: 1620043 - RNA, 13 nt, Human
ugugccucugccu

SEQ ID NO: 1620044 - RNA, 12 nt, Human
ugugccucugcc

SEQ ID NO: 1620045 - RNA, 20 nt, Human
ugugcccuaaaguguauuuu

SEQ ID NO: 1620046 - RNA, 21 nt, Human
ugugcccuaaaguguauuuuu

SEQ ID NO: 1620047 - RNA, 19 nt, Human
agucucacuguugcccagg

SEQ ID NO: 1620048 - RNA, 18 nt, Human
agucucacuguugcccag

SEQ ID NO: 1620049 - RNA, 20 nt, Human
agucucacuguugcccaggc

SEQ ID NO: 1620050 - RNA, 21 nt, Human
agucucacuguugcccaggcu

SEQ ID NO: 1620051 - RNA, 15 nt, Human
ugugcugcccugccc

SEQ ID NO: 1620052 - RNA, 14 nt, Human
ugugcugcccugcc

SEQ ID NO: 1620053 - RNA, 13 nt, Human
ugugcugcccugc

SEQ ID NO: 1620054 - RNA, 19 nt, Human
ugugcucuggacaggcaug

SEQ ID NO: 1620055 - RNA, 18 nt, Human
ugugcucuggacaggcau

SEQ ID NO: 1620056 - RNA, 16 nt, Human
ugugcucuggacaggc

SEQ ID NO: 1620057 - RNA, 16 nt, Human
uguugucugcaacucu

SEQ ID NO: 1620058 - RNA, 13 nt, Human
uguugucugcaac

SEQ ID NO: 1620059 - RNA, 17 nt, Human
uguuuauugucaaagug

SEQ ID NO: 1620060 - RNA, 14 nt, Human
uguuuauugucaaa

SEQ ID NO: 1620061 - RNA, 17 nt, Human
uguuuaguaaucauauu

SEQ ID NO: 1620062 - RNA, 14 nt, Human
uguuuaguaaucau

SEQ ID NO: 1620063 - RNA, 13 nt, Human
uguuuaguaauca

SEQ ID NO: 1620064 - RNA, 20 nt, Human
uguuuagucuugucucagau

SEQ ID NO: 1620065 - RNA, 19 nt, Human
uguuuagucuugucucaga

SEQ ID NO: 1620066 - RNA, 18 nt, Human
uguuuagucuugucucag

SEQ ID NO: 1620067 - RNA, 17 nt, Human
uguuuagucuugucuca

SEQ ID NO: 1620068 - RNA, 13 nt, Human
uguuuagucuugu

SEQ ID NO: 1620069 - RNA, 20 nt, Human
aguucggugagcuacaaaug

SEQ ID NO: 1620070 - RNA, 19 nt, Human
aguucggugagcuacaaau

SEQ ID NO: 1620071 - RNA, 12 nt, Human
aguucucuccuu

SEQ ID NO: 1620072 - RNA, 14 nt, Human
aguucagagcugcc

SEQ ID NO: 1620073 - RNA, 24 nt, Human
aguucacucuccauuuaauaauua

SEQ ID NO: 1620074 - RNA, 22 nt, Human
aguucacucuccauuuaauaau

SEQ ID NO: 1620075 - RNA, 23 nt, Human
aguuccucauuagcauuuugcua

SEQ ID NO: 1620076 - RNA, 15 nt, Human
aguucccuacuuccu

SEQ ID NO: 1620077 - RNA, 16 nt, Human
aguucaauucucauuu

SEQ ID NO: 1620078 - RNA, 16 nt, Human
aguguuggagaagaac

SEQ ID NO: 1620079 - RNA, 14 nt, Human
aguguuggagaaga

SEQ ID NO: 1620080 - RNA, 21 nt, Human
aguguugaaacggaugauuuc

SEQ ID NO: 1620081 - RNA, 18 nt, Human
aguguuggagaagaacug

SEQ ID NO: 1620082 - RNA, 17 nt, Human
aguguuggagaagaacu

SEQ ID NO: 1620083 - RNA, 23 nt, Human
aguguuggagaagaacugaaauc

SEQ ID NO: 1620084 - RNA, 21 nt, Human
aguuacucuucaguuaagccu

SEQ ID NO: 1620085 - RNA, 15 nt, Human
uguugcccaggcugg

SEQ ID NO: 1620086 - RNA, 13 nt, Human
uguugcccaggcu

SEQ ID NO: 1620087 - RNA, 19 nt, Human
uguucuuucacccuuuucu

SEQ ID NO: 1620088 - RNA, 22 nt, Human
uguucuugguuuguaaauuaac

SEQ ID NO: 1620089 - RNA, 20 nt, Human
uguucuugguuuguaaauua

SEQ ID NO: 1620090 - RNA, 21 nt, Human
aguguucauaaauaaaguuug

SEQ ID NO: 1620091 - RNA, 18 nt, Human
uguucuuaguuugcaguu

SEQ ID NO: 1620092 - RNA, 18 nt, Human
uguucuagcauggcugcc

SEQ ID NO: 1620093 - RNA, 14 nt, Human
aguuuaaauuguaa

SEQ ID NO: 1620094 - RNA, 13 nt, Human
aguuggucccccu

SEQ ID NO: 1620095 - RNA, 11 nt, Human
aguuggucccc

SEQ ID NO: 1620096 - RNA, 17 nt, Human
aguuggucccccuucca

SEQ ID NO: 1620097 - RNA, 13 nt, Human
uuaaaaaaaaucc

SEQ ID NO: 1620098 - RNA, 13 nt, Human
uguuucaaacaua

SEQ ID NO: 1620099 - RNA, 23 nt, Human
aguugccagucaccccggccacc

SEQ ID NO: 1620100 - RNA, 19 nt, Human
aguugccuaaauccauuug

SEQ ID NO: 1620101 - RNA, 17 nt, Human
aguugccuaaauccauu

SEQ ID NO: 1620102 - RNA, 16 nt, Human
aguugccuaaauccau

SEQ ID NO: 1620103 - RNA, 15 nt, Human
aguugccuaaaucca

SEQ ID NO: 1620104 - RNA, 11 nt, Human
aguugccuaaa

SEQ ID NO: 1620105 - RNA, 19 nt, Human
aguugggcuuccucauagu

SEQ ID NO: 1620106 - RNA, 17 nt, Human
aguuggguggaugccug

SEQ ID NO: 1620107 - RNA, 15 nt, Human
uuaaauaaugugaaa

SEQ ID NO: 1620108 - RNA, 14 nt, Human
uuaaaaaucucaaa

SEQ ID NO: 1620109 - RNA, 15 nt, Human
uuaaaaaucucaaau

SEQ ID NO: 1620110 - RNA, 16 nt, Human
uuaaaaaucucaaauu

SEQ ID NO: 1620111 - RNA, 17 nt, Human
uuaaaaaucucaaauuu

SEQ ID NO: 1620112 - RNA, 19 nt, Human
uuaaauaaugugaaacugg

SEQ ID NO: 1620113 - RNA, 16 nt, Human
uuaaauaaugugaaac

SEQ ID NO: 1620114 - RNA, 18 nt, Human
uuaaauaaugugaaacug

SEQ ID NO: 1620115 - RNA, 19 nt, Human
uuaacagaaauguacagca

SEQ ID NO: 1620116 - RNA, 20 nt, Human
uuaacagaaauguacagcaa

SEQ ID NO: 1620117 - RNA, 15 nt, Human
uuaagugcugcauuu

SEQ ID NO: 1620118 - RNA, 16 nt, Human
uuaagugcugcauuua

SEQ ID NO: 1620119 - RNA, 19 nt, Human
uuaagugcugcauuuaaaa

SEQ ID NO: 1620120 - RNA, 20 nt, Human
uuaagaagacugcauuauau

SEQ ID NO: 1620121 - RNA, 22 nt, Human
uuaagaaagacuaucuaaaugu

SEQ ID NO: 1620122 - RNA, 9 nt, Human
uuaaggugg

SEQ ID NO: 1620123 - RNA, 22 nt, Human
uuaaucauuaggugugacugaa

SEQ ID NO: 1620124 - RNA, 23 nt, Human
uuaaucauuaggugugacugaau

SEQ ID NO: 1620125 - RNA, 21 nt, Human
uuaaucugggccagaauuuca

SEQ ID NO: 1620126 - RNA, 13 nt, Human
uuaaucauuaggu

SEQ ID NO: 1620127 - RNA, 22 nt, Human
uuaauauuuauaggucacuuug

SEQ ID NO: 1620128 - RNA, 19 nt, Human
uuaaugaaagacuguacaa

SEQ ID NO: 1620129 - RNA, 18 nt, Human
uuaaugaaagacuguaca

SEQ ID NO: 1620130 - RNA, 22 nt, Human
uuaaucugguuuauuuuuguuc

SEQ ID NO: 1620131 - RNA, 23 nt, Human
aguuuucugagaaagacuauuca

SEQ ID NO: 1620132 - RNA, 19 nt, Human
aguuuucugagaaagacua

SEQ ID NO: 1620133 - RNA, 23 nt, Human
aguuuuuauggcuuuugugcauu

SEQ ID NO: 1620134 - RNA, 15 nt, Human
auaaaauaauuuuua

SEQ ID NO: 1620135 - RNA, 20 nt, Human
uuaagaaaaaggaugcacag

SEQ ID NO: 1620136 - RNA, 21 nt, Human
uuaagaaaaaggaugcacaga

SEQ ID NO: 1620137 - RNA, 12 nt, Human
auaaaauaauuu

SEQ ID NO: 1620138 - RNA, 18 nt, Human
auaaaagccuguuuaaga

SEQ ID NO: 1620139 - RNA, 13 nt, Human
auaaaagccuguu

SEQ ID NO: 1620140 - RNA, 15 nt, Human
auaaauaguuuauga

SEQ ID NO: 1620141 - RNA, 14 nt, Human
auaaauaaaaauaa

SEQ ID NO: 1620142 - RNA, 22 nt, Human
auaaauagcuagacuggugacu

SEQ ID NO: 1620143 - RNA, 13 nt, Human
auaaauaaaaaua

SEQ ID NO: 1620144 - RNA, 17 nt, Human
auaaagguucaugcaaa

SEQ ID NO: 1620145 - RNA, 15 nt, Human
auaaagguucaugca

SEQ ID NO: 1620146 - RNA, 16 nt, Human
auaacuaaaagguaug

SEQ ID NO: 1620147 - RNA, 22 nt, Human
auaacgauaaaagacagugaaa

SEQ ID NO: 1620148 - RNA, 14 nt, Human
auaacguauaaaag

SEQ ID NO: 1620149 - RNA, 11 nt, Human
auaaauuauuu

SEQ ID NO: 1620150 - RNA, 24 nt, Human
uuacaggcgugagccaccgugccu

SEQ ID NO: 1620151 - RNA, 18 nt, Human
uuacaggcuccugccacc

SEQ ID NO: 1620152 - RNA, 16 nt, Human
uuacaggcuccugcca

SEQ ID NO: 1620153 - RNA, 19 nt, Human
uuacccucauguucuuaau

SEQ ID NO: 1620154 - RNA, 20 nt, Human
uuaccuuugacaaagguaaa

SEQ ID NO: 1620155 - RNA, 13 nt, Human
uuaccuuugacaa

SEQ ID NO: 1620156 - RNA, 13 nt, Human
uuagacagucccu

SEQ ID NO: 1620157 - RNA, 20 nt, Human
uuagacagagucucacuguu

SEQ ID NO: 1620158 - RNA, 13 nt, Human
uuagacagagucu

SEQ ID NO: 1620159 - RNA, 17 nt, Human
uuagaaauugcauuucc

SEQ ID NO: 1620160 - RNA, 23 nt, Human
uuacucuucaguuaagccuuugg

SEQ ID NO: 1620161 - RNA, 14 nt, Human
uuagggagagaaga

SEQ ID NO: 1620162 - RNA, 20 nt, Human
uuagggaaggauacaaaagc

SEQ ID NO: 1620163 - RNA, 21 nt, Human
uuaggugugacugaauuucuu

SEQ ID NO: 1620164 - RNA, 16 nt, Human
uuaggugaggaagcaa

SEQ ID NO: 1620165 - RNA, 16 nt, Human
uuaggugugacugaau

SEQ ID NO: 1620166 - RNA, 22 nt, Human
uuaguuugcaguuacacuaaaa

SEQ ID NO: 1620167 - RNA, 15 nt, Human
uuaguuucuccaagc

SEQ ID NO: 1620168 - RNA, 18 nt, Human
uuagcaaauucuguuuuu

SEQ ID NO: 1620169 - RNA, 12 nt, Human
uuagcaccaggg

SEQ ID NO: 1620170 - RNA, 18 nt, Human
auaauuuaccugaagucu

SEQ ID NO: 1620171 - RNA, 18 nt, Human
uuagccaagugugguaga

SEQ ID NO: 1620172 - RNA, 14 nt, Human
uuagcggagacgga

SEQ ID NO: 1620173 - RNA, 18 nt, Human
auaauccuaaacauauga

SEQ ID NO: 1620174 - RNA, 22 nt, Human
auaaucuggacuccucugucca

SEQ ID NO: 1620175 - RNA, 20 nt, Human
auaaucuggacuccucuguc

SEQ ID NO: 1620176 - RNA, 19 nt, Human
auaaucuggacuccucugu

SEQ ID NO: 1620177 - RNA, 18 nt, Human
auaaucuggacuccucug

SEQ ID NO: 1620178 - RNA, 22 nt, Human
auaauugacaggauuauuggaa

SEQ ID NO: 1620179 - RNA, 15 nt, Human
auaaugaaugaaaca

SEQ ID NO: 1620180 - RNA, 15 nt, Human
auaaugcgugcauac

SEQ ID NO: 1620181 - RNA, 20 nt, Human
auaaugcgugcauaccacuu

SEQ ID NO: 1620182 - RNA, 14 nt, Human
uuagacagucccug

SEQ ID NO: 1620183 - RNA, 21 nt, Human
auaauacaccacuacauucug

SEQ ID NO: 1620184 - RNA, 19 nt, Human
auaauacuugcuuuggaaa

SEQ ID NO: 1620185 - RNA, 18 nt, Human
auaauacaccacuacauu

SEQ ID NO: 1620186 - RNA, 20 nt, Human
auaauacaccacuacauucu

SEQ ID NO: 1620187 - RNA, 12 nt, Human
auaauacaccac

SEQ ID NO: 1620188 - RNA, 17 nt, Human
uuuguagaagucacauu

SEQ ID NO: 1620189 - RNA, 16 nt, Human
uuugugagcaggcugu

SEQ ID NO: 1620190 - RNA, 15 nt, Human
uuugucuacaccauu

SEQ ID NO: 1620191 - RNA, 19 nt, Human
uuugugaggaagccgcugg

SEQ ID NO: 1620192 - RNA, 18 nt, Human
uuugugaggaagccgcug

SEQ ID NO: 1620193 - RNA, 15 nt, Human
uuugugauacaaugc

SEQ ID NO: 1620194 - RNA, 13 nt, Human
uuuguuucuguac

SEQ ID NO: 1620195 - RNA, 12 nt, Human
uuuguuucugua

SEQ ID NO: 1620196 - RNA, 12 nt, Human
uuuguuugaacu

SEQ ID NO: 1620197 - RNA, 18 nt, Human
uuuguuucuguacuuuuu

SEQ ID NO: 1620198 - RNA, 13 nt, Human
uuuguuugaacug

SEQ ID NO: 1620199 - RNA, 14 nt, Human
uuuguuugaacuga

SEQ ID NO: 1620200 - RNA, 13 nt, Human
uuuguagagccag

SEQ ID NO: 1620201 - RNA, 13 nt, Human
uuuguaaauuguc

SEQ ID NO: 1620202 - RNA, 15 nt, Human
uuuuaagaggcaggg

SEQ ID NO: 1620203 - RNA, 16 nt, Human
uuuuaagaggcagggu

SEQ ID NO: 1620204 - RNA, 15 nt, Human
uuuuaagugcugcau

SEQ ID NO: 1620205 - RNA, 16 nt, Human
uuuuaaguaaggaauu

SEQ ID NO: 1620206 - RNA, 23 nt, Human
uuuuaaggguuuguggaaaauga

SEQ ID NO: 1620207 - RNA, 20 nt, Human
uuuuaaggguuuguggaaaa

SEQ ID NO: 1620208 - RNA, 13 nt, Human
uuuuaaaaaagaa

SEQ ID NO: 1620209 - RNA, 18 nt, Human
uuuguuugaacugauaaa

SEQ ID NO: 1620210 - RNA, 15 nt, Human
uuuuaaaagaaugau

SEQ ID NO: 1620211 - RNA, 14 nt, Human
uuuuaaaagaauga

SEQ ID NO: 1620212 - RNA, 22 nt, Human
uuuuaaaacacuuccauaaucu

SEQ ID NO: 1620213 - RNA, 16 nt, Human
uuuuaaaacacuucca

SEQ ID NO: 1620214 - RNA, 13 nt, Human
uuugcucauggaa

SEQ ID NO: 1620215 - RNA, 22 nt, Human
uuugggaggccaaggugggagg

SEQ ID NO: 1620216 - RNA, 14 nt, Human
uuuggggauauuuu

SEQ ID NO: 1620217 - RNA, 15 nt, Human
auggcuauaggugcu

SEQ ID NO: 1620218 - RNA, 12 nt, Human
uuugcucaugga

SEQ ID NO: 1620219 - RNA, 11 nt, Human
uuugcucaugg

SEQ ID NO: 1620220 - RNA, 16 nt, Human
auguccacugguucuu

SEQ ID NO: 1620221 - RNA, 20 nt, Human
augucccaacuuguaaaaau

SEQ ID NO: 1620222 - RNA, 24 nt, Human
augucccuaccgagucucuucucc

SEQ ID NO: 1620223 - RNA, 22 nt, Human
augucuauaaaccgaacugaug

SEQ ID NO: 1620224 - RNA, 23 nt, Human
auguccaagaagcccaggaaagg

SEQ ID NO: 1620225 - RNA, 19 nt, Human
auguccaagaagcccagga

SEQ ID NO: 1620226 - RNA, 16 nt, Human
augucagugugacuga

SEQ ID NO: 1620227 - RNA, 15 nt, Human
augucagugugacug

SEQ ID NO: 1620228 - RNA, 21 nt, Human
augucagugugacugaucucu

SEQ ID NO: 1620229 - RNA, 15 nt, Human
auguauguguaagua

SEQ ID NO: 1620230 - RNA, 12 nt, Human
auguauguguaa

SEQ ID NO: 1620231 - RNA, 15 nt, Human
auguaucugagcagg

SEQ ID NO: 1620232 - RNA, 22 nt, Human
uuugggggaaaauuuagaaaua

SEQ ID NO: 1620233 - RNA, 15 nt, Human
auguaucaaugagua

SEQ ID NO: 1620234 - RNA, 21 nt, Human
auguuucaaacauauauaaca

SEQ ID NO: 1620235 - RNA, 14 nt, Human
auguuuuccaugag

SEQ ID NO: 1620236 - RNA, 18 nt, Human
auguuucaaacauauaua

SEQ ID NO: 1620237 - RNA, 18 nt, Human
auguuuuucuucucccuc

SEQ ID NO: 1620238 - RNA, 17 nt, Human
auguuuuucuucucccu

SEQ ID NO: 1620239 - RNA, 16 nt, Human
auuaaaagaauauuuu

SEQ ID NO: 1620240 - RNA, 17 nt, Human
auuaaccacuucagcug

SEQ ID NO: 1620241 - RNA, 19 nt, Human
auuaacauguuaaaccaug

SEQ ID NO: 1620242 - RNA, 17 nt, Human
auuaacauguuaaacca

SEQ ID NO: 1620243 - RNA, 15 nt, Human
auuaacauguuaaac

SEQ ID NO: 1620244 - RNA, 14 nt, Human
auuaacauguuaaa

SEQ ID NO: 1620245 - RNA, 13 nt, Human
auuaacauguuaa

SEQ ID NO: 1620246 - RNA, 20 nt, Human
auuaaccacuucagcugacu

SEQ ID NO: 1620247 - RNA, 18 nt, Human
auuaaccacuucagcuga

SEQ ID NO: 1620248 - RNA, 17 nt, Human
auuaaacuuaaucuaaa

SEQ ID NO: 1620249 - RNA, 16 nt, Human
auuaaacuuaaucuaa

SEQ ID NO: 1620250 - RNA, 19 nt, Human
auuaaacuuaaucuaaaug

SEQ ID NO: 1620251 - RNA, 21 nt, Human
auuaaacuuaaucuaaaugga

SEQ ID NO: 1620252 - RNA, 21 nt, Human
auuaaagccauguuuauuaca

SEQ ID NO: 1620253 - RNA, 17 nt, Human
auuaaagccauguuuau

SEQ ID NO: 1620254 - RNA, 16 nt, Human
auuaaagccauguuua

SEQ ID NO: 1620255 - RNA, 12 nt, Human
auuaaagccaug

SEQ ID NO: 1620256 - RNA, 16 nt, Human
auuaacuuuuauaaac

SEQ ID NO: 1620257 - RNA, 17 nt, Human
auuaacuuuuauaaacu

SEQ ID NO: 1620258 - RNA, 19 nt, Human
auuaacuuuuauaaacuuu

SEQ ID NO: 1620259 - RNA, 20 nt, Human
auuaacuuuuauaaacuuua

SEQ ID NO: 1620260 - RNA, 12 nt, Human
auuaacuuuuau

SEQ ID NO: 1620261 - RNA, 14 nt, Human
auuaagaaagacua

SEQ ID NO: 1620262 - RNA, 13 nt, Human
auuaagaaagacu

SEQ ID NO: 1620263 - RNA, 23 nt, Human
auuaacuuuuauaaacuuuaccu

SEQ ID NO: 1620264 - RNA, 19 nt, Human
auguucaucaaugaaugaa

SEQ ID NO: 1620265 - RNA, 21 nt, Human
auguucaucauccuaagcuau

SEQ ID NO: 1620266 - RNA, 15 nt, Human
auguugacaugggac

SEQ ID NO: 1620267 - RNA, 16 nt, Human
auguugaagccuuugu

SEQ ID NO: 1620268 - RNA, 16 nt, Human
uuuuaagugcugcauu

SEQ ID NO: 1620269 - RNA, 17 nt, Human
uuuuaagugcugcauuu

SEQ ID NO: 1620270 - RNA, 21 nt, Human
uuuuaagugcugcauuuaaaa

SEQ ID NO: 1620271 - RNA, 12 nt, Human
uuuuauaaacuu

SEQ ID NO: 1620272 - RNA, 13 nt, Human
uuuuauaaacuuu

SEQ ID NO: 1620273 - RNA, 19 nt, Human
uuuuaguugcaacuuugua

SEQ ID NO: 1620274 - RNA, 16 nt, Human
auguuggccaggcugg

SEQ ID NO: 1620275 - RNA, 16 nt, Human
auguuggccaggcugc

SEQ ID NO: 1620276 - RNA, 14 nt, Human
auguuggccaggcu

SEQ ID NO: 1620277 - RNA, 15 nt, Human
auguugcauagaaua

SEQ ID NO: 1620278 - RNA, 14 nt, Human
uuuuauaauuuugu

SEQ ID NO: 1620279 - RNA, 19 nt, Human
uuuuauaaacuuuaccuuu

SEQ ID NO: 1620280 - RNA, 14 nt, Human
uuuuauaaacuuua

SEQ ID NO: 1620281 - RNA, 17 nt, Human
uuuuauaaacuuuaccu

SEQ ID NO: 1620282 - RNA, 23 nt, Human
uuuuauggaggcuuugcauagau

SEQ ID NO: 1620283 - RNA, 19 nt, Human
uuuuauggcacuaguauuu

SEQ ID NO: 1620284 - RNA, 22 nt, Human
uuuuauggcacuaguauuucua

SEQ ID NO: 1620285 - RNA, 18 nt, Human
uuuuaugugaaacauguu

SEQ ID NO: 1620286 - RNA, 22 nt, Human
uuuuauguugcauagaauaaaa

SEQ ID NO: 1620287 - RNA, 12 nt, Human
uuuuauuaugua

SEQ ID NO: 1620288 - RNA, 19 nt, Human
uuuuaugugaaacauguuu

SEQ ID NO: 1620289 - RNA, 19 nt, Human
uuuuccagguuuaagcugu

SEQ ID NO: 1620290 - RNA, 22 nt, Human
uuuucauucuccuaucaccugu

SEQ ID NO: 1620291 - RNA, 21 nt, Human
uuuucauuauuuuauuaugaa

SEQ ID NO: 1620292 - RNA, 15 nt, Human
uuuucauuauuuuau

SEQ ID NO: 1620293 - RNA, 21 nt, Human
uuuuauucagcucauggacuu

SEQ ID NO: 1620294 - RNA, 14 nt, Human
uuuuauuauguaaa

SEQ ID NO: 1620295 - RNA, 13 nt, Human
uuuuauuauguaa

SEQ ID NO: 1620296 - RNA, 21 nt, Human
auuaaguaaugauaacuggaa

SEQ ID NO: 1620297 - RNA, 15 nt, Human
auuaaguaaugauaa

SEQ ID NO: 1620298 - RNA, 13 nt, Human
auuaaguaaugau

SEQ ID NO: 1620299 - RNA, 23 nt, Human
uuuuuuaaaaaagaaacauuugg

SEQ ID NO: 1620300 - RNA, 20 nt, Human
auuaagagagucuauuuacg

SEQ ID NO: 1620301 - RNA, 12 nt, Human
auuaccagggac

SEQ ID NO: 1620302 - RNA, 22 nt, Human
auuaccugaauuuuggcugugu

SEQ ID NO: 1620303 - RNA, 16 nt, Human
auuacauuuguauaaa

SEQ ID NO: 1620304 - RNA, 15 nt, Human
auuacauuuguauaa

SEQ ID NO: 1620305 - RNA, 19 nt, Human
auuaccacagacauacuaa

SEQ ID NO: 1620306 - RNA, 13 nt, Human
auuacauuuguau

SEQ ID NO: 1620307 - RNA, 20 nt, Human
auuauuaccuuacagaaguu

SEQ ID NO: 1620308 - RNA, 23 nt, Human
auuauuuauuaaaugcccagccc

SEQ ID NO: 1620309 - RNA, 18 nt, Human
auuauuuuauguugcaua

SEQ ID NO: 1620310 - RNA, 15 nt, Human
auuauuuuauuauga

SEQ ID NO: 1620311 - RNA, 16 nt, Human
auuauuuuauguugca

SEQ ID NO: 1620312 - RNA, 17 nt, Human
auuauauuuacaaaugg

SEQ ID NO: 1620313 - RNA, 23 nt, Human
auuaucucaaaacugcacuguca

SEQ ID NO: 1620314 - RNA, 18 nt, Human
auuaucucaaaacugcac

SEQ ID NO: 1620315 - RNA, 16 nt, Human
auuauauuuacaaaug

SEQ ID NO: 1620316 - RNA, 19 nt, Human
auuagagaguguugaaacg

SEQ ID NO: 1620317 - RNA, 18 nt, Human
auuagagaguguugaaac

SEQ ID NO: 1620318 - RNA, 17 nt, Human
auuagagaguguugaaa

SEQ ID NO: 1620319 - RNA, 16 nt, Human
auuagagaguguugaa

SEQ ID NO: 1620320 - RNA, 15 nt, Human
auuagagaguguuga

SEQ ID NO: 1620321 - RNA, 15 nt, Human
auucaaacagucuca

SEQ ID NO: 1620322 - RNA, 14 nt, Human
auucaaacagucuc

SEQ ID NO: 1620323 - RNA, 14 nt, Human
auucagcucaugga

SEQ ID NO: 1620324 - RNA, 22 nt, Human
auuauuuuauuaugaaacuugu

SEQ ID NO: 1620325 - RNA, 21 nt, Human
auuauuuuauuaugaaacuug

SEQ ID NO: 1620326 - RNA, 16 nt, Human
auucaaaaugauguau

SEQ ID NO: 1620327 - RNA, 22 nt, Human
auucaggaagcucagggccugg

SEQ ID NO: 1620328 - RNA, 21 nt, Human
auucaggaagcucagggccug

SEQ ID NO: 1620329 - RNA, 18 nt, Human
auucagcucugcaagaau

SEQ ID NO: 1620330 - RNA, 14 nt, Human
auucagcucugcaa

SEQ ID NO: 1620331 - RNA, 23 nt, Human
auucaggaagcucagggccuggc

SEQ ID NO: 1620332 - RNA, 21 nt, Human
auucaguuguuagugugucuu

SEQ ID NO: 1620333 - RNA, 20 nt, Human
auuccacuuauaggaauuga

SEQ ID NO: 1620334 - RNA, 16 nt, Human
auuccccaggaggcca

SEQ ID NO: 1620335 - RNA, 20 nt, Human
auuccccagauugcaacagg

SEQ ID NO: 1620336 - RNA, 19 nt, Human
auuccccaggaggccagcc

SEQ ID NO: 1620337 - RNA, 23 nt, Human
auuggcuuuggguugcaggaccu

SEQ ID NO: 1620338 - RNA, 13 nt, Human
auugugccccugc

SEQ ID NO: 1620339 - RNA, 15 nt, Human
auugugaaauuauuc

SEQ ID NO: 1620340 - RNA, 14 nt, Human
auuguauuacaaau

SEQ ID NO: 1620341 - RNA, 15 nt, Human
auuguauuacaaauc

SEQ ID NO: 1620342 - RNA, 23 nt, Human
auugugcgcuaaacuuuucugau

SEQ ID NO: 1620343 - RNA, 13 nt, Human
auuuaaaagauac

SEQ ID NO: 1620344 - RNA, 19 nt, Human
auuuaaagcuuauuaaaac

SEQ ID NO: 1620345 - RNA, 20 nt, Human
auuuaacagaaauguacagc

SEQ ID NO: 1620346 - RNA, 17 nt, Human
auuuaacagaaauguac

SEQ ID NO: 1620347 - RNA, 19 nt, Human
auuuaacagaaauguacag

SEQ ID NO: 1620348 - RNA, 16 nt, Human
auuuaacagaaaugua

SEQ ID NO: 1620349 - RNA, 16 nt, Human
auuuacaaaugggaaa

SEQ ID NO: 1620350 - RNA, 22 nt, Human
auuuacaacugggggaggguga

SEQ ID NO: 1620351 - RNA, 23 nt, Human
auuuaauuuuuuugagacagagu

SEQ ID NO: 1620352 - RNA, 19 nt, Human
auuuaauuuuuuugagaca

SEQ ID NO: 1620353 - RNA, 18 nt, Human
auuuaaccucuaaauucu

SEQ ID NO: 1620354 - RNA, 16 nt, Human
auuuaaccucuaaauu

SEQ ID NO: 1620355 - RNA, 20 nt, Human
auugacacuuaaaaaugguu

SEQ ID NO: 1620356 - RNA, 17 nt, Human
auucuccaccugccagg

SEQ ID NO: 1620357 - RNA, 16 nt, Human
auucuccaccugccag

SEQ ID NO: 1620358 - RNA, 13 nt, Human
auucuccaccugc

SEQ ID NO: 1620359 - RNA, 20 nt, Human
auucucagaaucucaaauaa

SEQ ID NO: 1620360 - RNA, 18 nt, Human
auucucagaaucucaaau

SEQ ID NO: 1620361 - RNA, 16 nt, Human
auucuacuuugagugc

SEQ ID NO: 1620362 - RNA, 13 nt, Human
auucuacuuugag

SEQ ID NO: 1620363 - RNA, 14 nt, Human
auucucagaaucuc

SEQ ID NO: 1620364 - RNA, 22 nt, Human
auucucacagcuccaagaauuu

SEQ ID NO: 1620365 - RNA, 21 nt, Human
auucucacagcuccaagaauu

SEQ ID NO: 1620366 - RNA, 19 nt, Human
auucucacagcuccaagaa

SEQ ID NO: 1620367 - RNA, 18 nt, Human
auucuccaccugccaggg

SEQ ID NO: 1620368 - RNA, 23 nt, Human
auugccauuucuuccacaagagc

SEQ ID NO: 1620369 - RNA, 17 nt, Human
auugcauuuccugacag

SEQ ID NO: 1620370 - RNA, 21 nt, Human
auugcccacgcuggagugcag

SEQ ID NO: 1620371 - RNA, 17 nt, Human
auugcccacgcuggagu

SEQ ID NO: 1620372 - RNA, 19 nt, Human
auugcggacagccacggcc

SEQ ID NO: 1620373 - RNA, 18 nt, Human
auugcggacagccacggc

SEQ ID NO: 1620374 - RNA, 16 nt, Human
auugcggacagccacg

SEQ ID NO: 1620375 - RNA, 21 nt, Human
auugcaacaggcugggcuuca

SEQ ID NO: 1620376 - RNA, 16 nt, Human
auugcaacaggcuggg

SEQ ID NO: 1620377 - RNA, 18 nt, Human
auugacaggauuauugga

SEQ ID NO: 1620378 - RNA, 15 nt, Human
auugcaacaggcugg

SEQ ID NO: 1620379 - RNA, 13 nt, Human
auugaccugaggc

SEQ ID NO: 1620380 - RNA, 17 nt, Human
auugaccugaggcccuu

SEQ ID NO: 1620381 - RNA, 14 nt, Human
auugcuacuguccu

SEQ ID NO: 1620382 - RNA, 23 nt, Human
auuugguaaggggaauugaggac

SEQ ID NO: 1620383 - RNA, 17 nt, Human
auuuggugguuucagaa

SEQ ID NO: 1620384 - RNA, 18 nt, Human
auuuguaguguuggagaa

SEQ ID NO: 1620385 - RNA, 18 nt, Human
auuuggugguuucagaaa

SEQ ID NO: 1620386 - RNA, 20 nt, Human
auuuggugguuucagaaaug

SEQ ID NO: 1620387 - RNA, 17 nt, Human
auuugguuuucacauug

SEQ ID NO: 1620388 - RNA, 15 nt, Human
auuugguuuucacau

SEQ ID NO: 1620389 - RNA, 22 nt, Human
auuugguuuucacauuggaaac

SEQ ID NO: 1620390 - RNA, 21 nt, Human
auuugguuuucacauuggaaa

SEQ ID NO: 1620391 - RNA, 20 nt, Human
auuucuuuugccguuauuaa

SEQ ID NO: 1620392 - RNA, 15 nt, Human
auuugaggucuguuc

SEQ ID NO: 1620393 - RNA, 23 nt, Human
auuugaggucuguucuuuccaaa

SEQ ID NO: 1620394 - RNA, 17 nt, Human
auuugagcagggcucag

SEQ ID NO: 1620395 - RNA, 20 nt, Human
auuuggaaaucuuuaaaaaa

SEQ ID NO: 1620396 - RNA, 22 nt, Human
auuuauuacuguaagaaaauau

SEQ ID NO: 1620397 - RNA, 20 nt, Human
auuuauuaaaugcccagccc

SEQ ID NO: 1620398 - RNA, 22 nt, Human
auuuauuaaaugcccagccccu

SEQ ID NO: 1620399 - RNA, 13 nt, Human
auuuauuauggca

SEQ ID NO: 1620400 - RNA, 15 nt, Human
auuuacuaaaaugga

SEQ ID NO: 1620401 - RNA, 21 nt, Human
auuucuaaaucuccaaaauaa

SEQ ID NO: 1620402 - RNA, 12 nt, Human
auuucuaaaucu

SEQ ID NO: 1620403 - RNA, 13 nt, Human
auuucuaaaucuc

SEQ ID NO: 1620404 - RNA, 14 nt, Human
auuuccugugucuu

SEQ ID NO: 1620405 - RNA, 16 nt, Human
auuuauuauggcacau

SEQ ID NO: 1620406 - RNA, 22 nt, Human
auuuccugggagcuuuuguaga

SEQ ID NO: 1620407 - RNA, 23 nt, Human
auuuccugggagcuuuuguagaa

SEQ ID NO: 1620408 - RNA, 16 nt, Human
auuuuaauaauguuuc

SEQ ID NO: 1620409 - RNA, 15 nt, Human
auuuuaauaauguuu

SEQ ID NO: 1620410 - RNA, 14 nt, Human
auuuuaauaauguu

SEQ ID NO: 1620411 - RNA, 15 nt, Human
auuuguaucacaaau

SEQ ID NO: 1620412 - RNA, 19 nt, Human
auuuguaguguuggagaag

SEQ ID NO: 1620413 - RNA, 13 nt, Human
auuuuacauaaau

SEQ ID NO: 1620414 - RNA, 20 nt, Human
auuuuacuguacagacagaa

SEQ ID NO: 1620415 - RNA, 22 nt, Human
auuuuacuguacagacagaaaa

SEQ ID NO: 1620416 - RNA, 17 nt, Human
auuuuauuaugcaugaa

SEQ ID NO: 1620417 - RNA, 13 nt, Human
auuuuauuaugua

SEQ ID NO: 1620418 - RNA, 14 nt, Human
auuuuauuaugcau

SEQ ID NO: 1620419 - RNA, 15 nt, Human
auuuuauuaugcaug

SEQ ID NO: 1620420 - RNA, 15 nt, Human
auuuuauuauguaaa

SEQ ID NO: 1620421 - RNA, 14 nt, Human
auuuuauuauguaa

SEQ ID NO: 1620422 - RNA, 13 nt, Human
auuuuauuaugca

SEQ ID NO: 1620423 - RNA, 21 nt, Human
auuuuauuaugaaacuugugu

SEQ ID NO: 1620424 - RNA, 18 nt, Human
auuuuauuaugaaacuug

SEQ ID NO: 1620425 - RNA, 12 nt, Human
auuuuauuauga

SEQ ID NO: 1620426 - RNA, 11 nt, Human
auuuuauuaug

SEQ ID NO: 1620427 - RNA, 14 nt, Human
auuuuauuaugaaa

SEQ ID NO: 1620428 - RNA, 13 nt, Human
auuuuauuaugaa

SEQ ID NO: 1620429 - RNA, 21 nt, Human
auuuuacuuuaaaaggagcca

SEQ ID NO: 1620430 - RNA, 18 nt, Human
auuuuauguugcauagaa

SEQ ID NO: 1620431 - RNA, 21 nt, Human
auuuuauguugcauagaauaa

SEQ ID NO: 1620432 - RNA, 23 nt, Human
auuucuuuugccguuauuaaaaa

SEQ ID NO: 1620433 - RNA, 15 nt, Human
auauauuuuaagacg

SEQ ID NO: 1620434 - RNA, 14 nt, Human
auauauuuuaagac

SEQ ID NO: 1620435 - RNA, 21 nt, Human
auaucuccgucaacucauauu

SEQ ID NO: 1620436 - RNA, 20 nt, Human
auaucuccgucaacucauau

SEQ ID NO: 1620437 - RNA, 19 nt, Human
auaucuccgucaacucaua

SEQ ID NO: 1620438 - RNA, 20 nt, Human
auaucugaaaauguaugugu

SEQ ID NO: 1620439 - RNA, 17 nt, Human
auaucugaaaauguaug

SEQ ID NO: 1620440 - RNA, 16 nt, Human
auaucugaaaauguau

SEQ ID NO: 1620441 - RNA, 14 nt, Human
auaugcacacauuu

SEQ ID NO: 1620442 - RNA, 15 nt, Human
auaugcacacauuuu

SEQ ID NO: 1620443 - RNA, 16 nt, Human
auaugcacacauuuuu

SEQ ID NO: 1620444 - RNA, 22 nt, Human
auaugcacacauuuuuuaaaug

SEQ ID NO: 1620445 - RNA, 16 nt, Human
auauguaacaagccac

SEQ ID NO: 1620446 - RNA, 17 nt, Human
auauguaacaagccacc

SEQ ID NO: 1620447 - RNA, 18 nt, Human
uucagugccuuauggaac

SEQ ID NO: 1620448 - RNA, 19 nt, Human
uucauaauuauuauuuggc

SEQ ID NO: 1620449 - RNA, 13 nt, Human
uucagugccuuau

SEQ ID NO: 1620450 - RNA, 12 nt, Human
uucagugccuua

SEQ ID NO: 1620451 - RNA, 11 nt, Human
uucagaaaugu

SEQ ID NO: 1620452 - RNA, 13 nt, Human
uucagaaaugugu

SEQ ID NO: 1620453 - RNA, 13 nt, Human
auauauuuuaaga

SEQ ID NO: 1620454 - RNA, 12 nt, Human
auauauuuuaag

SEQ ID NO: 1620455 - RNA, 17 nt, Human
uucaucccucuggggcu

SEQ ID NO: 1620456 - RNA, 21 nt, Human
uucaucccucuggggcuguuc

SEQ ID NO: 1620457 - RNA, 12 nt, Human
uucccaaauuuc

SEQ ID NO: 1620458 - RNA, 18 nt, Human
uucccaacuccagaaagu

SEQ ID NO: 1620459 - RNA, 16 nt, Human
uucccaagcucugcuc

SEQ ID NO: 1620460 - RNA, 15 nt, Human
uucccaagcucugcu

SEQ ID NO: 1620461 - RNA, 14 nt, Human
uucccaagcucugc

SEQ ID NO: 1620462 - RNA, 13 nt, Human
uucccaagcucug

SEQ ID NO: 1620463 - RNA, 18 nt, Human
uucccaagcucugcuccu

SEQ ID NO: 1620464 - RNA, 22 nt, Human
uucccaccucucucacuccuug

SEQ ID NO: 1620465 - RNA, 12 nt, Human
uucccaccucuc

SEQ ID NO: 1620466 - RNA, 22 nt, Human
uuccagugaggcucugcccuug

SEQ ID NO: 1620467 - RNA, 21 nt, Human
uuccagugaggcucugcccuu

SEQ ID NO: 1620468 - RNA, 20 nt, Human
uuccagugaggcucugcccu

SEQ ID NO: 1620469 - RNA, 19 nt, Human
uuccagugaggcucugccc

SEQ ID NO: 1620470 - RNA, 17 nt, Human
uuccagugaggcucugc

SEQ ID NO: 1620471 - RNA, 21 nt, Human
uuccaggggugggacacccug

SEQ ID NO: 1620472 - RNA, 13 nt, Human
uuccaggcuggga

SEQ ID NO: 1620473 - RNA, 17 nt, Human
uuccagguuuaagcugu

SEQ ID NO: 1620474 - RNA, 23 nt, Human
uuccauaaucuggacuccucugu

SEQ ID NO: 1620475 - RNA, 22 nt, Human
uuccauaaucuggacuccucug

SEQ ID NO: 1620476 - RNA, 19 nt, Human
uuccauaaucuggacuccu

SEQ ID NO: 1620477 - RNA, 23 nt, Human
uucccaaagcagugcaugcuguc

SEQ ID NO: 1620478 - RNA, 19 nt, Human
uuccaccaucaagccacca

SEQ ID NO: 1620479 - RNA, 22 nt, Human
uuccacaagagcccaggccucc

SEQ ID NO: 1620480 - RNA, 17 nt, Human
uuccaggggugggacac

SEQ ID NO: 1620481 - RNA, 17 nt, Human
uuccaaggguacuaagg

SEQ ID NO: 1620482 - RNA, 15 nt, Human
uuccaaggguacuaa

SEQ ID NO: 1620483 - RNA, 18 nt, Human
uucauuuaggugaggaag

SEQ ID NO: 1620484 - RNA, 16 nt, Human
auauguggaguucauc

SEQ ID NO: 1620485 - RNA, 15 nt, Human
auauguggaguucau

SEQ ID NO: 1620486 - RNA, 13 nt, Human
auagucuggcugu

SEQ ID NO: 1620487 - RNA, 21 nt, Human
auagugaggcaucgcaaugua

SEQ ID NO: 1620488 - RNA, 17 nt, Human
auaguggcuuaaaacaa

SEQ ID NO: 1620489 - RNA, 15 nt, Human
auaguggugugauuu

SEQ ID NO: 1620490 - RNA, 20 nt, Human
auaguuguaccgcaauguga

SEQ ID NO: 1620491 - RNA, 22 nt, Human
auaguuggcuaggaccccucca

SEQ ID NO: 1620492 - RNA, 22 nt, Human
auaguuaagcgugcauaaguua

SEQ ID NO: 1620493 - RNA, 14 nt, Human
auauauaacaaugc

SEQ ID NO: 1620494 - RNA, 13 nt, Human
auauauaaccagu

SEQ ID NO: 1620495 - RNA, 12 nt, Human
auauauaaccag

SEQ ID NO: 1620496 - RNA, 21 nt, Human
auauauauuuuuuucugaaau

SEQ ID NO: 1620497 - RNA, 15 nt, Human
uucacuuacagcacc

SEQ ID NO: 1620498 - RNA, 17 nt, Human
uuauuuuuagacagagu

SEQ ID NO: 1620499 - RNA, 18 nt, Human
uuauuuuuagacagaguc

SEQ ID NO: 1620500 - RNA, 17 nt, Human
uuauuuuuuucugaauu

SEQ ID NO: 1620501 - RNA, 13 nt, Human
uuauuuuuuucug

SEQ ID NO: 1620502 - RNA, 18 nt, Human
uucaaacagucucaggaa

SEQ ID NO: 1620503 - RNA, 14 nt, Human
uucaaacauauaua

SEQ ID NO: 1620504 - RNA, 17 nt, Human
uucaaaauaaaaaugag

SEQ ID NO: 1620505 - RNA, 21 nt, Human
uucaaaauuguuacaaauugu

SEQ ID NO: 1620506 - RNA, 21 nt, Human
uucaagcgauucuucugcuuc

SEQ ID NO: 1620507 - RNA, 23 nt, Human
uucacaagacccaaaaggcagaa

SEQ ID NO: 1620508 - RNA, 17 nt, Human
uucaagugauucucaug

SEQ ID NO: 1620509 - RNA, 20 nt, Human
uucacaguucucuccuucuu

SEQ ID NO: 1620510 - RNA, 15 nt, Human
uucacaguucucucc

SEQ ID NO: 1620511 - RNA, 20 nt, Human
uucacagaugggugcuugga

SEQ ID NO: 1620512 - RNA, 17 nt, Human
auaggcguaacuaauuu

SEQ ID NO: 1620513 - RNA, 17 nt, Human
auaggaaaaacugauuu

SEQ ID NO: 1620514 - RNA, 16 nt, Human
auaggaaaaacugauu

SEQ ID NO: 1620515 - RNA, 14 nt, Human
auaggaaaaacuga

SEQ ID NO: 1620516 - RNA, 12 nt, Human
auaggaaaaacu

SEQ ID NO: 1620517 - RNA, 15 nt, Human
auagcuuuuuucucu

SEQ ID NO: 1620518 - RNA, 22 nt, Human
auagcuuuucccuuuuuuuaag

SEQ ID NO: 1620519 - RNA, 13 nt, Human
auccuaguuccac

SEQ ID NO: 1620520 - RNA, 21 nt, Human
auccuaggcauuugcugaaua

SEQ ID NO: 1620521 - RNA, 19 nt, Human
auccuaaugaaugcauaaa

SEQ ID NO: 1620522 - RNA, 14 nt, Human
auccuacaagacac

SEQ ID NO: 1620523 - RNA, 13 nt, Human
auccuaaugaaug

SEQ ID NO: 1620524 - RNA, 12 nt, Human
auccuaaugaau

SEQ ID NO: 1620525 - RNA, 18 nt, Human
uugaacccgggaggcaga

SEQ ID NO: 1620526 - RNA, 19 nt, Human
uugaaauauugacuuuuua

SEQ ID NO: 1620527 - RNA, 20 nt, Human
uugaaauauaggaacuuaaa

SEQ ID NO: 1620528 - RNA, 11 nt, Human
uugaaaucuuu

SEQ ID NO: 1620529 - RNA, 21 nt, Human
uugaaauuuuuauuaaauuau

SEQ ID NO: 1620530 - RNA, 16 nt, Human
uugaaaguuuacagga

SEQ ID NO: 1620531 - RNA, 20 nt, Human
uucuguuuuucuaggccugg

SEQ ID NO: 1620532 - RNA, 21 nt, Human
uucuguuggccagugugacaa

SEQ ID NO: 1620533 - RNA, 17 nt, Human
uucuguugcugccucau

SEQ ID NO: 1620534 - RNA, 18 nt, Human
uucuguucuuucuggcua

SEQ ID NO: 1620535 - RNA, 16 nt, Human
uucuguugcugccuca

SEQ ID NO: 1620536 - RNA, 15 nt, Human
uucuguugcugccuc

SEQ ID NO: 1620537 - RNA, 13 nt, Human
uucuuaauucuua

SEQ ID NO: 1620538 - RNA, 13 nt, Human
uucuuccucugcu

SEQ ID NO: 1620539 - RNA, 12 nt, Human
uucuuccucugc

SEQ ID NO: 1620540 - RNA, 11 nt, Human
uucuuccucug

SEQ ID NO: 1620541 - RNA, 22 nt, Human
uucuuucuggcuaugcauuuga

SEQ ID NO: 1620542 - RNA, 15 nt, Human
uucuuucuuccucug

SEQ ID NO: 1620543 - RNA, 13 nt, Human
uucuuucuuccuc

SEQ ID NO: 1620544 - RNA, 12 nt, Human
uucuugcaaagu

SEQ ID NO: 1620545 - RNA, 13 nt, Human
uucuugcaaagua

SEQ ID NO: 1620546 - RNA, 20 nt, Human
aucauuucugcaucagcugc

SEQ ID NO: 1620547 - RNA, 14 nt, Human
uucuccugccucag

SEQ ID NO: 1620548 - RNA, 13 nt, Human
uucuccugccuca

SEQ ID NO: 1620549 - RNA, 12 nt, Human
uucuccugccuc

SEQ ID NO: 1620550 - RNA, 23 nt, Human
aucaggccaggcccucugcccac

SEQ ID NO: 1620551 - RNA, 22 nt, Human
aucaggccaggcccucugccca

SEQ ID NO: 1620552 - RNA, 21 nt, Human
aucaggccaggcccucugccc

SEQ ID NO: 1620553 - RNA, 21 nt, Human
aucauugaaaucuuuuugcuu

SEQ ID NO: 1620554 - RNA, 14 nt, Human
uucugacccaugcu

SEQ ID NO: 1620555 - RNA, 16 nt, Human
uucugacccaugcugc

SEQ ID NO: 1620556 - RNA, 15 nt, Human
uucugcacacagcac

SEQ ID NO: 1620557 - RNA, 13 nt, Human
uucugccgcagcc

SEQ ID NO: 1620558 - RNA, 19 nt, Human
uucugcagccacuauuguu

SEQ ID NO: 1620559 - RNA, 17 nt, Human
uucucuacucuagggaa

SEQ ID NO: 1620560 - RNA, 16 nt, Human
uucucuuuucaaaaca

SEQ ID NO: 1620561 - RNA, 14 nt, Human
auccauacauuugu

SEQ ID NO: 1620562 - RNA, 20 nt, Human
auccauuuggaaaucuuuaa

SEQ ID NO: 1620563 - RNA, 15 nt, Human
aucccaccaacccuc

SEQ ID NO: 1620564 - RNA, 13 nt, Human
auccauuuggaaa

SEQ ID NO: 1620565 - RNA, 19 nt, Human
auccauuuggaaaucuuua

SEQ ID NO: 1620566 - RNA, 17 nt, Human
auccauuuggaaaucuu

SEQ ID NO: 1620567 - RNA, 18 nt, Human
auccaguuuuguuuggac

SEQ ID NO: 1620568 - RNA, 21 nt, Human
auccaguuuuguuuggaccaa

SEQ ID NO: 1620569 - RNA, 20 nt, Human
auccaguuuuguuuggacca

SEQ ID NO: 1620570 - RNA, 15 nt, Human
uucuggcucuuccag

SEQ ID NO: 1620571 - RNA, 16 nt, Human
uucugccgcagcccug

SEQ ID NO: 1620572 - RNA, 15 nt, Human
uucugccgcagcccu

SEQ ID NO: 1620573 - RNA, 14 nt, Human
uucugccgcagccc

SEQ ID NO: 1620574 - RNA, 18 nt, Human
uucuggcuaugcauuuga

SEQ ID NO: 1620575 - RNA, 20 nt, Human
uucuggcuaugcauuugaaa

SEQ ID NO: 1620576 - RNA, 19 nt, Human
uucuguacuuuuuggcaua

SEQ ID NO: 1620577 - RNA, 18 nt, Human
uucuguacuuuuuggcau

SEQ ID NO: 1620578 - RNA, 22 nt, Human
uucugguugaugccugugaacu

SEQ ID NO: 1620579 - RNA, 13 nt, Human
uucuguacuuuuu

SEQ ID NO: 1620580 - RNA, 19 nt, Human
uucuaaaucuccaaaauaa

SEQ ID NO: 1620581 - RNA, 13 nt, Human
uucgcuccugugu

SEQ ID NO: 1620582 - RNA, 15 nt, Human
uucuaaaguaaaaac

SEQ ID NO: 1620583 - RNA, 20 nt, Human
uucuaaguaaaaccacagca

SEQ ID NO: 1620584 - RNA, 19 nt, Human
uucuaaguaaaaccacagc

SEQ ID NO: 1620585 - RNA, 17 nt, Human
uucuaaguaaaaccaca

SEQ ID NO: 1620586 - RNA, 13 nt, Human
uucuaagaaguga

SEQ ID NO: 1620587 - RNA, 18 nt, Human
aucaauaaaaaauuauga

SEQ ID NO: 1620588 - RNA, 17 nt, Human
aucaauaaaaaauuaug

SEQ ID NO: 1620589 - RNA, 15 nt, Human
aucaauaaaaaauua

SEQ ID NO: 1620590 - RNA, 20 nt, Human
uucgauacaccgggccugga

SEQ ID NO: 1620591 - RNA, 21 nt, Human
uucgcaggauucuuccucccu

SEQ ID NO: 1620592 - RNA, 13 nt, Human
uucuauaauuuaa

SEQ ID NO: 1620593 - RNA, 14 nt, Human
uucuauaauuuaaa

SEQ ID NO: 1620594 - RNA, 21 nt, Human
uucucacugccaugccagcuu

SEQ ID NO: 1620595 - RNA, 21 nt, Human
uucuaaguaaaaccacagcag

SEQ ID NO: 1620596 - RNA, 13 nt, Human
uucucagaaucuc

SEQ ID NO: 1620597 - RNA, 13 nt, Human
uucucagcuccca

SEQ ID NO: 1620598 - RNA, 14 nt, Human
aucaggccaggccc

SEQ ID NO: 1620599 - RNA, 13 nt, Human
aucaggccaggcc

SEQ ID NO: 1620600 - RNA, 19 nt, Human
aucagacuaugaaguuuuu

SEQ ID NO: 1620601 - RNA, 20 nt, Human
aucaaauaugcaaagcacug

SEQ ID NO: 1620602 - RNA, 16 nt, Human
auauuuuuauauuuac

SEQ ID NO: 1620603 - RNA, 20 nt, Human
aucaaccccuucgcuccugu

SEQ ID NO: 1620604 - RNA, 19 nt, Human
aucaaccccuucgcuccug

SEQ ID NO: 1620605 - RNA, 22 nt, Human
aucaaccccuucgcuccugugu

SEQ ID NO: 1620606 - RNA, 14 nt, Human
aucaaguuauuuuu

SEQ ID NO: 1620607 - RNA, 23 nt, Human
aucaaguuggcuucuaaucaaag

SEQ ID NO: 1620608 - RNA, 22 nt, Human
aucaaguuggcuucuaaucaaa

SEQ ID NO: 1620609 - RNA, 17 nt, Human
auauuuucauucuccua

SEQ ID NO: 1620610 - RNA, 20 nt, Human
uuccuucaaagcaaaugucu

SEQ ID NO: 1620611 - RNA, 12 nt, Human
uuccucuccacu

SEQ ID NO: 1620612 - RNA, 16 nt, Human
uuccucuccacugccu

SEQ ID NO: 1620613 - RNA, 15 nt, Human
uuccucuccacugcc

SEQ ID NO: 1620614 - RNA, 14 nt, Human
uuccucuccacugc

SEQ ID NO: 1620615 - RNA, 13 nt, Human
uuccucuccacug

SEQ ID NO: 1620616 - RNA, 20 nt, Human
uucccuuuuuuggcugcuga

SEQ ID NO: 1620617 - RNA, 19 nt, Human
uucccuuuuuuggcugcug

SEQ ID NO: 1620618 - RNA, 18 nt, Human
uucccuuuuuuggcugcu

SEQ ID NO: 1620619 - RNA, 15 nt, Human
uucccuauuagagaa

SEQ ID NO: 1620620 - RNA, 17 nt, Human
uucccuacuuccuguga

SEQ ID NO: 1620621 - RNA, 16 nt, Human
uucccuacuuccugug

SEQ ID NO: 1620622 - RNA, 14 nt, Human
uucccuacuuccug

SEQ ID NO: 1620623 - RNA, 22 nt, Human
uuccccuuccuaauuccacagc

SEQ ID NO: 1620624 - RNA, 17 nt, Human
uuccccuguucacucua

SEQ ID NO: 1620625 - RNA, 14 nt, Human
uuccccuguucacu

SEQ ID NO: 1620626 - RNA, 20 nt, Human
auauuuuacauaaauuuagu

SEQ ID NO: 1620627 - RNA, 16 nt, Human
auauuuuacauaaauu

SEQ ID NO: 1620628 - RNA, 15 nt, Human
auauuuuacauaaau

SEQ ID NO: 1620629 - RNA, 19 nt, Human
uuguucuggcucuuccagg

SEQ ID NO: 1620630 - RNA, 17 nt, Human
uuguguguuuauuguca

SEQ ID NO: 1620631 - RNA, 22 nt, Human
uuguucuggcucuuccaggcug

SEQ ID NO: 1620632 - RNA, 20 nt, Human
uuguucuggcucuuccaggc

SEQ ID NO: 1620633 - RNA, 23 nt, Human
uugugugaaagguacuucaaauc

SEQ ID NO: 1620634 - RNA, 19 nt, Human
uuguguaaauacaauuuug

SEQ ID NO: 1620635 - RNA, 13 nt, Human
uugugguuaaucu

SEQ ID NO: 1620636 - RNA, 23 nt, Human
augagagacacacugaagaagca

SEQ ID NO: 1620637 - RNA, 21 nt, Human
augagagacacacugaagaag

SEQ ID NO: 1620638 - RNA, 20 nt, Human
augagagacacacugaagaa

SEQ ID NO: 1620639 - RNA, 21 nt, Human
uugugaggaagccgcuggggc

SEQ ID NO: 1620640 - RNA, 19 nt, Human
uugugauacaaugcugugc

SEQ ID NO: 1620641 - RNA, 18 nt, Human
uugugauacaaugcugug

SEQ ID NO: 1620642 - RNA, 22 nt, Human
augauuaugaauuacauuugua

SEQ ID NO: 1620643 - RNA, 21 nt, Human
augauuaaccacuucagcuga

SEQ ID NO: 1620644 - RNA, 20 nt, Human
augauuaaccacuucagcug

SEQ ID NO: 1620645 - RNA, 19 nt, Human
augauuaaccacuucagcu

SEQ ID NO: 1620646 - RNA, 15 nt, Human
uuguugucugcaacu

SEQ ID NO: 1620647 - RNA, 12 nt, Human
augauucccagc

SEQ ID NO: 1620648 - RNA, 17 nt, Human
augauuucagcucacug

SEQ ID NO: 1620649 - RNA, 21 nt, Human
augauucaacagguuuuccug

SEQ ID NO: 1620650 - RNA, 21 nt, Human
augauucaaaugucuauaaac

SEQ ID NO: 1620651 - RNA, 12 nt, Human
augcacuuuguu

SEQ ID NO: 1620652 - RNA, 14 nt, Human
augcaccagcccuu

SEQ ID NO: 1620653 - RNA, 13 nt, Human
augcaccagcccu

SEQ ID NO: 1620654 - RNA, 19 nt, Human
augauuucagcucacugca

SEQ ID NO: 1620655 - RNA, 16 nt, Human
augauuucuaugcuga

SEQ ID NO: 1620656 - RNA, 13 nt, Human
augauuucuaugc

SEQ ID NO: 1620657 - RNA, 12 nt, Human
augauuucuaug

SEQ ID NO: 1620658 - RNA, 15 nt, Human
augcaaagcacugac

SEQ ID NO: 1620659 - RNA, 14 nt, Human
uuguuuucauuauc

SEQ ID NO: 1620660 - RNA, 15 nt, Human
uuguuuuacugucuu

SEQ ID NO: 1620661 - RNA, 14 nt, Human
uuuaaauguuuuuu

SEQ ID NO: 1620662 - RNA, 16 nt, Human
uuguuuucaguguaca

SEQ ID NO: 1620663 - RNA, 13 nt, Human
uuguuuucagugu

SEQ ID NO: 1620664 - RNA, 15 nt, Human
augcacuuuguucug

SEQ ID NO: 1620665 - RNA, 16 nt, Human
augcacuuuguucugg

SEQ ID NO: 1620666 - RNA, 17 nt, Human
uuuaagugcugcauuua

SEQ ID NO: 1620667 - RNA, 19 nt, Human
uuuaagugcugcauuuaaa

SEQ ID NO: 1620668 - RNA, 15 nt, Human
uuuaagugcugcauu

SEQ ID NO: 1620669 - RNA, 16 nt, Human
uuuaagugcugcauuu

SEQ ID NO: 1620670 - RNA, 12 nt, Human
uuuaauuuuaca

SEQ ID NO: 1620671 - RNA, 17 nt, Human
augcaguucugaagaag

SEQ ID NO: 1620672 - RNA, 15 nt, Human
augcaguucugaaga

SEQ ID NO: 1620673 - RNA, 13 nt, Human
augcagccucaca

SEQ ID NO: 1620674 - RNA, 19 nt, Human
uuuaauuuuuuugagacag

SEQ ID NO: 1620675 - RNA, 17 nt, Human
uuuaauuuuggaauuuu

SEQ ID NO: 1620676 - RNA, 15 nt, Human
uuuaauuuuggaauu

SEQ ID NO: 1620677 - RNA, 14 nt, Human
uuuaauuuuggaau

SEQ ID NO: 1620678 - RNA, 15 nt, Human
augcagccucacagu

SEQ ID NO: 1620679 - RNA, 14 nt, Human
augcagccucacag

SEQ ID NO: 1620680 - RNA, 17 nt, Human
augcagccucacagucc

SEQ ID NO: 1620681 - RNA, 17 nt, Human
augccacuaaauugaca

SEQ ID NO: 1620682 - RNA, 15 nt, Human
augccacuaaauuga

SEQ ID NO: 1620683 - RNA, 11 nt, Human
augcccagccc

SEQ ID NO: 1620684 - RNA, 19 nt, Human
augcaguucugaagaagau

SEQ ID NO: 1620685 - RNA, 18 nt, Human
augcaguucugaagaaga

SEQ ID NO: 1620686 - RNA, 17 nt, Human
auggaauacucuuauau

SEQ ID NO: 1620687 - RNA, 16 nt, Human
auggaagacagcucuu

SEQ ID NO: 1620688 - RNA, 16 nt, Human
auggaauacucuuaua

SEQ ID NO: 1620689 - RNA, 14 nt, Human
uuucacugcuggcu

SEQ ID NO: 1620690 - RNA, 18 nt, Human
uuucacugcuggcugccu

SEQ ID NO: 1620691 - RNA, 17 nt, Human
uuucacugcuggcugcc

SEQ ID NO: 1620692 - RNA, 22 nt, Human
uuucacugcuggcugccuuaga

SEQ ID NO: 1620693 - RNA, 20 nt, Human
uuucacugcuggcugccuua

SEQ ID NO: 1620694 - RNA, 14 nt, Human
auggacaugaucuu

SEQ ID NO: 1620695 - RNA, 19 nt, Human
auggacaugaucuucuuua

SEQ ID NO: 1620696 - RNA, 20 nt, Human
auggcuaguaucaaaagaaa

SEQ ID NO: 1620697 - RNA, 20 nt, Human
auggccuuugcuugaaagaa

SEQ ID NO: 1620698 - RNA, 21 nt, Human
auggccgggcgcgguggcuca

SEQ ID NO: 1620699 - RNA, 16 nt, Human
auggccagguggccac

SEQ ID NO: 1620700 - RNA, 22 nt, Human
auggccagguggccacuccaga

SEQ ID NO: 1620701 - RNA, 23 nt, Human
auggacguguuaugacuccagaa

SEQ ID NO: 1620702 - RNA, 18 nt, Human
auggauuuccagccaaag

SEQ ID NO: 1620703 - RNA, 20 nt, Human
auggacguguuaugacucca

SEQ ID NO: 1620704 - RNA, 19 nt, Human
auggacguguuaugacucc

SEQ ID NO: 1620705 - RNA, 19 nt, Human
auggacuaacuugucuuug

SEQ ID NO: 1620706 - RNA, 17 nt, Human
auggcacaucagcacga

SEQ ID NO: 1620707 - RNA, 23 nt, Human
auggcacaucagcacgauuucug

SEQ ID NO: 1620708 - RNA, 22 nt, Human
auggcacaaucucggcucacug

SEQ ID NO: 1620709 - RNA, 19 nt, Human
auggcaaggacugcaggga

SEQ ID NO: 1620710 - RNA, 15 nt, Human
augcuagaacucccu

SEQ ID NO: 1620711 - RNA, 23 nt, Human
uuuauuacaguauaauuaacaug

SEQ ID NO: 1620712 - RNA, 19 nt, Human
augcuagaacucccuuuca

SEQ ID NO: 1620713 - RNA, 16 nt, Human
augcuagaacucccuu

SEQ ID NO: 1620714 - RNA, 16 nt, Human
uuuauuacuguaagaa

SEQ ID NO: 1620715 - RNA, 22 nt, Human
augcuguaacuuucugaaauaa

SEQ ID NO: 1620716 - RNA, 15 nt, Human
augcucugcauguua

SEQ ID NO: 1620717 - RNA, 22 nt, Human
augcugucuacacuaagagaga

SEQ ID NO: 1620718 - RNA, 23 nt, Human
augcugucccuuacgugaguccu

SEQ ID NO: 1620719 - RNA, 19 nt, Human
augcugucccuuacgugag

SEQ ID NO: 1620720 - RNA, 15 nt, Human
auggaagacagcucu

SEQ ID NO: 1620721 - RNA, 16 nt, Human
auggaacacucugaga

SEQ ID NO: 1620722 - RNA, 15 nt, Human
auggaacacucugag

SEQ ID NO: 1620723 - RNA, 14 nt, Human
auggaacacucuga

SEQ ID NO: 1620724 - RNA, 11 nt, Human
auggaacacuc

SEQ ID NO: 1620725 - RNA, 13 nt, Human
uuuauauaagcuu

SEQ ID NO: 1620726 - RNA, 24 nt, Human
uuuauggcuuuugugcauuaucua

SEQ ID NO: 1620727 - RNA, 22 nt, Human
uuuauuacaguauaauuaacau

SEQ ID NO: 1620728 - RNA, 20 nt, Human
uuuagcuggaaaaguauguu

SEQ ID NO: 1620729 - RNA, 18 nt, Human
augccccgucccccucug

SEQ ID NO: 1620730 - RNA, 22 nt, Human
uuuagcuggaaaaguauguuag

SEQ ID NO: 1620731 - RNA, 16 nt, Human
uuuaguaucuuuuuau

SEQ ID NO: 1620732 - RNA, 14 nt, Human
uuuagucuugucuc

SEQ ID NO: 1620733 - RNA, 21 nt, Human
aucucauuuccaagcaaguau

SEQ ID NO: 1620734 - RNA, 23 nt, Human
aucucauuuccaagcaaguauua

SEQ ID NO: 1620735 - RNA, 13 nt, Human
aucuccaaaauaa

SEQ ID NO: 1620736 - RNA, 13 nt, Human
aucucccccagcc

SEQ ID NO: 1620737 - RNA, 12 nt, Human
aucucccccagc

SEQ ID NO: 1620738 - RNA, 14 nt, Human
aucucccccagccc

SEQ ID NO: 1620739 - RNA, 16 nt, Human
aucuccccaucauugg

SEQ ID NO: 1620740 - RNA, 13 nt, Human
aucucaauauuuc

SEQ ID NO: 1620741 - RNA, 15 nt, Human
aucucacacaugagc

SEQ ID NO: 1620742 - RNA, 16 nt, Human
aucucacacaugagca

SEQ ID NO: 1620743 - RNA, 17 nt, Human
aucucaccuccugcugg

SEQ ID NO: 1620744 - RNA, 19 nt, Human
auccuaguuccaccaucaa

SEQ ID NO: 1620745 - RNA, 15 nt, Human
auccuaguuccacca

SEQ ID NO: 1620746 - RNA, 14 nt, Human
aucucagggccugg

SEQ ID NO: 1620747 - RNA, 21 nt, Human
aucucaccuccugcugggcag

SEQ ID NO: 1620748 - RNA, 20 nt, Human
aucucaccuccugcugggca

SEQ ID NO: 1620749 - RNA, 11 nt, Human
aucucagccca

SEQ ID NO: 1620750 - RNA, 14 nt, Human
uugauucagacagc

SEQ ID NO: 1620751 - RNA, 19 nt, Human
uugauggugguauguuuuc

SEQ ID NO: 1620752 - RNA, 23 nt, Human
uugauggugaugaaauguaaaua

SEQ ID NO: 1620753 - RNA, 18 nt, Human
uugauggugguauguuuu

SEQ ID NO: 1620754 - RNA, 15 nt, Human
uugaugggauuuggu

SEQ ID NO: 1620755 - RNA, 12 nt, Human
uugaugccuggc

SEQ ID NO: 1620756 - RNA, 19 nt, Human
aucucuucuggguuccuuc

SEQ ID NO: 1620757 - RNA, 16 nt, Human
uugauucagacagcug

SEQ ID NO: 1620758 - RNA, 15 nt, Human
uugauucagacagcu

SEQ ID NO: 1620759 - RNA, 12 nt, Human
uugcaugaggcu

SEQ ID NO: 1620760 - RNA, 14 nt, Human
uugcaccacugcac

SEQ ID NO: 1620761 - RNA, 14 nt, Human
uugcaucugaaaau

SEQ ID NO: 1620762 - RNA, 13 nt, Human
uugcccuguuaaa

SEQ ID NO: 1620763 - RNA, 13 nt, Human
uugccgucuaccu

SEQ ID NO: 1620764 - RNA, 18 nt, Human
uugccgucuaccugaggg

SEQ ID NO: 1620765 - RNA, 15 nt, Human
uugccgucuaccuga

SEQ ID NO: 1620766 - RNA, 19 nt, Human
uugccgucuaccugagggg

SEQ ID NO: 1620767 - RNA, 14 nt, Human
uugccguuauuaaa

SEQ ID NO: 1620768 - RNA, 22 nt, Human
uugccuaaauccauuuggaaau

SEQ ID NO: 1620769 - RNA, 15 nt, Human
uugccuaaauccauu

SEQ ID NO: 1620770 - RNA, 14 nt, Human
uugccuaaauccau

SEQ ID NO: 1620771 - RNA, 13 nt, Human
uugccuaaaucca

SEQ ID NO: 1620772 - RNA, 18 nt, Human
aucugaugcaagcaagaa

SEQ ID NO: 1620773 - RNA, 21 nt, Human
aucugaggaauucuguauaga

SEQ ID NO: 1620774 - RNA, 20 nt, Human
aucugaggaauucuguauag

SEQ ID NO: 1620775 - RNA, 18 nt, Human
aucugaggaauucuguau

SEQ ID NO: 1620776 - RNA, 17 nt, Human
aucugaggaauucugua

SEQ ID NO: 1620777 - RNA, 16 nt, Human
aucugaggaauucugu

SEQ ID NO: 1620778 - RNA, 15 nt, Human
aucugaggaauucug

SEQ ID NO: 1620779 - RNA, 19 nt, Human
aucuggguucacugcaacc

SEQ ID NO: 1620780 - RNA, 20 nt, Human
aucugccuaaggacuucuuu

SEQ ID NO: 1620781 - RNA, 19 nt, Human
aucugccuaaggacuucuu

SEQ ID NO: 1620782 - RNA, 18 nt, Human
aucugccuaaggacuucu

SEQ ID NO: 1620783 - RNA, 13 nt, Human
aucugccuaagga

SEQ ID NO: 1620784 - RNA, 17 nt, Human
aucugccuaaggacuuc

SEQ ID NO: 1620785 - RNA, 16 nt, Human
aucugccuaaggacuu

SEQ ID NO: 1620786 - RNA, 15 nt, Human
aucugccuaaggacu

SEQ ID NO: 1620787 - RNA, 14 nt, Human
aucugccuaaggac

SEQ ID NO: 1620788 - RNA, 19 nt, Human
aucugugaacuugaaauuu

SEQ ID NO: 1620789 - RNA, 18 nt, Human
aucugugaacuugaaauu

SEQ ID NO: 1620790 - RNA, 17 nt, Human
aucugugaacuugaaau

SEQ ID NO: 1620791 - RNA, 13 nt, Human
aucugugaacuug

SEQ ID NO: 1620792 - RNA, 19 nt, Human
aucuugcucugcugacaga

SEQ ID NO: 1620793 - RNA, 18 nt, Human
aucuugaauuguaaggaa

SEQ ID NO: 1620794 - RNA, 15 nt, Human
augaaagcagggacu

SEQ ID NO: 1620795 - RNA, 12 nt, Human
augaaagauuca

SEQ ID NO: 1620796 - RNA, 13 nt, Human
aucuuuuucuaac

SEQ ID NO: 1620797 - RNA, 13 nt, Human
aucuuuuuauuca

SEQ ID NO: 1620798 - RNA, 13 nt, Human
uuggcugcaggga

SEQ ID NO: 1620799 - RNA, 22 nt, Human
aucuuuaauuuuacauuuccua

SEQ ID NO: 1620800 - RNA, 21 nt, Human
aucuuuaauuuuacauuuccu

SEQ ID NO: 1620801 - RNA, 16 nt, Human
aucuuuaauuuuacau

SEQ ID NO: 1620802 - RNA, 21 nt, Human
uuggauaauaaggaaaaguuu

SEQ ID NO: 1620803 - RNA, 19 nt, Human
uuggauaauaaggaaaagu

SEQ ID NO: 1620804 - RNA, 15 nt, Human
uuggauaauaaggaa

SEQ ID NO: 1620805 - RNA, 23 nt, Human
uuggcgcugccccuggcagcccc

SEQ ID NO: 1620806 - RNA, 18 nt, Human
uuggcuagagguucaaag

SEQ ID NO: 1620807 - RNA, 15 nt, Human
augaauuaaguuuuu

SEQ ID NO: 1620808 - RNA, 14 nt, Human
uuggggauauuuuu

SEQ ID NO: 1620809 - RNA, 13 nt, Human
uuggggauucuua

SEQ ID NO: 1620810 - RNA, 18 nt, Human
uugggccccagaggcugg

SEQ ID NO: 1620811 - RNA, 22 nt, Human
uuggggggcugaggugggagga

SEQ ID NO: 1620812 - RNA, 15 nt, Human
uuggggauucuuaaa

SEQ ID NO: 1620813 - RNA, 18 nt, Human
augaaauauuauguuaaa

SEQ ID NO: 1620814 - RNA, 15 nt, Human
augaaagggcccaga

SEQ ID NO: 1620815 - RNA, 17 nt, Human
augaaauauuauguuaa

SEQ ID NO: 1620816 - RNA, 13 nt, Human
augaaauauuaug

SEQ ID NO: 1620817 - RNA, 15 nt, Human
augaagauacugaaa

SEQ ID NO: 1620818 - RNA, 13 nt, Human
augaaugaauggc

SEQ ID NO: 1620819 - RNA, 18 nt, Human
augaagauguagaggaga

SEQ ID NO: 1620820 - RNA, 17 nt, Human
augaagauacugaaaua

SEQ ID NO: 1620821 - RNA, 16 nt, Human
augaagauacugaaau

SEQ ID NO: 1620822 - RNA, 20 nt, Human
augaaugucagugugacuga

SEQ ID NO: 1620823 - RNA, 19 nt, Human
augagagacacacugaaga

SEQ ID NO: 1620824 - RNA, 17 nt, Human
augagagacacacugaa

SEQ ID NO: 1620825 - RNA, 14 nt, Human
augagagacacacu

SEQ ID NO: 1620826 - RNA, 13 nt, Human
augagagacacac

SEQ ID NO: 1620827 - RNA, 22 nt, Human
augagaaagguugaagcaccaa

SEQ ID NO: 1620828 - RNA, 21 nt, Human
augagaaagguugaagcacca

SEQ ID NO: 1620829 - RNA, 18 nt, Human
augagaaaucuaaaaaac

SEQ ID NO: 1620830 - RNA, 15 nt, Human
augagaaaucuaaaa

SEQ ID NO: 1620831 - RNA, 23 nt, Human
augagaaaucuaaaaaacgaaaa

SEQ ID NO: 1620832 - RNA, 16 nt, Human
augacuuacuguacau

SEQ ID NO: 1620833 - RNA, 17 nt, Human
augacuuacuguacaug

SEQ ID NO: 1620834 - RNA, 18 nt, Human
augacacgaauauugcug

SEQ ID NO: 1620835 - RNA, 22 nt, Human
augacuuaagcacacuugacau

SEQ ID NO: 1620836 - RNA, 14 nt, Human
augacuuacuguac

SEQ ID NO: 1620837 - RNA, 16 nt, Human
uuguaucacaaaucuu

SEQ ID NO: 1620838 - RNA, 14 nt, Human
augacacaugcaag

SEQ ID NO: 1620839 - RNA, 22 nt, Human
augacacaugcaaggucauuuu

SEQ ID NO: 1620840 - RNA, 23 nt, Human
uuguaguguuggagaagaacuga

SEQ ID NO: 1620841 - RNA, 17 nt, Human
uuguauaaaauaauuuu

SEQ ID NO: 1620842 - RNA, 15 nt, Human
uuguauaaaauaauu

SEQ ID NO: 1620843 - RNA, 16 nt, Human
uuguauaaaauaauuu

SEQ ID NO: 1620844 - RNA, 22 nt, Human
uuguacaaaguauuaagcauau

SEQ ID NO: 1620845 - RNA, 21 nt, Human
uuguacaaaguauuaagcaua

SEQ ID NO: 1620846 - RNA, 20 nt, Human
uuguacaaaguauuaagcau

SEQ ID NO: 1620847 - RNA, 17 nt, Human
uuguacaaaguauuaag

SEQ ID NO: 1620848 - RNA, 15 nt, Human
uuguacaaaguauua

SEQ ID NO: 1620849 - RNA, 14 nt, Human
uuguacaaaguauu

SEQ ID NO: 1620850 - RNA, 13 nt, Human
uuguacaaaguau

SEQ ID NO: 1620851 - RNA, 19 nt, Human
caaagugcugggauuacaa

SEQ ID NO: 1620852 - RNA, 21 nt, Human
caaaguucccuacuuccugug

SEQ ID NO: 1620853 - RNA, 20 nt, Human
caaaguucccuacuuccugu

SEQ ID NO: 1620854 - RNA, 23 nt, Human
caaagugcugggauuacaagcgu

SEQ ID NO: 1620855 - RNA, 18 nt, Human
caaagugcugggauuaca

SEQ ID NO: 1620856 - RNA, 14 nt, Human
caaauguucaucaa

SEQ ID NO: 1620857 - RNA, 18 nt, Human
caaauguucaucaaugaa

SEQ ID NO: 1620858 - RNA, 20 nt, Human
caaauguucaucaaugaaug

SEQ ID NO: 1620859 - RNA, 23 nt, Human
caaauggaaaugggcagagcaga

SEQ ID NO: 1620860 - RNA, 12 nt, Human
caaauaugcaaa

SEQ ID NO: 1620861 - RNA, 23 nt, Human
caaauauauucagccuggcuuca

SEQ ID NO: 1620862 - RNA, 13 nt, Human
caaauaugcaaag

SEQ ID NO: 1620863 - RNA, 14 nt, Human
caaauaugcaaagc

SEQ ID NO: 1620864 - RNA, 15 nt, Human
caaauuucuaaaucu

SEQ ID NO: 1620865 - RNA, 22 nt, Human
caaauuucuaaaucuccaaaau

SEQ ID NO: 1620866 - RNA, 19 nt, Human
caacauacucccaucugug

SEQ ID NO: 1620867 - RNA, 17 nt, Human
caacauacucccaucug

SEQ ID NO: 1620868 - RNA, 12 nt, Human
caacaggcuggg

SEQ ID NO: 1620869 - RNA, 23 nt, Human
caacagcuggugcccugcuuuca

SEQ ID NO: 1620870 - RNA, 16 nt, Human
caaccuucuguggcuc

SEQ ID NO: 1620871 - RNA, 16 nt, Human
caaccuggucacagga

SEQ ID NO: 1620872 - RNA, 20 nt, Human
caaccuucuguggcucacag

SEQ ID NO: 1620873 - RNA, 19 nt, Human
caaccuucuguggcucaca

SEQ ID NO: 1620874 - RNA, 17 nt, Human
caaccuucuguggcuca

SEQ ID NO: 1620875 - RNA, 20 nt, Human
caacauacucccaucuguga

SEQ ID NO: 1620876 - RNA, 18 nt, Human
caaccugcucuccucuug

SEQ ID NO: 1620877 - RNA, 23 nt, Human
caaccugcucuccucuugccacu

SEQ ID NO: 1620878 - RNA, 21 nt, Human
caaccugcucuccucuugcca

SEQ ID NO: 1620879 - RNA, 19 nt, Human
caagaaaugaaagcaggga

SEQ ID NO: 1620880 - RNA, 17 nt, Human
caagaaaugaaagcagg

SEQ ID NO: 1620881 - RNA, 13 nt, Human
caagaagcccagg

SEQ ID NO: 1620882 - RNA, 14 nt, Human
caagaagcccagga

SEQ ID NO: 1620883 - RNA, 16 nt, Human
caacuuguaaaugugg

SEQ ID NO: 1620884 - RNA, 12 nt, Human
caacuugggaac

SEQ ID NO: 1620885 - RNA, 13 nt, Human
caagagcccaggc

SEQ ID NO: 1620886 - RNA, 17 nt, Human
caagagcuuaacagugu

SEQ ID NO: 1620887 - RNA, 15 nt, Human
caagacgcugugcug

SEQ ID NO: 1620888 - RNA, 13 nt, Human
caagacgcugugc

SEQ ID NO: 1620889 - RNA, 23 nt, Human
caagaccuucuccuucaccuuug

SEQ ID NO: 1620890 - RNA, 21 nt, Human
caagaccuucuccuucaccuu

SEQ ID NO: 1620891 - RNA, 23 nt, Human
caagggaauuucuucaacucccu

SEQ ID NO: 1620892 - RNA, 16 nt, Human
caaaauaaaacuuuuu

SEQ ID NO: 1620893 - RNA, 20 nt, Human
caaaauaaaacuuuuuaaaa

SEQ ID NO: 1620894 - RNA, 21 nt, Human
caaaaucgaugcagugcuucc

SEQ ID NO: 1620895 - RNA, 18 nt, Human
caaaacugcacugucaag

SEQ ID NO: 1620896 - RNA, 17 nt, Human
caaaacugcacugucaa

SEQ ID NO: 1620897 - RNA, 14 nt, Human
caaaacugcacugu

SEQ ID NO: 1620898 - RNA, 19 nt, Human
caaaacucuccucugcugc

SEQ ID NO: 1620899 - RNA, 14 nt, Human
caaaaguuucucuu

SEQ ID NO: 1620900 - RNA, 16 nt, Human
caaaacucuccucugc

SEQ ID NO: 1620901 - RNA, 15 nt, Human
caaaacucuccucug

SEQ ID NO: 1620902 - RNA, 21 nt, Human
caaaacgguuuuacugcagcu

SEQ ID NO: 1620903 - RNA, 15 nt, Human
caaaacgguuuuacu

SEQ ID NO: 1620904 - RNA, 18 nt, Human
auuuuauuuuauuaugca

SEQ ID NO: 1620905 - RNA, 16 nt, Human
caaacugacucuuaag

SEQ ID NO: 1620906 - RNA, 21 nt, Human
caaacucuugaccucagguga

SEQ ID NO: 1620907 - RNA, 21 nt, Human
caaacugacucuuaagaagac

SEQ ID NO: 1620908 - RNA, 17 nt, Human
caaacugacucuuaaga

SEQ ID NO: 1620909 - RNA, 20 nt, Human
caaacucuugaccucaggug

SEQ ID NO: 1620910 - RNA, 19 nt, Human
caaacucuugaccucaggu

SEQ ID NO: 1620911 - RNA, 17 nt, Human
caaacucuugaccucag

SEQ ID NO: 1620912 - RNA, 22 nt, Human
caaaaugaaacgcaaccaccac

SEQ ID NO: 1620913 - RNA, 11 nt, Human
caaaaugaaac

SEQ ID NO: 1620914 - RNA, 21 nt, Human
caaaaugagcccuguccugcc

SEQ ID NO: 1620915 - RNA, 15 nt, Human
caaacagaggccgcc

SEQ ID NO: 1620916 - RNA, 13 nt, Human
caaacagaggccg

SEQ ID NO: 1620917 - RNA, 13 nt, Human
caacaggcugggc

SEQ ID NO: 1620918 - RNA, 18 nt, Human
caauaauaauaccucccu

SEQ ID NO: 1620919 - RNA, 19 nt, Human
caauagucaaauuguguga

SEQ ID NO: 1620920 - RNA, 17 nt, Human
caauagucaaauugugu

SEQ ID NO: 1620921 - RNA, 17 nt, Human
caauaggaaaaacugau

SEQ ID NO: 1620922 - RNA, 16 nt, Human
caauaggaaaaacuga

SEQ ID NO: 1620923 - RNA, 15 nt, Human
caauaggaaaaacug

SEQ ID NO: 1620924 - RNA, 21 nt, Human
caagggugaugggaaagcauu

SEQ ID NO: 1620925 - RNA, 18 nt, Human
caaggcugggggaagaag

SEQ ID NO: 1620926 - RNA, 23 nt, Human
caagggugaugggaaagcauugu

SEQ ID NO: 1620927 - RNA, 18 nt, Human
caaggaaaaaauaacaau

SEQ ID NO: 1620928 - RNA, 23 nt, Human
caagcuggucccacucaguccau

SEQ ID NO: 1620929 - RNA, 22 nt, Human
caagcuggucccacucagucca

SEQ ID NO: 1620930 - RNA, 20 nt, Human
caaggaaaaaauaacaauga

SEQ ID NO: 1620931 - RNA, 22 nt, Human
caaggcugcagugagccgagau

SEQ ID NO: 1620932 - RNA, 17 nt, Human
caaggcugcagugagcc

SEQ ID NO: 1620933 - RNA, 20 nt, Human
caaggauccugagccagauu

SEQ ID NO: 1620934 - RNA, 22 nt, Human
caaggauccugagccagauuuc

SEQ ID NO: 1620935 - RNA, 14 nt, Human
caaggagccaaaca

SEQ ID NO: 1620936 - RNA, 19 nt, Human
caaggauccugagccagau

SEQ ID NO: 1620937 - RNA, 18 nt, Human
caaggauccugagccaga

SEQ ID NO: 1620938 - RNA, 16 nt, Human
caaggagauuuacaac

SEQ ID NO: 1620939 - RNA, 21 nt, Human
caagcugcacccucaggcagg

SEQ ID NO: 1620940 - RNA, 18 nt, Human
caagcgauucuucugcuu

SEQ ID NO: 1620941 - RNA, 17 nt, Human
caagcgauucuucugcu

SEQ ID NO: 1620942 - RNA, 15 nt, Human
caagcgauucuucug

SEQ ID NO: 1620943 - RNA, 21 nt, Human
caagcuggucccacucagucc

SEQ ID NO: 1620944 - RNA, 22 nt, Human
caagcugcacccucaggcaggu

SEQ ID NO: 1620945 - RNA, 18 nt, Human
caauaggaaaaacugauu

SEQ ID NO: 1620946 - RNA, 14 nt, Human
cacacugaagaagc

SEQ ID NO: 1620947 - RNA, 13 nt, Human
cacacugaagaag

SEQ ID NO: 1620948 - RNA, 14 nt, Human
cacacuccagcugg

SEQ ID NO: 1620949 - RNA, 21 nt, Human
cacagagaaaguacuucucca

SEQ ID NO: 1620950 - RNA, 20 nt, Human
cacagagaaaguacuucucc

SEQ ID NO: 1620951 - RNA, 19 nt, Human
cacagagaaaguacuucuc

SEQ ID NO: 1620952 - RNA, 13 nt, Human
cacagaggcugcc

SEQ ID NO: 1620953 - RNA, 22 nt, Human
cacagaguuguuacauuuuuaa

SEQ ID NO: 1620954 - RNA, 19 nt, Human
cacagcaguugaaaagacu

SEQ ID NO: 1620955 - RNA, 22 nt, Human
cacagauuugagcucagcccug

SEQ ID NO: 1620956 - RNA, 18 nt, Human
cacagauuugagcucagc

SEQ ID NO: 1620957 - RNA, 17 nt, Human
cacagauuugagcucag

SEQ ID NO: 1620958 - RNA, 16 nt, Human
cacagauuugagcuca

SEQ ID NO: 1620959 - RNA, 21 nt, Human
cacagcaguugaaaagacucc

SEQ ID NO: 1620960 - RNA, 18 nt, Human
cacagccagacuggcaca

SEQ ID NO: 1620961 - RNA, 17 nt, Human
cacagccagacuggcac

SEQ ID NO: 1620962 - RNA, 22 nt, Human
caauuuuucuuauuucauuucu

SEQ ID NO: 1620963 - RNA, 14 nt, Human
cacaaacagaggcc

SEQ ID NO: 1620964 - RNA, 15 nt, Human
cacaaacagaggccg

SEQ ID NO: 1620965 - RNA, 18 nt, Human
cacaaagcccuuccaugu

SEQ ID NO: 1620966 - RNA, 13 nt, Human
cacaaacagaggc

SEQ ID NO: 1620967 - RNA, 18 nt, Human
caauuacaggaaguacug

SEQ ID NO: 1620968 - RNA, 21 nt, Human
caauaucuuuuuuuuaauaaa

SEQ ID NO: 1620969 - RNA, 22 nt, Human
caaugugacuuaaugccacuaa

SEQ ID NO: 1620970 - RNA, 22 nt, Human
caaugugaaaagaaaaaugagc

SEQ ID NO: 1620971 - RNA, 18 nt, Human
cacaagaaaugaaagcag

SEQ ID NO: 1620972 - RNA, 13 nt, Human
cacaaaggagagc

SEQ ID NO: 1620973 - RNA, 21 nt, Human
cacaagaaaugaaagcaggga

SEQ ID NO: 1620974 - RNA, 20 nt, Human
cacaagaaaugaaagcaggg

SEQ ID NO: 1620975 - RNA, 17 nt, Human
cacaaagguagcuuuuc

SEQ ID NO: 1620976 - RNA, 17 nt, Human
cacacacgcgugcacac

SEQ ID NO: 1620977 - RNA, 17 nt, Human
cacaguucaauucucau

SEQ ID NO: 1620978 - RNA, 19 nt, Human
cacagugcaucucagccca

SEQ ID NO: 1620979 - RNA, 18 nt, Human
cacagugcaucucagccc

SEQ ID NO: 1620980 - RNA, 22 nt, Human
cacaggcccuuccucuccacug

SEQ ID NO: 1620981 - RNA, 21 nt, Human
cacaggcccuuccucuccacu

SEQ ID NO: 1620982 - RNA, 12 nt, Human
cacagcugcuca

SEQ ID NO: 1620983 - RNA, 22 nt, Human
cacagcugcucaauaaaguaca

SEQ ID NO: 1620984 - RNA, 13 nt, Human
cacaggaaaccag

SEQ ID NO: 1620985 - RNA, 19 nt, Human
cacaggcccuuccucucca

SEQ ID NO: 1620986 - RNA, 18 nt, Human
cacaggcccuuccucucc

SEQ ID NO: 1620987 - RNA, 17 nt, Human
cacaggcccuuccucuc

SEQ ID NO: 1620988 - RNA, 16 nt, Human
cacaggcccuuccucu

SEQ ID NO: 1620989 - RNA, 12 nt, Human
cauauuuucaug

SEQ ID NO: 1620990 - RNA, 18 nt, Human
caucaaugaaugaaugaa

SEQ ID NO: 1620991 - RNA, 22 nt, Human
caucaagucuuucacauuuaaa

SEQ ID NO: 1620992 - RNA, 14 nt, Human
caucaagaugugac

SEQ ID NO: 1620993 - RNA, 14 nt, Human
cauauuuacuucuu

SEQ ID NO: 1620994 - RNA, 13 nt, Human
cauaugccugggc

SEQ ID NO: 1620995 - RNA, 17 nt, Human
cauauuuacuucuuaua

SEQ ID NO: 1620996 - RNA, 16 nt, Human
cauauuuacuucuuau

SEQ ID NO: 1620997 - RNA, 20 nt, Human
cauauuuacuucuuauacau

SEQ ID NO: 1620998 - RNA, 12 nt, Human
cauauuuauaaa

SEQ ID NO: 1620999 - RNA, 17 nt, Human
cauauuuauaaaaauaa

SEQ ID NO: 1621000 - RNA, 21 nt, Human
cauagagagcaagacgcugug

SEQ ID NO: 1621001 - RNA, 19 nt, Human
cauagagagcaagacgcug

SEQ ID NO: 1621002 - RNA, 23 nt, Human
cauagagagcaagacgcugugcu

SEQ ID NO: 1621003 - RNA, 20 nt, Human
cauagaauaaaauuuuuaau

SEQ ID NO: 1621004 - RNA, 14 nt, Human
cauagaauaaaauu

SEQ ID NO: 1621005 - RNA, 20 nt, Human
cauacucccaucugugaaag

SEQ ID NO: 1621006 - RNA, 18 nt, Human
cauacucccaucugugaa

SEQ ID NO: 1621007 - RNA, 15 nt, Human
cauacucccaucugu

SEQ ID NO: 1621008 - RNA, 16 nt, Human
cauacucccaucugug

SEQ ID NO: 1621009 - RNA, 11 nt, Human
cauacucugcu

SEQ ID NO: 1621010 - RNA, 19 nt, Human
cauaguaugguggcugggu

SEQ ID NO: 1621011 - RNA, 18 nt, Human
cauaguaugguggcuggg

SEQ ID NO: 1621012 - RNA, 20 nt, Human
cauaguaugguggcuggguu

SEQ ID NO: 1621013 - RNA, 22 nt, Human
cauaguggcuuaaaacaacacu

SEQ ID NO: 1621014 - RNA, 22 nt, Human
cauauauauguuuuaagaggca

SEQ ID NO: 1621015 - RNA, 23 nt, Human
cauauauauguuuuaagaggcag

SEQ ID NO: 1621016 - RNA, 21 nt, Human
cauaugauguacauguacuga

SEQ ID NO: 1621017 - RNA, 17 nt, Human
cauaugauguacaugua

SEQ ID NO: 1621018 - RNA, 15 nt, Human
cauaugauguacaug

SEQ ID NO: 1621019 - RNA, 20 nt, Human
caucccucccuccaccuccc

SEQ ID NO: 1621020 - RNA, 14 nt, Human
caucccucccucca

SEQ ID NO: 1621021 - RNA, 19 nt, Human
caucccucuggggcuguuc

SEQ ID NO: 1621022 - RNA, 13 nt, Human
caucccugaaggc

SEQ ID NO: 1621023 - RNA, 11 nt, Human
caucccugaag

SEQ ID NO: 1621024 - RNA, 12 nt, Human
caucccucccuc

SEQ ID NO: 1621025 - RNA, 13 nt, Human
caucccucccucc

SEQ ID NO: 1621026 - RNA, 17 nt, Human
cauccagguucagcuug

SEQ ID NO: 1621027 - RNA, 15 nt, Human
cauccagguucagcu

SEQ ID NO: 1621028 - RNA, 21 nt, Human
caucauugaaaucuuuuugcu

SEQ ID NO: 1621029 - RNA, 20 nt, Human
caucauugaaaucuuuuugc

SEQ ID NO: 1621030 - RNA, 15 nt, Human
caucauugaaaucuu

SEQ ID NO: 1621031 - RNA, 14 nt, Human
caucauugaaaucu

SEQ ID NO: 1621032 - RNA, 15 nt, Human
caucaccaacgucug

SEQ ID NO: 1621033 - RNA, 13 nt, Human
caucauugaaauc

SEQ ID NO: 1621034 - RNA, 17 nt, Human
cauccuacaagacacag

SEQ ID NO: 1621035 - RNA, 21 nt, Human
caucccugaaggccccgccca

SEQ ID NO: 1621036 - RNA, 19 nt, Human
caucccugaaggccccgcc

SEQ ID NO: 1621037 - RNA, 18 nt, Human
caucccugaaggccccgc

SEQ ID NO: 1621038 - RNA, 17 nt, Human
caucccugaaggccccg

SEQ ID NO: 1621039 - RNA, 22 nt, Human
caucccugaaggccccgcccag

SEQ ID NO: 1621040 - RNA, 14 nt, Human
cauccuaacuccau

SEQ ID NO: 1621041 - RNA, 21 nt, Human
cauccuaacuccaugucucug

SEQ ID NO: 1621042 - RNA, 22 nt, Human
caucuagugagcagucaggaaa

SEQ ID NO: 1621043 - RNA, 17 nt, Human
caucucacacaugagca

SEQ ID NO: 1621044 - RNA, 16 nt, Human
caucucacacaugagc

SEQ ID NO: 1621045 - RNA, 20 nt, Human
caucucacacaugagcauca

SEQ ID NO: 1621046 - RNA, 18 nt, Human
caucucaccuccugcugg

SEQ ID NO: 1621047 - RNA, 17 nt, Human
caucucaccuccugcug

SEQ ID NO: 1621048 - RNA, 16 nt, Human
caucucaccuccugcu

SEQ ID NO: 1621049 - RNA, 13 nt, Human
caucucagcccac

SEQ ID NO: 1621050 - RNA, 14 nt, Human
caucuagugagcag

SEQ ID NO: 1621051 - RNA, 18 nt, Human
caucuagguaaauuacag

SEQ ID NO: 1621052 - RNA, 17 nt, Human
caucuagguaaauuaca

SEQ ID NO: 1621053 - RNA, 15 nt, Human
caucuacccuccgau

SEQ ID NO: 1621054 - RNA, 12 nt, Human
caucuaggauuu

SEQ ID NO: 1621055 - RNA, 18 nt, Human
cauccucuguacagagcc

SEQ ID NO: 1621056 - RNA, 15 nt, Human
cauccucuguacaga

SEQ ID NO: 1621057 - RNA, 19 nt, Human
cauccucuguacagagccc

SEQ ID NO: 1621058 - RNA, 21 nt, Human
cauccucuguacagagcccac

SEQ ID NO: 1621059 - RNA, 19 nt, Human
cauccuccucagaucuucu

SEQ ID NO: 1621060 - RNA, 18 nt, Human
cauccuccucagaucuuc

SEQ ID NO: 1621061 - RNA, 16 nt, Human
cauccuccucagaucu

SEQ ID NO: 1621062 - RNA, 15 nt, Human
cauccuccucagauc

SEQ ID NO: 1621063 - RNA, 12 nt, Human
cauccuccucag

SEQ ID NO: 1621064 - RNA, 11 nt, Human
cauccuccuca

SEQ ID NO: 1621065 - RNA, 20 nt, Human
cauccuccgccucccggguu

SEQ ID NO: 1621066 - RNA, 22 nt, Human
cauccucauacccacccccacc

SEQ ID NO: 1621067 - RNA, 21 nt, Human
cauccucauacccacccccac

SEQ ID NO: 1621068 - RNA, 18 nt, Human
cauccucauacccacccc

SEQ ID NO: 1621069 - RNA, 17 nt, Human
cauccucauacccaccc

SEQ ID NO: 1621070 - RNA, 13 nt, Human
cauccucccaagg

SEQ ID NO: 1621071 - RNA, 16 nt, Human
cauccucauacccacc

SEQ ID NO: 1621072 - RNA, 15 nt, Human
cauccucauacccac

SEQ ID NO: 1621073 - RNA, 16 nt, Human
cauccuacaagacaca

SEQ ID NO: 1621074 - RNA, 20 nt, Human
caucuugcucugcugacaga

SEQ ID NO: 1621075 - RNA, 14 nt, Human
caucuugcucugcu

SEQ ID NO: 1621076 - RNA, 15 nt, Human
caucuugcucugcug

SEQ ID NO: 1621077 - RNA, 13 nt, Human
caucuugcucugc

SEQ ID NO: 1621078 - RNA, 22 nt, Human
caucucuucuggguuccuuccu

SEQ ID NO: 1621079 - RNA, 14 nt, Human
caucuccacuccag

SEQ ID NO: 1621080 - RNA, 22 nt, Human
caucuuccaaggguacuaagga

SEQ ID NO: 1621081 - RNA, 16 nt, Human
caucucuuguuuaaau

SEQ ID NO: 1621082 - RNA, 19 nt, Human
cauaaucuggacuccucug

SEQ ID NO: 1621083 - RNA, 17 nt, Human
cauaccaacacgagcag

SEQ ID NO: 1621084 - RNA, 15 nt, Human
cauaauacuugcuuu

SEQ ID NO: 1621085 - RNA, 13 nt, Human
cauaccacuuuug

SEQ ID NO: 1621086 - RNA, 14 nt, Human
cauaccacuuuugu

SEQ ID NO: 1621087 - RNA, 15 nt, Human
cauaccacuuuuguu

SEQ ID NO: 1621088 - RNA, 18 nt, Human
cauaccacuuuuguucuu

SEQ ID NO: 1621089 - RNA, 12 nt, Human
cauacccacccc

SEQ ID NO: 1621090 - RNA, 11 nt, Human
cauacccaccc

SEQ ID NO: 1621091 - RNA, 19 nt, Human
cauaccacuuuuguucuug

SEQ ID NO: 1621092 - RNA, 14 nt, Human
cauaagauaaaugu

SEQ ID NO: 1621093 - RNA, 21 nt, Human
cauaaaaauuagccaagugug

SEQ ID NO: 1621094 - RNA, 22 nt, Human
cauaaacaagaccacguuucua

SEQ ID NO: 1621095 - RNA, 20 nt, Human
cauaaacaagaccacguuuc

SEQ ID NO: 1621096 - RNA, 21 nt, Human
cauaaacaagaccacguuucu

SEQ ID NO: 1621097 - RNA, 16 nt, Human
cauaaagcaggcagaa

SEQ ID NO: 1621098 - RNA, 14 nt, Human
cauaaagcaggcag

SEQ ID NO: 1621099 - RNA, 16 nt, Human
cauaaccuagccuuag

SEQ ID NO: 1621100 - RNA, 21 nt, Human
cauaacauaaaucugugaacu

SEQ ID NO: 1621101 - RNA, 20 nt, Human
cauaaauuuaguauuuuguu

SEQ ID NO: 1621102 - RNA, 19 nt, Human
cauaaauuuaguauuuugu

SEQ ID NO: 1621103 - RNA, 19 nt, Human
cauaacauaaaucugugaa

SEQ ID NO: 1621104 - RNA, 12 nt, Human
cauaacauaaau

SEQ ID NO: 1621105 - RNA, 14 nt, Human
cauaaaucugugaa

SEQ ID NO: 1621106 - RNA, 23 nt, Human
cauaaaucugugaacuugaaauu

SEQ ID NO: 1621107 - RNA, 22 nt, Human
cauaaaucugugaacuugaaau

SEQ ID NO: 1621108 - RNA, 18 nt, Human
cauaaaucugugaacuug

SEQ ID NO: 1621109 - RNA, 16 nt, Human
cauaaaucugugaacu

SEQ ID NO: 1621110 - RNA, 20 nt, Human
caguuuucugagaaagacua

SEQ ID NO: 1621111 - RNA, 19 nt, Human
caguuuucugagaaagacu

SEQ ID NO: 1621112 - RNA, 18 nt, Human
caguuguuagugugucuu

SEQ ID NO: 1621113 - RNA, 21 nt, Human
caguuuuguuuggaccaaaaa

SEQ ID NO: 1621114 - RNA, 15 nt, Human
caguuuucugagaaa

SEQ ID NO: 1621115 - RNA, 14 nt, Human
caguuuucugagaa

SEQ ID NO: 1621116 - RNA, 17 nt, Human
caguuguuagugugucu

SEQ ID NO: 1621117 - RNA, 22 nt, Human
caguuggucccccuuccaugga

SEQ ID NO: 1621118 - RNA, 21 nt, Human
caguuggucccccuuccaugg

SEQ ID NO: 1621119 - RNA, 20 nt, Human
caguuggucccccuuccaug

SEQ ID NO: 1621120 - RNA, 19 nt, Human
caguuggucccccuuccau

SEQ ID NO: 1621121 - RNA, 18 nt, Human
caguuggucccccuucca

SEQ ID NO: 1621122 - RNA, 19 nt, Human
caguuggguggaugccugg

SEQ ID NO: 1621123 - RNA, 18 nt, Human
caguuggguggaugccug

SEQ ID NO: 1621124 - RNA, 23 nt, Human
caguugccagucaccccggccac

SEQ ID NO: 1621125 - RNA, 16 nt, Human
caguuggguggaugcc

SEQ ID NO: 1621126 - RNA, 14 nt, Human
caguugaaaagacu

SEQ ID NO: 1621127 - RNA, 18 nt, Human
caguugaaaagacuccaa

SEQ ID NO: 1621128 - RNA, 22 nt, Human
caguugaaaagacuccaaagaa

SEQ ID NO: 1621129 - RNA, 21 nt, Human
caguugaaaagacuccaaaga

SEQ ID NO: 1621130 - RNA, 23 nt, Human
caguugaaaagacuccaaagaaa

SEQ ID NO: 1621131 - RNA, 21 nt, Human
cauacccacccccacccaagg

SEQ ID NO: 1621132 - RNA, 18 nt, Human
cauacccacccccaccca

SEQ ID NO: 1621133 - RNA, 17 nt, Human
cauacccacccccaccc

SEQ ID NO: 1621134 - RNA, 14 nt, Human
cauacccaccccca

SEQ ID NO: 1621135 - RNA, 13 nt, Human
cauacguacacau

SEQ ID NO: 1621136 - RNA, 15 nt, Human
cauacguacacauuu

SEQ ID NO: 1621137 - RNA, 16 nt, Human
cauacguacacauuuu

SEQ ID NO: 1621138 - RNA, 17 nt, Human
cauacguacacauuuua

SEQ ID NO: 1621139 - RNA, 18 nt, Human
cauacguacacauuuuau

SEQ ID NO: 1621140 - RNA, 14 nt, Human
cauacuaaccagca

SEQ ID NO: 1621141 - RNA, 21 nt, Human
cauacuaaccagcagaaaugc

SEQ ID NO: 1621142 - RNA, 20 nt, Human
cauacuaauuauacccccug

SEQ ID NO: 1621143 - RNA, 12 nt, Human
cagugugacuga

SEQ ID NO: 1621144 - RNA, 14 nt, Human
cagugugacaagga

SEQ ID NO: 1621145 - RNA, 14 nt, Human
cagugucaaugcag

SEQ ID NO: 1621146 - RNA, 23 nt, Human
caguguacauggaauaacaugua

SEQ ID NO: 1621147 - RNA, 20 nt, Human
caguguacauggaauaacau

SEQ ID NO: 1621148 - RNA, 16 nt, Human
caguguacauggaaua

SEQ ID NO: 1621149 - RNA, 22 nt, Human
cagugguuccuaauccucuagg

SEQ ID NO: 1621150 - RNA, 16 nt, Human
cagugggacagggcau

SEQ ID NO: 1621151 - RNA, 11 nt, Human
cagugggaacu

SEQ ID NO: 1621152 - RNA, 16 nt, Human
caguggcagcugcuuu

SEQ ID NO: 1621153 - RNA, 15 nt, Human
caguggcagcugcuu

SEQ ID NO: 1621154 - RNA, 14 nt, Human
caguggcagcugcu

SEQ ID NO: 1621155 - RNA, 13 nt, Human
caguggcagcugc

SEQ ID NO: 1621156 - RNA, 12 nt, Human
caguggcagcug

SEQ ID NO: 1621157 - RNA, 22 nt, Human
caguucggugagcuacaaaugc

SEQ ID NO: 1621158 - RNA, 15 nt, Human
caguucucuccuucu

SEQ ID NO: 1621159 - RNA, 14 nt, Human
caguucucuccuuc

SEQ ID NO: 1621160 - RNA, 13 nt, Human
caguucucuccuu

SEQ ID NO: 1621161 - RNA, 12 nt, Human
caguucugaaga

SEQ ID NO: 1621162 - RNA, 22 nt, Human
caguucucuccuucuucccccc

SEQ ID NO: 1621163 - RNA, 14 nt, Human
caguucugaagaag

SEQ ID NO: 1621164 - RNA, 13 nt, Human
caguucugaagaa

SEQ ID NO: 1621165 - RNA, 22 nt, Human
caguucugaagaagaugguacc

SEQ ID NO: 1621166 - RNA, 16 nt, Human
caguucugaagaagau

SEQ ID NO: 1621167 - RNA, 15 nt, Human
caguucugaagaaga

SEQ ID NO: 1621168 - RNA, 19 nt, Human
caguugaaaaacagcugag

SEQ ID NO: 1621169 - RNA, 18 nt, Human
caguugaaaaacagcuga

SEQ ID NO: 1621170 - RNA, 12 nt, Human
caguugaaaaac

SEQ ID NO: 1621171 - RNA, 21 nt, Human
caguuaccucugccucagaaa

SEQ ID NO: 1621172 - RNA, 14 nt, Human
caguuacucagaau

SEQ ID NO: 1621173 - RNA, 14 nt, Human
caguuaagagaaau

SEQ ID NO: 1621174 - RNA, 13 nt, Human
caguuaagagaaa

SEQ ID NO: 1621175 - RNA, 17 nt, Human
caguuaagccuuuggaa

SEQ ID NO: 1621176 - RNA, 15 nt, Human
caguuaagccuuugg

SEQ ID NO: 1621177 - RNA, 14 nt, Human
caguuaagccuuug

SEQ ID NO: 1621178 - RNA, 20 nt, Human
caguuaagccuuuggaaaca

SEQ ID NO: 1621179 - RNA, 19 nt, Human
caguguuguggauuuaaca

SEQ ID NO: 1621180 - RNA, 20 nt, Human
caguguuguggauuuaacag

SEQ ID NO: 1621181 - RNA, 22 nt, Human
caguguuguggauuuaacagaa

SEQ ID NO: 1621182 - RNA, 17 nt, Human
caugggacagggaggac

SEQ ID NO: 1621183 - RNA, 22 nt, Human
caugggaaugaaugucagugug

SEQ ID NO: 1621184 - RNA, 23 nt, Human
caugggacagggaggacgcucuc

SEQ ID NO: 1621185 - RNA, 15 nt, Human
caugggccuccugug

SEQ ID NO: 1621186 - RNA, 17 nt, Human
caugggccuccugugug

SEQ ID NO: 1621187 - RNA, 16 nt, Human
caugggccuccugugu

SEQ ID NO: 1621188 - RNA, 17 nt, Human
cauggagguuugaagau

SEQ ID NO: 1621189 - RNA, 13 nt, Human
cauggacuuuguu

SEQ ID NO: 1621190 - RNA, 11 nt, Human
cauggacuuug

SEQ ID NO: 1621191 - RNA, 18 nt, Human
caugggaaugaaugucag

SEQ ID NO: 1621192 - RNA, 16 nt, Human
cauggaguauauguca

SEQ ID NO: 1621193 - RNA, 23 nt, Human
caugcugucuacacuaagagaga

SEQ ID NO: 1621194 - RNA, 22 nt, Human
caugcugucccuuacgugaguc

SEQ ID NO: 1621195 - RNA, 20 nt, Human
caugcuguucaugaaagauu

SEQ ID NO: 1621196 - RNA, 23 nt, Human
caugccuggauggggcugcaccg

SEQ ID NO: 1621197 - RNA, 21 nt, Human
caugccuggauggggcugcac

SEQ ID NO: 1621198 - RNA, 18 nt, Human
caugccuggauggggcug

SEQ ID NO: 1621199 - RNA, 22 nt, Human
cauggaaguacuauaauuuacc

SEQ ID NO: 1621200 - RNA, 20 nt, Human
cauggaaguacuauaauuua

SEQ ID NO: 1621201 - RNA, 23 nt, Human
cauggaacgcguugaaauuguaa

SEQ ID NO: 1621202 - RNA, 20 nt, Human
cauggaacgcguugaaauug

SEQ ID NO: 1621203 - RNA, 19 nt, Human
cauggaacgcguugaaauu

SEQ ID NO: 1621204 - RNA, 18 nt, Human
cauggaacgcguugaaau

SEQ ID NO: 1621205 - RNA, 18 nt, Human
cauggacaugaucuucuu

SEQ ID NO: 1621206 - RNA, 16 nt, Human
cauggaauaacaugua

SEQ ID NO: 1621207 - RNA, 13 nt, Human
caugccuggaugg

SEQ ID NO: 1621208 - RNA, 19 nt, Human
caugccucucucaggccaa

SEQ ID NO: 1621209 - RNA, 18 nt, Human
caugccucucucaggcca

SEQ ID NO: 1621210 - RNA, 17 nt, Human
caugccucucucaggcc

SEQ ID NO: 1621211 - RNA, 16 nt, Human
caugccucucucaggc

SEQ ID NO: 1621212 - RNA, 15 nt, Human
caugccucucucagg

SEQ ID NO: 1621213 - RNA, 14 nt, Human
caugccucucucag

SEQ ID NO: 1621214 - RNA, 13 nt, Human
caugccccugaac

SEQ ID NO: 1621215 - RNA, 20 nt, Human
caugccagcuuaucucaggg

SEQ ID NO: 1621216 - RNA, 19 nt, Human
caugccagcuuaucucagg

SEQ ID NO: 1621217 - RNA, 18 nt, Human
cauguuuuucuucucccu

SEQ ID NO: 1621218 - RNA, 15 nt, Human
cauguuuuguuuacg

SEQ ID NO: 1621219 - RNA, 21 nt, Human
cauuaaagccugaguuugcuu

SEQ ID NO: 1621220 - RNA, 11 nt, Human
cauuauuuuau

SEQ ID NO: 1621221 - RNA, 18 nt, Human
cauuagcaguuugcuuug

SEQ ID NO: 1621222 - RNA, 17 nt, Human
cauuagcaguuugcuuu

SEQ ID NO: 1621223 - RNA, 22 nt, Human
caugugccagguuuuuggucug

SEQ ID NO: 1621224 - RNA, 21 nt, Human
caugugccagguuuuuggucu

SEQ ID NO: 1621225 - RNA, 15 nt, Human
caugugcacaugcac

SEQ ID NO: 1621226 - RNA, 23 nt, Human
cauguuugauguaucugagcagg

SEQ ID NO: 1621227 - RNA, 22 nt, Human
cauguuucuuuguaaugaaaac

SEQ ID NO: 1621228 - RNA, 21 nt, Human
cauguuucuuuguaaugaaaa

SEQ ID NO: 1621229 - RNA, 22 nt, Human
cauguuuauuacaguauaauua

SEQ ID NO: 1621230 - RNA, 20 nt, Human
cauguuuauuacaguauaau

SEQ ID NO: 1621231 - RNA, 19 nt, Human
cauguuuauuacaguauaa

SEQ ID NO: 1621232 - RNA, 18 nt, Human
cauguuuauuacaguaua

SEQ ID NO: 1621233 - RNA, 13 nt, Human
cauguuuauuaca

SEQ ID NO: 1621234 - RNA, 12 nt, Human
cauguuuauuac

SEQ ID NO: 1621235 - RNA, 16 nt, Human
cauggucggaaaacau

SEQ ID NO: 1621236 - RNA, 21 nt, Human
cauguaauuaaguacuaugua

SEQ ID NO: 1621237 - RNA, 18 nt, Human
cauguaauuaaguacuau

SEQ ID NO: 1621238 - RNA, 15 nt, Human
caugucgccucugca

SEQ ID NO: 1621239 - RNA, 14 nt, Human
caugucgccucugc

SEQ ID NO: 1621240 - RNA, 20 nt, Human
caugucgccucugcauucag

SEQ ID NO: 1621241 - RNA, 18 nt, Human
caugucgccucugcauuc

SEQ ID NO: 1621242 - RNA, 23 nt, Human
caugucuuuucuugcaugaggcu

SEQ ID NO: 1621243 - RNA, 21 nt, Human
caugucuuuucuugcaugagg

SEQ ID NO: 1621244 - RNA, 19 nt, Human
caugucuuuucuugcauga

SEQ ID NO: 1621245 - RNA, 14 nt, Human
caugucuuuucuug

SEQ ID NO: 1621246 - RNA, 17 nt, Human
caugugaaaucauucau

SEQ ID NO: 1621247 - RNA, 16 nt, Human
caugugaaaucauuca

SEQ ID NO: 1621248 - RNA, 15 nt, Human
caugugaaaucauuc

SEQ ID NO: 1621249 - RNA, 20 nt, Human
ccaauauucauagcagcuua

SEQ ID NO: 1621250 - RNA, 16 nt, Human
ccaaguggcucccaca

SEQ ID NO: 1621251 - RNA, 13 nt, Human
ccaaguggcuccc

SEQ ID NO: 1621252 - RNA, 19 nt, Human
ccaaggcugauuaaaccaa

SEQ ID NO: 1621253 - RNA, 16 nt, Human
ccaaggcucugagcaa

SEQ ID NO: 1621254 - RNA, 14 nt, Human
ccaaggcuggggga

SEQ ID NO: 1621255 - RNA, 22 nt, Human
ccacaagaaaugaaagcaggga

SEQ ID NO: 1621256 - RNA, 16 nt, Human
ccacaagaaaugaaag

SEQ ID NO: 1621257 - RNA, 13 nt, Human
ccacaagagccca

SEQ ID NO: 1621258 - RNA, 16 nt, Human
ccacaagacccuugug

SEQ ID NO: 1621259 - RNA, 18 nt, Human
ccacaaaggagagcuagc

SEQ ID NO: 1621260 - RNA, 13 nt, Human
ccacaacacacag

SEQ ID NO: 1621261 - RNA, 18 nt, Human
ccaaggcuagaaccaccu

SEQ ID NO: 1621262 - RNA, 14 nt, Human
ccaagcuccaucuc

SEQ ID NO: 1621263 - RNA, 13 nt, Human
ccaagcucccagg

SEQ ID NO: 1621264 - RNA, 12 nt, Human
ccaagcucccag

SEQ ID NO: 1621265 - RNA, 23 nt, Human
ccaagccguggcuucccgcucag

SEQ ID NO: 1621266 - RNA, 14 nt, Human
ccaagcaggacaug

SEQ ID NO: 1621267 - RNA, 21 nt, Human
ccaagccguggcuucccgcuc

SEQ ID NO: 1621268 - RNA, 17 nt, Human
ccaagccguggcuuccc

SEQ ID NO: 1621269 - RNA, 16 nt, Human
ccaagccguggcuucc

SEQ ID NO: 1621270 - RNA, 15 nt, Human
ccaagccguggcuuc

SEQ ID NO: 1621271 - RNA, 20 nt, Human
ccacaaguuaaauaaaucau

SEQ ID NO: 1621272 - RNA, 15 nt, Human
ccacaaguuaaauaa

SEQ ID NO: 1621273 - RNA, 19 nt, Human
ccacaagagcccaggccuc

SEQ ID NO: 1621274 - RNA, 18 nt, Human
ccacaagagcccaggccu

SEQ ID NO: 1621275 - RNA, 17 nt, Human
ccacaagagcccaggcc

SEQ ID NO: 1621276 - RNA, 16 nt, Human
ccacaagagcccaggc

SEQ ID NO: 1621277 - RNA, 21 nt, Human
ccacaagagcccaggccuccu

SEQ ID NO: 1621278 - RNA, 20 nt, Human
ccacaagagcccaggccucc

SEQ ID NO: 1621279 - RNA, 14 nt, Human
ccaacacgagcagg

SEQ ID NO: 1621280 - RNA, 19 nt, Human
ccaaagcagugcaugcugu

SEQ ID NO: 1621281 - RNA, 22 nt, Human
ccaaauucuuucaguggcuacc

SEQ ID NO: 1621282 - RNA, 15 nt, Human
ccaaauucuuucagu

SEQ ID NO: 1621283 - RNA, 21 nt, Human
ccaacacgagcaggcuacugu

SEQ ID NO: 1621284 - RNA, 14 nt, Human
ccaacauacuccca

SEQ ID NO: 1621285 - RNA, 16 nt, Human
ccaacauacucccauc

SEQ ID NO: 1621286 - RNA, 16 nt, Human
ccaacaucaacaucuu

SEQ ID NO: 1621287 - RNA, 15 nt, Human
ccaacccucaucacc

SEQ ID NO: 1621288 - RNA, 13 nt, Human
ccaacccucauca

SEQ ID NO: 1621289 - RNA, 18 nt, Human
ccaacccuggcacccagg

SEQ ID NO: 1621290 - RNA, 15 nt, Human
ccaagaccuucuccu

SEQ ID NO: 1621291 - RNA, 14 nt, Human
ccaaagaugcagcc

SEQ ID NO: 1621292 - RNA, 13 nt, Human
ccaaagaugcagc

SEQ ID NO: 1621293 - RNA, 17 nt, Human
ccaaagaaauguaaggg

SEQ ID NO: 1621294 - RNA, 17 nt, Human
ccaaacucaccugcccc

SEQ ID NO: 1621295 - RNA, 18 nt, Human
ccaaaauaaaacuuuuua

SEQ ID NO: 1621296 - RNA, 21 nt, Human
ccaaaauaaaacuuuuuaaaa

SEQ ID NO: 1621297 - RNA, 20 nt, Human
cauuuuuaguagagacaggg

SEQ ID NO: 1621298 - RNA, 16 nt, Human
cauuugcucauggaau

SEQ ID NO: 1621299 - RNA, 22 nt, Human
cauuugaggucuguucuuucca

SEQ ID NO: 1621300 - RNA, 14 nt, Human
cauuugcucaugga

SEQ ID NO: 1621301 - RNA, 15 nt, Human
cauuugcucauggaa

SEQ ID NO: 1621302 - RNA, 22 nt, Human
cauuuuauuuuauuaugcauga

SEQ ID NO: 1621303 - RNA, 21 nt, Human
cauuuuauuuuauuaugcaug

SEQ ID NO: 1621304 - RNA, 19 nt, Human
cauuuuauuuuauuaugca

SEQ ID NO: 1621305 - RNA, 24 nt, Human
cauuuugcuaaaugugaaugauga

SEQ ID NO: 1621306 - RNA, 21 nt, Human
cauuuugcuaaaugugaauga

SEQ ID NO: 1621307 - RNA, 18 nt, Human
cauuuugcuaaaugugaa

SEQ ID NO: 1621308 - RNA, 22 nt, Human
cauuuugggguacccacugcuc

SEQ ID NO: 1621309 - RNA, 21 nt, Human
cauuuugggguacccacugcu

SEQ ID NO: 1621310 - RNA, 20 nt, Human
cauuuugggguacccacugc

SEQ ID NO: 1621311 - RNA, 15 nt, Human
cauuuuuaagugcug

SEQ ID NO: 1621312 - RNA, 20 nt, Human
cauuuuuaagugcugcauuu

SEQ ID NO: 1621313 - RNA, 19 nt, Human
cauuuuuaguagagacagg

SEQ ID NO: 1621314 - RNA, 23 nt, Human
cauuuugggguacccacugcucu

SEQ ID NO: 1621315 - RNA, 23 nt, Human
cauuucuuccacaagagcccagg

SEQ ID NO: 1621316 - RNA, 14 nt, Human
cauuugagcagggc

SEQ ID NO: 1621317 - RNA, 16 nt, Human
cauuugagcagggcuc

SEQ ID NO: 1621318 - RNA, 17 nt, Human
cauuugaggucuguucu

SEQ ID NO: 1621319 - RNA, 18 nt, Human
cauuugaggucuguucuu

SEQ ID NO: 1621320 - RNA, 19 nt, Human
cauuugaggucuguucuuu

SEQ ID NO: 1621321 - RNA, 19 nt, Human
cauuuaaagcuuauuaaaa

SEQ ID NO: 1621322 - RNA, 21 nt, Human
cauuuacuuuguguucaccuu

SEQ ID NO: 1621323 - RNA, 17 nt, Human
cauuuacuuuguguuca

SEQ ID NO: 1621324 - RNA, 23 nt, Human
cauuucugcaucagcugcugaaa

SEQ ID NO: 1621325 - RNA, 21 nt, Human
cauuucuuccacaagagccca

SEQ ID NO: 1621326 - RNA, 15 nt, Human
cauuuccuaaauaua

SEQ ID NO: 1621327 - RNA, 19 nt, Human
cauugaaaucuuuuugcuu

SEQ ID NO: 1621328 - RNA, 16 nt, Human
cauuauuuuauuauga

SEQ ID NO: 1621329 - RNA, 14 nt, Human
cauuauuuuauuau

SEQ ID NO: 1621330 - RNA, 12 nt, Human
cauuauuuuauu

SEQ ID NO: 1621331 - RNA, 22 nt, Human
cauugaccugaggcccuucucu

SEQ ID NO: 1621332 - RNA, 13 nt, Human
cauugaccugagg

SEQ ID NO: 1621333 - RNA, 17 nt, Human
cauuauuuuauuaugaa

SEQ ID NO: 1621334 - RNA, 15 nt, Human
ccauccugaggcucc

SEQ ID NO: 1621335 - RNA, 21 nt, Human
ccauccucuguacagagccca

SEQ ID NO: 1621336 - RNA, 16 nt, Human
ccauccugaggcucca

SEQ ID NO: 1621337 - RNA, 16 nt, Human
ccaucaugucuggcua

SEQ ID NO: 1621338 - RNA, 14 nt, Human
ccaucaugucuggc

SEQ ID NO: 1621339 - RNA, 23 nt, Human
ccaucucaccuccugcugggcag

SEQ ID NO: 1621340 - RNA, 16 nt, Human
ccaucgcugucaucuc

SEQ ID NO: 1621341 - RNA, 21 nt, Human
ccaucucaccuccugcugggc

SEQ ID NO: 1621342 - RNA, 19 nt, Human
ccaucucaccuccugcugg

SEQ ID NO: 1621343 - RNA, 19 nt, Human
ccauauucuguuggccagu

SEQ ID NO: 1621344 - RNA, 18 nt, Human
ccauauucuguuggccag

SEQ ID NO: 1621345 - RNA, 15 nt, Human
ccauauucuguuggc

SEQ ID NO: 1621346 - RNA, 23 nt, Human
ccauagagagcaagacgcugugc

SEQ ID NO: 1621347 - RNA, 12 nt, Human
ccaucacccgcu

SEQ ID NO: 1621348 - RNA, 12 nt, Human
ccaucaagccac

SEQ ID NO: 1621349 - RNA, 23 nt, Human
ccagggacagaggggguggccuc

SEQ ID NO: 1621350 - RNA, 12 nt, Human
ccaggccugccu

SEQ ID NO: 1621351 - RNA, 21 nt, Human
ccagcugugcucuggacaggc

SEQ ID NO: 1621352 - RNA, 20 nt, Human
ccagcugugcucuggacagg

SEQ ID NO: 1621353 - RNA, 18 nt, Human
ccagcugugcucuggaca

SEQ ID NO: 1621354 - RNA, 17 nt, Human
ccagcuggguuggaaaa

SEQ ID NO: 1621355 - RNA, 16 nt, Human
ccagcuggguuggaaa

SEQ ID NO: 1621356 - RNA, 15 nt, Human
ccagcugcuugggcu

SEQ ID NO: 1621357 - RNA, 18 nt, Human
ccagcugcuugggcuuca

SEQ ID NO: 1621358 - RNA, 16 nt, Human
ccagcugcuugggcuu

SEQ ID NO: 1621359 - RNA, 12 nt, Human
ccagcuggccgg

SEQ ID NO: 1621360 - RNA, 20 nt, Human
ccagcuggccgggagccuga

SEQ ID NO: 1621361 - RNA, 14 nt, Human
ccagcuggccggga

SEQ ID NO: 1621362 - RNA, 19 nt, Human
ccaggccuccuacagcuug

SEQ ID NO: 1621363 - RNA, 18 nt, Human
ccaggccuccuacagcuu

SEQ ID NO: 1621364 - RNA, 13 nt, Human
ccaggccuccuac

SEQ ID NO: 1621365 - RNA, 20 nt, Human
ccaggcccucugcccacucc

SEQ ID NO: 1621366 - RNA, 19 nt, Human
ccaggcccucugcccacuc

SEQ ID NO: 1621367 - RNA, 18 nt, Human
ccaggcccucugcccacu

SEQ ID NO: 1621368 - RNA, 17 nt, Human
ccaggcccucugcccac

SEQ ID NO: 1621369 - RNA, 23 nt, Human
ccaggccccugccacccugggga

SEQ ID NO: 1621370 - RNA, 21 nt, Human
ccaggccccugccacccuggg

SEQ ID NO: 1621371 - RNA, 21 nt, Human
ccaggccagagggagugacag

SEQ ID NO: 1621372 - RNA, 14 nt, Human
ccaggccagaggga

SEQ ID NO: 1621373 - RNA, 14 nt, Human
ccaggagcagccac

SEQ ID NO: 1621374 - RNA, 15 nt, Human
ccaggagcagccaca

SEQ ID NO: 1621375 - RNA, 13 nt, Human
ccaggagcagcca

SEQ ID NO: 1621376 - RNA, 12 nt, Human
ccaggagcagcc

SEQ ID NO: 1621377 - RNA, 19 nt, Human
ccaggaagccagcaggcuc

SEQ ID NO: 1621378 - RNA, 17 nt, Human
ccaggaagccagcaggc

SEQ ID NO: 1621379 - RNA, 15 nt, Human
ccaggaagccagcag

SEQ ID NO: 1621380 - RNA, 16 nt, Human
ccagcuguucagcugg

SEQ ID NO: 1621381 - RNA, 23 nt, Human
ccagcugugcucuggacaggcau

SEQ ID NO: 1621382 - RNA, 22 nt, Human
ccagcugugcucuggacaggca

SEQ ID NO: 1621383 - RNA, 20 nt, Human
ccaggaagccagcaggcucu

SEQ ID NO: 1621384 - RNA, 23 nt, Human
ccauggcacucuauguucuaaga

SEQ ID NO: 1621385 - RNA, 13 nt, Human
ccaugugccaggu

SEQ ID NO: 1621386 - RNA, 14 nt, Human
ccauguuggccagg

SEQ ID NO: 1621387 - RNA, 13 nt, Human
ccauguuggccag

SEQ ID NO: 1621388 - RNA, 18 nt, Human
ccaugcuccuggcccacu

SEQ ID NO: 1621389 - RNA, 15 nt, Human
ccaugcuccuggccc

SEQ ID NO: 1621390 - RNA, 17 nt, Human
ccaugcugcccugugag

SEQ ID NO: 1621391 - RNA, 16 nt, Human
ccaugcugcccuguga

SEQ ID NO: 1621392 - RNA, 14 nt, Human
ccaugcugccucca

SEQ ID NO: 1621393 - RNA, 14 nt, Human
cccacgcccccacu

SEQ ID NO: 1621394 - RNA, 13 nt, Human
cccacgcccccac

SEQ ID NO: 1621395 - RNA, 15 nt, Human
cccacgcccccacug

SEQ ID NO: 1621396 - RNA, 20 nt, Human
cccaccuuggcugcagggag

SEQ ID NO: 1621397 - RNA, 19 nt, Human
cccaccuuggcugcaggga

SEQ ID NO: 1621398 - RNA, 17 nt, Human
cccaccuuggcugcagg

SEQ ID NO: 1621399 - RNA, 16 nt, Human
cccaccuggccucugc

SEQ ID NO: 1621400 - RNA, 15 nt, Human
cccaccuggccucug

SEQ ID NO: 1621401 - RNA, 12 nt, Human
cccaccuggccu

SEQ ID NO: 1621402 - RNA, 21 nt, Human
ccauguuggccaggcuggucu

SEQ ID NO: 1621403 - RNA, 19 nt, Human
ccauguuggccaggcuggu

SEQ ID NO: 1621404 - RNA, 15 nt, Human
ccauguuggccaggc

SEQ ID NO: 1621405 - RNA, 16 nt, Human
ccauguuggccaggcu

SEQ ID NO: 1621406 - RNA, 18 nt, Human
cccagcucugguccauag

SEQ ID NO: 1621407 - RNA, 16 nt, Human
cccagcucugguccau

SEQ ID NO: 1621408 - RNA, 15 nt, Human
cccagcucuggucca

SEQ ID NO: 1621409 - RNA, 12 nt, Human
cccagcucuggu

SEQ ID NO: 1621410 - RNA, 14 nt, Human
cccagcucuggucc

SEQ ID NO: 1621411 - RNA, 13 nt, Human
cccagcucugguc

SEQ ID NO: 1621412 - RNA, 14 nt, Human
cccagcgagcccug

SEQ ID NO: 1621413 - RNA, 15 nt, Human
cccagcgagcccugg

SEQ ID NO: 1621414 - RNA, 14 nt, Human
cccaggaggccagc

SEQ ID NO: 1621415 - RNA, 18 nt, Human
cccaggagccccgaggcc

SEQ ID NO: 1621416 - RNA, 14 nt, Human
cccaggagccccga

SEQ ID NO: 1621417 - RNA, 13 nt, Human
cccaggagccccg

SEQ ID NO: 1621418 - RNA, 15 nt, Human
cccagccccauccuc

SEQ ID NO: 1621419 - RNA, 14 nt, Human
cccagccccauccu

SEQ ID NO: 1621420 - RNA, 14 nt, Human
cccagccccauccc

SEQ ID NO: 1621421 - RNA, 13 nt, Human
cccagccccaucc

SEQ ID NO: 1621422 - RNA, 19 nt, Human
cccagccccauccucugua

SEQ ID NO: 1621423 - RNA, 18 nt, Human
cccagccccauccucugu

SEQ ID NO: 1621424 - RNA, 23 nt, Human
cccagcccuccuuaucaaaggac

SEQ ID NO: 1621425 - RNA, 20 nt, Human
cccagccuccaagcuccauc

SEQ ID NO: 1621426 - RNA, 18 nt, Human
cccagccuccaagcucca

SEQ ID NO: 1621427 - RNA, 12 nt, Human
cccagccccauc

SEQ ID NO: 1621428 - RNA, 11 nt, Human
cccagccccau

SEQ ID NO: 1621429 - RNA, 17 nt, Human
cccagccccaaugaaca

SEQ ID NO: 1621430 - RNA, 13 nt, Human
cccagccccaaug

SEQ ID NO: 1621431 - RNA, 16 nt, Human
cccagaggcuggguga

SEQ ID NO: 1621432 - RNA, 18 nt, Human
cccaggaggccagccuug

SEQ ID NO: 1621433 - RNA, 22 nt, Human
cccaugagccucagcauccugg

SEQ ID NO: 1621434 - RNA, 21 nt, Human
ccccaaauggaaaugggcaga

SEQ ID NO: 1621435 - RNA, 17 nt, Human
cccaugucucgacucau

SEQ ID NO: 1621436 - RNA, 16 nt, Human
cccaugucucgacuca

SEQ ID NO: 1621437 - RNA, 12 nt, Human
cccauuauucaa

SEQ ID NO: 1621438 - RNA, 20 nt, Human
cccaugagccucagcauccu

SEQ ID NO: 1621439 - RNA, 16 nt, Human
cccaugagccucagca

SEQ ID NO: 1621440 - RNA, 15 nt, Human
cccaugagccucagc

SEQ ID NO: 1621441 - RNA, 13 nt, Human
cccaugcugcccu

SEQ ID NO: 1621442 - RNA, 12 nt, Human
cccaugcugccc

SEQ ID NO: 1621443 - RNA, 14 nt, Human
cccaugcugcccug

SEQ ID NO: 1621444 - RNA, 20 nt, Human
cccaucugugaaaggaaaga

SEQ ID NO: 1621445 - RNA, 13 nt, Human
cccaucucacaca

SEQ ID NO: 1621446 - RNA, 18 nt, Human
cccaucucacacaugagc

SEQ ID NO: 1621447 - RNA, 14 nt, Human
cccaguuagcucuc

SEQ ID NO: 1621448 - RNA, 20 nt, Human
cccagugguuccuaauccuc

SEQ ID NO: 1621449 - RNA, 17 nt, Human
cccagugccgagaagga

SEQ ID NO: 1621450 - RNA, 19 nt, Human
cccagucuggaaugcagug

SEQ ID NO: 1621451 - RNA, 18 nt, Human
cccagucuggaaugcagu

SEQ ID NO: 1621452 - RNA, 10 nt, Human
cccagucugg

SEQ ID NO: 1621453 - RNA, 21 nt, Human
cccagugcccacaggaucagu

SEQ ID NO: 1621454 - RNA, 15 nt, Human
cccagugccgagaag

SEQ ID NO: 1621455 - RNA, 15 nt, Human
cccaggcauucccca

SEQ ID NO: 1621456 - RNA, 23 nt, Human
cccaggcaggucuugaacuccug

SEQ ID NO: 1621457 - RNA, 16 nt, Human
cccaggaggccagccu

SEQ ID NO: 1621458 - RNA, 15 nt, Human
cccaggaggccagcc

SEQ ID NO: 1621459 - RNA, 18 nt, Human
cccaggcauuccccagga

SEQ ID NO: 1621460 - RNA, 17 nt, Human
cccaggcauuccccagg

SEQ ID NO: 1621461 - RNA, 19 nt, Human
cccagggugggaagggcua

SEQ ID NO: 1621462 - RNA, 13 nt, Human
cccagguuucuau

SEQ ID NO: 1621463 - RNA, 14 nt, Human
ccccaggugccagu

SEQ ID NO: 1621464 - RNA, 22 nt, Human
ccccaggugguuauggagaggg

SEQ ID NO: 1621465 - RNA, 14 nt, Human
ccccuggcagcccc

SEQ ID NO: 1621466 - RNA, 12 nt, Human
ccccuggcagcc

SEQ ID NO: 1621467 - RNA, 15 nt, Human
ccccuggcagccccu

SEQ ID NO: 1621468 - RNA, 12 nt, Human
ccccaggaggcc

SEQ ID NO: 1621469 - RNA, 15 nt, Human
ccccagccccauccu

SEQ ID NO: 1621470 - RNA, 19 nt, Human
ccccagcccuccuuaucaa

SEQ ID NO: 1621471 - RNA, 16 nt, Human
ccccagccccauccca

SEQ ID NO: 1621472 - RNA, 13 nt, Human
ccccagccugcua

SEQ ID NO: 1621473 - RNA, 22 nt, Human
ccccagcuggggccaggcuggg

SEQ ID NO: 1621474 - RNA, 21 nt, Human
ccccagcuggggccaggcugg

SEQ ID NO: 1621475 - RNA, 22 nt, Human
ccccuguccccgcacugggcuu

SEQ ID NO: 1621476 - RNA, 23 nt, Human
ccccuggcuuuucacugcuggcu

SEQ ID NO: 1621477 - RNA, 14 nt, Human
ccccuuaccacugc

SEQ ID NO: 1621478 - RNA, 20 nt, Human
ccccuguucuggcagaguug

SEQ ID NO: 1621479 - RNA, 12 nt, Human
ccccuucccccu

SEQ ID NO: 1621480 - RNA, 22 nt, Human
ccccuuccuaauuccacagcug

SEQ ID NO: 1621481 - RNA, 21 nt, Human
ccccuuccuaauuccacagcu

SEQ ID NO: 1621482 - RNA, 20 nt, Human
ccccuuccuaauuccacagc

SEQ ID NO: 1621483 - RNA, 15 nt, Human
cccgaggccuucucu

SEQ ID NO: 1621484 - RNA, 20 nt, Human
cccgaggccuucucugaagg

SEQ ID NO: 1621485 - RNA, 21 nt, Human
cccgaggccuucucugaagga

SEQ ID NO: 1621486 - RNA, 22 nt, Human
cccgcuaagagggagggagggc

SEQ ID NO: 1621487 - RNA, 19 nt, Human
cccgcucagcccucccugc

SEQ ID NO: 1621488 - RNA, 23 nt, Human
cccgcucagcccucccugccccu

SEQ ID NO: 1621489 - RNA, 20 nt, Human
cccucccuccaccucccugc

SEQ ID NO: 1621490 - RNA, 13 nt, Human
cccucccucuuuc

SEQ ID NO: 1621491 - RNA, 13 nt, Human
cccucccuccacc

SEQ ID NO: 1621492 - RNA, 12 nt, Human
cccucccuccac

SEQ ID NO: 1621493 - RNA, 14 nt, Human
cccucccuucaacc

SEQ ID NO: 1621494 - RNA, 17 nt, Human
cccuccaugugggcuag

SEQ ID NO: 1621495 - RNA, 19 nt, Human
cccuccaucuaaacugccc

SEQ ID NO: 1621496 - RNA, 20 nt, Human
cccucauccucauacccacc

SEQ ID NO: 1621497 - RNA, 17 nt, Human
cccucauccucauaccc

SEQ ID NO: 1621498 - RNA, 22 nt, Human
cccucaucaccaacgucugugc

SEQ ID NO: 1621499 - RNA, 19 nt, Human
cccucauagcccucacccu

SEQ ID NO: 1621500 - RNA, 20 nt, Human
cccucagucuggcccuuccu

SEQ ID NO: 1621501 - RNA, 21 nt, Human
cccucagggucccugguggca

SEQ ID NO: 1621502 - RNA, 15 nt, Human
cccucauagcccuca

SEQ ID NO: 1621503 - RNA, 13 nt, Human
cccucauagcccu

SEQ ID NO: 1621504 - RNA, 21 nt, Human
cccuccaagaccuucuccuuc

SEQ ID NO: 1621505 - RNA, 22 nt, Human
cccucauuccaccuucccaugc

SEQ ID NO: 1621506 - RNA, 22 nt, Human
cccucauccucauacccacccc

SEQ ID NO: 1621507 - RNA, 16 nt, Human
cccggcaggguccuag

SEQ ID NO: 1621508 - RNA, 18 nt, Human
cccggaggggccuggcag

SEQ ID NO: 1621509 - RNA, 17 nt, Human
cccggaggggccuggca

SEQ ID NO: 1621510 - RNA, 17 nt, Human
cccuaaaguguauuuuu

SEQ ID NO: 1621511 - RNA, 22 nt, Human
cccuaaaguguauuuuuuuacu

SEQ ID NO: 1621512 - RNA, 19 nt, Human
cccucagggucccuggugg

SEQ ID NO: 1621513 - RNA, 18 nt, Human
cccucagggucccuggug

SEQ ID NO: 1621514 - RNA, 17 nt, Human
cccucagggucccuggu

SEQ ID NO: 1621515 - RNA, 16 nt, Human
cccucagggucccugg

SEQ ID NO: 1621516 - RNA, 15 nt, Human
cccucagggucccug

SEQ ID NO: 1621517 - RNA, 18 nt, Human
cccuaauaaagcugugug

SEQ ID NO: 1621518 - RNA, 15 nt, Human
cccuaauaaagcugu

SEQ ID NO: 1621519 - RNA, 14 nt, Human
cccuaauaaagcug

SEQ ID NO: 1621520 - RNA, 13 nt, Human
cccuaauaaagcu

SEQ ID NO: 1621521 - RNA, 12 nt, Human
cccuaauaaagc

SEQ ID NO: 1621522 - RNA, 14 nt, Human
cccugcaauaaaau

SEQ ID NO: 1621523 - RNA, 15 nt, Human
cccugcaauaaaaug

SEQ ID NO: 1621524 - RNA, 16 nt, Human
cccugcaaccugauug

SEQ ID NO: 1621525 - RNA, 22 nt, Human
cccugcaaccugauugugucuc

SEQ ID NO: 1621526 - RNA, 18 nt, Human
cccugcagagggcacaga

SEQ ID NO: 1621527 - RNA, 20 nt, Human
cccugcagagggcacagaaa

SEQ ID NO: 1621528 - RNA, 12 nt, Human
cccugcagaggg

SEQ ID NO: 1621529 - RNA, 15 nt, Human
cccugccacccuggg

SEQ ID NO: 1621530 - RNA, 14 nt, Human
cccugccacccugg

SEQ ID NO: 1621531 - RNA, 12 nt, Human
cccugccacccu

SEQ ID NO: 1621532 - RNA, 18 nt, Human
cccugccacccuggggag

SEQ ID NO: 1621533 - RNA, 17 nt, Human
cccugccacccugggga

SEQ ID NO: 1621534 - RNA, 13 nt, Human
cccugcccaccug

SEQ ID NO: 1621535 - RNA, 23 nt, Human
cccugccuccuuugugaggaagc

SEQ ID NO: 1621536 - RNA, 16 nt, Human
cccugccuccuuugug

SEQ ID NO: 1621537 - RNA, 18 nt, Human
cccugccucucugcaggu

SEQ ID NO: 1621538 - RNA, 11 nt, Human
cccugccucuc

SEQ ID NO: 1621539 - RNA, 22 nt, Human
cccugguggcagugggagcugc

SEQ ID NO: 1621540 - RNA, 21 nt, Human
cccuggugcugccacacuuca

SEQ ID NO: 1621541 - RNA, 17 nt, Human
cccuggugcugccacac

SEQ ID NO: 1621542 - RNA, 18 nt, Human
cccugggaggcucuggag

SEQ ID NO: 1621543 - RNA, 17 nt, Human
cccugggaggcucugga

SEQ ID NO: 1621544 - RNA, 16 nt, Human
cccugggaggcucugg

SEQ ID NO: 1621545 - RNA, 20 nt, Human
cccugcugguucaggguugg

SEQ ID NO: 1621546 - RNA, 19 nt, Human
cccugcugguucaggguug

SEQ ID NO: 1621547 - RNA, 23 nt, Human
cccugcuuugggcugcccuggug

SEQ ID NO: 1621548 - RNA, 13 nt, Human
cccugcugguuca

SEQ ID NO: 1621549 - RNA, 22 nt, Human
cccugccucucugcaggucccu

SEQ ID NO: 1621550 - RNA, 21 nt, Human
cccugccucucugcagguccc

SEQ ID NO: 1621551 - RNA, 14 nt, Human
cccugguggcagcu

SEQ ID NO: 1621552 - RNA, 13 nt, Human
ccuaaacauauga

SEQ ID NO: 1621553 - RNA, 19 nt, Human
ccuaaauccauuuggaaau

SEQ ID NO: 1621554 - RNA, 16 nt, Human
ccuaaaauucagugga

SEQ ID NO: 1621555 - RNA, 19 nt, Human
ccuacagcuugaccgugag

SEQ ID NO: 1621556 - RNA, 22 nt, Human
ccuacaguugaaaaacagcuga

SEQ ID NO: 1621557 - RNA, 21 nt, Human
ccuaaauccauuuggaaaucu

SEQ ID NO: 1621558 - RNA, 20 nt, Human
ccuaaauccauuuggaaauc

SEQ ID NO: 1621559 - RNA, 13 nt, Human
ccuacccacccuc

SEQ ID NO: 1621560 - RNA, 18 nt, Human
ccuacaggagugagcacu

SEQ ID NO: 1621561 - RNA, 18 nt, Human
ccuacccacccuccuuuc

SEQ ID NO: 1621562 - RNA, 19 nt, Human
ccuacuguaauuugugaua

SEQ ID NO: 1621563 - RNA, 21 nt, Human
ccuagaaauuccccacccuga

SEQ ID NO: 1621564 - RNA, 13 nt, Human
ccuacuuccccuu

SEQ ID NO: 1621565 - RNA, 21 nt, Human
ccuacuuccccuuccuaauuc

SEQ ID NO: 1621566 - RNA, 16 nt, Human
ccuacuuccccuuccu

SEQ ID NO: 1621567 - RNA, 13 nt, Human
ccuaggugacaga

SEQ ID NO: 1621568 - RNA, 22 nt, Human
ccuagguauaauucacauugua

SEQ ID NO: 1621569 - RNA, 12 nt, Human
ccguuauuaaaa

SEQ ID NO: 1621570 - RNA, 22 nt, Human
ccgggaggcagagguugcagug

SEQ ID NO: 1621571 - RNA, 23 nt, Human
ccgggagccugaucaccugcccu

SEQ ID NO: 1621572 - RNA, 16 nt, Human
ccgggagccugaucac

SEQ ID NO: 1621573 - RNA, 17 nt, Human
ccgggaagggggcuggg

SEQ ID NO: 1621574 - RNA, 21 nt, Human
ccggaggggccuggcagccgu

SEQ ID NO: 1621575 - RNA, 17 nt, Human
ccggaggggccuggcag

SEQ ID NO: 1621576 - RNA, 17 nt, Human
cccuuggauuguccccg

SEQ ID NO: 1621577 - RNA, 19 nt, Human
cccuucuuuuucuucuuuu

SEQ ID NO: 1621578 - RNA, 11 nt, Human
cccuucuuuuu

SEQ ID NO: 1621579 - RNA, 21 nt, Human
cccuuccuaauuccacagcug

SEQ ID NO: 1621580 - RNA, 23 nt, Human
cccuugguuaggcauugugggaa

SEQ ID NO: 1621581 - RNA, 22 nt, Human
cccuugguuaggcauuguggga

SEQ ID NO: 1621582 - RNA, 22 nt, Human
cccuuguggucccaccccacac

SEQ ID NO: 1621583 - RNA, 13 nt, Human
cccuucccaccuc

SEQ ID NO: 1621584 - RNA, 12 nt, Human
cccuucccaccu

SEQ ID NO: 1621585 - RNA, 11 nt, Human
cccuucauuug

SEQ ID NO: 1621586 - RNA, 20 nt, Human
cccuuccuaauuccacagcu

SEQ ID NO: 1621587 - RNA, 19 nt, Human
cccuuccuaauuccacagc

SEQ ID NO: 1621588 - RNA, 14 nt, Human
cccuuccuaauucc

SEQ ID NO: 1621589 - RNA, 13 nt, Human
cccuuccuaauuc

SEQ ID NO: 1621590 - RNA, 13 nt, Human
cccuguucacucu

SEQ ID NO: 1621591 - RNA, 22 nt, Human
cccuguucacucuacuuagcau

SEQ ID NO: 1621592 - RNA, 14 nt, Human
cccuguucacucua

SEQ ID NO: 1621593 - RNA, 22 nt, Human
ccucaggugagaagcagaggaa

SEQ ID NO: 1621594 - RNA, 15 nt, Human
ccuaggugacagagu

SEQ ID NO: 1621595 - RNA, 18 nt, Human
ccuaggugacagagugag

SEQ ID NO: 1621596 - RNA, 23 nt, Human
ccucacaguccuuaccagcagag

SEQ ID NO: 1621597 - RNA, 24 nt, Human
ccucacaguccuuaccagcagagc

SEQ ID NO: 1621598 - RNA, 16 nt, Human
ccuauuagagaagaga

SEQ ID NO: 1621599 - RNA, 17 nt, Human
ccuauuagagaagagau

SEQ ID NO: 1621600 - RNA, 22 nt, Human
ccucagggucccugguggcagc

SEQ ID NO: 1621601 - RNA, 20 nt, Human
ccucagggucccugguggca

SEQ ID NO: 1621602 - RNA, 17 nt, Human
ccucagggucccuggug

SEQ ID NO: 1621603 - RNA, 16 nt, Human
ccucagggucccuggu

SEQ ID NO: 1621604 - RNA, 16 nt, Human
ccucagaucuucugug

SEQ ID NO: 1621605 - RNA, 14 nt, Human
ccucagcauccugg

SEQ ID NO: 1621606 - RNA, 14 nt, Human
ccucacccuggggc

SEQ ID NO: 1621607 - RNA, 16 nt, Human
ccucagagccaccccu

SEQ ID NO: 1621608 - RNA, 12 nt, Human
ccuccccuccuc

SEQ ID NO: 1621609 - RNA, 15 nt, Human
ccuccccuccuccug

SEQ ID NO: 1621610 - RNA, 13 nt, Human
ccuccccuccucu

SEQ ID NO: 1621611 - RNA, 14 nt, Human
ccuccccuccucug

SEQ ID NO: 1621612 - RNA, 18 nt, Human
ccucccgaauagcuggga

SEQ ID NO: 1621613 - RNA, 15 nt, Human
ccucccaacucaccc

SEQ ID NO: 1621614 - RNA, 12 nt, Human
ccuccuccagcc

SEQ ID NO: 1621615 - RNA, 11 nt, Human
ccuccucagau

SEQ ID NO: 1621616 - RNA, 13 nt, Human
ccucccucuuucc

SEQ ID NO: 1621617 - RNA, 20 nt, Human
ccucccgaauagcugggacu

SEQ ID NO: 1621618 - RNA, 19 nt, Human
ccucccgaauagcugggac

SEQ ID NO: 1621619 - RNA, 18 nt, Human
ccucccgaguagcuggga

SEQ ID NO: 1621620 - RNA, 17 nt, Human
ccucccgaguagcuggg

SEQ ID NO: 1621621 - RNA, 19 nt, Human
ccucccgaguagcugggac

SEQ ID NO: 1621622 - RNA, 13 nt, Human
ccuccauccugag

SEQ ID NO: 1621623 - RNA, 12 nt, Human
ccuccauccuga

SEQ ID NO: 1621624 - RNA, 14 nt, Human
ccuccauccugagg

SEQ ID NO: 1621625 - RNA, 19 nt, Human
ccuccaugcugccuccaga

SEQ ID NO: 1621626 - RNA, 14 nt, Human
ccucccaacucacc

SEQ ID NO: 1621627 - RNA, 17 nt, Human
ccucccaaagugcuggg

SEQ ID NO: 1621628 - RNA, 15 nt, Human
ccuccaugugggcua

SEQ ID NO: 1621629 - RNA, 12 nt, Human
ccuccauguggg

SEQ ID NO: 1621630 - RNA, 12 nt, Human
ccuccaggugca

SEQ ID NO: 1621631 - RNA, 11 nt, Human
ccuccaggugc

SEQ ID NO: 1621632 - RNA, 17 nt, Human
ccuccaggugcacaagc

SEQ ID NO: 1621633 - RNA, 20 nt, Human
ccucaggugagaagcagagg

SEQ ID NO: 1621634 - RNA, 18 nt, Human
ccucaggugagaagcaga

SEQ ID NO: 1621635 - RNA, 17 nt, Human
ccucaggugagaagcag

SEQ ID NO: 1621636 - RNA, 12 nt, Human
ccucauacccac

SEQ ID NO: 1621637 - RNA, 21 nt, Human
ccucccgaauagcugggacua

SEQ ID NO: 1621638 - RNA, 17 nt, Human
ccucugcacuccccugc

SEQ ID NO: 1621639 - RNA, 16 nt, Human
ccucugcacuccccug

SEQ ID NO: 1621640 - RNA, 12 nt, Human
ccucugagccuu

SEQ ID NO: 1621641 - RNA, 11 nt, Human
ccucugagccu

SEQ ID NO: 1621642 - RNA, 13 nt, Human
ccucugaggcuga

SEQ ID NO: 1621643 - RNA, 18 nt, Human
ccucugcacuccccugcu

SEQ ID NO: 1621644 - RNA, 23 nt, Human
ccucugcacuccccugcugggug

SEQ ID NO: 1621645 - RNA, 14 nt, Human
ccucugcagcaaua

SEQ ID NO: 1621646 - RNA, 18 nt, Human
ccucugcagcaauaaagc

SEQ ID NO: 1621647 - RNA, 16 nt, Human
ccucugcccacucccu

SEQ ID NO: 1621648 - RNA, 13 nt, Human
ccucugcccacuc

SEQ ID NO: 1621649 - RNA, 19 nt, Human
ccucugcacuccccugcug

SEQ ID NO: 1621650 - RNA, 19 nt, Human
ccucugcagcaauaaagca

SEQ ID NO: 1621651 - RNA, 20 nt, Human
ccucugacacacagcucugu

SEQ ID NO: 1621652 - RNA, 19 nt, Human
ccucugacacacagcucug

SEQ ID NO: 1621653 - RNA, 14 nt, Human
ccucugacacacag

SEQ ID NO: 1621654 - RNA, 15 nt, Human
ccucugacacacagc

SEQ ID NO: 1621655 - RNA, 13 nt, Human
ccucugacacaca

SEQ ID NO: 1621656 - RNA, 21 nt, Human
ccucugacacacagcucuguc

SEQ ID NO: 1621657 - RNA, 15 nt, Human
ccucuccccagcaag

SEQ ID NO: 1621658 - RNA, 22 nt, Human
ccucucccuuggauuguccccg

SEQ ID NO: 1621659 - RNA, 13 nt, Human
ccucucccuugga

SEQ ID NO: 1621660 - RNA, 20 nt, Human
ccucuccccagcaagugaga

SEQ ID NO: 1621661 - RNA, 21 nt, Human
ccuccuccagccgccaugcuc

SEQ ID NO: 1621662 - RNA, 15 nt, Human
ccuccucucugcccu

SEQ ID NO: 1621663 - RNA, 13 nt, Human
ccuccucucugcc

SEQ ID NO: 1621664 - RNA, 16 nt, Human
ccuccucucugcccua

SEQ ID NO: 1621665 - RNA, 14 nt, Human
cuaauguacugcau

SEQ ID NO: 1621666 - RNA, 16 nt, Human
cuaauguacugcauau

SEQ ID NO: 1621667 - RNA, 22 nt, Human
cuaaugaaugcauaaaauguua

SEQ ID NO: 1621668 - RNA, 19 nt, Human
cuaaugaaugcauaaaaug

SEQ ID NO: 1621669 - RNA, 16 nt, Human
cuaaggugugcucuga

SEQ ID NO: 1621670 - RNA, 21 nt, Human
cuaauaaaauuuaaaagucuu

SEQ ID NO: 1621671 - RNA, 12 nt, Human
cuaauaaagcug

SEQ ID NO: 1621672 - RNA, 13 nt, Human
cuaauaaagcugu

SEQ ID NO: 1621673 - RNA, 16 nt, Human
cuaauccucuuuuucu

SEQ ID NO: 1621674 - RNA, 19 nt, Human
cuaaucagcauucucacuc

SEQ ID NO: 1621675 - RNA, 17 nt, Human
cuaaucagcauucucac

SEQ ID NO: 1621676 - RNA, 17 nt, Human
cuacacuccagugagac

SEQ ID NO: 1621677 - RNA, 16 nt, Human
cuacacuccagugaga

SEQ ID NO: 1621678 - RNA, 21 nt, Human
cuacacacugcauguuuguga

SEQ ID NO: 1621679 - RNA, 13 nt, Human
cuacacacugcau

SEQ ID NO: 1621680 - RNA, 15 nt, Human
cuacacacugcaugu

SEQ ID NO: 1621681 - RNA, 15 nt, Human
cuacagaggccaugg

SEQ ID NO: 1621682 - RNA, 20 nt, Human
cuacccagcgagcccuggug

SEQ ID NO: 1621683 - RNA, 12 nt, Human
cuacccaggugc

SEQ ID NO: 1621684 - RNA, 22 nt, Human
cuacccacccuccuuucaccac

SEQ ID NO: 1621685 - RNA, 17 nt, Human
cuacccacccuccuuuc

SEQ ID NO: 1621686 - RNA, 18 nt, Human
cuaccauccccuguagag

SEQ ID NO: 1621687 - RNA, 17 nt, Human
cuacagaggccaugggc

SEQ ID NO: 1621688 - RNA, 14 nt, Human
cuaagcaaaaugug

SEQ ID NO: 1621689 - RNA, 17 nt, Human
cuaaccagcagaaaugc

SEQ ID NO: 1621690 - RNA, 17 nt, Human
cuaaccacgcuggaccu

SEQ ID NO: 1621691 - RNA, 16 nt, Human
cuaaccagcagaaaug

SEQ ID NO: 1621692 - RNA, 18 nt, Human
cuaagcaaaaugugauau

SEQ ID NO: 1621693 - RNA, 15 nt, Human
cuaagcaaaauguga

SEQ ID NO: 1621694 - RNA, 21 nt, Human
cuaagcuauucaguaauaacu

SEQ ID NO: 1621695 - RNA, 19 nt, Human
cuaagcuauucaguaauaa

SEQ ID NO: 1621696 - RNA, 11 nt, Human
cuaaggacuug

SEQ ID NO: 1621697 - RNA, 17 nt, Human
cuaaggacuuguuagau

SEQ ID NO: 1621698 - RNA, 16 nt, Human
cuaaggacuuguuaga

SEQ ID NO: 1621699 - RNA, 15 nt, Human
cuaaggugugcucug

SEQ ID NO: 1621700 - RNA, 14 nt, Human
cuaaggcugaacuu

SEQ ID NO: 1621701 - RNA, 19 nt, Human
cuacuugggaggcugagau

SEQ ID NO: 1621702 - RNA, 18 nt, Human
cuacuugggaggcugaga

SEQ ID NO: 1621703 - RNA, 15 nt, Human
cuacuugggaggcug

SEQ ID NO: 1621704 - RNA, 22 nt, Human
cuacuuauuguagcauccugga

SEQ ID NO: 1621705 - RNA, 20 nt, Human
cuacuuccccuuccuaauuc

SEQ ID NO: 1621706 - RNA, 15 nt, Human
cuacuuccccuuccu

SEQ ID NO: 1621707 - RNA, 14 nt, Human
cuacuuccccuucc

SEQ ID NO: 1621708 - RNA, 20 nt, Human
cuacuuccugugacuucagc

SEQ ID NO: 1621709 - RNA, 21 nt, Human
cuacccgggaagggggcuggg

SEQ ID NO: 1621710 - RNA, 20 nt, Human
cuacccgggaagggggcugg

SEQ ID NO: 1621711 - RNA, 15 nt, Human
cuacccgggaagggg

SEQ ID NO: 1621712 - RNA, 14 nt, Human
cuacccgggaaggg

SEQ ID NO: 1621713 - RNA, 21 nt, Human
cuacucugugucagguggggc

SEQ ID NO: 1621714 - RNA, 16 nt, Human
cuacucugugucaggu

SEQ ID NO: 1621715 - RNA, 14 nt, Human
cuacugaggugcua

SEQ ID NO: 1621716 - RNA, 17 nt, Human
cuacuguaauuugugau

SEQ ID NO: 1621717 - RNA, 16 nt, Human
cuacuguaauuuguga

SEQ ID NO: 1621718 - RNA, 21 nt, Human
cuacuguaaggcaaucauggu

SEQ ID NO: 1621719 - RNA, 21 nt, Human
cuagacgagcaggcuucuucc

SEQ ID NO: 1621720 - RNA, 20 nt, Human
cuagacgagcaggcuucuuc

SEQ ID NO: 1621721 - RNA, 18 nt, Human
cuagacucccaagcugga

SEQ ID NO: 1621722 - RNA, 15 nt, Human
cuagagguucaaaga

SEQ ID NO: 1621723 - RNA, 21 nt, Human
cuagagugaacuugggccacu

SEQ ID NO: 1621724 - RNA, 17 nt, Human
cuagagugaacuugggc

SEQ ID NO: 1621725 - RNA, 17 nt, Human
cuagcacuuugggaggc

SEQ ID NO: 1621726 - RNA, 21 nt, Human
cuacuguaauuugugauacaa

SEQ ID NO: 1621727 - RNA, 23 nt, Human
cuaguaucaaaagaaagaaaauc

SEQ ID NO: 1621728 - RNA, 17 nt, Human
cuaguaucaaaagaaag

SEQ ID NO: 1621729 - RNA, 15 nt, Human
cuaguaucaaaagaa

SEQ ID NO: 1621730 - RNA, 20 nt, Human
cuaguauuucuaugaaauau

SEQ ID NO: 1621731 - RNA, 19 nt, Human
cuaguauuucuaugaaaua

SEQ ID NO: 1621732 - RNA, 22 nt, Human
cuaguauuucuaugaaauauua

SEQ ID NO: 1621733 - RNA, 21 nt, Human
cuaggcauuugcugaauacag

SEQ ID NO: 1621734 - RNA, 22 nt, Human
cuagugugguguuuccuggcac

SEQ ID NO: 1621735 - RNA, 21 nt, Human
cuagugugguguuuccuggca

SEQ ID NO: 1621736 - RNA, 23 nt, Human
cuagugugguguuuccuggcacu

SEQ ID NO: 1621737 - RNA, 19 nt, Human
cuagugugguguuuccugg

SEQ ID NO: 1621738 - RNA, 12 nt, Human
cuagcagcaggg

SEQ ID NO: 1621739 - RNA, 15 nt, Human
cuaggaacacuccuu

SEQ ID NO: 1621740 - RNA, 13 nt, Human
cuaggaacacucc

SEQ ID NO: 1621741 - RNA, 21 nt, Human
cuaggaagacuuuggaaagag

SEQ ID NO: 1621742 - RNA, 17 nt, Human
cuaggaaauccagggug

SEQ ID NO: 1621743 - RNA, 16 nt, Human
cuaggaaauccagggu

SEQ ID NO: 1621744 - RNA, 17 nt, Human
cuaggaggucucuaaga

SEQ ID NO: 1621745 - RNA, 22 nt, Human
cuaggaccccuccaugugggcu

SEQ ID NO: 1621746 - RNA, 22 nt, Human
cuaggacugaauuaugaaacuu

SEQ ID NO: 1621747 - RNA, 14 nt, Human
cuaugacacaugca

SEQ ID NO: 1621748 - RNA, 18 nt, Human
cuaugaaauauuauguua

SEQ ID NO: 1621749 - RNA, 13 nt, Human
cuaugaaauauua

SEQ ID NO: 1621750 - RNA, 22 nt, Human
cuauauuuuuuguuaaaugauu

SEQ ID NO: 1621751 - RNA, 20 nt, Human
cuaucaaguauuauaccuuu

SEQ ID NO: 1621752 - RNA, 20 nt, Human
cuauauuuuuuguuaaauga

SEQ ID NO: 1621753 - RNA, 23 nt, Human
cuauauuguuuucaguguacaug

SEQ ID NO: 1621754 - RNA, 19 nt, Human
cuauauuguuugcuaagca

SEQ ID NO: 1621755 - RNA, 22 nt, Human
cuauauuguuuucaguguacau

SEQ ID NO: 1621756 - RNA, 12 nt, Human
cuaguucacucu

SEQ ID NO: 1621757 - RNA, 14 nt, Human
cuaguuccaccauc

SEQ ID NO: 1621758 - RNA, 11 nt, Human
cuaugcauuug

SEQ ID NO: 1621759 - RNA, 12 nt, Human
cuaugcauuuga

SEQ ID NO: 1621760 - RNA, 21 nt, Human
cuaugcauuugaaaauuuuga

SEQ ID NO: 1621761 - RNA, 17 nt, Human
cucaccccuugccauaa

SEQ ID NO: 1621762 - RNA, 16 nt, Human
cucacuaggcuucugg

SEQ ID NO: 1621763 - RNA, 13 nt, Human
cucacuaggcuuc

SEQ ID NO: 1621764 - RNA, 17 nt, Human
cucacuauguugcccag

SEQ ID NO: 1621765 - RNA, 16 nt, Human
cucacuauguugccca

SEQ ID NO: 1621766 - RNA, 20 nt, Human
cucacuaggcuucugguuga

SEQ ID NO: 1621767 - RNA, 21 nt, Human
cucacuaucccggcugcccuu

SEQ ID NO: 1621768 - RNA, 20 nt, Human
cucacuaucccggcugcccu

SEQ ID NO: 1621769 - RNA, 13 nt, Human
cucaccccagccc

SEQ ID NO: 1621770 - RNA, 12 nt, Human
cucaccccagcc

SEQ ID NO: 1621771 - RNA, 14 nt, Human
cucaccccagcccc

SEQ ID NO: 1621772 - RNA, 13 nt, Human
cucacauuuauau

SEQ ID NO: 1621773 - RNA, 19 nt, Human
cucaccagccccagugccc

SEQ ID NO: 1621774 - RNA, 21 nt, Human
cucaccagccccagugcccac

SEQ ID NO: 1621775 - RNA, 20 nt, Human
cucaccagccccagugccca

SEQ ID NO: 1621776 - RNA, 21 nt, Human
cucaagugauucuccugccuc

SEQ ID NO: 1621777 - RNA, 20 nt, Human
cucaagugauucuccugccu

SEQ ID NO: 1621778 - RNA, 19 nt, Human
cucaagugauucuccugcc

SEQ ID NO: 1621779 - RNA, 18 nt, Human
cucaagugauucuccugc

SEQ ID NO: 1621780 - RNA, 21 nt, Human
cucaacucuccuccagaguca

SEQ ID NO: 1621781 - RNA, 20 nt, Human
cucaacucuccuccagaguc

SEQ ID NO: 1621782 - RNA, 13 nt, Human
cucaaauuucuaa

SEQ ID NO: 1621783 - RNA, 17 nt, Human
cucaagagggcacuggu

SEQ ID NO: 1621784 - RNA, 21 nt, Human
cucaagagggcacugguggcc

SEQ ID NO: 1621785 - RNA, 19 nt, Human
cucaagagggcacuggugg

SEQ ID NO: 1621786 - RNA, 14 nt, Human
cuaugcauuugaaa

SEQ ID NO: 1621787 - RNA, 22 nt, Human
cuauuuuaauaaacacucuuga

SEQ ID NO: 1621788 - RNA, 18 nt, Human
cuauuuuaauaaacacuc

SEQ ID NO: 1621789 - RNA, 17 nt, Human
cuaacauggaaguacua

SEQ ID NO: 1621790 - RNA, 15 nt, Human
cuaacauggaaguac

SEQ ID NO: 1621791 - RNA, 15 nt, Human
cuaacaugauuuggg

SEQ ID NO: 1621792 - RNA, 23 nt, Human
cuaaauugacacuuaaaaauggu

SEQ ID NO: 1621793 - RNA, 16 nt, Human
cuaaauucaugcugcu

SEQ ID NO: 1621794 - RNA, 16 nt, Human
cuaaauguugaaagau

SEQ ID NO: 1621795 - RNA, 18 nt, Human
cuaaauggaaccacucua

SEQ ID NO: 1621796 - RNA, 16 nt, Human
cuaaauggaaccacuc

SEQ ID NO: 1621797 - RNA, 17 nt, Human
cuaaauggaaccacucu

SEQ ID NO: 1621798 - RNA, 15 nt, Human
cuaaauggaaccacu

SEQ ID NO: 1621799 - RNA, 20 nt, Human
cuaaaucuccaaaauaaaac

SEQ ID NO: 1621800 - RNA, 20 nt, Human
cuaaauauauuuuaagacga

SEQ ID NO: 1621801 - RNA, 18 nt, Human
cuaaauauauuuuaagac

SEQ ID NO: 1621802 - RNA, 16 nt, Human
cuaaauccauuuggaa

SEQ ID NO: 1621803 - RNA, 20 nt, Human
cuaaauccauuuggaaaucu

SEQ ID NO: 1621804 - RNA, 19 nt, Human
cuaaauccauuuggaaauc

SEQ ID NO: 1621805 - RNA, 17 nt, Human
cuaaauccauuuggaaa

SEQ ID NO: 1621806 - RNA, 15 nt, Human
cgugcuaaggacuug

SEQ ID NO: 1621807 - RNA, 14 nt, Human
cgugcuaaggacuu

SEQ ID NO: 1621808 - RNA, 13 nt, Human
cgugcuaaggacu

SEQ ID NO: 1621809 - RNA, 12 nt, Human
cgugcuaaggac

SEQ ID NO: 1621810 - RNA, 16 nt, Human
cgugcuaaggacuugu

SEQ ID NO: 1621811 - RNA, 19 nt, Human
cguggcuucccgcucagcc

SEQ ID NO: 1621812 - RNA, 18 nt, Human
cguggcuucccgcucagc

SEQ ID NO: 1621813 - RNA, 21 nt, Human
cguggcuucccgcucagcccu

SEQ ID NO: 1621814 - RNA, 20 nt, Human
cguggcuucccgcucagccc

SEQ ID NO: 1621815 - RNA, 23 nt, Human
cguugaaauuguaauuauaucug

SEQ ID NO: 1621816 - RNA, 19 nt, Human
cgugcacacaccagagccc

SEQ ID NO: 1621817 - RNA, 18 nt, Human
cgugcacacaccagagcc

SEQ ID NO: 1621818 - RNA, 22 nt, Human
cgugcaguggugcgaucugggu

SEQ ID NO: 1621819 - RNA, 21 nt, Human
cgugcaguggugcgaucuggg

SEQ ID NO: 1621820 - RNA, 22 nt, Human
cgucugacaggcaaugcuggcu

SEQ ID NO: 1621821 - RNA, 21 nt, Human
cgucugacaggcaaugcuggc

SEQ ID NO: 1621822 - RNA, 20 nt, Human
cgucugacaggcaaugcugg

SEQ ID NO: 1621823 - RNA, 16 nt, Human
cgugcacacaccagag

SEQ ID NO: 1621824 - RNA, 22 nt, Human
cggugcuaucucccccagcccc

SEQ ID NO: 1621825 - RNA, 21 nt, Human
cggugcuaucucccccagccc

SEQ ID NO: 1621826 - RNA, 20 nt, Human
cggugcuaucucccccagcc

SEQ ID NO: 1621827 - RNA, 18 nt, Human
cggugcuaucucccccag

SEQ ID NO: 1621828 - RNA, 16 nt, Human
cgucuaccugaggggc

SEQ ID NO: 1621829 - RNA, 16 nt, Human
cgucucauacucaccu

SEQ ID NO: 1621830 - RNA, 22 nt, Human
cggucggguuuuauuguuuaaa

SEQ ID NO: 1621831 - RNA, 16 nt, Human
cggugaauggcuuugu

SEQ ID NO: 1621832 - RNA, 15 nt, Human
cggugaauggcuuug

SEQ ID NO: 1621833 - RNA, 14 nt, Human
cggugaauggcuuu

SEQ ID NO: 1621834 - RNA, 13 nt, Human
cggugaauggcuu

SEQ ID NO: 1621835 - RNA, 17 nt, Human
cggugagcuacaaaugc

SEQ ID NO: 1621836 - RNA, 21 nt, Human
cggugagaggggaacagacug

SEQ ID NO: 1621837 - RNA, 20 nt, Human
cggugagaggggaacagacu

SEQ ID NO: 1621838 - RNA, 22 nt, Human
cggugaauggcuuuguauagaa

SEQ ID NO: 1621839 - RNA, 20 nt, Human
cggugaauggcuuuguauag

SEQ ID NO: 1621840 - RNA, 18 nt, Human
cggugaauggcuuuguau

SEQ ID NO: 1621841 - RNA, 21 nt, Human
cggguuuuauuguuuaaaauc

SEQ ID NO: 1621842 - RNA, 20 nt, Human
cgguccacccaggagccccg

SEQ ID NO: 1621843 - RNA, 16 nt, Human
cgguccacccaggagc

SEQ ID NO: 1621844 - RNA, 15 nt, Human
cgguccacccaggag

SEQ ID NO: 1621845 - RNA, 14 nt, Human
cgguccacccagga

SEQ ID NO: 1621846 - RNA, 11 nt, Human
cgggucacagg

SEQ ID NO: 1621847 - RNA, 19 nt, Human
cgggucacaggagggaggg

SEQ ID NO: 1621848 - RNA, 22 nt, Human
cgggcacucagaagacacugau

SEQ ID NO: 1621849 - RNA, 14 nt, Human
cgggcacucagaag

SEQ ID NO: 1621850 - RNA, 22 nt, Human
cggggacagcuccuucuguccu

SEQ ID NO: 1621851 - RNA, 20 nt, Human
cgggaggucgaggcaggagg

SEQ ID NO: 1621852 - RNA, 18 nt, Human
cgggaggucgaggcagga

SEQ ID NO: 1621853 - RNA, 17 nt, Human
cgggauuaguacacacu

SEQ ID NO: 1621854 - RNA, 22 nt, Human
cggcuggccuggccccucaggg

SEQ ID NO: 1621855 - RNA, 23 nt, Human
cggcuggccuggccccucagggu

SEQ ID NO: 1621856 - RNA, 21 nt, Human
cgggagccugaucaccugccc

SEQ ID NO: 1621857 - RNA, 15 nt, Human
cgggggcagagaggg

SEQ ID NO: 1621858 - RNA, 23 nt, Human
cggggacagcuccuucuguccua

SEQ ID NO: 1621859 - RNA, 14 nt, Human
cggccuccauccug

SEQ ID NO: 1621860 - RNA, 12 nt, Human
cggccuccaucc

SEQ ID NO: 1621861 - RNA, 12 nt, Human
cggcugcccuuu

SEQ ID NO: 1621862 - RNA, 11 nt, Human
cggcugcccuu

SEQ ID NO: 1621863 - RNA, 24 nt, Human
cggccaggccagagggagugacag

SEQ ID NO: 1621864 - RNA, 19 nt, Human
cggccccugcugguucagg

SEQ ID NO: 1621865 - RNA, 18 nt, Human
cggccccugcugguucag

SEQ ID NO: 1621866 - RNA, 13 nt, Human
cggccccugcugg

SEQ ID NO: 1621867 - RNA, 17 nt, Human
cggccaccugcggugcu

SEQ ID NO: 1621868 - RNA, 16 nt, Human
cggccaccugcggugc

SEQ ID NO: 1621869 - RNA, 15 nt, Human
cggccaccugcggug

SEQ ID NO: 1621870 - RNA, 11 nt, Human
cggccaccugc

SEQ ID NO: 1621871 - RNA, 14 nt, Human
cggaauaguuggcu

SEQ ID NO: 1621872 - RNA, 13 nt, Human
cggaagagccuug

SEQ ID NO: 1621873 - RNA, 18 nt, Human
cgcucucuggccuucggc

SEQ ID NO: 1621874 - RNA, 22 nt, Human
cgcugucagccauuccuguucc

SEQ ID NO: 1621875 - RNA, 17 nt, Human
cgcugugcugcccugcc

SEQ ID NO: 1621876 - RNA, 16 nt, Human
cgcugugcugcccugc

SEQ ID NO: 1621877 - RNA, 15 nt, Human
cgcugugcugcccug

SEQ ID NO: 1621878 - RNA, 15 nt, Human
cggaaaacaugcuac

SEQ ID NO: 1621879 - RNA, 20 nt, Human
cggaaaacaugcuacacacu

SEQ ID NO: 1621880 - RNA, 18 nt, Human
cgcugugcugcccugccc

SEQ ID NO: 1621881 - RNA, 15 nt, Human
cgcucucuggccuuc

SEQ ID NO: 1621882 - RNA, 14 nt, Human
cgcucucuggccuu

SEQ ID NO: 1621883 - RNA, 17 nt, Human
cgcuacccgggaagggg

SEQ ID NO: 1621884 - RNA, 12 nt, Human
cgcucagcccuc

SEQ ID NO: 1621885 - RNA, 21 nt, Human
cgcucagcccucccugccccu

SEQ ID NO: 1621886 - RNA, 16 nt, Human
cgcucagcccucccug

SEQ ID NO: 1621887 - RNA, 16 nt, Human
cgcuacccgggaaggg

SEQ ID NO: 1621888 - RNA, 22 nt, Human
cgcuaagagggagggagggcuc

SEQ ID NO: 1621889 - RNA, 17 nt, Human
cgccaucccagccccaa

SEQ ID NO: 1621890 - RNA, 16 nt, Human
cgccaucccagcccca

SEQ ID NO: 1621891 - RNA, 14 nt, Human
cgccaucccagccc

SEQ ID NO: 1621892 - RNA, 23 nt, Human
cgccaggggaaaaucagccugcu

SEQ ID NO: 1621893 - RNA, 20 nt, Human
ccucugcccacucccugcaa

SEQ ID NO: 1621894 - RNA, 19 nt, Human
ccucugcccacucccugca

SEQ ID NO: 1621895 - RNA, 17 nt, Human
ccucugcccacucccug

SEQ ID NO: 1621896 - RNA, 22 nt, Human
cgccagauucuuuccugaggcu

SEQ ID NO: 1621897 - RNA, 22 nt, Human
cgcccaggcuuagucacugaga

SEQ ID NO: 1621898 - RNA, 12 nt, Human
cgcccagucugg

SEQ ID NO: 1621899 - RNA, 16 nt, Human
cgcccuggacugugug

SEQ ID NO: 1621900 - RNA, 13 nt, Human
cgccccuuccccc

SEQ ID NO: 1621901 - RNA, 22 nt, Human
cucuccucuugccacugccucu

SEQ ID NO: 1621902 - RNA, 19 nt, Human
cucuccucuugccacugcc

SEQ ID NO: 1621903 - RNA, 17 nt, Human
cucuccucuugccacug

SEQ ID NO: 1621904 - RNA, 16 nt, Human
cucuccucuugccacu

SEQ ID NO: 1621905 - RNA, 15 nt, Human
cucuccucuugccac

SEQ ID NO: 1621906 - RNA, 14 nt, Human
cucuccucuugcca

SEQ ID NO: 1621907 - RNA, 18 nt, Human
cucuccucugcugcuggc

SEQ ID NO: 1621908 - RNA, 15 nt, Human
cucuccucugcugcu

SEQ ID NO: 1621909 - RNA, 14 nt, Human
cucuccucugcugc

SEQ ID NO: 1621910 - RNA, 13 nt, Human
cucuccucugcug

SEQ ID NO: 1621911 - RNA, 24 nt, Human
cucuccccagcaagugagagcugg

SEQ ID NO: 1621912 - RNA, 12 nt, Human
cucuccucugcu

SEQ ID NO: 1621913 - RNA, 22 nt, Human
cucuccccagcaagugagagcu

SEQ ID NO: 1621914 - RNA, 14 nt, Human
cucuccccagcaag

SEQ ID NO: 1621915 - RNA, 19 nt, Human
cucuccagccccuggaugc

SEQ ID NO: 1621916 - RNA, 15 nt, Human
cucuccacugccuuc

SEQ ID NO: 1621917 - RNA, 20 nt, Human
cucuccugggcagcugccuc

SEQ ID NO: 1621918 - RNA, 12 nt, Human
cucuccugggca

SEQ ID NO: 1621919 - RNA, 15 nt, Human
cucuccugggcagcu

SEQ ID NO: 1621920 - RNA, 16 nt, Human
cucuccugggcagcug

SEQ ID NO: 1621921 - RNA, 18 nt, Human
cucuccugggcagcugcc

SEQ ID NO: 1621922 - RNA, 19 nt, Human
cucuccugggcagcugccu

SEQ ID NO: 1621923 - RNA, 12 nt, Human
cucucucacucc

SEQ ID NO: 1621924 - RNA, 14 nt, Human
cucucucacuccuu

SEQ ID NO: 1621925 - RNA, 21 nt, Human
cucuaguuugauuaaauucuu

SEQ ID NO: 1621926 - RNA, 19 nt, Human
cucuaguuugauuaaauuc

SEQ ID NO: 1621927 - RNA, 20 nt, Human
cucuaguuugauuaaauucu

SEQ ID NO: 1621928 - RNA, 15 nt, Human
cucuaguuugauuaa

SEQ ID NO: 1621929 - RNA, 15 nt, Human
cucucaggccagcug

SEQ ID NO: 1621930 - RNA, 13 nt, Human
cucucaggccagc

SEQ ID NO: 1621931 - RNA, 23 nt, Human
cucucaggccaaacucaccugcc

SEQ ID NO: 1621932 - RNA, 22 nt, Human
cucucaggccaaacucaccugc

SEQ ID NO: 1621933 - RNA, 21 nt, Human
cucucaggccaaacucaccug

SEQ ID NO: 1621934 - RNA, 20 nt, Human
cucucaggccaaacucaccu

SEQ ID NO: 1621935 - RNA, 12 nt, Human
cucucaggccaa

SEQ ID NO: 1621936 - RNA, 18 nt, Human
cucuccagccccuggaug

SEQ ID NO: 1621937 - RNA, 17 nt, Human
cucuccagccccuggau

SEQ ID NO: 1621938 - RNA, 16 nt, Human
cucuccagccccugga

SEQ ID NO: 1621939 - RNA, 15 nt, Human
cucuccagccccugg

SEQ ID NO: 1621940 - RNA, 14 nt, Human
cucuccagccccug

SEQ ID NO: 1621941 - RNA, 14 nt, Human
cucuccacugccuu

SEQ ID NO: 1621942 - RNA, 12 nt, Human
cucuccacugcc

SEQ ID NO: 1621943 - RNA, 11 nt, Human
cucuccacugc

SEQ ID NO: 1621944 - RNA, 21 nt, Human
cucucaggccagcugcuuggg

SEQ ID NO: 1621945 - RNA, 19 nt, Human
cucucaggccagcugcuug

SEQ ID NO: 1621946 - RNA, 18 nt, Human
cucucaggccagcugcuu

SEQ ID NO: 1621947 - RNA, 17 nt, Human
cucucaggccagcugcu

SEQ ID NO: 1621948 - RNA, 22 nt, Human
cucucaggccagcugcuugggc

SEQ ID NO: 1621949 - RNA, 17 nt, Human
cucuaggaaauauuuau

SEQ ID NO: 1621950 - RNA, 23 nt, Human
cucuagggaaaaaccagcgugug

SEQ ID NO: 1621951 - RNA, 15 nt, Human
cucuaggaaauauuu

SEQ ID NO: 1621952 - RNA, 13 nt, Human
cucuacccuggca

SEQ ID NO: 1621953 - RNA, 20 nt, Human
cucuaccauccccuguagag

SEQ ID NO: 1621954 - RNA, 16 nt, Human
cucuacuuagcauguc

SEQ ID NO: 1621955 - RNA, 20 nt, Human
cucuacuuagcaugucccua

SEQ ID NO: 1621956 - RNA, 19 nt, Human
cucuacuuagcaugucccu

SEQ ID NO: 1621957 - RNA, 17 nt, Human
cucuacuuagcaugucc

SEQ ID NO: 1621958 - RNA, 17 nt, Human
cuccuucacagaugggu

SEQ ID NO: 1621959 - RNA, 16 nt, Human
cuccuucacagauggg

SEQ ID NO: 1621960 - RNA, 20 nt, Human
cuccugugugugcgccuaca

SEQ ID NO: 1621961 - RNA, 19 nt, Human
cuccuucacagaugggugc

SEQ ID NO: 1621962 - RNA, 13 nt, Human
cuccuucaccuuu

SEQ ID NO: 1621963 - RNA, 18 nt, Human
cucggcucacugcauccu

SEQ ID NO: 1621964 - RNA, 17 nt, Human
cucggcucacugcaucc

SEQ ID NO: 1621965 - RNA, 14 nt, Human
cucggcucacugca

SEQ ID NO: 1621966 - RNA, 16 nt, Human
cucuacagaggccaug

SEQ ID NO: 1621967 - RNA, 14 nt, Human
cucuacagaggcca

SEQ ID NO: 1621968 - RNA, 19 nt, Human
cucuacagaggccaugggc

SEQ ID NO: 1621969 - RNA, 21 nt, Human
cucuacagcuaaucagcauuc

SEQ ID NO: 1621970 - RNA, 13 nt, Human
cucuacagaggcc

SEQ ID NO: 1621971 - RNA, 13 nt, Human
cucuacaaaaagc

SEQ ID NO: 1621972 - RNA, 20 nt, Human
cuccauccugaggcuccacu

SEQ ID NO: 1621973 - RNA, 18 nt, Human
cuccauccugaggcucca

SEQ ID NO: 1621974 - RNA, 16 nt, Human
cuccauccugaggcuc

SEQ ID NO: 1621975 - RNA, 11 nt, Human
cuccauccuga

SEQ ID NO: 1621976 - RNA, 18 nt, Human
cucacuauguugcccagg

SEQ ID NO: 1621977 - RNA, 13 nt, Human
cuccaugugggcu

SEQ ID NO: 1621978 - RNA, 17 nt, Human
cucccaaagugcuggga

SEQ ID NO: 1621979 - RNA, 22 nt, Human
cuccaugucucugagcauuaga

SEQ ID NO: 1621980 - RNA, 13 nt, Human
cuccaugucucug

SEQ ID NO: 1621981 - RNA, 13 nt, Human
cuccaugcugccu

SEQ ID NO: 1621982 - RNA, 16 nt, Human
cuccaucuccacucca

SEQ ID NO: 1621983 - RNA, 23 nt, Human
cucccaucugugaaaggaaagag

SEQ ID NO: 1621984 - RNA, 18 nt, Human
cucccaucugugaaagga

SEQ ID NO: 1621985 - RNA, 15 nt, Human
cucccaucugugaaa

SEQ ID NO: 1621986 - RNA, 14 nt, Human
cucccaucugugaa

SEQ ID NO: 1621987 - RNA, 11 nt, Human
cucccaucugu

SEQ ID NO: 1621988 - RNA, 17 nt, Human
cucccaacucaccccag

SEQ ID NO: 1621989 - RNA, 14 nt, Human
cuccaugugggcua

SEQ ID NO: 1621990 - RNA, 18 nt, Human
cucccaaagugcugggau

SEQ ID NO: 1621991 - RNA, 22 nt, Human
cucccaaagugcugggauuaca

SEQ ID NO: 1621992 - RNA, 22 nt, Human
cucccaacucaccccagcccca

SEQ ID NO: 1621993 - RNA, 12 nt, Human
cuccccugcugg

SEQ ID NO: 1621994 - RNA, 21 nt, Human
cuccccagcaagugagagcug

SEQ ID NO: 1621995 - RNA, 20 nt, Human
cuccccagcaagugagagcu

SEQ ID NO: 1621996 - RNA, 12 nt, Human
cuccccagcaag

SEQ ID NO: 1621997 - RNA, 17 nt, Human
cucccgaguagcuggga

SEQ ID NO: 1621998 - RNA, 16 nt, Human
cucccgaguagcuggg

SEQ ID NO: 1621999 - RNA, 18 nt, Human
cucccgaauagcugggac

SEQ ID NO: 1622000 - RNA, 17 nt, Human
cucccgaauagcuggga

SEQ ID NO: 1622001 - RNA, 14 nt, Human
cuccccugcugggu

SEQ ID NO: 1622002 - RNA, 13 nt, Human
cuccccugcuggg

SEQ ID NO: 1622003 - RNA, 18 nt, Human
cucccgaguagcugggac

SEQ ID NO: 1622004 - RNA, 19 nt, Human
cucccgaauagcugggacu

SEQ ID NO: 1622005 - RNA, 20 nt, Human
cucccggcuaugggggcacu

SEQ ID NO: 1622006 - RNA, 15 nt, Human
cucccuccaccuccc

SEQ ID NO: 1622007 - RNA, 17 nt, Human
cucccuccaccucccug

SEQ ID NO: 1622008 - RNA, 13 nt, Human
cucccucauucca

SEQ ID NO: 1622009 - RNA, 15 nt, Human
cuccgaccagacacc

SEQ ID NO: 1622010 - RNA, 20 nt, Human
cucccuuuuaauccuggcug

SEQ ID NO: 1622011 - RNA, 19 nt, Human
cucccuuuuaauccuggcu

SEQ ID NO: 1622012 - RNA, 15 nt, Human
cuccgccucccgggu

SEQ ID NO: 1622013 - RNA, 22 nt, Human
cuccucuccccagcaagugaga

SEQ ID NO: 1622014 - RNA, 14 nt, Human
cuccucccggugcc

SEQ ID NO: 1622015 - RNA, 17 nt, Human
cuccucccggugcccaa

SEQ ID NO: 1622016 - RNA, 15 nt, Human
cuccucccggugccc

SEQ ID NO: 1622017 - RNA, 11 nt, Human
cuccugcccuu

SEQ ID NO: 1622018 - RNA, 14 nt, Human
cuccugccucagcc

SEQ ID NO: 1622019 - RNA, 13 nt, Human
cuccugccucagc

SEQ ID NO: 1622020 - RNA, 20 nt, Human
cuccugcaggcagccaggcc

SEQ ID NO: 1622021 - RNA, 18 nt, Human
cuccugcaggcagccagg

SEQ ID NO: 1622022 - RNA, 17 nt, Human
cuccugcaggcagccag

SEQ ID NO: 1622023 - RNA, 12 nt, Human
cuccugcaggca

SEQ ID NO: 1622024 - RNA, 11 nt, Human
cuccugcaggc

SEQ ID NO: 1622025 - RNA, 19 nt, Human
cuccugugugugcgccuac

SEQ ID NO: 1622026 - RNA, 16 nt, Human
cuccugugugugcgcc

SEQ ID NO: 1622027 - RNA, 15 nt, Human
cuccugccucagccu

SEQ ID NO: 1622028 - RNA, 16 nt, Human
cuccugccucagccuc

SEQ ID NO: 1622029 - RNA, 17 nt, Human
cugacucuuaagaagac

SEQ ID NO: 1622030 - RNA, 16 nt, Human
cugacuguuuucucuu

SEQ ID NO: 1622031 - RNA, 15 nt, Human
cugacuucuaaguaa

SEQ ID NO: 1622032 - RNA, 13 nt, Human
cugacuucuaagu

SEQ ID NO: 1622033 - RNA, 18 nt, Human
cugacuguuuucucuuga

SEQ ID NO: 1622034 - RNA, 16 nt, Human
cugacuucuaaguaaa

SEQ ID NO: 1622035 - RNA, 23 nt, Human
cugagaaagacuauucaaacagu

SEQ ID NO: 1622036 - RNA, 22 nt, Human
cugagaaagacuauucaaacag

SEQ ID NO: 1622037 - RNA, 14 nt, Human
cugagaaauuuaua

SEQ ID NO: 1622038 - RNA, 11 nt, Human
cugagaaauuu

SEQ ID NO: 1622039 - RNA, 15 nt, Human
cugagacagcccggg

SEQ ID NO: 1622040 - RNA, 14 nt, Human
cugagacagcccgg

SEQ ID NO: 1622041 - RNA, 19 nt, Human
cugaagacucauucuucug

SEQ ID NO: 1622042 - RNA, 22 nt, Human
cugacauuguuggccaaagcca

SEQ ID NO: 1622043 - RNA, 14 nt, Human
cugacccacugcuu

SEQ ID NO: 1622044 - RNA, 13 nt, Human
cugacccacugcu

SEQ ID NO: 1622045 - RNA, 13 nt, Human
cugacccaugcug

SEQ ID NO: 1622046 - RNA, 15 nt, Human
cugacccaugcugcc

SEQ ID NO: 1622047 - RNA, 14 nt, Human
cugacccaugcugc

SEQ ID NO: 1622048 - RNA, 16 nt, Human
cugacccaugcugccc

SEQ ID NO: 1622049 - RNA, 20 nt, Human
cugagcgacagugagacucu

SEQ ID NO: 1622050 - RNA, 16 nt, Human
cugagcgacagugaga

SEQ ID NO: 1622051 - RNA, 22 nt, Human
cugagccucagucucccucccu

SEQ ID NO: 1622052 - RNA, 21 nt, Human
cugagccagauuucacucucc

SEQ ID NO: 1622053 - RNA, 20 nt, Human
cugagccagauuucacucuc

SEQ ID NO: 1622054 - RNA, 19 nt, Human
cugagccagauuucacucu

SEQ ID NO: 1622055 - RNA, 18 nt, Human
cugagccagauuucacuc

SEQ ID NO: 1622056 - RNA, 17 nt, Human
cugagccagauuucacu

SEQ ID NO: 1622057 - RNA, 18 nt, Human
cugagacagcccgggcuc

SEQ ID NO: 1622058 - RNA, 17 nt, Human
cugagacagcccgggcu

SEQ ID NO: 1622059 - RNA, 16 nt, Human
cugagacagcccgggc

SEQ ID NO: 1622060 - RNA, 21 nt, Human
cugagccucagucucccuccc

SEQ ID NO: 1622061 - RNA, 16 nt, Human
cugagccucagucucc

SEQ ID NO: 1622062 - RNA, 20 nt, Human
cugaggcccuucucuccagc

SEQ ID NO: 1622063 - RNA, 19 nt, Human
cugaggcccuucucuccag

SEQ ID NO: 1622064 - RNA, 18 nt, Human
cugaggcccuucucucca

SEQ ID NO: 1622065 - RNA, 15 nt, Human
cugaggcccuucucu

SEQ ID NO: 1622066 - RNA, 14 nt, Human
cugaggcccuucuc

SEQ ID NO: 1622067 - RNA, 23 nt, Human
cugaggcccagagggccugcaag

SEQ ID NO: 1622068 - RNA, 21 nt, Human
cugaggcccagagggccugca

SEQ ID NO: 1622069 - RNA, 19 nt, Human
cugaggcccagagggccug

SEQ ID NO: 1622070 - RNA, 18 nt, Human
cugaggcccagagggccu

SEQ ID NO: 1622071 - RNA, 17 nt, Human
cugaggcccagagggcc

SEQ ID NO: 1622072 - RNA, 16 nt, Human
cugaggcccagagggc

SEQ ID NO: 1622073 - RNA, 15 nt, Human
cugaggcccagaggg

SEQ ID NO: 1622074 - RNA, 14 nt, Human
cugaggcccagagg

SEQ ID NO: 1622075 - RNA, 13 nt, Human
cugaggcccagag

SEQ ID NO: 1622076 - RNA, 12 nt, Human
cugaggcccaga

SEQ ID NO: 1622077 - RNA, 19 nt, Human
cugaggaucagaguaaucc

SEQ ID NO: 1622078 - RNA, 17 nt, Human
cugaggaucagaguaau

SEQ ID NO: 1622079 - RNA, 12 nt, Human
cucugcuugcca

SEQ ID NO: 1622080 - RNA, 14 nt, Human
cucugcuugccauc

SEQ ID NO: 1622081 - RNA, 17 nt, Human
cucugcuugccaucccu

SEQ ID NO: 1622082 - RNA, 20 nt, Human
cucugcuugccaucccuccc

SEQ ID NO: 1622083 - RNA, 15 nt, Human
cucuggacaggcaug

SEQ ID NO: 1622084 - RNA, 22 nt, Human
cucugccugaagucacacagug

SEQ ID NO: 1622085 - RNA, 21 nt, Human
cucugccugaagucacacagu

SEQ ID NO: 1622086 - RNA, 13 nt, Human
cucucuccucccu

SEQ ID NO: 1622087 - RNA, 19 nt, Human
cucuggccuucggccucca

SEQ ID NO: 1622088 - RNA, 16 nt, Human
cucuggcuccagcugg

SEQ ID NO: 1622089 - RNA, 15 nt, Human
cucuggcuccagcug

SEQ ID NO: 1622090 - RNA, 12 nt, Human
cucuggccuucg

SEQ ID NO: 1622091 - RNA, 16 nt, Human
cucuggcagcucagag

SEQ ID NO: 1622092 - RNA, 15 nt, Human
cucuggcagcucaga

SEQ ID NO: 1622093 - RNA, 14 nt, Human
cucuggcagcucag

SEQ ID NO: 1622094 - RNA, 12 nt, Human
cucuggcagcuc

SEQ ID NO: 1622095 - RNA, 22 nt, Human
cucuggacaggcauguucucug

SEQ ID NO: 1622096 - RNA, 16 nt, Human
cucuggacaggcaugu

SEQ ID NO: 1622097 - RNA, 15 nt, Human
cucuuccaggcuggg

SEQ ID NO: 1622098 - RNA, 14 nt, Human
cucuuccaggcugg

SEQ ID NO: 1622099 - RNA, 13 nt, Human
cucuuccaggcug

SEQ ID NO: 1622100 - RNA, 15 nt, Human
cucuuagaaaaacca

SEQ ID NO: 1622101 - RNA, 13 nt, Human
cucuuagaaaaac

SEQ ID NO: 1622102 - RNA, 15 nt, Human
cucugugucaggugg

SEQ ID NO: 1622103 - RNA, 19 nt, Human
cucugugucagguggggca

SEQ ID NO: 1622104 - RNA, 22 nt, Human
cucuggcuccagcuggccggga

SEQ ID NO: 1622105 - RNA, 23 nt, Human
cugaagaagcaccaaucaugaau

SEQ ID NO: 1622106 - RNA, 19 nt, Human
cugaagaauugaaaaacca

SEQ ID NO: 1622107 - RNA, 17 nt, Human
cugaacucugacaacag

SEQ ID NO: 1622108 - RNA, 16 nt, Human
cugaacucugacaaca

SEQ ID NO: 1622109 - RNA, 16 nt, Human
cugaaauuuccuggga

SEQ ID NO: 1622110 - RNA, 23 nt, Human
cugaaauuuccugggagcuuuug

SEQ ID NO: 1622111 - RNA, 13 nt, Human
cugaaauuuccug

SEQ ID NO: 1622112 - RNA, 15 nt, Human
cugaaagcccugagc

SEQ ID NO: 1622113 - RNA, 17 nt, Human
cucuuucuauuguuucu

SEQ ID NO: 1622114 - RNA, 19 nt, Human
cugaaagcccugagcuuuc

SEQ ID NO: 1622115 - RNA, 18 nt, Human
cugaaagcccugagcuuu

SEQ ID NO: 1622116 - RNA, 17 nt, Human
cugaaagcccugagcuu

SEQ ID NO: 1622117 - RNA, 16 nt, Human
cugaaagcccugagcu

SEQ ID NO: 1622118 - RNA, 23 nt, Human
cugaaagcccugagcuuucugcu

SEQ ID NO: 1622119 - RNA, 21 nt, Human
cugaaauaaacgucuuaaaua

SEQ ID NO: 1622120 - RNA, 22 nt, Human
cugaaauagacccacaagaggc

SEQ ID NO: 1622121 - RNA, 22 nt, Human
cucuucuuuaaagggauggcaa

SEQ ID NO: 1622122 - RNA, 22 nt, Human
cucuugaaauauaggaacuuaa

SEQ ID NO: 1622123 - RNA, 19 nt, Human
cucuuggguucaagcgauu

SEQ ID NO: 1622124 - RNA, 15 nt, Human
cucuugaacuccuga

SEQ ID NO: 1622125 - RNA, 21 nt, Human
cucuuggguucaagcgauucu

SEQ ID NO: 1622126 - RNA, 23 nt, Human
cucuuuaaugucacaggcagguc

SEQ ID NO: 1622127 - RNA, 22 nt, Human
cucuuuaaugucacaggcaggu

SEQ ID NO: 1622128 - RNA, 21 nt, Human
cucuuuaaugucacaggcagg

SEQ ID NO: 1622129 - RNA, 20 nt, Human
cucuuuaaugucacaggcag

SEQ ID NO: 1622130 - RNA, 17 nt, Human
cucuuucccucccuucc

SEQ ID NO: 1622131 - RNA, 17 nt, Human
cucuugguccugcugca

SEQ ID NO: 1622132 - RNA, 16 nt, Human
cucuugguccugcugc

SEQ ID NO: 1622133 - RNA, 15 nt, Human
cucuugguccugcug

SEQ ID NO: 1622134 - RNA, 13 nt, Human
cucuugguccugc

SEQ ID NO: 1622135 - RNA, 18 nt, Human
cucuuuaaugucacaggc

SEQ ID NO: 1622136 - RNA, 18 nt, Human
cugucucuacuaaaaaua

SEQ ID NO: 1622137 - RNA, 22 nt, Human
cugucucaaaaaaagaaaaaga

SEQ ID NO: 1622138 - RNA, 21 nt, Human
cuguccuacucugugucaggu

SEQ ID NO: 1622139 - RNA, 14 nt, Human
cuguccgagcuuug

SEQ ID NO: 1622140 - RNA, 21 nt, Human
cugucucaagagggcacuggu

SEQ ID NO: 1622141 - RNA, 20 nt, Human
cugucucaagagggcacugg

SEQ ID NO: 1622142 - RNA, 19 nt, Human
cugucucaagagggcacug

SEQ ID NO: 1622143 - RNA, 18 nt, Human
cugucucaagagggcacu

SEQ ID NO: 1622144 - RNA, 20 nt, Human
cuguccuacucugugucagg

SEQ ID NO: 1622145 - RNA, 18 nt, Human
cuguccuacucuguguca

SEQ ID NO: 1622146 - RNA, 17 nt, Human
cuguccuacucuguguc

SEQ ID NO: 1622147 - RNA, 16 nt, Human
cuguccuacucugugu

SEQ ID NO: 1622148 - RNA, 17 nt, Human
cuguccccgcacugggc

SEQ ID NO: 1622149 - RNA, 14 nt, Human
cugucccccugaca

SEQ ID NO: 1622150 - RNA, 13 nt, Human
cugucccccugac

SEQ ID NO: 1622151 - RNA, 19 nt, Human
cuguauuuuaaaagaauga

SEQ ID NO: 1622152 - RNA, 16 nt, Human
cuguauuuuaaaagaa

SEQ ID NO: 1622153 - RNA, 13 nt, Human
cuguauuuuaaaa

SEQ ID NO: 1622154 - RNA, 22 nt, Human
cugucccagugccgagaaggaa

SEQ ID NO: 1622155 - RNA, 19 nt, Human
cuguccaggcacugcugcc

SEQ ID NO: 1622156 - RNA, 18 nt, Human
cuguccaggcacugcugc

SEQ ID NO: 1622157 - RNA, 23 nt, Human
cuguccaggcacugcugcccagc

SEQ ID NO: 1622158 - RNA, 22 nt, Human
cuguccaggcacugcugcccag

SEQ ID NO: 1622159 - RNA, 21 nt, Human
cuguccaggcacugcugccca

SEQ ID NO: 1622160 - RNA, 20 nt, Human
cuguccaggcacugcugccc

SEQ ID NO: 1622161 - RNA, 15 nt, Human
cuguaugauucccag

SEQ ID NO: 1622162 - RNA, 18 nt, Human
cuguaucccaugagccuc

SEQ ID NO: 1622163 - RNA, 19 nt, Human
cuguaucccaugagccuca

SEQ ID NO: 1622164 - RNA, 15 nt, Human
cuguaucccaugagc

SEQ ID NO: 1622165 - RNA, 22 nt, Human
cuguaccucuugagccuugaac

SEQ ID NO: 1622166 - RNA, 16 nt, Human
cuguauagauuagaga

SEQ ID NO: 1622167 - RNA, 15 nt, Human
cuguauagauuagag

SEQ ID NO: 1622168 - RNA, 13 nt, Human
cuggucccacuca

SEQ ID NO: 1622169 - RNA, 14 nt, Human
cuggucccacucag

SEQ ID NO: 1622170 - RNA, 23 nt, Human
cuggucucaaacucuugaccuca

SEQ ID NO: 1622171 - RNA, 23 nt, Human
cuggucacaggacucugccuccu

SEQ ID NO: 1622172 - RNA, 22 nt, Human
cuggucacaggacucugccucc

SEQ ID NO: 1622173 - RNA, 21 nt, Human
cuggucacaggacucugccuc

SEQ ID NO: 1622174 - RNA, 20 nt, Human
cuggucacaggacucugccu

SEQ ID NO: 1622175 - RNA, 16 nt, Human
cuggguacuuguggac

SEQ ID NO: 1622176 - RNA, 18 nt, Human
cuggguacuuguggacac

SEQ ID NO: 1622177 - RNA, 19 nt, Human
cuggguacuuguggacaca

SEQ ID NO: 1622178 - RNA, 22 nt, Human
cugggcucccuucccaccucuc

SEQ ID NO: 1622179 - RNA, 21 nt, Human
cugggcucccuucccaccucu

SEQ ID NO: 1622180 - RNA, 20 nt, Human
cugggcucccuucccaccuc

SEQ ID NO: 1622181 - RNA, 15 nt, Human
cuggguuggagggug

SEQ ID NO: 1622182 - RNA, 22 nt, Human
cugggucgcccuggacugugug

SEQ ID NO: 1622183 - RNA, 18 nt, Human
cugggucgcccuggacug

SEQ ID NO: 1622184 - RNA, 17 nt, Human
cugggucgcccuggacu

SEQ ID NO: 1622185 - RNA, 21 nt, Human
cuguaccucuugagccuugaa

SEQ ID NO: 1622186 - RNA, 22 nt, Human
cuguacaugaaaacacauuuuu

SEQ ID NO: 1622187 - RNA, 23 nt, Human
cuguacaugaaaacacauuuuuc

SEQ ID NO: 1622188 - RNA, 23 nt, Human
cuguacagagcccacgcccccac

SEQ ID NO: 1622189 - RNA, 21 nt, Human
cuguaauuugugauacaaugc

SEQ ID NO: 1622190 - RNA, 22 nt, Human
cuguaauuugugauacaaugcu

SEQ ID NO: 1622191 - RNA, 18 nt, Human
cuguaauuugugauacaa

SEQ ID NO: 1622192 - RNA, 17 nt, Human
cuguaauuugugauaca

SEQ ID NO: 1622193 - RNA, 14 nt, Human
cugguggcagcuca

SEQ ID NO: 1622194 - RNA, 13 nt, Human
cugguggcagcuc

SEQ ID NO: 1622195 - RNA, 16 nt, Human
cugguggcagcucacc

SEQ ID NO: 1622196 - RNA, 12 nt, Human
cugguggcagcu

SEQ ID NO: 1622197 - RNA, 21 nt, Human
cuggucucgaacuccugaccu

SEQ ID NO: 1622198 - RNA, 16 nt, Human
cuggucucgaacuccu

SEQ ID NO: 1622199 - RNA, 20 nt, Human
cugguucaggguuggccccu

SEQ ID NO: 1622200 - RNA, 23 nt, Human
cugguuaauauuuauaggucacu

SEQ ID NO: 1622201 - RNA, 16 nt, Human
cugguuccauggccuc

SEQ ID NO: 1622202 - RNA, 18 nt, Human
cuguaaggcaaucauggu

SEQ ID NO: 1622203 - RNA, 15 nt, Human
cuggccuucggccuc

SEQ ID NO: 1622204 - RNA, 19 nt, Human
cuggccuggccccucaggg

SEQ ID NO: 1622205 - RNA, 17 nt, Human
cuggccuggccccucag

SEQ ID NO: 1622206 - RNA, 16 nt, Human
cuggccuggccccuca

SEQ ID NO: 1622207 - RNA, 21 nt, Human
cuggccuucggccuccauccu

SEQ ID NO: 1622208 - RNA, 18 nt, Human
cuggccuucggccuccau

SEQ ID NO: 1622209 - RNA, 17 nt, Human
cuggccuucggccucca

SEQ ID NO: 1622210 - RNA, 16 nt, Human
cuggccuucggccucc

SEQ ID NO: 1622211 - RNA, 16 nt, Human
cuggccugagcuggga

SEQ ID NO: 1622212 - RNA, 16 nt, Human
cuggccucugcacucc

SEQ ID NO: 1622213 - RNA, 14 nt, Human
cuggccucugcacu

SEQ ID NO: 1622214 - RNA, 13 nt, Human
cuggccucugcac

SEQ ID NO: 1622215 - RNA, 18 nt, Human
cuggccugagcugggaug

SEQ ID NO: 1622216 - RNA, 14 nt, Human
cuggccuggccccu

SEQ ID NO: 1622217 - RNA, 23 nt, Human
cuggccucaagugauucuccugc

SEQ ID NO: 1622218 - RNA, 12 nt, Human
cuggccucugca

SEQ ID NO: 1622219 - RNA, 22 nt, Human
cuggcaugggaaugaaugucag

SEQ ID NO: 1622220 - RNA, 19 nt, Human
cuggcaugggaaugaaugu

SEQ ID NO: 1622221 - RNA, 18 nt, Human
cuggcaugggaaugaaug

SEQ ID NO: 1622222 - RNA, 16 nt, Human
cuggcaugggaaugaa

SEQ ID NO: 1622223 - RNA, 22 nt, Human
cuggcacuauaauguaagcucu

SEQ ID NO: 1622224 - RNA, 16 nt, Human
cuggcacuauaaugua

SEQ ID NO: 1622225 - RNA, 15 nt, Human
cuggcacuauaaugu

SEQ ID NO: 1622226 - RNA, 24 nt, Human
cuggcaugggaaugaaugucagug

SEQ ID NO: 1622227 - RNA, 19 nt, Human
cuggcacccggccccugcu

SEQ ID NO: 1622228 - RNA, 18 nt, Human
cuggcacccggccccugc

SEQ ID NO: 1622229 - RNA, 17 nt, Human
cuggcacccggccccug

SEQ ID NO: 1622230 - RNA, 16 nt, Human
cuggcacccggccccu

SEQ ID NO: 1622231 - RNA, 16 nt, Human
cuggcacagggcagug

SEQ ID NO: 1622232 - RNA, 15 nt, Human
cuggcacagggcagu

SEQ ID NO: 1622233 - RNA, 14 nt, Human
cuggaaugcagugg

SEQ ID NO: 1622234 - RNA, 14 nt, Human
cuggcaagaaugug

SEQ ID NO: 1622235 - RNA, 18 nt, Human
cuggaauauauaaccagu

SEQ ID NO: 1622236 - RNA, 20 nt, Human
cuggaagugcuaauuuugaa

SEQ ID NO: 1622237 - RNA, 20 nt, Human
cugggagagccuuccagggg

SEQ ID NO: 1622238 - RNA, 19 nt, Human
cugggagagccuuccaggg

SEQ ID NO: 1622239 - RNA, 21 nt, Human
cugggagagccuuccaggggu

SEQ ID NO: 1622240 - RNA, 18 nt, Human
cugggagagccuuccagg

SEQ ID NO: 1622241 - RNA, 17 nt, Human
cugggagagccuuccag

SEQ ID NO: 1622242 - RNA, 18 nt, Human
cuggcuguuggcuggggg

SEQ ID NO: 1622243 - RNA, 23 nt, Human
cuggcuuuucacugcuggcugcc

SEQ ID NO: 1622244 - RNA, 20 nt, Human
cuggcugguuagagguuccc

SEQ ID NO: 1622245 - RNA, 17 nt, Human
cuggcuguuggcugggg

SEQ ID NO: 1622246 - RNA, 16 nt, Human
cuggcuguuggcuggg

SEQ ID NO: 1622247 - RNA, 13 nt, Human
cuggcugucgaga

SEQ ID NO: 1622248 - RNA, 17 nt, Human
cugggauuacaggugug

SEQ ID NO: 1622249 - RNA, 20 nt, Human
cugggauuacaggugugaac

SEQ ID NO: 1622250 - RNA, 18 nt, Human
cugggauuacagguguga

SEQ ID NO: 1622251 - RNA, 16 nt, Human
cugggauuacaggugu

SEQ ID NO: 1622252 - RNA, 18 nt, Human
cugggaugauuggagggg

SEQ ID NO: 1622253 - RNA, 20 nt, Human
cugggaucccucauccucau

SEQ ID NO: 1622254 - RNA, 12 nt, Human
cugggagugagc

SEQ ID NO: 1622255 - RNA, 19 nt, Human
cugggccccaguuguauuu

SEQ ID NO: 1622256 - RNA, 15 nt, Human
cugggccccaguugu

SEQ ID NO: 1622257 - RNA, 21 nt, Human
cugggaggucaaggcugcagu

SEQ ID NO: 1622258 - RNA, 19 nt, Human
cugggaggucaaggcugca

SEQ ID NO: 1622259 - RNA, 22 nt, Human
cugggaggcucuggagcccacu

SEQ ID NO: 1622260 - RNA, 17 nt, Human
cugggaggcucuggagc

SEQ ID NO: 1622261 - RNA, 21 nt, Human
cugggaggcucuggagcccac

SEQ ID NO: 1622262 - RNA, 20 nt, Human
cugggaggcucuggagccca

SEQ ID NO: 1622263 - RNA, 18 nt, Human
cugggaggcucuggagcc

SEQ ID NO: 1622264 - RNA, 14 nt, Human
cugggaggcaguga

SEQ ID NO: 1622265 - RNA, 18 nt, Human
cugcuugccaucccuccc

SEQ ID NO: 1622266 - RNA, 19 nt, Human
cugcuugccaucccucccu

SEQ ID NO: 1622267 - RNA, 20 nt, Human
cugcuugccaucccucccuc

SEQ ID NO: 1622268 - RNA, 22 nt, Human
cugcuugccaucccucccucca

SEQ ID NO: 1622269 - RNA, 20 nt, Human
cugcuugcuugcuuuuuaau

SEQ ID NO: 1622270 - RNA, 16 nt, Human
cugcuugccaucccuc

SEQ ID NO: 1622271 - RNA, 15 nt, Human
cugcuugccaucccu

SEQ ID NO: 1622272 - RNA, 22 nt, Human
cugcuugaggcaacucaucuua

SEQ ID NO: 1622273 - RNA, 18 nt, Human
cugcuugggcuucauccu

SEQ ID NO: 1622274 - RNA, 17 nt, Human
cugcuugggcuucaucc

SEQ ID NO: 1622275 - RNA, 15 nt, Human
cugcuugggcuucau

SEQ ID NO: 1622276 - RNA, 13 nt, Human
cugcuugggcuuc

SEQ ID NO: 1622277 - RNA, 19 nt, Human
cugcuugugaaaggaaaga

SEQ ID NO: 1622278 - RNA, 19 nt, Human
cugcuugggcuucauccuc

SEQ ID NO: 1622279 - RNA, 15 nt, Human
cugcuuuuggucugu

SEQ ID NO: 1622280 - RNA, 17 nt, Human
cugcuuugggcugcccu

SEQ ID NO: 1622281 - RNA, 13 nt, Human
cugcuuuggaaau

SEQ ID NO: 1622282 - RNA, 16 nt, Human
cugcuuugggcugccc

SEQ ID NO: 1622283 - RNA, 16 nt, Human
cugcuuucagauacug

SEQ ID NO: 1622284 - RNA, 15 nt, Human
cugcuuucagauacu

SEQ ID NO: 1622285 - RNA, 12 nt, Human
cugcuuucagau

SEQ ID NO: 1622286 - RNA, 17 nt, Human
cugcuuuuggucugugu

SEQ ID NO: 1622287 - RNA, 19 nt, Human
cugcuuuugucuaugggac

SEQ ID NO: 1622288 - RNA, 17 nt, Human
cugcuggguguggcgca

SEQ ID NO: 1622289 - RNA, 15 nt, Human
cugcuggguguggcg

SEQ ID NO: 1622290 - RNA, 14 nt, Human
cugcuggguguggc

SEQ ID NO: 1622291 - RNA, 14 nt, Human
cugcugcuggcugg

SEQ ID NO: 1622292 - RNA, 13 nt, Human
cugcuggcugccu

SEQ ID NO: 1622293 - RNA, 15 nt, Human
cugcuggcugccuua

SEQ ID NO: 1622294 - RNA, 14 nt, Human
cugcuggcugccuu

SEQ ID NO: 1622295 - RNA, 13 nt, Human
cugcugcuggcug

SEQ ID NO: 1622296 - RNA, 12 nt, Human
cugcugcuggcu

SEQ ID NO: 1622297 - RNA, 21 nt, Human
cugcuugaggcaacucaucuu

SEQ ID NO: 1622298 - RNA, 20 nt, Human
cugcuugaggcaacucaucu

SEQ ID NO: 1622299 - RNA, 13 nt, Human
cugcuugaggcaa

SEQ ID NO: 1622300 - RNA, 12 nt, Human
cugcccucuccu

SEQ ID NO: 1622301 - RNA, 13 nt, Human
cugcccucuccug

SEQ ID NO: 1622302 - RNA, 14 nt, Human
cugcccucuccugg

SEQ ID NO: 1622303 - RNA, 20 nt, Human
cugcccugcccaccuggccu

SEQ ID NO: 1622304 - RNA, 15 nt, Human
cugcccucuccuggg

SEQ ID NO: 1622305 - RNA, 21 nt, Human
cugcccugcccaccuggccuc

SEQ ID NO: 1622306 - RNA, 16 nt, Human
cugccugaagucacac

SEQ ID NO: 1622307 - RNA, 18 nt, Human
cugccugaagucacacag

SEQ ID NO: 1622308 - RNA, 19 nt, Human
cugccugaagucacacagu

SEQ ID NO: 1622309 - RNA, 23 nt, Human
cugccugaagucacacagugagu

SEQ ID NO: 1622310 - RNA, 21 nt, Human
cugccugcaguacuuuaccuc

SEQ ID NO: 1622311 - RNA, 20 nt, Human
cugccugcaguacuuuaccu

SEQ ID NO: 1622312 - RNA, 19 nt, Human
cugcggugcuaucuccccc

SEQ ID NO: 1622313 - RNA, 18 nt, Human
cugcggugcuaucucccc

SEQ ID NO: 1622314 - RNA, 23 nt, Human
cugcgguccacccaggagccccg

SEQ ID NO: 1622315 - RNA, 23 nt, Human
cugcgggucacaggagggagggg

SEQ ID NO: 1622316 - RNA, 22 nt, Human
cugcgggucacaggagggaggg

SEQ ID NO: 1622317 - RNA, 21 nt, Human
cugcgggucacaggagggagg

SEQ ID NO: 1622318 - RNA, 15 nt, Human
cugcgggucacagga

SEQ ID NO: 1622319 - RNA, 22 nt, Human
cugccugcuuuuuauggccugu

SEQ ID NO: 1622320 - RNA, 19 nt, Human
cugcucuccgaccagacac

SEQ ID NO: 1622321 - RNA, 15 nt, Human
cugcucuccgaccag

SEQ ID NO: 1622322 - RNA, 20 nt, Human
cugcuccucuccccagcaag

SEQ ID NO: 1622323 - RNA, 19 nt, Human
cugcuccucuccccagcaa

SEQ ID NO: 1622324 - RNA, 23 nt, Human
cugcuccucuccccagcaaguga

SEQ ID NO: 1622325 - RNA, 23 nt, Human
cugcggugcuaucucccccagcc

SEQ ID NO: 1622326 - RNA, 22 nt, Human
cugcggugcuaucucccccagc

SEQ ID NO: 1622327 - RNA, 21 nt, Human
cugcggugcuaucucccccag

SEQ ID NO: 1622328 - RNA, 20 nt, Human
cugcggugcuaucuccccca

SEQ ID NO: 1622329 - RNA, 12 nt, Human
cugcucugguua

SEQ ID NO: 1622330 - RNA, 19 nt, Human
cugcucuugaacuccugac

SEQ ID NO: 1622331 - RNA, 18 nt, Human
cugcucuugaacuccuga

SEQ ID NO: 1622332 - RNA, 16 nt, Human
cugcucuugaacuccu

SEQ ID NO: 1622333 - RNA, 13 nt, Human
cugcugcaguugc

SEQ ID NO: 1622334 - RNA, 10 nt, Human
cugcugcagu

SEQ ID NO: 1622335 - RNA, 14 nt, Human
cugcugcaguugcc

SEQ ID NO: 1622336 - RNA, 15 nt, Human
cugcugcaguugcca

SEQ ID NO: 1622337 - RNA, 23 nt, Human
cugcugccugcuuuuuauggccu

SEQ ID NO: 1622338 - RNA, 14 nt, Human
cugcugccugcuuu

SEQ ID NO: 1622339 - RNA, 20 nt, Human
cugcaucagcugcugaaaca

SEQ ID NO: 1622340 - RNA, 20 nt, Human
cugcaucaagaugugacaug

SEQ ID NO: 1622341 - RNA, 15 nt, Human
cugcauaugaaagga

SEQ ID NO: 1622342 - RNA, 14 nt, Human
cugccacccugggg

SEQ ID NO: 1622343 - RNA, 12 nt, Human
cugccacccugg

SEQ ID NO: 1622344 - RNA, 21 nt, Human
cugccacccuggggagaaagu

SEQ ID NO: 1622345 - RNA, 15 nt, Human
cugccagcaacgcag

SEQ ID NO: 1622346 - RNA, 21 nt, Human
cugccaggaagccagcaggcu

SEQ ID NO: 1622347 - RNA, 20 nt, Human
cugccaggaagccagcaggc

SEQ ID NO: 1622348 - RNA, 14 nt, Human
cugccaggaagcca

SEQ ID NO: 1622349 - RNA, 13 nt, Human
cugccaggaagcc

SEQ ID NO: 1622350 - RNA, 15 nt, Human
cugccauccucccaa

SEQ ID NO: 1622351 - RNA, 21 nt, Human
cugccauccagguucagcuug

SEQ ID NO: 1622352 - RNA, 22 nt, Human
cugccaggaagccagcaggcuc

SEQ ID NO: 1622353 - RNA, 20 nt, Human
cugccaucucaccuccugcu

SEQ ID NO: 1622354 - RNA, 20 nt, Human
cugcccaggccccugccacc

SEQ ID NO: 1622355 - RNA, 19 nt, Human
cugcccaggccccugccac

SEQ ID NO: 1622356 - RNA, 18 nt, Human
cugcccaggccccugcca

SEQ ID NO: 1622357 - RNA, 16 nt, Human
cugcccaggccccugc

SEQ ID NO: 1622358 - RNA, 17 nt, Human
cugcccaggccugccug

SEQ ID NO: 1622359 - RNA, 15 nt, Human
cugcccaggccccug

SEQ ID NO: 1622360 - RNA, 14 nt, Human
cugcccaggccccu

SEQ ID NO: 1622361 - RNA, 13 nt, Human
cugcccaccuggc

SEQ ID NO: 1622362 - RNA, 12 nt, Human
cugcccaccugg

SEQ ID NO: 1622363 - RNA, 15 nt, Human
cugccauuucugaga

SEQ ID NO: 1622364 - RNA, 20 nt, Human
cugcccggcaggguccuaga

SEQ ID NO: 1622365 - RNA, 13 nt, Human
cugcccggcaggg

SEQ ID NO: 1622366 - RNA, 18 nt, Human
cugccccuggcagccccu

SEQ ID NO: 1622367 - RNA, 19 nt, Human
cugccccuggcagccccug

SEQ ID NO: 1622368 - RNA, 22 nt, Human
cugcccuaaugcgcaggcuggc

SEQ ID NO: 1622369 - RNA, 21 nt, Human
cugcccuaaugcgcaggcugg

SEQ ID NO: 1622370 - RNA, 20 nt, Human
cugcccuaaugcgcaggcug

SEQ ID NO: 1622371 - RNA, 12 nt, Human
cugcacugucaa

SEQ ID NO: 1622372 - RNA, 21 nt, Human
cugcacuccccugcugggugu

SEQ ID NO: 1622373 - RNA, 13 nt, Human
cugcagagggcac

SEQ ID NO: 1622374 - RNA, 15 nt, Human
cugcagcaauaaagc

SEQ ID NO: 1622375 - RNA, 16 nt, Human
cugcagcaauaaagca

SEQ ID NO: 1622376 - RNA, 10 nt, Human
cugcagaggg

SEQ ID NO: 1622377 - RNA, 20 nt, Human
cugcacuccccugcugggug

SEQ ID NO: 1622378 - RNA, 19 nt, Human
cugcacuccccugcugggu

SEQ ID NO: 1622379 - RNA, 13 nt, Human
cugcacuccccug

SEQ ID NO: 1622380 - RNA, 14 nt, Human
cugcacuccccugc

SEQ ID NO: 1622381 - RNA, 20 nt, Human
cugcaccgggccacagagaa

SEQ ID NO: 1622382 - RNA, 18 nt, Human
cugcaccgggccacagag

SEQ ID NO: 1622383 - RNA, 20 nt, Human
cugcacuccagccuggguga

SEQ ID NO: 1622384 - RNA, 15 nt, Human
cugcaccgggccaca

SEQ ID NO: 1622385 - RNA, 14 nt, Human
cugcaccgggccac

SEQ ID NO: 1622386 - RNA, 16 nt, Human
cugcaccggcuggccu

SEQ ID NO: 1622387 - RNA, 15 nt, Human
cugcaccggcuggcc

SEQ ID NO: 1622388 - RNA, 23 nt, Human
cugaggcccuucucuccagcccc

SEQ ID NO: 1622389 - RNA, 22 nt, Human
cugaggcccuucucuccagccc

SEQ ID NO: 1622390 - RNA, 14 nt, Human
cugcaccggcuggc

SEQ ID NO: 1622391 - RNA, 17 nt, Human
cugcagcaauaaagcag

SEQ ID NO: 1622392 - RNA, 18 nt, Human
cugcaggucccuaauaaa

SEQ ID NO: 1622393 - RNA, 17 nt, Human
cugcaggucccuaauaa

SEQ ID NO: 1622394 - RNA, 16 nt, Human
cugcaggucccuaaua

SEQ ID NO: 1622395 - RNA, 15 nt, Human
cugcaggucccuaau

SEQ ID NO: 1622396 - RNA, 14 nt, Human
cugcaggucccuaa

SEQ ID NO: 1622397 - RNA, 13 nt, Human
cugcaggucccua

SEQ ID NO: 1622398 - RNA, 12 nt, Human
cugcaggucccu

SEQ ID NO: 1622399 - RNA, 11 nt, Human
cugcagguccc

SEQ ID NO: 1622400 - RNA, 16 nt, Human
cugcaguugccaguca

SEQ ID NO: 1622401 - RNA, 13 nt, Human
cugcaguugccag

SEQ ID NO: 1622402 - RNA, 17 nt, Human
cugcaguugccagucac

SEQ ID NO: 1622403 - RNA, 23 nt, Human
cugcaggucccuaauaaagcugu

SEQ ID NO: 1622404 - RNA, 22 nt, Human
cugcaggucccuaauaaagcug

SEQ ID NO: 1622405 - RNA, 21 nt, Human
cugcaggucccuaauaaagcu

SEQ ID NO: 1622406 - RNA, 20 nt, Human
cugcaggucccuaauaaagc

SEQ ID NO: 1622407 - RNA, 19 nt, Human
cugcaggucccuaauaaag

SEQ ID NO: 1622408 - RNA, 14 nt, Human
cuuuggauaauaag

SEQ ID NO: 1622409 - RNA, 18 nt, Human
cuuuuaaaacacuuccau

SEQ ID NO: 1622410 - RNA, 15 nt, Human
cuuuuaauccuggcu

SEQ ID NO: 1622411 - RNA, 21 nt, Human
cuuuucgcaggauucuuccuc

SEQ ID NO: 1622412 - RNA, 20 nt, Human
cuuuucgcaggauucuuccu

SEQ ID NO: 1622413 - RNA, 14 nt, Human
cuuuucccuucuuu

SEQ ID NO: 1622414 - RNA, 16 nt, Human
cuuuucacugcuggcu

SEQ ID NO: 1622415 - RNA, 23 nt, Human
cuuuuccaacccucaucaccaac

SEQ ID NO: 1622416 - RNA, 13 nt, Human
cuuuuccaacccu

SEQ ID NO: 1622417 - RNA, 22 nt, Human
cuuuucauuuaggugaggaagc

SEQ ID NO: 1622418 - RNA, 12 nt, Human
cuuuucacugcu

SEQ ID NO: 1622419 - RNA, 17 nt, Human
cuuuucuuucagccaag

SEQ ID NO: 1622420 - RNA, 13 nt, Human
cuuuucuuuucuu

SEQ ID NO: 1622421 - RNA, 22 nt, Human
cuuuuuaauauugauaugcuua

SEQ ID NO: 1622422 - RNA, 16 nt, Human
cuuuuuuauacauaaa

SEQ ID NO: 1622423 - RNA, 17 nt, Human
cuuuuuuauacauaaac

SEQ ID NO: 1622424 - RNA, 15 nt, Human
cuuuuuuauacauaa

SEQ ID NO: 1622425 - RNA, 18 nt, Human
cuuuuuuauacauaaaca

SEQ ID NO: 1622426 - RNA, 19 nt, Human
cuuuuuuaucaugugaaau

SEQ ID NO: 1622427 - RNA, 16 nt, Human
gaaaaagaaaaaauau

SEQ ID NO: 1622428 - RNA, 11 nt, Human
gaaaaagaaaa

SEQ ID NO: 1622429 - RNA, 15 nt, Human
cuuuuuucacuacau

SEQ ID NO: 1622430 - RNA, 19 nt, Human
cuuuccucaaaacuucaga

SEQ ID NO: 1622431 - RNA, 21 nt, Human
cuuuccgguguuuaagacauu

SEQ ID NO: 1622432 - RNA, 15 nt, Human
cuuuccaggaaggcu

SEQ ID NO: 1622433 - RNA, 21 nt, Human
cuuuccccaugucucgacuca

SEQ ID NO: 1622434 - RNA, 20 nt, Human
cuuuccccaugucucgacuc

SEQ ID NO: 1622435 - RNA, 15 nt, Human
cuuuccccaugucuc

SEQ ID NO: 1622436 - RNA, 14 nt, Human
cuuuccaggaaggc

SEQ ID NO: 1622437 - RNA, 16 nt, Human
cuuuccaaaguacacu

SEQ ID NO: 1622438 - RNA, 16 nt, Human
cuuuccaaaugcccag

SEQ ID NO: 1622439 - RNA, 22 nt, Human
cuuuccaaaguacacuguuuca

SEQ ID NO: 1622440 - RNA, 21 nt, Human
cuuguggacacagcucuucuc

SEQ ID NO: 1622441 - RNA, 20 nt, Human
cuuguguguuuauugucaaa

SEQ ID NO: 1622442 - RNA, 19 nt, Human
cuuuauuuuguguuuagga

SEQ ID NO: 1622443 - RNA, 15 nt, Human
cuuugcagacaggca

SEQ ID NO: 1622444 - RNA, 14 nt, Human
cuuugcagacaggc

SEQ ID NO: 1622445 - RNA, 23 nt, Human
cuuuggaaagaguaggaagacuu

SEQ ID NO: 1622446 - RNA, 19 nt, Human
cuuuggaaagaguaggaag

SEQ ID NO: 1622447 - RNA, 16 nt, Human
cuuugcagacaggcaa

SEQ ID NO: 1622448 - RNA, 21 nt, Human
cuuuccugaggcugggcuccc

SEQ ID NO: 1622449 - RNA, 20 nt, Human
cuuuccugaggcugggcucc

SEQ ID NO: 1622450 - RNA, 16 nt, Human
cuuuccugaggcuggg

SEQ ID NO: 1622451 - RNA, 17 nt, Human
cuuuccugaggcugggc

SEQ ID NO: 1622452 - RNA, 23 nt, Human
cuugcaucaauuuuucuuauuuc

SEQ ID NO: 1622453 - RNA, 21 nt, Human
cuugcaugaggcuaguguggu

SEQ ID NO: 1622454 - RNA, 21 nt, Human
cuugcaugguuuagaaagcuu

SEQ ID NO: 1622455 - RNA, 18 nt, Human
cuugcagacucuacagag

SEQ ID NO: 1622456 - RNA, 20 nt, Human
cuugcagacucuacagaggc

SEQ ID NO: 1622457 - RNA, 14 nt, Human
cuugcaauggcagc

SEQ ID NO: 1622458 - RNA, 22 nt, Human
cuugcaaaguaucccuacugua

SEQ ID NO: 1622459 - RNA, 21 nt, Human
cuugaccauucuccaccugcc

SEQ ID NO: 1622460 - RNA, 14 nt, Human
cuugagagggugga

SEQ ID NO: 1622461 - RNA, 20 nt, Human
cuugaccauucuccaccugc

SEQ ID NO: 1622462 - RNA, 17 nt, Human
cuugaccauucuccacc

SEQ ID NO: 1622463 - RNA, 19 nt, Human
cuugagccuugaacuuuga

SEQ ID NO: 1622464 - RNA, 20 nt, Human
cuugagccuugaacuuugac

SEQ ID NO: 1622465 - RNA, 22 nt, Human
cuugagccuugaacuuugaccu

SEQ ID NO: 1622466 - RNA, 13 nt, Human
cuugagcucagga

SEQ ID NO: 1622467 - RNA, 20 nt, Human
cuugaacccgggaggcagag

SEQ ID NO: 1622468 - RNA, 19 nt, Human
cuugaacccgggaggcaga

SEQ ID NO: 1622469 - RNA, 20 nt, Human
cuugaaauuugaauuuugug

SEQ ID NO: 1622470 - RNA, 19 nt, Human
cuugaaauuugaauuuugu

SEQ ID NO: 1622471 - RNA, 14 nt, Human
cuugaacccgggag

SEQ ID NO: 1622472 - RNA, 18 nt, Human
cuugaacuccuggccuca

SEQ ID NO: 1622473 - RNA, 17 nt, Human
cuugaacuccuggccuc

SEQ ID NO: 1622474 - RNA, 15 nt, Human
cuugaacuccuggcc

SEQ ID NO: 1622475 - RNA, 14 nt, Human
cuugaacuccuggc

SEQ ID NO: 1622476 - RNA, 20 nt, Human
cuugaacuggguacuugugg

SEQ ID NO: 1622477 - RNA, 18 nt, Human
cuugaacuggguacuugu

SEQ ID NO: 1622478 - RNA, 15 nt, Human
cuugaacuuugaccu

SEQ ID NO: 1622479 - RNA, 16 nt, Human
cuugaacuggguacuu

SEQ ID NO: 1622480 - RNA, 19 nt, Human
cuugaacuccuggccucaa

SEQ ID NO: 1622481 - RNA, 19 nt, Human
cuucuuuccacagaagcuc

SEQ ID NO: 1622482 - RNA, 13 nt, Human
cuucuuuccacag

SEQ ID NO: 1622483 - RNA, 19 nt, Human
cuugaaauauaggaacuua

SEQ ID NO: 1622484 - RNA, 17 nt, Human
cuucuuuuuuugugaug

SEQ ID NO: 1622485 - RNA, 17 nt, Human
cuugccaaauauaaaua

SEQ ID NO: 1622486 - RNA, 13 nt, Human
cuugcuugcuuuu

SEQ ID NO: 1622487 - RNA, 15 nt, Human
cuugcuuuuaaaauc

SEQ ID NO: 1622488 - RNA, 13 nt, Human
cuuggcugcaggg

SEQ ID NO: 1622489 - RNA, 12 nt, Human
cuuggcugcagg

SEQ ID NO: 1622490 - RNA, 14 nt, Human
cuuggauugucccc

SEQ ID NO: 1622491 - RNA, 13 nt, Human
cuuggauuguccc

SEQ ID NO: 1622492 - RNA, 23 nt, Human
cuuggcucaaguccucuuuucug

SEQ ID NO: 1622493 - RNA, 18 nt, Human
cuuguaaaggaauuuaaa

SEQ ID NO: 1622494 - RNA, 18 nt, Human
cuuguaaaaauuaaaagu

SEQ ID NO: 1622495 - RNA, 15 nt, Human
cuuggggccuaugca

SEQ ID NO: 1622496 - RNA, 19 nt, Human
cuuggggaccagagcugcc

SEQ ID NO: 1622497 - RNA, 18 nt, Human
cuuggggaccagagcugc

SEQ ID NO: 1622498 - RNA, 17 nt, Human
cuuggggaccagagcug

SEQ ID NO: 1622499 - RNA, 14 nt, Human
cuuggcugcaggga

SEQ ID NO: 1622500 - RNA, 18 nt, Human
cuuguggacacagcucuu

SEQ ID NO: 1622501 - RNA, 17 nt, Human
cuuguggacacagcucu

SEQ ID NO: 1622502 - RNA, 18 nt, Human
cuuguauuauguguguuu

SEQ ID NO: 1622503 - RNA, 13 nt, Human
cuuguauuaugug

SEQ ID NO: 1622504 - RNA, 21 nt, Human
cuuguaugaaagauggcugug

SEQ ID NO: 1622505 - RNA, 23 nt, Human
gaagagcuguucacagccagacu

SEQ ID NO: 1622506 - RNA, 20 nt, Human
gaagagcuguucacagccag

SEQ ID NO: 1622507 - RNA, 15 nt, Human
gaagagcuguucaca

SEQ ID NO: 1622508 - RNA, 13 nt, Human
gaagagcuguuca

SEQ ID NO: 1622509 - RNA, 19 nt, Human
gaagacuucaucccucugg

SEQ ID NO: 1622510 - RNA, 17 nt, Human
gaagacuucaucccucu

SEQ ID NO: 1622511 - RNA, 12 nt, Human
gaagagccuugc

SEQ ID NO: 1622512 - RNA, 16 nt, Human
gaagacuucaucccuc

SEQ ID NO: 1622513 - RNA, 15 nt, Human
gaagacuucaucccu

SEQ ID NO: 1622514 - RNA, 17 nt, Human
gaagauguagaggagaa

SEQ ID NO: 1622515 - RNA, 23 nt, Human
gaagauuuugaaauuuuuauuaa

SEQ ID NO: 1622516 - RNA, 22 nt, Human
gaagauugagauguguucacaa

SEQ ID NO: 1622517 - RNA, 17 nt, Human
gaagauugagauguguu

SEQ ID NO: 1622518 - RNA, 22 nt, Human
gaacuuguaaaggaauuuaaaa

SEQ ID NO: 1622519 - RNA, 17 nt, Human
gaacuugggccacugug

SEQ ID NO: 1622520 - RNA, 18 nt, Human
gaacuuggcgcugccccu

SEQ ID NO: 1622521 - RNA, 15 nt, Human
gaacuuguuuucugg

SEQ ID NO: 1622522 - RNA, 12 nt, Human
gaacuugguucc

SEQ ID NO: 1622523 - RNA, 17 nt, Human
gaacuuuccaggaaggc

SEQ ID NO: 1622524 - RNA, 16 nt, Human
gaacuuugaccucugc

SEQ ID NO: 1622525 - RNA, 22 nt, Human
gaacuuugaccucugcagcaau

SEQ ID NO: 1622526 - RNA, 16 nt, Human
gaacucccuuucaaca

SEQ ID NO: 1622527 - RNA, 15 nt, Human
gaacuccuaaaucaa

SEQ ID NO: 1622528 - RNA, 13 nt, Human
gaacuccugaccu

SEQ ID NO: 1622529 - RNA, 16 nt, Human
gaacuccuaaaucaag

SEQ ID NO: 1622530 - RNA, 15 nt, Human
gaaccacaagacugc

SEQ ID NO: 1622531 - RNA, 14 nt, Human
gaaccacaagacug

SEQ ID NO: 1622532 - RNA, 18 nt, Human
gaaccacaucuugcucug

SEQ ID NO: 1622533 - RNA, 20 nt, Human
gaaccacaucuugcucugcu

SEQ ID NO: 1622534 - RNA, 14 nt, Human
gaacuuaaauaaug

SEQ ID NO: 1622535 - RNA, 17 nt, Human
gaacuuaaauaauguga

SEQ ID NO: 1622536 - RNA, 22 nt, Human
gaacuugaaauuugaauuuugu

SEQ ID NO: 1622537 - RNA, 15 nt, Human
gaacuugaaauuuga

SEQ ID NO: 1622538 - RNA, 13 nt, Human
gaacuugaaauuu

SEQ ID NO: 1622539 - RNA, 12 nt, Human
gaacuugaaauu

SEQ ID NO: 1622540 - RNA, 23 nt, Human
gaaguccaagcauuuagauguau

SEQ ID NO: 1622541 - RNA, 20 nt, Human
gaagucacauuccugaacag

SEQ ID NO: 1622542 - RNA, 16 nt, Human
gaagucacauuccuga

SEQ ID NO: 1622543 - RNA, 21 nt, Human
gaagucacauuccugaacagg

SEQ ID NO: 1622544 - RNA, 15 nt, Human
gaagucacugcacag

SEQ ID NO: 1622545 - RNA, 14 nt, Human
gaagucagaucugc

SEQ ID NO: 1622546 - RNA, 23 nt, Human
gaagucagaucugccuaaggacu

SEQ ID NO: 1622547 - RNA, 22 nt, Human
gaagucagaucugccuaaggac

SEQ ID NO: 1622548 - RNA, 21 nt, Human
gaaggugaggagcuugaaacc

SEQ ID NO: 1622549 - RNA, 19 nt, Human
gaaguaauaugcacacauu

SEQ ID NO: 1622550 - RNA, 20 nt, Human
gaaguaauaugcacacauuu

SEQ ID NO: 1622551 - RNA, 13 nt, Human
gaagucacacagu

SEQ ID NO: 1622552 - RNA, 21 nt, Human
gaaguaauaugcacacauuuu

SEQ ID NO: 1622553 - RNA, 15 nt, Human
gaagggggcugggac

SEQ ID NO: 1622554 - RNA, 13 nt, Human
gaagggggcuggg

SEQ ID NO: 1622555 - RNA, 18 nt, Human
gaaggcagggagggccug

SEQ ID NO: 1622556 - RNA, 23 nt, Human
gaaggcagggagggccugggccc

SEQ ID NO: 1622557 - RNA, 22 nt, Human
gaaggcagggagggccugggcc

SEQ ID NO: 1622558 - RNA, 20 nt, Human
gaaggcagggagggccuggg

SEQ ID NO: 1622559 - RNA, 21 nt, Human
gaagccgcuggggccaguugg

SEQ ID NO: 1622560 - RNA, 20 nt, Human
gaagccgcuggggccaguug

SEQ ID NO: 1622561 - RNA, 18 nt, Human
gaagccgcuggggccagu

SEQ ID NO: 1622562 - RNA, 14 nt, Human
gaagccgcuggggc

SEQ ID NO: 1622563 - RNA, 20 nt, Human
gaaggaaacccagcucuggu

SEQ ID NO: 1622564 - RNA, 19 nt, Human
gaaggaaacccagcucugg

SEQ ID NO: 1622565 - RNA, 21 nt, Human
gaaggacauugcggacagcca

SEQ ID NO: 1622566 - RNA, 20 nt, Human
gaaggacauugcggacagcc

SEQ ID NO: 1622567 - RNA, 19 nt, Human
gaaggacauugcggacagc

SEQ ID NO: 1622568 - RNA, 22 nt, Human
gaaggaauaaauugcuccuuga

SEQ ID NO: 1622569 - RNA, 23 nt, Human
gaaggacccggaggggccuggca

SEQ ID NO: 1622570 - RNA, 22 nt, Human
gaaggacccggaggggccuggc

SEQ ID NO: 1622571 - RNA, 15 nt, Human
gaaggaacguccccu

SEQ ID NO: 1622572 - RNA, 22 nt, Human
gaaggaaacccagcucuggucc

SEQ ID NO: 1622573 - RNA, 21 nt, Human
gaaggaaacccagcucugguc

SEQ ID NO: 1622574 - RNA, 19 nt, Human
gaaggaagacuucaucccu

SEQ ID NO: 1622575 - RNA, 13 nt, Human
gaaaguucaugcu

SEQ ID NO: 1622576 - RNA, 16 nt, Human
gaaaguuuacaggaaa

SEQ ID NO: 1622577 - RNA, 14 nt, Human
gaaaguuuacagga

SEQ ID NO: 1622578 - RNA, 16 nt, Human
gaaaggaaagaggcuc

SEQ ID NO: 1622579 - RNA, 11 nt, Human
gaaaggaaaga

SEQ ID NO: 1622580 - RNA, 14 nt, Human
gaaagcagaacagu

SEQ ID NO: 1622581 - RNA, 13 nt, Human
gaaagcagaacag

SEQ ID NO: 1622582 - RNA, 23 nt, Human
gaaagauggcugugccucugccu

SEQ ID NO: 1622583 - RNA, 16 nt, Human
gaaagaucaaaagguu

SEQ ID NO: 1622584 - RNA, 22 nt, Human
gaaagauggcugugccucugcc

SEQ ID NO: 1622585 - RNA, 23 nt, Human
gaaagacuauucaaacagucuca

SEQ ID NO: 1622586 - RNA, 22 nt, Human
gaaagacuauucaaacagucuc

SEQ ID NO: 1622587 - RNA, 19 nt, Human
gaaagacuauucaaacagu

SEQ ID NO: 1622588 - RNA, 17 nt, Human
gaaagacuguacaaagu

SEQ ID NO: 1622589 - RNA, 15 nt, Human
gaaacugccagcaac

SEQ ID NO: 1622590 - RNA, 13 nt, Human
gaaacugccagca

SEQ ID NO: 1622591 - RNA, 20 nt, Human
gaaacuaggugcauauuuau

SEQ ID NO: 1622592 - RNA, 16 nt, Human
gaaacggaugauuucu

SEQ ID NO: 1622593 - RNA, 16 nt, Human
gaaaaaugagccuggc

SEQ ID NO: 1622594 - RNA, 22 nt, Human
gaacagacuggaagcacagcuu

SEQ ID NO: 1622595 - RNA, 17 nt, Human
gaacaggauauucucac

SEQ ID NO: 1622596 - RNA, 24 nt, Human
gaacaguuaccucugccucagaaa

SEQ ID NO: 1622597 - RNA, 20 nt, Human
gaacaguuguguuugaagca

SEQ ID NO: 1622598 - RNA, 22 nt, Human
gaacaguuguguuugaagcaca

SEQ ID NO: 1622599 - RNA, 23 nt, Human
gaaauuaguacuccccuccuuga

SEQ ID NO: 1622600 - RNA, 20 nt, Human
gaacagacuggaagcacagc

SEQ ID NO: 1622601 - RNA, 17 nt, Human
gaacacuccuucacaga

SEQ ID NO: 1622602 - RNA, 16 nt, Human
gaacacuccuucacag

SEQ ID NO: 1622603 - RNA, 15 nt, Human
gaacacuccuucaca

SEQ ID NO: 1622604 - RNA, 21 nt, Human
gaaauuuccugggagcuuuug

SEQ ID NO: 1622605 - RNA, 13 nt, Human
gaaauuugaauuu

SEQ ID NO: 1622606 - RNA, 24 nt, Human
gaaauuugaauuuuguguuagaga

SEQ ID NO: 1622607 - RNA, 16 nt, Human
gaaauuugaauuuugu

SEQ ID NO: 1622608 - RNA, 13 nt, Human
gaaauauuuauuu

SEQ ID NO: 1622609 - RNA, 20 nt, Human
gaaauaucugaaaauguaug

SEQ ID NO: 1622610 - RNA, 19 nt, Human
gaaauaucugaaaauguau

SEQ ID NO: 1622611 - RNA, 18 nt, Human
gaaauaucugaaaaugua

SEQ ID NO: 1622612 - RNA, 16 nt, Human
gaaauauuuauuuuaa

SEQ ID NO: 1622613 - RNA, 15 nt, Human
gaaauauuuauuuua

SEQ ID NO: 1622614 - RNA, 21 nt, Human
gaaauaaacgucuuaaauauu

SEQ ID NO: 1622615 - RNA, 18 nt, Human
gaaauaaacgucuuaaau

SEQ ID NO: 1622616 - RNA, 17 nt, Human
gaaauaaacgucuuaaa

SEQ ID NO: 1622617 - RNA, 16 nt, Human
gaaauaaacgucuuaa

SEQ ID NO: 1622618 - RNA, 14 nt, Human
gaaauaaacgucuu

SEQ ID NO: 1622619 - RNA, 19 nt, Human
gaaaugggcagagcagaga

SEQ ID NO: 1622620 - RNA, 17 nt, Human
gaaaugggcagagcaga

SEQ ID NO: 1622621 - RNA, 17 nt, Human
gaaauguacagcaagga

SEQ ID NO: 1622622 - RNA, 15 nt, Human
gaaaugggcagagca

SEQ ID NO: 1622623 - RNA, 16 nt, Human
gaaaugggcagagcag

SEQ ID NO: 1622624 - RNA, 18 nt, Human
gaaaugaggucagagccu

SEQ ID NO: 1622625 - RNA, 11 nt, Human
gaaaugagcug

SEQ ID NO: 1622626 - RNA, 18 nt, Human
gagcugcccucuccuggg

SEQ ID NO: 1622627 - RNA, 19 nt, Human
gagcugcccucuccugggc

SEQ ID NO: 1622628 - RNA, 21 nt, Human
gagcugcccucuccugggcag

SEQ ID NO: 1622629 - RNA, 23 nt, Human
gagcugcccucuccugggcagcu

SEQ ID NO: 1622630 - RNA, 22 nt, Human
gagcuuucugcuaucaaagagg

SEQ ID NO: 1622631 - RNA, 20 nt, Human
gagcuuugaaaauucagugg

SEQ ID NO: 1622632 - RNA, 17 nt, Human
gaggaaagcaaaggaga

SEQ ID NO: 1622633 - RNA, 16 nt, Human
gaggaaagcaaaggag

SEQ ID NO: 1622634 - RNA, 14 nt, Human
gagcuuuuguagaa

SEQ ID NO: 1622635 - RNA, 23 nt, Human
gaggaaaaccaagccguggcuuc

SEQ ID NO: 1622636 - RNA, 21 nt, Human
gaggaaaaccaagccguggcu

SEQ ID NO: 1622637 - RNA, 20 nt, Human
gaggaaaaccaagccguggc

SEQ ID NO: 1622638 - RNA, 16 nt, Human
gaggaacaaggcaagg

SEQ ID NO: 1622639 - RNA, 14 nt, Human
gaggaacaaggcaa

SEQ ID NO: 1622640 - RNA, 17 nt, Human
gaggaagccgcuggggc

SEQ ID NO: 1622641 - RNA, 14 nt, Human
gaggaagccgcugg

SEQ ID NO: 1622642 - RNA, 18 nt, Human
gaggaagccgcuggggcc

SEQ ID NO: 1622643 - RNA, 19 nt, Human
gaggaagccugauuaaaga

SEQ ID NO: 1622644 - RNA, 18 nt, Human
gaggaagccugauuaaag

SEQ ID NO: 1622645 - RNA, 13 nt, Human
gaggaagccgcug

SEQ ID NO: 1622646 - RNA, 17 nt, Human
gaggaagagaaaaaaua

SEQ ID NO: 1622647 - RNA, 16 nt, Human
gagcucgugggacagu

SEQ ID NO: 1622648 - RNA, 15 nt, Human
gagcugaguggggga

SEQ ID NO: 1622649 - RNA, 17 nt, Human
gagcuagcagcagggag

SEQ ID NO: 1622650 - RNA, 15 nt, Human
gagcuagcagcaggg

SEQ ID NO: 1622651 - RNA, 15 nt, Human
gagccugcaguuauu

SEQ ID NO: 1622652 - RNA, 20 nt, Human
gagccgagaucacgccacug

SEQ ID NO: 1622653 - RNA, 19 nt, Human
gagccgagaucacgccacu

SEQ ID NO: 1622654 - RNA, 11 nt, Human
gagcccacgcc

SEQ ID NO: 1622655 - RNA, 21 nt, Human
gagcccacuguacuugcucuu

SEQ ID NO: 1622656 - RNA, 18 nt, Human
gagcccacuguacuugcu

SEQ ID NO: 1622657 - RNA, 22 nt, Human
gagccgagaucacgccacugca

SEQ ID NO: 1622658 - RNA, 21 nt, Human
gagccgagaucacgccacugc

SEQ ID NO: 1622659 - RNA, 15 nt, Human
gagccucagcauccu

SEQ ID NO: 1622660 - RNA, 14 nt, Human
gagccucagcaucc

SEQ ID NO: 1622661 - RNA, 17 nt, Human
gagccucagcauccugg

SEQ ID NO: 1622662 - RNA, 19 nt, Human
gagccucagucucccuccc

SEQ ID NO: 1622663 - RNA, 13 nt, Human
gagccucagcauc

SEQ ID NO: 1622664 - RNA, 13 nt, Human
gagccuccugccc

SEQ ID NO: 1622665 - RNA, 12 nt, Human
gagccugcaguu

SEQ ID NO: 1622666 - RNA, 16 nt, Human
gagcagagaccauccc

SEQ ID NO: 1622667 - RNA, 18 nt, Human
gagcagagaccaucccug

SEQ ID NO: 1622668 - RNA, 17 nt, Human
gagcagagaccaucccu

SEQ ID NO: 1622669 - RNA, 21 nt, Human
gagauagccaaggccaaagga

SEQ ID NO: 1622670 - RNA, 20 nt, Human
gagauagccaaggccaaagg

SEQ ID NO: 1622671 - RNA, 21 nt, Human
gagcagagaccaucccugaag

SEQ ID NO: 1622672 - RNA, 19 nt, Human
gagcagagaccaucccuga

SEQ ID NO: 1622673 - RNA, 23 nt, Human
gagcagagaccaucccugaaggc

SEQ ID NO: 1622674 - RNA, 22 nt, Human
gagcagccacauuccugaugcu

SEQ ID NO: 1622675 - RNA, 21 nt, Human
gagcagccacauuccugaugc

SEQ ID NO: 1622676 - RNA, 19 nt, Human
gagccagauuucacucucc

SEQ ID NO: 1622677 - RNA, 18 nt, Human
gagccagauuucacucuc

SEQ ID NO: 1622678 - RNA, 15 nt, Human
gagccagauuucacu

SEQ ID NO: 1622679 - RNA, 20 nt, Human
gagccacugcaccgggccac

SEQ ID NO: 1622680 - RNA, 19 nt, Human
gagccacugcaccgggcca

SEQ ID NO: 1622681 - RNA, 18 nt, Human
gagccacugcaccgggcc

SEQ ID NO: 1622682 - RNA, 17 nt, Human
gagcccaccuuggcuca

SEQ ID NO: 1622683 - RNA, 15 nt, Human
gagcccaccuuggcu

SEQ ID NO: 1622684 - RNA, 13 nt, Human
gagcccaccuugg

SEQ ID NO: 1622685 - RNA, 20 nt, Human
gagccagauuucacucuccu

SEQ ID NO: 1622686 - RNA, 13 nt, Human
gagacagcucugc

SEQ ID NO: 1622687 - RNA, 24 nt, Human
gagacagcccgggcucugccuccc

SEQ ID NO: 1622688 - RNA, 18 nt, Human
gagacagcucugcauacu

SEQ ID NO: 1622689 - RNA, 15 nt, Human
gagacagcucugcau

SEQ ID NO: 1622690 - RNA, 23 nt, Human
gagacagcccgggcucugccucc

SEQ ID NO: 1622691 - RNA, 22 nt, Human
gagacagcccgggcucugccuc

SEQ ID NO: 1622692 - RNA, 21 nt, Human
gagacagcccgggcucugccu

SEQ ID NO: 1622693 - RNA, 20 nt, Human
gagacagcccgggcucugcc

SEQ ID NO: 1622694 - RNA, 19 nt, Human
gagacagcccgggcucugc

SEQ ID NO: 1622695 - RNA, 18 nt, Human
gagacagcccgggcucug

SEQ ID NO: 1622696 - RNA, 17 nt, Human
gagacagcccgggcucu

SEQ ID NO: 1622697 - RNA, 14 nt, Human
gagacagcccgggc

SEQ ID NO: 1622698 - RNA, 14 nt, Human
gagacucugucuca

SEQ ID NO: 1622699 - RNA, 22 nt, Human
gagacugucucaagagggcacu

SEQ ID NO: 1622700 - RNA, 13 nt, Human
gagacuuguauga

SEQ ID NO: 1622701 - RNA, 23 nt, Human
gagacugucucaagagggcacug

SEQ ID NO: 1622702 - RNA, 18 nt, Human
gagacucgcgacaaugca

SEQ ID NO: 1622703 - RNA, 16 nt, Human
gagacucgcgacaaug

SEQ ID NO: 1622704 - RNA, 12 nt, Human
gagaccaucccu

SEQ ID NO: 1622705 - RNA, 15 nt, Human
gagagugaacaaauu

SEQ ID NO: 1622706 - RNA, 19 nt, Human
gagagugaacaaauuuaca

SEQ ID NO: 1622707 - RNA, 13 nt, Human
gagaguggcuccu

SEQ ID NO: 1622708 - RNA, 17 nt, Human
gagauacagaauuuuau

SEQ ID NO: 1622709 - RNA, 14 nt, Human
gagagccuuccagg

SEQ ID NO: 1622710 - RNA, 13 nt, Human
gagagccuuccag

SEQ ID NO: 1622711 - RNA, 18 nt, Human
gagaggggaacagacugg

SEQ ID NO: 1622712 - RNA, 13 nt, Human
gagaggggaacag

SEQ ID NO: 1622713 - RNA, 21 nt, Human
gagagggugggagugggccca

SEQ ID NO: 1622714 - RNA, 19 nt, Human
gagagacacacugaagaag

SEQ ID NO: 1622715 - RNA, 17 nt, Human
gagagaagagaaugcac

SEQ ID NO: 1622716 - RNA, 18 nt, Human
gagaaagacuauucaaac

SEQ ID NO: 1622717 - RNA, 17 nt, Human
gagaaagacuauucaaa

SEQ ID NO: 1622718 - RNA, 15 nt, Human
gagaaagacuauuca

SEQ ID NO: 1622719 - RNA, 13 nt, Human
gagaaagacuauu

SEQ ID NO: 1622720 - RNA, 16 nt, Human
gagaaacagccugugu

SEQ ID NO: 1622721 - RNA, 23 nt, Human
gagaaaguacuucuccacccugc

SEQ ID NO: 1622722 - RNA, 12 nt, Human
gagaaaugaaaa

SEQ ID NO: 1622723 - RNA, 18 nt, Human
gacucgcgacaaugcaaa

SEQ ID NO: 1622724 - RNA, 17 nt, Human
gacuccugcaggcagcc

SEQ ID NO: 1622725 - RNA, 19 nt, Human
gacucgcgacaaugcaaac

SEQ ID NO: 1622726 - RNA, 16 nt, Human
gacuuggaagcuccgc

SEQ ID NO: 1622727 - RNA, 15 nt, Human
gacuuggaagcuccg

SEQ ID NO: 1622728 - RNA, 14 nt, Human
gacuuggaagcucc

SEQ ID NO: 1622729 - RNA, 21 nt, Human
gagaaaauggacguguuauga

SEQ ID NO: 1622730 - RNA, 19 nt, Human
gacuugugacgguguaccu

SEQ ID NO: 1622731 - RNA, 12 nt, Human
gacuuguuagau

SEQ ID NO: 1622732 - RNA, 18 nt, Human
gagacacacugaagaagc

SEQ ID NO: 1622733 - RNA, 17 nt, Human
gagacacaagccuucgg

SEQ ID NO: 1622734 - RNA, 15 nt, Human
gagacacaagccuuc

SEQ ID NO: 1622735 - RNA, 19 nt, Human
gagacagaguuuucacucu

SEQ ID NO: 1622736 - RNA, 12 nt, Human
gagacagcccgg

SEQ ID NO: 1622737 - RNA, 16 nt, Human
gagacagccaacuaug

SEQ ID NO: 1622738 - RNA, 22 nt, Human
gagaagagcuguucacagccag

SEQ ID NO: 1622739 - RNA, 15 nt, Human
gagaagagcuguuca

SEQ ID NO: 1622740 - RNA, 16 nt, Human
gagaagaacugaaauc

SEQ ID NO: 1622741 - RNA, 14 nt, Human
gagaagaacugaaa

SEQ ID NO: 1622742 - RNA, 13 nt, Human
gagaagaacugaa

SEQ ID NO: 1622743 - RNA, 21 nt, Human
gagaaugcacaaacagaggcc

SEQ ID NO: 1622744 - RNA, 20 nt, Human
gagaaugcacaaacagaggc

SEQ ID NO: 1622745 - RNA, 22 nt, Human
gagaaugcacaaacagaggccg

SEQ ID NO: 1622746 - RNA, 23 nt, Human
gaccugauuucugagcauuuaau

SEQ ID NO: 1622747 - RNA, 15 nt, Human
gaccugccucggccu

SEQ ID NO: 1622748 - RNA, 21 nt, Human
gaccugccccuccucucugcc

SEQ ID NO: 1622749 - RNA, 15 nt, Human
gaccugaggcccuuc

SEQ ID NO: 1622750 - RNA, 13 nt, Human
gaccucaggccug

SEQ ID NO: 1622751 - RNA, 12 nt, Human
gaccucaggccu

SEQ ID NO: 1622752 - RNA, 11 nt, Human
gaccucaggcc

SEQ ID NO: 1622753 - RNA, 21 nt, Human
gaccugaggcccuucucucca

SEQ ID NO: 1622754 - RNA, 18 nt, Human
gaccugaggcccuucucu

SEQ ID NO: 1622755 - RNA, 17 nt, Human
gacccugcccugugggc

SEQ ID NO: 1622756 - RNA, 15 nt, Human
gaccgugaggccaga

SEQ ID NO: 1622757 - RNA, 14 nt, Human
gaccgugaggccag

SEQ ID NO: 1622758 - RNA, 17 nt, Human
gacccaugcugcccugu

SEQ ID NO: 1622759 - RNA, 16 nt, Human
gacccaugcugcccug

SEQ ID NO: 1622760 - RNA, 15 nt, Human
gacccaugcugcccu

SEQ ID NO: 1622761 - RNA, 14 nt, Human
gacccaugcugccc

SEQ ID NO: 1622762 - RNA, 12 nt, Human
gacccacugcuu

SEQ ID NO: 1622763 - RNA, 11 nt, Human
gacccacugcu

SEQ ID NO: 1622764 - RNA, 13 nt, Human
gaccccuccaugu

SEQ ID NO: 1622765 - RNA, 23 nt, Human
gaccccucauagcccucacccug

SEQ ID NO: 1622766 - RNA, 22 nt, Human
gaccccucauagcccucacccu

SEQ ID NO: 1622767 - RNA, 23 nt, Human
gacccugucucaaaaaaagaaaa

SEQ ID NO: 1622768 - RNA, 16 nt, Human
gacccugcccuguggg

SEQ ID NO: 1622769 - RNA, 15 nt, Human
gacccugcccugugg

SEQ ID NO: 1622770 - RNA, 13 nt, Human
gacccugcccugu

SEQ ID NO: 1622771 - RNA, 21 nt, Human
gacccugaggcccagagggcc

SEQ ID NO: 1622772 - RNA, 20 nt, Human
gacccugaggcccagagggc

SEQ ID NO: 1622773 - RNA, 19 nt, Human
gacccugaggcccagaggg

SEQ ID NO: 1622774 - RNA, 16 nt, Human
gacuccugcaggcagc

SEQ ID NO: 1622775 - RNA, 15 nt, Human
gacuccugcaggcag

SEQ ID NO: 1622776 - RNA, 14 nt, Human
gacuccugcaggca

SEQ ID NO: 1622777 - RNA, 15 nt, Human
gacucagguugucug

SEQ ID NO: 1622778 - RNA, 15 nt, Human
gacucaguggggagg

SEQ ID NO: 1622779 - RNA, 22 nt, Human
gacguguuaugacuccagaauu

SEQ ID NO: 1622780 - RNA, 17 nt, Human
gacuacucccccaggug

SEQ ID NO: 1622781 - RNA, 12 nt, Human
gacuacaggcac

SEQ ID NO: 1622782 - RNA, 21 nt, Human
gaccuuucaauaggaaaaacu

SEQ ID NO: 1622783 - RNA, 22 nt, Human
gaccuuuaagagaaaugagcug

SEQ ID NO: 1622784 - RNA, 23 nt, Human
gaccuugaacuggguacuugugg

SEQ ID NO: 1622785 - RNA, 19 nt, Human
gaccugccucggccuccca

SEQ ID NO: 1622786 - RNA, 20 nt, Human
gacguguuaugacuccagaa

SEQ ID NO: 1622787 - RNA, 17 nt, Human
gacguguuaugacucca

SEQ ID NO: 1622788 - RNA, 18 nt, Human
gacggagucccaccuugg

SEQ ID NO: 1622789 - RNA, 21 nt, Human
gacggagucccaccuuggcug

SEQ ID NO: 1622790 - RNA, 23 nt, Human
gacggagucccaccuuggcugca

SEQ ID NO: 1622791 - RNA, 17 nt, Human
gacgggguuucaccaug

SEQ ID NO: 1622792 - RNA, 22 nt, Human
gacaugggacauuugcucaugg

SEQ ID NO: 1622793 - RNA, 17 nt, Human
gacaugggacauuugcu

SEQ ID NO: 1622794 - RNA, 17 nt, Human
gacaugucuuuucuugc

SEQ ID NO: 1622795 - RNA, 21 nt, Human
gacaugucuuuucuugcauga

SEQ ID NO: 1622796 - RNA, 20 nt, Human
gaccaaaaaccaguauugua

SEQ ID NO: 1622797 - RNA, 19 nt, Human
gaccaaaaaccaguauugu

SEQ ID NO: 1622798 - RNA, 13 nt, Human
gaccaaaaaccag

SEQ ID NO: 1622799 - RNA, 14 nt, Human
gacaucaacagaua

SEQ ID NO: 1622800 - RNA, 23 nt, Human
gacauacuaaccagcagaaaugc

SEQ ID NO: 1622801 - RNA, 16 nt, Human
gacauagucuggcugu

SEQ ID NO: 1622802 - RNA, 15 nt, Human
gacauacuaaccagc

SEQ ID NO: 1622803 - RNA, 16 nt, Human
gacauacuaaccagca

SEQ ID NO: 1622804 - RNA, 20 nt, Human
gacaggcauguucucugagg

SEQ ID NO: 1622805 - RNA, 16 nt, Human
gacagacacaggcccg

SEQ ID NO: 1622806 - RNA, 15 nt, Human
gacagacacaggccc

SEQ ID NO: 1622807 - RNA, 23 nt, Human
gacagaucucugcuuuggaaauc

SEQ ID NO: 1622808 - RNA, 21 nt, Human
gacagaucucugcuuuggaaa

SEQ ID NO: 1622809 - RNA, 19 nt, Human
gacagaucucugcuuugga

SEQ ID NO: 1622810 - RNA, 21 nt, Human
gacacuaaccacgcuggaccu

SEQ ID NO: 1622811 - RNA, 20 nt, Human
gacacuaaccacgcuggacc

SEQ ID NO: 1622812 - RNA, 14 nt, Human
gacagacacaggcc

SEQ ID NO: 1622813 - RNA, 13 nt, Human
gacagcugccugg

SEQ ID NO: 1622814 - RNA, 12 nt, Human
gacagcugccug

SEQ ID NO: 1622815 - RNA, 13 nt, Human
gacagccacggcc

SEQ ID NO: 1622816 - RNA, 22 nt, Human
gacagccaacuauggccugugg

SEQ ID NO: 1622817 - RNA, 19 nt, Human
gacagccaacuauggccug

SEQ ID NO: 1622818 - RNA, 15 nt, Human
gacagcugccuggga

SEQ ID NO: 1622819 - RNA, 14 nt, Human
gacagcugccuggg

SEQ ID NO: 1622820 - RNA, 19 nt, Human
gacaggcauguucucugag

SEQ ID NO: 1622821 - RNA, 18 nt, Human
gacaggcauguucucuga

SEQ ID NO: 1622822 - RNA, 18 nt, Human
gacaggcaaugcuggcug

SEQ ID NO: 1622823 - RNA, 17 nt, Human
gacaggcaaugcuggcu

SEQ ID NO: 1622824 - RNA, 16 nt, Human
gacaggcaaugcuggc

SEQ ID NO: 1622825 - RNA, 14 nt, Human
gacaggcaaugcug

SEQ ID NO: 1622826 - RNA, 15 nt, Human
gacaagcucacagac

SEQ ID NO: 1622827 - RNA, 22 nt, Human
gacaaggauugcuacuguccua

SEQ ID NO: 1622828 - RNA, 16 nt, Human
gaagucuuuguacaga

SEQ ID NO: 1622829 - RNA, 14 nt, Human
gaagucuuuguaca

SEQ ID NO: 1622830 - RNA, 16 nt, Human
gacaaugacccagugg

SEQ ID NO: 1622831 - RNA, 17 nt, Human
gacacaggcccggcucc

SEQ ID NO: 1622832 - RNA, 15 nt, Human
gacacaggcccggcu

SEQ ID NO: 1622833 - RNA, 13 nt, Human
gacacacagcucu

SEQ ID NO: 1622834 - RNA, 13 nt, Human
gacaauuuauuau

SEQ ID NO: 1622835 - RNA, 19 nt, Human
gacaauuuauuauggcaca

SEQ ID NO: 1622836 - RNA, 17 nt, Human
gacaaugacuuacugua

SEQ ID NO: 1622837 - RNA, 20 nt, Human
gacaaugacuuacuguacau

SEQ ID NO: 1622838 - RNA, 12 nt, Human
gacaaugcaaac

SEQ ID NO: 1622839 - RNA, 21 nt, Human
gacaaugacuuacuguacaug

SEQ ID NO: 1622840 - RNA, 18 nt, Human
gacaaugcaaaccaucau

SEQ ID NO: 1622841 - RNA, 16 nt, Human
gacaaugcaaaccauc

SEQ ID NO: 1622842 - RNA, 12 nt, Human
gacaauuuauua

SEQ ID NO: 1622843 - RNA, 18 nt, Human
gacacuaaccacgcugga

SEQ ID NO: 1622844 - RNA, 17 nt, Human
gacacuaaccacgcugg

SEQ ID NO: 1622845 - RNA, 16 nt, Human
gacacuaaccacgcug

SEQ ID NO: 1622846 - RNA, 15 nt, Human
gacacuaaccacgcu

SEQ ID NO: 1622847 - RNA, 18 nt, Human
gacacgaauauugcugau

SEQ ID NO: 1622848 - RNA, 17 nt, Human
gacacgaauauugcuga

SEQ ID NO: 1622849 - RNA, 19 nt, Human
gacacgaauauugcugaug

SEQ ID NO: 1622850 - RNA, 17 nt, Human
gacaccuugacagggca

SEQ ID NO: 1622851 - RNA, 15 nt, Human
gacaccuugacaggg

SEQ ID NO: 1622852 - RNA, 20 nt, Human
gacaccuugacagggcacac

SEQ ID NO: 1622853 - RNA, 18 nt, Human
gacaccuugacagggcac

SEQ ID NO: 1622854 - RNA, 15 nt, Human
gacacgaauauugcu

SEQ ID NO: 1622855 - RNA, 18 nt, Human
gacacaggcccggcucca

SEQ ID NO: 1622856 - RNA, 17 nt, Human
gacacagugaccauacu

SEQ ID NO: 1622857 - RNA, 13 nt, Human
gacacccugugau

SEQ ID NO: 1622858 - RNA, 12 nt, Human
gacacccuguga

SEQ ID NO: 1622859 - RNA, 23 nt, Human
gacacccugugauggggcccugc

SEQ ID NO: 1622860 - RNA, 22 nt, Human
gacacccugugauggggcccug

SEQ ID NO: 1622861 - RNA, 17 nt, Human
gacaccuacugaguggc

SEQ ID NO: 1622862 - RNA, 15 nt, Human
gcaguugaaaagacu

SEQ ID NO: 1622863 - RNA, 17 nt, Human
gcauagguuuaauaauu

SEQ ID NO: 1622864 - RNA, 16 nt, Human
gcaguucagagcugcc

SEQ ID NO: 1622865 - RNA, 17 nt, Human
gcaguuauuaacacuaa

SEQ ID NO: 1622866 - RNA, 15 nt, Human
gcaguucugaagaag

SEQ ID NO: 1622867 - RNA, 17 nt, Human
gcaguucagagcugccc

SEQ ID NO: 1622868 - RNA, 18 nt, Human
gcaguucagagcugcccu

SEQ ID NO: 1622869 - RNA, 17 nt, Human
gcaguucugaagaagau

SEQ ID NO: 1622870 - RNA, 13 nt, Human
gcauagaaguaaa

SEQ ID NO: 1622871 - RNA, 15 nt, Human
gcagugggagcugcc

SEQ ID NO: 1622872 - RNA, 14 nt, Human
gcagugggagcugc

SEQ ID NO: 1622873 - RNA, 13 nt, Human
gcagugggagcug

SEQ ID NO: 1622874 - RNA, 23 nt, Human
gcaguggugguuuucuguucuuu

SEQ ID NO: 1622875 - RNA, 21 nt, Human
gcagggcucagcggggacagc

SEQ ID NO: 1622876 - RNA, 19 nt, Human
gcagggcucagcggggaca

SEQ ID NO: 1622877 - RNA, 16 nt, Human
gcaggcagccaggcca

SEQ ID NO: 1622878 - RNA, 15 nt, Human
gcaggcagccaggcc

SEQ ID NO: 1622879 - RNA, 17 nt, Human
gcaggcagccaggccac

SEQ ID NO: 1622880 - RNA, 18 nt, Human
gcagggucucacucuguc

SEQ ID NO: 1622881 - RNA, 17 nt, Human
gcagggucucacucugu

SEQ ID NO: 1622882 - RNA, 22 nt, Human
gcagggcucagcggggacagcu

SEQ ID NO: 1622883 - RNA, 20 nt, Human
gcaggucuugaacuccuggc

SEQ ID NO: 1622884 - RNA, 19 nt, Human
gcaggucuugaacuccugg

SEQ ID NO: 1622885 - RNA, 22 nt, Human
gcagguccaggguuugaguuca

SEQ ID NO: 1622886 - RNA, 16 nt, Human
gcagugcaugcugucc

SEQ ID NO: 1622887 - RNA, 15 nt, Human
gcagugcaugcuguc

SEQ ID NO: 1622888 - RNA, 13 nt, Human
gcauuauauuuau

SEQ ID NO: 1622889 - RNA, 22 nt, Human
gcauguucucugaggacacuaa

SEQ ID NO: 1622890 - RNA, 21 nt, Human
gcauguucucugaggacacua

SEQ ID NO: 1622891 - RNA, 15 nt, Human
gcauguucucugagg

SEQ ID NO: 1622892 - RNA, 20 nt, Human
gcauggcaaggacugcaggg

SEQ ID NO: 1622893 - RNA, 18 nt, Human
gcaugcgggcuuccuccu

SEQ ID NO: 1622894 - RNA, 12 nt, Human
gcaucagcugcu

SEQ ID NO: 1622895 - RNA, 16 nt, Human
gcaucugaaaauugau

SEQ ID NO: 1622896 - RNA, 18 nt, Human
gcaugaaguaauaugcac

SEQ ID NO: 1622897 - RNA, 12 nt, Human
gccaaaggaagc

SEQ ID NO: 1622898 - RNA, 22 nt, Human
gccaaagcuaggccuggccaga

SEQ ID NO: 1622899 - RNA, 16 nt, Human
gccaaagcuaggccug

SEQ ID NO: 1622900 - RNA, 19 nt, Human
gccaaagccuccuccagcc

SEQ ID NO: 1622901 - RNA, 16 nt, Human
gccaaagccuccucca

SEQ ID NO: 1622902 - RNA, 20 nt, Human
gccaaagccaaagcuaggcc

SEQ ID NO: 1622903 - RNA, 19 nt, Human
gccaaacucaccugccccu

SEQ ID NO: 1622904 - RNA, 16 nt, Human
gccaaacucaccugcc

SEQ ID NO: 1622905 - RNA, 14 nt, Human
gccaaacucaccug

SEQ ID NO: 1622906 - RNA, 18 nt, Human
gcauuuguuugaacugau

SEQ ID NO: 1622907 - RNA, 13 nt, Human
gcauuugcugaau

SEQ ID NO: 1622908 - RNA, 17 nt, Human
gcauuugcugaauacag

SEQ ID NO: 1622909 - RNA, 14 nt, Human
gcauuugcugaaua

SEQ ID NO: 1622910 - RNA, 16 nt, Human
gcauuuguuugaacug

SEQ ID NO: 1622911 - RNA, 16 nt, Human
gcauuuguguugaaga

SEQ ID NO: 1622912 - RNA, 17 nt, Human
gcauuaucuagauacug

SEQ ID NO: 1622913 - RNA, 19 nt, Human
gcauuaucuagauacugua

SEQ ID NO: 1622914 - RNA, 19 nt, Human
gcauucaaauguauuacag

SEQ ID NO: 1622915 - RNA, 20 nt, Human
gcagccccgugggguuccuc

SEQ ID NO: 1622916 - RNA, 21 nt, Human
gcagccccuguucuggcagag

SEQ ID NO: 1622917 - RNA, 20 nt, Human
gcagccccuguucuggcaga

SEQ ID NO: 1622918 - RNA, 13 nt, Human
gcagcccugcaga

SEQ ID NO: 1622919 - RNA, 24 nt, Human
gcagccccauucugccugcccagg

SEQ ID NO: 1622920 - RNA, 21 nt, Human
gcagccccauucugccugccc

SEQ ID NO: 1622921 - RNA, 19 nt, Human
gcagccccauucugccugc

SEQ ID NO: 1622922 - RNA, 18 nt, Human
gcagccccauucugccug

SEQ ID NO: 1622923 - RNA, 16 nt, Human
gcagcaauaaagcagc

SEQ ID NO: 1622924 - RNA, 23 nt, Human
gcagcaauaaagcagcguuucua

SEQ ID NO: 1622925 - RNA, 17 nt, Human
gcagccccauucugccu

SEQ ID NO: 1622926 - RNA, 18 nt, Human
gcagauaaacaguaguga

SEQ ID NO: 1622927 - RNA, 21 nt, Human
gcagaguugaagacagagcua

SEQ ID NO: 1622928 - RNA, 17 nt, Human
gcagacaguuaagagaa

SEQ ID NO: 1622929 - RNA, 22 nt, Human
gcagauacaggaaaagcugcug

SEQ ID NO: 1622930 - RNA, 18 nt, Human
gcagauuauucacugauu

SEQ ID NO: 1622931 - RNA, 14 nt, Human
gcaggcagccaggc

SEQ ID NO: 1622932 - RNA, 13 nt, Human
gcaggcagccagg

SEQ ID NO: 1622933 - RNA, 12 nt, Human
gcaggcagccag

SEQ ID NO: 1622934 - RNA, 23 nt, Human
gcaggaggaucacuugaguccag

SEQ ID NO: 1622935 - RNA, 20 nt, Human
gcaggaaggcugagaggaga

SEQ ID NO: 1622936 - RNA, 14 nt, Human
gcagcucaccucuc

SEQ ID NO: 1622937 - RNA, 15 nt, Human
gcagccuuggcaaac

SEQ ID NO: 1622938 - RNA, 15 nt, Human
gcagcucaccucucc

SEQ ID NO: 1622939 - RNA, 17 nt, Human
gcagcccugcagagggc

SEQ ID NO: 1622940 - RNA, 16 nt, Human
gcagcccugcagaggg

SEQ ID NO: 1622941 - RNA, 15 nt, Human
gcagcccugcagagg

SEQ ID NO: 1622942 - RNA, 14 nt, Human
gcagcccugcagag

SEQ ID NO: 1622943 - RNA, 13 nt, Human
gcagcccugcuuu

SEQ ID NO: 1622944 - RNA, 20 nt, Human
gcacugcuuccagugaggcu

SEQ ID NO: 1622945 - RNA, 22 nt, Human
gcacugcuuccagugaggcucu

SEQ ID NO: 1622946 - RNA, 12 nt, Human
gcacugcugccc

SEQ ID NO: 1622947 - RNA, 24 nt, Human
gcacugguggcccgacagccuggc

SEQ ID NO: 1622948 - RNA, 23 nt, Human
gcacugguggcccgacagccugg

SEQ ID NO: 1622949 - RNA, 22 nt, Human
gcacugguggcccgacagccug

SEQ ID NO: 1622950 - RNA, 18 nt, Human
gcacugcuuccagugagg

SEQ ID NO: 1622951 - RNA, 16 nt, Human
gcacugcuuccaguga

SEQ ID NO: 1622952 - RNA, 15 nt, Human
gcagacaggaccagg

SEQ ID NO: 1622953 - RNA, 13 nt, Human
gcagacaggacca

SEQ ID NO: 1622954 - RNA, 12 nt, Human
gcagacaggacc

SEQ ID NO: 1622955 - RNA, 19 nt, Human
gcagacaggcaagcaccuc

SEQ ID NO: 1622956 - RNA, 18 nt, Human
gcagacaggaccagggau

SEQ ID NO: 1622957 - RNA, 23 nt, Human
gcagacaggcaagcaccuccugc

SEQ ID NO: 1622958 - RNA, 14 nt, Human
gcaauggcagccuu

SEQ ID NO: 1622959 - RNA, 13 nt, Human
gcaauggcagccu

SEQ ID NO: 1622960 - RNA, 12 nt, Human
gcaauggcagcc

SEQ ID NO: 1622961 - RNA, 22 nt, Human
gcaccacugcacuccagccugg

SEQ ID NO: 1622962 - RNA, 21 nt, Human
gcaccacugcacuccagccug

SEQ ID NO: 1622963 - RNA, 15 nt, Human
gcaccagcagccugg

SEQ ID NO: 1622964 - RNA, 19 nt, Human
gcacccggccccugcuggu

SEQ ID NO: 1622965 - RNA, 22 nt, Human
gcacccaccaucaugucuggcu

SEQ ID NO: 1622966 - RNA, 16 nt, Human
gcaccagcagccugga

SEQ ID NO: 1622967 - RNA, 17 nt, Human
gcaccuuagacaguccc

SEQ ID NO: 1622968 - RNA, 14 nt, Human
gcaccuuagacagu

SEQ ID NO: 1622969 - RNA, 22 nt, Human
gcaccuggaauauauaaccagu

SEQ ID NO: 1622970 - RNA, 15 nt, Human
gcacccucaggcagg

SEQ ID NO: 1622971 - RNA, 18 nt, Human
gcaccuggaauauauaac

SEQ ID NO: 1622972 - RNA, 21 nt, Human
gcaccuggaauauauaaccag

SEQ ID NO: 1622973 - RNA, 18 nt, Human
gcaccuuagacagucccu

SEQ ID NO: 1622974 - RNA, 19 nt, Human
gcaccuuagacagucccug

SEQ ID NO: 1622975 - RNA, 12 nt, Human
gcacgauuucug

SEQ ID NO: 1622976 - RNA, 18 nt, Human
gcacggugaauggcuuug

SEQ ID NO: 1622977 - RNA, 22 nt, Human
gaugcacagaguuguuacauuu

SEQ ID NO: 1622978 - RNA, 13 nt, Human
gaugcaccagccc

SEQ ID NO: 1622979 - RNA, 14 nt, Human
gaugcaccagcccu

SEQ ID NO: 1622980 - RNA, 12 nt, Human
gaugcagccuca

SEQ ID NO: 1622981 - RNA, 14 nt, Human
gaugcagccucaca

SEQ ID NO: 1622982 - RNA, 19 nt, Human
gaugcagccucacaguccu

SEQ ID NO: 1622983 - RNA, 21 nt, Human
gauggcuaguaucaaaagaaa

SEQ ID NO: 1622984 - RNA, 19 nt, Human
gauggcugugccucugccu

SEQ ID NO: 1622985 - RNA, 18 nt, Human
gauggcugugccucugcc

SEQ ID NO: 1622986 - RNA, 17 nt, Human
gauggcugugccucugc

SEQ ID NO: 1622987 - RNA, 13 nt, Human
gauggcugugccu

SEQ ID NO: 1622988 - RNA, 22 nt, Human
gauggggcccugccuccuuugu

SEQ ID NO: 1622989 - RNA, 14 nt, Human
gauggggcccugcc

SEQ ID NO: 1622990 - RNA, 13 nt, Human
gauggggcccugc

SEQ ID NO: 1622991 - RNA, 20 nt, Human
gauggcugugccucugccug

SEQ ID NO: 1622992 - RNA, 19 nt, Human
gaugccugguggcagcugc

SEQ ID NO: 1622993 - RNA, 18 nt, Human
gaugccugguggcagcug

SEQ ID NO: 1622994 - RNA, 20 nt, Human
gaugccugguggcagcugcg

SEQ ID NO: 1622995 - RNA, 22 nt, Human
gauggauuuccagccaaagccu

SEQ ID NO: 1622996 - RNA, 14 nt, Human
gaugaaaauauuug

SEQ ID NO: 1622997 - RNA, 18 nt, Human
gaucuuugcagacaggca

SEQ ID NO: 1622998 - RNA, 13 nt, Human
gauccuggaaauc

SEQ ID NO: 1622999 - RNA, 22 nt, Human
gauccugagccagauuucacuc

SEQ ID NO: 1623000 - RNA, 21 nt, Human
gauccugagccagauuucacu

SEQ ID NO: 1623001 - RNA, 16 nt, Human
gaucccucauccucau

SEQ ID NO: 1623002 - RNA, 15 nt, Human
gaucccucauccuca

SEQ ID NO: 1623003 - RNA, 22 nt, Human
gauaaauaguuuaugauuccac

SEQ ID NO: 1623004 - RNA, 21 nt, Human
gaggaaggaaacccagcucug

SEQ ID NO: 1623005 - RNA, 20 nt, Human
gaggaaggaaacccagcucu

SEQ ID NO: 1623006 - RNA, 19 nt, Human
gaggaaggaaacccagcuc

SEQ ID NO: 1623007 - RNA, 13 nt, Human
gaggaaggaaacc

SEQ ID NO: 1623008 - RNA, 19 nt, Human
gauaaaguugguaaaccuu

SEQ ID NO: 1623009 - RNA, 13 nt, Human
gauagcagggcau

SEQ ID NO: 1623010 - RNA, 22 nt, Human
gauagcacagacccugcccugu

SEQ ID NO: 1623011 - RNA, 21 nt, Human
gauagcacagacccugcccug

SEQ ID NO: 1623012 - RNA, 19 nt, Human
gauacaggaaaagcugcug

SEQ ID NO: 1623013 - RNA, 18 nt, Human
gauacaggaaaagcugcu

SEQ ID NO: 1623014 - RNA, 23 nt, Human
gauagauaggucagugcaaauac

SEQ ID NO: 1623015 - RNA, 11 nt, Human
gauacagaaaa

SEQ ID NO: 1623016 - RNA, 19 nt, Human
gauacaccgggccuggaga

SEQ ID NO: 1623017 - RNA, 18 nt, Human
gauaauacaccacuacau

SEQ ID NO: 1623018 - RNA, 21 nt, Human
gauaauacaccacuacauucu

SEQ ID NO: 1623019 - RNA, 22 nt, Human
gauaauacaccacuacauucug

SEQ ID NO: 1623020 - RNA, 18 nt, Human
gaucacgccacugcacua

SEQ ID NO: 1623021 - RNA, 21 nt, Human
gaucaaguuauuuuuaauuug

SEQ ID NO: 1623022 - RNA, 15 nt, Human
gaucagccugggcaa

SEQ ID NO: 1623023 - RNA, 12 nt, Human
gaucagccuggg

SEQ ID NO: 1623024 - RNA, 22 nt, Human
gaucagucugauucccaagcuc

SEQ ID NO: 1623025 - RNA, 12 nt, Human
gaucacggcuca

SEQ ID NO: 1623026 - RNA, 21 nt, Human
gaucauccacugugccaugug

SEQ ID NO: 1623027 - RNA, 19 nt, Human
gaucauccacugugccaug

SEQ ID NO: 1623028 - RNA, 17 nt, Human
gaucauccacugugcca

SEQ ID NO: 1623029 - RNA, 20 nt, Human
gauccccaagccuggcaagg

SEQ ID NO: 1623030 - RNA, 20 nt, Human
gaucauugugaaauuauuca

SEQ ID NO: 1623031 - RNA, 14 nt, Human
gaucauugugaaau

SEQ ID NO: 1623032 - RNA, 13 nt, Human
gcaaagcccagcu

SEQ ID NO: 1623033 - RNA, 21 nt, Human
gcaaagcccagcuugaaaccu

SEQ ID NO: 1623034 - RNA, 16 nt, Human
gcaaaguaucccuacu

SEQ ID NO: 1623035 - RNA, 22 nt, Human
gcaagacgcugugcugcccugc

SEQ ID NO: 1623036 - RNA, 21 nt, Human
gcaagacgcugugcugcccug

SEQ ID NO: 1623037 - RNA, 20 nt, Human
gcaagacgcugugcugcccu

SEQ ID NO: 1623038 - RNA, 14 nt, Human
gcaagacgcugugc

SEQ ID NO: 1623039 - RNA, 23 nt, Human
gcaagacgcugugcugcccugcc

SEQ ID NO: 1623040 - RNA, 17 nt, Human
gcaagaauugaagcagg

SEQ ID NO: 1623041 - RNA, 10 nt, Human
gcaagccaga

SEQ ID NO: 1623042 - RNA, 18 nt, Human
gcaaggagauuuacaacu

SEQ ID NO: 1623043 - RNA, 14 nt, Human
gcaagggugauggg

SEQ ID NO: 1623044 - RNA, 13 nt, Human
gcaaggcugucaa

SEQ ID NO: 1623045 - RNA, 11 nt, Human
gcaaggcuguc

SEQ ID NO: 1623046 - RNA, 23 nt, Human
gcaaugcuggcuguuggcugggg

SEQ ID NO: 1623047 - RNA, 22 nt, Human
gcaaugcuggcuguuggcuggg

SEQ ID NO: 1623048 - RNA, 14 nt, Human
gcaaugcuggcugu

SEQ ID NO: 1623049 - RNA, 13 nt, Human
gcaaugcuggcug

SEQ ID NO: 1623050 - RNA, 23 nt, Human
gcaaugaccuuucaauaggaaaa

SEQ ID NO: 1623051 - RNA, 22 nt, Human
gcaaugaccuuucaauaggaaa

SEQ ID NO: 1623052 - RNA, 20 nt, Human
gcaaugaccuuucaauagga

SEQ ID NO: 1623053 - RNA, 17 nt, Human
gcaaugaccuuucaaua

SEQ ID NO: 1623054 - RNA, 17 nt, Human
gcaaucaaaucugcuuu

SEQ ID NO: 1623055 - RNA, 15 nt, Human
gcaaucaaaucugcu

SEQ ID NO: 1623056 - RNA, 14 nt, Human
gcaaggucauuuuu

SEQ ID NO: 1623057 - RNA, 15 nt, Human
gauuuuccugaaaac

SEQ ID NO: 1623058 - RNA, 19 nt, Human
gauuuguuaaugauagcua

SEQ ID NO: 1623059 - RNA, 23 nt, Human
gauuuuauuauguaaaucccauu

SEQ ID NO: 1623060 - RNA, 20 nt, Human
gauuuuauuauguaaauccc

SEQ ID NO: 1623061 - RNA, 19 nt, Human
gauuuuauuauguaaaucc

SEQ ID NO: 1623062 - RNA, 18 nt, Human
gauuuuauuauguaaauc

SEQ ID NO: 1623063 - RNA, 15 nt, Human
gauuuuauuauguaa

SEQ ID NO: 1623064 - RNA, 13 nt, Human
gauuuuauuaugu

SEQ ID NO: 1623065 - RNA, 11 nt, Human
gauuucuguuu

SEQ ID NO: 1623066 - RNA, 19 nt, Human
gauuucuguuuagauaaua

SEQ ID NO: 1623067 - RNA, 22 nt, Human
gauuuggucaacacuaacauga

SEQ ID NO: 1623068 - RNA, 15 nt, Human
gauuuccguuaaaau

SEQ ID NO: 1623069 - RNA, 18 nt, Human
gauuuccguuaaaauacc

SEQ ID NO: 1623070 - RNA, 20 nt, Human
gauugcaacaggcugggcuu

SEQ ID NO: 1623071 - RNA, 18 nt, Human
gauucuuuccugaggcug

SEQ ID NO: 1623072 - RNA, 17 nt, Human
gauucuuuccugaggcu

SEQ ID NO: 1623073 - RNA, 16 nt, Human
gauucuuuccugaggc

SEQ ID NO: 1623074 - RNA, 23 nt, Human
gauugcaccacugcacuccagcc

SEQ ID NO: 1623075 - RNA, 16 nt, Human
gauugcaccacugcac

SEQ ID NO: 1623076 - RNA, 21 nt, Human
gauugcaacaggcugggcuuc

SEQ ID NO: 1623077 - RNA, 20 nt, Human
gauucccaagcucugcuccu

SEQ ID NO: 1623078 - RNA, 19 nt, Human
gauucccaagcucugcucc

SEQ ID NO: 1623079 - RNA, 21 nt, Human
gauucccaagcucugcuccuc

SEQ ID NO: 1623080 - RNA, 23 nt, Human
gauggggcugcaccggcuggccu

SEQ ID NO: 1623081 - RNA, 15 nt, Human
gauucagcucugcaa

SEQ ID NO: 1623082 - RNA, 13 nt, Human
gauucagcucugc

SEQ ID NO: 1623083 - RNA, 19 nt, Human
gauucagacagcugccugg

SEQ ID NO: 1623084 - RNA, 19 nt, Human
gauucauauuuacuucuua

SEQ ID NO: 1623085 - RNA, 18 nt, Human
gauucauauuuacuucuu

SEQ ID NO: 1623086 - RNA, 17 nt, Human
gauucauauuuacuucu

SEQ ID NO: 1623087 - RNA, 22 nt, Human
gauuccagagaguggcuccucc

SEQ ID NO: 1623088 - RNA, 20 nt, Human
gauuccagagaguggcuccu

SEQ ID NO: 1623089 - RNA, 19 nt, Human
gauuccagagaguggcucc

SEQ ID NO: 1623090 - RNA, 22 nt, Human
gccugggggcugggcagaggaa

SEQ ID NO: 1623091 - RNA, 21 nt, Human
gccugguggcagcugcggucc

SEQ ID NO: 1623092 - RNA, 19 nt, Human
gccugguggcagcugcggu

SEQ ID NO: 1623093 - RNA, 18 nt, Human
gccugguggcagcugcgg

SEQ ID NO: 1623094 - RNA, 14 nt, Human
gccugguggcagcu

SEQ ID NO: 1623095 - RNA, 13 nt, Human
gccugguggcagc

SEQ ID NO: 1623096 - RNA, 14 nt, Human
gccuuauggaacac

SEQ ID NO: 1623097 - RNA, 10 nt, Human
gccuuaugga

SEQ ID NO: 1623098 - RNA, 18 nt, Human
gccuuagaagucacacag

SEQ ID NO: 1623099 - RNA, 17 nt, Human
gccuuagaagucacaca

SEQ ID NO: 1623100 - RNA, 19 nt, Human
gccuuagaagucacacagu

SEQ ID NO: 1623101 - RNA, 19 nt, Human
gccuuacccucauguucuu

SEQ ID NO: 1623102 - RNA, 20 nt, Human
gccuuacacaaugguuuucu

SEQ ID NO: 1623103 - RNA, 21 nt, Human
gccuuacacaaugguuuucuu

SEQ ID NO: 1623104 - RNA, 18 nt, Human
gccuuacccucauguucu

SEQ ID NO: 1623105 - RNA, 13 nt, Human
gccuguuuaagag

SEQ ID NO: 1623106 - RNA, 12 nt, Human
gccuguuuaaga

SEQ ID NO: 1623107 - RNA, 20 nt, Human
gccuuauggaacacucugag

SEQ ID NO: 1623108 - RNA, 19 nt, Human
gccuuauggaacacucuga

SEQ ID NO: 1623109 - RNA, 18 nt, Human
gccuuauggaacacucug

SEQ ID NO: 1623110 - RNA, 16 nt, Human
gccuuauggaacacuc

SEQ ID NO: 1623111 - RNA, 12 nt, Human
gccuuccagggg

SEQ ID NO: 1623112 - RNA, 13 nt, Human
gccuucaucuccc

SEQ ID NO: 1623113 - RNA, 21 nt, Human
gccuucagggagugagggauu

SEQ ID NO: 1623114 - RNA, 13 nt, Human
gccuucagggagu

SEQ ID NO: 1623115 - RNA, 21 nt, Human
gccuuccaggggugggacacc

SEQ ID NO: 1623116 - RNA, 16 nt, Human
gccuuccagggguggg

SEQ ID NO: 1623117 - RNA, 15 nt, Human
gccuuccaggggugg

SEQ ID NO: 1623118 - RNA, 22 nt, Human
gccuucgauacaccgggccugg

SEQ ID NO: 1623119 - RNA, 18 nt, Human
gccuucgauacaccgggc

SEQ ID NO: 1623120 - RNA, 23 nt, Human
gccuucgauacaccgggccugga

SEQ ID NO: 1623121 - RNA, 23 nt, Human
gcgacaaugcaaaccaucauuga

SEQ ID NO: 1623122 - RNA, 13 nt, Human
gccuuuggcuuca

SEQ ID NO: 1623123 - RNA, 22 nt, Human
gccuuuggaaacagcucgacuu

SEQ ID NO: 1623124 - RNA, 12 nt, Human
gcgacagugaga

SEQ ID NO: 1623125 - RNA, 22 nt, Human
gcgacagugagacucugucuca

SEQ ID NO: 1623126 - RNA, 15 nt, Human
gcgccuacaggagug

SEQ ID NO: 1623127 - RNA, 18 nt, Human
gcgccuacaggagugagc

SEQ ID NO: 1623128 - RNA, 13 nt, Human
gcggacagccacg

SEQ ID NO: 1623129 - RNA, 11 nt, Human
gcggacagcca

SEQ ID NO: 1623130 - RNA, 19 nt, Human
gcgucucauacucaccuca

SEQ ID NO: 1623131 - RNA, 20 nt, Human
gcgggucacaggagggaggg

SEQ ID NO: 1623132 - RNA, 19 nt, Human
gcgggucacaggagggagg

SEQ ID NO: 1623133 - RNA, 15 nt, Human
gcggacagccacggc

SEQ ID NO: 1623134 - RNA, 16 nt, Human
gcggacagccacggcc

SEQ ID NO: 1623135 - RNA, 15 nt, Human
gcgggucacaggagg

SEQ ID NO: 1623136 - RNA, 13 nt, Human
gcgggucacagga

SEQ ID NO: 1623137 - RNA, 13 nt, Human
gcuauaggugcua

SEQ ID NO: 1623138 - RNA, 16 nt, Human
gcuaggaacacuccuu

SEQ ID NO: 1623139 - RNA, 22 nt, Human
gcuaggaaauccaggguggugg

SEQ ID NO: 1623140 - RNA, 15 nt, Human
gcuaggaacacuccu

SEQ ID NO: 1623141 - RNA, 19 nt, Human
gcuaggaaauccagggugg

SEQ ID NO: 1623142 - RNA, 19 nt, Human
gcuagaacucccuuucaac

SEQ ID NO: 1623143 - RNA, 16 nt, Human
gcuaccuuuguauucu

SEQ ID NO: 1623144 - RNA, 20 nt, Human
gcuaccuuuguauucucucc

SEQ ID NO: 1623145 - RNA, 13 nt, Human
gcuaagagggagg

SEQ ID NO: 1623146 - RNA, 17 nt, Human
gcuaaacuuuucugaua

SEQ ID NO: 1623147 - RNA, 15 nt, Human
gcuaaacuuuucuga

SEQ ID NO: 1623148 - RNA, 13 nt, Human
gcuaaacuuuucu

SEQ ID NO: 1623149 - RNA, 14 nt, Human
gcuacacaggggaa

SEQ ID NO: 1623150 - RNA, 22 nt, Human
gcuacacaggggaaaagaggag

SEQ ID NO: 1623151 - RNA, 13 nt, Human
gcuacacacugca

SEQ ID NO: 1623152 - RNA, 20 nt, Human
gcuacacacugcauguuugu

SEQ ID NO: 1623153 - RNA, 20 nt, Human
gcuaagagggagggagggcu

SEQ ID NO: 1623154 - RNA, 21 nt, Human
gcuaagagggagggagggcuc

SEQ ID NO: 1623155 - RNA, 17 nt, Human
gccuccccuccucugcu

SEQ ID NO: 1623156 - RNA, 19 nt, Human
gccuccccuccucugcuug

SEQ ID NO: 1623157 - RNA, 17 nt, Human
gccucccaucacccgcu

SEQ ID NO: 1623158 - RNA, 20 nt, Human
gccuccccuccucugcuugc

SEQ ID NO: 1623159 - RNA, 22 nt, Human
gccuccccuccucugcuugcca

SEQ ID NO: 1623160 - RNA, 23 nt, Human
gccuccccuccucugcuugccau

SEQ ID NO: 1623161 - RNA, 19 nt, Human
gccucccgaguagcuggga

SEQ ID NO: 1623162 - RNA, 18 nt, Human
gccucccgaguagcuggg

SEQ ID NO: 1623163 - RNA, 20 nt, Human
gccucccgaguagcugggac

SEQ ID NO: 1623164 - RNA, 19 nt, Human
gccucccaacucaccccag

SEQ ID NO: 1623165 - RNA, 18 nt, Human
gccucccaacucacccca

SEQ ID NO: 1623166 - RNA, 17 nt, Human
gccucccaacucacccc

SEQ ID NO: 1623167 - RNA, 16 nt, Human
gccucccaacucaccc

SEQ ID NO: 1623168 - RNA, 16 nt, Human
gccucccaucacccgc

SEQ ID NO: 1623169 - RNA, 14 nt, Human
gccucccaucaccc

SEQ ID NO: 1623170 - RNA, 13 nt, Human
gccucccaacuca

SEQ ID NO: 1623171 - RNA, 19 nt, Human
gccucccaaagugcuggga

SEQ ID NO: 1623172 - RNA, 18 nt, Human
gccucccaaagugcuggg

SEQ ID NO: 1623173 - RNA, 17 nt, Human
gccucagcauccuggca

SEQ ID NO: 1623174 - RNA, 16 nt, Human
gccucagcauccuggc

SEQ ID NO: 1623175 - RNA, 15 nt, Human
gccucagcauccugg

SEQ ID NO: 1623176 - RNA, 18 nt, Human
gccucacaguccuuacca

SEQ ID NO: 1623177 - RNA, 21 nt, Human
gccucacaguccuuaccagca

SEQ ID NO: 1623178 - RNA, 15 nt, Human
gccugcaagggagug

SEQ ID NO: 1623179 - RNA, 13 nt, Human
gccugcaagggag

SEQ ID NO: 1623180 - RNA, 13 nt, Human
gccucugccucug

SEQ ID NO: 1623181 - RNA, 12 nt, Human
gccucugccucu

SEQ ID NO: 1623182 - RNA, 15 nt, Human
gccucugcacucccc

SEQ ID NO: 1623183 - RNA, 18 nt, Human
gccucugccucugacaca

SEQ ID NO: 1623184 - RNA, 21 nt, Human
gccucugacacacagcucugu

SEQ ID NO: 1623185 - RNA, 20 nt, Human
gccucugacacacagcucug

SEQ ID NO: 1623186 - RNA, 19 nt, Human
gccucugacacacagcucu

SEQ ID NO: 1623187 - RNA, 14 nt, Human
gccucugcacuccc

SEQ ID NO: 1623188 - RNA, 18 nt, Human
gccucugacacacagcuc

SEQ ID NO: 1623189 - RNA, 17 nt, Human
gccucugacacacagcu

SEQ ID NO: 1623190 - RNA, 16 nt, Human
gccucucucaggccaa

SEQ ID NO: 1623191 - RNA, 14 nt, Human
gccucucucaggcc

SEQ ID NO: 1623192 - RNA, 13 nt, Human
gccucucucaggc

SEQ ID NO: 1623193 - RNA, 20 nt, Human
gccgggcgugguggugagug

SEQ ID NO: 1623194 - RNA, 21 nt, Human
gccgggcgcgguggcucacgc

SEQ ID NO: 1623195 - RNA, 13 nt, Human
gccgcagcccugc

SEQ ID NO: 1623196 - RNA, 12 nt, Human
gccgcagcccug

SEQ ID NO: 1623197 - RNA, 11 nt, Human
gccgcagcccu

SEQ ID NO: 1623198 - RNA, 21 nt, Human
gccgagaucacgccacugcac

SEQ ID NO: 1623199 - RNA, 20 nt, Human
gccgagaucacgccacugca

SEQ ID NO: 1623200 - RNA, 22 nt, Human
gccgagaucacgccacugcacu

SEQ ID NO: 1623201 - RNA, 19 nt, Human
gcccugcuuugggcugccc

SEQ ID NO: 1623202 - RNA, 18 nt, Human
gcccuucucuccagcccc

SEQ ID NO: 1623203 - RNA, 17 nt, Human
gcccuucucuccagccc

SEQ ID NO: 1623204 - RNA, 16 nt, Human
gcccuucucuccagcc

SEQ ID NO: 1623205 - RNA, 14 nt, Human
gcccuucucuccag

SEQ ID NO: 1623206 - RNA, 18 nt, Human
gcccugcuuugggcugcc

SEQ ID NO: 1623207 - RNA, 16 nt, Human
gcccugcuuugggcug

SEQ ID NO: 1623208 - RNA, 16 nt, Human
gcccugcuuucagaua

SEQ ID NO: 1623209 - RNA, 14 nt, Human
gcccugcuuucaga

SEQ ID NO: 1623210 - RNA, 21 nt, Human
gccuaaauccauuuggaaauc

SEQ ID NO: 1623211 - RNA, 19 nt, Human
gccuaaauccauuuggaaa

SEQ ID NO: 1623212 - RNA, 13 nt, Human
gccuaaauccauu

SEQ ID NO: 1623213 - RNA, 12 nt, Human
gccuaaauccau

SEQ ID NO: 1623214 - RNA, 23 nt, Human
gccuaaauccauuuggaaaucuu

SEQ ID NO: 1623215 - RNA, 22 nt, Human
gccuaaauccauuuggaaaucu

SEQ ID NO: 1623216 - RNA, 17 nt, Human
gccucacaguccuuacc

SEQ ID NO: 1623217 - RNA, 13 nt, Human
gccucacaguccu

SEQ ID NO: 1623218 - RNA, 19 nt, Human
gccucaaccuccugggcua

SEQ ID NO: 1623219 - RNA, 18 nt, Human
gccucaaccuccugggcu

SEQ ID NO: 1623220 - RNA, 22 nt, Human
gccuaugugcaugcagcaucua

SEQ ID NO: 1623221 - RNA, 20 nt, Human
gccguguaaccauggaccca

SEQ ID NO: 1623222 - RNA, 22 nt, Human
gccguggcuucccgcucagccc

SEQ ID NO: 1623223 - RNA, 21 nt, Human
gccguggcuucccgcucagcc

SEQ ID NO: 1623224 - RNA, 19 nt, Human
gccguggcuucccgcucag

SEQ ID NO: 1623225 - RNA, 19 nt, Human
gccgugccuucagcucuac

SEQ ID NO: 1623226 - RNA, 17 nt, Human
gccgugccuucagcucu

SEQ ID NO: 1623227 - RNA, 15 nt, Human
gccgugccuucagcu

SEQ ID NO: 1623228 - RNA, 14 nt, Human
gccgugccuucagc

SEQ ID NO: 1623229 - RNA, 17 nt, Human
gccgucuaccugagggg

SEQ ID NO: 1623230 - RNA, 16 nt, Human
gccgucuaccugaggg

SEQ ID NO: 1623231 - RNA, 15 nt, Human
gccgucuaccugagg

SEQ ID NO: 1623232 - RNA, 18 nt, Human
gccaucccucccuccacc

SEQ ID NO: 1623233 - RNA, 23 nt, Human
gccaucccucccuccaccucccu

SEQ ID NO: 1623234 - RNA, 14 nt, Human
gccauccagguuca

SEQ ID NO: 1623235 - RNA, 14 nt, Human
gccaugcuccuggc

SEQ ID NO: 1623236 - RNA, 23 nt, Human
gccaguaaaugggggugcauuug

SEQ ID NO: 1623237 - RNA, 15 nt, Human
gccaggcuggucuca

SEQ ID NO: 1623238 - RNA, 13 nt, Human
gccaggcuggucu

SEQ ID NO: 1623239 - RNA, 23 nt, Human
gccaggcugggucgcccuggacu

SEQ ID NO: 1623240 - RNA, 17 nt, Human
gccaggcugggucgccc

SEQ ID NO: 1623241 - RNA, 17 nt, Human
gcccaccuuggcucaag

SEQ ID NO: 1623242 - RNA, 16 nt, Human
gcccaccuuggcucaa

SEQ ID NO: 1623243 - RNA, 15 nt, Human
gcccaccuuggcuca

SEQ ID NO: 1623244 - RNA, 13 nt, Human
gcccaccuuggcu

SEQ ID NO: 1623245 - RNA, 14 nt, Human
gcccacuucugcca

SEQ ID NO: 1623246 - RNA, 24 nt, Human
gcccaccuggccucugcacucccc

SEQ ID NO: 1623247 - RNA, 21 nt, Human
gcccaccuggccucugcacuc

SEQ ID NO: 1623248 - RNA, 20 nt, Human
gcccaccuggccucugcacu

SEQ ID NO: 1623249 - RNA, 17 nt, Human
gcccaccuggccucugc

SEQ ID NO: 1623250 - RNA, 16 nt, Human
gcccaccuggccucug

SEQ ID NO: 1623251 - RNA, 15 nt, Human
gcccaccuggccucu

SEQ ID NO: 1623252 - RNA, 16 nt, Human
gccaugggccuccugu

SEQ ID NO: 1623253 - RNA, 15 nt, Human
gccaugggccuccug

SEQ ID NO: 1623254 - RNA, 24 nt, Human
gccaugcuccuggcccacugcauc

SEQ ID NO: 1623255 - RNA, 24 nt, Human
gcccaaccugcucuccucuugcca

SEQ ID NO: 1623256 - RNA, 22 nt, Human
gcccaagaauagaugcugacug

SEQ ID NO: 1623257 - RNA, 21 nt, Human
gcccaagaauagaugcugacu

SEQ ID NO: 1623258 - RNA, 20 nt, Human
gcccacauagugaugguucc

SEQ ID NO: 1623259 - RNA, 21 nt, Human
gccagagacacaagccuucgg

SEQ ID NO: 1623260 - RNA, 22 nt, Human
gccacugcaccgggccacagag

SEQ ID NO: 1623261 - RNA, 22 nt, Human
gccagagacacaagccuucggc

SEQ ID NO: 1623262 - RNA, 21 nt, Human
gccacugcaccgggccacaga

SEQ ID NO: 1623263 - RNA, 20 nt, Human
gccacugcaccgggccacag

SEQ ID NO: 1623264 - RNA, 22 nt, Human
gccacuccagaccccuggcuuu

SEQ ID NO: 1623265 - RNA, 24 nt, Human
gccaaggccaaaggaagcacaugc

SEQ ID NO: 1623266 - RNA, 20 nt, Human
gccacuccagaccccuggcu

SEQ ID NO: 1623267 - RNA, 21 nt, Human
gccacuccagaccccuggcuu

SEQ ID NO: 1623268 - RNA, 20 nt, Human
gccaaggccaaaggaagcac

SEQ ID NO: 1623269 - RNA, 13 nt, Human
gccagauuucacu

SEQ ID NO: 1623270 - RNA, 24 nt, Human
gccagauucuuuccugaggcuggg

SEQ ID NO: 1623271 - RNA, 20 nt, Human
gccagauucuuuccugaggc

SEQ ID NO: 1623272 - RNA, 15 nt, Human
gccagaugcaccagc

SEQ ID NO: 1623273 - RNA, 22 nt, Human
gccagccgagauagccaaggcc

SEQ ID NO: 1623274 - RNA, 17 nt, Human
gccagagggagugacag

SEQ ID NO: 1623275 - RNA, 14 nt, Human
gccagaugcaccag

SEQ ID NO: 1623276 - RNA, 14 nt, Human
gccaggaagccagc

SEQ ID NO: 1623277 - RNA, 13 nt, Human
gccaggaagccag

SEQ ID NO: 1623278 - RNA, 12 nt, Human
gccaggaagcca

SEQ ID NO: 1623279 - RNA, 20 nt, Human
gccagcugcuugggcuucau

SEQ ID NO: 1623280 - RNA, 18 nt, Human
gccagcugcuugggcuuc

SEQ ID NO: 1623281 - RNA, 17 nt, Human
gccagcugcuugggcuu

SEQ ID NO: 1623282 - RNA, 15 nt, Human
gccaggaagccagca

SEQ ID NO: 1623283 - RNA, 16 nt, Human
gccaggagccuccugc

SEQ ID NO: 1623284 - RNA, 14 nt, Human
gccaggagccuccu

SEQ ID NO: 1623285 - RNA, 20 nt, Human
gccaggagccuccugcccuu

SEQ ID NO: 1623286 - RNA, 19 nt, Human
gccaggagccuccugcccu

SEQ ID NO: 1623287 - RNA, 12 nt, Human
gcccaggcuggc

SEQ ID NO: 1623288 - RNA, 23 nt, Human
gcccaggccccugccacccuggg

SEQ ID NO: 1623289 - RNA, 21 nt, Human
gcccagagaggguggugaccu

SEQ ID NO: 1623290 - RNA, 13 nt, Human
gcccaggccuccu

SEQ ID NO: 1623291 - RNA, 20 nt, Human
gcccaggcuggagugcaaug

SEQ ID NO: 1623292 - RNA, 12 nt, Human
gccccagugccc

SEQ ID NO: 1623293 - RNA, 18 nt, Human
gccccaucccaaacccuu

SEQ ID NO: 1623294 - RNA, 21 nt, Human
gccccauaauuuuuuuuuucc

SEQ ID NO: 1623295 - RNA, 19 nt, Human
gccccaguuguauuuauuu

SEQ ID NO: 1623296 - RNA, 14 nt, Human
gccccagugcccac

SEQ ID NO: 1623297 - RNA, 13 nt, Human
gccccagugccca

SEQ ID NO: 1623298 - RNA, 15 nt, Human
gccccagugcccaca

SEQ ID NO: 1623299 - RNA, 22 nt, Human
gccccauccucuguacagagcc

SEQ ID NO: 1623300 - RNA, 14 nt, Human
gccccauccucugu

SEQ ID NO: 1623301 - RNA, 13 nt, Human
gccccauccucug

SEQ ID NO: 1623302 - RNA, 14 nt, Human
gccccauucugccu

SEQ ID NO: 1623303 - RNA, 15 nt, Human
gccccauucugccug

SEQ ID NO: 1623304 - RNA, 14 nt, Human
gcccugcagagggc

SEQ ID NO: 1623305 - RNA, 13 nt, Human
gcccugcagaggg

SEQ ID NO: 1623306 - RNA, 15 nt, Human
gcccugcagagggca

SEQ ID NO: 1623307 - RNA, 16 nt, Human
gcccugcagagggcac

SEQ ID NO: 1623308 - RNA, 14 nt, Human
gcccugagcuuucu

SEQ ID NO: 1623309 - RNA, 19 nt, Human
gcccucugcccacucccug

SEQ ID NO: 1623310 - RNA, 18 nt, Human
gcccucugcccacucccu

SEQ ID NO: 1623311 - RNA, 16 nt, Human
gcccucugcccacucc

SEQ ID NO: 1623312 - RNA, 13 nt, Human
gcccucugcccac

SEQ ID NO: 1623313 - RNA, 21 nt, Human
gcccucccugccccucccuuc

SEQ ID NO: 1623314 - RNA, 23 nt, Human
gcccuccaagaccuucuccuuca

SEQ ID NO: 1623315 - RNA, 22 nt, Human
gcccuccaagaccuucuccuuc

SEQ ID NO: 1623316 - RNA, 21 nt, Human
gcccuccaucuaaacugcccc

SEQ ID NO: 1623317 - RNA, 20 nt, Human
gcccuccaucuaaacugccc

SEQ ID NO: 1623318 - RNA, 21 nt, Human
gcccuccaagaccuucuccuu

SEQ ID NO: 1623319 - RNA, 19 nt, Human
gcccuccaagaccuucucc

SEQ ID NO: 1623320 - RNA, 12 nt, Human
gcccgggcucug

SEQ ID NO: 1623321 - RNA, 22 nt, Human
gccccgaggccuucucugaagg

SEQ ID NO: 1623322 - RNA, 18 nt, Human
gccccgaggccuucucug

SEQ ID NO: 1623323 - RNA, 14 nt, Human
gccccucagggucc

SEQ ID NO: 1623324 - RNA, 15 nt, Human
gccccgaggccuucu

SEQ ID NO: 1623325 - RNA, 18 nt, Human
gccccucagggucccugg

SEQ ID NO: 1623326 - RNA, 16 nt, Human
gccccucagggucccu

SEQ ID NO: 1623327 - RNA, 17 nt, Human
gccccuguucuggcaga

SEQ ID NO: 1623328 - RNA, 15 nt, Human
gcccgacagccuggc

SEQ ID NO: 1623329 - RNA, 14 nt, Human
gcccgacagccugg

SEQ ID NO: 1623330 - RNA, 12 nt, Human
gcccgacagccu

SEQ ID NO: 1623331 - RNA, 19 nt, Human
uuuuguagagccagggucu

SEQ ID NO: 1623332 - RNA, 18 nt, Human
uuuuuaaaaaagaaacau

SEQ ID NO: 1623333 - RNA, 16 nt, Human
uuuugucauauaagau

SEQ ID NO: 1623334 - RNA, 18 nt, Human
uuuuuaaagacuuuuaug

SEQ ID NO: 1623335 - RNA, 13 nt, Human
uuuuuaaagacuu

SEQ ID NO: 1623336 - RNA, 12 nt, Human
uuuuuaaagacu

SEQ ID NO: 1623337 - RNA, 20 nt, Human
uuuugacaaggggcaguggu

SEQ ID NO: 1623338 - RNA, 21 nt, Human
uuuuggcauaacauaaaucug

SEQ ID NO: 1623339 - RNA, 18 nt, Human
uuuuggucuggagggaag

SEQ ID NO: 1623340 - RNA, 15 nt, Human
uuuuggucuguguga

SEQ ID NO: 1623341 - RNA, 14 nt, Human
uuuuggcugcugaa

SEQ ID NO: 1623342 - RNA, 14 nt, Human
uuuuccugaaaacc

SEQ ID NO: 1623343 - RNA, 18 nt, Human
uuuucuaaaguaaaaaca

SEQ ID NO: 1623344 - RNA, 19 nt, Human
uuuuucucuaggaaauauu

SEQ ID NO: 1623345 - RNA, 23 nt, Human
uuuuucucugauacagaaaaguu

SEQ ID NO: 1623346 - RNA, 19 nt, Human
uuuuuccuucagugccuua

SEQ ID NO: 1623347 - RNA, 11 nt, Human
uuuuuccuuuu

SEQ ID NO: 1623348 - RNA, 11 nt, Human
uuuuuaaaugc

SEQ ID NO: 1623349 - RNA, 11 nt, Human
uuuuuccuuca

SEQ ID NO: 1623350 - RNA, 18 nt, Human
uuugaaucaucaagucuu

SEQ ID NO: 1623351 - RNA, 22 nt, Human
uuugaagaugccgcauuuggau

SEQ ID NO: 1623352 - RNA, 14 nt, Human
uuugaacucuucaa

SEQ ID NO: 1623353 - RNA, 15 nt, Human
uuugaacugauaaag

SEQ ID NO: 1623354 - RNA, 17 nt, Human
uuugaacugauaaagau

SEQ ID NO: 1623355 - RNA, 19 nt, Human
uuugaacugauaaagauga

SEQ ID NO: 1623356 - RNA, 17 nt, Human
uuucuuauuucauuucu

SEQ ID NO: 1623357 - RNA, 18 nt, Human
uuucuuagggaaggauac

SEQ ID NO: 1623358 - RNA, 23 nt, Human
uuucuuagggaaggauacaaaag

SEQ ID NO: 1623359 - RNA, 12 nt, Human
uuucuucucccu

SEQ ID NO: 1623360 - RNA, 16 nt, Human
uuucuuccucugcuga

SEQ ID NO: 1623361 - RNA, 14 nt, Human
uuucuuccucugcu

SEQ ID NO: 1623362 - RNA, 13 nt, Human
uuucuucucccuc

SEQ ID NO: 1623363 - RNA, 13 nt, Human
uuucuuccucugc

SEQ ID NO: 1623364 - RNA, 11 nt, Human
uuucuuccucu

SEQ ID NO: 1623365 - RNA, 13 nt, Human
uuucugagaaaga

SEQ ID NO: 1623366 - RNA, 15 nt, Human
uuucugagaaagacu

SEQ ID NO: 1623367 - RNA, 20 nt, Human
uuucuguucuuucuggcuau

SEQ ID NO: 1623368 - RNA, 21 nt, Human
uuucugaaauuuccugggagc

SEQ ID NO: 1623369 - RNA, 18 nt, Human
uuucucugauacagaaaa

SEQ ID NO: 1623370 - RNA, 17 nt, Human
uuucucugauacagaaa

SEQ ID NO: 1623371 - RNA, 16 nt, Human
uuucucugauacagaa

SEQ ID NO: 1623372 - RNA, 15 nt, Human
uuucucugauacaga

SEQ ID NO: 1623373 - RNA, 20 nt, Human
uuucuaaaggcuaccuuugu

SEQ ID NO: 1623374 - RNA, 21 nt, Human
uuucuaaaggcuaccuuugua

SEQ ID NO: 1623375 - RNA, 14 nt, Human
uuucuaaaguaaaa

SEQ ID NO: 1623376 - RNA, 12 nt, Human
uuucuaaaguaa

SEQ ID NO: 1623377 - RNA, 23 nt, Human
uuucuacucgaguuacagacaaa

SEQ ID NO: 1623378 - RNA, 16 nt, Human
uuuccugaggcugggc

SEQ ID NO: 1623379 - RNA, 13 nt, Human
uuuccugcccugg

SEQ ID NO: 1623380 - RNA, 12 nt, Human
uuuccugcccug

SEQ ID NO: 1623381 - RNA, 14 nt, Human
uuaccacagacaua

SEQ ID NO: 1623382 - RNA, 17 nt, Human
uuaccacagacauacua

SEQ ID NO: 1623383 - RNA, 20 nt, Human
uuuuaauaauguuucaaaca

SEQ ID NO: 1623384 - RNA, 11 nt, Human
uuuuaaaugca

SEQ ID NO: 1623385 - RNA, 12 nt, Human
uuuuaaaugcac

SEQ ID NO: 1623386 - RNA, 21 nt, Human
uuuuaaaugcaccuggaauau

SEQ ID NO: 1623387 - RNA, 21 nt, Human
uuuuaaaagaaugauuaugaa

SEQ ID NO: 1623388 - RNA, 17 nt, Human
uuuuaaagaaugcucuu

SEQ ID NO: 1623389 - RNA, 18 nt, Human
uuuuaaagacuuuuauga

SEQ ID NO: 1623390 - RNA, 21 nt, Human
uuuguucuggcucuuccaggc

SEQ ID NO: 1623391 - RNA, 16 nt, Human
uuuguauaaaauaauu

SEQ ID NO: 1623392 - RNA, 14 nt, Human
uuuguauaaaauaa

SEQ ID NO: 1623393 - RNA, 13 nt, Human
uuuguauaaaaua

SEQ ID NO: 1623394 - RNA, 19 nt, Human
uuuggugguuucagaaaug

SEQ ID NO: 1623395 - RNA, 19 nt, Human
uuugguuuucacauuggaa

SEQ ID NO: 1623396 - RNA, 21 nt, Human
uuuggaauuuugugcccccau

SEQ ID NO: 1623397 - RNA, 19 nt, Human
uuuggacaaaauggaauac

SEQ ID NO: 1623398 - RNA, 16 nt, Human
uuuggauaauaaggaa

SEQ ID NO: 1623399 - RNA, 20 nt, Human
uuuggagucagacagaugug

SEQ ID NO: 1623400 - RNA, 15 nt, Human
uuugcuuugugauuu

SEQ ID NO: 1623401 - RNA, 16 nt, Human
uuugcuuugugauuuu

SEQ ID NO: 1623402 - RNA, 14 nt, Human
uuuggaauuuugug

SEQ ID NO: 1623403 - RNA, 12 nt, Human
uuuggaaaauaa

SEQ ID NO: 1623404 - RNA, 22 nt, Human
uuuggaauuuuccuccuuucuc

SEQ ID NO: 1623405 - RNA, 15 nt, Human
uuugcaucugaaaau

SEQ ID NO: 1623406 - RNA, 16 nt, Human
guagcauccuggaaua

SEQ ID NO: 1623407 - RNA, 18 nt, Human
gcuauaggugcuacaaaa

SEQ ID NO: 1623408 - RNA, 15 nt, Human
guagagugugccuga

SEQ ID NO: 1623409 - RNA, 19 nt, Human
gcuauaggugcuacaaaaa

SEQ ID NO: 1623410 - RNA, 16 nt, Human
guagggcgggaggaug

SEQ ID NO: 1623411 - RNA, 22 nt, Human
guagggcgggaggauguucugg

SEQ ID NO: 1623412 - RNA, 21 nt, Human
guagggcgggaggauguucug

SEQ ID NO: 1623413 - RNA, 23 nt, Human
guagggcgggaggauguucuggg

SEQ ID NO: 1623414 - RNA, 21 nt, Human
guagcauuuguguugaagagg

SEQ ID NO: 1623415 - RNA, 17 nt, Human
guaguguuggagaagaa

SEQ ID NO: 1623416 - RNA, 14 nt, Human
guauaauuaacaug

SEQ ID NO: 1623417 - RNA, 13 nt, Human
guauaauuaacau

SEQ ID NO: 1623418 - RNA, 15 nt, Human
guaguguuggagaag

SEQ ID NO: 1623419 - RNA, 14 nt, Human
guaguguuggagaa

SEQ ID NO: 1623420 - RNA, 17 nt, Human
guauaauucacauugua

SEQ ID NO: 1623421 - RNA, 23 nt, Human
guauaauuaacauguuaaaccau

SEQ ID NO: 1623422 - RNA, 22 nt, Human
guauaauuaacauguuaaacca

SEQ ID NO: 1623423 - RNA, 19 nt, Human
guauaauuaacauguuaaa

SEQ ID NO: 1623424 - RNA, 17 nt, Human
guauaauuaacauguua

SEQ ID NO: 1623425 - RNA, 15 nt, Human
guauaauuaacaugu

SEQ ID NO: 1623426 - RNA, 16 nt, Human
guaggguuauaauaau

SEQ ID NO: 1623427 - RNA, 22 nt, Human
guagggugggccuucagggagu

SEQ ID NO: 1623428 - RNA, 17 nt, Human
guagggugggccuucag

SEQ ID NO: 1623429 - RNA, 14 nt, Human
guagggugggccuu

SEQ ID NO: 1623430 - RNA, 14 nt, Human
guagucaggugccu

SEQ ID NO: 1623431 - RNA, 19 nt, Human
guaugaauaaagacaccua

SEQ ID NO: 1623432 - RNA, 18 nt, Human
guaugaauaaagacaccu

SEQ ID NO: 1623433 - RNA, 13 nt, Human
guaugaggcauuu

SEQ ID NO: 1623434 - RNA, 15 nt, Human
guaugaggcauuugu

SEQ ID NO: 1623435 - RNA, 19 nt, Human
guaucuggugacuuuccuc

SEQ ID NO: 1623436 - RNA, 12 nt, Human
guaucuggugac

SEQ ID NO: 1623437 - RNA, 12 nt, Human
guaucugagcag

SEQ ID NO: 1623438 - RNA, 23 nt, Human
guaugaaagauggcugugccucu

SEQ ID NO: 1623439 - RNA, 22 nt, Human
guaugaaagauggcugugccuc

SEQ ID NO: 1623440 - RNA, 17 nt, Human
guauguuagugcaaauu

SEQ ID NO: 1623441 - RNA, 21 nt, Human
guaugaucacggcucacugca

SEQ ID NO: 1623442 - RNA, 22 nt, Human
guaugaucacggcucacugcag

SEQ ID NO: 1623443 - RNA, 20 nt, Human
guaugaucacggcucacugc

SEQ ID NO: 1623444 - RNA, 17 nt, Human
guaugaggcauuuguuu

SEQ ID NO: 1623445 - RNA, 20 nt, Human
guaugaggcauuuguuugaa

SEQ ID NO: 1623446 - RNA, 17 nt, Human
guauguugaagccuuug

SEQ ID NO: 1623447 - RNA, 22 nt, Human
guauaugucaagccauaauugu

SEQ ID NO: 1623448 - RNA, 16 nt, Human
guauauguugggugca

SEQ ID NO: 1623449 - RNA, 21 nt, Human
guauaugucucaggucccugc

SEQ ID NO: 1623450 - RNA, 15 nt, Human
guauaugucucaggu

SEQ ID NO: 1623451 - RNA, 13 nt, Human
guauaugucucag

SEQ ID NO: 1623452 - RNA, 14 nt, Human
guauagauuagaau

SEQ ID NO: 1623453 - RNA, 19 nt, Human
guauagaaccucuuugucu

SEQ ID NO: 1623454 - RNA, 15 nt, Human
gucaaugcagccccc

SEQ ID NO: 1623455 - RNA, 22 nt, Human
gucaauaaaauccauacauuug

SEQ ID NO: 1623456 - RNA, 15 nt, Human
gucaagugaaaaagg

SEQ ID NO: 1623457 - RNA, 23 nt, Human
gucaauaaaauccauacauuugu

SEQ ID NO: 1623458 - RNA, 19 nt, Human
guauuuuguuuuugucuua

SEQ ID NO: 1623459 - RNA, 13 nt, Human
guauuuuaaucac

SEQ ID NO: 1623460 - RNA, 20 nt, Human
guauuuuaaaagaaugauua

SEQ ID NO: 1623461 - RNA, 21 nt, Human
guauuaagcauauauuuuuau

SEQ ID NO: 1623462 - RNA, 18 nt, Human
guauuaagcauauauuuu

SEQ ID NO: 1623463 - RNA, 15 nt, Human
guauuaagcauauau

SEQ ID NO: 1623464 - RNA, 17 nt, Human
guauuaagcauauauuu

SEQ ID NO: 1623465 - RNA, 16 nt, Human
guauuaagcauauauu

SEQ ID NO: 1623466 - RNA, 14 nt, Human
guauuuuacuaaua

SEQ ID NO: 1623467 - RNA, 19 nt, Human
gucagcuccccucggagaa

SEQ ID NO: 1623468 - RNA, 22 nt, Human
gucagaugcugugcaaauguua

SEQ ID NO: 1623469 - RNA, 21 nt, Human
gucagaucugccuaaggacuu

SEQ ID NO: 1623470 - RNA, 20 nt, Human
gucagaucugccuaaggacu

SEQ ID NO: 1623471 - RNA, 19 nt, Human
gucagaucugccuaaggac

SEQ ID NO: 1623472 - RNA, 18 nt, Human
gucagaucugccuaagga

SEQ ID NO: 1623473 - RNA, 16 nt, Human
gucagaucugccuaag

SEQ ID NO: 1623474 - RNA, 14 nt, Human
gucagagccugcag

SEQ ID NO: 1623475 - RNA, 16 nt, Human
gucagagccugcaguu

SEQ ID NO: 1623476 - RNA, 15 nt, Human
gucagagccugcagu

SEQ ID NO: 1623477 - RNA, 16 nt, Human
gucacucuggcagcuc

SEQ ID NO: 1623478 - RNA, 14 nt, Human
gucacucuggcagc

SEQ ID NO: 1623479 - RNA, 13 nt, Human
gucacucuggcag

SEQ ID NO: 1623480 - RNA, 12 nt, Human
gucacucuggca

SEQ ID NO: 1623481 - RNA, 19 nt, Human
gucacucuggcagcucaga

SEQ ID NO: 1623482 - RNA, 17 nt, Human
gucacucuggcagcuca

SEQ ID NO: 1623483 - RNA, 22 nt, Human
gucacucuggcagcucagagag

SEQ ID NO: 1623484 - RNA, 18 nt, Human
gucaccccggccaccugc

SEQ ID NO: 1623485 - RNA, 17 nt, Human
gucaccccggccaccug

SEQ ID NO: 1623486 - RNA, 22 nt, Human
gucaccccggccaccugcggug

SEQ ID NO: 1623487 - RNA, 23 nt, Human
gucagcuccccucggagaagagc

SEQ ID NO: 1623488 - RNA, 22 nt, Human
gucagcuccccucggagaagag

SEQ ID NO: 1623489 - RNA, 21 nt, Human
gucagcuccccucggagaaga

SEQ ID NO: 1623490 - RNA, 13 nt, Human
gucaggaaagaga

SEQ ID NO: 1623491 - RNA, 21 nt, Human
gucauucagauaugauucaaa

SEQ ID NO: 1623492 - RNA, 21 nt, Human
gucccaccuuggcugcaggga

SEQ ID NO: 1623493 - RNA, 23 nt, Human
guccacccaggagccccgaggcc

SEQ ID NO: 1623494 - RNA, 12 nt, Human
guccacccagga

SEQ ID NO: 1623495 - RNA, 13 nt, Human
guccacccaggag

SEQ ID NO: 1623496 - RNA, 23 nt, Human
gucccaccuuggcugcagggagu

SEQ ID NO: 1623497 - RNA, 17 nt, Human
gucccaggcugagccuc

SEQ ID NO: 1623498 - RNA, 16 nt, Human
gucccaggcugagccu

SEQ ID NO: 1623499 - RNA, 15 nt, Human
gucccaggcugagcc

SEQ ID NO: 1623500 - RNA, 21 nt, Human
gucccaggcugagccucaguc

SEQ ID NO: 1623501 - RNA, 19 nt, Human
gucccaggcugagccucag

SEQ ID NO: 1623502 - RNA, 18 nt, Human
gucccaggcugagccuca

SEQ ID NO: 1623503 - RNA, 17 nt, Human
guccccaccgcagacag

SEQ ID NO: 1623504 - RNA, 17 nt, Human
gucccuaauaaagcugu

SEQ ID NO: 1623505 - RNA, 16 nt, Human
gucccuaauaaagcug

SEQ ID NO: 1623506 - RNA, 21 nt, Human
gucccugcacuugcagacucu

SEQ ID NO: 1623507 - RNA, 19 nt, Human
gucccugcacuugcagacu

SEQ ID NO: 1623508 - RNA, 16 nt, Human
gucccugcacuugcag

SEQ ID NO: 1623509 - RNA, 20 nt, Human
gucccuaauaaagcugugug

SEQ ID NO: 1623510 - RNA, 18 nt, Human
gucccuaauaaagcugug

SEQ ID NO: 1623511 - RNA, 23 nt, Human
gucccuaccgagucucuucucca

SEQ ID NO: 1623512 - RNA, 22 nt, Human
gucccuaccgagucucuucucc

SEQ ID NO: 1623513 - RNA, 21 nt, Human
gucccuaccgagucucuucuc

SEQ ID NO: 1623514 - RNA, 19 nt, Human
gucucacuauguugcccag

SEQ ID NO: 1623515 - RNA, 18 nt, Human
gucucacuauguugccca

SEQ ID NO: 1623516 - RNA, 18 nt, Human
gucgucaaagcugaaaug

SEQ ID NO: 1623517 - RNA, 23 nt, Human
gucggguuuuauuguuuaaaauc

SEQ ID NO: 1623518 - RNA, 16 nt, Human
gucgggcaugacacga

SEQ ID NO: 1623519 - RNA, 21 nt, Human
gucggaaaacaugcuacacac

SEQ ID NO: 1623520 - RNA, 19 nt, Human
guccuuaccagcagagcac

SEQ ID NO: 1623521 - RNA, 21 nt, Human
guccuuaccagcagagcaccu

SEQ ID NO: 1623522 - RNA, 14 nt, Human
gucccugccaaugg

SEQ ID NO: 1623523 - RNA, 11 nt, Human
gucccugccaa

SEQ ID NO: 1623524 - RNA, 15 nt, Human
gucccugccaaugga

SEQ ID NO: 1623525 - RNA, 13 nt, Human
gucucuugguccu

SEQ ID NO: 1623526 - RNA, 13 nt, Human
gucugacuguuuc

SEQ ID NO: 1623527 - RNA, 21 nt, Human
gucucuggauuauauuaugaa

SEQ ID NO: 1623528 - RNA, 18 nt, Human
gucucuucuccacuggau

SEQ ID NO: 1623529 - RNA, 17 nt, Human
gucucugguuccucccc

SEQ ID NO: 1623530 - RNA, 16 nt, Human
gucucugguuccuccc

SEQ ID NO: 1623531 - RNA, 17 nt, Human
gucucuggaauuugaaa

SEQ ID NO: 1623532 - RNA, 13 nt, Human
gucucugagcauu

SEQ ID NO: 1623533 - RNA, 19 nt, Human
gucucacucugucgcccag

SEQ ID NO: 1623534 - RNA, 18 nt, Human
gucucacucugucgccca

SEQ ID NO: 1623535 - RNA, 16 nt, Human
gucucacucugucgcc

SEQ ID NO: 1623536 - RNA, 15 nt, Human
gucucacucugucgc

SEQ ID NO: 1623537 - RNA, 22 nt, Human
gucucacucugucgcccagucu

SEQ ID NO: 1623538 - RNA, 14 nt, Human
gucucagauuuuau

SEQ ID NO: 1623539 - RNA, 16 nt, Human
gucucagauuuuauua

SEQ ID NO: 1623540 - RNA, 15 nt, Human
gucucagauuuuauu

SEQ ID NO: 1623541 - RNA, 21 nt, Human
gucucagauuuuauuauguaa

SEQ ID NO: 1623542 - RNA, 17 nt, Human
gucucagauuuuauuau

SEQ ID NO: 1623543 - RNA, 21 nt, Human
gucugugagaugcuagaacuc

SEQ ID NO: 1623544 - RNA, 17 nt, Human
gucugugagaugcuaga

SEQ ID NO: 1623545 - RNA, 16 nt, Human
gucugugagaugcuag

SEQ ID NO: 1623546 - RNA, 15 nt, Human
gucugugagaugcua

SEQ ID NO: 1623547 - RNA, 23 nt, Human
gucugugagaugcuagaacuccc

SEQ ID NO: 1623548 - RNA, 22 nt, Human
gucugugagaugcuagaacucc

SEQ ID NO: 1623549 - RNA, 18 nt, Human
gucugugccauuuuguau

SEQ ID NO: 1623550 - RNA, 14 nt, Human
gucuguucuuucca

SEQ ID NO: 1623551 - RNA, 17 nt, Human
gucuguucuuuccaaag

SEQ ID NO: 1623552 - RNA, 21 nt, Human
gucuugcaauggcagccuugg

SEQ ID NO: 1623553 - RNA, 20 nt, Human
gucuugcaauggcagccuug

SEQ ID NO: 1623554 - RNA, 23 nt, Human
gucuugcaauggcagccuuggca

SEQ ID NO: 1623555 - RNA, 20 nt, Human
gucuugccuuuuucauuauu

SEQ ID NO: 1623556 - RNA, 18 nt, Human
gucuugccuuuuucauua

SEQ ID NO: 1623557 - RNA, 17 nt, Human
gucuugccuuuuucauu

SEQ ID NO: 1623558 - RNA, 16 nt, Human
gucuugccuuuuucau

SEQ ID NO: 1623559 - RNA, 15 nt, Human
gucuugccuuuuuca

SEQ ID NO: 1623560 - RNA, 22 nt, Human
gucuugucucagauuuuauuau

SEQ ID NO: 1623561 - RNA, 20 nt, Human
gucuugucucagauuuuauu

SEQ ID NO: 1623562 - RNA, 15 nt, Human
gucuugucucagauu

SEQ ID NO: 1623563 - RNA, 17 nt, Human
gucuugaacuccuggcc

SEQ ID NO: 1623564 - RNA, 16 nt, Human
gucuugaacuccuggc

SEQ ID NO: 1623565 - RNA, 21 nt, Human
gucuuaaaaaguggaaaaaua

SEQ ID NO: 1623566 - RNA, 19 nt, Human
gucuugcaauggcagccuu

SEQ ID NO: 1623567 - RNA, 18 nt, Human
gucuugcaauggcagccu

SEQ ID NO: 1623568 - RNA, 17 nt, Human
gucuugcaauggcagcc

SEQ ID NO: 1623569 - RNA, 16 nt, Human
gucuugcaauggcagc

SEQ ID NO: 1623570 - RNA, 20 nt, Human
gucuugaacuccuggccuca

SEQ ID NO: 1623571 - RNA, 18 nt, Human
gucuugaacuccuggccu

SEQ ID NO: 1623572 - RNA, 21 nt, Human
gucuugaacuccuggccucaa

SEQ ID NO: 1623573 - RNA, 20 nt, Human
gugacaaggauugcuacugu

SEQ ID NO: 1623574 - RNA, 21 nt, Human
gugaaugaugauccuaggcau

SEQ ID NO: 1623575 - RNA, 13 nt, Human
gugaacacaucag

SEQ ID NO: 1623576 - RNA, 21 nt, Human
gugaacaaauuuacagagaca

SEQ ID NO: 1623577 - RNA, 15 nt, Human
gugaccucugccuga

SEQ ID NO: 1623578 - RNA, 14 nt, Human
gugaccucugccug

SEQ ID NO: 1623579 - RNA, 13 nt, Human
gugaccucugccu

SEQ ID NO: 1623580 - RNA, 15 nt, Human
gugacagaggcagcc

SEQ ID NO: 1623581 - RNA, 14 nt, Human
gugacagaggcagc

SEQ ID NO: 1623582 - RNA, 13 nt, Human
gugacagaggcag

SEQ ID NO: 1623583 - RNA, 12 nt, Human
gugacagaggca

SEQ ID NO: 1623584 - RNA, 14 nt, Human
gugagcuacaaaug

SEQ ID NO: 1623585 - RNA, 19 nt, Human
gugagccgagaucacgcca

SEQ ID NO: 1623586 - RNA, 17 nt, Human
gugaggaugaaaaaaua

SEQ ID NO: 1623587 - RNA, 18 nt, Human
gugaggagcuugaaaccc

SEQ ID NO: 1623588 - RNA, 20 nt, Human
gugagccacugcaccgggcc

SEQ ID NO: 1623589 - RNA, 15 nt, Human
gugagccacugcacc

SEQ ID NO: 1623590 - RNA, 19 nt, Human
gugauauaaguguguguuu

SEQ ID NO: 1623591 - RNA, 17 nt, Human
gugaguugauagcacag

SEQ ID NO: 1623592 - RNA, 15 nt, Human
gugauacaaugcugu

SEQ ID NO: 1623593 - RNA, 17 nt, Human
gugauacaaugcugugc

SEQ ID NO: 1623594 - RNA, 22 nt, Human
gugcauaccacuuuuguucuug

SEQ ID NO: 1623595 - RNA, 14 nt, Human
gugcaucucagccc

SEQ ID NO: 1623596 - RNA, 13 nt, Human
gugcaucucagcc

SEQ ID NO: 1623597 - RNA, 23 nt, Human
gugcaguggugcgaucuggguuc

SEQ ID NO: 1623598 - RNA, 20 nt, Human
gugcaguggugcgaucuggg

SEQ ID NO: 1623599 - RNA, 12 nt, Human
gugauuuucauu

SEQ ID NO: 1623600 - RNA, 13 nt, Human
gugauuuuuguaa

SEQ ID NO: 1623601 - RNA, 18 nt, Human
gugauuuuuguaauuuuu

SEQ ID NO: 1623602 - RNA, 24 nt, Human
gugauccacccaccucagccuccc

SEQ ID NO: 1623603 - RNA, 23 nt, Human
gugauccacccaccucagccucc

SEQ ID NO: 1623604 - RNA, 22 nt, Human
gugcacuaauguguaagacaaa

SEQ ID NO: 1623605 - RNA, 14 nt, Human
gugcggccuuuggc

SEQ ID NO: 1623606 - RNA, 14 nt, Human
gugcgccuacagga

SEQ ID NO: 1623607 - RNA, 17 nt, Human
gugcgcuaaacuuuucu

SEQ ID NO: 1623608 - RNA, 21 nt, Human
gugcgcuaaacuuuucugaua

SEQ ID NO: 1623609 - RNA, 12 nt, Human
gugcuaaggacu

SEQ ID NO: 1623610 - RNA, 20 nt, Human
gugcuaaggacuuguuagau

SEQ ID NO: 1623611 - RNA, 14 nt, Human
gugcuaaggacuug

SEQ ID NO: 1623612 - RNA, 13 nt, Human
gugcuaaggacuu

SEQ ID NO: 1623613 - RNA, 21 nt, Human
gugcgaucuggguucacugca

SEQ ID NO: 1623614 - RNA, 15 nt, Human
gugccuucagcucua

SEQ ID NO: 1623615 - RNA, 16 nt, Human
gugccaugugccaggu

SEQ ID NO: 1623616 - RNA, 14 nt, Human
gugccaugugccag

SEQ ID NO: 1623617 - RNA, 20 nt, Human
gugcccaagaauagaugcug

SEQ ID NO: 1623618 - RNA, 23 nt, Human
gugcccaagaauagaugcugacu

SEQ ID NO: 1623619 - RNA, 22 nt, Human
guguacauggaauaacauguaa

SEQ ID NO: 1623620 - RNA, 17 nt, Human
guguacauggaauaaca

SEQ ID NO: 1623621 - RNA, 18 nt, Human
gugucccugcacuugcag

SEQ ID NO: 1623622 - RNA, 16 nt, Human
gugucccugcacuugc

SEQ ID NO: 1623623 - RNA, 13 nt, Human
gugucccugcacu

SEQ ID NO: 1623624 - RNA, 21 nt, Human
guguaaguagauaggccaugg

SEQ ID NO: 1623625 - RNA, 21 nt, Human
guguaaguauucuuauuuaau

SEQ ID NO: 1623626 - RNA, 16 nt, Human
guggugacuuuggaua

SEQ ID NO: 1623627 - RNA, 19 nt, Human
guggugcgaucuggguuca

SEQ ID NO: 1623628 - RNA, 17 nt, Human
guguaagacaaaaagcu

SEQ ID NO: 1623629 - RNA, 17 nt, Human
guggugaccucugccug

SEQ ID NO: 1623630 - RNA, 14 nt, Human
guggugaccucugc

SEQ ID NO: 1623631 - RNA, 21 nt, Human
guggugagaggcauccaguau

SEQ ID NO: 1623632 - RNA, 15 nt, Human
guggugacuuuggau

SEQ ID NO: 1623633 - RNA, 13 nt, Human
guggugacuuugg

SEQ ID NO: 1623634 - RNA, 17 nt, Human
gugguagagugugccug

SEQ ID NO: 1623635 - RNA, 19 nt, Human
gugguaugaucacggcuca

SEQ ID NO: 1623636 - RNA, 18 nt, Human
gugguccuaaucuucuga

SEQ ID NO: 1623637 - RNA, 17 nt, Human
guggucccaccccacac

SEQ ID NO: 1623638 - RNA, 16 nt, Human
guggucccaccccaca

SEQ ID NO: 1623639 - RNA, 15 nt, Human
guggucccaccccac

SEQ ID NO: 1623640 - RNA, 14 nt, Human
guggucccacccca

SEQ ID NO: 1623641 - RNA, 21 nt, Human
gugcuacaaaaacacagcaag

SEQ ID NO: 1623642 - RNA, 14 nt, Human
guggcucacgccug

SEQ ID NO: 1623643 - RNA, 20 nt, Human
gugcuacaaaaacacagcaa

SEQ ID NO: 1623644 - RNA, 15 nt, Human
gugcuacaaaaacac

SEQ ID NO: 1623645 - RNA, 15 nt, Human
gugcuaauuuugaaa

SEQ ID NO: 1623646 - RNA, 13 nt, Human
gugcuaauuuuga

SEQ ID NO: 1623647 - RNA, 14 nt, Human
guggcugcuucaag

SEQ ID NO: 1623648 - RNA, 12 nt, Human
guggcugcuuca

SEQ ID NO: 1623649 - RNA, 20 nt, Human
guggcuccucccggugccca

SEQ ID NO: 1623650 - RNA, 13 nt, Human
guggcuccucccg

SEQ ID NO: 1623651 - RNA, 22 nt, Human
guggcuuaaaacaacacucaca

SEQ ID NO: 1623652 - RNA, 20 nt, Human
guggcuucccgcucagcccu

SEQ ID NO: 1623653 - RNA, 19 nt, Human
guggcuucccgcucagccc

SEQ ID NO: 1623654 - RNA, 18 nt, Human
guggcuucccgcucagcc

SEQ ID NO: 1623655 - RNA, 22 nt, Human
guggcugcuucaaggauccuga

SEQ ID NO: 1623656 - RNA, 19 nt, Human
guggcugcuucaaggaucc

SEQ ID NO: 1623657 - RNA, 16 nt, Human
guggcugcuucaagga

SEQ ID NO: 1623658 - RNA, 15 nt, Human
guggcugcuucaagg

SEQ ID NO: 1623659 - RNA, 23 nt, Human
guggcugcuucaaggauccugag

SEQ ID NO: 1623660 - RNA, 19 nt, Human
guggcuggguuggagggug

SEQ ID NO: 1623661 - RNA, 17 nt, Human
guggggcagcuugaggg

SEQ ID NO: 1623662 - RNA, 13 nt, Human
guggggcagcuug

SEQ ID NO: 1623663 - RNA, 23 nt, Human
guggguuucuaaagcugccagcc

SEQ ID NO: 1623664 - RNA, 18 nt, Human
guggggaccucaggccug

SEQ ID NO: 1623665 - RNA, 15 nt, Human
guggggaccucaggc

SEQ ID NO: 1623666 - RNA, 13 nt, Human
guggggaggggcu

SEQ ID NO: 1623667 - RNA, 15 nt, Human
gugggcuaguugggc

SEQ ID NO: 1623668 - RNA, 19 nt, Human
gugggccuucagggaguga

SEQ ID NO: 1623669 - RNA, 22 nt, Human
gugggcgugagaccugccccuc

SEQ ID NO: 1623670 - RNA, 21 nt, Human
gugggcgugagaccugccccu

SEQ ID NO: 1623671 - RNA, 18 nt, Human
gugggcgugagaccugcc

SEQ ID NO: 1623672 - RNA, 17 nt, Human
gugggcccaaugcacuu

SEQ ID NO: 1623673 - RNA, 15 nt, Human
gugggcauucaaaug

SEQ ID NO: 1623674 - RNA, 16 nt, Human
guuaaaagaugaaaau

SEQ ID NO: 1623675 - RNA, 14 nt, Human
guuaaaagaugaaa

SEQ ID NO: 1623676 - RNA, 20 nt, Human
guuaaaagaugaaaauauuu

SEQ ID NO: 1623677 - RNA, 22 nt, Human
guuaaaauaccagccaguaaau

SEQ ID NO: 1623678 - RNA, 18 nt, Human
guuaaaccaugggauaaa

SEQ ID NO: 1623679 - RNA, 21 nt, Human
guuaaaccaugggauaaaugc

SEQ ID NO: 1623680 - RNA, 16 nt, Human
guuacacuaaaaggug

SEQ ID NO: 1623681 - RNA, 15 nt, Human
guuacacuaaaaggu

SEQ ID NO: 1623682 - RNA, 18 nt, Human
guuaacugagugccuuuu

SEQ ID NO: 1623683 - RNA, 13 nt, Human
guuacagacaaag

SEQ ID NO: 1623684 - RNA, 13 nt, Human
guuacagaagccc

SEQ ID NO: 1623685 - RNA, 14 nt, Human
guguuacuaaguuu

SEQ ID NO: 1623686 - RNA, 12 nt, Human
guguuacuaagu

SEQ ID NO: 1623687 - RNA, 18 nt, Human
guguuaugacuccagaau

SEQ ID NO: 1623688 - RNA, 14 nt, Human
guguguuuuucaua

SEQ ID NO: 1623689 - RNA, 19 nt, Human
guguguuuuaaaaugagaa

SEQ ID NO: 1623690 - RNA, 16 nt, Human
guguguuuuaaaauga

SEQ ID NO: 1623691 - RNA, 13 nt, Human
guguguuuuaaaa

SEQ ID NO: 1623692 - RNA, 18 nt, Human
guguuuuucauaaagcag

SEQ ID NO: 1623693 - RNA, 13 nt, Human
guguucugugaua

SEQ ID NO: 1623694 - RNA, 14 nt, Human
guguccggucccug

SEQ ID NO: 1623695 - RNA, 23 nt, Human
gugucccugcacuugcagacucu

SEQ ID NO: 1623696 - RNA, 15 nt, Human
gugucgggcaugaca

SEQ ID NO: 1623697 - RNA, 14 nt, Human
gugucucuuggucc

SEQ ID NO: 1623698 - RNA, 17 nt, Human
gugucucccuucauccu

SEQ ID NO: 1623699 - RNA, 21 nt, Human
gugucucuugguccugcugca

SEQ ID NO: 1623700 - RNA, 20 nt, Human
gugucucuugguccugcugc

SEQ ID NO: 1623701 - RNA, 19 nt, Human
gugucucuugguccugcug

SEQ ID NO: 1623702 - RNA, 18 nt, Human
gugucucuugguccugcu

SEQ ID NO: 1623703 - RNA, 22 nt, Human
gugucucuugguccugcugcag

SEQ ID NO: 1623704 - RNA, 13 nt, Human
guguggagaagcg

SEQ ID NO: 1623705 - RNA, 21 nt, Human
guguggagaagcggcuggcag

SEQ ID NO: 1623706 - RNA, 12 nt, Human
guguguuuuaaa

SEQ ID NO: 1623707 - RNA, 15 nt, Human
guguguuucugaucu

SEQ ID NO: 1623708 - RNA, 22 nt, Human
gugugcucugaucauccacugu

SEQ ID NO: 1623709 - RNA, 15 nt, Human
gugugcucugaucau

SEQ ID NO: 1623710 - RNA, 12 nt, Human
gugugcucugau

SEQ ID NO: 1623711 - RNA, 19 nt, Human
gugugcucaggagcccugg

SEQ ID NO: 1623712 - RNA, 18 nt, Human
gugugcucaggagcccug

SEQ ID NO: 1623713 - RNA, 17 nt, Human
gugugcucaggagcccu

SEQ ID NO: 1623714 - RNA, 16 nt, Human
gugugcucaggagccc

SEQ ID NO: 1623715 - RNA, 23 nt, Human
guucaagugauucucaugccuca

SEQ ID NO: 1623716 - RNA, 20 nt, Human
guucaagcgauucuucugcu

SEQ ID NO: 1623717 - RNA, 16 nt, Human
guucaauucucauuug

SEQ ID NO: 1623718 - RNA, 23 nt, Human
guucaauucucauuugucacaca

SEQ ID NO: 1623719 - RNA, 17 nt, Human
guuauuauauuuacaaa

SEQ ID NO: 1623720 - RNA, 19 nt, Human
guucaagcgauucuucugc

SEQ ID NO: 1623721 - RNA, 19 nt, Human
guuauuaaaaaucucaaau

SEQ ID NO: 1623722 - RNA, 21 nt, Human
guuaugacuccagaauuuccc

SEQ ID NO: 1623723 - RNA, 19 nt, Human
guuaucugaagucagaucu

SEQ ID NO: 1623724 - RNA, 23 nt, Human
guuaccucugccucagaaaacaa

SEQ ID NO: 1623725 - RNA, 21 nt, Human
guuacauuuuuaagugcugca

SEQ ID NO: 1623726 - RNA, 23 nt, Human
guuaccauuuugggguacccacu

SEQ ID NO: 1623727 - RNA, 16 nt, Human
guuacccaaauuaaga

SEQ ID NO: 1623728 - RNA, 19 nt, Human
guuacauaagauaaaugug

SEQ ID NO: 1623729 - RNA, 18 nt, Human
guuacauaagauaaaugu

SEQ ID NO: 1623730 - RNA, 17 nt, Human
guuacagacaaagcgug

SEQ ID NO: 1623731 - RNA, 15 nt, Human
guuacagacaaagcg

SEQ ID NO: 1623732 - RNA, 19 nt, Human
guuaguuucuccaagcagg

SEQ ID NO: 1623733 - RNA, 16 nt, Human
guuaguuucuccaagc

SEQ ID NO: 1623734 - RNA, 22 nt, Human
guuaguuucuccaagcaggaca

SEQ ID NO: 1623735 - RNA, 15 nt, Human
guuacucagaauucu

SEQ ID NO: 1623736 - RNA, 22 nt, Human
guuacuaaguuuuuauggcuuu

SEQ ID NO: 1623737 - RNA, 13 nt, Human
guucagagcugcc

SEQ ID NO: 1623738 - RNA, 14 nt, Human
guucagagcugccc

SEQ ID NO: 1623739 - RNA, 23 nt, Human
guucagagcugcccucuccuggg

SEQ ID NO: 1623740 - RNA, 20 nt, Human
guucagagcugcccucuccu

SEQ ID NO: 1623741 - RNA, 22 nt, Human
guucagagcugcccucuccugg

SEQ ID NO: 1623742 - RNA, 15 nt, Human
guucagagcugcccu

SEQ ID NO: 1623743 - RNA, 16 nt, Human
guucagagcugcccuc

SEQ ID NO: 1623744 - RNA, 17 nt, Human
guucagagcugcccucu

SEQ ID NO: 1623745 - RNA, 19 nt, Human
guucagagcugcccucucc

SEQ ID NO: 1623746 - RNA, 19 nt, Human
guucacugcaaccuccgcc

SEQ ID NO: 1623747 - RNA, 19 nt, Human
guucacucuccauuuaaua

SEQ ID NO: 1623748 - RNA, 24 nt, Human
guucacucuacuuagcaugucccu

SEQ ID NO: 1623749 - RNA, 16 nt, Human
guucaucaaugaauga

SEQ ID NO: 1623750 - RNA, 17 nt, Human
guucaucauccuaagcu

SEQ ID NO: 1623751 - RNA, 13 nt, Human
guucaucuugaau

SEQ ID NO: 1623752 - RNA, 12 nt, Human
guucaucuugaa

SEQ ID NO: 1623753 - RNA, 18 nt, Human
guucaucuugaauuguaa

SEQ ID NO: 1623754 - RNA, 12 nt, Human
guucaugaaaga

SEQ ID NO: 1623755 - RNA, 23 nt, Human
guucauggaacgcguugaaauug

SEQ ID NO: 1623756 - RNA, 22 nt, Human
guucauggaacgcguugaaauu

SEQ ID NO: 1623757 - RNA, 14 nt, Human
guuccuaauccucu

SEQ ID NO: 1623758 - RNA, 22 nt, Human
guuccucauuagcauuuugcua

SEQ ID NO: 1623759 - RNA, 23 nt, Human
guuccuccccuccuccuggacuc

SEQ ID NO: 1623760 - RNA, 20 nt, Human
guuccaccaucaagccacca

SEQ ID NO: 1623761 - RNA, 17 nt, Human
guuccaccaucaagcca

SEQ ID NO: 1623762 - RNA, 21 nt, Human
guuccagcaauucuccugccu

SEQ ID NO: 1623763 - RNA, 20 nt, Human
guuccagcaauucuccugcc

SEQ ID NO: 1623764 - RNA, 23 nt, Human
guuccagcaauucuccugccuca

SEQ ID NO: 1623765 - RNA, 21 nt, Human
guugauggugguauguuuuca

SEQ ID NO: 1623766 - RNA, 20 nt, Human
guugauggugguauguuuuc

SEQ ID NO: 1623767 - RNA, 22 nt, Human
guugaauuuauuggcuuuucug

SEQ ID NO: 1623768 - RNA, 21 nt, Human
guugaauuuauuggcuuuucu

SEQ ID NO: 1623769 - RNA, 14 nt, Human
guugaagccuuugu

SEQ ID NO: 1623770 - RNA, 13 nt, Human
guugaagccuuug

SEQ ID NO: 1623771 - RNA, 14 nt, Human
guugaauuuauugg

SEQ ID NO: 1623772 - RNA, 16 nt, Human
guugaagacagagcua

SEQ ID NO: 1623773 - RNA, 18 nt, Human
guugaagagguuuuaaag

SEQ ID NO: 1623774 - RNA, 15 nt, Human
guugaaauuguaauu

SEQ ID NO: 1623775 - RNA, 20 nt, Human
guugaaauuguaauuauauc

SEQ ID NO: 1623776 - RNA, 16 nt, Human
guugaaauuguaauua

SEQ ID NO: 1623777 - RNA, 22 nt, Human
guugaaacggaugauuucuaug

SEQ ID NO: 1623778 - RNA, 21 nt, Human
guugaaacggaugauuucuau

SEQ ID NO: 1623779 - RNA, 15 nt, Human
guugcaggaccucag

SEQ ID NO: 1623780 - RNA, 14 nt, Human
guugcaacuuugua

SEQ ID NO: 1623781 - RNA, 16 nt, Human
guugcaacuuuguaua

SEQ ID NO: 1623782 - RNA, 18 nt, Human
guuggcaaaaaggcagga

SEQ ID NO: 1623783 - RNA, 14 nt, Human
guuggcaaaaaggc

SEQ ID NO: 1623784 - RNA, 23 nt, Human
guuggccaaagccaaagcuaggc

SEQ ID NO: 1623785 - RNA, 14 nt, Human
guuggccaguguga

SEQ ID NO: 1623786 - RNA, 19 nt, Human
guuggccaggcuggucuca

SEQ ID NO: 1623787 - RNA, 17 nt, Human
guuggccaggcuggucu

SEQ ID NO: 1623788 - RNA, 18 nt, Human
guuggccaggcuggucuc

SEQ ID NO: 1623789 - RNA, 19 nt, Human
guuggccaggcugcucuug

SEQ ID NO: 1623790 - RNA, 14 nt, Human
guuggccaggcugg

SEQ ID NO: 1623791 - RNA, 15 nt, Human
guuggccaggcuggu

SEQ ID NO: 1623792 - RNA, 13 nt, Human
guuggccaggcug

SEQ ID NO: 1623793 - RNA, 14 nt, Human
guuggccaggcugc

SEQ ID NO: 1623794 - RNA, 23 nt, Human
guugccagucaccccggccaccu

SEQ ID NO: 1623795 - RNA, 18 nt, Human
guugccagucaccccggc

SEQ ID NO: 1623796 - RNA, 17 nt, Human
guugccagucaccccgg

SEQ ID NO: 1623797 - RNA, 16 nt, Human
guugccagucaccccg

SEQ ID NO: 1623798 - RNA, 14 nt, Human
guugccagucaccc

SEQ ID NO: 1623799 - RNA, 13 nt, Human
guugccagucacc

SEQ ID NO: 1623800 - RNA, 14 nt, Human
guugcccaggcagg

SEQ ID NO: 1623801 - RNA, 15 nt, Human
guugcccaggcaggu

SEQ ID NO: 1623802 - RNA, 12 nt, Human
guugcccaggca

SEQ ID NO: 1623803 - RNA, 22 nt, Human
guugaaaagacuccaaagaaau

SEQ ID NO: 1623804 - RNA, 17 nt, Human
guugaaaagacuccaaa

SEQ ID NO: 1623805 - RNA, 23 nt, Human
guugaaaagacuccaaagaaaug

SEQ ID NO: 1623806 - RNA, 17 nt, Human
guugaaaaacagcugag

SEQ ID NO: 1623807 - RNA, 13 nt, Human
guucuuuccaaag

SEQ ID NO: 1623808 - RNA, 14 nt, Human
guucuuuccaaagu

SEQ ID NO: 1623809 - RNA, 18 nt, Human
guucuuuccaaaguacac

SEQ ID NO: 1623810 - RNA, 20 nt, Human
guucuuuccaaaguacacug

SEQ ID NO: 1623811 - RNA, 15 nt, Human
guucuuucuuccucu

SEQ ID NO: 1623812 - RNA, 14 nt, Human
guucuuucuuccuc

SEQ ID NO: 1623813 - RNA, 19 nt, Human
guucuuucuuccucugcug

SEQ ID NO: 1623814 - RNA, 18 nt, Human
guucuuucuuccucugcu

SEQ ID NO: 1623815 - RNA, 17 nt, Human
guucuuucuuccucugc

SEQ ID NO: 1623816 - RNA, 16 nt, Human
guucuuucuuccucug

SEQ ID NO: 1623817 - RNA, 18 nt, Human
guucuuucacccuuuucu

SEQ ID NO: 1623818 - RNA, 23 nt, Human
guucugggacacaguucaauucu

SEQ ID NO: 1623819 - RNA, 16 nt, Human
guucugggacacaguu

SEQ ID NO: 1623820 - RNA, 15 nt, Human
guucugggacacagu

SEQ ID NO: 1623821 - RNA, 14 nt, Human
guucugggacacag

SEQ ID NO: 1623822 - RNA, 12 nt, Human
guucugggacac

SEQ ID NO: 1623823 - RNA, 11 nt, Human
guucugggaca

SEQ ID NO: 1623824 - RNA, 20 nt, Human
guucuggcucuuccaggcug

SEQ ID NO: 1623825 - RNA, 16 nt, Human
guucuggcucuuccag

SEQ ID NO: 1623826 - RNA, 12 nt, Human
guucuggcucuu

SEQ ID NO: 1623827 - RNA, 23 nt, Human
guucuggcagaguugaagacaga

SEQ ID NO: 1623828 - RNA, 15 nt, Human
guucugaagaagaug

SEQ ID NO: 1623829 - RNA, 14 nt, Human
guucugaagaagau

SEQ ID NO: 1623830 - RNA, 13 nt, Human
guucugaagaaga

SEQ ID NO: 1623831 - RNA, 12 nt, Human
guucugaagaag

SEQ ID NO: 1623832 - RNA, 19 nt, Human
guucugauccuaguuccac

SEQ ID NO: 1623833 - RNA, 16 nt, Human
guucugcacacagcac

SEQ ID NO: 1623834 - RNA, 15 nt, Human
guucugcacacagca

SEQ ID NO: 1623835 - RNA, 17 nt, Human
guuccuuccucugagcc

SEQ ID NO: 1623836 - RNA, 19 nt, Human
guuccuuccucugagccuu

SEQ ID NO: 1623837 - RNA, 18 nt, Human
guuccuuccucugagccu

SEQ ID NO: 1623838 - RNA, 19 nt, Human
guugucugcaacucugaag

SEQ ID NO: 1623839 - RNA, 22 nt, Human
guugucugaagucacugcacag

SEQ ID NO: 1623840 - RNA, 19 nt, Human
guugucugaagucacugca

SEQ ID NO: 1623841 - RNA, 14 nt, Human
guugugguuaaucu

SEQ ID NO: 1623842 - RNA, 22 nt, Human
guuguggauuuaacagaaaugu

SEQ ID NO: 1623843 - RNA, 14 nt, Human
guuggccccugccc

SEQ ID NO: 1623844 - RNA, 13 nt, Human
guuggccccugcc

SEQ ID NO: 1623845 - RNA, 20 nt, Human
guuggccccugcccggcugc

SEQ ID NO: 1623846 - RNA, 12 nt, Human
guuggcuggggg

SEQ ID NO: 1623847 - RNA, 19 nt, Human
guuggcugggggccucagu

SEQ ID NO: 1623848 - RNA, 23 nt, Human
guuggcugggggccucagugcca

SEQ ID NO: 1623849 - RNA, 12 nt, Human
guugucagcuga

SEQ ID NO: 1623850 - RNA, 20 nt, Human
guuuauauaagcuuguauuc

SEQ ID NO: 1623851 - RNA, 20 nt, Human
guuuaggauguugaaaaagu

SEQ ID NO: 1623852 - RNA, 19 nt, Human
guuuaggaacuacugagga

SEQ ID NO: 1623853 - RNA, 21 nt, Human
guuuagcuggaaaaguauguu

SEQ ID NO: 1623854 - RNA, 20 nt, Human
guuuagcuggaaaaguaugu

SEQ ID NO: 1623855 - RNA, 20 nt, Human
guuguuugauucagacagcu

SEQ ID NO: 1623856 - RNA, 14 nt, Human
guuguuacauuuuu

SEQ ID NO: 1623857 - RNA, 15 nt, Human
guuguuacauuuuua

SEQ ID NO: 1623858 - RNA, 14 nt, Human
guuuagauaauaca

SEQ ID NO: 1623859 - RNA, 15 nt, Human
guuuagauaauacac

SEQ ID NO: 1623860 - RNA, 21 nt, Human
guuugauucagacagcugccu

SEQ ID NO: 1623861 - RNA, 20 nt, Human
guuugauucagacagcugcc

SEQ ID NO: 1623862 - RNA, 16 nt, Human
guuugauucagacagc

SEQ ID NO: 1623863 - RNA, 18 nt, Human
guuugagaucagccuggg

SEQ ID NO: 1623864 - RNA, 23 nt, Human
guuugauuaaauucuugcaaagu

SEQ ID NO: 1623865 - RNA, 17 nt, Human
guuugagaucagccugg

SEQ ID NO: 1623866 - RNA, 19 nt, Human
guuucuuuguaaugaaaac

SEQ ID NO: 1623867 - RNA, 18 nt, Human
guuucuuuguaaugaaaa

SEQ ID NO: 1623868 - RNA, 20 nt, Human
guuuuccaugaguccccugu

SEQ ID NO: 1623869 - RNA, 19 nt, Human
guuuuccaugaguccccug

SEQ ID NO: 1623870 - RNA, 13 nt, Human
guuuuccugaaga

SEQ ID NO: 1623871 - RNA, 20 nt, Human
guuuguuucugaaagggacg

SEQ ID NO: 1623872 - RNA, 16 nt, Human
guuuuaaaaugagaaa

SEQ ID NO: 1623873 - RNA, 15 nt, Human
guuuuaaaaugagaa

SEQ ID NO: 1623874 - RNA, 12 nt, Human
guuuucacucuu

SEQ ID NO: 1623875 - RNA, 11 nt, Human
guuuucacucu

SEQ ID NO: 1623876 - RNA, 17 nt, Human
guuuucaaaauaaaaau

SEQ ID NO: 1623877 - RNA, 20 nt, Human
guuuucaaaauuguuacaaa

SEQ ID NO: 1623878 - RNA, 17 nt, Human
guuuuaaaaugagaaau

SEQ ID NO: 1623879 - RNA, 21 nt, Human
uaaaaacaaagaaauuaugug

SEQ ID NO: 1623880 - RNA, 21 nt, Human
guuuuuaaggguuuguggaaa

SEQ ID NO: 1623881 - RNA, 18 nt, Human
uaaaaaugguuuaaaugg

SEQ ID NO: 1623882 - RNA, 19 nt, Human
uaaaaaugguuuaaauggu

SEQ ID NO: 1623883 - RNA, 22 nt, Human
uaaaacaagcacuaaacaaaga

SEQ ID NO: 1623884 - RNA, 15 nt, Human
uaaaacaacacucac

SEQ ID NO: 1623885 - RNA, 23 nt, Human
uaaaacacaacaucuuuuucuac

SEQ ID NO: 1623886 - RNA, 22 nt, Human
uaaaacacaacaucuuuuucua

SEQ ID NO: 1623887 - RNA, 17 nt, Human
uaaaacacaacaucuuu

SEQ ID NO: 1623888 - RNA, 19 nt, Human
uaaaacacuuccauaaucu

SEQ ID NO: 1623889 - RNA, 13 nt, Human
uaaaaccacagca

SEQ ID NO: 1623890 - RNA, 17 nt, Human
uaaaagauacaguuacu

SEQ ID NO: 1623891 - RNA, 20 nt, Human
uaaaagauacaguuacucag

SEQ ID NO: 1623892 - RNA, 14 nt, Human
uaaaagauacaguu

SEQ ID NO: 1623893 - RNA, 21 nt, Human
uaaaagauacaguuacucaga

SEQ ID NO: 1623894 - RNA, 13 nt, Human
uaaaaucauuucu

SEQ ID NO: 1623895 - RNA, 10 nt, Human
uaaaaucauu

SEQ ID NO: 1623896 - RNA, 12 nt, Human
uaaaaggugacc

SEQ ID NO: 1623897 - RNA, 19 nt, Human
uaaaaggugaccaaugaug

SEQ ID NO: 1623898 - RNA, 22 nt, Human
uaaaaucauuucugcaucagcu

SEQ ID NO: 1623899 - RNA, 18 nt, Human
uaaaaucauuucugcauc

SEQ ID NO: 1623900 - RNA, 17 nt, Human
uaaaauccauacauuug

SEQ ID NO: 1623901 - RNA, 15 nt, Human
uaaaauccauacauu

SEQ ID NO: 1623902 - RNA, 21 nt, Human
uaaaagguaugcaaucaaauc

SEQ ID NO: 1623903 - RNA, 12 nt, Human
uaaaaggagcca

SEQ ID NO: 1623904 - RNA, 14 nt, Human
uaaaguguuugaaa

SEQ ID NO: 1623905 - RNA, 17 nt, Human
uaaaggcuaccuuugua

SEQ ID NO: 1623906 - RNA, 14 nt, Human
uaaaggaauuuaaa

SEQ ID NO: 1623907 - RNA, 15 nt, Human
uaaaggcuaccuuug

SEQ ID NO: 1623908 - RNA, 20 nt, Human
uaaagccugaguuugcuuuc

SEQ ID NO: 1623909 - RNA, 14 nt, Human
uaaagcugaaaacu

SEQ ID NO: 1623910 - RNA, 12 nt, Human
uaaagaaaacug

SEQ ID NO: 1623911 - RNA, 16 nt, Human
uaaagcagcguuucua

SEQ ID NO: 1623912 - RNA, 17 nt, Human
uaaagcagcguuucuau

SEQ ID NO: 1623913 - RNA, 19 nt, Human
uaaagcagcguuucuauga

SEQ ID NO: 1623914 - RNA, 18 nt, Human
uaaagcaggcagaacuca

SEQ ID NO: 1623915 - RNA, 20 nt, Human
uaaagccauguuuauuacag

SEQ ID NO: 1623916 - RNA, 15 nt, Human
uaaagccauguuuau

SEQ ID NO: 1623917 - RNA, 13 nt, Human
uaaagccauguuu

SEQ ID NO: 1623918 - RNA, 11 nt, Human
uaaagccaugu

SEQ ID NO: 1623919 - RNA, 22 nt, Human
uaaacuugguuuuuaaaaaacu

SEQ ID NO: 1623920 - RNA, 13 nt, Human
uaaacuuaaucua

SEQ ID NO: 1623921 - RNA, 21 nt, Human
uaaacaagaccacguuucuaa

SEQ ID NO: 1623922 - RNA, 22 nt, Human
uaaacaagaccacguuucuaaa

SEQ ID NO: 1623923 - RNA, 20 nt, Human
uaaacaagaccacguuucua

SEQ ID NO: 1623924 - RNA, 16 nt, Human
uaaaaucuugaaaaug

SEQ ID NO: 1623925 - RNA, 18 nt, Human
uaaacacucuugaaaaau

SEQ ID NO: 1623926 - RNA, 17 nt, Human
uaaacacucuugaaaaa

SEQ ID NO: 1623927 - RNA, 15 nt, Human
uaaacacucuugaaa

SEQ ID NO: 1623928 - RNA, 23 nt, Human
uaaauugacacuuaaaaaugguu

SEQ ID NO: 1623929 - RNA, 22 nt, Human
uaaauuuaguauuuuguuucag

SEQ ID NO: 1623930 - RNA, 20 nt, Human
uaaauugacacuuaaaaaug

SEQ ID NO: 1623931 - RNA, 13 nt, Human
uaaauucuuucau

SEQ ID NO: 1623932 - RNA, 18 nt, Human
uaacaccaugauuaacca

SEQ ID NO: 1623933 - RNA, 16 nt, Human
uaaaugugcuuuuaaa

SEQ ID NO: 1623934 - RNA, 11 nt, Human
uaaauuauuuu

SEQ ID NO: 1623935 - RNA, 16 nt, Human
uaaaugugccuucauu

SEQ ID NO: 1623936 - RNA, 17 nt, Human
uaaauucuugcaaagua

SEQ ID NO: 1623937 - RNA, 18 nt, Human
uaaauucuugcaaaguau

SEQ ID NO: 1623938 - RNA, 22 nt, Human
uaaauucuugcaaaguaucccu

SEQ ID NO: 1623939 - RNA, 16 nt, Human
uaaauucuugcaaagu

SEQ ID NO: 1623940 - RNA, 20 nt, Human
uaaauggcuuccuggcaaua

SEQ ID NO: 1623941 - RNA, 14 nt, Human
uaaaugggggugca

SEQ ID NO: 1623942 - RNA, 17 nt, Human
uaaaugggggugcauuu

SEQ ID NO: 1623943 - RNA, 18 nt, Human
uaaaugggggugcauuug

SEQ ID NO: 1623944 - RNA, 19 nt, Human
uaaaugggggugcauuuga

SEQ ID NO: 1623945 - RNA, 22 nt, Human
uaaaugucucuuuaaugucaca

SEQ ID NO: 1623946 - RNA, 20 nt, Human
uaaaugucuaguuguaacac

SEQ ID NO: 1623947 - RNA, 17 nt, Human
uaaaugcccagccccuu

SEQ ID NO: 1623948 - RNA, 16 nt, Human
uaaaugcccagccccu

SEQ ID NO: 1623949 - RNA, 15 nt, Human
uaaaugcccagcccc

SEQ ID NO: 1623950 - RNA, 14 nt, Human
uaaaugcccagccc

SEQ ID NO: 1623951 - RNA, 16 nt, Human
uaaauggaaccacucu

SEQ ID NO: 1623952 - RNA, 11 nt, Human
uaaaugcugcu

SEQ ID NO: 1623953 - RNA, 17 nt, Human
uaaaugcugcuuuuucu

SEQ ID NO: 1623954 - RNA, 13 nt, Human
uaaaugcccagcc

SEQ ID NO: 1623955 - RNA, 23 nt, Human
uaaaugccaucaauaaaaaauua

SEQ ID NO: 1623956 - RNA, 16 nt, Human
uaaaugccaucaauaa

SEQ ID NO: 1623957 - RNA, 17 nt, Human
uaaaguugguaaaccuu

SEQ ID NO: 1623958 - RNA, 16 nt, Human
uaaaguugguaaaccu

SEQ ID NO: 1623959 - RNA, 15 nt, Human
uaacuggaaacuuca

SEQ ID NO: 1623960 - RNA, 19 nt, Human
uaagaaaaaggaugcacag

SEQ ID NO: 1623961 - RNA, 23 nt, Human
uaagaaaaaggaugcacagaguu

SEQ ID NO: 1623962 - RNA, 16 nt, Human
uaagaaaaaggaugca

SEQ ID NO: 1623963 - RNA, 18 nt, Human
uaagaaaaaggaugcaca

SEQ ID NO: 1623964 - RNA, 21 nt, Human
uaagaaaauaucacuugucaa

SEQ ID NO: 1623965 - RNA, 24 nt, Human
uaagaaagacuaucuaaauguuga

SEQ ID NO: 1623966 - RNA, 13 nt, Human
uaagagagaauga

SEQ ID NO: 1623967 - RNA, 19 nt, Human
uaagaaccuuuugagugcc

SEQ ID NO: 1623968 - RNA, 23 nt, Human
uaagagagaaugagagacacacu

SEQ ID NO: 1623969 - RNA, 14 nt, Human
uaagagagaaugag

SEQ ID NO: 1623970 - RNA, 17 nt, Human
uaaccaggggccaugaa

SEQ ID NO: 1623971 - RNA, 23 nt, Human
uaaccaguguuguggauuuaaca

SEQ ID NO: 1623972 - RNA, 16 nt, Human
uaaccacuucagcuga

SEQ ID NO: 1623973 - RNA, 13 nt, Human
uaaccagaucauu

SEQ ID NO: 1623974 - RNA, 11 nt, Human
uaacagaaaug

SEQ ID NO: 1623975 - RNA, 12 nt, Human
uaacagaaaugu

SEQ ID NO: 1623976 - RNA, 16 nt, Human
uaacuauguugauaaa

SEQ ID NO: 1623977 - RNA, 18 nt, Human
uaauaaggaaaaguuuaa

SEQ ID NO: 1623978 - RNA, 16 nt, Human
uaauaaggaaaaguuu

SEQ ID NO: 1623979 - RNA, 12 nt, Human
uaauaaagcugu

SEQ ID NO: 1623980 - RNA, 16 nt, Human
uaagugguguguguau

SEQ ID NO: 1623981 - RNA, 15 nt, Human
uaaguggugugugua

SEQ ID NO: 1623982 - RNA, 15 nt, Human
uaagugcugcauuua

SEQ ID NO: 1623983 - RNA, 16 nt, Human
uaagugcugcauuuaa

SEQ ID NO: 1623984 - RNA, 18 nt, Human
uaagugcugcauuuaaaa

SEQ ID NO: 1623985 - RNA, 22 nt, Human
uaagugcugcauuuaaaagaua

SEQ ID NO: 1623986 - RNA, 13 nt, Human
uaagugaaauaag

SEQ ID NO: 1623987 - RNA, 14 nt, Human
uaagugcugcauuu

SEQ ID NO: 1623988 - RNA, 23 nt, Human
uaagugaggaugaaaaaauaaca

SEQ ID NO: 1623989 - RNA, 12 nt, Human
uaagugagagag

SEQ ID NO: 1623990 - RNA, 22 nt, Human
uaagugauugcugguuuuaguu

SEQ ID NO: 1623991 - RNA, 20 nt, Human
uaagguggguacgggagggu

SEQ ID NO: 1623992 - RNA, 15 nt, Human
uaaggugugcucuga

SEQ ID NO: 1623993 - RNA, 17 nt, Human
uaaggguaucuggugac

SEQ ID NO: 1623994 - RNA, 15 nt, Human
uaagaggcagggucu

SEQ ID NO: 1623995 - RNA, 12 nt, Human
uaagaggcaggg

SEQ ID NO: 1623996 - RNA, 22 nt, Human
uaagaggcagggucucacucug

SEQ ID NO: 1623997 - RNA, 14 nt, Human
uaagcuauucagua

SEQ ID NO: 1623998 - RNA, 14 nt, Human
uaaggcaaucaugg

SEQ ID NO: 1623999 - RNA, 22 nt, Human
uaauguuucaaacauauauaac

SEQ ID NO: 1624000 - RNA, 20 nt, Human
uaauuaaguacuauguauca

SEQ ID NO: 1624001 - RNA, 17 nt, Human
uaauuaaguacuaugua

SEQ ID NO: 1624002 - RNA, 14 nt, Human
uaauuaaguacuau

SEQ ID NO: 1624003 - RNA, 21 nt, Human
uaauuaacauguuaaaccaug

SEQ ID NO: 1624004 - RNA, 23 nt, Human
uaaugauaacuggaaacuucagc

SEQ ID NO: 1624005 - RNA, 15 nt, Human
uaaugcgugcauacc

SEQ ID NO: 1624006 - RNA, 22 nt, Human
uaaugauaacuggaaacuucag

SEQ ID NO: 1624007 - RNA, 17 nt, Human
uaaugauaacuggaaac

SEQ ID NO: 1624008 - RNA, 19 nt, Human
uaaugcgugcauaccacuu

SEQ ID NO: 1624009 - RNA, 22 nt, Human
uaaugcgugcauaccacuuuug

SEQ ID NO: 1624010 - RNA, 23 nt, Human
uaaugcgugcauaccacuuuugu

SEQ ID NO: 1624011 - RNA, 15 nt, Human
uaauggggcggugag

SEQ ID NO: 1624012 - RNA, 14 nt, Human
uaauaauguuucaa

SEQ ID NO: 1624013 - RNA, 19 nt, Human
uaauaugcacacauuuuuu

SEQ ID NO: 1624014 - RNA, 16 nt, Human
uaauauuaaagccaug

SEQ ID NO: 1624015 - RNA, 15 nt, Human
uaauaugcacacauu

SEQ ID NO: 1624016 - RNA, 16 nt, Human
uaauaugcacacauuu

SEQ ID NO: 1624017 - RNA, 17 nt, Human
uaauaugcacacauuuu

SEQ ID NO: 1624018 - RNA, 18 nt, Human
uaauaugcacacauuuuu

SEQ ID NO: 1624019 - RNA, 20 nt, Human
uaauauuaaggaagacaaug

SEQ ID NO: 1624020 - RNA, 21 nt, Human
uaauauuaaagccauguuuau

SEQ ID NO: 1624021 - RNA, 20 nt, Human
uaauauuaaagccauguuua

SEQ ID NO: 1624022 - RNA, 17 nt, Human
uaauauuaaagccaugu

SEQ ID NO: 1624023 - RNA, 20 nt, Human
uaauccucuaggaggucucu

SEQ ID NO: 1624024 - RNA, 13 nt, Human
uaaucuaaaugga

SEQ ID NO: 1624025 - RNA, 23 nt, Human
uaaucugggccagaauuucaaac

SEQ ID NO: 1624026 - RNA, 18 nt, Human
uaaucugggccagaauuu

SEQ ID NO: 1624027 - RNA, 22 nt, Human
uaaucuggacuccucuguccag

SEQ ID NO: 1624028 - RNA, 21 nt, Human
uaaucuggacuccucugucca

SEQ ID NO: 1624029 - RNA, 20 nt, Human
uaaucuggacuccucugucc

SEQ ID NO: 1624030 - RNA, 19 nt, Human
uaaucuggacuccucuguc

SEQ ID NO: 1624031 - RNA, 15 nt, Human
uaaucuggacuccuc

SEQ ID NO: 1624032 - RNA, 18 nt, Human
uaaucuggacuccucugu

SEQ ID NO: 1624033 - RNA, 17 nt, Human
uaaucuggacuccucug

SEQ ID NO: 1624034 - RNA, 23 nt, Human
uauaucugaggaauucuguauag

SEQ ID NO: 1624035 - RNA, 19 nt, Human
uauauaacaaugcuguauu

SEQ ID NO: 1624036 - RNA, 17 nt, Human
uauauaacaaugcugua

SEQ ID NO: 1624037 - RNA, 21 nt, Human
uauagaaccucuuugucuaca

SEQ ID NO: 1624038 - RNA, 20 nt, Human
uauagaaccucuuugucuac

SEQ ID NO: 1624039 - RNA, 14 nt, Human
uaucaaaagaaaga

SEQ ID NO: 1624040 - RNA, 19 nt, Human
uaucaggugcugccaucca

SEQ ID NO: 1624041 - RNA, 20 nt, Human
uaucaggugcugccauccag

SEQ ID NO: 1624042 - RNA, 16 nt, Human
uauaugcuucuguuuu

SEQ ID NO: 1624043 - RNA, 14 nt, Human
uauaugcuucuguu

SEQ ID NO: 1624044 - RNA, 20 nt, Human
uauauuugaaauauugacuu

SEQ ID NO: 1624045 - RNA, 21 nt, Human
uauauuuuuuguuaaaugauu

SEQ ID NO: 1624046 - RNA, 20 nt, Human
uauauuuuuuucugaaauuu

SEQ ID NO: 1624047 - RNA, 19 nt, Human
uauauuuuuuucugaaauu

SEQ ID NO: 1624048 - RNA, 16 nt, Human
uauauuuuuuucugaa

SEQ ID NO: 1624049 - RNA, 16 nt, Human
uauauuuucauucucc

SEQ ID NO: 1624050 - RNA, 17 nt, Human
uaggugugggggaagca

SEQ ID NO: 1624051 - RNA, 13 nt, Human
uagguguggggga

SEQ ID NO: 1624052 - RNA, 19 nt, Human
uaggugugacugaauuucu

SEQ ID NO: 1624053 - RNA, 21 nt, Human
uaggugugacugaauuucuuu

SEQ ID NO: 1624054 - RNA, 23 nt, Human
uaggugugacugaauuucuuuug

SEQ ID NO: 1624055 - RNA, 17 nt, Human
uaguaugaggcauuugu

SEQ ID NO: 1624056 - RNA, 18 nt, Human
uaguaugaggcauuuguu

SEQ ID NO: 1624057 - RNA, 22 nt, Human
uaggugcuacaaaaacacagca

SEQ ID NO: 1624058 - RNA, 20 nt, Human
uaggugcuacaaaaacacag

SEQ ID NO: 1624059 - RNA, 23 nt, Human
uaggugcuacaaaaacacagcaa

SEQ ID NO: 1624060 - RNA, 16 nt, Human
uaggugacagagugag

SEQ ID NO: 1624061 - RNA, 11 nt, Human
uaggugacaga

SEQ ID NO: 1624062 - RNA, 11 nt, Human
uagggaaaaac

SEQ ID NO: 1624063 - RNA, 22 nt, Human
uagcuggucuuauuuguaaagc

SEQ ID NO: 1624064 - RNA, 17 nt, Human
uaguauuguccaggucu

SEQ ID NO: 1624065 - RNA, 16 nt, Human
uaguaugguggcuggg

SEQ ID NO: 1624066 - RNA, 20 nt, Human
uaguggcuuaaaacaacacu

SEQ ID NO: 1624067 - RNA, 22 nt, Human
uaguuguuugauucagacagcu

SEQ ID NO: 1624068 - RNA, 21 nt, Human
uaguuguuugauucagacagc

SEQ ID NO: 1624069 - RNA, 20 nt, Human
uaguuguuugauucagacag

SEQ ID NO: 1624070 - RNA, 16 nt, Human
uaguuugauuaaauuc

SEQ ID NO: 1624071 - RNA, 21 nt, Human
uaguuugauuaaauucuugca

SEQ ID NO: 1624072 - RNA, 15 nt, Human
uaguuugauuaaauu

SEQ ID NO: 1624073 - RNA, 15 nt, Human
uauaaacuuuaccuu

SEQ ID NO: 1624074 - RNA, 16 nt, Human
uauaaacuuuaccuuu

SEQ ID NO: 1624075 - RNA, 17 nt, Human
uauaaacuuuaccuuuu

SEQ ID NO: 1624076 - RNA, 18 nt, Human
uauaaacuuuaccuuuuu

SEQ ID NO: 1624077 - RNA, 13 nt, Human
uauaaacuuuacc

SEQ ID NO: 1624078 - RNA, 14 nt, Human
uauaaacuuuaccu

SEQ ID NO: 1624079 - RNA, 11 nt, Human
uauaaacuuua

SEQ ID NO: 1624080 - RNA, 18 nt, Human
uauaaaccgaacugaugu

SEQ ID NO: 1624081 - RNA, 16 nt, Human
uagccuaggugacaga

SEQ ID NO: 1624082 - RNA, 16 nt, Human
uagccccucuccugga

SEQ ID NO: 1624083 - RNA, 19 nt, Human
uagcugggacuacaggcac

SEQ ID NO: 1624084 - RNA, 17 nt, Human
uagcugggacuacaggc

SEQ ID NO: 1624085 - RNA, 15 nt, Human
uagcugggacuacag

SEQ ID NO: 1624086 - RNA, 21 nt, Human
uagcucaggugucccugcacu

SEQ ID NO: 1624087 - RNA, 20 nt, Human
uagcucaggugucccugcac

SEQ ID NO: 1624088 - RNA, 12 nt, Human
uagcucauucuc

SEQ ID NO: 1624089 - RNA, 20 nt, Human
uagccugugccucugggacu

SEQ ID NO: 1624090 - RNA, 18 nt, Human
uagccugugccucuggga

SEQ ID NO: 1624091 - RNA, 14 nt, Human
uagauaggccaugg

SEQ ID NO: 1624092 - RNA, 16 nt, Human
uagauacuguaucaug

SEQ ID NO: 1624093 - RNA, 15 nt, Human
uagauuagaauucug

SEQ ID NO: 1624094 - RNA, 14 nt, Human
uagauuagaauucu

SEQ ID NO: 1624095 - RNA, 20 nt, Human
uagauuagaauucuguauag

SEQ ID NO: 1624096 - RNA, 19 nt, Human
uagauuagaauucuguaua

SEQ ID NO: 1624097 - RNA, 17 nt, Human
uagauuagaauucugua

SEQ ID NO: 1624098 - RNA, 16 nt, Human
uagauuagaauucugu

SEQ ID NO: 1624099 - RNA, 20 nt, Human
uagauuagagaguguugaaa

SEQ ID NO: 1624100 - RNA, 11 nt, Human
uagcagggaaa

SEQ ID NO: 1624101 - RNA, 16 nt, Human
uagcauacguacacau

SEQ ID NO: 1624102 - RNA, 17 nt, Human
uagcauacguacacauu

SEQ ID NO: 1624103 - RNA, 18 nt, Human
uagcauacguacacauuu

SEQ ID NO: 1624104 - RNA, 19 nt, Human
uagcauacguacacauuuu

SEQ ID NO: 1624105 - RNA, 18 nt, Human
uagcauccuggaauaucu

SEQ ID NO: 1624106 - RNA, 16 nt, Human
uagcauccuggaauau

SEQ ID NO: 1624107 - RNA, 15 nt, Human
uagcauccuggaaua

SEQ ID NO: 1624108 - RNA, 13 nt, Human
uagcauccuggaa

SEQ ID NO: 1624109 - RNA, 18 nt, Human
uagaauuaacacaugauc

SEQ ID NO: 1624110 - RNA, 23 nt, Human
uagaauuaguggcacuugcuuuu

SEQ ID NO: 1624111 - RNA, 16 nt, Human
uagaauuaacacauga

SEQ ID NO: 1624112 - RNA, 15 nt, Human
uagaauuaacacaug

SEQ ID NO: 1624113 - RNA, 23 nt, Human
uagaauaccacaggaaccacaag

SEQ ID NO: 1624114 - RNA, 14 nt, Human
uacuuguggacaca

SEQ ID NO: 1624115 - RNA, 14 nt, Human
uagaguugauacua

SEQ ID NO: 1624116 - RNA, 17 nt, Human
uagaguugauacuacag

SEQ ID NO: 1624117 - RNA, 12 nt, Human
uagagugggagc

SEQ ID NO: 1624118 - RNA, 14 nt, Human
uagagguucaaaga

SEQ ID NO: 1624119 - RNA, 15 nt, Human
uagagguucaaagau

SEQ ID NO: 1624120 - RNA, 11 nt, Human
uagagacaggg

SEQ ID NO: 1624121 - RNA, 22 nt, Human
uagagaaggacccggaggggcc

SEQ ID NO: 1624122 - RNA, 13 nt, Human
uagagaaggaccc

SEQ ID NO: 1624123 - RNA, 20 nt, Human
uagacccacuggacucaccu

SEQ ID NO: 1624124 - RNA, 21 nt, Human
uagaauucuguauagauuaga

SEQ ID NO: 1624125 - RNA, 16 nt, Human
uagaauucuguauaga

SEQ ID NO: 1624126 - RNA, 15 nt, Human
uagaauucuguauag

SEQ ID NO: 1624127 - RNA, 14 nt, Human
uagaauucuguaua

SEQ ID NO: 1624128 - RNA, 13 nt, Human
uagaauucuguau

SEQ ID NO: 1624129 - RNA, 11 nt, Human
uagaauucugu

SEQ ID NO: 1624130 - RNA, 20 nt, Human
uagacuggugacugauucuu

SEQ ID NO: 1624131 - RNA, 23 nt, Human
uagacuggugacugauucuucag

SEQ ID NO: 1624132 - RNA, 21 nt, Human
uagacuggugacugauucuuc

SEQ ID NO: 1624133 - RNA, 22 nt, Human
uaccaaaaaucucaauauuuca

SEQ ID NO: 1624134 - RNA, 23 nt, Human
uacauuuuuaagugcugcauuua

SEQ ID NO: 1624135 - RNA, 22 nt, Human
uaccuaacgaaguauccuucag

SEQ ID NO: 1624136 - RNA, 22 nt, Human
uaccgagucucuucuccacugg

SEQ ID NO: 1624137 - RNA, 16 nt, Human
uacccagcgagcccug

SEQ ID NO: 1624138 - RNA, 17 nt, Human
uaccgagucucuucucc

SEQ ID NO: 1624139 - RNA, 21 nt, Human
uaccgagucucuucuccacug

SEQ ID NO: 1624140 - RNA, 18 nt, Human
uaccgagucucuucucca

SEQ ID NO: 1624141 - RNA, 16 nt, Human
uaccuaucaucuuaag

SEQ ID NO: 1624142 - RNA, 15 nt, Human
uaccuacauacaauu

SEQ ID NO: 1624143 - RNA, 17 nt, Human
uacuaaccagcagaaau

SEQ ID NO: 1624144 - RNA, 23 nt, Human
uacuaaaauggacuguggugacu

SEQ ID NO: 1624145 - RNA, 22 nt, Human
uacuaauaaaauuuaaaagucu

SEQ ID NO: 1624146 - RNA, 21 nt, Human
uacuaauagacaauuuauuau

SEQ ID NO: 1624147 - RNA, 14 nt, Human
uacuaaggaaucuu

SEQ ID NO: 1624148 - RNA, 21 nt, Human
uacgaaaagaggggaagagac

SEQ ID NO: 1624149 - RNA, 18 nt, Human
uacgaaaagaggggaaga

SEQ ID NO: 1624150 - RNA, 17 nt, Human
uacuaaaauggacugug

SEQ ID NO: 1624151 - RNA, 13 nt, Human
uaccuuuuuuaua

SEQ ID NO: 1624152 - RNA, 16 nt, Human
uaccuuuuuuauacau

SEQ ID NO: 1624153 - RNA, 17 nt, Human
uaccuuuuuuauacaua

SEQ ID NO: 1624154 - RNA, 13 nt, Human
uaccuuuuuuaga

SEQ ID NO: 1624155 - RNA, 19 nt, Human
uaccuuuuuuagaguugau

SEQ ID NO: 1624156 - RNA, 22 nt, Human
uaccuuuuuuagaguugauacu

SEQ ID NO: 1624157 - RNA, 21 nt, Human
uaccucuugagccuugaacuu

SEQ ID NO: 1624158 - RNA, 18 nt, Human
uaccucggugccuuccuc

SEQ ID NO: 1624159 - RNA, 13 nt, Human
uacuuguggacac

SEQ ID NO: 1624160 - RNA, 20 nt, Human
uacuugcucuugaugccugg

SEQ ID NO: 1624161 - RNA, 19 nt, Human
uacuugcucuugaugccug

SEQ ID NO: 1624162 - RNA, 18 nt, Human
uacuugcucuugaugccu

SEQ ID NO: 1624163 - RNA, 14 nt, Human
uacuugcucuugau

SEQ ID NO: 1624164 - RNA, 13 nt, Human
uacuugcucuuga

SEQ ID NO: 1624165 - RNA, 23 nt, Human
uacugucagcuccccucggagaa

SEQ ID NO: 1624166 - RNA, 16 nt, Human
uacuguccuacccacc

SEQ ID NO: 1624167 - RNA, 21 nt, Human
uacugucuucaguaagccgug

SEQ ID NO: 1624168 - RNA, 22 nt, Human
uacuacaguccucccaucucac

SEQ ID NO: 1624169 - RNA, 13 nt, Human
uacuacaguuugu

SEQ ID NO: 1624170 - RNA, 14 nt, Human
uacuacaguuuguu

SEQ ID NO: 1624171 - RNA, 20 nt, Human
uacuacaguuuguuaguaug

SEQ ID NO: 1624172 - RNA, 18 nt, Human
uacucgaguuacagacaa

SEQ ID NO: 1624173 - RNA, 22 nt, Human
uacucgaguuacagacaaagcg

SEQ ID NO: 1624174 - RNA, 12 nt, Human
uacuccucccag

SEQ ID NO: 1624175 - RNA, 12 nt, Human
uacucccaucug

SEQ ID NO: 1624176 - RNA, 15 nt, Human
uacuccccuccuuga

SEQ ID NO: 1624177 - RNA, 16 nt, Human
uacucuacccucuuag

SEQ ID NO: 1624178 - RNA, 21 nt, Human
uacugccuauuuuaauaaaca

SEQ ID NO: 1624179 - RNA, 14 nt, Human
uacugccuauuuua

SEQ ID NO: 1624180 - RNA, 22 nt, Human
uacugcccaggccugccuguuc

SEQ ID NO: 1624181 - RNA, 21 nt, Human
uacugcccaggccugccuguu

SEQ ID NO: 1624182 - RNA, 20 nt, Human
uacugcccaggccugccugu

SEQ ID NO: 1624183 - RNA, 19 nt, Human
uacugcccaggccugccug

SEQ ID NO: 1624184 - RNA, 14 nt, Human
uacaggauuugaaa

SEQ ID NO: 1624185 - RNA, 20 nt, Human
uacaggaugaugacuaugga

SEQ ID NO: 1624186 - RNA, 23 nt, Human
uacaguucggugagcuacaaaug

SEQ ID NO: 1624187 - RNA, 15 nt, Human
uacaggagugagcac

SEQ ID NO: 1624188 - RNA, 22 nt, Human
uacaggaaguacuggagaaaau

SEQ ID NO: 1624189 - RNA, 15 nt, Human
uacaggaaguacugg

SEQ ID NO: 1624190 - RNA, 14 nt, Human
uacaggaaguacug

SEQ ID NO: 1624191 - RNA, 19 nt, Human
uacaguugaaaaacagcug

SEQ ID NO: 1624192 - RNA, 17 nt, Human
uacaguugaaaaacagc

SEQ ID NO: 1624193 - RNA, 21 nt, Human
uacagcuugaccgugaggcca

SEQ ID NO: 1624194 - RNA, 20 nt, Human
uacaguugaaaaacagcuga

SEQ ID NO: 1624195 - RNA, 18 nt, Human
uacaguuuguuaguauga

SEQ ID NO: 1624196 - RNA, 13 nt, Human
uacagcugccugc

SEQ ID NO: 1624197 - RNA, 14 nt, Human
uacagcugccugca

SEQ ID NO: 1624198 - RNA, 13 nt, Human
uacaggaaguacu

SEQ ID NO: 1624199 - RNA, 18 nt, Human
uacaggaagguagaaaua

SEQ ID NO: 1624200 - RNA, 20 nt, Human
uacagcuugaccgugaggcc

SEQ ID NO: 1624201 - RNA, 23 nt, Human
uacacugugcugagucugaaggc

SEQ ID NO: 1624202 - RNA, 22 nt, Human
uacacugugcugagucugaagg

SEQ ID NO: 1624203 - RNA, 20 nt, Human
uacacuguuucaaacuuuac

SEQ ID NO: 1624204 - RNA, 16 nt, Human
uacacuuacacuuuau

SEQ ID NO: 1624205 - RNA, 22 nt, Human
uacacuguuucaaacuuuacua

SEQ ID NO: 1624206 - RNA, 18 nt, Human
uacagcuaaucagcauuc

SEQ ID NO: 1624207 - RNA, 16 nt, Human
uacagcuaaucagcau

SEQ ID NO: 1624208 - RNA, 17 nt, Human
uacauaagauaaaugug

SEQ ID NO: 1624209 - RNA, 16 nt, Human
uacauaagauaaaugu

SEQ ID NO: 1624210 - RNA, 16 nt, Human
uacaugaaaacacauu

SEQ ID NO: 1624211 - RNA, 17 nt, Human
uacaugaaaacacauuu

SEQ ID NO: 1624212 - RNA, 18 nt, Human
uacaugaaaacacauuuu

SEQ ID NO: 1624213 - RNA, 19 nt, Human
uacaugaaaacacauuuuu

SEQ ID NO: 1624214 - RNA, 23 nt, Human
uacaugaaaacacauuuuucuua

SEQ ID NO: 1624215 - RNA, 19 nt, Human
uacaguuuguuaguaugag

SEQ ID NO: 1624216 - RNA, 21 nt, Human
uacaguuuguuaguaugaggc

SEQ ID NO: 1624217 - RNA, 16 nt, Human
uacauaaacaaguccu

SEQ ID NO: 1624218 - RNA, 22 nt, Human
uacauggaauaacauguaauua

SEQ ID NO: 1624219 - RNA, 19 nt, Human
uacauggaauaacauguaa

SEQ ID NO: 1624220 - RNA, 18 nt, Human
uacauggaauaacaugua

SEQ ID NO: 1624221 - RNA, 14 nt, Human
uacauggaauaaca

SEQ ID NO: 1624222 - RNA, 19 nt, Human
uacauuuuuaagugcugca

SEQ ID NO: 1624223 - RNA, 22 nt, Human
uacauuuuuaagugcugcauuu

SEQ ID NO: 1624224 - RNA, 14 nt, Human
uacauuuuuaagug

SEQ ID NO: 1624225 - RNA, 21 nt, Human
uacauggcuggagcuagaauu

SEQ ID NO: 1624226 - RNA, 13 nt, Human
uaauuuugugaag

SEQ ID NO: 1624227 - RNA, 17 nt, Human
uaauuuuuauauuugaa

SEQ ID NO: 1624228 - RNA, 16 nt, Human
uaauuuuuauauuuga

SEQ ID NO: 1624229 - RNA, 12 nt, Human
uaauuuuuauau

SEQ ID NO: 1624230 - RNA, 18 nt, Human
uaauuuugugaagcaaaa

SEQ ID NO: 1624231 - RNA, 18 nt, Human
uacaaaguagaagucuua

SEQ ID NO: 1624232 - RNA, 14 nt, Human
uacaaaguagaagu

SEQ ID NO: 1624233 - RNA, 12 nt, Human
uacaaaguauua

SEQ ID NO: 1624234 - RNA, 14 nt, Human
uacaaaguauuaag

SEQ ID NO: 1624235 - RNA, 13 nt, Human
uacaaaguauuaa

SEQ ID NO: 1624236 - RNA, 19 nt, Human
uacaaaguauuaagcauau

SEQ ID NO: 1624237 - RNA, 18 nt, Human
uacaaaguauuaagcaua

SEQ ID NO: 1624238 - RNA, 16 nt, Human
uacaaaguauuaagca

SEQ ID NO: 1624239 - RNA, 15 nt, Human
uacaaaguauuaagc

SEQ ID NO: 1624240 - RNA, 16 nt, Human
uacacacucaaaucaa

SEQ ID NO: 1624241 - RNA, 17 nt, Human
uacacacucaaaucaag

SEQ ID NO: 1624242 - RNA, 15 nt, Human
uacacacugcauguu

SEQ ID NO: 1624243 - RNA, 17 nt, Human
uacacacugcauguuug

SEQ ID NO: 1624244 - RNA, 21 nt, Human
uacacugugcugagucugaag

SEQ ID NO: 1624245 - RNA, 11 nt, Human
uacacacacac

SEQ ID NO: 1624246 - RNA, 17 nt, Human
uacaauuuuguuucugu

SEQ ID NO: 1624247 - RNA, 16 nt, Human
uacaauuuuguuucug

SEQ ID NO: 1624248 - RNA, 15 nt, Human
uacaauuuuguuucu

SEQ ID NO: 1624249 - RNA, 12 nt, Human
uacaauuuuguu

SEQ ID NO: 1624250 - RNA, 18 nt, Human
ugaaggccccgcccaggc

SEQ ID NO: 1624251 - RNA, 16 nt, Human
ugaagcuuuuauguga

SEQ ID NO: 1624252 - RNA, 21 nt, Human
ugaagcuuuuaugugaaacau

SEQ ID NO: 1624253 - RNA, 20 nt, Human
ugaaggccccgcccaggcuu

SEQ ID NO: 1624254 - RNA, 19 nt, Human
ugaaggccccgcccaggcu

SEQ ID NO: 1624255 - RNA, 19 nt, Human
ugaagagguuuuaaagcuu

SEQ ID NO: 1624256 - RNA, 21 nt, Human
ugaagagguuuuaaagcuucc

SEQ ID NO: 1624257 - RNA, 20 nt, Human
ugaagagguuuuaaagcuuc

SEQ ID NO: 1624258 - RNA, 20 nt, Human
ugaagacucauucuucugua

SEQ ID NO: 1624259 - RNA, 19 nt, Human
ugaagacucauucuucugu

SEQ ID NO: 1624260 - RNA, 18 nt, Human
ugaacuugaaauuugaau

SEQ ID NO: 1624261 - RNA, 14 nt, Human
ugaacuugaaauuu

SEQ ID NO: 1624262 - RNA, 13 nt, Human
ugaacuugaaauu

SEQ ID NO: 1624263 - RNA, 13 nt, Human
ugaaacauguuuc

SEQ ID NO: 1624264 - RNA, 16 nt, Human
ugaaacacuuugcaua

SEQ ID NO: 1624265 - RNA, 16 nt, Human
ugaaucuuggugucua

SEQ ID NO: 1624266 - RNA, 20 nt, Human
ugaaugaauggcuaagcaaa

SEQ ID NO: 1624267 - RNA, 15 nt, Human
ugaaugaauggcuaa

SEQ ID NO: 1624268 - RNA, 14 nt, Human
ugaaugcauaaaau

SEQ ID NO: 1624269 - RNA, 21 nt, Human
ugaaggcuggguucugauccu

SEQ ID NO: 1624270 - RNA, 20 nt, Human
ugaaggcuggguucugaucc

SEQ ID NO: 1624271 - RNA, 23 nt, Human
ugacaaggauugcuacuguccua

SEQ ID NO: 1624272 - RNA, 13 nt, Human
ugacagacacagg

SEQ ID NO: 1624273 - RNA, 16 nt, Human
ugacagacacaggccc

SEQ ID NO: 1624274 - RNA, 14 nt, Human
ugacagacacaggc

SEQ ID NO: 1624275 - RNA, 15 nt, Human
ugacacacagcucug

SEQ ID NO: 1624276 - RNA, 14 nt, Human
ugacacacagcucu

SEQ ID NO: 1624277 - RNA, 14 nt, Human
ugaauuacauuugu

SEQ ID NO: 1624278 - RNA, 13 nt, Human
ugaauuguaagga

SEQ ID NO: 1624279 - RNA, 21 nt, Human
ugaauuguaaggaaugauuaa

SEQ ID NO: 1624280 - RNA, 13 nt, Human
ugaauuacauuug

SEQ ID NO: 1624281 - RNA, 14 nt, Human
ugaauuaaguuuuu

SEQ ID NO: 1624282 - RNA, 23 nt, Human
ugacaacacucauugaccugagg

SEQ ID NO: 1624283 - RNA, 15 nt, Human
ugacaacagacuucu

SEQ ID NO: 1624284 - RNA, 19 nt, Human
ugacaacagacuucugaaa

SEQ ID NO: 1624285 - RNA, 18 nt, Human
ugacaacagacuucugaa

SEQ ID NO: 1624286 - RNA, 13 nt, Human
ugacaacacucau

SEQ ID NO: 1624287 - RNA, 16 nt, Human
ugaauuuaaauagcuu

SEQ ID NO: 1624288 - RNA, 20 nt, Human
ugacaaagguaaaucagacu

SEQ ID NO: 1624289 - RNA, 18 nt, Human
ugacagacacaggcccgg

SEQ ID NO: 1624290 - RNA, 17 nt, Human
ugacagacacaggcccg

SEQ ID NO: 1624291 - RNA, 23 nt, Human
ugacaucaacugcaucaagaugu

SEQ ID NO: 1624292 - RNA, 22 nt, Human
ugacagagcaagugagacccug

SEQ ID NO: 1624293 - RNA, 13 nt, Human
ugacagaggcagc

SEQ ID NO: 1624294 - RNA, 15 nt, Human
ugacauauuuuugcu

SEQ ID NO: 1624295 - RNA, 18 nt, Human
ugaccacugcagaagaca

SEQ ID NO: 1624296 - RNA, 13 nt, Human
ugacauguuuuau

SEQ ID NO: 1624297 - RNA, 17 nt, Human
ugaccacugcagaagac

SEQ ID NO: 1624298 - RNA, 16 nt, Human
ugaccacugcagaaga

SEQ ID NO: 1624299 - RNA, 23 nt, Human
ugaccagccuccaugcugccucc

SEQ ID NO: 1624300 - RNA, 22 nt, Human
ugaccagccuccaugcugccuc

SEQ ID NO: 1624301 - RNA, 21 nt, Human
ugaccagccuccaugcugccu

SEQ ID NO: 1624302 - RNA, 19 nt, Human
ugacauguguuggcagccu

SEQ ID NO: 1624303 - RNA, 15 nt, Human
ugagcaggauuuuaa

SEQ ID NO: 1624304 - RNA, 20 nt, Human
ugagcaggauuuuaaucuuu

SEQ ID NO: 1624305 - RNA, 14 nt, Human
ugagaggggaacag

SEQ ID NO: 1624306 - RNA, 18 nt, Human
ugagaggggaacagacug

SEQ ID NO: 1624307 - RNA, 19 nt, Human
ugagaggggaacagacugg

SEQ ID NO: 1624308 - RNA, 14 nt, Human
ugagaccaaccugg

SEQ ID NO: 1624309 - RNA, 12 nt, Human
ugagaccugccc

SEQ ID NO: 1624310 - RNA, 22 nt, Human
ugagaccugccccuccucucug

SEQ ID NO: 1624311 - RNA, 15 nt, Human
ugagaccugccccuc

SEQ ID NO: 1624312 - RNA, 14 nt, Human
ugagaccugccccu

SEQ ID NO: 1624313 - RNA, 13 nt, Human
ugagaccugcccc

SEQ ID NO: 1624314 - RNA, 15 nt, Human
ugagaaagacuauuc

SEQ ID NO: 1624315 - RNA, 15 nt, Human
ugagaaauaaaguuu

SEQ ID NO: 1624316 - RNA, 22 nt, Human
ugacuuuucuguccgagcuuug

SEQ ID NO: 1624317 - RNA, 16 nt, Human
ugacucuuaagaagac

SEQ ID NO: 1624318 - RNA, 15 nt, Human
ugacucuuaagaaga

SEQ ID NO: 1624319 - RNA, 14 nt, Human
ugacucuuaagaag

SEQ ID NO: 1624320 - RNA, 13 nt, Human
ugaccauucucca

SEQ ID NO: 1624321 - RNA, 14 nt, Human
ugaccauucuccac

SEQ ID NO: 1624322 - RNA, 21 nt, Human
ugacucuuucuauuguuucuu

SEQ ID NO: 1624323 - RNA, 16 nt, Human
ugacuuuccucuuugg

SEQ ID NO: 1624324 - RNA, 22 nt, Human
ugacuuuggauaauaaggaaaa

SEQ ID NO: 1624325 - RNA, 20 nt, Human
ugacuuuggauaauaaggaa

SEQ ID NO: 1624326 - RNA, 16 nt, Human
ugacuuuggauaauaa

SEQ ID NO: 1624327 - RNA, 15 nt, Human
ugacuuuggauaaua

SEQ ID NO: 1624328 - RNA, 14 nt, Human
ugacuuuggauaau

SEQ ID NO: 1624329 - RNA, 13 nt, Human
ugacuuuggauaa

SEQ ID NO: 1624330 - RNA, 12 nt, Human
ugacuuuggaua

SEQ ID NO: 1624331 - RNA, 19 nt, Human
ugagcucaggaguuugaga

SEQ ID NO: 1624332 - RNA, 11 nt, Human
ugagcucagga

SEQ ID NO: 1624333 - RNA, 12 nt, Human
ugagcucagccc

SEQ ID NO: 1624334 - RNA, 11 nt, Human
ugagcucagcc

SEQ ID NO: 1624335 - RNA, 20 nt, Human
ugagcucagcccuggugggc

SEQ ID NO: 1624336 - RNA, 22 nt, Human
ugagccgagaucacgccacugc

SEQ ID NO: 1624337 - RNA, 23 nt, Human
ugagcagggcucagcggggacag

SEQ ID NO: 1624338 - RNA, 22 nt, Human
ugagcagggcucagcggggaca

SEQ ID NO: 1624339 - RNA, 20 nt, Human
ugagcagggcucagcgggga

SEQ ID NO: 1624340 - RNA, 23 nt, Human
ugagccgagaucacgccacugca

SEQ ID NO: 1624341 - RNA, 22 nt, Human
ugaggaugaaaaaauaacacug

SEQ ID NO: 1624342 - RNA, 19 nt, Human
ugaggaucagaguaaucca

SEQ ID NO: 1624343 - RNA, 17 nt, Human
ugaggaucagaguaauc

SEQ ID NO: 1624344 - RNA, 13 nt, Human
ugaggaucagagu

SEQ ID NO: 1624345 - RNA, 23 nt, Human
ugagcuuaagaauuuugagcagg

SEQ ID NO: 1624346 - RNA, 19 nt, Human
ugaggucagagccugcagu

SEQ ID NO: 1624347 - RNA, 18 nt, Human
ugaggucagagccugcag

SEQ ID NO: 1624348 - RNA, 21 nt, Human
ugaggcugggcucccuuccca

SEQ ID NO: 1624349 - RNA, 15 nt, Human
ugaggugcuauguuc

SEQ ID NO: 1624350 - RNA, 21 nt, Human
ugagucccaggcugagccuca

SEQ ID NO: 1624351 - RNA, 20 nt, Human
ugagucccaggcugagccuc

SEQ ID NO: 1624352 - RNA, 16 nt, Human
ugaggcugggcucccu

SEQ ID NO: 1624353 - RNA, 15 nt, Human
ugaggcugggcuccc

SEQ ID NO: 1624354 - RNA, 18 nt, Human
ugaggcucugcccuuggu

SEQ ID NO: 1624355 - RNA, 16 nt, Human
ugaggcucugcccuug

SEQ ID NO: 1624356 - RNA, 23 nt, Human
ucuugcauggcaaggacugcagg

SEQ ID NO: 1624357 - RNA, 19 nt, Human
ucuugccaaauauaaauaa

SEQ ID NO: 1624358 - RNA, 14 nt, Human
ucuugcucugcuga

SEQ ID NO: 1624359 - RNA, 17 nt, Human
ucuugccacugccucuu

SEQ ID NO: 1624360 - RNA, 16 nt, Human
ucuugccacugccucu

SEQ ID NO: 1624361 - RNA, 23 nt, Human
ucuugcucugcugacagacacag

SEQ ID NO: 1624362 - RNA, 15 nt, Human
ucuugcucugcugac

SEQ ID NO: 1624363 - RNA, 16 nt, Human
ucuucuuggucucagu

SEQ ID NO: 1624364 - RNA, 20 nt, Human
ucuugaaauauaggaacuua

SEQ ID NO: 1624365 - RNA, 21 nt, Human
ucuugaaauauaggaacuuaa

SEQ ID NO: 1624366 - RNA, 22 nt, Human
ucuugaagacuuuucuuucagc

SEQ ID NO: 1624367 - RNA, 13 nt, Human
ucuugaagacuuu

SEQ ID NO: 1624368 - RNA, 13 nt, Human
ucuuauaauuuaa

SEQ ID NO: 1624369 - RNA, 14 nt, Human
ucuuauaauuuaaa

SEQ ID NO: 1624370 - RNA, 23 nt, Human
ucuuagguuggcaaaaaggcagg

SEQ ID NO: 1624371 - RNA, 20 nt, Human
ucuuagguuggcaaaaaggc

SEQ ID NO: 1624372 - RNA, 22 nt, Human
ucuuaggguuaugauuaaguaa

SEQ ID NO: 1624373 - RNA, 15 nt, Human
ucuuagauguauaua

SEQ ID NO: 1624374 - RNA, 20 nt, Human
ucugugucagguggggcagc

SEQ ID NO: 1624375 - RNA, 17 nt, Human
ucugugucagguggggc

SEQ ID NO: 1624376 - RNA, 22 nt, Human
ucugugucagguggggcagcuu

SEQ ID NO: 1624377 - RNA, 22 nt, Human
ucuuauccaacaucaacaucuu

SEQ ID NO: 1624378 - RNA, 14 nt, Human
ucuuauacauuuga

SEQ ID NO: 1624379 - RNA, 21 nt, Human
ucuucagagacuccugcaggc

SEQ ID NO: 1624380 - RNA, 14 nt, Human
ucuucagaucucua

SEQ ID NO: 1624381 - RNA, 15 nt, Human
ucuucagaucucuaa

SEQ ID NO: 1624382 - RNA, 20 nt, Human
ucuucaguuaagccuuugga

SEQ ID NO: 1624383 - RNA, 19 nt, Human
ucuucaguuaagccuuugg

SEQ ID NO: 1624384 - RNA, 22 nt, Human
ucuucaguuaagccuuuggaaa

SEQ ID NO: 1624385 - RNA, 15 nt, Human
ugaaacacuuugcau

SEQ ID NO: 1624386 - RNA, 12 nt, Human
ugaaaauuuuga

SEQ ID NO: 1624387 - RNA, 14 nt, Human
ugaaaauucagugg

SEQ ID NO: 1624388 - RNA, 20 nt, Human
ugaaaauuaggauuucauga

SEQ ID NO: 1624389 - RNA, 22 nt, Human
ugaaaagaaaaaugagccuggc

SEQ ID NO: 1624390 - RNA, 20 nt, Human
ugaaaagaaaaaugagccug

SEQ ID NO: 1624391 - RNA, 19 nt, Human
ugaaaagaaaaaugagccu

SEQ ID NO: 1624392 - RNA, 18 nt, Human
ugaaaaccacauuggaga

SEQ ID NO: 1624393 - RNA, 23 nt, Human
ugaaaacacuguucucugcccuc

SEQ ID NO: 1624394 - RNA, 22 nt, Human
ugaaaacacuguucucugcccu

SEQ ID NO: 1624395 - RNA, 21 nt, Human
ugaaaacacuguucucugccc

SEQ ID NO: 1624396 - RNA, 20 nt, Human
ugaaaacacuguucucugcc

SEQ ID NO: 1624397 - RNA, 17 nt, Human
ugaaaacacuguucucu

SEQ ID NO: 1624398 - RNA, 21 nt, Human
ugaaaacacauuuuucuuagg

SEQ ID NO: 1624399 - RNA, 17 nt, Human
ucuuuccacagaagcuc

SEQ ID NO: 1624400 - RNA, 12 nt, Human
ucuuucccuccc

SEQ ID NO: 1624401 - RNA, 23 nt, Human
ucuuucccucccuuccucuuucc

SEQ ID NO: 1624402 - RNA, 13 nt, Human
ucuuucccucccu

SEQ ID NO: 1624403 - RNA, 13 nt, Human
ucuuguguguuua

SEQ ID NO: 1624404 - RNA, 23 nt, Human
ucuuuccaaaguacacuguuuca

SEQ ID NO: 1624405 - RNA, 12 nt, Human
ucuugucucaga

SEQ ID NO: 1624406 - RNA, 15 nt, Human
ucuugucucagauuu

SEQ ID NO: 1624407 - RNA, 14 nt, Human
ucuugucucagauu

SEQ ID NO: 1624408 - RNA, 17 nt, Human
ucuugucucagauuuua

SEQ ID NO: 1624409 - RNA, 13 nt, Human
ucuuuggacccug

SEQ ID NO: 1624410 - RNA, 15 nt, Human
ucuuuggacccugag

SEQ ID NO: 1624411 - RNA, 14 nt, Human
ucuuuggacccuga

SEQ ID NO: 1624412 - RNA, 16 nt, Human
ucuuuggacccugagg

SEQ ID NO: 1624413 - RNA, 13 nt, Human
ucuuugcagacag

SEQ ID NO: 1624414 - RNA, 23 nt, Human
ucuuugagugaagcugggagaac

SEQ ID NO: 1624415 - RNA, 17 nt, Human
ucuuugcagacaggcaa

SEQ ID NO: 1624416 - RNA, 14 nt, Human
ucuuugcagacagg

SEQ ID NO: 1624417 - RNA, 23 nt, Human
ucugacccaugcugcccugugag

SEQ ID NO: 1624418 - RNA, 22 nt, Human
ucugacccaugcugcccuguga

SEQ ID NO: 1624419 - RNA, 20 nt, Human
ucugacccaugcugcccugu

SEQ ID NO: 1624420 - RNA, 24 nt, Human
ucugagaucaaaacgguuuuacug

SEQ ID NO: 1624421 - RNA, 18 nt, Human
ucugagaggacuuuucuu

SEQ ID NO: 1624422 - RNA, 21 nt, Human
ucugaggaauccagacccggc

SEQ ID NO: 1624423 - RNA, 18 nt, Human
ucugaggaauccagaccc

SEQ ID NO: 1624424 - RNA, 22 nt, Human
ucugaggaauccagacccggcu

SEQ ID NO: 1624425 - RNA, 23 nt, Human
ucugaggaauccagacccggcug

SEQ ID NO: 1624426 - RNA, 13 nt, Human
ucugcacuccccu

SEQ ID NO: 1624427 - RNA, 20 nt, Human
ucugccugaagucacacagu

SEQ ID NO: 1624428 - RNA, 19 nt, Human
ucugccugaagucacacag

SEQ ID NO: 1624429 - RNA, 22 nt, Human
ucugccucugacacacagcucu

SEQ ID NO: 1624430 - RNA, 21 nt, Human
ucugccucugacacacagcuc

SEQ ID NO: 1624431 - RNA, 23 nt, Human
ucugccucugacacacagcucug

SEQ ID NO: 1624432 - RNA, 21 nt, Human
ucugccucccaucacccgcua

SEQ ID NO: 1624433 - RNA, 20 nt, Human
ucugccucccaucacccgcu

SEQ ID NO: 1624434 - RNA, 17 nt, Human
ucugccucccaucaccc

SEQ ID NO: 1624435 - RNA, 16 nt, Human
ucugccucccaucacc

SEQ ID NO: 1624436 - RNA, 18 nt, Human
ucugccucugacacacag

SEQ ID NO: 1624437 - RNA, 15 nt, Human
ucugccucugacaca

SEQ ID NO: 1624438 - RNA, 15 nt, Human
ucugccuccucuuca

SEQ ID NO: 1624439 - RNA, 14 nt, Human
ucugcccacucccu

SEQ ID NO: 1624440 - RNA, 13 nt, Human
ucugcccacuccc

SEQ ID NO: 1624441 - RNA, 16 nt, Human
ucugcccacucccugc

SEQ ID NO: 1624442 - RNA, 21 nt, Human
ucugccuaaggacuucuuuaa

SEQ ID NO: 1624443 - RNA, 20 nt, Human
ucugccuaaggacuucuuua

SEQ ID NO: 1624444 - RNA, 15 nt, Human
ucugccucccaucac

SEQ ID NO: 1624445 - RNA, 13 nt, Human
ucugccucccauc

SEQ ID NO: 1624446 - RNA, 12 nt, Human
ucugccucccau

SEQ ID NO: 1624447 - RNA, 23 nt, Human
ucugccuaaggacuucuuuaauu

SEQ ID NO: 1624448 - RNA, 23 nt, Human
ucugccauauucuguuggccagu

SEQ ID NO: 1624449 - RNA, 22 nt, Human
ucugccauauucuguuggccag

SEQ ID NO: 1624450 - RNA, 12 nt, Human
ucugcccacucc

SEQ ID NO: 1624451 - RNA, 14 nt, Human
ucugucucagucca

SEQ ID NO: 1624452 - RNA, 21 nt, Human
ucuguccugggagugagcugg

SEQ ID NO: 1624453 - RNA, 13 nt, Human
ucugucuaggaau

SEQ ID NO: 1624454 - RNA, 17 nt, Human
ucugucgcccagucugg

SEQ ID NO: 1624455 - RNA, 12 nt, Human
ucuguccuggga

SEQ ID NO: 1624456 - RNA, 15 nt, Human
ucuguacagagccca

SEQ ID NO: 1624457 - RNA, 23 nt, Human
ucuguacagagcccacgccccca

SEQ ID NO: 1624458 - RNA, 14 nt, Human
ucuguacagagccc

SEQ ID NO: 1624459 - RNA, 16 nt, Human
ucuggugacuuuccuc

SEQ ID NO: 1624460 - RNA, 22 nt, Human
ucuggagcccacuguacuugcu

SEQ ID NO: 1624461 - RNA, 16 nt, Human
ucuggagcccacugua

SEQ ID NO: 1624462 - RNA, 12 nt, Human
ucuggagcccac

SEQ ID NO: 1624463 - RNA, 20 nt, Human
ucugccugcccaggccccug

SEQ ID NO: 1624464 - RNA, 18 nt, Human
ucugccugcccaggcccc

SEQ ID NO: 1624465 - RNA, 17 nt, Human
ucugccugcccaggccc

SEQ ID NO: 1624466 - RNA, 13 nt, Human
ucugccugcccag

SEQ ID NO: 1624467 - RNA, 13 nt, Human
ucugcugcuggcu

SEQ ID NO: 1624468 - RNA, 11 nt, Human
ucugcugcugg

SEQ ID NO: 1624469 - RNA, 17 nt, Human
ucugcugacagacacag

SEQ ID NO: 1624470 - RNA, 13 nt, Human
ucugcugaaggaa

SEQ ID NO: 1624471 - RNA, 15 nt, Human
ucugcugcuggcugg

SEQ ID NO: 1624472 - RNA, 14 nt, Human
ucugcugcuggcug

SEQ ID NO: 1624473 - RNA, 17 nt, Human
ucugcugcuggcugguu

SEQ ID NO: 1624474 - RNA, 14 nt, Human
ucuggaauuugaaa

SEQ ID NO: 1624475 - RNA, 18 nt, Human
ucuggacuccucugucca

SEQ ID NO: 1624476 - RNA, 16 nt, Human
ucuggacuccucuguc

SEQ ID NO: 1624477 - RNA, 15 nt, Human
ucuggacuccucugu

SEQ ID NO: 1624478 - RNA, 22 nt, Human
ucuggacuccucuguccaggca

SEQ ID NO: 1624479 - RNA, 16 nt, Human
ucagcugcugaaacaa

SEQ ID NO: 1624480 - RNA, 15 nt, Human
ucagcugcuacuacu

SEQ ID NO: 1624481 - RNA, 22 nt, Human
ucagcuccccucggagaagagc

SEQ ID NO: 1624482 - RNA, 22 nt, Human
ucagcuccagcucaccagcccc

SEQ ID NO: 1624483 - RNA, 21 nt, Human
ucagcuccagcucaccagccc

SEQ ID NO: 1624484 - RNA, 18 nt, Human
ucagcuccagcucaccag

SEQ ID NO: 1624485 - RNA, 16 nt, Human
ucagccugcuccagcu

SEQ ID NO: 1624486 - RNA, 20 nt, Human
ucagccucccgaauagcugg

SEQ ID NO: 1624487 - RNA, 12 nt, Human
ucagccucccga

SEQ ID NO: 1624488 - RNA, 22 nt, Human
ucagccucccaaagugcuggga

SEQ ID NO: 1624489 - RNA, 18 nt, Human
ucagcauccuggcacccg

SEQ ID NO: 1624490 - RNA, 17 nt, Human
ucagcauccuggcaccc

SEQ ID NO: 1624491 - RNA, 16 nt, Human
ucagcauccuggcacc

SEQ ID NO: 1624492 - RNA, 15 nt, Human
ucagcauccuggcac

SEQ ID NO: 1624493 - RNA, 13 nt, Human
ucagccucccaaa

SEQ ID NO: 1624494 - RNA, 12 nt, Human
ucagccucccaa

SEQ ID NO: 1624495 - RNA, 15 nt, Human
ucagcacgauuucug

SEQ ID NO: 1624496 - RNA, 16 nt, Human
ucagcacgauuucugu

SEQ ID NO: 1624497 - RNA, 17 nt, Human
ucagcacgauuucuguu

SEQ ID NO: 1624498 - RNA, 18 nt, Human
ucagcacgauuucuguuu

SEQ ID NO: 1624499 - RNA, 15 nt, Human
ucagaucucuaacuu

SEQ ID NO: 1624500 - RNA, 18 nt, Human
ucagauaugauucaaaug

SEQ ID NO: 1624501 - RNA, 16 nt, Human
ucagauaugauucaaa

SEQ ID NO: 1624502 - RNA, 17 nt, Human
ucagauaugauucaaau

SEQ ID NO: 1624503 - RNA, 20 nt, Human
ucagauacuggauuguacuu

SEQ ID NO: 1624504 - RNA, 19 nt, Human
ucagauacuggauuguacu

SEQ ID NO: 1624505 - RNA, 16 nt, Human
ucagauacuggauugu

SEQ ID NO: 1624506 - RNA, 15 nt, Human
ucagauacuggauug

SEQ ID NO: 1624507 - RNA, 14 nt, Human
ucagauacuggauu

SEQ ID NO: 1624508 - RNA, 18 nt, Human
ucagugugacugaucucu

SEQ ID NO: 1624509 - RNA, 19 nt, Human
ucagucugauucccaagcu

SEQ ID NO: 1624510 - RNA, 17 nt, Human
ucagucugauucccaag

SEQ ID NO: 1624511 - RNA, 17 nt, Human
ucaguuaagccuuugga

SEQ ID NO: 1624512 - RNA, 16 nt, Human
ucaguuaagccuuugg

SEQ ID NO: 1624513 - RNA, 18 nt, Human
ucaguccaugaagaugua

SEQ ID NO: 1624514 - RNA, 15 nt, Human
ucaguccauagcaga

SEQ ID NO: 1624515 - RNA, 18 nt, Human
ucaguccccgugaaggag

SEQ ID NO: 1624516 - RNA, 20 nt, Human
ucagguggggucacucuggc

SEQ ID NO: 1624517 - RNA, 17 nt, Human
ucagguggggucacucu

SEQ ID NO: 1624518 - RNA, 21 nt, Human
ucagguggggucacucuggca

SEQ ID NO: 1624519 - RNA, 17 nt, Human
ucagguggggcagcuug

SEQ ID NO: 1624520 - RNA, 21 nt, Human
ucagguggggcagcuugaggg

SEQ ID NO: 1624521 - RNA, 16 nt, Human
ucagguggggcagcuu

SEQ ID NO: 1624522 - RNA, 15 nt, Human
ucagguggggcagcu

SEQ ID NO: 1624523 - RNA, 20 nt, Human
ucaggugcugccauccaggu

SEQ ID NO: 1624524 - RNA, 18 nt, Human
ucaggugcugccauccag

SEQ ID NO: 1624525 - RNA, 14 nt, Human
ucagguggggcagc

SEQ ID NO: 1624526 - RNA, 19 nt, Human
ucauggaauuggagcucgu

SEQ ID NO: 1624527 - RNA, 13 nt, Human
ucaugaaagauuc

SEQ ID NO: 1624528 - RNA, 21 nt, Human
ucauggaauuggagcucgugg

SEQ ID NO: 1624529 - RNA, 15 nt, Human
ucaugaaagauucaa

SEQ ID NO: 1624530 - RNA, 24 nt, Human
ucauggacuucugccagcauaaua

SEQ ID NO: 1624531 - RNA, 14 nt, Human
ucaucauccuaagc

SEQ ID NO: 1624532 - RNA, 12 nt, Human
uccauacauuug

SEQ ID NO: 1624533 - RNA, 17 nt, Human
uccauagagagcaagac

SEQ ID NO: 1624534 - RNA, 23 nt, Human
uccauaaucuggacuccucuguc

SEQ ID NO: 1624535 - RNA, 20 nt, Human
uccauagagagcaagacgcu

SEQ ID NO: 1624536 - RNA, 21 nt, Human
ucccaacucaccccagcccca

SEQ ID NO: 1624537 - RNA, 19 nt, Human
ucccaacucaccccagccc

SEQ ID NO: 1624538 - RNA, 14 nt, Human
ucccaacuuguaaa

SEQ ID NO: 1624539 - RNA, 18 nt, Human
ucccaacucaccccagcc

SEQ ID NO: 1624540 - RNA, 17 nt, Human
ucccaacucaccccagc

SEQ ID NO: 1624541 - RNA, 16 nt, Human
uccaugucgccucugc

SEQ ID NO: 1624542 - RNA, 19 nt, Human
uccaugucgccucugcauu

SEQ ID NO: 1624543 - RNA, 18 nt, Human
uccaugucgccucugcau

SEQ ID NO: 1624544 - RNA, 17 nt, Human
uccaugucgccucugca

SEQ ID NO: 1624545 - RNA, 14 nt, Human
ucccacucagucca

SEQ ID NO: 1624546 - RNA, 21 nt, Human
ucccaccuuggcugcagggag

SEQ ID NO: 1624547 - RNA, 19 nt, Human
ucccaccuuggcugcaggg

SEQ ID NO: 1624548 - RNA, 20 nt, Human
ucccaccucucucacuccuu

SEQ ID NO: 1624549 - RNA, 18 nt, Human
ucccaccucagccucccg

SEQ ID NO: 1624550 - RNA, 16 nt, Human
ucccaccucagccucc

SEQ ID NO: 1624551 - RNA, 18 nt, Human
ucccaccucucucacucc

SEQ ID NO: 1624552 - RNA, 17 nt, Human
ucccaccucucucacuc

SEQ ID NO: 1624553 - RNA, 14 nt, Human
ucccaccucucuca

SEQ ID NO: 1624554 - RNA, 16 nt, Human
ucccaugagccucagc

SEQ ID NO: 1624555 - RNA, 15 nt, Human
ucccaugagccucag

SEQ ID NO: 1624556 - RNA, 19 nt, Human
ucccaggcauuccccagga

SEQ ID NO: 1624557 - RNA, 19 nt, Human
ucccaggcugagccucagu

SEQ ID NO: 1624558 - RNA, 18 nt, Human
ucccaggcauuccccagg

SEQ ID NO: 1624559 - RNA, 17 nt, Human
ucccaggcauuccccag

SEQ ID NO: 1624560 - RNA, 18 nt, Human
uccagcaauucuccugcc

SEQ ID NO: 1624561 - RNA, 21 nt, Human
uccagcaauucuccugccuca

SEQ ID NO: 1624562 - RNA, 20 nt, Human
uccagcaauucuccugccuc

SEQ ID NO: 1624563 - RNA, 19 nt, Human
uccagcaauucuccugccu

SEQ ID NO: 1624564 - RNA, 22 nt, Human
uccagauuuuuuacagcugccu

SEQ ID NO: 1624565 - RNA, 19 nt, Human
uccagcuggguuggaaaac

SEQ ID NO: 1624566 - RNA, 22 nt, Human
uccagcuggccgggagccugau

SEQ ID NO: 1624567 - RNA, 21 nt, Human
uccagcuggccgggagccuga

SEQ ID NO: 1624568 - RNA, 15 nt, Human
uccagcuggccggga

SEQ ID NO: 1624569 - RNA, 14 nt, Human
uccacccugcucuc

SEQ ID NO: 1624570 - RNA, 21 nt, Human
uccacccugcucuccgaccag

SEQ ID NO: 1624571 - RNA, 22 nt, Human
uccacugugccaugugccaggu

SEQ ID NO: 1624572 - RNA, 15 nt, Human
uccacuuuaucuuga

SEQ ID NO: 1624573 - RNA, 23 nt, Human
uccacuuagaaauugcauuuccu

SEQ ID NO: 1624574 - RNA, 21 nt, Human
uccacuuagaaauugcauuuc

SEQ ID NO: 1624575 - RNA, 14 nt, Human
uccacuuucuagcc

SEQ ID NO: 1624576 - RNA, 17 nt, Human
uccacuuuaucuugaau

SEQ ID NO: 1624577 - RNA, 19 nt, Human
uccacuuucuagccagagg

SEQ ID NO: 1624578 - RNA, 19 nt, Human
uccagagaguggcuccucc

SEQ ID NO: 1624579 - RNA, 22 nt, Human
uccagagaguggcuccucccgg

SEQ ID NO: 1624580 - RNA, 20 nt, Human
uccacaagagcccaggccuc

SEQ ID NO: 1624581 - RNA, 21 nt, Human
uccacaagagcccaggccucc

SEQ ID NO: 1624582 - RNA, 16 nt, Human
uccaagaagcccagga

SEQ ID NO: 1624583 - RNA, 15 nt, Human
uccaagaagcccagg

SEQ ID NO: 1624584 - RNA, 14 nt, Human
uccaagaagcccag

SEQ ID NO: 1624585 - RNA, 20 nt, Human
uccaagaccuucuccuucac

SEQ ID NO: 1624586 - RNA, 19 nt, Human
uccaagaagcccaggaaag

SEQ ID NO: 1624587 - RNA, 22 nt, Human
uccaagcaggacauggacaagg

SEQ ID NO: 1624588 - RNA, 14 nt, Human
uccaagcaggacau

SEQ ID NO: 1624589 - RNA, 17 nt, Human
uccaagcaaaugugaau

SEQ ID NO: 1624590 - RNA, 15 nt, Human
uccaagcaaauguga

SEQ ID NO: 1624591 - RNA, 13 nt, Human
ucucagauuuuau

SEQ ID NO: 1624592 - RNA, 15 nt, Human
ucucagauuuuauua

SEQ ID NO: 1624593 - RNA, 14 nt, Human
ucucagauuuuauu

SEQ ID NO: 1624594 - RNA, 19 nt, Human
ucucagauuuuauuaugua

SEQ ID NO: 1624595 - RNA, 18 nt, Human
ucucagauuuuauuaugu

SEQ ID NO: 1624596 - RNA, 17 nt, Human
ucucagauuuuauuaug

SEQ ID NO: 1624597 - RNA, 16 nt, Human
ucucagauuuuauuau

SEQ ID NO: 1624598 - RNA, 15 nt, Human
ucucacuguugccca

SEQ ID NO: 1624599 - RNA, 14 nt, Human
ucucacuguugccc

SEQ ID NO: 1624600 - RNA, 17 nt, Human
ucucacuguugcccagg

SEQ ID NO: 1624601 - RNA, 13 nt, Human
ucucaaauuucua

SEQ ID NO: 1624602 - RNA, 22 nt, Human
ucuaucuuugagcgcccacuag

SEQ ID NO: 1624603 - RNA, 14 nt, Human
ucucaaauuucuaa

SEQ ID NO: 1624604 - RNA, 16 nt, Human
ucucaaauuucuaaau

SEQ ID NO: 1624605 - RNA, 19 nt, Human
ucuauauuuucauucuccu

SEQ ID NO: 1624606 - RNA, 16 nt, Human
ucuauauuuucauucu

SEQ ID NO: 1624607 - RNA, 15 nt, Human
ucuauauuuucauuc

SEQ ID NO: 1624608 - RNA, 23 nt, Human
ucucacucugucgcccagucugg

SEQ ID NO: 1624609 - RNA, 21 nt, Human
ucucacacaugagcaucaggc

SEQ ID NO: 1624610 - RNA, 20 nt, Human
ucucacugccaugccagcuu

SEQ ID NO: 1624611 - RNA, 23 nt, Human
ucucacacaugagcaucaggcca

SEQ ID NO: 1624612 - RNA, 16 nt, Human
ucucacacaugagcau

SEQ ID NO: 1624613 - RNA, 18 nt, Human
ucucaaauuucuaaaucu

SEQ ID NO: 1624614 - RNA, 19 nt, Human
ucuacuaaaaauacaaaaa

SEQ ID NO: 1624615 - RNA, 15 nt, Human
ucuacuaaaaauaca

SEQ ID NO: 1624616 - RNA, 14 nt, Human
ucuacuauuuaugu

SEQ ID NO: 1624617 - RNA, 12 nt, Human
ucuacuaaaaau

SEQ ID NO: 1624618 - RNA, 21 nt, Human
ucuacucgaguuacagacaaa

SEQ ID NO: 1624619 - RNA, 20 nt, Human
ucuacucgaguuacagacaa

SEQ ID NO: 1624620 - RNA, 18 nt, Human
ucuacucuagggaaaaac

SEQ ID NO: 1624621 - RNA, 19 nt, Human
ucuagggaaaaaccagcgu

SEQ ID NO: 1624622 - RNA, 12 nt, Human
ucuagggaaaaa

SEQ ID NO: 1624623 - RNA, 15 nt, Human
ucuagguaaauuaca

SEQ ID NO: 1624624 - RNA, 13 nt, Human
ucuauauuuuaca

SEQ ID NO: 1624625 - RNA, 14 nt, Human
ucuauauuuucauu

SEQ ID NO: 1624626 - RNA, 13 nt, Human
ucuauauuuucau

SEQ ID NO: 1624627 - RNA, 17 nt, Human
uccuugcaucaauuuuu

SEQ ID NO: 1624628 - RNA, 21 nt, Human
uccuuggugucgggcaugaca

SEQ ID NO: 1624629 - RNA, 18 nt, Human
uccuuggugucgggcaug

SEQ ID NO: 1624630 - RNA, 22 nt, Human
uccuuugugaggaagccgcugg

SEQ ID NO: 1624631 - RNA, 18 nt, Human
uccuuugugaggaagccg

SEQ ID NO: 1624632 - RNA, 17 nt, Human
uccuuugugaggaagcc

SEQ ID NO: 1624633 - RNA, 22 nt, Human
uccuuggugucgggcaugacac

SEQ ID NO: 1624634 - RNA, 21 nt, Human
uccuuaccagcagagcaccuu

SEQ ID NO: 1624635 - RNA, 23 nt, Human
uccuugaaaacacuguucucugc

SEQ ID NO: 1624636 - RNA, 22 nt, Human
uccuugaaaacacuguucucug

SEQ ID NO: 1624637 - RNA, 17 nt, Human
uccuuaucaaaggacac

SEQ ID NO: 1624638 - RNA, 15 nt, Human
uccuuaucaaaggac

SEQ ID NO: 1624639 - RNA, 14 nt, Human
uccuuaucaaagga

SEQ ID NO: 1624640 - RNA, 17 nt, Human
ucggccuccauccugag

SEQ ID NO: 1624641 - RNA, 16 nt, Human
ucggccuccauccuga

SEQ ID NO: 1624642 - RNA, 15 nt, Human
ucggccuccauccug

SEQ ID NO: 1624643 - RNA, 15 nt, Human
ucggaaaacaugcua

SEQ ID NO: 1624644 - RNA, 18 nt, Human
ucggaaaacaugcuacac

SEQ ID NO: 1624645 - RNA, 23 nt, Human
ucgcccagucuggaaugcagugg

SEQ ID NO: 1624646 - RNA, 19 nt, Human
ucgcccagucuggaaugca

SEQ ID NO: 1624647 - RNA, 14 nt, Human
ucgcccagucugga

SEQ ID NO: 1624648 - RNA, 22 nt, Human
uccuuuucgcaggauucuuccu

SEQ ID NO: 1624649 - RNA, 23 nt, Human
ucgcaggauucuuccucccuccc

SEQ ID NO: 1624650 - RNA, 21 nt, Human
ucgcaggauucuuccucccuc

SEQ ID NO: 1624651 - RNA, 17 nt, Human
ucgcaggauucuuccuc

SEQ ID NO: 1624652 - RNA, 20 nt, Human
uccucaaaacuucagacaua

SEQ ID NO: 1624653 - RNA, 13 nt, Human
uccuccaggugca

SEQ ID NO: 1624654 - RNA, 12 nt, Human
uccuccaggugc

SEQ ID NO: 1624655 - RNA, 22 nt, Human
uccuccaggugcacaagcucca

SEQ ID NO: 1624656 - RNA, 20 nt, Human
uccuccaggugcacaagcuc

SEQ ID NO: 1624657 - RNA, 18 nt, Human
uccuccaggugcacaagc

SEQ ID NO: 1624658 - RNA, 14 nt, Human
uccuccaggugcac

SEQ ID NO: 1624659 - RNA, 12 nt, Human
uccuccucagau

SEQ ID NO: 1624660 - RNA, 17 nt, Human
uccuaguuccaccauca

SEQ ID NO: 1624661 - RNA, 14 nt, Human
uccuaguuccacca

SEQ ID NO: 1624662 - RNA, 18 nt, Human
uccuaagcuauucaguaa

SEQ ID NO: 1624663 - RNA, 16 nt, Human
uccuaagcuauucagu

SEQ ID NO: 1624664 - RNA, 21 nt, Human
uccuaguuccaccaucaagcc

SEQ ID NO: 1624665 - RNA, 22 nt, Human
uccuaguuccaccaucaagcca

SEQ ID NO: 1624666 - RNA, 17 nt, Human
uccugaggcuccacuug

SEQ ID NO: 1624667 - RNA, 16 nt, Human
uccugaggcuccacuu

SEQ ID NO: 1624668 - RNA, 12 nt, Human
uccugaggcugg

SEQ ID NO: 1624669 - RNA, 19 nt, Human
uccugaggcugggcucccu

SEQ ID NO: 1624670 - RNA, 17 nt, Human
uccugaggcugggcucc

SEQ ID NO: 1624671 - RNA, 16 nt, Human
uccugaggcugggcuc

SEQ ID NO: 1624672 - RNA, 15 nt, Human
uccugaggcugggcu

SEQ ID NO: 1624673 - RNA, 15 nt, Human
uccugaggcuccacu

SEQ ID NO: 1624674 - RNA, 21 nt, Human
uccugagccagauuucacucu

SEQ ID NO: 1624675 - RNA, 22 nt, Human
uccucuguccaggcacugcugc

SEQ ID NO: 1624676 - RNA, 19 nt, Human
uccugagccagauuucacu

SEQ ID NO: 1624677 - RNA, 18 nt, Human
uccugagccagauuucac

SEQ ID NO: 1624678 - RNA, 23 nt, Human
uccucuguacagagcccacgccc

SEQ ID NO: 1624679 - RNA, 17 nt, Human
uccugagccagauuuca

SEQ ID NO: 1624680 - RNA, 17 nt, Human
uccucuguccaggcacu

SEQ ID NO: 1624681 - RNA, 19 nt, Human
uccucugcuugccaucccu

SEQ ID NO: 1624682 - RNA, 15 nt, Human
uccucuggccugugu

SEQ ID NO: 1624683 - RNA, 13 nt, Human
uccucuguacaga

SEQ ID NO: 1624684 - RNA, 15 nt, Human
uccucuguacagagc

SEQ ID NO: 1624685 - RNA, 14 nt, Human
uccucugcuugcca

SEQ ID NO: 1624686 - RNA, 15 nt, Human
uccucugcuugccau

SEQ ID NO: 1624687 - RNA, 16 nt, Human
uccucugcuugccauc

SEQ ID NO: 1624688 - RNA, 17 nt, Human
uccucugcuugccaucc

SEQ ID NO: 1624689 - RNA, 21 nt, Human
uccuccuuuucacaguucucu

SEQ ID NO: 1624690 - RNA, 13 nt, Human
uccuccuggacuc

SEQ ID NO: 1624691 - RNA, 21 nt, Human
uccucuaggaggucucuaaga

SEQ ID NO: 1624692 - RNA, 21 nt, Human
ucccuucccacuggaggcaug

SEQ ID NO: 1624693 - RNA, 17 nt, Human
ucccuucccaccucucu

SEQ ID NO: 1624694 - RNA, 16 nt, Human
ucccuucccaccucuc

SEQ ID NO: 1624695 - RNA, 14 nt, Human
ucccugccccuccc

SEQ ID NO: 1624696 - RNA, 16 nt, Human
ucccugccccccagcc

SEQ ID NO: 1624697 - RNA, 19 nt, Human
ucccugccccucccuucaa

SEQ ID NO: 1624698 - RNA, 18 nt, Human
ucccugccccucccuuca

SEQ ID NO: 1624699 - RNA, 21 nt, Human
uccgcuuucuacccagcgagc

SEQ ID NO: 1624700 - RNA, 21 nt, Human
uccgaaagggacuuggaagcu

SEQ ID NO: 1624701 - RNA, 17 nt, Human
ucccuucuuuuucuucu

SEQ ID NO: 1624702 - RNA, 22 nt, Human
uccgaaagggacuuggaagcuc

SEQ ID NO: 1624703 - RNA, 13 nt, Human
ucccucuggggcu

SEQ ID NO: 1624704 - RNA, 17 nt, Human
ucccucuggggcuguuc

SEQ ID NO: 1624705 - RNA, 20 nt, Human
ucccugcacuugcagacucu

SEQ ID NO: 1624706 - RNA, 16 nt, Human
ucccugccaauggacu

SEQ ID NO: 1624707 - RNA, 14 nt, Human
ucccugccaaugga

SEQ ID NO: 1624708 - RNA, 18 nt, Human
ucccucccuuccucuuuc

SEQ ID NO: 1624709 - RNA, 17 nt, Human
ucccuacuuccugugac

SEQ ID NO: 1624710 - RNA, 14 nt, Human
ucccucccuugggg

SEQ ID NO: 1624711 - RNA, 13 nt, Human
ucccucccuuggg

SEQ ID NO: 1624712 - RNA, 22 nt, Human
ucccaugagccucagcauccug

SEQ ID NO: 1624713 - RNA, 17 nt, Human
ucccaugagccucagca

SEQ ID NO: 1624714 - RNA, 12 nt, Human
ucccaugcccug

SEQ ID NO: 1624715 - RNA, 23 nt, Human
ucccuaccgagucucuucuccac

SEQ ID NO: 1624716 - RNA, 22 nt, Human
ucccuaccgagucucuucucca

SEQ ID NO: 1624717 - RNA, 21 nt, Human
ucccuaccgagucucuucucc

SEQ ID NO: 1624718 - RNA, 19 nt, Human
ucccuaccgagucucuucu

SEQ ID NO: 1624719 - RNA, 19 nt, Human
uggacaugcacagcuaaca

SEQ ID NO: 1624720 - RNA, 13 nt, Human
uggacaugcacag

SEQ ID NO: 1624721 - RNA, 20 nt, Human
uggacucaccucccccaucu

SEQ ID NO: 1624722 - RNA, 18 nt, Human
uggacucaccucccccau

SEQ ID NO: 1624723 - RNA, 22 nt, Human
uggaauaauccuaaacauauga

SEQ ID NO: 1624724 - RNA, 17 nt, Human
uggaauaaggagaauga

SEQ ID NO: 1624725 - RNA, 15 nt, Human
uggaauauauaacca

SEQ ID NO: 1624726 - RNA, 16 nt, Human
uggaauauauaaccag

SEQ ID NO: 1624727 - RNA, 16 nt, Human
uggaauaucuccguca

SEQ ID NO: 1624728 - RNA, 19 nt, Human
uggaauaacauguaauuaa

SEQ ID NO: 1624729 - RNA, 15 nt, Human
uggaauaacauguaa

SEQ ID NO: 1624730 - RNA, 14 nt, Human
uggaauaacaugua

SEQ ID NO: 1624731 - RNA, 18 nt, Human
uggaacgcguugaaauug

SEQ ID NO: 1624732 - RNA, 19 nt, Human
uggaacgcguugaaauugu

SEQ ID NO: 1624733 - RNA, 21 nt, Human
uggaacauaaaauacaauguu

SEQ ID NO: 1624734 - RNA, 20 nt, Human
uggaacauaaaauacaaugu

SEQ ID NO: 1624735 - RNA, 20 nt, Human
uggaaagaguaggaagacuu

SEQ ID NO: 1624736 - RNA, 14 nt, Human
uggaaagaguacuc

SEQ ID NO: 1624737 - RNA, 23 nt, Human
uggaaacuucagcgguuuauaua

SEQ ID NO: 1624738 - RNA, 22 nt, Human
uggaaacagcucgacuuuaaaa

SEQ ID NO: 1624739 - RNA, 21 nt, Human
uggaaagacuuuuccaacccu

SEQ ID NO: 1624740 - RNA, 17 nt, Human
uggaaacaagucaguca

SEQ ID NO: 1624741 - RNA, 17 nt, Human
uggaaacagcucgacuu

SEQ ID NO: 1624742 - RNA, 20 nt, Human
uggaaaaauagccugccucu

SEQ ID NO: 1624743 - RNA, 11 nt, Human
uggagggaagc

SEQ ID NO: 1624744 - RNA, 18 nt, Human
uggaggaaggaaacccag

SEQ ID NO: 1624745 - RNA, 12 nt, Human
uggaggaaggaa

SEQ ID NO: 1624746 - RNA, 20 nt, Human
uggaggaaggaaacccagcu

SEQ ID NO: 1624747 - RNA, 15 nt, Human
uggacuccugcacac

SEQ ID NO: 1624748 - RNA, 15 nt, Human
uggacuccucugucc

SEQ ID NO: 1624749 - RNA, 20 nt, Human
uggauuuaacagaaauguac

SEQ ID NO: 1624750 - RNA, 24 nt, Human
uggauuuaacagaaauguacagca

SEQ ID NO: 1624751 - RNA, 21 nt, Human
uggccagaugcaccagcccuu

SEQ ID NO: 1624752 - RNA, 20 nt, Human
uggccacuccagaccccugg

SEQ ID NO: 1624753 - RNA, 17 nt, Human
uggccacuccagacccc

SEQ ID NO: 1624754 - RNA, 21 nt, Human
uggcacccggccccugcuggu

SEQ ID NO: 1624755 - RNA, 13 nt, Human
uggcagcugcuuu

SEQ ID NO: 1624756 - RNA, 19 nt, Human
uggcaggaguuggaagugu

SEQ ID NO: 1624757 - RNA, 13 nt, Human
uggcagugggagc

SEQ ID NO: 1624758 - RNA, 21 nt, Human
uggcuugaguuuaaauuguaa

SEQ ID NO: 1624759 - RNA, 14 nt, Human
uggcuuuugugcau

SEQ ID NO: 1624760 - RNA, 19 nt, Human
uggcuuuucugauccaguu

SEQ ID NO: 1624761 - RNA, 18 nt, Human
uggcuuuucugauccagu

SEQ ID NO: 1624762 - RNA, 17 nt, Human
uggcuuuucugauccag

SEQ ID NO: 1624763 - RNA, 14 nt, Human
uggcuuuucugauc

SEQ ID NO: 1624764 - RNA, 16 nt, Human
uggcuuccuggcaaua

SEQ ID NO: 1624765 - RNA, 21 nt, Human
uggcugcuucaaggauccuga

SEQ ID NO: 1624766 - RNA, 21 nt, Human
uggcugggggccucagugcca

SEQ ID NO: 1624767 - RNA, 14 nt, Human
ugggagcugccugu

SEQ ID NO: 1624768 - RNA, 13 nt, Human
ugggagcugccug

SEQ ID NO: 1624769 - RNA, 12 nt, Human
ugggagcugccu

SEQ ID NO: 1624770 - RNA, 13 nt, Human
ugggagcaaaaga

SEQ ID NO: 1624771 - RNA, 13 nt, Human
ugggacacccugu

SEQ ID NO: 1624772 - RNA, 15 nt, Human
uggcuuuugugcauu

SEQ ID NO: 1624773 - RNA, 12 nt, Human
ugggacacccug

SEQ ID NO: 1624774 - RNA, 16 nt, Human
ugggauuacaggugug

SEQ ID NO: 1624775 - RNA, 18 nt, Human
ugggauuacaggcuccug

SEQ ID NO: 1624776 - RNA, 13 nt, Human
ugggauccuggag

SEQ ID NO: 1624777 - RNA, 18 nt, Human
ugggauccuccaggugca

SEQ ID NO: 1624778 - RNA, 15 nt, Human
ugggcagaggaaagc

SEQ ID NO: 1624779 - RNA, 17 nt, Human
ugggauuacagguguga

SEQ ID NO: 1624780 - RNA, 23 nt, Human
ugggagcugccuguucagcucca

SEQ ID NO: 1624781 - RNA, 22 nt, Human
ugggagcugccuguucagcucc

SEQ ID NO: 1624782 - RNA, 21 nt, Human
ugggagcugccuguucagcuc

SEQ ID NO: 1624783 - RNA, 17 nt, Human
ugggagcugccuguuca

SEQ ID NO: 1624784 - RNA, 15 nt, Human
ugggauccuccaggu

SEQ ID NO: 1624785 - RNA, 15 nt, Human
ugggagugagcuggu

SEQ ID NO: 1624786 - RNA, 18 nt, Human
ugggggcugggcagagga

SEQ ID NO: 1624787 - RNA, 17 nt, Human
ugggggcugggcagagg

SEQ ID NO: 1624788 - RNA, 19 nt, Human
ugggggcugggcagaggaa

SEQ ID NO: 1624789 - RNA, 12 nt, Human
ugggggugcauu

SEQ ID NO: 1624790 - RNA, 15 nt, Human
ugggggugcauuuga

SEQ ID NO: 1624791 - RNA, 21 nt, Human
ugggggaucacagccucugaa

SEQ ID NO: 1624792 - RNA, 20 nt, Human
ugggggaucacagccucuga

SEQ ID NO: 1624793 - RNA, 20 nt, Human
uggggauucuuaaaguugaa

SEQ ID NO: 1624794 - RNA, 18 nt, Human
uggggauucuuaaaguug

SEQ ID NO: 1624795 - RNA, 16 nt, Human
uggggauucuuaaagu

SEQ ID NO: 1624796 - RNA, 13 nt, Human
uggggauucuuaa

SEQ ID NO: 1624797 - RNA, 12 nt, Human
uggggauucuua

SEQ ID NO: 1624798 - RNA, 17 nt, Human
ugggcuucaguggcagc

SEQ ID NO: 1624799 - RNA, 15 nt, Human
ugggcuucaguggca

SEQ ID NO: 1624800 - RNA, 17 nt, Human
ugggcuggugucaccug

SEQ ID NO: 1624801 - RNA, 16 nt, Human
ugggcuaguugggcuu

SEQ ID NO: 1624802 - RNA, 22 nt, Human
ugggcuaagugauccucccacc

SEQ ID NO: 1624803 - RNA, 20 nt, Human
ugggcgugagaccugccccu

SEQ ID NO: 1624804 - RNA, 16 nt, Human
ugggcagaggaaagca

SEQ ID NO: 1624805 - RNA, 18 nt, Human
uggguuucuaaagcugcc

SEQ ID NO: 1624806 - RNA, 17 nt, Human
uggguuucuaaagcugc

SEQ ID NO: 1624807 - RNA, 21 nt, Human
uggguuucuaaagcugccagc

SEQ ID NO: 1624808 - RNA, 18 nt, Human
ugguaugaucacggcuca

SEQ ID NO: 1624809 - RNA, 23 nt, Human
ugguauuggcuagagguucaaag

SEQ ID NO: 1624810 - RNA, 16 nt, Human
uggguaacuagggaag

SEQ ID NO: 1624811 - RNA, 19 nt, Human
ugggguuuaucagaauucu

SEQ ID NO: 1624812 - RNA, 16 nt, Human
uggguucuacccaggu

SEQ ID NO: 1624813 - RNA, 15 nt, Human
uggguucuacccagg

SEQ ID NO: 1624814 - RNA, 22 nt, Human
uggguucuacccaggugcuagg

SEQ ID NO: 1624815 - RNA, 14 nt, Human
uggguuaguggaug

SEQ ID NO: 1624816 - RNA, 17 nt, Human
ugccuucucaacuccaa

SEQ ID NO: 1624817 - RNA, 15 nt, Human
ugccuucucaacucc

SEQ ID NO: 1624818 - RNA, 21 nt, Human
ugccugugaacugaacucuga

SEQ ID NO: 1624819 - RNA, 18 nt, Human
ugccugugaacugaacuc

SEQ ID NO: 1624820 - RNA, 17 nt, Human
ugccugugaacugaacu

SEQ ID NO: 1624821 - RNA, 21 nt, Human
ugcgaucuggguucacugcaa

SEQ ID NO: 1624822 - RNA, 20 nt, Human
ugcgaucuggguucacugca

SEQ ID NO: 1624823 - RNA, 19 nt, Human
ugcgaucuggguucacugc

SEQ ID NO: 1624824 - RNA, 15 nt, Human
ugcgaucuggguuca

SEQ ID NO: 1624825 - RNA, 14 nt, Human
ugcgaucuggguuc

SEQ ID NO: 1624826 - RNA, 15 nt, Human
ugcuaaaugugaaug

SEQ ID NO: 1624827 - RNA, 22 nt, Human
ugcgccuacaggagugagcacu

SEQ ID NO: 1624828 - RNA, 16 nt, Human
ugcgccuacaggagug

SEQ ID NO: 1624829 - RNA, 14 nt, Human
ugcgccuacaggag

SEQ ID NO: 1624830 - RNA, 18 nt, Human
ugccuguaaucacagcua

SEQ ID NO: 1624831 - RNA, 16 nt, Human
ugccugguggcagcug

SEQ ID NO: 1624832 - RNA, 15 nt, Human
ugccugguggcagcu

SEQ ID NO: 1624833 - RNA, 14 nt, Human
ugccugguggcagc

SEQ ID NO: 1624834 - RNA, 14 nt, Human
ugccugugaacuga

SEQ ID NO: 1624835 - RNA, 18 nt, Human
ugccugggcagaaggaag

SEQ ID NO: 1624836 - RNA, 21 nt, Human
ugccugggaucccucauccuc

SEQ ID NO: 1624837 - RNA, 19 nt, Human
ugccucgaacuggcugcaa

SEQ ID NO: 1624838 - RNA, 18 nt, Human
ugccucgaacuggcugca

SEQ ID NO: 1624839 - RNA, 20 nt, Human
ugccucgaacuggcugcaaa

SEQ ID NO: 1624840 - RNA, 18 nt, Human
ugccccuggcagccccug

SEQ ID NO: 1624841 - RNA, 17 nt, Human
ugccugaagucacacag

SEQ ID NO: 1624842 - RNA, 9 nt, Human
ugccucucu

SEQ ID NO: 1624843 - RNA, 19 nt, Human
ugcuaagcauuccaacuau

SEQ ID NO: 1624844 - RNA, 15 nt, Human
ugcuaagcauuccaa

SEQ ID NO: 1624845 - RNA, 16 nt, Human
ugcucacauaucuguc

SEQ ID NO: 1624846 - RNA, 15 nt, Human
ugcucacauaucugu

SEQ ID NO: 1624847 - RNA, 17 nt, Human
ugcucagagcaguguuu

SEQ ID NO: 1624848 - RNA, 14 nt, Human
ugcuccucucccca

SEQ ID NO: 1624849 - RNA, 18 nt, Human
ugcuccucuccccagcaa

SEQ ID NO: 1624850 - RNA, 17 nt, Human
ugcuccucuccccagca

SEQ ID NO: 1624851 - RNA, 18 nt, Human
ugcuccuuucuuguuuua

SEQ ID NO: 1624852 - RNA, 22 nt, Human
ugcucuccucuugccacugccu

SEQ ID NO: 1624853 - RNA, 21 nt, Human
ugcucuccucuugccacugcc

SEQ ID NO: 1624854 - RNA, 18 nt, Human
ugcucuccucuugccacu

SEQ ID NO: 1624855 - RNA, 16 nt, Human
ugcucuccucuugcca

SEQ ID NO: 1624856 - RNA, 23 nt, Human
ugcugacagacacaggcccggcu

SEQ ID NO: 1624857 - RNA, 22 nt, Human
ugcugacagacacaggcccggc

SEQ ID NO: 1624858 - RNA, 21 nt, Human
ugcugaaggcucgagcaugcc

SEQ ID NO: 1624859 - RNA, 13 nt, Human
ugcugaaggcucg

SEQ ID NO: 1624860 - RNA, 12 nt, Human
ugcugaaggcuc

SEQ ID NO: 1624861 - RNA, 23 nt, Human
ugcugaaggaauaaauugcuccu

SEQ ID NO: 1624862 - RNA, 17 nt, Human
ugcugauggugcaauga

SEQ ID NO: 1624863 - RNA, 15 nt, Human
ugcugauggugcaau

SEQ ID NO: 1624864 - RNA, 13 nt, Human
ugcugauggugca

SEQ ID NO: 1624865 - RNA, 18 nt, Human
ugcugauggugcaaugac

SEQ ID NO: 1624866 - RNA, 14 nt, Human
ugcugcauuuaaaa

SEQ ID NO: 1624867 - RNA, 18 nt, Human
ugcugcaguugccaguca

SEQ ID NO: 1624868 - RNA, 23 nt, Human
ugcugcaguugccagucaccccg

SEQ ID NO: 1624869 - RNA, 13 nt, Human
ugcugcuggcugg

SEQ ID NO: 1624870 - RNA, 22 nt, Human
ugcaguucugaagaagauggua

SEQ ID NO: 1624871 - RNA, 19 nt, Human
ugcaguucugaagaagaug

SEQ ID NO: 1624872 - RNA, 14 nt, Human
ugcaguugccaguc

SEQ ID NO: 1624873 - RNA, 13 nt, Human
ugcaguugccagu

SEQ ID NO: 1624874 - RNA, 15 nt, Human
ugcaguugccaguca

SEQ ID NO: 1624875 - RNA, 18 nt, Human
ugcaguucugaagaagau

SEQ ID NO: 1624876 - RNA, 17 nt, Human
ugcaguucugaagaaga

SEQ ID NO: 1624877 - RNA, 16 nt, Human
ugcaguucugaagaag

SEQ ID NO: 1624878 - RNA, 15 nt, Human
ugcaguucugaagaa

SEQ ID NO: 1624879 - RNA, 20 nt, Human
ugcaguggugcgaucugggu

SEQ ID NO: 1624880 - RNA, 22 nt, Human
ugcagugguaugaucacggcuc

SEQ ID NO: 1624881 - RNA, 16 nt, Human
ugcagugcuuccaagg

SEQ ID NO: 1624882 - RNA, 14 nt, Human
ugcaggcagccagg

SEQ ID NO: 1624883 - RNA, 13 nt, Human
ugcaggcagccag

SEQ ID NO: 1624884 - RNA, 15 nt, Human
ugcaggcagccaggc

SEQ ID NO: 1624885 - RNA, 16 nt, Human
ugcacugucaagauga

SEQ ID NO: 1624886 - RNA, 14 nt, Human
ugcacuuuguucug

SEQ ID NO: 1624887 - RNA, 12 nt, Human
ugcacuuuguuc

SEQ ID NO: 1624888 - RNA, 23 nt, Human
ugcagcaauaaagcagcguuucu

SEQ ID NO: 1624889 - RNA, 21 nt, Human
ugcagagcaggaaacaugacu

SEQ ID NO: 1624890 - RNA, 15 nt, Human
ugcaccgggccacag

SEQ ID NO: 1624891 - RNA, 14 nt, Human
ugcaccgggccaca

SEQ ID NO: 1624892 - RNA, 23 nt, Human
ugcaccggcuggccuggccccuc

SEQ ID NO: 1624893 - RNA, 19 nt, Human
ugaguccccuguuuguuuc

SEQ ID NO: 1624894 - RNA, 22 nt, Human
ugcaccgggccacagagaaagu

SEQ ID NO: 1624895 - RNA, 17 nt, Human
ugcaccgggccacagag

SEQ ID NO: 1624896 - RNA, 20 nt, Human
ugaguccccuguuuguuucu

SEQ ID NO: 1624897 - RNA, 19 nt, Human
ugcacggugaauggcuuug

SEQ ID NO: 1624898 - RNA, 18 nt, Human
ugcacggugaauggcuuu

SEQ ID NO: 1624899 - RNA, 14 nt, Human
ugcacggugaaugg

SEQ ID NO: 1624900 - RNA, 14 nt, Human
ugccaucccucccu

SEQ ID NO: 1624901 - RNA, 11 nt, Human
ugccaucccuc

SEQ ID NO: 1624902 - RNA, 12 nt, Human
ugccaucccucc

SEQ ID NO: 1624903 - RNA, 21 nt, Human
ugccauccagguucagcuugu

SEQ ID NO: 1624904 - RNA, 24 nt, Human
ugccagguuuuuggucugacccac

SEQ ID NO: 1624905 - RNA, 14 nt, Human
ugcccaccuggccu

SEQ ID NO: 1624906 - RNA, 13 nt, Human
ugcccaccuggcc

SEQ ID NO: 1624907 - RNA, 13 nt, Human
ugcccaggcuggc

SEQ ID NO: 1624908 - RNA, 21 nt, Human
ugcccacucccugcaaccuga

SEQ ID NO: 1624909 - RNA, 11 nt, Human
ugcccaggcug

SEQ ID NO: 1624910 - RNA, 16 nt, Human
ugcccacucccugcaa

SEQ ID NO: 1624911 - RNA, 15 nt, Human
ugcccacucccugca

SEQ ID NO: 1624912 - RNA, 14 nt, Human
ugcccacucccugc

SEQ ID NO: 1624913 - RNA, 23 nt, Human
ugccccucaacucuccuccagag

SEQ ID NO: 1624914 - RNA, 15 nt, Human
ugccccagggcuccc

SEQ ID NO: 1624915 - RNA, 13 nt, Human
ugccccucccuuc

SEQ ID NO: 1624916 - RNA, 19 nt, Human
ugccaaauauaaauaaaaa

SEQ ID NO: 1624917 - RNA, 22 nt, Human
ugccaaauauaaauaaaaauaa

SEQ ID NO: 1624918 - RNA, 14 nt, Human
ugcaucaagaugug

SEQ ID NO: 1624919 - RNA, 19 nt, Human
ugcaucaagaugugacaug

SEQ ID NO: 1624920 - RNA, 17 nt, Human
ugccaaauauaaauaaa

SEQ ID NO: 1624921 - RNA, 18 nt, Human
ugccaaauauaaauaaaa

SEQ ID NO: 1624922 - RNA, 21 nt, Human
ugcauauuuauaaaaauaaaa

SEQ ID NO: 1624923 - RNA, 20 nt, Human
ugcauauuuauaaaaauaaa

SEQ ID NO: 1624924 - RNA, 20 nt, Human
ugccacuaaauugacacuua

SEQ ID NO: 1624925 - RNA, 19 nt, Human
ugccacccuggggagaaag

SEQ ID NO: 1624926 - RNA, 22 nt, Human
ugccacuacggaauaguuggcu

SEQ ID NO: 1624927 - RNA, 20 nt, Human
ugccacccuggggagaaagu

SEQ ID NO: 1624928 - RNA, 22 nt, Human
ugccagguuuuuggucugaccc

SEQ ID NO: 1624929 - RNA, 19 nt, Human
ugccagguuuuuggucuga

SEQ ID NO: 1624930 - RNA, 18 nt, Human
ugccagguuuuuggucug

SEQ ID NO: 1624931 - RNA, 10 nt, Human
ugccaggcau

SEQ ID NO: 1624932 - RNA, 15 nt, Human
uguacgucugacagg

SEQ ID NO: 1624933 - RNA, 16 nt, Human
uguacgucugacaggc

SEQ ID NO: 1624934 - RNA, 18 nt, Human
uguagcauccuggaauau

SEQ ID NO: 1624935 - RNA, 17 nt, Human
uguagcauccuggaaua

SEQ ID NO: 1624936 - RNA, 16 nt, Human
uguagcauccuggaau

SEQ ID NO: 1624937 - RNA, 14 nt, Human
uguagcauccugga

SEQ ID NO: 1624938 - RNA, 22 nt, Human
uguaguguuggagaagaacuga

SEQ ID NO: 1624939 - RNA, 18 nt, Human
uguagccccucuccugga

SEQ ID NO: 1624940 - RNA, 16 nt, Human
uguaccgcaaugugac

SEQ ID NO: 1624941 - RNA, 21 nt, Human
uguacagagcccacgccccca

SEQ ID NO: 1624942 - RNA, 18 nt, Human
uguacagagcccacgccc

SEQ ID NO: 1624943 - RNA, 17 nt, Human
uguacagagcccacgcc

SEQ ID NO: 1624944 - RNA, 16 nt, Human
uguacagagcccacgc

SEQ ID NO: 1624945 - RNA, 17 nt, Human
uguaauuaaguacuaug

SEQ ID NO: 1624946 - RNA, 23 nt, Human
uguacaaggacagccccuccucc

SEQ ID NO: 1624947 - RNA, 20 nt, Human
uguacaaggacagccccucc

SEQ ID NO: 1624948 - RNA, 16 nt, Human
uguacaaggacagccc

SEQ ID NO: 1624949 - RNA, 17 nt, Human
uggucacaggaaguaga

SEQ ID NO: 1624950 - RNA, 14 nt, Human
uguaaucacagcua

SEQ ID NO: 1624951 - RNA, 16 nt, Human
uguaugauucccagcc

SEQ ID NO: 1624952 - RNA, 22 nt, Human
uguauucucuccuguaccucuu

SEQ ID NO: 1624953 - RNA, 21 nt, Human
uguauugugcgcuaaacuuuu

SEQ ID NO: 1624954 - RNA, 15 nt, Human
uguaugauucccagc

SEQ ID NO: 1624955 - RNA, 22 nt, Human
uguauaaaagggacugagaaau

SEQ ID NO: 1624956 - RNA, 17 nt, Human
ugucacacacuuuggcu

SEQ ID NO: 1624957 - RNA, 12 nt, Human
ugucacaggcag

SEQ ID NO: 1624958 - RNA, 13 nt, Human
ugucacaggcagg

SEQ ID NO: 1624959 - RNA, 20 nt, Human
uguauuuauuuaguauuuau

SEQ ID NO: 1624960 - RNA, 22 nt, Human
uguccccaccgcagacaggacc

SEQ ID NO: 1624961 - RNA, 19 nt, Human
uguccccaccgcagacagg

SEQ ID NO: 1624962 - RNA, 18 nt, Human
uguccccaccgcagacag

SEQ ID NO: 1624963 - RNA, 20 nt, Human
uguccuacccacccuccuuu

SEQ ID NO: 1624964 - RNA, 17 nt, Human
uguccccgacccuugcc

SEQ ID NO: 1624965 - RNA, 16 nt, Human
uguccccgacccuugc

SEQ ID NO: 1624966 - RNA, 17 nt, Human
uguccuacucuguguca

SEQ ID NO: 1624967 - RNA, 12 nt, Human
uguccuacucug

SEQ ID NO: 1624968 - RNA, 16 nt, Human
ugucauuugagcaggg

SEQ ID NO: 1624969 - RNA, 19 nt, Human
ugucauuugagcagggcuc

SEQ ID NO: 1624970 - RNA, 16 nt, Human
ugucccaacuuguaaa

SEQ ID NO: 1624971 - RNA, 13 nt, Human
ugucaccugaaga

SEQ ID NO: 1624972 - RNA, 20 nt, Human
ugugaggaagccgcuggggc

SEQ ID NO: 1624973 - RNA, 18 nt, Human
ugugaggaagccgcuggg

SEQ ID NO: 1624974 - RNA, 13 nt, Human
ugugaggaagccg

SEQ ID NO: 1624975 - RNA, 21 nt, Human
ugugagucaccaagcccaguu

SEQ ID NO: 1624976 - RNA, 19 nt, Human
ugugagucaccaagcccag

SEQ ID NO: 1624977 - RNA, 17 nt, Human
ugugagucaccaagccc

SEQ ID NO: 1624978 - RNA, 16 nt, Human
ugugauauaagugugu

SEQ ID NO: 1624979 - RNA, 16 nt, Human
ugucugaagucacugc

SEQ ID NO: 1624980 - RNA, 18 nt, Human
ugucugaagucacugcac

SEQ ID NO: 1624981 - RNA, 17 nt, Human
ugucugaagucacugca

SEQ ID NO: 1624982 - RNA, 20 nt, Human
ugucugaagucacugcacag

SEQ ID NO: 1624983 - RNA, 19 nt, Human
ugucugaagucacugcaca

SEQ ID NO: 1624984 - RNA, 21 nt, Human
ugucuuuucuugcaugaggcu

SEQ ID NO: 1624985 - RNA, 16 nt, Human
ugucuuuggacccuga

SEQ ID NO: 1624986 - RNA, 14 nt, Human
ugucuuuggacccu

SEQ ID NO: 1624987 - RNA, 17 nt, Human
ugucuuuggacccugag

SEQ ID NO: 1624988 - RNA, 23 nt, Human
ugucuuuucuugcaugaggcuag

SEQ ID NO: 1624989 - RNA, 23 nt, Human
ugugaaaagaaaaaugagccugg

SEQ ID NO: 1624990 - RNA, 16 nt, Human
ugucuuuuuucacuac

SEQ ID NO: 1624991 - RNA, 16 nt, Human
ugugaaaaugugugug

SEQ ID NO: 1624992 - RNA, 17 nt, Human
ugugaaaaugugugugu

SEQ ID NO: 1624993 - RNA, 19 nt, Human
ugugcuaguaauuggaaag

SEQ ID NO: 1624994 - RNA, 19 nt, Human
ugugcgccuacaggaguga

SEQ ID NO: 1624995 - RNA, 14 nt, Human
ugugcgccuacagg

SEQ ID NO: 1624996 - RNA, 16 nt, Human
ugugcucaggagcccu

SEQ ID NO: 1624997 - RNA, 15 nt, Human
ugugcucaggagccc

SEQ ID NO: 1624998 - RNA, 17 nt, Human
ugugcucaggagcccug

SEQ ID NO: 1624999 - RNA, 20 nt, Human
ugugcucaggagcccuggga

SEQ ID NO: 1625000 - RNA, 14 nt, Human
ugugcuuguuaacu

SEQ ID NO: 1625001 - RNA, 14 nt, Human
ugugcauuaucuag

SEQ ID NO: 1625002 - RNA, 16 nt, Human
ugugcauuaucuagau

SEQ ID NO: 1625003 - RNA, 19 nt, Human
ugugcauuaucuagauacu

SEQ ID NO: 1625004 - RNA, 16 nt, Human
ugugcacaugcacgug

SEQ ID NO: 1625005 - RNA, 20 nt, Human
ugugcauuaucuagauacug

SEQ ID NO: 1625006 - RNA, 21 nt, Human
ugugcauuaucuagauacugu

SEQ ID NO: 1625007 - RNA, 23 nt, Human
ugugcauuaucuagauacuguau

SEQ ID NO: 1625008 - RNA, 23 nt, Human
ugugcauuuggugguuucagaaa

SEQ ID NO: 1625009 - RNA, 12 nt, Human
uguguagggcgg

SEQ ID NO: 1625010 - RNA, 16 nt, Human
uguguagggcgggagg

SEQ ID NO: 1625011 - RNA, 22 nt, Human
ugugggcuaguugggcuuccuc

SEQ ID NO: 1625012 - RNA, 22 nt, Human
ugugggcgugagaccugccccu

SEQ ID NO: 1625013 - RNA, 21 nt, Human
ugugggcgugagaccugcccc

SEQ ID NO: 1625014 - RNA, 20 nt, Human
ugugggcgugagaccugccc

SEQ ID NO: 1625015 - RNA, 23 nt, Human
uguggcgcagcauauucaggaag

SEQ ID NO: 1625016 - RNA, 10 nt, Human
uguggcucac

SEQ ID NO: 1625017 - RNA, 19 nt, Human
uguggacacagcucuucuc

SEQ ID NO: 1625018 - RNA, 13 nt, Human
uguggacacagcu

SEQ ID NO: 1625019 - RNA, 18 nt, Human
uguggacacagcucuucu

SEQ ID NO: 1625020 - RNA, 17 nt, Human
uguucauaaauaaaguu

SEQ ID NO: 1625021 - RNA, 22 nt, Human
uguucagcuccagcucaccagc

SEQ ID NO: 1625022 - RNA, 21 nt, Human
uguucagcuccagcucaccag

SEQ ID NO: 1625023 - RNA, 20 nt, Human
uguucagcuccagcucacca

SEQ ID NO: 1625024 - RNA, 14 nt, Human
uguuagugcaaauu

SEQ ID NO: 1625025 - RNA, 17 nt, Human
uguuaguaugaggcauu

SEQ ID NO: 1625026 - RNA, 19 nt, Human
uguuaguaugaggcauuug

SEQ ID NO: 1625027 - RNA, 20 nt, Human
uguuaguaugaggcauuugu

SEQ ID NO: 1625028 - RNA, 21 nt, Human
uguuaaaagaugaaaauauuu

SEQ ID NO: 1625029 - RNA, 16 nt, Human
uguuaaaccaugggau

SEQ ID NO: 1625030 - RNA, 14 nt, Human
uguuacuaaguuuu

SEQ ID NO: 1625031 - RNA, 17 nt, Human
uguuagccccauaauuu

SEQ ID NO: 1625032 - RNA, 19 nt, Human
uguguuuugcaagccagau

SEQ ID NO: 1625033 - RNA, 13 nt, Human
uguguuuugcaag

SEQ ID NO: 1625034 - RNA, 13 nt, Human
uguguuugaagca

SEQ ID NO: 1625035 - RNA, 18 nt, Human
uguguuuuucauaaagca

SEQ ID NO: 1625036 - RNA, 15 nt, Human
uguguuuuucauaaa

SEQ ID NO: 1625037 - RNA, 16 nt, Human
uguguuuauugucaaa

SEQ ID NO: 1625038 - RNA, 19 nt, Human
ugugugugcuuauguauga

SEQ ID NO: 1625039 - RNA, 20 nt, Human
ugugugugcuuauguaugag

SEQ ID NO: 1625040 - RNA, 17 nt, Human
ugugugugaaaaugugu

SEQ ID NO: 1625041 - RNA, 22 nt, Human
ugugugaaagguacuucaaauc

SEQ ID NO: 1625042 - RNA, 21 nt, Human
ugugugaaagguacuucaaau

SEQ ID NO: 1625043 - RNA, 18 nt, Human
uguguaugcgugugugug

SEQ ID NO: 1625044 - RNA, 19 nt, Human
ugugugcacguacacacac

SEQ ID NO: 1625045 - RNA, 15 nt, Human
ugugugcuuauguau

SEQ ID NO: 1625046 - RNA, 20 nt, Human
uguuggagaagaacugaaau

SEQ ID NO: 1625047 - RNA, 19 nt, Human
uguuggagaagaacugaaa

SEQ ID NO: 1625048 - RNA, 16 nt, Human
uguuggccaggcuggu

SEQ ID NO: 1625049 - RNA, 15 nt, Human
uguuggccaggcugg

SEQ ID NO: 1625050 - RNA, 15 nt, Human
uguuggccaaagcca

SEQ ID NO: 1625051 - RNA, 14 nt, Human
uguuggcagccucu

SEQ ID NO: 1625052 - RNA, 17 nt, Human
uguuggagaagaacuga

SEQ ID NO: 1625053 - RNA, 16 nt, Human
uguuggagaagaacug

SEQ ID NO: 1625054 - RNA, 14 nt, Human
uguuggagaagaac

SEQ ID NO: 1625055 - RNA, 18 nt, Human
uguuuaaaaucauuucug

SEQ ID NO: 1625056 - RNA, 17 nt, Human
uguuuaaaaucauuucu

SEQ ID NO: 1625057 - RNA, 19 nt, Human
uguuggcugggggccucag

SEQ ID NO: 1625058 - RNA, 17 nt, Human
uguuggcugggggccuc

SEQ ID NO: 1625059 - RNA, 12 nt, Human
uguuuaagagac

SEQ ID NO: 1625060 - RNA, 20 nt, Human
uguugacaugggacauuugc

SEQ ID NO: 1625061 - RNA, 15 nt, Human
uguugaagccuuugu

SEQ ID NO: 1625062 - RNA, 20 nt, Human
uguucuggcucuuccaggcu

SEQ ID NO: 1625063 - RNA, 17 nt, Human
uguucuggcucuuccag

SEQ ID NO: 1625064 - RNA, 21 nt, Human
uguucuggcucuuccaggcug

SEQ ID NO: 1625065 - RNA, 12 nt, Human
uguucugggaca

SEQ ID NO: 1625066 - RNA, 15 nt, Human
uguucugcuuuccuc

SEQ ID NO: 1625067 - RNA, 23 nt, Human
uguucuuucuggcuaugcauuug

SEQ ID NO: 1625068 - RNA, 16 nt, Human
uguucuggcucuucca

SEQ ID NO: 1625069 - RNA, 13 nt, Human
uguucuggcucuu

SEQ ID NO: 1625070 - RNA, 12 nt, Human
uguucuggcucu

SEQ ID NO: 1625071 - RNA, 13 nt, Human
uguucucugagga

SEQ ID NO: 1625072 - RNA, 16 nt, Human
uguucucugcccucca

SEQ ID NO: 1625073 - RNA, 15 nt, Human
uguucucugcccucc

SEQ ID NO: 1625074 - RNA, 14 nt, Human
uguucucugcccuc

SEQ ID NO: 1625075 - RNA, 13 nt, Human
uguucucugcccu

SEQ ID NO: 1625076 - RNA, 16 nt, Human
uguucucucuucucca

SEQ ID NO: 1625077 - RNA, 15 nt, Human
uguucucucuucucc

SEQ ID NO: 1625078 - RNA, 19 nt, Human
uguucaucauccuaagcua

SEQ ID NO: 1625079 - RNA, 14 nt, Human
uguucaugaaagau

SEQ ID NO: 1625080 - RNA, 13 nt, Human
uguucaugaaaga

SEQ ID NO: 1625081 - RNA, 15 nt, Human
uguuuccuggcacug

SEQ ID NO: 1625082 - RNA, 16 nt, Human
uguuuuaagaggcagg

SEQ ID NO: 1625083 - RNA, 16 nt, Human
uguuuguugucagcug

SEQ ID NO: 1625084 - RNA, 23 nt, Human
uguuucuguacuuuuuggcauaa

SEQ ID NO: 1625085 - RNA, 22 nt, Human
uguuucuguacuuuuuggcaua

SEQ ID NO: 1625086 - RNA, 11 nt, Human
uguuucuguac

SEQ ID NO: 1625087 - RNA, 22 nt, Human
uuaaaaaaaaaccugagcccca

SEQ ID NO: 1625088 - RNA, 15 nt, Human
uuaaaaaaaaaauug

SEQ ID NO: 1625089 - RNA, 17 nt, Human
uguuuuaagaggcaggg

SEQ ID NO: 1625090 - RNA, 22 nt, Human
uguuuuaaggaugcuuguacau

SEQ ID NO: 1625091 - RNA, 23 nt, Human
uguuuuaaggaugcuuguacaua

SEQ ID NO: 1625092 - RNA, 19 nt, Human
uuaaaauacacacucaaau

SEQ ID NO: 1625093 - RNA, 18 nt, Human
uuaaaauacacacucaaa

SEQ ID NO: 1625094 - RNA, 14 nt, Human
uuaaaacccaagug

SEQ ID NO: 1625095 - RNA, 20 nt, Human
uuaaagccauguuuauuaca

SEQ ID NO: 1625096 - RNA, 18 nt, Human
uuaaagccauguuuauua

SEQ ID NO: 1625097 - RNA, 14 nt, Human
uuaaagccauguuu

SEQ ID NO: 1625098 - RNA, 12 nt, Human
uuaaagccaugu

SEQ ID NO: 1625099 - RNA, 16 nt, Human
uuaaaugcccagcccc

SEQ ID NO: 1625100 - RNA, 15 nt, Human
uuaaaugcccagccc

SEQ ID NO: 1625101 - RNA, 14 nt, Human
uuaaaugcccagcc

SEQ ID NO: 1625102 - RNA, 11 nt, Human
uuaaaugcacc

SEQ ID NO: 1625103 - RNA, 22 nt, Human
uuaauuaaaacacaacaucuuu

SEQ ID NO: 1625104 - RNA, 20 nt, Human
uuaauauuaaagccauguuu

SEQ ID NO: 1625105 - RNA, 19 nt, Human
uuaauauuaaagccauguu

SEQ ID NO: 1625106 - RNA, 18 nt, Human
uuaauauuaaagccaugu

SEQ ID NO: 1625107 - RNA, 20 nt, Human
uuacagagacagaaagcaga

SEQ ID NO: 1625108 - RNA, 20 nt, Human
uuacauuuguauaaaauaau

SEQ ID NO: 1625109 - RNA, 12 nt, Human
uuacauuuuuaa

SEQ ID NO: 1625110 - RNA, 17 nt, Human
uuacauuuuuaagugcu

SEQ ID NO: 1625111 - RNA, 20 nt, Human
uuacacuuuaugcacaaaau

SEQ ID NO: 1625112 - RNA, 13 nt, Human
uuacacuuuaugc

SEQ ID NO: 1625113 - RNA, 12 nt, Human
uuacagaagccc

SEQ ID NO: 1625114 - RNA, 16 nt, Human
uuaauaauguuucaaa

SEQ ID NO: 1625115 - RNA, 11 nt, Human
uuaauauuaaa

SEQ ID NO: 1625116 - RNA, 17 nt, Human
uuaauauuaaagccaug

SEQ ID NO: 1625117 - RNA, 16 nt, Human
uuaauauuaaagccau

SEQ ID NO: 1625118 - RNA, 14 nt, Human
uuaauauuaaagcc

SEQ ID NO: 1625119 - RNA, 13 nt, Human
uuaauauuaaagc

SEQ ID NO: 1625120 - RNA, 14 nt, Human
uuaacuuuuauaaa

SEQ ID NO: 1625121 - RNA, 12 nt, Human
uuaagaguaaaa

SEQ ID NO: 1625122 - RNA, 17 nt, Human
uuaaaugcccagccccu

SEQ ID NO: 1625123 - RNA, 12 nt, Human
uuaacuuuuaua

SEQ ID NO: 1625124 - RNA, 13 nt, Human
uuaacuuuuauaa

SEQ ID NO: 1625125 - RNA, 12 nt, Human
aaaaacacagca

SEQ ID NO: 1625126 - RNA, 14 nt, Human
aaaaacacaaaagu

SEQ ID NO: 1625127 - RNA, 14 nt, Human
aaaacaaggaugaa

SEQ ID NO: 1625128 - RNA, 13 nt, Human
aaaacacagcaag

SEQ ID NO: 1625129 - RNA, 12 nt, Human
aaaacacagcaa

SEQ ID NO: 1625130 - RNA, 18 nt, Human
aaaacacagcaaggguga

SEQ ID NO: 1625131 - RNA, 12 nt, Human
aaaacacauuuu

SEQ ID NO: 1625132 - RNA, 17 nt, Human
aaaacaaggaugaauua

SEQ ID NO: 1625133 - RNA, 12 nt, Human
aaaaagaggcua

SEQ ID NO: 1625134 - RNA, 20 nt, Human
aaaaauuggggauucuuaaa

SEQ ID NO: 1625135 - RNA, 19 nt, Human
aaaaauuggggauucuuaa

SEQ ID NO: 1625136 - RNA, 18 nt, Human
aaaaauuggggauucuua

SEQ ID NO: 1625137 - RNA, 17 nt, Human
aaaaauuggggauucuu

SEQ ID NO: 1625138 - RNA, 13 nt, Human
aaaaacugauuuu

SEQ ID NO: 1625139 - RNA, 18 nt, Human
aaaaaccaguauuguaca

SEQ ID NO: 1625140 - RNA, 16 nt, Human
aaaaaccaguauugua

SEQ ID NO: 1625141 - RNA, 14 nt, Human
aaaaacauggccuu

SEQ ID NO: 1625142 - RNA, 15 nt, Human
aaaaacugauuuuuu

SEQ ID NO: 1625143 - RNA, 20 nt, Human
aaaaaccaguauuguacaaa

SEQ ID NO: 1625144 - RNA, 18 nt, Human
aauuaaaacacaacaucu

SEQ ID NO: 1625145 - RNA, 19 nt, Human
aauguuugccucugccucu

SEQ ID NO: 1625146 - RNA, 18 nt, Human
aauguuugccucugccuc

SEQ ID NO: 1625147 - RNA, 13 nt, Human
aaugggcagagca

SEQ ID NO: 1625148 - RNA, 15 nt, Human
aaugggcagagcaga

SEQ ID NO: 1625149 - RNA, 13 nt, Human
aauggcuuuguau

SEQ ID NO: 1625150 - RNA, 18 nt, Human
aauggcuuuguauagaac

SEQ ID NO: 1625151 - RNA, 16 nt, Human
aauggcuuuguauaga

SEQ ID NO: 1625152 - RNA, 15 nt, Human
aauggcuuuguauag

SEQ ID NO: 1625153 - RNA, 21 nt, Human
aaugucagugugacugaucuc

SEQ ID NO: 1625154 - RNA, 17 nt, Human
aaugucagugugacuga

SEQ ID NO: 1625155 - RNA, 22 nt, Human
aaugucuaguuguaacaccaug

SEQ ID NO: 1625156 - RNA, 20 nt, Human
aaugucucuuuaaugucaca

SEQ ID NO: 1625157 - RNA, 13 nt, Human
aaugucaguguga

SEQ ID NO: 1625158 - RNA, 16 nt, Human
aaugucagugugacug

SEQ ID NO: 1625159 - RNA, 15 nt, Human
aaugucagugugacu

SEQ ID NO: 1625160 - RNA, 22 nt, Human
aauggucuuucuaaugugugaa

SEQ ID NO: 1625161 - RNA, 20 nt, Human
aauuaguuuuauaugcuucu

SEQ ID NO: 1625162 - RNA, 17 nt, Human
aauuaguuuuauaugcu

SEQ ID NO: 1625163 - RNA, 14 nt, Human
aauuaguuuuauau

SEQ ID NO: 1625164 - RNA, 18 nt, Human
aauuaguggcacuugcuu

SEQ ID NO: 1625165 - RNA, 17 nt, Human
aaugaagauacugaaau

SEQ ID NO: 1625166 - RNA, 20 nt, Human
aaugauaacuggaaacuuca

SEQ ID NO: 1625167 - RNA, 21 nt, Human
aaugaugauccuaggcauuug

SEQ ID NO: 1625168 - RNA, 17 nt, Human
aaugauaacuggaaacu

SEQ ID NO: 1625169 - RNA, 12 nt, Human
aaugaagauacu

SEQ ID NO: 1625170 - RNA, 22 nt, Human
aaucugcuuuuuaaagaaugcu

SEQ ID NO: 1625171 - RNA, 23 nt, Human
aaugaaccacaucuugcucugcu

SEQ ID NO: 1625172 - RNA, 17 nt, Human
aaugaaccacaucuugc

SEQ ID NO: 1625173 - RNA, 16 nt, Human
aaugaaccacaucuug

SEQ ID NO: 1625174 - RNA, 13 nt, Human
aaucuccaaaaua

SEQ ID NO: 1625175 - RNA, 14 nt, Human
aaucuccaaaauaa

SEQ ID NO: 1625176 - RNA, 18 nt, Human
aaucuccaaaauaaaacu

SEQ ID NO: 1625177 - RNA, 22 nt, Human
aauccauuuggaaaucuuuaaa

SEQ ID NO: 1625178 - RNA, 18 nt, Human
aauccauuuggaaaucuu

SEQ ID NO: 1625179 - RNA, 17 nt, Human
aauccauuuggaaaucu

SEQ ID NO: 1625180 - RNA, 15 nt, Human
aauccauuuggaaau

SEQ ID NO: 1625181 - RNA, 14 nt, Human
aauccauuuggaaa

SEQ ID NO: 1625182 - RNA, 14 nt, Human
aauccauacauuug

SEQ ID NO: 1625183 - RNA, 13 nt, Human
aauccauacauuu

SEQ ID NO: 1625184 - RNA, 18 nt, Human
aauccaggguggugguga

SEQ ID NO: 1625185 - RNA, 19 nt, Human
aaugaugccaugaggaaca

SEQ ID NO: 1625186 - RNA, 16 nt, Human
aauauuauguuaaaac

SEQ ID NO: 1625187 - RNA, 15 nt, Human
aaucaagaaacuuaa

SEQ ID NO: 1625188 - RNA, 13 nt, Human
aaucacaauacau

SEQ ID NO: 1625189 - RNA, 18 nt, Human
aauauaggaacuuaaaua

SEQ ID NO: 1625190 - RNA, 20 nt, Human
aauauaggaacuuaaauaau

SEQ ID NO: 1625191 - RNA, 21 nt, Human
aauauaggaacuuaaauaaug

SEQ ID NO: 1625192 - RNA, 23 nt, Human
aaguccaggcuuuuuuaucaugu

SEQ ID NO: 1625193 - RNA, 16 nt, Human
aaguaucccuacugua

SEQ ID NO: 1625194 - RNA, 11 nt, Human
aaguacuucuu

SEQ ID NO: 1625195 - RNA, 15 nt, Human
aaguacuuuuggcau

SEQ ID NO: 1625196 - RNA, 14 nt, Human
aaguacuuuuggca

SEQ ID NO: 1625197 - RNA, 11 nt, Human
aaggugggagg

SEQ ID NO: 1625198 - RNA, 20 nt, Human
aagguuaauguucaucaucc

SEQ ID NO: 1625199 - RNA, 16 nt, Human
aagguuaauaaaguaa

SEQ ID NO: 1625200 - RNA, 15 nt, Human
aagguuaauaaagua

SEQ ID NO: 1625201 - RNA, 16 nt, Human
aagucuuagauguaua

SEQ ID NO: 1625202 - RNA, 17 nt, Human
aagucuuagauguauau

SEQ ID NO: 1625203 - RNA, 19 nt, Human
aagucucuggaauuugaaa

SEQ ID NO: 1625204 - RNA, 21 nt, Human
aauaauccuaaacauaugaau

SEQ ID NO: 1625205 - RNA, 16 nt, Human
aauaaugugaaacugg

SEQ ID NO: 1625206 - RNA, 19 nt, Human
aauaauguaagacaaauau

SEQ ID NO: 1625207 - RNA, 12 nt, Human
aauaauguaaga

SEQ ID NO: 1625208 - RNA, 19 nt, Human
aauaaaauggguuuuacug

SEQ ID NO: 1625209 - RNA, 23 nt, Human
aauaaaauuaaagcugaaaacug

SEQ ID NO: 1625210 - RNA, 16 nt, Human
aauaaacgucuuaaau

SEQ ID NO: 1625211 - RNA, 17 nt, Human
aauaaacgucuuaaaua

SEQ ID NO: 1625212 - RNA, 19 nt, Human
aauaaacuauuuguaaagu

SEQ ID NO: 1625213 - RNA, 14 nt, Human
aauaaaauggguuu

SEQ ID NO: 1625214 - RNA, 13 nt, Human
aagccagauuuuc

SEQ ID NO: 1625215 - RNA, 21 nt, Human
aagcagaggaaggagaggaga

SEQ ID NO: 1625216 - RNA, 14 nt, Human
aagcagaggaagga

SEQ ID NO: 1625217 - RNA, 16 nt, Human
aagauuuaccacuugu

SEQ ID NO: 1625218 - RNA, 22 nt, Human
aagaaauuaugugccagauuua

SEQ ID NO: 1625219 - RNA, 13 nt, Human
aagaaauuaugug

SEQ ID NO: 1625220 - RNA, 13 nt, Human
aagccauguuuau

SEQ ID NO: 1625221 - RNA, 18 nt, Human
aaggcaaggcugucaauu

SEQ ID NO: 1625222 - RNA, 17 nt, Human
aaggcaaggcugucaau

SEQ ID NO: 1625223 - RNA, 12 nt, Human
aagcguggugga

SEQ ID NO: 1625224 - RNA, 20 nt, Human
aagcugcacccucaggcagg

SEQ ID NO: 1625225 - RNA, 21 nt, Human
aagcugcacccucaggcaggu

SEQ ID NO: 1625226 - RNA, 22 nt, Human
aagcugcacccucaggcaggug

SEQ ID NO: 1625227 - RNA, 18 nt, Human
aaggacauugcggacagc

SEQ ID NO: 1625228 - RNA, 13 nt, Human
aagcugggcaggu

SEQ ID NO: 1625229 - RNA, 15 nt, Human
aagcugggcagguug

SEQ ID NO: 1625230 - RNA, 11 nt, Human
aagcugggcag

SEQ ID NO: 1625231 - RNA, 20 nt, Human
aaggacuaggguccugggga

SEQ ID NO: 1625232 - RNA, 18 nt, Human
aaggacuaggguccuggg

SEQ ID NO: 1625233 - RNA, 21 nt, Human
aaggacccggaggggccuggc

SEQ ID NO: 1625234 - RNA, 18 nt, Human
aaggacccggaggggccu

SEQ ID NO: 1625235 - RNA, 16 nt, Human
aaauaguaaaaauaaa

SEQ ID NO: 1625236 - RNA, 13 nt, Human
aaauaguaaaaau

SEQ ID NO: 1625237 - RNA, 14 nt, Human
aaauauaauugaca

SEQ ID NO: 1625238 - RNA, 14 nt, Human
aaauauuuuaugau

SEQ ID NO: 1625239 - RNA, 19 nt, Human
aaauauuuuaugauccagc

SEQ ID NO: 1625240 - RNA, 18 nt, Human
aaauauuuuaugauccag

SEQ ID NO: 1625241 - RNA, 22 nt, Human
aaauacuguuuuuaacaacuau

SEQ ID NO: 1625242 - RNA, 19 nt, Human
aaaucaaauaugcaaagca

SEQ ID NO: 1625243 - RNA, 18 nt, Human
aaaucaaauaugcaaagc

SEQ ID NO: 1625244 - RNA, 18 nt, Human
aaauggaagacagcucuu

SEQ ID NO: 1625245 - RNA, 16 nt, Human
aaauggaaaugggcag

SEQ ID NO: 1625246 - RNA, 22 nt, Human
aaauggacguguuaugacucca

SEQ ID NO: 1625247 - RNA, 21 nt, Human
aaauggacguguuaugacucc

SEQ ID NO: 1625248 - RNA, 20 nt, Human
aaauggacguguuaugacuc

SEQ ID NO: 1625249 - RNA, 18 nt, Human
aaauggcuuccuggcaau

SEQ ID NO: 1625250 - RNA, 20 nt, Human
aaauggacuguggugacuuu

SEQ ID NO: 1625251 - RNA, 19 nt, Human
aaauggacuguggugacuu

SEQ ID NO: 1625252 - RNA, 12 nt, Human
aaauaacaauga

SEQ ID NO: 1625253 - RNA, 22 nt, Human
aaauaaaauuaaagcugaaaac

SEQ ID NO: 1625254 - RNA, 14 nt, Human
aaagugcugggauu

SEQ ID NO: 1625255 - RNA, 11 nt, Human
aaagugcuggg

SEQ ID NO: 1625256 - RNA, 22 nt, Human
aaagucucuggaauuugaaaca

SEQ ID NO: 1625257 - RNA, 20 nt, Human
aaagucucuggaauuugaaa

SEQ ID NO: 1625258 - RNA, 19 nt, Human
aaagucucuggaauuugaa

SEQ ID NO: 1625259 - RNA, 16 nt, Human
aaagggacugagaaau

SEQ ID NO: 1625260 - RNA, 20 nt, Human
aaagggacugagaaauuuau

SEQ ID NO: 1625261 - RNA, 13 nt, Human
aaaacacauuuuu

SEQ ID NO: 1625262 - RNA, 15 nt, Human
aaaacacauuuuucu

SEQ ID NO: 1625263 - RNA, 13 nt, Human
aaaauucagugga

SEQ ID NO: 1625264 - RNA, 18 nt, Human
aaacacuguucucugccc

SEQ ID NO: 1625265 - RNA, 17 nt, Human
aaacacucuugaaaaau

SEQ ID NO: 1625266 - RNA, 14 nt, Human
aaacacucuugaaa

SEQ ID NO: 1625267 - RNA, 13 nt, Human
aaacacucuugaa

SEQ ID NO: 1625268 - RNA, 19 nt, Human
aaaauuggggauucuuaaa

SEQ ID NO: 1625269 - RNA, 18 nt, Human
aaaauuggggauucuuaa

SEQ ID NO: 1625270 - RNA, 17 nt, Human
aaaauuggggauucuua

SEQ ID NO: 1625271 - RNA, 22 nt, Human
aaacacuguucucugcccucca

SEQ ID NO: 1625272 - RNA, 19 nt, Human
aaacacuguucucugcccu

SEQ ID NO: 1625273 - RNA, 16 nt, Human
aaagaugaaaauauuu

SEQ ID NO: 1625274 - RNA, 13 nt, Human
aaagaugaaaaua

SEQ ID NO: 1625275 - RNA, 17 nt, Human
aaagaugaaaauauuug

SEQ ID NO: 1625276 - RNA, 15 nt, Human
aaacugccagcaacg

SEQ ID NO: 1625277 - RNA, 14 nt, Human
aaacugccagcaac

SEQ ID NO: 1625278 - RNA, 17 nt, Human
aaacugacucuuaagaa

SEQ ID NO: 1625279 - RNA, 16 nt, Human
aaacugacucuuaaga

SEQ ID NO: 1625280 - RNA, 19 nt, Human
aaacugccagcaacgcagg

SEQ ID NO: 1625281 - RNA, 11 nt, Human
aaacugccccc

SEQ ID NO: 1625282 - RNA, 20 nt, Human
aaagaaaacuuguauuaugu

SEQ ID NO: 1625283 - RNA, 12 nt, Human
aaagaaaacuug

SEQ ID NO: 1625284 - RNA, 11 nt, Human
aaagaacaucc

SEQ ID NO: 1625285 - RNA, 15 nt, Human
aaagaaauuaugugc

SEQ ID NO: 1625286 - RNA, 13 nt, Human
aaagaaauuaugu

SEQ ID NO: 1625287 - RNA, 12 nt, Human
aaagaguacucu

SEQ ID NO: 1625288 - RNA, 17 nt, Human
aaagaguacucuuguuu

SEQ ID NO: 1625289 - RNA, 19 nt, Human
aacuuugaccucugcagca

SEQ ID NO: 1625290 - RNA, 20 nt, Human
aacuuugaccucugcagcaa

SEQ ID NO: 1625291 - RNA, 12 nt, Human
aacuuuuauaaa

SEQ ID NO: 1625292 - RNA, 15 nt, Human
aacuuuuauaaacuu

SEQ ID NO: 1625293 - RNA, 13 nt, Human
aacuuugaccucu

SEQ ID NO: 1625294 - RNA, 14 nt, Human
aacuuugaccucug

SEQ ID NO: 1625295 - RNA, 17 nt, Human
aacuuugaccucugcag

SEQ ID NO: 1625296 - RNA, 14 nt, Human
aagaaauguaaggg

SEQ ID NO: 1625297 - RNA, 13 nt, Human
aagaaauguaagg

SEQ ID NO: 1625298 - RNA, 16 nt, Human
aacuuuuauaaacuuu

SEQ ID NO: 1625299 - RNA, 19 nt, Human
aacuuuuauaaacuuuacc

SEQ ID NO: 1625300 - RNA, 12 nt, Human
aacuuuucugau

SEQ ID NO: 1625301 - RNA, 14 nt, Human
aacuuuucugauag

SEQ ID NO: 1625302 - RNA, 13 nt, Human
aacuuuucugaua

SEQ ID NO: 1625303 - RNA, 13 nt, Human
aacuucacauauu

SEQ ID NO: 1625304 - RNA, 16 nt, Human
aacucaccugccccuc

SEQ ID NO: 1625305 - RNA, 15 nt, Human
aacucaccugccccu

SEQ ID NO: 1625306 - RNA, 15 nt, Human
aacucaccccagccc

SEQ ID NO: 1625307 - RNA, 12 nt, Human
aacucaccccag

SEQ ID NO: 1625308 - RNA, 16 nt, Human
aacugaacucugacaa

SEQ ID NO: 1625309 - RNA, 20 nt, Human
aacugaacucugacaacaga

SEQ ID NO: 1625310 - RNA, 19 nt, Human
aacugaacucugacaacag

SEQ ID NO: 1625311 - RNA, 23 nt, Human
aacugaacucugacaacagacuu

SEQ ID NO: 1625312 - RNA, 19 nt, Human
aacuuaaauaaugugaaac

SEQ ID NO: 1625313 - RNA, 17 nt, Human
aacuuaaauaaugugaa

SEQ ID NO: 1625314 - RNA, 19 nt, Human
aacugauuuuuuuuuccuu

SEQ ID NO: 1625315 - RNA, 20 nt, Human
aacugauuuuuuuuuccuuc

SEQ ID NO: 1625316 - RNA, 17 nt, Human
aacugauuuuuuuuucc

SEQ ID NO: 1625317 - RNA, 19 nt, Human
aacugaccagccuccaugc

SEQ ID NO: 1625318 - RNA, 14 nt, Human
aacugaccagccuc

SEQ ID NO: 1625319 - RNA, 15 nt, Human
aacacgagcaggcua

SEQ ID NO: 1625320 - RNA, 19 nt, Human
aacacauuuuucuuaggga

SEQ ID NO: 1625321 - RNA, 17 nt, Human
aacaaagaaauuaugug

SEQ ID NO: 1625322 - RNA, 15 nt, Human
aacaaagaaauuaug

SEQ ID NO: 1625323 - RNA, 17 nt, Human
aaauuggggauucuuaa

SEQ ID NO: 1625324 - RNA, 16 nt, Human
aaauuggggauucuua

SEQ ID NO: 1625325 - RNA, 18 nt, Human
aaauugcauuuccugaca

SEQ ID NO: 1625326 - RNA, 22 nt, Human
aaccacuggaaaguuuaugguu

SEQ ID NO: 1625327 - RNA, 14 nt, Human
aaccagaucauugu

SEQ ID NO: 1625328 - RNA, 21 nt, Human
aacauguaauuaaguacuaug

SEQ ID NO: 1625329 - RNA, 14 nt, Human
aacauguaauuaag

SEQ ID NO: 1625330 - RNA, 23 nt, Human
aacauguaauuaaguacuaugua

SEQ ID NO: 1625331 - RNA, 22 nt, Human
aaccacucuaucaaguauuaua

SEQ ID NO: 1625332 - RNA, 17 nt, Human
aaccaguguuguggauu

SEQ ID NO: 1625333 - RNA, 22 nt, Human
aaccaguauuguacaaaguauu

SEQ ID NO: 1625334 - RNA, 21 nt, Human
aaccaguauuguacaaaguau

SEQ ID NO: 1625335 - RNA, 20 nt, Human
aaccaguauuguacaaagua

SEQ ID NO: 1625336 - RNA, 22 nt, Human
aacaugcuacacacugcauguu

SEQ ID NO: 1625337 - RNA, 13 nt, Human
aacaugauuuggg

SEQ ID NO: 1625338 - RNA, 17 nt, Human
aacagcuggugcccugc

SEQ ID NO: 1625339 - RNA, 13 nt, Human
aacagcucgacuu

SEQ ID NO: 1625340 - RNA, 14 nt, Human
aacccuggugacca

SEQ ID NO: 1625341 - RNA, 14 nt, Human
acucccccaggugg

SEQ ID NO: 1625342 - RNA, 17 nt, Human
acuccccugcugggugu

SEQ ID NO: 1625343 - RNA, 13 nt, Human
acuccccugcugg

SEQ ID NO: 1625344 - RNA, 12 nt, Human
acuccccuccuu

SEQ ID NO: 1625345 - RNA, 14 nt, Human
acucaguggggagg

SEQ ID NO: 1625346 - RNA, 14 nt, Human
acucaaaucaagaa

SEQ ID NO: 1625347 - RNA, 11 nt, Human
acuauaaugua

SEQ ID NO: 1625348 - RNA, 16 nt, Human
acucaaacucuuaaaa

SEQ ID NO: 1625349 - RNA, 17 nt, Human
acucaaacucuuaaaac

SEQ ID NO: 1625350 - RNA, 14 nt, Human
acuagcuauggugu

SEQ ID NO: 1625351 - RNA, 15 nt, Human
acuaggguccugggg

SEQ ID NO: 1625352 - RNA, 16 nt, Human
acuaggguccugggga

SEQ ID NO: 1625353 - RNA, 13 nt, Human
acucccuuucaac

SEQ ID NO: 1625354 - RNA, 12 nt, Human
acucccuuucaa

SEQ ID NO: 1625355 - RNA, 18 nt, Human
acucuacccucuuagaaa

SEQ ID NO: 1625356 - RNA, 21 nt, Human
acucuacccucuuagaaaaac

SEQ ID NO: 1625357 - RNA, 14 nt, Human
acucuaucaaguau

SEQ ID NO: 1625358 - RNA, 16 nt, Human
acucuaucaaguauua

SEQ ID NO: 1625359 - RNA, 21 nt, Human
acucuaucaaguauuauaccu

SEQ ID NO: 1625360 - RNA, 16 nt, Human
acucugugucaggugg

SEQ ID NO: 1625361 - RNA, 19 nt, Human
acucugugucagguggggc

SEQ ID NO: 1625362 - RNA, 18 nt, Human
acucuuaaaacccaagug

SEQ ID NO: 1625363 - RNA, 11 nt, Human
acucuuaaaac

SEQ ID NO: 1625364 - RNA, 16 nt, Human
acuaagagagaaugag

SEQ ID NO: 1625365 - RNA, 17 nt, Human
acguggcugcuucaagg

SEQ ID NO: 1625366 - RNA, 15 nt, Human
acguggcugcuucaa

SEQ ID NO: 1625367 - RNA, 14 nt, Human
acguggcugcuuca

SEQ ID NO: 1625368 - RNA, 13 nt, Human
acguggcugcuuc

SEQ ID NO: 1625369 - RNA, 18 nt, Human
acgcugugcugcccugcc

SEQ ID NO: 1625370 - RNA, 17 nt, Human
acgcugugcugcccugc

SEQ ID NO: 1625371 - RNA, 16 nt, Human
acgcugugcugcccug

SEQ ID NO: 1625372 - RNA, 17 nt, Human
acgccagauucuuuccu

SEQ ID NO: 1625373 - RNA, 15 nt, Human
acuaaguuuuuaugg

SEQ ID NO: 1625374 - RNA, 22 nt, Human
acuaaguuuuuauggcuuuugu

SEQ ID NO: 1625375 - RNA, 12 nt, Human
acgauuucuguu

SEQ ID NO: 1625376 - RNA, 13 nt, Human
acgauuucuguuu

SEQ ID NO: 1625377 - RNA, 14 nt, Human
acgauuucuguuua

SEQ ID NO: 1625378 - RNA, 17 nt, Human
acgauuucuguuuagau

SEQ ID NO: 1625379 - RNA, 18 nt, Human
acgccacugcacuauagc

SEQ ID NO: 1625380 - RNA, 18 nt, Human
accucugcacaagcugca

SEQ ID NO: 1625381 - RNA, 16 nt, Human
accucugcacaagcug

SEQ ID NO: 1625382 - RNA, 21 nt, Human
accucugcacaagcugcaccc

SEQ ID NO: 1625383 - RNA, 15 nt, Human
accucugcagcaaua

SEQ ID NO: 1625384 - RNA, 23 nt, Human
accugccccucaacucuccucca

SEQ ID NO: 1625385 - RNA, 18 nt, Human
accugccccuccucucug

SEQ ID NO: 1625386 - RNA, 14 nt, Human
accugccccuccuc

SEQ ID NO: 1625387 - RNA, 21 nt, Human
accugcccaaccugcucuccu

SEQ ID NO: 1625388 - RNA, 23 nt, Human
accuuucaauaggaaaaacugau

SEQ ID NO: 1625389 - RNA, 21 nt, Human
accuuucaauaggaaaaacug

SEQ ID NO: 1625390 - RNA, 17 nt, Human
accuuucaauaggaaaa

SEQ ID NO: 1625391 - RNA, 14 nt, Human
accuuggcugcagg

SEQ ID NO: 1625392 - RNA, 16 nt, Human
accuuucaauaggaaa

SEQ ID NO: 1625393 - RNA, 13 nt, Human
accuuuauucugg

SEQ ID NO: 1625394 - RNA, 12 nt, Human
accuuuauucug

SEQ ID NO: 1625395 - RNA, 12 nt, Human
accuuggcugca

SEQ ID NO: 1625396 - RNA, 14 nt, Human
accuuggcucaagu

SEQ ID NO: 1625397 - RNA, 22 nt, Human
accugccccuccucucugcccu

SEQ ID NO: 1625398 - RNA, 20 nt, Human
accugccccuccucucugcc

SEQ ID NO: 1625399 - RNA, 23 nt, Human
acuuauuguagcauccuggaaua

SEQ ID NO: 1625400 - RNA, 20 nt, Human
acuuauuguagcauccugga

SEQ ID NO: 1625401 - RNA, 19 nt, Human
acuucacauauugauuucc

SEQ ID NO: 1625402 - RNA, 13 nt, Human
acuguuucaaacu

SEQ ID NO: 1625403 - RNA, 21 nt, Human
acuuggucugugagaugcuag

SEQ ID NO: 1625404 - RNA, 18 nt, Human
acuuguaaaugugguaaa

SEQ ID NO: 1625405 - RNA, 20 nt, Human
acuuguaaaugugguaaaga

SEQ ID NO: 1625406 - RNA, 15 nt, Human
acuuggucugugaga

SEQ ID NO: 1625407 - RNA, 14 nt, Human
acuuggucugugag

SEQ ID NO: 1625408 - RNA, 19 nt, Human
acuuguaaaggaauuuaaa

SEQ ID NO: 1625409 - RNA, 20 nt, Human
acuuguaaaggaauuuaaaa

SEQ ID NO: 1625410 - RNA, 19 nt, Human
acuucugccauauucuguu

SEQ ID NO: 1625411 - RNA, 21 nt, Human
acuucuuuaauuuuggaauuu

SEQ ID NO: 1625412 - RNA, 23 nt, Human
acuucacauauugauuuccguua

SEQ ID NO: 1625413 - RNA, 18 nt, Human
acuucugccauauucugu

SEQ ID NO: 1625414 - RNA, 22 nt, Human
acuucugccagcauaauacuug

SEQ ID NO: 1625415 - RNA, 12 nt, Human
acugucuucagu

SEQ ID NO: 1625416 - RNA, 16 nt, Human
acugugccaugugcca

SEQ ID NO: 1625417 - RNA, 23 nt, Human
acugguggcccgacagccuggca

SEQ ID NO: 1625418 - RNA, 22 nt, Human
acugguggcccgacagccuggc

SEQ ID NO: 1625419 - RNA, 21 nt, Human
acugguggcccgacagccugg

SEQ ID NO: 1625420 - RNA, 19 nt, Human
acugucucaagagggcacu

SEQ ID NO: 1625421 - RNA, 14 nt, Human
acuggaagcacagc

SEQ ID NO: 1625422 - RNA, 15 nt, Human
acuggaagcacagcu

SEQ ID NO: 1625423 - RNA, 16 nt, Human
acuggaagcacagcuu

SEQ ID NO: 1625424 - RNA, 20 nt, Human
acugcccccucugcccugcg

SEQ ID NO: 1625425 - RNA, 18 nt, Human
acugcccccucugcccug

SEQ ID NO: 1625426 - RNA, 19 nt, Human
acugcccccucugcccugc

SEQ ID NO: 1625427 - RNA, 14 nt, Human
acuggagaaaaugg

SEQ ID NO: 1625428 - RNA, 23 nt, Human
agaaaauggacguguuaugacuc

SEQ ID NO: 1625429 - RNA, 22 nt, Human
agaaaauggacguguuaugacu

SEQ ID NO: 1625430 - RNA, 14 nt, Human
agaaaauaacaaua

SEQ ID NO: 1625431 - RNA, 20 nt, Human
agaaaauggacguguuauga

SEQ ID NO: 1625432 - RNA, 15 nt, Human
agaaaauggacgugu

SEQ ID NO: 1625433 - RNA, 23 nt, Human
agaaaauggaagacagcucuuau

SEQ ID NO: 1625434 - RNA, 19 nt, Human
acuuuuauaaacuuuaccu

SEQ ID NO: 1625435 - RNA, 22 nt, Human
acuuuuauaaacuuuaccuuuu

SEQ ID NO: 1625436 - RNA, 12 nt, Human
acuuuucugaua

SEQ ID NO: 1625437 - RNA, 21 nt, Human
agaaaaguugaauuuuacaug

SEQ ID NO: 1625438 - RNA, 18 nt, Human
agaaaaguugaauuuuac

SEQ ID NO: 1625439 - RNA, 23 nt, Human
acuuuagggaaguacuuuuggca

SEQ ID NO: 1625440 - RNA, 23 nt, Human
acuuuccuucauucaacccaccu

SEQ ID NO: 1625441 - RNA, 23 nt, Human
acuuuguucuggcucuuccaggc

SEQ ID NO: 1625442 - RNA, 16 nt, Human
acuuucuagccagagg

SEQ ID NO: 1625443 - RNA, 23 nt, Human
agaaaggaggggauagagagaga

SEQ ID NO: 1625444 - RNA, 20 nt, Human
agaaaggaggggauagagag

SEQ ID NO: 1625445 - RNA, 18 nt, Human
agaaauaaaguuucuguu

SEQ ID NO: 1625446 - RNA, 15 nt, Human
agaaauaaaguuucu

SEQ ID NO: 1625447 - RNA, 16 nt, Human
agaaaggauaaaguug

SEQ ID NO: 1625448 - RNA, 20 nt, Human
acaagucagucauucagaua

SEQ ID NO: 1625449 - RNA, 23 nt, Human
acaaguaugaauaaagacaccua

SEQ ID NO: 1625450 - RNA, 21 nt, Human
acaaguaugaauaaagacacc

SEQ ID NO: 1625451 - RNA, 13 nt, Human
aauuuugaaaaac

SEQ ID NO: 1625452 - RNA, 19 nt, Human
acaaaauggaauacucuua

SEQ ID NO: 1625453 - RNA, 15 nt, Human
acaaaauggaauacu

SEQ ID NO: 1625454 - RNA, 20 nt, Human
acaaaauguaggguuauaau

SEQ ID NO: 1625455 - RNA, 20 nt, Human
acaaaauggaauacucuuau

SEQ ID NO: 1625456 - RNA, 13 nt, Human
acaacuauauugu

SEQ ID NO: 1625457 - RNA, 18 nt, Human
acaacuaugauuuggaaa

SEQ ID NO: 1625458 - RNA, 13 nt, Human
acaaagacugagu

SEQ ID NO: 1625459 - RNA, 15 nt, Human
acaaacgggcucagc

SEQ ID NO: 1625460 - RNA, 21 nt, Human
acaaaccuguuucugcagcca

SEQ ID NO: 1625461 - RNA, 18 nt, Human
acacaaacgggcucagca

SEQ ID NO: 1625462 - RNA, 18 nt, Human
acaauuuuguuucuguac

SEQ ID NO: 1625463 - RNA, 17 nt, Human
acaauuuuguuucugua

SEQ ID NO: 1625464 - RNA, 15 nt, Human
acaauuuuguuucug

SEQ ID NO: 1625465 - RNA, 14 nt, Human
acaauuuuguuucu

SEQ ID NO: 1625466 - RNA, 16 nt, Human
acaauuuauuauggca

SEQ ID NO: 1625467 - RNA, 15 nt, Human
acaauuuauuauggc

SEQ ID NO: 1625468 - RNA, 14 nt, Human
acaccacuacauuc

SEQ ID NO: 1625469 - RNA, 13 nt, Human
acaccagagccca

SEQ ID NO: 1625470 - RNA, 12 nt, Human
acaccagagccc

SEQ ID NO: 1625471 - RNA, 19 nt, Human
acacgcuccuuccucugag

SEQ ID NO: 1625472 - RNA, 17 nt, Human
acacgcuccuuccucug

SEQ ID NO: 1625473 - RNA, 12 nt, Human
acacagcucugu

SEQ ID NO: 1625474 - RNA, 11 nt, Human
acacagcucug

SEQ ID NO: 1625475 - RNA, 14 nt, Human
acacagcucugucc

SEQ ID NO: 1625476 - RNA, 15 nt, Human
acacuaaccacgcug

SEQ ID NO: 1625477 - RNA, 14 nt, Human
acacuaaccacgcu

SEQ ID NO: 1625478 - RNA, 15 nt, Human
acacggacacucaaa

SEQ ID NO: 1625479 - RNA, 14 nt, Human
acagagucucacug

SEQ ID NO: 1625480 - RNA, 12 nt, Human
acagagucucac

SEQ ID NO: 1625481 - RNA, 22 nt, Human
acagaggggguggccucccaac

SEQ ID NO: 1625482 - RNA, 18 nt, Human
acagcaguugaaaagacu

SEQ ID NO: 1625483 - RNA, 15 nt, Human
acagcaguugaaaag

SEQ ID NO: 1625484 - RNA, 23 nt, Human
acagagucucacuguugcccagg

SEQ ID NO: 1625485 - RNA, 19 nt, Human
acagagucucacuguugcc

SEQ ID NO: 1625486 - RNA, 17 nt, Human
acagagucucacuguug

SEQ ID NO: 1625487 - RNA, 15 nt, Human
acagccagacuggca

SEQ ID NO: 1625488 - RNA, 13 nt, Human
acagccagacugg

SEQ ID NO: 1625489 - RNA, 16 nt, Human
acagccagacuggcac

SEQ ID NO: 1625490 - RNA, 15 nt, Human
acagccaugauucuu

SEQ ID NO: 1625491 - RNA, 17 nt, Human
acacugugcugagucug

SEQ ID NO: 1625492 - RNA, 21 nt, Human
acagaacacauaauucaggaa

SEQ ID NO: 1625493 - RNA, 23 nt, Human
acaggugugaaccaccacaccca

SEQ ID NO: 1625494 - RNA, 20 nt, Human
acaggugugaaccaccacac

SEQ ID NO: 1625495 - RNA, 21 nt, Human
acaggugugagccaccacgcc

SEQ ID NO: 1625496 - RNA, 22 nt, Human
acaggugugagccaccacgccc

SEQ ID NO: 1625497 - RNA, 16 nt, Human
acaggcaagcaccucc

SEQ ID NO: 1625498 - RNA, 15 nt, Human
acaggcaagcaccuc

SEQ ID NO: 1625499 - RNA, 18 nt, Human
acaggcaagcaccuccug

SEQ ID NO: 1625500 - RNA, 19 nt, Human
acaggcaagcaccuccugc

SEQ ID NO: 1625501 - RNA, 21 nt, Human
acagcugcucaauaaaguaca

SEQ ID NO: 1625502 - RNA, 20 nt, Human
acagcucugcauacucauua

SEQ ID NO: 1625503 - RNA, 15 nt, Human
acagcuccuucuguc

SEQ ID NO: 1625504 - RNA, 14 nt, Human
acagcugccuggga

SEQ ID NO: 1625505 - RNA, 13 nt, Human
acagcucuguccu

SEQ ID NO: 1625506 - RNA, 23 nt, Human
acagcugccugggaucccucauc

SEQ ID NO: 1625507 - RNA, 14 nt, Human
acagcuccuucugu

SEQ ID NO: 1625508 - RNA, 13 nt, Human
acagcuccuucug

SEQ ID NO: 1625509 - RNA, 12 nt, Human
acagcuccuucu

SEQ ID NO: 1625510 - RNA, 15 nt, Human
acccacaagaaauga

SEQ ID NO: 1625511 - RNA, 16 nt, Human
acccaaguccaagcau

SEQ ID NO: 1625512 - RNA, 16 nt, Human
acccaagggccuggcc

SEQ ID NO: 1625513 - RNA, 13 nt, Human
acccaagggccug

SEQ ID NO: 1625514 - RNA, 18 nt, Human
acccaugcugcccuguga

SEQ ID NO: 1625515 - RNA, 17 nt, Human
acccaugcugcccugug

SEQ ID NO: 1625516 - RNA, 19 nt, Human
acccaugcugcccugugag

SEQ ID NO: 1625517 - RNA, 18 nt, Human
accccgaccaccugccca

SEQ ID NO: 1625518 - RNA, 15 nt, Human
accccggccaccugc

SEQ ID NO: 1625519 - RNA, 22 nt, Human
accccuaaagagauacuuugau

SEQ ID NO: 1625520 - RNA, 18 nt, Human
accaucccugaaggcccc

SEQ ID NO: 1625521 - RNA, 12 nt, Human
accaucauugaa

SEQ ID NO: 1625522 - RNA, 17 nt, Human
accaucaugucuggcua

SEQ ID NO: 1625523 - RNA, 16 nt, Human
accaucaugucuggcu

SEQ ID NO: 1625524 - RNA, 22 nt, Human
accaucccugaaggccccgccc

SEQ ID NO: 1625525 - RNA, 21 nt, Human
accaucccugaaggccccgcc

SEQ ID NO: 1625526 - RNA, 14 nt, Human
accaucaugucugg

SEQ ID NO: 1625527 - RNA, 20 nt, Human
accccucaacaccucugcac

SEQ ID NO: 1625528 - RNA, 14 nt, Human
acauuuguauaaaa

SEQ ID NO: 1625529 - RNA, 18 nt, Human
acauuugcucauggaauu

SEQ ID NO: 1625530 - RNA, 17 nt, Human
accagcagccuggaccc

SEQ ID NO: 1625531 - RNA, 14 nt, Human
accagcagccugga

SEQ ID NO: 1625532 - RNA, 15 nt, Human
accacuacauucugu

SEQ ID NO: 1625533 - RNA, 15 nt, Human
accacguuucuaaag

SEQ ID NO: 1625534 - RNA, 19 nt, Human
accacguuucuaaaggcua

SEQ ID NO: 1625535 - RNA, 14 nt, Human
accacuacauucug

SEQ ID NO: 1625536 - RNA, 14 nt, Human
accacgcccggcua

SEQ ID NO: 1625537 - RNA, 20 nt, Human
accacgcccggcuaauuuuu

SEQ ID NO: 1625538 - RNA, 13 nt, Human
acauguuacaaca

SEQ ID NO: 1625539 - RNA, 21 nt, Human
acauguuuuucuucucccuca

SEQ ID NO: 1625540 - RNA, 23 nt, Human
acaugcacagcuaacauggaagu

SEQ ID NO: 1625541 - RNA, 20 nt, Human
acaugcacagcuaacaugga

SEQ ID NO: 1625542 - RNA, 19 nt, Human
acaugcaaggucauuuuuu

SEQ ID NO: 1625543 - RNA, 20 nt, Human
acaucagcacgauuucuguu

SEQ ID NO: 1625544 - RNA, 21 nt, Human
acaucagcacgauuucuguuu

SEQ ID NO: 1625545 - RNA, 22 nt, Human
acaucagcacgauuucuguuua

SEQ ID NO: 1625546 - RNA, 20 nt, Human
acauaaauuuaguauuuugu

SEQ ID NO: 1625547 - RNA, 18 nt, Human
acauaaaucugugaacuu

SEQ ID NO: 1625548 - RNA, 15 nt, Human
acauaaaucugugaa

SEQ ID NO: 1625549 - RNA, 14 nt, Human
acauaaaucuguga

SEQ ID NO: 1625550 - RNA, 23 nt, Human
acauaaacaagaccacguuucua

SEQ ID NO: 1625551 - RNA, 22 nt, Human
auaugccugggcagaaggaaga

SEQ ID NO: 1625552 - RNA, 14 nt, Human
auaugcuauuucua

SEQ ID NO: 1625553 - RNA, 19 nt, Human
auaugcuuauacacuuaca

SEQ ID NO: 1625554 - RNA, 23 nt, Human
auaugcuucuguuuuauaauuuu

SEQ ID NO: 1625555 - RNA, 16 nt, Human
auaugcuuauacacuu

SEQ ID NO: 1625556 - RNA, 14 nt, Human
auaugcuuauacac

SEQ ID NO: 1625557 - RNA, 21 nt, Human
auaugcuuauacacuuacacu

SEQ ID NO: 1625558 - RNA, 18 nt, Human
auaucacuugucaauaaa

SEQ ID NO: 1625559 - RNA, 22 nt, Human
auauuuauuacuguaagaaaau

SEQ ID NO: 1625560 - RNA, 18 nt, Human
auauuuauuuuaauaaug

SEQ ID NO: 1625561 - RNA, 19 nt, Human
auauuuauuacuguaagaa

SEQ ID NO: 1625562 - RNA, 14 nt, Human
auauuuauuacugu

SEQ ID NO: 1625563 - RNA, 16 nt, Human
auauuuauaaaaauaa

SEQ ID NO: 1625564 - RNA, 18 nt, Human
auauuuaguguucauaaa

SEQ ID NO: 1625565 - RNA, 13 nt, Human
auauucaggaagc

SEQ ID NO: 1625566 - RNA, 16 nt, Human
auauucaggaagcuca

SEQ ID NO: 1625567 - RNA, 14 nt, Human
auauucaggaagcu

SEQ ID NO: 1625568 - RNA, 17 nt, Human
auauucaggaagcucag

SEQ ID NO: 1625569 - RNA, 23 nt, Human
auauuucagauaaucacaauaca

SEQ ID NO: 1625570 - RNA, 16 nt, Human
auaguaugguggcugg

SEQ ID NO: 1625571 - RNA, 15 nt, Human
auauaagugauugcu

SEQ ID NO: 1625572 - RNA, 15 nt, Human
auauaaguguguguu

SEQ ID NO: 1625573 - RNA, 15 nt, Human
auaguaugguggcug

SEQ ID NO: 1625574 - RNA, 19 nt, Human
auacuugaaaauuaacaug

SEQ ID NO: 1625575 - RNA, 16 nt, Human
auacuugaaaauuaac

SEQ ID NO: 1625576 - RNA, 15 nt, Human
auacuugaaaauuaa

SEQ ID NO: 1625577 - RNA, 16 nt, Human
auauaggaacuuaaau

SEQ ID NO: 1625578 - RNA, 14 nt, Human
auaauuacuauguc

SEQ ID NO: 1625579 - RNA, 20 nt, Human
auacaauuuuguuucuguac

SEQ ID NO: 1625580 - RNA, 19 nt, Human
auacaauuuuguuucugua

SEQ ID NO: 1625581 - RNA, 22 nt, Human
auacccccugcaaagcccagcu

SEQ ID NO: 1625582 - RNA, 12 nt, Human
auaccugucccc

SEQ ID NO: 1625583 - RNA, 13 nt, Human
auaccuguccccc

SEQ ID NO: 1625584 - RNA, 19 nt, Human
auaaugugaaacuggauua

SEQ ID NO: 1625585 - RNA, 21 nt, Human
auaaugugaaacuggauuaaa

SEQ ID NO: 1625586 - RNA, 22 nt, Human
auaauuaacauguuaaaccaug

SEQ ID NO: 1625587 - RNA, 21 nt, Human
auaauuaacauguuaaaccau

SEQ ID NO: 1625588 - RNA, 20 nt, Human
auaauuaacauguuaaacca

SEQ ID NO: 1625589 - RNA, 18 nt, Human
auaaugugaaacuggauu

SEQ ID NO: 1625590 - RNA, 22 nt, Human
auaaguguguguuuuucauaaa

SEQ ID NO: 1625591 - RNA, 19 nt, Human
auaaguguguguuuuucau

SEQ ID NO: 1625592 - RNA, 19 nt, Human
auaaguauuuaauucaugu

SEQ ID NO: 1625593 - RNA, 13 nt, Human
agucaaauugugu

SEQ ID NO: 1625594 - RNA, 17 nt, Human
agucaaauugugugaaa

SEQ ID NO: 1625595 - RNA, 15 nt, Human
agucaaauuguguga

SEQ ID NO: 1625596 - RNA, 16 nt, Human
agucaagugaaaaagg

SEQ ID NO: 1625597 - RNA, 18 nt, Human
agucaaggguaggguggg

SEQ ID NO: 1625598 - RNA, 20 nt, Human
agucaagugaaaaaggagga

SEQ ID NO: 1625599 - RNA, 21 nt, Human
aguccaagcauuuagauguau

SEQ ID NO: 1625600 - RNA, 16 nt, Human
aguccaagcauuuaga

SEQ ID NO: 1625601 - RNA, 23 nt, Human
agucauucagauaugauucaaau

SEQ ID NO: 1625602 - RNA, 20 nt, Human
agucauucagauaugauuca

SEQ ID NO: 1625603 - RNA, 15 nt, Human
agucauucagauaug

SEQ ID NO: 1625604 - RNA, 13 nt, Human
agugauccuccca

SEQ ID NO: 1625605 - RNA, 18 nt, Human
agugauuaccagggacug

SEQ ID NO: 1625606 - RNA, 19 nt, Human
agugauucucaugccucag

SEQ ID NO: 1625607 - RNA, 18 nt, Human
agugauucucaugccuca

SEQ ID NO: 1625608 - RNA, 23 nt, Human
agugugacaaggauugcuacugu

SEQ ID NO: 1625609 - RNA, 18 nt, Human
aguuguaccgcaauguga

SEQ ID NO: 1625610 - RNA, 15 nt, Human
aguugaauuuuacau

SEQ ID NO: 1625611 - RNA, 20 nt, Human
aguugaauuuauuggcuuuu

SEQ ID NO: 1625612 - RNA, 19 nt, Human
aguuguaccgcaaugugac

SEQ ID NO: 1625613 - RNA, 18 nt, Human
aguuacagacaaagcgug

SEQ ID NO: 1625614 - RNA, 19 nt, Human
aguugaauuuauuggcuuu

SEQ ID NO: 1625615 - RNA, 17 nt, Human
aguugaauuuauuggcu

SEQ ID NO: 1625616 - RNA, 13 nt, Human
aguugaauuuauu

SEQ ID NO: 1625617 - RNA, 11 nt, Human
aguugaauuua

SEQ ID NO: 1625618 - RNA, 19 nt, Human
aguuguuacauuuuuaagu

SEQ ID NO: 1625619 - RNA, 16 nt, Human
aguuguuacauuuuua

SEQ ID NO: 1625620 - RNA, 13 nt, Human
aguuguuacauuu

SEQ ID NO: 1625621 - RNA, 15 nt, Human
aguuguuacauuuuu

SEQ ID NO: 1625622 - RNA, 16 nt, Human
auguaaguaaacgguc

SEQ ID NO: 1625623 - RNA, 20 nt, Human
auguaagggaaacugccagc

SEQ ID NO: 1625624 - RNA, 17 nt, Human
auguaagcucuacugag

SEQ ID NO: 1625625 - RNA, 22 nt, Human
auguaagggaaacugccagcaa

SEQ ID NO: 1625626 - RNA, 21 nt, Human
auguaagggaaacugccagca

SEQ ID NO: 1625627 - RNA, 16 nt, Human
augucaaucagccuag

SEQ ID NO: 1625628 - RNA, 17 nt, Human
auguacauguacugauu

SEQ ID NO: 1625629 - RNA, 17 nt, Human
augucacaggcaggucc

SEQ ID NO: 1625630 - RNA, 16 nt, Human
augucacaggcagguc

SEQ ID NO: 1625631 - RNA, 15 nt, Human
augucacaggcaggu

SEQ ID NO: 1625632 - RNA, 14 nt, Human
auguguaaguauuc

SEQ ID NO: 1625633 - RNA, 13 nt, Human
auuaaauucuugc

SEQ ID NO: 1625634 - RNA, 16 nt, Human
auuaaaugcccagccc

SEQ ID NO: 1625635 - RNA, 15 nt, Human
auuaaaugcccagcc

SEQ ID NO: 1625636 - RNA, 14 nt, Human
auuaaaugcccagc

SEQ ID NO: 1625637 - RNA, 18 nt, Human
auguuuuaagaggcaggg

SEQ ID NO: 1625638 - RNA, 16 nt, Human
auguuuuaagaggcag

SEQ ID NO: 1625639 - RNA, 14 nt, Human
auguuugccucugc

SEQ ID NO: 1625640 - RNA, 18 nt, Human
auguucucugaggacacu

SEQ ID NO: 1625641 - RNA, 22 nt, Human
auguucugacccugcuucaaau

SEQ ID NO: 1625642 - RNA, 20 nt, Human
auguucuuaguggauguucu

SEQ ID NO: 1625643 - RNA, 15 nt, Human
auguucuuaauucuu

SEQ ID NO: 1625644 - RNA, 20 nt, Human
auguucuuucacccuuuucu

SEQ ID NO: 1625645 - RNA, 18 nt, Human
auguuucuuuguaaugaa

SEQ ID NO: 1625646 - RNA, 14 nt, Human
augccuuuucccaa

SEQ ID NO: 1625647 - RNA, 21 nt, Human
augccuuuguacuuuagggaa

SEQ ID NO: 1625648 - RNA, 16 nt, Human
augaugugugaaaacu

SEQ ID NO: 1625649 - RNA, 23 nt, Human
augauguauguugaagccuuugu

SEQ ID NO: 1625650 - RNA, 17 nt, Human
augcacacauuuuuuaa

SEQ ID NO: 1625651 - RNA, 19 nt, Human
augcacacauuuuuuaaau

SEQ ID NO: 1625652 - RNA, 22 nt, Human
augcacacauuuuuuaaaugca

SEQ ID NO: 1625653 - RNA, 14 nt, Human
augcacagcuaaca

SEQ ID NO: 1625654 - RNA, 23 nt, Human
augcacacauuuuuuaaaugcac

SEQ ID NO: 1625655 - RNA, 21 nt, Human
augcacagcuaacauggaagu

SEQ ID NO: 1625656 - RNA, 18 nt, Human
augccugguggcagcugc

SEQ ID NO: 1625657 - RNA, 17 nt, Human
augccugguggcagcug

SEQ ID NO: 1625658 - RNA, 16 nt, Human
augccugguggcagcu

SEQ ID NO: 1625659 - RNA, 15 nt, Human
augccugguggcagc

SEQ ID NO: 1625660 - RNA, 11 nt, Human
augccuggugg

SEQ ID NO: 1625661 - RNA, 17 nt, Human
augccugggcagaagga

SEQ ID NO: 1625662 - RNA, 23 nt, Human
augccuggauggggcugcaccgg

SEQ ID NO: 1625663 - RNA, 21 nt, Human
augccuggauggggcugcacc

SEQ ID NO: 1625664 - RNA, 10 nt, Human
augcauuuga

SEQ ID NO: 1625665 - RNA, 12 nt, Human
augcauuugaaa

SEQ ID NO: 1625666 - RNA, 18 nt, Human
augcauuugaaaauuuug

SEQ ID NO: 1625667 - RNA, 23 nt, Human
augcaugaaguaauaugcacaca

SEQ ID NO: 1625668 - RNA, 20 nt, Human
auggaaaugggcagagcaga

SEQ ID NO: 1625669 - RNA, 19 nt, Human
auggaaaugggcagagcag

SEQ ID NO: 1625670 - RNA, 13 nt, Human
auggaaauguuua

SEQ ID NO: 1625671 - RNA, 22 nt, Human
auggagccugcacggugaaugg

SEQ ID NO: 1625672 - RNA, 18 nt, Human
auggagccugcacgguga

SEQ ID NO: 1625673 - RNA, 16 nt, Human
auggaggaaaaccaag

SEQ ID NO: 1625674 - RNA, 15 nt, Human
augggaaugaauguc

SEQ ID NO: 1625675 - RNA, 21 nt, Human
augggaaugaaugucagugug

SEQ ID NO: 1625676 - RNA, 23 nt, Human
auggcugccaaugggagcucaug

SEQ ID NO: 1625677 - RNA, 18 nt, Human
auggcuggagcuagaauu

SEQ ID NO: 1625678 - RNA, 23 nt, Human
augaaaaaauauauaucaaauau

SEQ ID NO: 1625679 - RNA, 22 nt, Human
augaaaaaauauauaucaaaua

SEQ ID NO: 1625680 - RNA, 17 nt, Human
augaaaaaauauauauc

SEQ ID NO: 1625681 - RNA, 14 nt, Human
augaaaaaauauau

SEQ ID NO: 1625682 - RNA, 16 nt, Human
augacuccagaauuuc

SEQ ID NO: 1625683 - RNA, 12 nt, Human
augacuccagaa

SEQ ID NO: 1625684 - RNA, 17 nt, Human
augacuccagaauuucc

SEQ ID NO: 1625685 - RNA, 12 nt, Human
augacccagugg

SEQ ID NO: 1625686 - RNA, 21 nt, Human
augaagcuuuuaugugaaaca

SEQ ID NO: 1625687 - RNA, 20 nt, Human
augaagcuuuuaugugaaac

SEQ ID NO: 1625688 - RNA, 19 nt, Human
augaagcuuuuaugugaaa

SEQ ID NO: 1625689 - RNA, 18 nt, Human
augaagcuuuuaugugaa

SEQ ID NO: 1625690 - RNA, 14 nt, Human
augagccuggcaag

SEQ ID NO: 1625691 - RNA, 13 nt, Human
augagccuggcaa

SEQ ID NO: 1625692 - RNA, 22 nt, Human
aucuuauaauuuaaaauaugcu

SEQ ID NO: 1625693 - RNA, 17 nt, Human
aucugggccagaauuuc

SEQ ID NO: 1625694 - RNA, 15 nt, Human
aucugggccagaauu

SEQ ID NO: 1625695 - RNA, 19 nt, Human
aucuuccaacucaaacucu

SEQ ID NO: 1625696 - RNA, 22 nt, Human
aucucucgugauugauaagaac

SEQ ID NO: 1625697 - RNA, 17 nt, Human
aucuucuuuauaauucu

SEQ ID NO: 1625698 - RNA, 22 nt, Human
aucuucugaacuuggcgcugcc

SEQ ID NO: 1625699 - RNA, 17 nt, Human
aucuugaagacuuuucu

SEQ ID NO: 1625700 - RNA, 14 nt, Human
auccuccucagauc

SEQ ID NO: 1625701 - RNA, 13 nt, Human
aucgaugcagugc

SEQ ID NO: 1625702 - RNA, 22 nt, Human
auccuccaggugcacaagcucc

SEQ ID NO: 1625703 - RNA, 19 nt, Human
auccuccaggugcacaagc

SEQ ID NO: 1625704 - RNA, 14 nt, Human
auccuccaggugca

SEQ ID NO: 1625705 - RNA, 11 nt, Human
auccuccucag

SEQ ID NO: 1625706 - RNA, 23 nt, Human
auccucauacccacccccaccca

SEQ ID NO: 1625707 - RNA, 22 nt, Human
auccucauacccacccccaccc

SEQ ID NO: 1625708 - RNA, 19 nt, Human
auccucauacccaccccca

SEQ ID NO: 1625709 - RNA, 18 nt, Human
auccucauacccaccccc

SEQ ID NO: 1625710 - RNA, 13 nt, Human
aucccucauccuc

SEQ ID NO: 1625711 - RNA, 15 nt, Human
aucccuacuguaauu

SEQ ID NO: 1625712 - RNA, 14 nt, Human
aucccggcugcccu

SEQ ID NO: 1625713 - RNA, 20 nt, Human
auccacccaccucagccucc

SEQ ID NO: 1625714 - RNA, 18 nt, Human
auccacccaccucagccu

SEQ ID NO: 1625715 - RNA, 17 nt, Human
aucagcugcugaaacaa

SEQ ID NO: 1625716 - RNA, 23 nt, Human
aucagcugcuacuacuccuguag

SEQ ID NO: 1625717 - RNA, 13 nt, Human
aucagcugcuacu

SEQ ID NO: 1625718 - RNA, 12 nt, Human
aucagcugcuac

SEQ ID NO: 1625719 - RNA, 21 nt, Human
aucagccugggcaaugugaua

SEQ ID NO: 1625720 - RNA, 20 nt, Human
aucagccugggcaaugugau

SEQ ID NO: 1625721 - RNA, 11 nt, Human
aucagccuggg

SEQ ID NO: 1625722 - RNA, 22 nt, Human
aucaccugucuugccuuuuuca

SEQ ID NO: 1625723 - RNA, 21 nt, Human
aucaccugucuugccuuuuuc

SEQ ID NO: 1625724 - RNA, 12 nt, Human
aucaccugucuu

SEQ ID NO: 1625725 - RNA, 13 nt, Human
aucaccugcccug

SEQ ID NO: 1625726 - RNA, 12 nt, Human
aucaccugcccu

SEQ ID NO: 1625727 - RNA, 17 nt, Human
agacagcccgggcucug

SEQ ID NO: 1625728 - RNA, 20 nt, Human
agacagcccgggcucugccu

SEQ ID NO: 1625729 - RNA, 18 nt, Human
agacagcccgggcucugc

SEQ ID NO: 1625730 - RNA, 21 nt, Human
agacagcccgggcucugccuc

SEQ ID NO: 1625731 - RNA, 21 nt, Human
agaccaucccugaaggccccg

SEQ ID NO: 1625732 - RNA, 18 nt, Human
agaccaucccugaaggcc

SEQ ID NO: 1625733 - RNA, 17 nt, Human
agaccaucccugaaggc

SEQ ID NO: 1625734 - RNA, 14 nt, Human
agaccaucccugaa

SEQ ID NO: 1625735 - RNA, 13 nt, Human
agaccaucccuga

SEQ ID NO: 1625736 - RNA, 18 nt, Human
agacgggggcagagaggg

SEQ ID NO: 1625737 - RNA, 19 nt, Human
agacggagucccaccuugg

SEQ ID NO: 1625738 - RNA, 13 nt, Human
agacaaugacuua

SEQ ID NO: 1625739 - RNA, 17 nt, Human
agacaaugacuuacugu

SEQ ID NO: 1625740 - RNA, 19 nt, Human
agacaaugacuuacuguac

SEQ ID NO: 1625741 - RNA, 15 nt, Human
agacaauuuauuaug

SEQ ID NO: 1625742 - RNA, 21 nt, Human
agacaauuuauuauggcacau

SEQ ID NO: 1625743 - RNA, 17 nt, Human
agacugcauuauauuua

SEQ ID NO: 1625744 - RNA, 21 nt, Human
agagaagagauugugguuuca

SEQ ID NO: 1625745 - RNA, 10 nt, Human
agagaagaga

SEQ ID NO: 1625746 - RNA, 18 nt, Human
agagaaaguacuucucca

SEQ ID NO: 1625747 - RNA, 16 nt, Human
agagagcuucuguugc

SEQ ID NO: 1625748 - RNA, 23 nt, Human
agagagcuucuguugcugccuca

SEQ ID NO: 1625749 - RNA, 20 nt, Human
agagagcuucuguugcugcc

SEQ ID NO: 1625750 - RNA, 16 nt, Human
agagaguggcuccucc

SEQ ID NO: 1625751 - RNA, 14 nt, Human
agagaguggcuccu

SEQ ID NO: 1625752 - RNA, 15 nt, Human
agagcccuucauuug

SEQ ID NO: 1625753 - RNA, 21 nt, Human
agauaggucagugcaaauacu

SEQ ID NO: 1625754 - RNA, 16 nt, Human
agauagccaaggccaa

SEQ ID NO: 1625755 - RNA, 15 nt, Human
agauagccaaggcca

SEQ ID NO: 1625756 - RNA, 14 nt, Human
agaucuucuguggg

SEQ ID NO: 1625757 - RNA, 23 nt, Human
agauggcugugccucugccuguc

SEQ ID NO: 1625758 - RNA, 22 nt, Human
agaggggaacagacuggaagca

SEQ ID NO: 1625759 - RNA, 16 nt, Human
agaggggaagagacuu

SEQ ID NO: 1625760 - RNA, 13 nt, Human
agaggagaggggc

SEQ ID NO: 1625761 - RNA, 22 nt, Human
agauacuuggggggcugaggug

SEQ ID NO: 1625762 - RNA, 13 nt, Human
agauagccaaggc

SEQ ID NO: 1625763 - RNA, 14 nt, Human
agaguguugaaacg

SEQ ID NO: 1625764 - RNA, 19 nt, Human
agccagauuuuccugaaaa

SEQ ID NO: 1625765 - RNA, 15 nt, Human
agccagauuuuccug

SEQ ID NO: 1625766 - RNA, 22 nt, Human
agccauguuuauuacaguauaa

SEQ ID NO: 1625767 - RNA, 23 nt, Human
agccaaggccaaaggaagcacau

SEQ ID NO: 1625768 - RNA, 22 nt, Human
agccaaggccaaaggaagcaca

SEQ ID NO: 1625769 - RNA, 20 nt, Human
agccagaggagagaggaccc

SEQ ID NO: 1625770 - RNA, 23 nt, Human
agccaaagcuaggccuggccaga

SEQ ID NO: 1625771 - RNA, 20 nt, Human
agccaaagcuaggccuggcc

SEQ ID NO: 1625772 - RNA, 19 nt, Human
agccaaagcuaggccuggc

SEQ ID NO: 1625773 - RNA, 20 nt, Human
agcaugccuggauggggcug

SEQ ID NO: 1625774 - RNA, 12 nt, Human
agcaugccugga

SEQ ID NO: 1625775 - RNA, 14 nt, Human
agcaugcacaaauu

SEQ ID NO: 1625776 - RNA, 20 nt, Human
agcaguucagagcugcccuc

SEQ ID NO: 1625777 - RNA, 19 nt, Human
agcaguucagagcugcccu

SEQ ID NO: 1625778 - RNA, 21 nt, Human
agaugggagaaucacuugaac

SEQ ID NO: 1625779 - RNA, 14 nt, Human
agauguagaggaga

SEQ ID NO: 1625780 - RNA, 21 nt, Human
agcaguugaaaagacuccaaa

SEQ ID NO: 1625781 - RNA, 23 nt, Human
agcaguugaaaagacuccaaaga

SEQ ID NO: 1625782 - RNA, 16 nt, Human
agcaguucagagcugc

SEQ ID NO: 1625783 - RNA, 15 nt, Human
agcaguucagagcug

SEQ ID NO: 1625784 - RNA, 17 nt, Human
agcaguucagagcugcc

SEQ ID NO: 1625785 - RNA, 18 nt, Human
agcaguucagagcugccc

SEQ ID NO: 1625786 - RNA, 19 nt, Human
agcacuaaggugugcucug

SEQ ID NO: 1625787 - RNA, 20 nt, Human
agcacuaaggugugcucuga

SEQ ID NO: 1625788 - RNA, 21 nt, Human
agcagccacauuccugaugcu

SEQ ID NO: 1625789 - RNA, 20 nt, Human
agccgagaucacgccacugc

SEQ ID NO: 1625790 - RNA, 19 nt, Human
agccgagaucacgccacug

SEQ ID NO: 1625791 - RNA, 15 nt, Human
agcccugagcuuucu

SEQ ID NO: 1625792 - RNA, 11 nt, Human
agccccauccu

SEQ ID NO: 1625793 - RNA, 20 nt, Human
agccccaucccaaacccuuc

SEQ ID NO: 1625794 - RNA, 16 nt, Human
agccccagugcccaca

SEQ ID NO: 1625795 - RNA, 23 nt, Human
agccccauaauuuuuuuuuuccu

SEQ ID NO: 1625796 - RNA, 19 nt, Human
agccgagauugcaccacug

SEQ ID NO: 1625797 - RNA, 21 nt, Human
agccgagaucacgccacugca

SEQ ID NO: 1625798 - RNA, 20 nt, Human
agccgagauugcaccacugc

SEQ ID NO: 1625799 - RNA, 22 nt, Human
agccgcuggggccaguuggucc

SEQ ID NO: 1625800 - RNA, 14 nt, Human
agccgcuggggcca

SEQ ID NO: 1625801 - RNA, 19 nt, Human
agccucccaaagugcuggg

SEQ ID NO: 1625802 - RNA, 18 nt, Human
agccucccaaagugcugg

SEQ ID NO: 1625803 - RNA, 17 nt, Human
agccucccgaguagcug

SEQ ID NO: 1625804 - RNA, 22 nt, Human
agccucccgaauagcugggacu

SEQ ID NO: 1625805 - RNA, 20 nt, Human
agccucccgaauagcuggga

SEQ ID NO: 1625806 - RNA, 19 nt, Human
agccucccgaauagcuggg

SEQ ID NO: 1625807 - RNA, 18 nt, Human
agccucccgaauagcugg

SEQ ID NO: 1625808 - RNA, 20 nt, Human
agccucccaaagugcuggga

SEQ ID NO: 1625809 - RNA, 14 nt, Human
agguuaauguucau

SEQ ID NO: 1625810 - RNA, 17 nt, Human
agguucaaagauauuuu

SEQ ID NO: 1625811 - RNA, 13 nt, Human
agguucccuuuga

SEQ ID NO: 1625812 - RNA, 13 nt, Human
agguucagcuugu

SEQ ID NO: 1625813 - RNA, 17 nt, Human
agguucaugcaaacuuu

SEQ ID NO: 1625814 - RNA, 17 nt, Human
aggugcugccauccagg

SEQ ID NO: 1625815 - RNA, 16 nt, Human
aggugcugccauccag

SEQ ID NO: 1625816 - RNA, 14 nt, Human
aggucgaggcagga

SEQ ID NO: 1625817 - RNA, 15 nt, Human
agguggaaauaaacu

SEQ ID NO: 1625818 - RNA, 17 nt, Human
agguaaggaauaccugu

SEQ ID NO: 1625819 - RNA, 17 nt, Human
agguaaucgaccugccu

SEQ ID NO: 1625820 - RNA, 19 nt, Human
agguaaucgaccugccucg

SEQ ID NO: 1625821 - RNA, 18 nt, Human
agguaaucgaccugccuc

SEQ ID NO: 1625822 - RNA, 22 nt, Human
agguacgaaaagaggggaagag

SEQ ID NO: 1625823 - RNA, 23 nt, Human
aggucccuaauaaagcugugugg

SEQ ID NO: 1625824 - RNA, 20 nt, Human
aggucccuaauaaagcugug

SEQ ID NO: 1625825 - RNA, 19 nt, Human
aggucccuaauaaagcugu

SEQ ID NO: 1625826 - RNA, 18 nt, Human
aggucccuaauaaagcug

SEQ ID NO: 1625827 - RNA, 17 nt, Human
aggucccuaauaaagcu

SEQ ID NO: 1625828 - RNA, 20 nt, Human
agggacagaggggguggccu

SEQ ID NO: 1625829 - RNA, 13 nt, Human
agggacagagggg

SEQ ID NO: 1625830 - RNA, 12 nt, Human
agggacagaggg

SEQ ID NO: 1625831 - RNA, 21 nt, Human
agggacgcuacccgggaaggg

SEQ ID NO: 1625832 - RNA, 18 nt, Human
aggcugccucucccauca

SEQ ID NO: 1625833 - RNA, 23 nt, Human
aggcuagugugguguuuccuggc

SEQ ID NO: 1625834 - RNA, 21 nt, Human
aggcugaacuuguuuucuggg

SEQ ID NO: 1625835 - RNA, 20 nt, Human
aggcugaacuuguuuucugg

SEQ ID NO: 1625836 - RNA, 17 nt, Human
agggccuggccugagcu

SEQ ID NO: 1625837 - RNA, 16 nt, Human
agggccuggccugagc

SEQ ID NO: 1625838 - RNA, 15 nt, Human
agggccuggccugag

SEQ ID NO: 1625839 - RNA, 21 nt, Human
agggcacaccgggcacucaga

SEQ ID NO: 1625840 - RNA, 20 nt, Human
agggcacaccgggcacucag

SEQ ID NO: 1625841 - RNA, 22 nt, Human
agggcacagaaaauggaagaca

SEQ ID NO: 1625842 - RNA, 17 nt, Human
agggcacaccgggcacu

SEQ ID NO: 1625843 - RNA, 18 nt, Human
agggccuggccugagcug

SEQ ID NO: 1625844 - RNA, 19 nt, Human
agggcgggaggauguucug

SEQ ID NO: 1625845 - RNA, 21 nt, Human
aggggauagagagagaccacu

SEQ ID NO: 1625846 - RNA, 15 nt, Human
aggggcacagggucu

SEQ ID NO: 1625847 - RNA, 22 nt, Human
agcuucuguugcugccucaugc

SEQ ID NO: 1625848 - RNA, 21 nt, Human
agcuucuguugcugccucaug

SEQ ID NO: 1625849 - RNA, 15 nt, Human
aggaaaaacugauuu

SEQ ID NO: 1625850 - RNA, 13 nt, Human
aggaaaaacugau

SEQ ID NO: 1625851 - RNA, 15 nt, Human
agcuuuucccuuuuu

SEQ ID NO: 1625852 - RNA, 16 nt, Human
agcuuuucccuucuuu

SEQ ID NO: 1625853 - RNA, 13 nt, Human
agcuuuucccuuc

SEQ ID NO: 1625854 - RNA, 23 nt, Human
agcuucuguugcugccucaugcu

SEQ ID NO: 1625855 - RNA, 17 nt, Human
aggaaauccaggguggu

SEQ ID NO: 1625856 - RNA, 22 nt, Human
aggaacguaaucguguccccua

SEQ ID NO: 1625857 - RNA, 14 nt, Human
agcuguaugauucc

SEQ ID NO: 1625858 - RNA, 21 nt, Human
agcuggucccacucaguccau

SEQ ID NO: 1625859 - RNA, 14 nt, Human
agcuggguuggaaa

SEQ ID NO: 1625860 - RNA, 14 nt, Human
agcuggugcccugc

SEQ ID NO: 1625861 - RNA, 22 nt, Human
agcugggugucaagagggucug

SEQ ID NO: 1625862 - RNA, 17 nt, Human
agcugggugucaagagg

SEQ ID NO: 1625863 - RNA, 14 nt, Human
aggauguugaaaaa

SEQ ID NO: 1625864 - RNA, 20 nt, Human
aggauguucugggacacagu

SEQ ID NO: 1625865 - RNA, 17 nt, Human
aggauguugaaaaaguu

SEQ ID NO: 1625866 - RNA, 17 nt, Human
aggaggggauagagaga

SEQ ID NO: 1625867 - RNA, 12 nt, Human
aggauucuuccu

SEQ ID NO: 1625868 - RNA, 16 nt, Human
aggauucuuccucccu

SEQ ID NO: 1625869 - RNA, 22 nt, Human
aggcacugcugcccagccucca

SEQ ID NO: 1625870 - RNA, 16 nt, Human
aggcacugcugcccag

SEQ ID NO: 1625871 - RNA, 14 nt, Human
aggcacugcugccc

SEQ ID NO: 1625872 - RNA, 17 nt, Human
aggacccggaggggccu

SEQ ID NO: 1625873 - RNA, 20 nt, Human
aggaccucaggugagaagca

SEQ ID NO: 1625874 - RNA, 14 nt, Human
aggaccucagguga

SEQ ID NO: 1625875 - RNA, 18 nt, Human
aggagaggggcacagggu

SEQ ID NO: 1625876 - RNA, 16 nt, Human
aggagaggggcacagg

SEQ ID NO: 1625877 - RNA, 15 nt, Human
aggagaggagagggg

SEQ ID NO: 1625878 - RNA, 15 nt, Human
aggagagcuagcagc

SEQ ID NO: 1625879 - RNA, 20 nt, Human
aggaccccuccaugugggcu

SEQ ID NO: 1625880 - RNA, 15 nt, Human
aggaacuacugagga

SEQ ID NO: 1625881 - RNA, 16 nt, Human
cuucuuauacauuuga

SEQ ID NO: 1625882 - RNA, 13 nt, Human
cuucuuauacauu

SEQ ID NO: 1625883 - RNA, 17 nt, Human
cuucugacccaugcugc

SEQ ID NO: 1625884 - RNA, 16 nt, Human
cuucugacccaugcug

SEQ ID NO: 1625885 - RNA, 18 nt, Human
cuucugacccaugcugcc

SEQ ID NO: 1625886 - RNA, 23 nt, Human
cuucugaacuuggcgcugccccu

SEQ ID NO: 1625887 - RNA, 18 nt, Human
cuuccucccucccucuuu

SEQ ID NO: 1625888 - RNA, 14 nt, Human
cuuccucccucccu

SEQ ID NO: 1625889 - RNA, 13 nt, Human
cuuccucccuccc

SEQ ID NO: 1625890 - RNA, 12 nt, Human
cuuccucccucc

SEQ ID NO: 1625891 - RNA, 21 nt, Human
cuuccucuuuccaucuacccu

SEQ ID NO: 1625892 - RNA, 13 nt, Human
cuuccucugcuga

SEQ ID NO: 1625893 - RNA, 12 nt, Human
cuuccucugcug

SEQ ID NO: 1625894 - RNA, 11 nt, Human
cuuccucugcu

SEQ ID NO: 1625895 - RNA, 21 nt, Human
cuuccucuccacugccuucga

SEQ ID NO: 1625896 - RNA, 19 nt, Human
cuuccucuccacugccuuc

SEQ ID NO: 1625897 - RNA, 17 nt, Human
cuuccucuccacugccu

SEQ ID NO: 1625898 - RNA, 16 nt, Human
cuuccucuccacugcc

SEQ ID NO: 1625899 - RNA, 22 nt, Human
cuucugaacuuggcgcugcccc

SEQ ID NO: 1625900 - RNA, 19 nt, Human
cuucugaacuuggcgcugc

SEQ ID NO: 1625901 - RNA, 20 nt, Human
cuuacauuagcaguuugcuu

SEQ ID NO: 1625902 - RNA, 15 nt, Human
cuugauguguuaucu

SEQ ID NO: 1625903 - RNA, 19 nt, Human
cuugauucauaaugacuua

SEQ ID NO: 1625904 - RNA, 18 nt, Human
cuugccgucuaccugagg

SEQ ID NO: 1625905 - RNA, 19 nt, Human
cuugccgucuaccugaggg

SEQ ID NO: 1625906 - RNA, 15 nt, Human
cuuggauuguccccg

SEQ ID NO: 1625907 - RNA, 20 nt, Human
cuuggauuguccccgacccu

SEQ ID NO: 1625908 - RNA, 18 nt, Human
cuuggauuguccccgacc

SEQ ID NO: 1625909 - RNA, 22 nt, Human
cuuggauuguccccgacccuug

SEQ ID NO: 1625910 - RNA, 23 nt, Human
cuuggcgcugccccuggcagccc

SEQ ID NO: 1625911 - RNA, 22 nt, Human
cuuggcgcugccccuggcagcc

SEQ ID NO: 1625912 - RNA, 21 nt, Human
cuuggcgcugccccuggcagc

SEQ ID NO: 1625913 - RNA, 18 nt, Human
cuuucaauaggaaaaacu

SEQ ID NO: 1625914 - RNA, 17 nt, Human
cuuucaauaggaaaaac

SEQ ID NO: 1625915 - RNA, 20 nt, Human
cuuuaaugucacaggcaggu

SEQ ID NO: 1625916 - RNA, 19 nt, Human
cuuuaaugucacaggcagg

SEQ ID NO: 1625917 - RNA, 18 nt, Human
cuuuaaugucacaggcag

SEQ ID NO: 1625918 - RNA, 17 nt, Human
cuuuaaugucacaggca

SEQ ID NO: 1625919 - RNA, 15 nt, Human
cuuucaauaggaaaa

SEQ ID NO: 1625920 - RNA, 14 nt, Human
cuuucaauaggaaa

SEQ ID NO: 1625921 - RNA, 22 nt, Human
cuuuaaugucacaggcaggucc

SEQ ID NO: 1625922 - RNA, 22 nt, Human
cuugucuuuggacccugaggcc

SEQ ID NO: 1625923 - RNA, 21 nt, Human
cuugucuuuggacccugaggc

SEQ ID NO: 1625924 - RNA, 15 nt, Human
cuugguccugcugca

SEQ ID NO: 1625925 - RNA, 20 nt, Human
cuugguccugcugcaguugc

SEQ ID NO: 1625926 - RNA, 18 nt, Human
cuugguccugcugcaguu

SEQ ID NO: 1625927 - RNA, 17 nt, Human
cuugguccugcugcagu

SEQ ID NO: 1625928 - RNA, 16 nt, Human
cuugguccugcugcag

SEQ ID NO: 1625929 - RNA, 23 nt, Human
cuuggucucagugucaaugcagc

SEQ ID NO: 1625930 - RNA, 22 nt, Human
cuugguccugcugcaguugcca

SEQ ID NO: 1625931 - RNA, 16 nt, Human
cuugguucccauuugc

SEQ ID NO: 1625932 - RNA, 20 nt, Human
cuugguucccauuugcuccu

SEQ ID NO: 1625933 - RNA, 13 nt, Human
cuugucuguagau

SEQ ID NO: 1625934 - RNA, 20 nt, Human
cuugucuuuggacccugagg

SEQ ID NO: 1625935 - RNA, 21 nt, Human
cuugucucagauuuuauuaug

SEQ ID NO: 1625936 - RNA, 19 nt, Human
cuuuuaugugaaacauguu

SEQ ID NO: 1625937 - RNA, 18 nt, Human
gaaaauuuugauguuuua

SEQ ID NO: 1625938 - RNA, 21 nt, Human
gaaaagacuccaaagaaaugu

SEQ ID NO: 1625939 - RNA, 20 nt, Human
gaaaagacuccaaagaaaug

SEQ ID NO: 1625940 - RNA, 18 nt, Human
gaaaacuuguauuaugug

SEQ ID NO: 1625941 - RNA, 19 nt, Human
gaaaacugcaacuuguaaa

SEQ ID NO: 1625942 - RNA, 22 nt, Human
gaaaauuaggauuucaugauuu

SEQ ID NO: 1625943 - RNA, 18 nt, Human
gaaaauuaggauuucaug

SEQ ID NO: 1625944 - RNA, 14 nt, Human
gaaaauuaacauga

SEQ ID NO: 1625945 - RNA, 18 nt, Human
cuuuugccguuauuaaaa

SEQ ID NO: 1625946 - RNA, 17 nt, Human
cuuuugucuaugggacu

SEQ ID NO: 1625947 - RNA, 16 nt, Human
cuuuuggucuguguga

SEQ ID NO: 1625948 - RNA, 15 nt, Human
cuuuuggucugugug

SEQ ID NO: 1625949 - RNA, 14 nt, Human
cuuuugugcauuau

SEQ ID NO: 1625950 - RNA, 18 nt, Human
cuuuugugcauuaucuag

SEQ ID NO: 1625951 - RNA, 21 nt, Human
cuuuuuuuuuuuuuuugacaa

SEQ ID NO: 1625952 - RNA, 19 nt, Human
gaaaaaauauuuuccugcc

SEQ ID NO: 1625953 - RNA, 14 nt, Human
gaaaaaauauauau

SEQ ID NO: 1625954 - RNA, 21 nt, Human
gaacaaggcaaggcugucaau

SEQ ID NO: 1625955 - RNA, 18 nt, Human
gaacaaggcaaggcuguc

SEQ ID NO: 1625956 - RNA, 17 nt, Human
gaacaaggcaaggcugu

SEQ ID NO: 1625957 - RNA, 15 nt, Human
gaacaaggcaaggcu

SEQ ID NO: 1625958 - RNA, 14 nt, Human
gaacaaggcaaggc

SEQ ID NO: 1625959 - RNA, 23 nt, Human
gaaacuucagcgguuuauauaag

SEQ ID NO: 1625960 - RNA, 18 nt, Human
gaaagaaguggggacaga

SEQ ID NO: 1625961 - RNA, 20 nt, Human
gaaacuuguguaaauacaau

SEQ ID NO: 1625962 - RNA, 16 nt, Human
gaaacuuguguaaaua

SEQ ID NO: 1625963 - RNA, 14 nt, Human
gaaacuuguguaaa

SEQ ID NO: 1625964 - RNA, 23 nt, Human
gaacaaauuuacagagacagaaa

SEQ ID NO: 1625965 - RNA, 18 nt, Human
gaacaaauuuacagagac

SEQ ID NO: 1625966 - RNA, 17 nt, Human
gaacaaauuuacagaga

SEQ ID NO: 1625967 - RNA, 19 nt, Human
gaaauuuuuauuaaauuau

SEQ ID NO: 1625968 - RNA, 18 nt, Human
gaaaugaaagcagggacu

SEQ ID NO: 1625969 - RNA, 18 nt, Human
gaaauuuuuauuaaauua

SEQ ID NO: 1625970 - RNA, 23 nt, Human
gaaaucaaauaugcaaagcacug

SEQ ID NO: 1625971 - RNA, 19 nt, Human
gaaaucaccgaaaacgugg

SEQ ID NO: 1625972 - RNA, 17 nt, Human
gaaaucaccgaaaacgu

SEQ ID NO: 1625973 - RNA, 16 nt, Human
gaaaucaaauaugcaa

SEQ ID NO: 1625974 - RNA, 17 nt, Human
gaaaucaaauaugcaaa

SEQ ID NO: 1625975 - RNA, 21 nt, Human
gaaaguacuucuccacccugc

SEQ ID NO: 1625976 - RNA, 22 nt, Human
gaaaguacuucuccacccugcu

SEQ ID NO: 1625977 - RNA, 20 nt, Human
gaaaggcuccaggagcagcc

SEQ ID NO: 1625978 - RNA, 19 nt, Human
gaaaggcuccaggagcagc

SEQ ID NO: 1625979 - RNA, 18 nt, Human
gaaaggcuccaggagcag

SEQ ID NO: 1625980 - RNA, 17 nt, Human
gaaaggcuccaggagca

SEQ ID NO: 1625981 - RNA, 18 nt, Human
gaaagacuaucuaaaugu

SEQ ID NO: 1625982 - RNA, 22 nt, Human
cuggcagaguugaagacagagc

SEQ ID NO: 1625983 - RNA, 23 nt, Human
cuggcagccccuguucuggcaga

SEQ ID NO: 1625984 - RNA, 13 nt, Human
cuggcagccgugc

SEQ ID NO: 1625985 - RNA, 21 nt, Human
cuggcagaguugaagacagag

SEQ ID NO: 1625986 - RNA, 20 nt, Human
cuggcagaguugaagacaga

SEQ ID NO: 1625987 - RNA, 17 nt, Human
cugggacuacaggugug

SEQ ID NO: 1625988 - RNA, 21 nt, Human
cugggacuacaggcacccacc

SEQ ID NO: 1625989 - RNA, 17 nt, Human
cugggacuacaggcacc

SEQ ID NO: 1625990 - RNA, 15 nt, Human
cuggcucuuccaggc

SEQ ID NO: 1625991 - RNA, 14 nt, Human
cuggcucuuccagg

SEQ ID NO: 1625992 - RNA, 13 nt, Human
cuggcucuuccag

SEQ ID NO: 1625993 - RNA, 22 nt, Human
cuggcucccacaggcccuuccu

SEQ ID NO: 1625994 - RNA, 19 nt, Human
cuggcucccacaggcccuu

SEQ ID NO: 1625995 - RNA, 19 nt, Human
cuggcagcucagagagggu

SEQ ID NO: 1625996 - RNA, 17 nt, Human
cuggcagcucagagagg

SEQ ID NO: 1625997 - RNA, 16 nt, Human
cuggcagcucagagag

SEQ ID NO: 1625998 - RNA, 18 nt, Human
cuggcagccgugccuuca

SEQ ID NO: 1625999 - RNA, 17 nt, Human
cuggcagccgugccuuc

SEQ ID NO: 1626000 - RNA, 19 nt, Human
cuggcagccgugccuucag

SEQ ID NO: 1626001 - RNA, 22 nt, Human
cuggaugcagccucacaguccu

SEQ ID NO: 1626002 - RNA, 18 nt, Human
cuggaugcagccucacag

SEQ ID NO: 1626003 - RNA, 17 nt, Human
cuggaugcagccucaca

SEQ ID NO: 1626004 - RNA, 16 nt, Human
cuggaugcagccucac

SEQ ID NO: 1626005 - RNA, 20 nt, Human
cuggaucuccauucucucag

SEQ ID NO: 1626006 - RNA, 19 nt, Human
cuggauccaucaggccacu

SEQ ID NO: 1626007 - RNA, 23 nt, Human
cuggaaaaguauguuagugcaaa

SEQ ID NO: 1626008 - RNA, 14 nt, Human
cugcuuccagugag

SEQ ID NO: 1626009 - RNA, 20 nt, Human
cugcuucaaggauccugagc

SEQ ID NO: 1626010 - RNA, 19 nt, Human
cugcuucaaggauccugag

SEQ ID NO: 1626011 - RNA, 16 nt, Human
cugcuucaaggauccu

SEQ ID NO: 1626012 - RNA, 14 nt, Human
cugcuucaaggauc

SEQ ID NO: 1626013 - RNA, 17 nt, Human
cuggauccaucaggcca

SEQ ID NO: 1626014 - RNA, 15 nt, Human
cuggagaacuagaga

SEQ ID NO: 1626015 - RNA, 14 nt, Human
cuggagaacuagag

SEQ ID NO: 1626016 - RNA, 21 nt, Human
cuggagaaaauggacguguua

SEQ ID NO: 1626017 - RNA, 23 nt, Human
cuggacuccucuguccaggcacu

SEQ ID NO: 1626018 - RNA, 22 nt, Human
cuggacuccucuguccaggcac

SEQ ID NO: 1626019 - RNA, 23 nt, Human
cugcccuuaccugccaggaagcc

SEQ ID NO: 1626020 - RNA, 22 nt, Human
cugcccuuaccugccaggaagc

SEQ ID NO: 1626021 - RNA, 12 nt, Human
cugcccuguggg

SEQ ID NO: 1626022 - RNA, 11 nt, Human
cugcccugugg

SEQ ID NO: 1626023 - RNA, 19 nt, Human
cugcccuuaccugccagga

SEQ ID NO: 1626024 - RNA, 14 nt, Human
cugcccugugggcc

SEQ ID NO: 1626025 - RNA, 20 nt, Human
cugcccugguuuccugcccu

SEQ ID NO: 1626026 - RNA, 24 nt, Human
cugcccugugaguacuacaguccu

SEQ ID NO: 1626027 - RNA, 21 nt, Human
cugcccugguuuccugcccug

SEQ ID NO: 1626028 - RNA, 19 nt, Human
cugcccugguuuccugccc

SEQ ID NO: 1626029 - RNA, 18 nt, Human
cugcccugguuuccugcc

SEQ ID NO: 1626030 - RNA, 17 nt, Human
cugcccugguuuccugc

SEQ ID NO: 1626031 - RNA, 23 nt, Human
cugcccuggugcugccacacuuc

SEQ ID NO: 1626032 - RNA, 16 nt, Human
cugcccuggugcugcc

SEQ ID NO: 1626033 - RNA, 15 nt, Human
cugcccuggugcugc

SEQ ID NO: 1626034 - RNA, 14 nt, Human
cugcccuggugcug

SEQ ID NO: 1626035 - RNA, 13 nt, Human
cugcccuggugcu

SEQ ID NO: 1626036 - RNA, 12 nt, Human
cugcccuggugc

SEQ ID NO: 1626037 - RNA, 21 nt, Human
cugccuccccuccucugcuug

SEQ ID NO: 1626038 - RNA, 19 nt, Human
cugccuccccuccucugcu

SEQ ID NO: 1626039 - RNA, 20 nt, Human
cugccuccccuccucugcuu

SEQ ID NO: 1626040 - RNA, 14 nt, Human
cugccuccuuugug

SEQ ID NO: 1626041 - RNA, 14 nt, Human
cugccucgaacugg

SEQ ID NO: 1626042 - RNA, 23 nt, Human
cugccuccuuugugaggaagccg

SEQ ID NO: 1626043 - RNA, 21 nt, Human
cugccuccuuugugaggaagc

SEQ ID NO: 1626044 - RNA, 17 nt, Human
cugccuccuuugugagg

SEQ ID NO: 1626045 - RNA, 20 nt, Human
cugccucgaacuggcugcaa

SEQ ID NO: 1626046 - RNA, 17 nt, Human
cugccuccccuccucug

SEQ ID NO: 1626047 - RNA, 18 nt, Human
cugccuccccuccucugc

SEQ ID NO: 1626048 - RNA, 23 nt, Human
cugccuguucagcuccagcucac

SEQ ID NO: 1626049 - RNA, 20 nt, Human
cugccuguucagcuccagcu

SEQ ID NO: 1626050 - RNA, 14 nt, Human
cugccuguugggcc

SEQ ID NO: 1626051 - RNA, 19 nt, Human
cugccuguucccauucuug

SEQ ID NO: 1626052 - RNA, 15 nt, Human
cugccuguucccauu

SEQ ID NO: 1626053 - RNA, 18 nt, Human
cugcugaaggcucgagca

SEQ ID NO: 1626054 - RNA, 23 nt, Human
cugcugaaggcucgagcaugccu

SEQ ID NO: 1626055 - RNA, 24 nt, Human
cugcugaaggcucgagcaugccug

SEQ ID NO: 1626056 - RNA, 14 nt, Human
cugcucacauaucu

SEQ ID NO: 1626057 - RNA, 20 nt, Human
cuguaagaaaauaucacuug

SEQ ID NO: 1626058 - RNA, 15 nt, Human
cuguagagugggagc

SEQ ID NO: 1626059 - RNA, 21 nt, Human
cuguacuugcucuugaugccu

SEQ ID NO: 1626060 - RNA, 20 nt, Human
cuguacuugcucuugaugcc

SEQ ID NO: 1626061 - RNA, 19 nt, Human
cuguacuugcucuugaugc

SEQ ID NO: 1626062 - RNA, 16 nt, Human
cuguacuugcucuuga

SEQ ID NO: 1626063 - RNA, 22 nt, Human
cugucuaaugaaaccugugucu

SEQ ID NO: 1626064 - RNA, 21 nt, Human
cuguccugggagugagcuggu

SEQ ID NO: 1626065 - RNA, 16 nt, Human
cugucauuugagcagg

SEQ ID NO: 1626066 - RNA, 20 nt, Human
cuguccugggagugagcugg

SEQ ID NO: 1626067 - RNA, 14 nt, Human
cuguccugggagug

SEQ ID NO: 1626068 - RNA, 13 nt, Human
cuguccugggagu

SEQ ID NO: 1626069 - RNA, 14 nt, Human
cugucauuugagca

SEQ ID NO: 1626070 - RNA, 18 nt, Human
cuguaggaagguuaaugu

SEQ ID NO: 1626071 - RNA, 12 nt, Human
cuggugccucac

SEQ ID NO: 1626072 - RNA, 23 nt, Human
cuggugcccugcuuucagauacu

SEQ ID NO: 1626073 - RNA, 21 nt, Human
cuggugcccugcuuucagaua

SEQ ID NO: 1626074 - RNA, 19 nt, Human
cuggugcccugcuuucaga

SEQ ID NO: 1626075 - RNA, 16 nt, Human
cuggugcccugcuuuc

SEQ ID NO: 1626076 - RNA, 15 nt, Human
cuggugcccugcuuu

SEQ ID NO: 1626077 - RNA, 18 nt, Human
cuggugacugauucuuca

SEQ ID NO: 1626078 - RNA, 18 nt, Human
cuggucuuauuuguaaag

SEQ ID NO: 1626079 - RNA, 17 nt, Human
cuggugacugauucuuc

SEQ ID NO: 1626080 - RNA, 15 nt, Human
cuggugacugauucu

SEQ ID NO: 1626081 - RNA, 14 nt, Human
cuggugacugauuc

SEQ ID NO: 1626082 - RNA, 13 nt, Human
cuggugacugauu

SEQ ID NO: 1626083 - RNA, 20 nt, Human
cuuaaaaaugguuuaaaugg

SEQ ID NO: 1626084 - RNA, 13 nt, Human
cuuaaaaaugguu

SEQ ID NO: 1626085 - RNA, 21 nt, Human
cuuaaaaaugguuuaaauggu

SEQ ID NO: 1626086 - RNA, 14 nt, Human
cuuaaauaauguga

SEQ ID NO: 1626087 - RNA, 16 nt, Human
cuuaaauaaugugaaa

SEQ ID NO: 1626088 - RNA, 19 nt, Human
cuuaaauaaugugaaacug

SEQ ID NO: 1626089 - RNA, 15 nt, Human
cuguuggccagugug

SEQ ID NO: 1626090 - RNA, 12 nt, Human
cuguuggccagu

SEQ ID NO: 1626091 - RNA, 14 nt, Human
cuguugcugccuca

SEQ ID NO: 1626092 - RNA, 23 nt, Human
cugugagaugcuagaacucccuu

SEQ ID NO: 1626093 - RNA, 17 nt, Human
cugugcucuggacaggc

SEQ ID NO: 1626094 - RNA, 18 nt, Human
cugugaacuugaaauuug

SEQ ID NO: 1626095 - RNA, 17 nt, Human
cugugaacuugaaauuu

SEQ ID NO: 1626096 - RNA, 16 nt, Human
cugugaacuugaaauu

SEQ ID NO: 1626097 - RNA, 15 nt, Human
cugugaacugaacuc

SEQ ID NO: 1626098 - RNA, 13 nt, Human
cugugaacugaac

SEQ ID NO: 1626099 - RNA, 16 nt, Human
cugugaacugaacucu

SEQ ID NO: 1626100 - RNA, 15 nt, Human
cugugaacuugaaau

SEQ ID NO: 1626101 - RNA, 22 nt, Human
cuguucacagccagacuggcac

SEQ ID NO: 1626102 - RNA, 15 nt, Human
cuguucagcuccagc

SEQ ID NO: 1626103 - RNA, 13 nt, Human
cuguucacucuac

SEQ ID NO: 1626104 - RNA, 19 nt, Human
cuguucacagccagacugg

SEQ ID NO: 1626105 - RNA, 18 nt, Human
cuguucagcugguugagg

SEQ ID NO: 1626106 - RNA, 12 nt, Human
cuguucagcugg

SEQ ID NO: 1626107 - RNA, 22 nt, Human
cuguucagcuccagcucaccag

SEQ ID NO: 1626108 - RNA, 19 nt, Human
cuguucagcuccagcucac

SEQ ID NO: 1626109 - RNA, 18 nt, Human
cuguucagcuccagcuca

SEQ ID NO: 1626110 - RNA, 16 nt, Human
cuguucagcuccagcu

SEQ ID NO: 1626111 - RNA, 17 nt, Human
cuguuacugucuucagu

SEQ ID NO: 1626112 - RNA, 19 nt, Human
cugugcucuggacaggcau

SEQ ID NO: 1626113 - RNA, 18 nt, Human
cugugcucuggacaggca

SEQ ID NO: 1626114 - RNA, 21 nt, Human
gagggccugcaagggagugag

SEQ ID NO: 1626115 - RNA, 17 nt, Human
gagggccugcaagggag

SEQ ID NO: 1626116 - RNA, 14 nt, Human
gagggccugcaagg

SEQ ID NO: 1626117 - RNA, 12 nt, Human
gagggccugggc

SEQ ID NO: 1626118 - RNA, 15 nt, Human
gaggcuccacuuggu

SEQ ID NO: 1626119 - RNA, 17 nt, Human
gaggccaaggugggagg

SEQ ID NO: 1626120 - RNA, 21 nt, Human
gaggcauuuguuugaacugau

SEQ ID NO: 1626121 - RNA, 21 nt, Human
gaggcaugugaugagaggaaa

SEQ ID NO: 1626122 - RNA, 20 nt, Human
gaggcaugugaugagaggaa

SEQ ID NO: 1626123 - RNA, 22 nt, Human
gaggcaugugaugagaggaaau

SEQ ID NO: 1626124 - RNA, 19 nt, Human
gaggcauuuguuugaacug

SEQ ID NO: 1626125 - RNA, 18 nt, Human
gaggcuccacuuggucug

SEQ ID NO: 1626126 - RNA, 17 nt, Human
gaggcuccacuuggucu

SEQ ID NO: 1626127 - RNA, 18 nt, Human
gaggcugagaugggagaa

SEQ ID NO: 1626128 - RNA, 20 nt, Human
gaggcucuggagcccacugu

SEQ ID NO: 1626129 - RNA, 14 nt, Human
gaggagaaacugga

SEQ ID NO: 1626130 - RNA, 12 nt, Human
gaggagaaacug

SEQ ID NO: 1626131 - RNA, 15 nt, Human
gaggagagaggaccc

SEQ ID NO: 1626132 - RNA, 14 nt, Human
gaggagagaggacc

SEQ ID NO: 1626133 - RNA, 12 nt, Human
gaggagagagga

SEQ ID NO: 1626134 - RNA, 20 nt, Human
gaggcagggucucacucugu

SEQ ID NO: 1626135 - RNA, 19 nt, Human
gaggcagggucucacucug

SEQ ID NO: 1626136 - RNA, 22 nt, Human
gaggcagggucucacucugucg

SEQ ID NO: 1626137 - RNA, 21 nt, Human
gaggacgcucucuggccuucg

SEQ ID NO: 1626138 - RNA, 23 nt, Human
gaggacuuuucuuuguggcuucc

SEQ ID NO: 1626139 - RNA, 20 nt, Human
gaggacuuuucuuuguggcu

SEQ ID NO: 1626140 - RNA, 16 nt, Human
gaggacuuuucuuugu

SEQ ID NO: 1626141 - RNA, 14 nt, Human
gagcagucaggaaa

SEQ ID NO: 1626142 - RNA, 14 nt, Human
gagcaucaggccag

SEQ ID NO: 1626143 - RNA, 13 nt, Human
gagcaugccugga

SEQ ID NO: 1626144 - RNA, 21 nt, Human
gagcaugccuggauggggcug

SEQ ID NO: 1626145 - RNA, 16 nt, Human
gagcaucaggccaggc

SEQ ID NO: 1626146 - RNA, 15 nt, Human
gagcaucaggccagg

SEQ ID NO: 1626147 - RNA, 17 nt, Human
gagcaucaggccaggcc

SEQ ID NO: 1626148 - RNA, 17 nt, Human
gagccccgaggccuucu

SEQ ID NO: 1626149 - RNA, 14 nt, Human
gagccccgaggccu

SEQ ID NO: 1626150 - RNA, 20 nt, Human
gagcccugggaggcucugga

SEQ ID NO: 1626151 - RNA, 19 nt, Human
gagcccugggaggcucugg

SEQ ID NO: 1626152 - RNA, 18 nt, Human
gagcccugggaggcucug

SEQ ID NO: 1626153 - RNA, 16 nt, Human
gagcccugggaggcuc

SEQ ID NO: 1626154 - RNA, 12 nt, Human
gagcccugggag

SEQ ID NO: 1626155 - RNA, 20 nt, Human
gagcuguucacagccagacu

SEQ ID NO: 1626156 - RNA, 14 nt, Human
gagcccugguggca

SEQ ID NO: 1626157 - RNA, 13 nt, Human
gagcccugguggc

SEQ ID NO: 1626158 - RNA, 22 nt, Human
gagcuguucacagccagacugg

SEQ ID NO: 1626159 - RNA, 23 nt, Human
gagaaugaaagggcccagagagg

SEQ ID NO: 1626160 - RNA, 15 nt, Human
gagaaugaaagggcc

SEQ ID NO: 1626161 - RNA, 14 nt, Human
gagacggaguccca

SEQ ID NO: 1626162 - RNA, 19 nt, Human
gagacggagucccaccuug

SEQ ID NO: 1626163 - RNA, 16 nt, Human
gagacggagucccacc

SEQ ID NO: 1626164 - RNA, 18 nt, Human
gagacgggggcagagagg

SEQ ID NO: 1626165 - RNA, 22 nt, Human
gacuuuuuauggcacuaguauu

SEQ ID NO: 1626166 - RNA, 19 nt, Human
gacuuuuccaacccucauc

SEQ ID NO: 1626167 - RNA, 14 nt, Human
gacuuuuccaaccc

SEQ ID NO: 1626168 - RNA, 18 nt, Human
gacuuuuauuuccaguga

SEQ ID NO: 1626169 - RNA, 20 nt, Human
gacuuuuccaacccucauca

SEQ ID NO: 1626170 - RNA, 16 nt, Human
gagaugcuagaacucc

SEQ ID NO: 1626171 - RNA, 20 nt, Human
gagaugcuagaacucccuuu

SEQ ID NO: 1626172 - RNA, 15 nt, Human
gagauuauguucuuu

SEQ ID NO: 1626173 - RNA, 21 nt, Human
gagauugugccccugcacucc

SEQ ID NO: 1626174 - RNA, 14 nt, Human
gagauuggaaggaa

SEQ ID NO: 1626175 - RNA, 20 nt, Human
gagagcugggugucaagagg

SEQ ID NO: 1626176 - RNA, 12 nt, Human
gagaggaaauca

SEQ ID NO: 1626177 - RNA, 22 nt, Human
gagagcuucuguugcugccuca

SEQ ID NO: 1626178 - RNA, 15 nt, Human
gagaggacccccuga

SEQ ID NO: 1626179 - RNA, 20 nt, Human
gagagccuuccagggguggg

SEQ ID NO: 1626180 - RNA, 18 nt, Human
gagagccuuccaggggug

SEQ ID NO: 1626181 - RNA, 21 nt, Human
gagagcuagcagcagggaggg

SEQ ID NO: 1626182 - RNA, 15 nt, Human
gagagcuagcagcag

SEQ ID NO: 1626183 - RNA, 13 nt, Human
gagagcugggugu

SEQ ID NO: 1626184 - RNA, 16 nt, Human
gagagccuuccagggg

SEQ ID NO: 1626185 - RNA, 15 nt, Human
gagagccuuccaggg

SEQ ID NO: 1626186 - RNA, 14 nt, Human
gagacuccugcagg

SEQ ID NO: 1626187 - RNA, 13 nt, Human
gagacuccugcag

SEQ ID NO: 1626188 - RNA, 23 nt, Human
gacauugcggacagccacggcca

SEQ ID NO: 1626189 - RNA, 19 nt, Human
gacauuguagagcuucugg

SEQ ID NO: 1626190 - RNA, 12 nt, Human
gacagcucugca

SEQ ID NO: 1626191 - RNA, 19 nt, Human
gacagcuccuucuguccua

SEQ ID NO: 1626192 - RNA, 10 nt, Human
gacagcucuu

SEQ ID NO: 1626193 - RNA, 18 nt, Human
gacagucaccucauggaa

SEQ ID NO: 1626194 - RNA, 11 nt, Human
gacagcucuua

SEQ ID NO: 1626195 - RNA, 12 nt, Human
gacagucccugc

SEQ ID NO: 1626196 - RNA, 20 nt, Human
gacagucccugccaauggac

SEQ ID NO: 1626197 - RNA, 16 nt, Human
gacagucccugccaau

SEQ ID NO: 1626198 - RNA, 15 nt, Human
gacagucccugccaa

SEQ ID NO: 1626199 - RNA, 14 nt, Human
gacagucccugcca

SEQ ID NO: 1626200 - RNA, 18 nt, Human
gacagcuccuucuguccu

SEQ ID NO: 1626201 - RNA, 17 nt, Human
gacagcuccuucugucc

SEQ ID NO: 1626202 - RNA, 16 nt, Human
gacagcccgggcucug

SEQ ID NO: 1626203 - RNA, 14 nt, Human
gacagcccgggcuc

SEQ ID NO: 1626204 - RNA, 14 nt, Human
gacgcucucuggcc

SEQ ID NO: 1626205 - RNA, 23 nt, Human
gacgcuacccgggaagggggcug

SEQ ID NO: 1626206 - RNA, 22 nt, Human
gacgcuacccgggaagggggcu

SEQ ID NO: 1626207 - RNA, 21 nt, Human
gacgcugugcugcccugccca

SEQ ID NO: 1626208 - RNA, 18 nt, Human
gacgcugugcugcccugc

SEQ ID NO: 1626209 - RNA, 17 nt, Human
gacgcugugcugcccug

SEQ ID NO: 1626210 - RNA, 16 nt, Human
gacgcugugcugcccu

SEQ ID NO: 1626211 - RNA, 13 nt, Human
gacgccaucccag

SEQ ID NO: 1626212 - RNA, 12 nt, Human
gacgccauccca

SEQ ID NO: 1626213 - RNA, 13 nt, Human
gaccucugccuga

SEQ ID NO: 1626214 - RNA, 21 nt, Human
gacgccaucccagccccaaug

SEQ ID NO: 1626215 - RNA, 15 nt, Human
gacgccaucccagcc

SEQ ID NO: 1626216 - RNA, 16 nt, Human
gaccucugcagcaaua

SEQ ID NO: 1626217 - RNA, 18 nt, Human
gaccucugcagcaauaaa

SEQ ID NO: 1626218 - RNA, 22 nt, Human
gaccucugcagcaauaaagcag

SEQ ID NO: 1626219 - RNA, 17 nt, Human
gacccggaggggccugg

SEQ ID NO: 1626220 - RNA, 16 nt, Human
gaccccugagcuugca

SEQ ID NO: 1626221 - RNA, 20 nt, Human
gacccggaggggccuggcag

SEQ ID NO: 1626222 - RNA, 19 nt, Human
gacccggaggggccuggca

SEQ ID NO: 1626223 - RNA, 18 nt, Human
gacccggaggggccuggc

SEQ ID NO: 1626224 - RNA, 21 nt, Human
gaccucaggugauccacccac

SEQ ID NO: 1626225 - RNA, 20 nt, Human
gaccucaggugauccaccca

SEQ ID NO: 1626226 - RNA, 19 nt, Human
gaccucaggugauccaccc

SEQ ID NO: 1626227 - RNA, 21 nt, Human
gaccucaggugagaagcagag

SEQ ID NO: 1626228 - RNA, 19 nt, Human
gaccucaggugagaagcag

SEQ ID NO: 1626229 - RNA, 18 nt, Human
gaccucaggugagaagca

SEQ ID NO: 1626230 - RNA, 19 nt, Human
gaccucaggccugggggcu

SEQ ID NO: 1626231 - RNA, 23 nt, Human
gaccucagguaaucgaccugccu

SEQ ID NO: 1626232 - RNA, 22 nt, Human
gaccucagguaaucgaccugcc

SEQ ID NO: 1626233 - RNA, 14 nt, Human
gaccucaggccugg

SEQ ID NO: 1626234 - RNA, 10 nt, Human
gacccugagg

SEQ ID NO: 1626235 - RNA, 14 nt, Human
gaaugaauggcuaa

SEQ ID NO: 1626236 - RNA, 24 nt, Human
gaauauugcugauggugcaaugac

SEQ ID NO: 1626237 - RNA, 23 nt, Human
gaauauugcugauggugcaauga

SEQ ID NO: 1626238 - RNA, 22 nt, Human
gaauauugcugauggugcaaug

SEQ ID NO: 1626239 - RNA, 15 nt, Human
gaauauauaaccagu

SEQ ID NO: 1626240 - RNA, 13 nt, Human
gaauauugcugau

SEQ ID NO: 1626241 - RNA, 12 nt, Human
gaauauugcuga

SEQ ID NO: 1626242 - RNA, 11 nt, Human
gaauauugcug

SEQ ID NO: 1626243 - RNA, 22 nt, Human
gaauaucuccgucaacucauau

SEQ ID NO: 1626244 - RNA, 13 nt, Human
gacacagcucuuc

SEQ ID NO: 1626245 - RNA, 21 nt, Human
gacacagcucuucuccaggcu

SEQ ID NO: 1626246 - RNA, 20 nt, Human
gacacagcucuucuccaggc

SEQ ID NO: 1626247 - RNA, 19 nt, Human
gacacagcucuucuccagg

SEQ ID NO: 1626248 - RNA, 12 nt, Human
gacacagcucuu

SEQ ID NO: 1626249 - RNA, 14 nt, Human
gaauuaugaaacuu

SEQ ID NO: 1626250 - RNA, 14 nt, Human
gacaaaaagcuacu

SEQ ID NO: 1626251 - RNA, 20 nt, Human
gaaugaauggcuaagcaaaa

SEQ ID NO: 1626252 - RNA, 15 nt, Human
gaaugaauggcuaag

SEQ ID NO: 1626253 - RNA, 14 nt, Human
gaaugauuaugaau

SEQ ID NO: 1626254 - RNA, 14 nt, Human
gaaugauuaauuaa

SEQ ID NO: 1626255 - RNA, 14 nt, Human
gaaugaugccauga

SEQ ID NO: 1626256 - RNA, 20 nt, Human
gaaugaugauccuaggcauu

SEQ ID NO: 1626257 - RNA, 22 nt, Human
gaaugauuaugaauuacauuug

SEQ ID NO: 1626258 - RNA, 18 nt, Human
gaaugcacaaacagaggc

SEQ ID NO: 1626259 - RNA, 17 nt, Human
gaauguuugccucugcc

SEQ ID NO: 1626260 - RNA, 16 nt, Human
gaauguuugccucugc

SEQ ID NO: 1626261 - RNA, 19 nt, Human
gaaugcacaaacagaggcc

SEQ ID NO: 1626262 - RNA, 15 nt, Human
gaauuaacacaugau

SEQ ID NO: 1626263 - RNA, 14 nt, Human
gaauuaacacauga

SEQ ID NO: 1626264 - RNA, 19 nt, Human
gaauguuugccucugccuc

SEQ ID NO: 1626265 - RNA, 18 nt, Human
gaauguuugccucugccu

SEQ ID NO: 1626266 - RNA, 20 nt, Human
gaauuacauuuguauaaaau

SEQ ID NO: 1626267 - RNA, 18 nt, Human
gaauuacauuuguauaaa

SEQ ID NO: 1626268 - RNA, 15 nt, Human
gaauuacauuuguau

SEQ ID NO: 1626269 - RNA, 13 nt, Human
gaauuacauuugu

SEQ ID NO: 1626270 - RNA, 16 nt, Human
gauacaguuacucaga

SEQ ID NO: 1626271 - RNA, 19 nt, Human
gauacaguuacucagaauu

SEQ ID NO: 1626272 - RNA, 23 nt, Human
gauacaguuacucagaauucucu

SEQ ID NO: 1626273 - RNA, 17 nt, Human
gauacuguaucaugaca

SEQ ID NO: 1626274 - RNA, 20 nt, Human
gauacuggauuguacuuugu

SEQ ID NO: 1626275 - RNA, 16 nt, Human
gauacuggauuguacu

SEQ ID NO: 1626276 - RNA, 21 nt, Human
gauacuguaucaugacaaaga

SEQ ID NO: 1626277 - RNA, 12 nt, Human
gauacugaaaua

SEQ ID NO: 1626278 - RNA, 18 nt, Human
gauacuuugauauuuuca

SEQ ID NO: 1626279 - RNA, 19 nt, Human
gauauuuucaacgcagccc

SEQ ID NO: 1626280 - RNA, 20 nt, Human
gaucaaaagguuaauaaagu

SEQ ID NO: 1626281 - RNA, 15 nt, Human
gauauuuugcuuugu

SEQ ID NO: 1626282 - RNA, 23 nt, Human
gauauuuucaacgcagcccugcu

SEQ ID NO: 1626283 - RNA, 22 nt, Human
gauauuuucaacgcagcccugc

SEQ ID NO: 1626284 - RNA, 21 nt, Human
gauauuuucaacgcagcccug

SEQ ID NO: 1626285 - RNA, 22 nt, Human
gaucaaaccccgaccaccugcc

SEQ ID NO: 1626286 - RNA, 23 nt, Human
gaucaaaagguuaauaaaguaau

SEQ ID NO: 1626287 - RNA, 19 nt, Human
gauccaagcuggucccacu

SEQ ID NO: 1626288 - RNA, 17 nt, Human
gauccaagcugguccca

SEQ ID NO: 1626289 - RNA, 16 nt, Human
gauccaagcugguccc

SEQ ID NO: 1626290 - RNA, 12 nt, Human
gauccaagcugg

SEQ ID NO: 1626291 - RNA, 21 nt, Human
gaucaaccccuucgcuccugu

SEQ ID NO: 1626292 - RNA, 19 nt, Human
gauccacccaccucagccu

SEQ ID NO: 1626293 - RNA, 18 nt, Human
gauccacccaccucagcc

SEQ ID NO: 1626294 - RNA, 21 nt, Human
gauccaagcuggucccacuca

SEQ ID NO: 1626295 - RNA, 21 nt, Human
gauccacccaccucagccucc

SEQ ID NO: 1626296 - RNA, 20 nt, Human
gauccacccaccucagccuc

SEQ ID NO: 1626297 - RNA, 22 nt, Human
gauccacccaccucagccuccc

SEQ ID NO: 1626298 - RNA, 14 nt, Human
gaugauccuaggca

SEQ ID NO: 1626299 - RNA, 13 nt, Human
gaugauccuaggc

SEQ ID NO: 1626300 - RNA, 22 nt, Human
gaugauuggaggggggaggugg

SEQ ID NO: 1626301 - RNA, 21 nt, Human
gaugcuucuucagagacuccu

SEQ ID NO: 1626302 - RNA, 20 nt, Human
gaugcuucuucagagacucc

SEQ ID NO: 1626303 - RNA, 17 nt, Human
gaugcuucuucagagac

SEQ ID NO: 1626304 - RNA, 12 nt, Human
gaugauuucuau

SEQ ID NO: 1626305 - RNA, 23 nt, Human
gaugauuucuaugcugaguuugu

SEQ ID NO: 1626306 - RNA, 13 nt, Human
gaugauuucuaug

SEQ ID NO: 1626307 - RNA, 15 nt, Human
gaucugccuaaggac

SEQ ID NO: 1626308 - RNA, 12 nt, Human
gaucugccuaag

SEQ ID NO: 1626309 - RNA, 17 nt, Human
gaucugccuaaggacuu

SEQ ID NO: 1626310 - RNA, 16 nt, Human
gaucugccuaaggacu

SEQ ID NO: 1626311 - RNA, 19 nt, Human
gaucucuugagccugggag

SEQ ID NO: 1626312 - RNA, 17 nt, Human
gaucugaugcaagcaag

SEQ ID NO: 1626313 - RNA, 18 nt, Human
gauccagcagauuauuca

SEQ ID NO: 1626314 - RNA, 19 nt, Human
gauccagcagauuauucac

SEQ ID NO: 1626315 - RNA, 15 nt, Human
gauucuucugcuuca

SEQ ID NO: 1626316 - RNA, 13 nt, Human
gauucuucugcuu

SEQ ID NO: 1626317 - RNA, 19 nt, Human
gauuuaacagaaauguaca

SEQ ID NO: 1626318 - RNA, 20 nt, Human
gauucuucugcuucagccuc

SEQ ID NO: 1626319 - RNA, 16 nt, Human
gauuuaacagaaaugu

SEQ ID NO: 1626320 - RNA, 17 nt, Human
gauuuaacagaaaugua

SEQ ID NO: 1626321 - RNA, 18 nt, Human
gauuuaacagaaauguac

SEQ ID NO: 1626322 - RNA, 18 nt, Human
gauuuuuuuuuccuucag

SEQ ID NO: 1626323 - RNA, 17 nt, Human
gauuuuuuuuuccuuca

SEQ ID NO: 1626324 - RNA, 12 nt, Human
gauuucacucuc

SEQ ID NO: 1626325 - RNA, 16 nt, Human
gauuuuuuuuuccuuc

SEQ ID NO: 1626326 - RNA, 11 nt, Human
gauuucacucu

SEQ ID NO: 1626327 - RNA, 21 nt, Human
gauuuuuuuuuccuucagugc

SEQ ID NO: 1626328 - RNA, 14 nt, Human
gcaaaaaggcagga

SEQ ID NO: 1626329 - RNA, 22 nt, Human
gcaaaagaugcuucucacugcc

SEQ ID NO: 1626330 - RNA, 17 nt, Human
gcaaaagaugcuucuca

SEQ ID NO: 1626331 - RNA, 16 nt, Human
gcaagugagagcuggg

SEQ ID NO: 1626332 - RNA, 13 nt, Human
gcaacaggcuggg

SEQ ID NO: 1626333 - RNA, 15 nt, Human
gcaacaggcugggcu

SEQ ID NO: 1626334 - RNA, 14 nt, Human
gcaacaggcugggc

SEQ ID NO: 1626335 - RNA, 18 nt, Human
gcaaccaccaccaaccac

SEQ ID NO: 1626336 - RNA, 16 nt, Human
gcaaccaccaccaacc

SEQ ID NO: 1626337 - RNA, 13 nt, Human
gcaaccaccacca

SEQ ID NO: 1626338 - RNA, 19 nt, Human
gcaacaggcugggcuucag

SEQ ID NO: 1626339 - RNA, 16 nt, Human
gcaacaggcugggcuu

SEQ ID NO: 1626340 - RNA, 20 nt, Human
gcaaccuucgccaccugggu

SEQ ID NO: 1626341 - RNA, 20 nt, Human
gcaaccuccgccucuugggu

SEQ ID NO: 1626342 - RNA, 17 nt, Human
gcaacccccagccugcu

SEQ ID NO: 1626343 - RNA, 16 nt, Human
gcaacccccagccugc

SEQ ID NO: 1626344 - RNA, 15 nt, Human
gcaacccccagccug

SEQ ID NO: 1626345 - RNA, 14 nt, Human
gcaacccccagccu

SEQ ID NO: 1626346 - RNA, 18 nt, Human
gcagcccaccccucaaca

SEQ ID NO: 1626347 - RNA, 15 nt, Human
gcagccacauuccug

SEQ ID NO: 1626348 - RNA, 22 nt, Human
gcagaacagugauuaccaggga

SEQ ID NO: 1626349 - RNA, 18 nt, Human
gcagaacagugauuacca

SEQ ID NO: 1626350 - RNA, 20 nt, Human
gcagaggaaagcaaaggaga

SEQ ID NO: 1626351 - RNA, 18 nt, Human
gcagaggaaagcaaagga

SEQ ID NO: 1626352 - RNA, 14 nt, Human
gcagaggaaagcaa

SEQ ID NO: 1626353 - RNA, 13 nt, Human
gcagaggaaagca

SEQ ID NO: 1626354 - RNA, 21 nt, Human
gcagaggaaagcaaaggagau

SEQ ID NO: 1626355 - RNA, 23 nt, Human
gcagcauauucaggaagcucagg

SEQ ID NO: 1626356 - RNA, 19 nt, Human
gcagcauauucaggaagcu

SEQ ID NO: 1626357 - RNA, 18 nt, Human
gcagcauauucaggaagc

SEQ ID NO: 1626358 - RNA, 17 nt, Human
gcagcauauucaggaag

SEQ ID NO: 1626359 - RNA, 14 nt, Human
gcagagggcacaga

SEQ ID NO: 1626360 - RNA, 13 nt, Human
gcagaacagugau

SEQ ID NO: 1626361 - RNA, 12 nt, Human
gcagaacaguga

SEQ ID NO: 1626362 - RNA, 22 nt, Human
gcacuuuguucuggcucuucca

SEQ ID NO: 1626363 - RNA, 15 nt, Human
gcacuccagccuggg

SEQ ID NO: 1626364 - RNA, 14 nt, Human
gcacuccagccugg

SEQ ID NO: 1626365 - RNA, 14 nt, Human
gcacuccccugcug

SEQ ID NO: 1626366 - RNA, 13 nt, Human
gcacuccccugcu

SEQ ID NO: 1626367 - RNA, 19 nt, Human
gcacuuuguucuggcucuu

SEQ ID NO: 1626368 - RNA, 18 nt, Human
gcacuuuguucuggcucu

SEQ ID NO: 1626369 - RNA, 16 nt, Human
gcacuccccugcuggg

SEQ ID NO: 1626370 - RNA, 15 nt, Human
gcacuccccugcugg

SEQ ID NO: 1626371 - RNA, 19 nt, Human
gcaagugagagcugggugu

SEQ ID NO: 1626372 - RNA, 18 nt, Human
gcaagugagagcugggug

SEQ ID NO: 1626373 - RNA, 20 nt, Human
gcacucagaagacacugaug

SEQ ID NO: 1626374 - RNA, 13 nt, Human
gcagugaugucac

SEQ ID NO: 1626375 - RNA, 22 nt, Human
gcaguuguugcccacagcugua

SEQ ID NO: 1626376 - RNA, 15 nt, Human
gcauacguacacauu

SEQ ID NO: 1626377 - RNA, 16 nt, Human
gcauacguacacauuu

SEQ ID NO: 1626378 - RNA, 17 nt, Human
gcauacguacacauuuu

SEQ ID NO: 1626379 - RNA, 18 nt, Human
gcauacguacacauuuua

SEQ ID NO: 1626380 - RNA, 11 nt, Human
gcagcugccuc

SEQ ID NO: 1626381 - RNA, 20 nt, Human
gcaucuagcaugucgucaaa

SEQ ID NO: 1626382 - RNA, 13 nt, Human
gcauccuggcacc

SEQ ID NO: 1626383 - RNA, 17 nt, Human
gcauccuccgccucccg

SEQ ID NO: 1626384 - RNA, 14 nt, Human
gcauccuggcaccc

SEQ ID NO: 1626385 - RNA, 13 nt, Human
gcaugggaaugaa

SEQ ID NO: 1626386 - RNA, 21 nt, Human
gcauggcugccaaugggagcu

SEQ ID NO: 1626387 - RNA, 15 nt, Human
gcauuuacuuugugu

SEQ ID NO: 1626388 - RNA, 18 nt, Human
gcauuuaaaagauacagu

SEQ ID NO: 1626389 - RNA, 22 nt, Human
gcauuuaaaagauacaguuacu

SEQ ID NO: 1626390 - RNA, 18 nt, Human
gcauugugggaaggggag

SEQ ID NO: 1626391 - RNA, 16 nt, Human
gcauugugggaagggg

SEQ ID NO: 1626392 - RNA, 16 nt, Human
gcauuuaaaagauaca

SEQ ID NO: 1626393 - RNA, 17 nt, Human
gcauuuaaaagauacag

SEQ ID NO: 1626394 - RNA, 15 nt, Human
gcauugugggaaggg

SEQ ID NO: 1626395 - RNA, 13 nt, Human
gcauugugggaag

SEQ ID NO: 1626396 - RNA, 21 nt, Human
gcaugugaugagaggaaauca

SEQ ID NO: 1626397 - RNA, 19 nt, Human
gcaugugaugagaggaaau

SEQ ID NO: 1626398 - RNA, 17 nt, Human
gcauccaguaucuugaa

SEQ ID NO: 1626399 - RNA, 14 nt, Human
gcauccaguaucuu

SEQ ID NO: 1626400 - RNA, 18 nt, Human
gcauccaguaucuugaag

SEQ ID NO: 1626401 - RNA, 20 nt, Human
gcucagggccuggcucaggu

SEQ ID NO: 1626402 - RNA, 19 nt, Human
gcucagggccuggcucagg

SEQ ID NO: 1626403 - RNA, 18 nt, Human
gcucagggccuggcucag

SEQ ID NO: 1626404 - RNA, 13 nt, Human
gcucaggaguuug

SEQ ID NO: 1626405 - RNA, 23 nt, Human
gcucaggagcccugggaggcucu

SEQ ID NO: 1626406 - RNA, 22 nt, Human
gcucaggagcccugggaggcuc

SEQ ID NO: 1626407 - RNA, 16 nt, Human
gcucagagcaguguuu

SEQ ID NO: 1626408 - RNA, 20 nt, Human
gcuaggaccccuccaugugg

SEQ ID NO: 1626409 - RNA, 22 nt, Human
gcuaggaccccuccaugugggc

SEQ ID NO: 1626410 - RNA, 21 nt, Human
gcuaggaauuguguuuauaau

SEQ ID NO: 1626411 - RNA, 16 nt, Human
gcuaguugggcuuccu

SEQ ID NO: 1626412 - RNA, 14 nt, Human
gcuaguugggcuuc

SEQ ID NO: 1626413 - RNA, 21 nt, Human
gcuaguugggcuuccucauag

SEQ ID NO: 1626414 - RNA, 18 nt, Human
gcuauucaguaauaacuc

SEQ ID NO: 1626415 - RNA, 16 nt, Human
gcuauuucuauauuuu

SEQ ID NO: 1626416 - RNA, 15 nt, Human
gcuauuucuauauuu

SEQ ID NO: 1626417 - RNA, 13 nt, Human
gcuauuucuauau

SEQ ID NO: 1626418 - RNA, 11 nt, Human
gcuauuucuau

SEQ ID NO: 1626419 - RNA, 22 nt, Human
gcuauuucuauauuuucauucu

SEQ ID NO: 1626420 - RNA, 20 nt, Human
gcuauuucuauauuuucauu

SEQ ID NO: 1626421 - RNA, 19 nt, Human
gcuauuucuauauuuucau

SEQ ID NO: 1626422 - RNA, 18 nt, Human
gcuauuucuauauuuuca

SEQ ID NO: 1626423 - RNA, 22 nt, Human
gcuaagugauccucccaccuca

SEQ ID NO: 1626424 - RNA, 18 nt, Human
gcuaagugauccucccac

SEQ ID NO: 1626425 - RNA, 16 nt, Human
gcgcaggcuggcccug

SEQ ID NO: 1626426 - RNA, 15 nt, Human
gcgcaggcuggcccu

SEQ ID NO: 1626427 - RNA, 23 nt, Human
gcgauucuucugcuucagccucc

SEQ ID NO: 1626428 - RNA, 21 nt, Human
gcgcagcauauucaggaagcu

SEQ ID NO: 1626429 - RNA, 14 nt, Human
gcgcaggcuggccc

SEQ ID NO: 1626430 - RNA, 23 nt, Human
gccuugaccauucuccaccugcc

SEQ ID NO: 1626431 - RNA, 22 nt, Human
gcgauucuucugcuucagccuc

SEQ ID NO: 1626432 - RNA, 22 nt, Human
gccuugaccauucuccaccugc

SEQ ID NO: 1626433 - RNA, 16 nt, Human
gccuugaccauucucc

SEQ ID NO: 1626434 - RNA, 23 nt, Human
gccuugaacuuugaccucugcag

SEQ ID NO: 1626435 - RNA, 19 nt, Human
gccugugccucugggacug

SEQ ID NO: 1626436 - RNA, 11 nt, Human
gccugggcaga

SEQ ID NO: 1626437 - RNA, 23 nt, Human
gccugggaucccucauccucaua

SEQ ID NO: 1626438 - RNA, 17 nt, Human
gccuguucagcuccagc

SEQ ID NO: 1626439 - RNA, 16 nt, Human
gccuguucagcuccag

SEQ ID NO: 1626440 - RNA, 15 nt, Human
gccuguucagcucca

SEQ ID NO: 1626441 - RNA, 16 nt, Human
gccuucucugaaggac

SEQ ID NO: 1626442 - RNA, 15 nt, Human
gccuucucugaagga

SEQ ID NO: 1626443 - RNA, 14 nt, Human
gccuugaacuuuga

SEQ ID NO: 1626444 - RNA, 21 nt, Human
gccuucuuuucucccuuuuaa

SEQ ID NO: 1626445 - RNA, 15 nt, Human
gcggcuggcagccca

SEQ ID NO: 1626446 - RNA, 20 nt, Human
gcgggaggauguucugggac

SEQ ID NO: 1626447 - RNA, 22 nt, Human
gcguucauggaacgcguugaaa

SEQ ID NO: 1626448 - RNA, 23 nt, Human
gcuaaggacuuguuagaucuagu

SEQ ID NO: 1626449 - RNA, 12 nt, Human
gcguugaaauug

SEQ ID NO: 1626450 - RNA, 12 nt, Human
gcuaaggacuug

SEQ ID NO: 1626451 - RNA, 18 nt, Human
gcguugaaauuguaauua

SEQ ID NO: 1626452 - RNA, 17 nt, Human
gccccuggcagccccug

SEQ ID NO: 1626453 - RNA, 16 nt, Human
gccccuggcagccccu

SEQ ID NO: 1626454 - RNA, 21 nt, Human
gccccugcugguucaggguug

SEQ ID NO: 1626455 - RNA, 22 nt, Human
gcccuuaccugccaggaagcca

SEQ ID NO: 1626456 - RNA, 17 nt, Human
gcccugugggcccccaa

SEQ ID NO: 1626457 - RNA, 16 nt, Human
gcccugugggccccca

SEQ ID NO: 1626458 - RNA, 21 nt, Human
gcccugugggcccccaaaugg

SEQ ID NO: 1626459 - RNA, 23 nt, Human
gcccuuaccugccaggaagccag

SEQ ID NO: 1626460 - RNA, 19 nt, Human
gcccuuagcagggaaacag

SEQ ID NO: 1626461 - RNA, 15 nt, Human
gcccugcccaccugg

SEQ ID NO: 1626462 - RNA, 14 nt, Human
gcccugcccaccug

SEQ ID NO: 1626463 - RNA, 20 nt, Human
gcccugcgggucacaggagg

SEQ ID NO: 1626464 - RNA, 13 nt, Human
gcccugugcucca

SEQ ID NO: 1626465 - RNA, 16 nt, Human
gccuacaggagugagc

SEQ ID NO: 1626466 - RNA, 21 nt, Human
gcccuuccaugucgccucugc

SEQ ID NO: 1626467 - RNA, 12 nt, Human
gcccuuccaugu

SEQ ID NO: 1626468 - RNA, 12 nt, Human
gcccuuccucuc

SEQ ID NO: 1626469 - RNA, 22 nt, Human
gcccuuccaugucgccucugca

SEQ ID NO: 1626470 - RNA, 15 nt, Human
gcccuuccucuccac

SEQ ID NO: 1626471 - RNA, 14 nt, Human
gcccuuccucucca

SEQ ID NO: 1626472 - RNA, 12 nt, Human
gccuagcauacg

SEQ ID NO: 1626473 - RNA, 19 nt, Human
gccuagcauacguacacau

SEQ ID NO: 1626474 - RNA, 17 nt, Human
gccuacaggagugagca

SEQ ID NO: 1626475 - RNA, 22 nt, Human
gccucauguccacugguucuuc

SEQ ID NO: 1626476 - RNA, 19 nt, Human
gccucaugcuaagacucag

SEQ ID NO: 1626477 - RNA, 15 nt, Human
gccuccauccugagg

SEQ ID NO: 1626478 - RNA, 14 nt, Human
gccuccauccugag

SEQ ID NO: 1626479 - RNA, 13 nt, Human
gccuccauccuga

SEQ ID NO: 1626480 - RNA, 18 nt, Human
gccuccugcccuuaccug

SEQ ID NO: 1626481 - RNA, 19 nt, Human
gccuccugaguagcuggga

SEQ ID NO: 1626482 - RNA, 13 nt, Human
gccucgaacuggc

SEQ ID NO: 1626483 - RNA, 22 nt, Human
gccuccuuugugaggaagccgc

SEQ ID NO: 1626484 - RNA, 16 nt, Human
gccucgaacuggcugc

SEQ ID NO: 1626485 - RNA, 11 nt, Human
gccccaaaagg

SEQ ID NO: 1626486 - RNA, 21 nt, Human
gccccaaaacucuccucugcu

SEQ ID NO: 1626487 - RNA, 20 nt, Human
gccccaaaacucuccucugc

SEQ ID NO: 1626488 - RNA, 15 nt, Human
gccccuggcagcccc

SEQ ID NO: 1626489 - RNA, 12 nt, Human
gccccuggcagc

SEQ ID NO: 1626490 - RNA, 16 nt, Human
gccccugcugguucag

SEQ ID NO: 1626491 - RNA, 15 nt, Human
gccccugcugguuca

SEQ ID NO: 1626492 - RNA, 17 nt, Human
gcccccucugcccugcg

SEQ ID NO: 1626493 - RNA, 12 nt, Human
gccccugcuggu

SEQ ID NO: 1626494 - RNA, 16 nt, Human
gcccccucugcccugc

SEQ ID NO: 1626495 - RNA, 15 nt, Human
gcccccucugcccug

SEQ ID NO: 1626496 - RNA, 22 nt, Human
gcccaggccccugccacccugg

SEQ ID NO: 1626497 - RNA, 21 nt, Human
gcccaggccccugccacccug

SEQ ID NO: 1626498 - RNA, 20 nt, Human
gcccaggccccugccacccu

SEQ ID NO: 1626499 - RNA, 12 nt, Human
gcccaggccccu

SEQ ID NO: 1626500 - RNA, 11 nt, Human
gcccaggcccc

SEQ ID NO: 1626501 - RNA, 11 nt, Human
gcccaggcagg

SEQ ID NO: 1626502 - RNA, 12 nt, Human
gcccaggcaggu

SEQ ID NO: 1626503 - RNA, 12 nt, Human
gcauuuagaugu

SEQ ID NO: 1626504 - RNA, 18 nt, Human
gcauuuacuuuguguuca

SEQ ID NO: 1626505 - RNA, 19 nt, Human
gcauuuaggccaugggaca

SEQ ID NO: 1626506 - RNA, 13 nt, Human
gcauuuagaugua

SEQ ID NO: 1626507 - RNA, 22 nt, Human
gccauguuuauuacaguauaau

SEQ ID NO: 1626508 - RNA, 18 nt, Human
gccauguuuauuacagua

SEQ ID NO: 1626509 - RNA, 14 nt, Human
gccauguuuauuac

SEQ ID NO: 1626510 - RNA, 13 nt, Human
gccauguuuauua

SEQ ID NO: 1626511 - RNA, 21 nt, Human
gcccacgcccccacuggugac

SEQ ID NO: 1626512 - RNA, 17 nt, Human
gcccacgcccccacugg

SEQ ID NO: 1626513 - RNA, 16 nt, Human
gcccacgcccccacug

SEQ ID NO: 1626514 - RNA, 17 nt, Human
gccauugacuucuuccc

SEQ ID NO: 1626515 - RNA, 23 nt, Human
gcccaggaaaggcuccaggagca

SEQ ID NO: 1626516 - RNA, 22 nt, Human
gcccaggaaaggcuccaggagc

SEQ ID NO: 1626517 - RNA, 24 nt, Human
gcccaggaaaggcuccaggagcag

SEQ ID NO: 1626518 - RNA, 13 nt, Human
gcccacuucugcc

SEQ ID NO: 1626519 - RNA, 21 nt, Human
gcccacgcuggagugcaguga

SEQ ID NO: 1626520 - RNA, 19 nt, Human
gcccacgcuggagugcagu

SEQ ID NO: 1626521 - RNA, 23 nt, Human
gcccacgcuggagugcagugagc

SEQ ID NO: 1626522 - RNA, 22 nt, Human
gcccacuguacuugcucuugau

SEQ ID NO: 1626523 - RNA, 20 nt, Human
gcccacuguacuugcucuug

SEQ ID NO: 1626524 - RNA, 15 nt, Human
gcccacuguacuugc

SEQ ID NO: 1626525 - RNA, 16 nt, Human
gcuuggggaccagagc

SEQ ID NO: 1626526 - RNA, 23 nt, Human
gcuugggcuucauccuccucaga

SEQ ID NO: 1626527 - RNA, 19 nt, Human
gcuugaccgugaggccaga

SEQ ID NO: 1626528 - RNA, 18 nt, Human
gcuugaccgugaggccag

SEQ ID NO: 1626529 - RNA, 17 nt, Human
gcuugaccgugaggcca

SEQ ID NO: 1626530 - RNA, 23 nt, Human
gcuucuucagagacuccugcagg

SEQ ID NO: 1626531 - RNA, 21 nt, Human
gcuucuucagagacuccugca

SEQ ID NO: 1626532 - RNA, 19 nt, Human
gcuucuucagagacuccug

SEQ ID NO: 1626533 - RNA, 16 nt, Human
gcuuaacuucacauau

SEQ ID NO: 1626534 - RNA, 17 nt, Human
gcuuaacuucacauauu

SEQ ID NO: 1626535 - RNA, 16 nt, Human
gcuucuucagagacuc

SEQ ID NO: 1626536 - RNA, 23 nt, Human
gcuuucuacccagcgagcccugg

SEQ ID NO: 1626537 - RNA, 22 nt, Human
gcuuucuacccagcgagcccug

SEQ ID NO: 1626538 - RNA, 19 nt, Human
gcuuucuacccagcgagcc

SEQ ID NO: 1626539 - RNA, 13 nt, Human
gcuuucuacccag

SEQ ID NO: 1626540 - RNA, 21 nt, Human
gcuuggggaccagagcugcca

SEQ ID NO: 1626541 - RNA, 20 nt, Human
gcuuggggaccagagcugcc

SEQ ID NO: 1626542 - RNA, 18 nt, Human
gcuuggggaccagagcug

SEQ ID NO: 1626543 - RNA, 17 nt, Human
gcuuggggaccagagcu

SEQ ID NO: 1626544 - RNA, 22 nt, Human
gcuuggggaccagagcugccac

SEQ ID NO: 1626545 - RNA, 20 nt, Human
gcuugaccgugaggccagag

SEQ ID NO: 1626546 - RNA, 13 nt, Human
ggaaacugccagc

SEQ ID NO: 1626547 - RNA, 20 nt, Human
ggaaacagcuaaugggacac

SEQ ID NO: 1626548 - RNA, 15 nt, Human
ggaaacccagcucug

SEQ ID NO: 1626549 - RNA, 16 nt, Human
ggaaaaaauaacaaug

SEQ ID NO: 1626550 - RNA, 15 nt, Human
gcuuuuuaauauuga

SEQ ID NO: 1626551 - RNA, 13 nt, Human
gcuuuugugcauu

SEQ ID NO: 1626552 - RNA, 19 nt, Human
gcuuuugugcauuaucuag

SEQ ID NO: 1626553 - RNA, 17 nt, Human
ggaaagaguaggaagac

SEQ ID NO: 1626554 - RNA, 16 nt, Human
ggaaagaguaggaaga

SEQ ID NO: 1626555 - RNA, 19 nt, Human
ggaaagcaaaggagauugg

SEQ ID NO: 1626556 - RNA, 14 nt, Human
ggaaagaggcucug

SEQ ID NO: 1626557 - RNA, 20 nt, Human
ggaaagacuuuuccaacccu

SEQ ID NO: 1626558 - RNA, 16 nt, Human
ggaaagcccugugcuc

SEQ ID NO: 1626559 - RNA, 20 nt, Human
gcuuuucccuuuuuuuaagu

SEQ ID NO: 1626560 - RNA, 21 nt, Human
gcuuuucccuuuuuuuaagua

SEQ ID NO: 1626561 - RNA, 21 nt, Human
ggaagccagcaggcucucagg

SEQ ID NO: 1626562 - RNA, 23 nt, Human
ggaagccagcaggcucucaggcc

SEQ ID NO: 1626563 - RNA, 22 nt, Human
ggaagccagcaggcucucaggc

SEQ ID NO: 1626564 - RNA, 18 nt, Human
ggaagccgcuggggccag

SEQ ID NO: 1626565 - RNA, 19 nt, Human
ggaaaucaggguuaguauu

SEQ ID NO: 1626566 - RNA, 23 nt, Human
ggaaaucaccgaaaacguggcug

SEQ ID NO: 1626567 - RNA, 13 nt, Human
ggaaaucuuuaaa

SEQ ID NO: 1626568 - RNA, 16 nt, Human
ggaaauccaggguggu

SEQ ID NO: 1626569 - RNA, 21 nt, Human
ggacagucaccucauggaauu

SEQ ID NO: 1626570 - RNA, 18 nt, Human
ggacagucaccucaugga

SEQ ID NO: 1626571 - RNA, 17 nt, Human
ggacagucaccucaugg

SEQ ID NO: 1626572 - RNA, 15 nt, Human
ggacagggcauggcc

SEQ ID NO: 1626573 - RNA, 22 nt, Human
ggacagggcauggccagguggc

SEQ ID NO: 1626574 - RNA, 17 nt, Human
ggacagggaggugaccc

SEQ ID NO: 1626575 - RNA, 23 nt, Human
ggacacccugugauggggcccug

SEQ ID NO: 1626576 - RNA, 13 nt, Human
ggacacccuguga

SEQ ID NO: 1626577 - RNA, 14 nt, Human
ggacauggacaagg

SEQ ID NO: 1626578 - RNA, 13 nt, Human
ggacauggacaag

SEQ ID NO: 1626579 - RNA, 12 nt, Human
ggacacagcucu

SEQ ID NO: 1626580 - RNA, 14 nt, Human
ggaaugauuaauua

SEQ ID NO: 1626581 - RNA, 19 nt, Human
ggaaugaaugucaguguga

SEQ ID NO: 1626582 - RNA, 13 nt, Human
ggacacagcucuu

SEQ ID NO: 1626583 - RNA, 14 nt, Human
ggacacagcucuuc

SEQ ID NO: 1626584 - RNA, 12 nt, Human
ggacacccugug

SEQ ID NO: 1626585 - RNA, 15 nt, Human
ggaauaccugucccc

SEQ ID NO: 1626586 - RNA, 21 nt, Human
ggaagcucagggccuggcuca

SEQ ID NO: 1626587 - RNA, 22 nt, Human
ggaagcucagggccuggcucag

SEQ ID NO: 1626588 - RNA, 17 nt, Human
ggaagcucagggccugg

SEQ ID NO: 1626589 - RNA, 16 nt, Human
ggaagcucagggccug

SEQ ID NO: 1626590 - RNA, 15 nt, Human
ggaagccugauuaaa

SEQ ID NO: 1626591 - RNA, 16 nt, Human
ggaauauauaaccagu

SEQ ID NO: 1626592 - RNA, 19 nt, Human
ggaauaccugucccccuga

SEQ ID NO: 1626593 - RNA, 16 nt, Human
ggaauaccuguccccc

SEQ ID NO: 1626594 - RNA, 19 nt, Human
ggaauacucuuauaucuau

SEQ ID NO: 1626595 - RNA, 21 nt, Human
gcuguauuuuaaaagaaugau

SEQ ID NO: 1626596 - RNA, 18 nt, Human
gcuguauuuuaaaagaau

SEQ ID NO: 1626597 - RNA, 20 nt, Human
gcuguauuuuaaaagaauga

SEQ ID NO: 1626598 - RNA, 19 nt, Human
gcuguaucccaugagccuc

SEQ ID NO: 1626599 - RNA, 17 nt, Human
gcuguaucccaugagcc

SEQ ID NO: 1626600 - RNA, 15 nt, Human
gcuguuggcuggggg

SEQ ID NO: 1626601 - RNA, 17 nt, Human
gcugugcugcccugccc

SEQ ID NO: 1626602 - RNA, 16 nt, Human
gcugugcugcccugcc

SEQ ID NO: 1626603 - RNA, 15 nt, Human
gcugugcugcccugc

SEQ ID NO: 1626604 - RNA, 20 nt, Human
gcuguuggcugggggccuca

SEQ ID NO: 1626605 - RNA, 16 nt, Human
gcuguuggcugggggc

SEQ ID NO: 1626606 - RNA, 13 nt, Human
gcugugcucugga

SEQ ID NO: 1626607 - RNA, 16 nt, Human
gcugugccucugccug

SEQ ID NO: 1626608 - RNA, 15 nt, Human
gcugugccucugccu

SEQ ID NO: 1626609 - RNA, 14 nt, Human
gcugugccucugcc

SEQ ID NO: 1626610 - RNA, 16 nt, Human
gcugugcucuggacag

SEQ ID NO: 1626611 - RNA, 15 nt, Human
gcugugcucuggaca

SEQ ID NO: 1626612 - RNA, 18 nt, Human
gcugugcucuggacaggc

SEQ ID NO: 1626613 - RNA, 13 nt, Human
gcugcugaaacaa

SEQ ID NO: 1626614 - RNA, 12 nt, Human
gcugcugaaggc

SEQ ID NO: 1626615 - RNA, 14 nt, Human
gcuggcgugcagug

SEQ ID NO: 1626616 - RNA, 19 nt, Human
gcuggcuguuggcuggggg

SEQ ID NO: 1626617 - RNA, 18 nt, Human
gcuggcuguuggcugggg

SEQ ID NO: 1626618 - RNA, 11 nt, Human
gcuggcugccu

SEQ ID NO: 1626619 - RNA, 20 nt, Human
gcuggcugccuuagaaccuu

SEQ ID NO: 1626620 - RNA, 14 nt, Human
gcuggcugccuuag

SEQ ID NO: 1626621 - RNA, 18 nt, Human
gcuggcgugcaguggugc

SEQ ID NO: 1626622 - RNA, 15 nt, Human
gcuggcgugcagugg

SEQ ID NO: 1626623 - RNA, 20 nt, Human
gcuggcgugcaguggugcga

SEQ ID NO: 1626624 - RNA, 21 nt, Human
gcuggguucuacccaggugcu

SEQ ID NO: 1626625 - RNA, 20 nt, Human
gcuggguucuacccaggugc

SEQ ID NO: 1626626 - RNA, 18 nt, Human
gcuggguucuacccaggu

SEQ ID NO: 1626627 - RNA, 23 nt, Human
gcugggguggggaccucaggccu

SEQ ID NO: 1626628 - RNA, 22 nt, Human
gcugggguggggaccucaggcc

SEQ ID NO: 1626629 - RNA, 19 nt, Human
gcugggguggggaccucag

SEQ ID NO: 1626630 - RNA, 17 nt, Human
gcugggguggggaccuc

SEQ ID NO: 1626631 - RNA, 20 nt, Human
gcugggccccugccucucug

SEQ ID NO: 1626632 - RNA, 18 nt, Human
gcugggccccugccucuc

SEQ ID NO: 1626633 - RNA, 14 nt, Human
gcugggccccugcc

SEQ ID NO: 1626634 - RNA, 13 nt, Human
gcugggccccugc

SEQ ID NO: 1626635 - RNA, 12 nt, Human
gcugggccccug

SEQ ID NO: 1626636 - RNA, 23 nt, Human
gcuggcuguuggcugggggccuc

SEQ ID NO: 1626637 - RNA, 20 nt, Human
gcuggcuguuggcugggggc

SEQ ID NO: 1626638 - RNA, 15 nt, Human
gcugaggugggagga

SEQ ID NO: 1626639 - RNA, 14 nt, Human
gcugaggugggagg

SEQ ID NO: 1626640 - RNA, 23 nt, Human
gcugagggugagugggugaauaa

SEQ ID NO: 1626641 - RNA, 14 nt, Human
gcugcaccggcugg

SEQ ID NO: 1626642 - RNA, 13 nt, Human
gcugcaccggcug

SEQ ID NO: 1626643 - RNA, 19 nt, Human
gcugcacccucaggcaggu

SEQ ID NO: 1626644 - RNA, 18 nt, Human
gcugcacccucaggcagg

SEQ ID NO: 1626645 - RNA, 14 nt, Human
gcugccuccccucc

SEQ ID NO: 1626646 - RNA, 13 nt, Human
gcugccucaugcu

SEQ ID NO: 1626647 - RNA, 16 nt, Human
gcugccucucccauca

SEQ ID NO: 1626648 - RNA, 20 nt, Human
gcugccugggaucccucauc

SEQ ID NO: 1626649 - RNA, 13 nt, Human
gcugccuguucag

SEQ ID NO: 1626650 - RNA, 12 nt, Human
gcugccuguuca

SEQ ID NO: 1626651 - RNA, 17 nt, Human
gcugccuguucagcucc

SEQ ID NO: 1626652 - RNA, 23 nt, Human
gcugcucuugaacuccugaccuc

SEQ ID NO: 1626653 - RNA, 21 nt, Human
gcugccugggaucccucaucc

SEQ ID NO: 1626654 - RNA, 19 nt, Human
gcugccccuggcagccccu

SEQ ID NO: 1626655 - RNA, 18 nt, Human
gcugccccuggcagcccc

SEQ ID NO: 1626656 - RNA, 20 nt, Human
gcugccccuggcagccccug

SEQ ID NO: 1626657 - RNA, 10 nt, Human
ggcaaaauaa

SEQ ID NO: 1626658 - RNA, 15 nt, Human
ggcaaaaaggcagga

SEQ ID NO: 1626659 - RNA, 18 nt, Human
ggcacaccgggcacucag

SEQ ID NO: 1626660 - RNA, 16 nt, Human
ggcacugcuuccagug

SEQ ID NO: 1626661 - RNA, 18 nt, Human
ggcacaucagcacgauuu

SEQ ID NO: 1626662 - RNA, 21 nt, Human
ggcagccccauucugccugcc

SEQ ID NO: 1626663 - RNA, 20 nt, Human
ggcagccccauucugccugc

SEQ ID NO: 1626664 - RNA, 16 nt, Human
ggcagccccauucugc

SEQ ID NO: 1626665 - RNA, 22 nt, Human
ggcagccccauucugccugccc

SEQ ID NO: 1626666 - RNA, 23 nt, Human
ggcagccccauucugccugccca

SEQ ID NO: 1626667 - RNA, 16 nt, Human
ggcagccucuucaaaa

SEQ ID NO: 1626668 - RNA, 20 nt, Human
ggcacugcuuccagugaggc

SEQ ID NO: 1626669 - RNA, 22 nt, Human
ggcacugcuuccagugaggcuc

SEQ ID NO: 1626670 - RNA, 13 nt, Human
ggcagccaggcca

SEQ ID NO: 1626671 - RNA, 14 nt, Human
ggcagccaggccac

SEQ ID NO: 1626672 - RNA, 18 nt, Human
ggcaggaggaucacuuga

SEQ ID NO: 1626673 - RNA, 10 nt, Human
ggcagggagg

SEQ ID NO: 1626674 - RNA, 18 nt, Human
ggcagggagggccugggc

SEQ ID NO: 1626675 - RNA, 17 nt, Human
ggcagggagggccuggg

SEQ ID NO: 1626676 - RNA, 20 nt, Human
ggcagggagggccugggccc

SEQ ID NO: 1626677 - RNA, 19 nt, Human
ggcagggagggccugggcc

SEQ ID NO: 1626678 - RNA, 14 nt, Human
ggcauuugcugaau

SEQ ID NO: 1626679 - RNA, 20 nt, Human
ggcaucgcaauguaagacuc

SEQ ID NO: 1626680 - RNA, 19 nt, Human
ggccaaaggaagcacaugc

SEQ ID NO: 1626681 - RNA, 21 nt, Human
ggccaaaggaagcacaugccu

SEQ ID NO: 1626682 - RNA, 16 nt, Human
ggccaaaggaagcaca

SEQ ID NO: 1626683 - RNA, 14 nt, Human
ggccaaaggaagca

SEQ ID NO: 1626684 - RNA, 17 nt, Human
ggcauuuguuugaacug

SEQ ID NO: 1626685 - RNA, 18 nt, Human
ggcauuuuacuguacaga

SEQ ID NO: 1626686 - RNA, 19 nt, Human
ggccagagggagugacaga

SEQ ID NO: 1626687 - RNA, 17 nt, Human
ggccagagggagugaca

SEQ ID NO: 1626688 - RNA, 18 nt, Human
ggccagagacacaagccu

SEQ ID NO: 1626689 - RNA, 17 nt, Human
ggccagagacacaagcc

SEQ ID NO: 1626690 - RNA, 15 nt, Human
ggaggcucuggagcc

SEQ ID NO: 1626691 - RNA, 14 nt, Human
ggaggggggaggug

SEQ ID NO: 1626692 - RNA, 13 nt, Human
ggaggggggaggu

SEQ ID NO: 1626693 - RNA, 23 nt, Human
ggaggugggauccuccaggugca

SEQ ID NO: 1626694 - RNA, 22 nt, Human
ggaggugggauccuccaggugc

SEQ ID NO: 1626695 - RNA, 21 nt, Human
ggagggugacgggggugaacu

SEQ ID NO: 1626696 - RNA, 22 nt, Human
ggagguaaggaauaccuguccc

SEQ ID NO: 1626697 - RNA, 15 nt, Human
ggaguggccacagaa

SEQ ID NO: 1626698 - RNA, 22 nt, Human
ggagugggcccaaugcacuuug

SEQ ID NO: 1626699 - RNA, 12 nt, Human
ggagugggccca

SEQ ID NO: 1626700 - RNA, 16 nt, Human
ggaguggccacagaaa

SEQ ID NO: 1626701 - RNA, 18 nt, Human
ggaucucuugagccuggg

SEQ ID NO: 1626702 - RNA, 23 nt, Human
ggauccugagccagauuucacuc

SEQ ID NO: 1626703 - RNA, 20 nt, Human
ggauccugagccagauuuca

SEQ ID NO: 1626704 - RNA, 19 nt, Human
ggauccugagccagauuuc

SEQ ID NO: 1626705 - RNA, 18 nt, Human
ggauccugagccagauuu

SEQ ID NO: 1626706 - RNA, 16 nt, Human
ggauccugagccagau

SEQ ID NO: 1626707 - RNA, 15 nt, Human
ggauccugagccaga

SEQ ID NO: 1626708 - RNA, 16 nt, Human
ggaguucaucuugaau

SEQ ID NO: 1626709 - RNA, 20 nt, Human
ggauuguccccgacccuugc

SEQ ID NO: 1626710 - RNA, 16 nt, Human
ggauuguccccgaccc

SEQ ID NO: 1626711 - RNA, 12 nt, Human
ggauuuaacaga

SEQ ID NO: 1626712 - RNA, 22 nt, Human
ggauuuaacagaaauguacagc

SEQ ID NO: 1626713 - RNA, 16 nt, Human
ggauuuaacagaaaug

SEQ ID NO: 1626714 - RNA, 17 nt, Human
ggauuuaacagaaaugu

SEQ ID NO: 1626715 - RNA, 14 nt, Human
ggaugaaaaaauaa

SEQ ID NO: 1626716 - RNA, 13 nt, Human
ggauuguccccga

SEQ ID NO: 1626717 - RNA, 14 nt, Human
ggauuguaguccca

SEQ ID NO: 1626718 - RNA, 15 nt, Human
ggcucacugcagccu

SEQ ID NO: 1626719 - RNA, 14 nt, Human
ggcucacugcagcc

SEQ ID NO: 1626720 - RNA, 13 nt, Human
ggcucacugcagc

SEQ ID NO: 1626721 - RNA, 20 nt, Human
ggcucuuccaggcugggaga

SEQ ID NO: 1626722 - RNA, 18 nt, Human
ggcucuuccaggcuggga

SEQ ID NO: 1626723 - RNA, 17 nt, Human
ggcucuuccaggcuggg

SEQ ID NO: 1626724 - RNA, 15 nt, Human
ggcucuuccaggcug

SEQ ID NO: 1626725 - RNA, 13 nt, Human
ggcucccuuccca

SEQ ID NO: 1626726 - RNA, 18 nt, Human
ggcugcccuuucugggca

SEQ ID NO: 1626727 - RNA, 14 nt, Human
ggcugcccuuucug

SEQ ID NO: 1626728 - RNA, 11 nt, Human
ggcugcccuuu

SEQ ID NO: 1626729 - RNA, 10 nt, Human
ggcugcccuu

SEQ ID NO: 1626730 - RNA, 12 nt, Human
ggcugcccuggu

SEQ ID NO: 1626731 - RNA, 15 nt, Human
ggcuggccuggcccc

SEQ ID NO: 1626732 - RNA, 14 nt, Human
ggcuggccuggccc

SEQ ID NO: 1626733 - RNA, 13 nt, Human
ggcuggccuggcc

SEQ ID NO: 1626734 - RNA, 22 nt, Human
aaaaaacugcugacuguuuucu

SEQ ID NO: 1626735 - RNA, 14 nt, Human
aaaaaggaggaaga

SEQ ID NO: 1626736 - RNA, 12 nt, Human
aaaaaggcagga

SEQ ID NO: 1626737 - RNA, 21 nt, Human
aaaaaggaugcacagaguugu

SEQ ID NO: 1626738 - RNA, 14 nt, Human
aaaaauaaaaaaca

SEQ ID NO: 1626739 - RNA, 13 nt, Human
aaaaauacaaaaa

SEQ ID NO: 1626740 - RNA, 14 nt, Human
ggcuggguuggagg

SEQ ID NO: 1626741 - RNA, 16 nt, Human
ggccuucggccuccau

SEQ ID NO: 1626742 - RNA, 22 nt, Human
ggccuucggccuccauccugag

SEQ ID NO: 1626743 - RNA, 18 nt, Human
ggccuucggccuccaucc

SEQ ID NO: 1626744 - RNA, 20 nt, Human
ggcuaagcuucacuguaaaa

SEQ ID NO: 1626745 - RNA, 14 nt, Human
ggcgugcaguggug

SEQ ID NO: 1626746 - RNA, 18 nt, Human
ggcgugagaccugccccu

SEQ ID NO: 1626747 - RNA, 17 nt, Human
ggcgugagaccugcccc

SEQ ID NO: 1626748 - RNA, 16 nt, Human
ggcgugagaccugccc

SEQ ID NO: 1626749 - RNA, 14 nt, Human
ggcgugagaccugc

SEQ ID NO: 1626750 - RNA, 16 nt, Human
ggcuaauguacugcau

SEQ ID NO: 1626751 - RNA, 20 nt, Human
ggcuaagugauccucccacc

SEQ ID NO: 1626752 - RNA, 18 nt, Human
ggcuaauuuuuguuuugu

SEQ ID NO: 1626753 - RNA, 13 nt, Human
ggcuaccuuugua

SEQ ID NO: 1626754 - RNA, 22 nt, Human
ggcuacaccuuagccugcccuc

SEQ ID NO: 1626755 - RNA, 23 nt, Human
ggcuacaccuuagccugcccucc

SEQ ID NO: 1626756 - RNA, 14 nt, Human
ggcuaccuuuguau

SEQ ID NO: 1626757 - RNA, 16 nt, Human
ggcuagagguucaaag

SEQ ID NO: 1626758 - RNA, 16 nt, Human
ggccugcaagggagug

SEQ ID NO: 1626759 - RNA, 11 nt, Human
ggccugccugu

SEQ ID NO: 1626760 - RNA, 15 nt, Human
ggccuggccagaugc

SEQ ID NO: 1626761 - RNA, 12 nt, Human
ggccuggccaga

SEQ ID NO: 1626762 - RNA, 15 nt, Human
ggccuggcagccgug

SEQ ID NO: 1626763 - RNA, 14 nt, Human
ggccuggcagccgu

SEQ ID NO: 1626764 - RNA, 16 nt, Human
ggccuggccagaugca

SEQ ID NO: 1626765 - RNA, 17 nt, Human
ggccuucagggagugag

SEQ ID NO: 1626766 - RNA, 19 nt, Human
ggccucccaacucacccca

SEQ ID NO: 1626767 - RNA, 18 nt, Human
ggccucccaacucacccc

SEQ ID NO: 1626768 - RNA, 17 nt, Human
ggccucccaacucaccc

SEQ ID NO: 1626769 - RNA, 13 nt, Human
ggccucagugcca

SEQ ID NO: 1626770 - RNA, 22 nt, Human
ggccucccaacucaccccagcc

SEQ ID NO: 1626771 - RNA, 20 nt, Human
ggccucccaacucaccccag

SEQ ID NO: 1626772 - RNA, 23 nt, Human
ggccucccaacucaccccagccc

SEQ ID NO: 1626773 - RNA, 16 nt, Human
ggccagaugcaccagc

SEQ ID NO: 1626774 - RNA, 15 nt, Human
ggccagaugcaccag

SEQ ID NO: 1626775 - RNA, 22 nt, Human
ggccagagggagugacagaggc

SEQ ID NO: 1626776 - RNA, 17 nt, Human
ggccagaugcaccagcc

SEQ ID NO: 1626777 - RNA, 21 nt, Human
ggccccugccucucugcaggu

SEQ ID NO: 1626778 - RNA, 19 nt, Human
ggccccugccucucugcag

SEQ ID NO: 1626779 - RNA, 18 nt, Human
ggccccugccucucugca

SEQ ID NO: 1626780 - RNA, 17 nt, Human
ggccccugccucucugc

SEQ ID NO: 1626781 - RNA, 13 nt, Human
ggccccugccucu

SEQ ID NO: 1626782 - RNA, 15 nt, Human
aaaauauuccugcau

SEQ ID NO: 1626783 - RNA, 22 nt, Human
aaaauaugaccacacuccagcu

SEQ ID NO: 1626784 - RNA, 16 nt, Human
aaaauauuuuccugcc

SEQ ID NO: 1626785 - RNA, 18 nt, Human
aaaauauuuuaugaucca

SEQ ID NO: 1626786 - RNA, 15 nt, Human
aaaauauuuuaugau

SEQ ID NO: 1626787 - RNA, 20 nt, Human
aaaauggaagacagcucuua

SEQ ID NO: 1626788 - RNA, 23 nt, Human
aaaaugcuguauuagucacagag

SEQ ID NO: 1626789 - RNA, 12 nt, Human
aaaaugagaaau

SEQ ID NO: 1626790 - RNA, 11 nt, Human
aaaaugagaaa

SEQ ID NO: 1626791 - RNA, 14 nt, Human
aaaauacacacuca

SEQ ID NO: 1626792 - RNA, 20 nt, Human
aaaauaauuuuuauauuuga

SEQ ID NO: 1626793 - RNA, 17 nt, Human
aaaauaauuuuuauauu

SEQ ID NO: 1626794 - RNA, 16 nt, Human
aaaauaauuuuuauau

SEQ ID NO: 1626795 - RNA, 13 nt, Human
aaaauaccaagga

SEQ ID NO: 1626796 - RNA, 14 nt, Human
aaaauaccaaggaa

SEQ ID NO: 1626797 - RNA, 11 nt, Human
aaaauaauuuu

SEQ ID NO: 1626798 - RNA, 11 nt, Human
aaaaggcagga

SEQ ID NO: 1626799 - RNA, 17 nt, Human
aaaagguuaauaaagua

SEQ ID NO: 1626800 - RNA, 16 nt, Human
aaaagguuaauaaagu

SEQ ID NO: 1626801 - RNA, 14 nt, Human
aaaaggaugcacag

SEQ ID NO: 1626802 - RNA, 15 nt, Human
aaaaggaugcacaga

SEQ ID NO: 1626803 - RNA, 19 nt, Human
aaaaggaugcacagaguug

SEQ ID NO: 1626804 - RNA, 22 nt, Human
aaaaggaugcacagaguuguua

SEQ ID NO: 1626805 - RNA, 22 nt, Human
aaaaggagccaauuuaaagaaa

SEQ ID NO: 1626806 - RNA, 13 nt, Human
aaaaggaugcaca

SEQ ID NO: 1626807 - RNA, 15 nt, Human
gggcgugguggugag

SEQ ID NO: 1626808 - RNA, 21 nt, Human
gggcggugagaggggaacaga

SEQ ID NO: 1626809 - RNA, 19 nt, Human
gggcgugagaccugccccu

SEQ ID NO: 1626810 - RNA, 18 nt, Human
gggcgugagaccugcccc

SEQ ID NO: 1626811 - RNA, 22 nt, Human
gggccucgguguggagaagcgg

SEQ ID NO: 1626812 - RNA, 18 nt, Human
gggccucuuaugggcugg

SEQ ID NO: 1626813 - RNA, 19 nt, Human
gggccucuuaugggcuggg

SEQ ID NO: 1626814 - RNA, 14 nt, Human
gggccucagugcca

SEQ ID NO: 1626815 - RNA, 13 nt, Human
gggccucagugcc

SEQ ID NO: 1626816 - RNA, 15 nt, Human
gggccucagugccac

SEQ ID NO: 1626817 - RNA, 14 nt, Human
gggccaggagccuc

SEQ ID NO: 1626818 - RNA, 13 nt, Human
gggccaggagccu

SEQ ID NO: 1626819 - RNA, 16 nt, Human
aaaauggguuuuacug

SEQ ID NO: 1626820 - RNA, 17 nt, Human
gggcuggguucuaccca

SEQ ID NO: 1626821 - RNA, 18 nt, Human
aaaaugguuuaaaugguc

SEQ ID NO: 1626822 - RNA, 16 nt, Human
aaaaugguuuaaaugg

SEQ ID NO: 1626823 - RNA, 15 nt, Human
gggcugggcagagga

SEQ ID NO: 1626824 - RNA, 21 nt, Human
gggcugcaccggcuggccugg

SEQ ID NO: 1626825 - RNA, 20 nt, Human
gggcugcaccggcuggccug

SEQ ID NO: 1626826 - RNA, 19 nt, Human
gggcucagcggggacagcu

SEQ ID NO: 1626827 - RNA, 17 nt, Human
gggcucagcggggacag

SEQ ID NO: 1626828 - RNA, 22 nt, Human
gggcucagcaaaagaugcuucu

SEQ ID NO: 1626829 - RNA, 18 nt, Human
gggcuaguugggcuuccu

SEQ ID NO: 1626830 - RNA, 15 nt, Human
gggcuaguugggcuu

SEQ ID NO: 1626831 - RNA, 20 nt, Human
gggcuaggaaauccagggug

SEQ ID NO: 1626832 - RNA, 13 nt, Human
gggcuccagacac

SEQ ID NO: 1626833 - RNA, 10 nt, Human
gggcuccaga

SEQ ID NO: 1626834 - RNA, 21 nt, Human
gggcucagcggggacagcucc

SEQ ID NO: 1626835 - RNA, 19 nt, Human
gggcugcaccggcuggccu

SEQ ID NO: 1626836 - RNA, 14 nt, Human
ggucagugcaaaua

SEQ ID NO: 1626837 - RNA, 19 nt, Human
gguaucaggugcugccauc

SEQ ID NO: 1626838 - RNA, 22 nt, Human
aaacuugauguguuaucucuua

SEQ ID NO: 1626839 - RNA, 20 nt, Human
gguaaggaauaccugucccc

SEQ ID NO: 1626840 - RNA, 20 nt, Human
gguaggguaagugagagagg

SEQ ID NO: 1626841 - RNA, 23 nt, Human
gguagggugggccuucagggagu

SEQ ID NO: 1626842 - RNA, 11 nt, Human
gguaggguggg

SEQ ID NO: 1626843 - RNA, 14 nt, Human
gguaucaggugcug

SEQ ID NO: 1626844 - RNA, 19 nt, Human
aaacuucagacauagaauu

SEQ ID NO: 1626845 - RNA, 18 nt, Human
gggugggacacccuguga

SEQ ID NO: 1626846 - RNA, 15 nt, Human
gggugggacacccug

SEQ ID NO: 1626847 - RNA, 14 nt, Human
aaacuuaaucuaaa

SEQ ID NO: 1626848 - RNA, 21 nt, Human
aaacguggcugcuucaaggau

SEQ ID NO: 1626849 - RNA, 20 nt, Human
ggguuuugccauguuggcca

SEQ ID NO: 1626850 - RNA, 23 nt, Human
ggguuuugccauguuggccaggc

SEQ ID NO: 1626851 - RNA, 19 nt, Human
gggugggacacccugugau

SEQ ID NO: 1626852 - RNA, 15 nt, Human
gggugguggugauag

SEQ ID NO: 1626853 - RNA, 13 nt, Human
gguaacaggcaga

SEQ ID NO: 1626854 - RNA, 22 nt, Human
gguaaaucagacuaugaaguuu

SEQ ID NO: 1626855 - RNA, 19 nt, Human
aaacauuuugucauauaag

SEQ ID NO: 1626856 - RNA, 20 nt, Human
gggucacucuggcagcucag

SEQ ID NO: 1626857 - RNA, 14 nt, Human
gggucacucuggca

SEQ ID NO: 1626858 - RNA, 22 nt, Human
gggucacucuggcagcucagag

SEQ ID NO: 1626859 - RNA, 22 nt, Human
aaaccugugucucugagaguag

SEQ ID NO: 1626860 - RNA, 17 nt, Human
aaaccuucacuuaggaa

SEQ ID NO: 1626861 - RNA, 15 nt, Human
ggggaccagagcugc

SEQ ID NO: 1626862 - RNA, 14 nt, Human
ggggaccagagcug

SEQ ID NO: 1626863 - RNA, 13 nt, Human
ggggaccagagcu

SEQ ID NO: 1626864 - RNA, 12 nt, Human
ggggaccagagc

SEQ ID NO: 1626865 - RNA, 18 nt, Human
aaaauguauguguaagua

SEQ ID NO: 1626866 - RNA, 15 nt, Human
gggggcugggcagag

SEQ ID NO: 1626867 - RNA, 13 nt, Human
ggggguggccucc

SEQ ID NO: 1626868 - RNA, 21 nt, Human
ggggucacucuggcagcucag

SEQ ID NO: 1626869 - RNA, 15 nt, Human
ggggcccugccuccu

SEQ ID NO: 1626870 - RNA, 11 nt, Human
gggggcuggga

SEQ ID NO: 1626871 - RNA, 18 nt, Human
aaauauaugcuaagucuu

SEQ ID NO: 1626872 - RNA, 14 nt, Human
aaauauauaucaaa

SEQ ID NO: 1626873 - RNA, 22 nt, Human
aaauauauuuuaagacgaaaca

SEQ ID NO: 1626874 - RNA, 16 nt, Human
aaauauauuuuaagac

SEQ ID NO: 1626875 - RNA, 22 nt, Human
aaauaucacuugucaauaaaau

SEQ ID NO: 1626876 - RNA, 21 nt, Human
aaauaccaugccauuuaaagc

SEQ ID NO: 1626877 - RNA, 20 nt, Human
aaauaccagccaguaaaugg

SEQ ID NO: 1626878 - RNA, 21 nt, Human
aaauaccagccaguaaauggg

SEQ ID NO: 1626879 - RNA, 16 nt, Human
guacacacacauacac

SEQ ID NO: 1626880 - RNA, 19 nt, Human
aaauaccagccaguaaaug

SEQ ID NO: 1626881 - RNA, 15 nt, Human
aaauauaggaacuua

SEQ ID NO: 1626882 - RNA, 21 nt, Human
aaauacgugggcauucaaaug

SEQ ID NO: 1626883 - RNA, 20 nt, Human
aaauacgugggcauucaaau

SEQ ID NO: 1626884 - RNA, 23 nt, Human
aaaucagccugcuccagcuguuc

SEQ ID NO: 1626885 - RNA, 21 nt, Human
aaaucagccugcuccagcugu

SEQ ID NO: 1626886 - RNA, 19 nt, Human
aaaucagccugcuccagcu

SEQ ID NO: 1626887 - RNA, 19 nt, Human
aaauauuaagaaagacuau

SEQ ID NO: 1626888 - RNA, 20 nt, Human
aaauauuccugcauuuguga

SEQ ID NO: 1626889 - RNA, 17 nt, Human
aaauaugcaaagcacug

SEQ ID NO: 1626890 - RNA, 16 nt, Human
aaauaugcaaagcacu

SEQ ID NO: 1626891 - RNA, 15 nt, Human
aaauaugcaaagcac

SEQ ID NO: 1626892 - RNA, 13 nt, Human
aaauaugcaaagc

SEQ ID NO: 1626893 - RNA, 23 nt, Human
aaauaucugaaaauguaugugua

SEQ ID NO: 1626894 - RNA, 22 nt, Human
aaauaucugaaaauguaugugu

SEQ ID NO: 1626895 - RNA, 21 nt, Human
aaauaucugaaaauguaugug

SEQ ID NO: 1626896 - RNA, 19 nt, Human
aaauaucugaaaauguaug

SEQ ID NO: 1626897 - RNA, 18 nt, Human
aaauaucugaaaauguau

SEQ ID NO: 1626898 - RNA, 17 nt, Human
aaauaucugaaaaugua

SEQ ID NO: 1626899 - RNA, 14 nt, Human
aaauaucugaaaau

SEQ ID NO: 1626900 - RNA, 12 nt, Human
aaauaucugaaa

SEQ ID NO: 1626901 - RNA, 23 nt, Human
guaauccuagcacuuugggaggc

SEQ ID NO: 1626902 - RNA, 15 nt, Human
guaaucgaccugccu

SEQ ID NO: 1626903 - RNA, 15 nt, Human
guaauuugugauaca

SEQ ID NO: 1626904 - RNA, 17 nt, Human
guaaucgaccugccucg

SEQ ID NO: 1626905 - RNA, 17 nt, Human
guaauuugugauacaau

SEQ ID NO: 1626906 - RNA, 20 nt, Human
guaauuugugauacaaugcu

SEQ ID NO: 1626907 - RNA, 22 nt, Human
guaauuugugauacaaugcugu

SEQ ID NO: 1626908 - RNA, 21 nt, Human
guacaaaguauuaagcauaua

SEQ ID NO: 1626909 - RNA, 20 nt, Human
guacaaaguauuaagcauau

SEQ ID NO: 1626910 - RNA, 22 nt, Human
guacaaccuguucugcuuuccu

SEQ ID NO: 1626911 - RNA, 12 nt, Human
aaaguggugaga

SEQ ID NO: 1626912 - RNA, 22 nt, Human
aaaguguauuuuuuuacuaaua

SEQ ID NO: 1626913 - RNA, 22 nt, Human
aaauaaugugaaacuggauuaa

SEQ ID NO: 1626914 - RNA, 13 nt, Human
guaaaccuuuuau

SEQ ID NO: 1626915 - RNA, 20 nt, Human
guaacaggaaaauuuuaaaa

SEQ ID NO: 1626916 - RNA, 19 nt, Human
guaacaggaaaauuuuaaa

SEQ ID NO: 1626917 - RNA, 16 nt, Human
guaacaagccacccca

SEQ ID NO: 1626918 - RNA, 17 nt, Human
gguucccauuugcuccu

SEQ ID NO: 1626919 - RNA, 19 nt, Human
gguguuuccuggcacugcu

SEQ ID NO: 1626920 - RNA, 17 nt, Human
gguguuuccuggcacug

SEQ ID NO: 1626921 - RNA, 20 nt, Human
gguguuguacucaauuuuaa

SEQ ID NO: 1626922 - RNA, 19 nt, Human
gguguuguacucaauuuua

SEQ ID NO: 1626923 - RNA, 22 nt, Human
gguucccuuuuuuggcugcuga

SEQ ID NO: 1626924 - RNA, 23 nt, Human
gguucccuuugacgccaucccag

SEQ ID NO: 1626925 - RNA, 23 nt, Human
gguguggagaagcggcuggcagc

SEQ ID NO: 1626926 - RNA, 14 nt, Human
gguguggagaagcg

SEQ ID NO: 1626927 - RNA, 13 nt, Human
ggugggggccucg

SEQ ID NO: 1626928 - RNA, 13 nt, Human
ggugugggggaag

SEQ ID NO: 1626929 - RNA, 11 nt, Human
gguguggggga

SEQ ID NO: 1626930 - RNA, 17 nt, Human
aaaguauguuagugcaa

SEQ ID NO: 1626931 - RNA, 14 nt, Human
aaaguguauuuuuu

SEQ ID NO: 1626932 - RNA, 21 nt, Human
aaaguguauuuuuuuacuaau

SEQ ID NO: 1626933 - RNA, 19 nt, Human
aaaguacacuguuucaaac

SEQ ID NO: 1626934 - RNA, 18 nt, Human
aaaguacacuguuucaaa

SEQ ID NO: 1626935 - RNA, 22 nt, Human
aaaguagaagucuuagauguau

SEQ ID NO: 1626936 - RNA, 20 nt, Human
aaaguagaagucuuagaugu

SEQ ID NO: 1626937 - RNA, 21 nt, Human
aaaguaucccuacuguaauuu

SEQ ID NO: 1626938 - RNA, 19 nt, Human
gguuuuauuguuuaaaauc

SEQ ID NO: 1626939 - RNA, 17 nt, Human
gguuuucacauuggaaa

SEQ ID NO: 1626940 - RNA, 20 nt, Human
gguuuguaaauuaacuuuua

SEQ ID NO: 1626941 - RNA, 16 nt, Human
gguuucuaaagcugcc

SEQ ID NO: 1626942 - RNA, 19 nt, Human
gguuuccugcccugggagg

SEQ ID NO: 1626943 - RNA, 16 nt, Human
gguuuccugcccuggg

SEQ ID NO: 1626944 - RNA, 22 nt, Human
gguuucuaaagcugccagccga

SEQ ID NO: 1626945 - RNA, 15 nt, Human
gguuuccugcccugg

SEQ ID NO: 1626946 - RNA, 13 nt, Human
gguuuccugcccu

SEQ ID NO: 1626947 - RNA, 12 nt, Human
gguuuccugccc

SEQ ID NO: 1626948 - RNA, 19 nt, Human
aaacuuuaugcuaagugaa

SEQ ID NO: 1626949 - RNA, 12 nt, Human
aaacuuuaugcu

SEQ ID NO: 1626950 - RNA, 16 nt, Human
aaagcagaacagugau

SEQ ID NO: 1626951 - RNA, 20 nt, Human
gguggcaccagcagccugga

SEQ ID NO: 1626952 - RNA, 14 nt, Human
gguggcaccagcag

SEQ ID NO: 1626953 - RNA, 16 nt, Human
aaagcuaggccuggcc

SEQ ID NO: 1626954 - RNA, 14 nt, Human
aaagcuaggccugg

SEQ ID NO: 1626955 - RNA, 16 nt, Human
aaagcagugcaugcug

SEQ ID NO: 1626956 - RNA, 13 nt, Human
aaagcagugcaug

SEQ ID NO: 1626957 - RNA, 15 nt, Human
aaagcagcguuucua

SEQ ID NO: 1626958 - RNA, 13 nt, Human
aaagcugccagcc

SEQ ID NO: 1626959 - RNA, 12 nt, Human
aaagcugccagc

SEQ ID NO: 1626960 - RNA, 17 nt, Human
aaagcuaggccuggcca

SEQ ID NO: 1626961 - RNA, 22 nt, Human
aaagcugccagccgagauagcc

SEQ ID NO: 1626962 - RNA, 14 nt, Human
aaagcuguguggca

SEQ ID NO: 1626963 - RNA, 13 nt, Human
aaagcuuauuaaa

SEQ ID NO: 1626964 - RNA, 20 nt, Human
aaagggcccagagagggugg

SEQ ID NO: 1626965 - RNA, 22 nt, Human
aaagggcuguuauaaucuuuca

SEQ ID NO: 1626966 - RNA, 20 nt, Human
aaagggcuguuauaaucuuu

SEQ ID NO: 1626967 - RNA, 18 nt, Human
aaagguucaugcaaacuu

SEQ ID NO: 1626968 - RNA, 20 nt, Human
ggugggaggaucucuugagc

SEQ ID NO: 1626969 - RNA, 17 nt, Human
ggugggacacccuguga

SEQ ID NO: 1626970 - RNA, 16 nt, Human
ggugggacacccugug

SEQ ID NO: 1626971 - RNA, 13 nt, Human
ggugggacacccu

SEQ ID NO: 1626972 - RNA, 19 nt, Human
gguggggaccucaggccug

SEQ ID NO: 1626973 - RNA, 18 nt, Human
gguggcuggguuggaggg

SEQ ID NO: 1626974 - RNA, 21 nt, Human
aaaguaaaaacaaagaaauua

SEQ ID NO: 1626975 - RNA, 15 nt, Human
auuauguguguuuua

SEQ ID NO: 1626976 - RNA, 21 nt, Human
auuauguguguuuuaaaauga

SEQ ID NO: 1626977 - RNA, 20 nt, Human
auuauguguguuuuaaaaug

SEQ ID NO: 1626978 - RNA, 20 nt, Human
auuaaauucuugcaaaguau

SEQ ID NO: 1626979 - RNA, 14 nt, Human
auuaaauucuugca

SEQ ID NO: 1626980 - RNA, 18 nt, Human
auuaaauucuugcaaagu

SEQ ID NO: 1626981 - RNA, 18 nt, Human
auucacaagacccaaaag

SEQ ID NO: 1626982 - RNA, 19 nt, Human
auucauauuuacuucuuau

SEQ ID NO: 1626983 - RNA, 18 nt, Human
auucauauuuacuucuua

SEQ ID NO: 1626984 - RNA, 20 nt, Human
auucauauuuacuucuuaua

SEQ ID NO: 1626985 - RNA, 17 nt, Human
auucuugccaaauauaa

SEQ ID NO: 1626986 - RNA, 21 nt, Human
auuccugaugcuucuucagag

SEQ ID NO: 1626987 - RNA, 19 nt, Human
auucucuccuguaccucuu

SEQ ID NO: 1626988 - RNA, 21 nt, Human
auucucuccuguaccucuuga

SEQ ID NO: 1626989 - RNA, 13 nt, Human
auuccugaacagg

SEQ ID NO: 1626990 - RNA, 22 nt, Human
auucuuuccugaggcugggcuc

SEQ ID NO: 1626991 - RNA, 17 nt, Human
auucuuuccugaggcug

SEQ ID NO: 1626992 - RNA, 17 nt, Human
auugauccagaaagaaa

SEQ ID NO: 1626993 - RNA, 16 nt, Human
auugauccagaaagaa

SEQ ID NO: 1626994 - RNA, 16 nt, Human
auuucagcagcugcag

SEQ ID NO: 1626995 - RNA, 15 nt, Human
auuuaaugaaagacu

SEQ ID NO: 1626996 - RNA, 14 nt, Human
auuuaaugaaagac

SEQ ID NO: 1626997 - RNA, 20 nt, Human
auuucuaugaaauauuaugu

SEQ ID NO: 1626998 - RNA, 18 nt, Human
auuucuaugaaauauuau

SEQ ID NO: 1626999 - RNA, 15 nt, Human
auuucuaugaaauau

SEQ ID NO: 1627000 - RNA, 12 nt, Human
auuucuguuuag

SEQ ID NO: 1627001 - RNA, 14 nt, Human
auuucuguuuagau

SEQ ID NO: 1627002 - RNA, 16 nt, Human
auuucuguuuagauaa

SEQ ID NO: 1627003 - RNA, 19 nt, Human
auuguuuaaaaucauuucu

SEQ ID NO: 1627004 - RNA, 22 nt, Human
auuguacaaaguauuaagcaua

SEQ ID NO: 1627005 - RNA, 23 nt, Human
auuguacaaaguauuaagcauau

SEQ ID NO: 1627006 - RNA, 19 nt, Human
auuguucuuaguuugcagu

SEQ ID NO: 1627007 - RNA, 17 nt, Human
auuguaaaugugcuuuu

SEQ ID NO: 1627008 - RNA, 15 nt, Human
auuguaaaugugcuu

SEQ ID NO: 1627009 - RNA, 14 nt, Human
auuguaaaugugcu

SEQ ID NO: 1627010 - RNA, 23 nt, Human
auuguaauaggcguaacuaauuu

SEQ ID NO: 1627011 - RNA, 16 nt, Human
auuguaaggaaugauu

SEQ ID NO: 1627012 - RNA, 15 nt, Human
auuguaaggaaugau

SEQ ID NO: 1627013 - RNA, 13 nt, Human
auuguaaaauggu

SEQ ID NO: 1627014 - RNA, 18 nt, Human
auugaugggauuugguca

SEQ ID NO: 1627015 - RNA, 22 nt, Human
auugauccagaaagaaaacuug

SEQ ID NO: 1627016 - RNA, 19 nt, Human
auugauccagaaagaaaac

SEQ ID NO: 1627017 - RNA, 18 nt, Human
auugauccagaaagaaaa

SEQ ID NO: 1627018 - RNA, 17 nt, Human
auuuuuuuuuccuucag

SEQ ID NO: 1627019 - RNA, 13 nt, Human
auuuuuaagugcu

SEQ ID NO: 1627020 - RNA, 16 nt, Human
auuuuuuuuuccuuca

SEQ ID NO: 1627021 - RNA, 13 nt, Human
auuuuuuuuuccu

SEQ ID NO: 1627022 - RNA, 12 nt, Human
auuuuuuuuucc

SEQ ID NO: 1627023 - RNA, 19 nt, Human
caaaagcugggcagguugg

SEQ ID NO: 1627024 - RNA, 15 nt, Human
caaaagcugggcagg

SEQ ID NO: 1627025 - RNA, 17 nt, Human
auuuuauagcuacuaau

SEQ ID NO: 1627026 - RNA, 20 nt, Human
auuuguuugaacugauaaag

SEQ ID NO: 1627027 - RNA, 14 nt, Human
auuuguuugaacug

SEQ ID NO: 1627028 - RNA, 16 nt, Human
auuuguuugaacugau

SEQ ID NO: 1627029 - RNA, 13 nt, Human
auuuguuugaacu

SEQ ID NO: 1627030 - RNA, 18 nt, Human
auuuugauccaagcuggu

SEQ ID NO: 1627031 - RNA, 19 nt, Human
caacccaaauguucaucaa

SEQ ID NO: 1627032 - RNA, 14 nt, Human
caaccauuccccau

SEQ ID NO: 1627033 - RNA, 21 nt, Human
caacuaucucauuuccaagca

SEQ ID NO: 1627034 - RNA, 17 nt, Human
caacuaugauuuggaaa

SEQ ID NO: 1627035 - RNA, 22 nt, Human
caacuaugauuuggaaaauaaa

SEQ ID NO: 1627036 - RNA, 19 nt, Human
caacuaugauuuggaaaau

SEQ ID NO: 1627037 - RNA, 18 nt, Human
caacuaugauuuggaaaa

SEQ ID NO: 1627038 - RNA, 17 nt, Human
caacccccagccugcua

SEQ ID NO: 1627039 - RNA, 16 nt, Human
caacccccagccugcu

SEQ ID NO: 1627040 - RNA, 15 nt, Human
caacccccagccugc

SEQ ID NO: 1627041 - RNA, 15 nt, Human
caacucaccccagcc

SEQ ID NO: 1627042 - RNA, 13 nt, Human
caacucaccccag

SEQ ID NO: 1627043 - RNA, 16 nt, Human
caacucaccccagccc

SEQ ID NO: 1627044 - RNA, 17 nt, Human
caacucaccccagcccc

SEQ ID NO: 1627045 - RNA, 19 nt, Human
caagacccuugugguccca

SEQ ID NO: 1627046 - RNA, 18 nt, Human
caagacccuugugguccc

SEQ ID NO: 1627047 - RNA, 22 nt, Human
caagacccuuguggucccaccc

SEQ ID NO: 1627048 - RNA, 23 nt, Human
caagacccuuguggucccacccc

SEQ ID NO: 1627049 - RNA, 23 nt, Human
caagaauuucuaggacugaauua

SEQ ID NO: 1627050 - RNA, 13 nt, Human
caagacacaguga

SEQ ID NO: 1627051 - RNA, 18 nt, Human
caaccacugcgaccacaa

SEQ ID NO: 1627052 - RNA, 15 nt, Human
caacacgagcaggcu

SEQ ID NO: 1627053 - RNA, 20 nt, Human
caacaccuuguuucccucuc

SEQ ID NO: 1627054 - RNA, 22 nt, Human
caacaccucugcacaagcugca

SEQ ID NO: 1627055 - RNA, 23 nt, Human
caacaaaccuguuucugcagcca

SEQ ID NO: 1627056 - RNA, 21 nt, Human
caaaucugcuuuuuaaagaau

SEQ ID NO: 1627057 - RNA, 13 nt, Human
caaaugcagcuuu

SEQ ID NO: 1627058 - RNA, 14 nt, Human
caaagaugcagccg

SEQ ID NO: 1627059 - RNA, 13 nt, Human
caaagaugcagcc

SEQ ID NO: 1627060 - RNA, 21 nt, Human
caaaguacacuguuucaaacu

SEQ ID NO: 1627061 - RNA, 15 nt, Human
caaaguauuaagcau

SEQ ID NO: 1627062 - RNA, 14 nt, Human
caaaguauuaagca

SEQ ID NO: 1627063 - RNA, 16 nt, Human
caaaguacacuguuuc

SEQ ID NO: 1627064 - RNA, 20 nt, Human
caaaguacacuguuucaaac

SEQ ID NO: 1627065 - RNA, 17 nt, Human
caaaucagcugcuacua

SEQ ID NO: 1627066 - RNA, 21 nt, Human
caaaguauuaagcauauauuu

SEQ ID NO: 1627067 - RNA, 19 nt, Human
caaaguauuaagcauauau

SEQ ID NO: 1627068 - RNA, 17 nt, Human
caaaguauuaagcauau

SEQ ID NO: 1627069 - RNA, 16 nt, Human
caaaguauuaagcaua

SEQ ID NO: 1627070 - RNA, 22 nt, Human
caaauccagccugcugccugcu

SEQ ID NO: 1627071 - RNA, 22 nt, Human
cagaauauuagugaccucagcu

SEQ ID NO: 1627072 - RNA, 21 nt, Human
cagaaguuucugccgcagccc

SEQ ID NO: 1627073 - RNA, 20 nt, Human
cagaaguuucugccgcagcc

SEQ ID NO: 1627074 - RNA, 22 nt, Human
cagaaguuucugccgcagcccu

SEQ ID NO: 1627075 - RNA, 23 nt, Human
cagaaguuucugccgcagcccug

SEQ ID NO: 1627076 - RNA, 15 nt, Human
cagaacacauaauuc

SEQ ID NO: 1627077 - RNA, 20 nt, Human
cacuuggucugugagaugcu

SEQ ID NO: 1627078 - RNA, 20 nt, Human
cacuuagaaauugcauuucc

SEQ ID NO: 1627079 - RNA, 19 nt, Human
cacuguuucaaacuuuacu

SEQ ID NO: 1627080 - RNA, 17 nt, Human
cacuguugcccaggcug

SEQ ID NO: 1627081 - RNA, 19 nt, Human
cacuuagaaauugcauuuc

SEQ ID NO: 1627082 - RNA, 17 nt, Human
cacuuagaaauugcauu

SEQ ID NO: 1627083 - RNA, 22 nt, Human
cacugggcuuggggaccagagc

SEQ ID NO: 1627084 - RNA, 23 nt, Human
cacugggcuuggggaccagagcu

SEQ ID NO: 1627085 - RNA, 16 nt, Human
cacuguugcccaggcu

SEQ ID NO: 1627086 - RNA, 15 nt, Human
cacuguugcccaggc

SEQ ID NO: 1627087 - RNA, 22 nt, Human
cacugguggcccgacagccugg

SEQ ID NO: 1627088 - RNA, 21 nt, Human
cacugguggcccgacagccug

SEQ ID NO: 1627089 - RNA, 13 nt, Human
cacugguggcccg

SEQ ID NO: 1627090 - RNA, 17 nt, Human
cacuggugacaugucuu

SEQ ID NO: 1627091 - RNA, 23 nt, Human
caccucaaaauaccaugccauuu

SEQ ID NO: 1627092 - RNA, 16 nt, Human
caccugccagggacag

SEQ ID NO: 1627093 - RNA, 14 nt, Human
caccugccagggac

SEQ ID NO: 1627094 - RNA, 20 nt, Human
caccuaccaccacgcccggc

SEQ ID NO: 1627095 - RNA, 21 nt, Human
caccuacaugagguacugaga

SEQ ID NO: 1627096 - RNA, 13 nt, Human
caccuuggcucaa

SEQ ID NO: 1627097 - RNA, 14 nt, Human
caccuuggcucaag

SEQ ID NO: 1627098 - RNA, 19 nt, Human
caccuugacagggcacacc

SEQ ID NO: 1627099 - RNA, 17 nt, Human
caccugccagggacaga

SEQ ID NO: 1627100 - RNA, 15 nt, Human
caccuuuguccccac

SEQ ID NO: 1627101 - RNA, 14 nt, Human
caccuuugucccca

SEQ ID NO: 1627102 - RNA, 17 nt, Human
caccuuuguccccaccg

SEQ ID NO: 1627103 - RNA, 14 nt, Human
caccuuuauucugg

SEQ ID NO: 1627104 - RNA, 11 nt, Human
cacugaagaag

SEQ ID NO: 1627105 - RNA, 23 nt, Human
cacuacggaauaguuggcuagga

SEQ ID NO: 1627106 - RNA, 17 nt, Human
cacggccaggccagagg

SEQ ID NO: 1627107 - RNA, 20 nt, Human
cacggagggugacgggggug

SEQ ID NO: 1627108 - RNA, 16 nt, Human
cacggccaggccagag

SEQ ID NO: 1627109 - RNA, 15 nt, Human
cacggccaggccaga

SEQ ID NO: 1627110 - RNA, 14 nt, Human
cacggccaggccag

SEQ ID NO: 1627111 - RNA, 19 nt, Human
cacucuuauugcccacgcu

SEQ ID NO: 1627112 - RNA, 18 nt, Human
cacucuuauugcccacgc

SEQ ID NO: 1627113 - RNA, 17 nt, Human
cacucuuauugcccacg

SEQ ID NO: 1627114 - RNA, 17 nt, Human
cacucuugaaaaaugca

SEQ ID NO: 1627115 - RNA, 23 nt, Human
caaugcuguauuuuaaaagaaug

SEQ ID NO: 1627116 - RNA, 14 nt, Human
caaugcuguauuuu

SEQ ID NO: 1627117 - RNA, 23 nt, Human
caaugcuggcuguuggcuggggg

SEQ ID NO: 1627118 - RNA, 22 nt, Human
caaugcuggcuguuggcugggg

SEQ ID NO: 1627119 - RNA, 21 nt, Human
caauauuucagauaaucacaa

SEQ ID NO: 1627120 - RNA, 20 nt, Human
caauauuucagauaaucaca

SEQ ID NO: 1627121 - RNA, 12 nt, Human
caauauuucaga

SEQ ID NO: 1627122 - RNA, 22 nt, Human
caaugcugugcccuaaagugua

SEQ ID NO: 1627123 - RNA, 17 nt, Human
caauucuccugccucag

SEQ ID NO: 1627124 - RNA, 19 nt, Human
caauucuccugccucagcc

SEQ ID NO: 1627125 - RNA, 12 nt, Human
caauuuaaaaaa

SEQ ID NO: 1627126 - RNA, 16 nt, Human
cacaagacccuugugg

SEQ ID NO: 1627127 - RNA, 14 nt, Human
cacaagacccuugu

SEQ ID NO: 1627128 - RNA, 16 nt, Human
cacaagacugcacauc

SEQ ID NO: 1627129 - RNA, 14 nt, Human
cacaagccuucggc

SEQ ID NO: 1627130 - RNA, 20 nt, Human
caaguauuagaauaccacag

SEQ ID NO: 1627131 - RNA, 13 nt, Human
caaguauuauacc

SEQ ID NO: 1627132 - RNA, 14 nt, Human
caaguauuagaaua

SEQ ID NO: 1627133 - RNA, 17 nt, Human
caauaaaaaauuaugac

SEQ ID NO: 1627134 - RNA, 16 nt, Human
caauaaaaaauuauga

SEQ ID NO: 1627135 - RNA, 13 nt, Human
caauaaaaaauua

SEQ ID NO: 1627136 - RNA, 22 nt, Human
cacaucagcacgauuucuguuu

SEQ ID NO: 1627137 - RNA, 17 nt, Human
cacaucuugcucugcug

SEQ ID NO: 1627138 - RNA, 20 nt, Human
cacaucagcacgauuucugu

SEQ ID NO: 1627139 - RNA, 21 nt, Human
cacaucagcacgauuucuguu

SEQ ID NO: 1627140 - RNA, 21 nt, Human
caccaacauacucccaucugu

SEQ ID NO: 1627141 - RNA, 20 nt, Human
caccaacauacucccaucug

SEQ ID NO: 1627142 - RNA, 13 nt, Human
cacauuuuucuua

SEQ ID NO: 1627143 - RNA, 14 nt, Human
cacauuuuucuuag

SEQ ID NO: 1627144 - RNA, 17 nt, Human
cacauuuuuuaaaugca

SEQ ID NO: 1627145 - RNA, 21 nt, Human
cacauuuuuuaaaugcaccug

SEQ ID NO: 1627146 - RNA, 18 nt, Human
cacaucuugcucugcuga

SEQ ID NO: 1627147 - RNA, 19 nt, Human
cacaucuugcucugcugac

SEQ ID NO: 1627148 - RNA, 15 nt, Human
cacauuuuauuuuau

SEQ ID NO: 1627149 - RNA, 23 nt, Human
cacccaggagccccgaggccuuc

SEQ ID NO: 1627150 - RNA, 20 nt, Human
cacccaggagccccgaggcc

SEQ ID NO: 1627151 - RNA, 19 nt, Human
cacccagcccacuucugcc

SEQ ID NO: 1627152 - RNA, 24 nt, Human
cacccaggagccccgaggccuucu

SEQ ID NO: 1627153 - RNA, 15 nt, Human
caccagcagccugga

SEQ ID NO: 1627154 - RNA, 14 nt, Human
caccagcagccugg

SEQ ID NO: 1627155 - RNA, 23 nt, Human
caccaacauacucccaucuguga

SEQ ID NO: 1627156 - RNA, 17 nt, Human
cacccagcccacuucug

SEQ ID NO: 1627157 - RNA, 19 nt, Human
cacaguauuacuucugcua

SEQ ID NO: 1627158 - RNA, 18 nt, Human
cacaguauuacuucugcu

SEQ ID NO: 1627159 - RNA, 16 nt, Human
cacaguauuacuucug

SEQ ID NO: 1627160 - RNA, 16 nt, Human
cacagcuaacauggaa

SEQ ID NO: 1627161 - RNA, 15 nt, Human
cacagcuaacaugga

SEQ ID NO: 1627162 - RNA, 22 nt, Human
cacagacccugcccugugggcc

SEQ ID NO: 1627163 - RNA, 18 nt, Human
cacagacauacuaaccag

SEQ ID NO: 1627164 - RNA, 21 nt, Human
cacagacccugcccugugggc

SEQ ID NO: 1627165 - RNA, 20 nt, Human
cacagacccugcccuguggg

SEQ ID NO: 1627166 - RNA, 19 nt, Human
cacagacccugcccugugg

SEQ ID NO: 1627167 - RNA, 10 nt, Human
cacagcucuu

SEQ ID NO: 1627168 - RNA, 23 nt, Human
cacagcucuguccugggagugag

SEQ ID NO: 1627169 - RNA, 20 nt, Human
cacagcucuguccugggagu

SEQ ID NO: 1627170 - RNA, 22 nt, Human
cacagcuaacauggaaguacua

SEQ ID NO: 1627171 - RNA, 18 nt, Human
cauauucuguuggccagu

SEQ ID NO: 1627172 - RNA, 17 nt, Human
cauauucuguuggccag

SEQ ID NO: 1627173 - RNA, 16 nt, Human
cauauuaccacagaca

SEQ ID NO: 1627174 - RNA, 19 nt, Human
caguggugguuuucuguuc

SEQ ID NO: 1627175 - RNA, 20 nt, Human
caguggugguuuucuguucu

SEQ ID NO: 1627176 - RNA, 21 nt, Human
caguggugguuuucuguucuu

SEQ ID NO: 1627177 - RNA, 22 nt, Human
caguggugguuuucuguucuuu

SEQ ID NO: 1627178 - RNA, 14 nt, Human
caucacuucccuac

SEQ ID NO: 1627179 - RNA, 12 nt, Human
caucacuucccu

SEQ ID NO: 1627180 - RNA, 15 nt, Human
cauccuggcacccgg

SEQ ID NO: 1627181 - RNA, 22 nt, Human
cauccuggcacccggccccugc

SEQ ID NO: 1627182 - RNA, 23 nt, Human
cauccuggcacccggccccugcu

SEQ ID NO: 1627183 - RNA, 12 nt, Human
cauccuggaaua

SEQ ID NO: 1627184 - RNA, 16 nt, Human
cauucuccaccugcca

SEQ ID NO: 1627185 - RNA, 14 nt, Human
cauucuccaccugc

SEQ ID NO: 1627186 - RNA, 13 nt, Human
cauucuccaccug

SEQ ID NO: 1627187 - RNA, 15 nt, Human
cauguuggccaggcu

SEQ ID NO: 1627188 - RNA, 14 nt, Human
cauguuggccaggc

SEQ ID NO: 1627189 - RNA, 16 nt, Human
cauguuggccaggcug

SEQ ID NO: 1627190 - RNA, 20 nt, Human
cauguuggccaggcugcucu

SEQ ID NO: 1627191 - RNA, 23 nt, Human
caugucccuaccgagucucuucu

SEQ ID NO: 1627192 - RNA, 19 nt, Human
caugucaaacgugaaaaug

SEQ ID NO: 1627193 - RNA, 14 nt, Human
caugucaaacguga

SEQ ID NO: 1627194 - RNA, 22 nt, Human
caugucccuaccgagucucuuc

SEQ ID NO: 1627195 - RNA, 16 nt, Human
caugucccuaccgagu

SEQ ID NO: 1627196 - RNA, 14 nt, Human
caugauguuuagaa

SEQ ID NO: 1627197 - RNA, 13 nt, Human
caugauguuuucc

SEQ ID NO: 1627198 - RNA, 20 nt, Human
caugcuacacacugcauguu

SEQ ID NO: 1627199 - RNA, 23 nt, Human
caugcuacacacugcauguuugu

SEQ ID NO: 1627200 - RNA, 14 nt, Human
caugcuacacacug

SEQ ID NO: 1627201 - RNA, 17 nt, Human
caugggaaugaauguca

SEQ ID NO: 1627202 - RNA, 16 nt, Human
caugggaaugaauguc

SEQ ID NO: 1627203 - RNA, 15 nt, Human
caugggaaugaaugu

SEQ ID NO: 1627204 - RNA, 14 nt, Human
caugggaaugaaug

SEQ ID NO: 1627205 - RNA, 17 nt, Human
cauggcugccaauggga

SEQ ID NO: 1627206 - RNA, 17 nt, Human
ccaaauguucaucaaug

SEQ ID NO: 1627207 - RNA, 14 nt, Human
ccaacucaccccag

SEQ ID NO: 1627208 - RNA, 23 nt, Human
ccaaauggaaaugggcagagcag

SEQ ID NO: 1627209 - RNA, 18 nt, Human
ccaaauguucaucaauga

SEQ ID NO: 1627210 - RNA, 18 nt, Human
ccaacucaccccagcccc

SEQ ID NO: 1627211 - RNA, 17 nt, Human
ccaacucaccccagccc

SEQ ID NO: 1627212 - RNA, 16 nt, Human
ccaacucaccccagcc

SEQ ID NO: 1627213 - RNA, 13 nt, Human
ccaagcucugcuc

SEQ ID NO: 1627214 - RNA, 12 nt, Human
ccaagcucugcu

SEQ ID NO: 1627215 - RNA, 18 nt, Human
ccaagcucugcuccucuc

SEQ ID NO: 1627216 - RNA, 14 nt, Human
ccaaugcacuuugu

SEQ ID NO: 1627217 - RNA, 15 nt, Human
ccaaugauggucacc

SEQ ID NO: 1627218 - RNA, 17 nt, Human
ccaauauuuaccagacc

SEQ ID NO: 1627219 - RNA, 17 nt, Human
ccaaugggagcucaugg

SEQ ID NO: 1627220 - RNA, 20 nt, Human
cauuuguauaaaauaauuuu

SEQ ID NO: 1627221 - RNA, 19 nt, Human
cauuuguauaaaauaauuu

SEQ ID NO: 1627222 - RNA, 20 nt, Human
cauuuguguugaagagguuu

SEQ ID NO: 1627223 - RNA, 16 nt, Human
cauuuguguugaagag

SEQ ID NO: 1627224 - RNA, 21 nt, Human
ccaaaacucuccucugcugcu

SEQ ID NO: 1627225 - RNA, 22 nt, Human
cauuuuuuuuaagaaaaaggau

SEQ ID NO: 1627226 - RNA, 12 nt, Human
ccacagcaguug

SEQ ID NO: 1627227 - RNA, 18 nt, Human
ccacagcaguugaaaaga

SEQ ID NO: 1627228 - RNA, 17 nt, Human
ccacagcaguugaaaag

SEQ ID NO: 1627229 - RNA, 23 nt, Human
ccacagcaguugaaaagacucca

SEQ ID NO: 1627230 - RNA, 15 nt, Human
ccaccaucaagccac

SEQ ID NO: 1627231 - RNA, 14 nt, Human
ccaccaucaagcca

SEQ ID NO: 1627232 - RNA, 13 nt, Human
ccaccaucaagcc

SEQ ID NO: 1627233 - RNA, 14 nt, Human
ccacagcugcucaa

SEQ ID NO: 1627234 - RNA, 17 nt, Human
ccaccacacccagccca

SEQ ID NO: 1627235 - RNA, 17 nt, Human
ccacgcccccacuggug

SEQ ID NO: 1627236 - RNA, 16 nt, Human
ccacgcccccacuggu

SEQ ID NO: 1627237 - RNA, 19 nt, Human
ccacgcccccacuggugac

SEQ ID NO: 1627238 - RNA, 18 nt, Human
ccacgcccccacugguga

SEQ ID NO: 1627239 - RNA, 13 nt, Human
ccacgcccggcua

SEQ ID NO: 1627240 - RNA, 21 nt, Human
ccaccuuugaagaaguaagga

SEQ ID NO: 1627241 - RNA, 22 nt, Human
ccaccgcagacaggaccaggga

SEQ ID NO: 1627242 - RNA, 13 nt, Human
ccaccgcagacag

SEQ ID NO: 1627243 - RNA, 17 nt, Human
ccacucccugcaaccug

SEQ ID NO: 1627244 - RNA, 20 nt, Human
cagucugacuguuuccauca

SEQ ID NO: 1627245 - RNA, 18 nt, Human
cagucuggaaugcagugg

SEQ ID NO: 1627246 - RNA, 12 nt, Human
cagugcaucuca

SEQ ID NO: 1627247 - RNA, 17 nt, Human
cagucuggaaugcagug

SEQ ID NO: 1627248 - RNA, 15 nt, Human
cagucuggaaugcag

SEQ ID NO: 1627249 - RNA, 14 nt, Human
cagugcaugcuguc

SEQ ID NO: 1627250 - RNA, 13 nt, Human
cagugcaugcugu

SEQ ID NO: 1627251 - RNA, 18 nt, Human
cagugcaucucagcccac

SEQ ID NO: 1627252 - RNA, 17 nt, Human
cagugcaucucagccca

SEQ ID NO: 1627253 - RNA, 16 nt, Human
cagugcaucucagccc

SEQ ID NO: 1627254 - RNA, 15 nt, Human
cagugcaucucagcc

SEQ ID NO: 1627255 - RNA, 18 nt, Human
cagugcccacaggaucag

SEQ ID NO: 1627256 - RNA, 23 nt, Human
cagugggagcugccuguucagcu

SEQ ID NO: 1627257 - RNA, 20 nt, Human
cagugggagcugccuguuca

SEQ ID NO: 1627258 - RNA, 17 nt, Human
cagugcccacaggauca

SEQ ID NO: 1627259 - RNA, 15 nt, Human
cagugcccacaggau

SEQ ID NO: 1627260 - RNA, 13 nt, Human
cagugcccacagg

SEQ ID NO: 1627261 - RNA, 17 nt, Human
cagugcaugcugucccu

SEQ ID NO: 1627262 - RNA, 16 nt, Human
cagugcaugcuguccc

SEQ ID NO: 1627263 - RNA, 21 nt, Human
caguggugcgaucuggguuca

SEQ ID NO: 1627264 - RNA, 18 nt, Human
caguggugguuuucuguu

SEQ ID NO: 1627265 - RNA, 20 nt, Human
caguggggaggggcuguggg

SEQ ID NO: 1627266 - RNA, 14 nt, Human
caguggggaaugaa

SEQ ID NO: 1627267 - RNA, 19 nt, Human
caggugccaguuauggcua

SEQ ID NO: 1627268 - RNA, 21 nt, Human
caggugcacaagcuccaagcu

SEQ ID NO: 1627269 - RNA, 22 nt, Human
caggugcacaagcuccaagcuc

SEQ ID NO: 1627270 - RNA, 23 nt, Human
cagguugucugaagucacugcac

SEQ ID NO: 1627271 - RNA, 22 nt, Human
cagguugucugaagucacugca

SEQ ID NO: 1627272 - RNA, 16 nt, Human
cagguuuuccugaaga

SEQ ID NO: 1627273 - RNA, 12 nt, Human
cagguuuuccug

SEQ ID NO: 1627274 - RNA, 14 nt, Human
cagguuuaagcugu

SEQ ID NO: 1627275 - RNA, 23 nt, Human
caguaaagaacaucccuccuggg

SEQ ID NO: 1627276 - RNA, 20 nt, Human
caggugcacaagcuccaagc

SEQ ID NO: 1627277 - RNA, 19 nt, Human
caggugcacaagcuccaag

SEQ ID NO: 1627278 - RNA, 18 nt, Human
caggugcacaagcuccaa

SEQ ID NO: 1627279 - RNA, 17 nt, Human
caggugcacaagcucca

SEQ ID NO: 1627280 - RNA, 23 nt, Human
caggugauccacccaccucagcc

SEQ ID NO: 1627281 - RNA, 22 nt, Human
caggugauccacccaccucagc

SEQ ID NO: 1627282 - RNA, 15 nt, Human
caggugcacaagcuc

SEQ ID NO: 1627283 - RNA, 21 nt, Human
caggugauccacccaccucag

SEQ ID NO: 1627284 - RNA, 19 nt, Human
cagucaccucauggaauug

SEQ ID NO: 1627285 - RNA, 14 nt, Human
cagucaccccggcc

SEQ ID NO: 1627286 - RNA, 15 nt, Human
cagucacauuccaag

SEQ ID NO: 1627287 - RNA, 16 nt, Human
cagucaccucauggaa

SEQ ID NO: 1627288 - RNA, 20 nt, Human
caggcugggcuucaguggca

SEQ ID NO: 1627289 - RNA, 15 nt, Human
caggcugggagagcc

SEQ ID NO: 1627290 - RNA, 14 nt, Human
caggcugggagagc

SEQ ID NO: 1627291 - RNA, 12 nt, Human
caggcugggaga

SEQ ID NO: 1627292 - RNA, 22 nt, Human
caggcugggcuucaguggcagc

SEQ ID NO: 1627293 - RNA, 21 nt, Human
caggcugggcuucaguggcag

SEQ ID NO: 1627294 - RNA, 23 nt, Human
cagggcucagcggggacagcucc

SEQ ID NO: 1627295 - RNA, 21 nt, Human
cagggcucagcggggacagcu

SEQ ID NO: 1627296 - RNA, 19 nt, Human
caggggaaaaucagccugc

SEQ ID NO: 1627297 - RNA, 20 nt, Human
caggggaaaaucagccugcu

SEQ ID NO: 1627298 - RNA, 20 nt, Human
caggccaggcccucugccca

SEQ ID NO: 1627299 - RNA, 16 nt, Human
caggccagagggagug

SEQ ID NO: 1627300 - RNA, 19 nt, Human
caggccaggcccucugccc

SEQ ID NO: 1627301 - RNA, 18 nt, Human
caggccaggcccucugcc

SEQ ID NO: 1627302 - RNA, 17 nt, Human
caggccaggcccucugc

SEQ ID NO: 1627303 - RNA, 23 nt, Human
caggccagcugcuugggcuucau

SEQ ID NO: 1627304 - RNA, 21 nt, Human
caggccagcugcuugggcuuc

SEQ ID NO: 1627305 - RNA, 19 nt, Human
caggccagcugcuugggcu

SEQ ID NO: 1627306 - RNA, 17 nt, Human
caggccagcugcuuggg

SEQ ID NO: 1627307 - RNA, 15 nt, Human
caggccagagggagu

SEQ ID NO: 1627308 - RNA, 13 nt, Human
caggccagaggga

SEQ ID NO: 1627309 - RNA, 18 nt, Human
caggcagauacaggaaaa

SEQ ID NO: 1627310 - RNA, 15 nt, Human
caggccacuugauga

SEQ ID NO: 1627311 - RNA, 22 nt, Human
cagcuccccucggagaagagcu

SEQ ID NO: 1627312 - RNA, 21 nt, Human
cagcuccccucggagaagagc

SEQ ID NO: 1627313 - RNA, 14 nt, Human
cagcugccugggau

SEQ ID NO: 1627314 - RNA, 13 nt, Human
cagcugccuggga

SEQ ID NO: 1627315 - RNA, 12 nt, Human
cagcugccuggg

SEQ ID NO: 1627316 - RNA, 20 nt, Human
cagcugugcucuggacaggc

SEQ ID NO: 1627317 - RNA, 15 nt, Human
cagcugccugggauc

SEQ ID NO: 1627318 - RNA, 24 nt, Human
cagcugugcucuggacaggcaugu

SEQ ID NO: 1627319 - RNA, 16 nt, Human
caggaaaagcugcuga

SEQ ID NO: 1627320 - RNA, 15 nt, Human
caggaaaagcugcug

SEQ ID NO: 1627321 - RNA, 18 nt, Human
caggaaaagcugcugaca

SEQ ID NO: 1627322 - RNA, 21 nt, Human
cagcggggacagcuccuucug

SEQ ID NO: 1627323 - RNA, 19 nt, Human
cagcggggacagcuccuuc

SEQ ID NO: 1627324 - RNA, 18 nt, Human
cagcggggacagcuccuu

SEQ ID NO: 1627325 - RNA, 12 nt, Human
cagccugcucca

SEQ ID NO: 1627326 - RNA, 15 nt, Human
cagccugcuccagcu

SEQ ID NO: 1627327 - RNA, 19 nt, Human
cagccugcuaauuccccag

SEQ ID NO: 1627328 - RNA, 20 nt, Human
cagccgagauagccaaggcc

SEQ ID NO: 1627329 - RNA, 19 nt, Human
cagccgagauagccaaggc

SEQ ID NO: 1627330 - RNA, 13 nt, Human
cagcaguucagag

SEQ ID NO: 1627331 - RNA, 17 nt, Human
cagcauagaaguaacuu

SEQ ID NO: 1627332 - RNA, 13 nt, Human
cagcauaauacuu

SEQ ID NO: 1627333 - RNA, 22 nt, Human
cagauucuuuccugaggcuggg

SEQ ID NO: 1627334 - RNA, 20 nt, Human
cagauucuuuccugaggcug

SEQ ID NO: 1627335 - RNA, 17 nt, Human
cagauugcaacaggcug

SEQ ID NO: 1627336 - RNA, 16 nt, Human
cagcacgauuucuguu

SEQ ID NO: 1627337 - RNA, 18 nt, Human
cagcacgauuucuguuua

SEQ ID NO: 1627338 - RNA, 19 nt, Human
cagcacgauuucuguuuag

SEQ ID NO: 1627339 - RNA, 20 nt, Human
cagcacgauuucuguuuaga

SEQ ID NO: 1627340 - RNA, 13 nt, Human
cagccaguaaaug

SEQ ID NO: 1627341 - RNA, 20 nt, Human
cagcaucauggagguuugaa

SEQ ID NO: 1627342 - RNA, 17 nt, Human
cagagguugcagugagc

SEQ ID NO: 1627343 - RNA, 20 nt, Human
cagagguccacaacacacag

SEQ ID NO: 1627344 - RNA, 15 nt, Human
cagagguccacaaca

SEQ ID NO: 1627345 - RNA, 21 nt, Human
cagaguaauccaagcaaaugu

SEQ ID NO: 1627346 - RNA, 23 nt, Human
cagaggggguggccucccaacuc

SEQ ID NO: 1627347 - RNA, 22 nt, Human
cagaggggguggccucccaacu

SEQ ID NO: 1627348 - RNA, 12 nt, Human
cagauccuggaa

SEQ ID NO: 1627349 - RNA, 13 nt, Human
cagauccuggaaa

SEQ ID NO: 1627350 - RNA, 19 nt, Human
cagauccccaagccuggca

SEQ ID NO: 1627351 - RNA, 19 nt, Human
cagauucuuuccugaggcu

SEQ ID NO: 1627352 - RNA, 18 nt, Human
cagauucuuuccugaggc

SEQ ID NO: 1627353 - RNA, 17 nt, Human
cagauucuuuccugagg

SEQ ID NO: 1627354 - RNA, 15 nt, Human
cagauucuuuccuga

SEQ ID NO: 1627355 - RNA, 22 nt, Human
ccauuuaaagcuuauuaaaacu

SEQ ID NO: 1627356 - RNA, 15 nt, Human
ccaugggccuccugu

SEQ ID NO: 1627357 - RNA, 14 nt, Human
ccaugggccuccug

SEQ ID NO: 1627358 - RNA, 17 nt, Human
ccaugggccuccugugu

SEQ ID NO: 1627359 - RNA, 14 nt, Human
ccauacauuugugu

SEQ ID NO: 1627360 - RNA, 13 nt, Human
ccauacauuugug

SEQ ID NO: 1627361 - RNA, 20 nt, Human
ccauaauuuuuuuuuuccuu

SEQ ID NO: 1627362 - RNA, 13 nt, Human
ccaucccagcccc

SEQ ID NO: 1627363 - RNA, 12 nt, Human
ccaucccagccc

SEQ ID NO: 1627364 - RNA, 23 nt, Human
ccaucccaaacccuucagugcca

SEQ ID NO: 1627365 - RNA, 19 nt, Human
ccaguuuuguuuggaccaa

SEQ ID NO: 1627366 - RNA, 16 nt, Human
ccaguuuuguuuggac

SEQ ID NO: 1627367 - RNA, 13 nt, Human
ccaugggccuccu

SEQ ID NO: 1627368 - RNA, 16 nt, Human
ccaugaguccccuguu

SEQ ID NO: 1627369 - RNA, 15 nt, Human
ccaugaguccccugu

SEQ ID NO: 1627370 - RNA, 14 nt, Human
ccaugaguccccug

SEQ ID NO: 1627371 - RNA, 19 nt, Human
ccaugagccucagcauccu

SEQ ID NO: 1627372 - RNA, 18 nt, Human
ccaugagccucagcaucc

SEQ ID NO: 1627373 - RNA, 14 nt, Human
ccaugagccucagc

SEQ ID NO: 1627374 - RNA, 22 nt, Human
ccauccccuguagagugggagc

SEQ ID NO: 1627375 - RNA, 16 nt, Human
ccauccccuguagagu

SEQ ID NO: 1627376 - RNA, 22 nt, Human
ccaggauguacaaggacagccc

SEQ ID NO: 1627377 - RNA, 14 nt, Human
ccaggcugggagag

SEQ ID NO: 1627378 - RNA, 13 nt, Human
ccaggcugggaga

SEQ ID NO: 1627379 - RNA, 17 nt, Human
ccaggcaacuugggaac

SEQ ID NO: 1627380 - RNA, 22 nt, Human
ccaggcugggagagccuuccag

SEQ ID NO: 1627381 - RNA, 23 nt, Human
ccaggcugggagagccuuccagg

SEQ ID NO: 1627382 - RNA, 21 nt, Human
ccaggcugggagagccuucca

SEQ ID NO: 1627383 - RNA, 18 nt, Human
ccaggcugggagagccuu

SEQ ID NO: 1627384 - RNA, 17 nt, Human
ccaggcugggagagccu

SEQ ID NO: 1627385 - RNA, 15 nt, Human
ccaggcugggagagc

SEQ ID NO: 1627386 - RNA, 21 nt, Human
ccagucaccccggccaccugc

SEQ ID NO: 1627387 - RNA, 20 nt, Human
ccagucaccccggccaccug

SEQ ID NO: 1627388 - RNA, 13 nt, Human
ccagucaccccgg

SEQ ID NO: 1627389 - RNA, 12 nt, Human
ccagucaccccg

SEQ ID NO: 1627390 - RNA, 22 nt, Human
ccaguauuguacaaaguauuaa

SEQ ID NO: 1627391 - RNA, 20 nt, Human
ccaguauuguacaaaguauu

SEQ ID NO: 1627392 - RNA, 14 nt, Human
ccagucccccugcc

SEQ ID NO: 1627393 - RNA, 19 nt, Human
ccagcagagcaccuuagac

SEQ ID NO: 1627394 - RNA, 23 nt, Human
ccagcagagcaccuuagacaguc

SEQ ID NO: 1627395 - RNA, 23 nt, Human
ccaggaaaggcuccaggagcagc

SEQ ID NO: 1627396 - RNA, 22 nt, Human
ccaggaaaggcuccaggagcag

SEQ ID NO: 1627397 - RNA, 21 nt, Human
ccaggaaaggcuccaggagca

SEQ ID NO: 1627398 - RNA, 20 nt, Human
ccagcuugaaaccuucacuu

SEQ ID NO: 1627399 - RNA, 18 nt, Human
ccagcuugaaaccuucac

SEQ ID NO: 1627400 - RNA, 20 nt, Human
ccagcagccuggacccugug

SEQ ID NO: 1627401 - RNA, 19 nt, Human
ccagcagccuggacccugu

SEQ ID NO: 1627402 - RNA, 15 nt, Human
ccagcagccuggacc

SEQ ID NO: 1627403 - RNA, 16 nt, Human
ccagcagauuauucac

SEQ ID NO: 1627404 - RNA, 10 nt, Human
ccagccccuu

SEQ ID NO: 1627405 - RNA, 21 nt, Human
ccagccccuggaugcagccuc

SEQ ID NO: 1627406 - RNA, 15 nt, Human
ccagcagauuauuca

SEQ ID NO: 1627407 - RNA, 18 nt, Human
ccccugcacuccagccug

SEQ ID NO: 1627408 - RNA, 17 nt, Human
ccccugcaaagcccagc

SEQ ID NO: 1627409 - RNA, 16 nt, Human
ccccugcaaagcccag

SEQ ID NO: 1627410 - RNA, 15 nt, Human
ccccugcaaagccca

SEQ ID NO: 1627411 - RNA, 17 nt, Human
ccccuucgcuccugugu

SEQ ID NO: 1627412 - RNA, 15 nt, Human
ccccuucgcuccugu

SEQ ID NO: 1627413 - RNA, 14 nt, Human
ccccuucgcuccug

SEQ ID NO: 1627414 - RNA, 19 nt, Human
ccccuucgcuccugugucu

SEQ ID NO: 1627415 - RNA, 14 nt, Human
ccccauucugccug

SEQ ID NO: 1627416 - RNA, 13 nt, Human
ccccauucugccu

SEQ ID NO: 1627417 - RNA, 15 nt, Human
ccccauucugccugc

SEQ ID NO: 1627418 - RNA, 12 nt, Human
cccggcugcgga

SEQ ID NO: 1627419 - RNA, 13 nt, Human
cccggcugcccuu

SEQ ID NO: 1627420 - RNA, 12 nt, Human
cccggcugcccu

SEQ ID NO: 1627421 - RNA, 12 nt, Human
cccgggaagggg

SEQ ID NO: 1627422 - RNA, 17 nt, Human
ccccuucugacccaugc

SEQ ID NO: 1627423 - RNA, 13 nt, Human
cccucagagccac

SEQ ID NO: 1627424 - RNA, 20 nt, Human
cccaggcuuagucacugaga

SEQ ID NO: 1627425 - RNA, 15 nt, Human
cccaggcuuagucac

SEQ ID NO: 1627426 - RNA, 22 nt, Human
cccaggaauggagccugcacgg

SEQ ID NO: 1627427 - RNA, 20 nt, Human
cccaggaauggagccugcac

SEQ ID NO: 1627428 - RNA, 19 nt, Human
cccaggaauggagccugca

SEQ ID NO: 1627429 - RNA, 18 nt, Human
cccaggaauggagccugc

SEQ ID NO: 1627430 - RNA, 23 nt, Human
cccagcugugcucuggacaggca

SEQ ID NO: 1627431 - RNA, 21 nt, Human
cccagcugugcucuggacagg

SEQ ID NO: 1627432 - RNA, 19 nt, Human
cccaggaaaggcuccagga

SEQ ID NO: 1627433 - RNA, 22 nt, Human
cccagcuuaaaggggcuagagu

SEQ ID NO: 1627434 - RNA, 22 nt, Human
cccaggaaaggcuccaggagca

SEQ ID NO: 1627435 - RNA, 21 nt, Human
cccaggaaaggcuccaggagc

SEQ ID NO: 1627436 - RNA, 23 nt, Human
cccaggaaaggcuccaggagcag

SEQ ID NO: 1627437 - RNA, 14 nt, Human
cccagcccacuucu

SEQ ID NO: 1627438 - RNA, 17 nt, Human
cccagcccacuucugcc

SEQ ID NO: 1627439 - RNA, 22 nt, Human
cccauucugccugcccaggccc

SEQ ID NO: 1627440 - RNA, 21 nt, Human
cccauucugccugcccaggcc

SEQ ID NO: 1627441 - RNA, 21 nt, Human
ccccagcaagugagagcuggg

SEQ ID NO: 1627442 - RNA, 20 nt, Human
ccccagcaagugagagcugg

SEQ ID NO: 1627443 - RNA, 19 nt, Human
ccccagcaagugagagcug

SEQ ID NO: 1627444 - RNA, 21 nt, Human
ccccauccucuguacagagcc

SEQ ID NO: 1627445 - RNA, 19 nt, Human
ccccauccucuguacagag

SEQ ID NO: 1627446 - RNA, 22 nt, Human
ccccauccucuguacagagccc

SEQ ID NO: 1627447 - RNA, 17 nt, Human
ccccagcaagugagagc

SEQ ID NO: 1627448 - RNA, 23 nt, Human
ccccagauugcaacaggcugggc

SEQ ID NO: 1627449 - RNA, 22 nt, Human
ccccagauugcaacaggcuggg

SEQ ID NO: 1627450 - RNA, 21 nt, Human
ccccagauugcaacaggcugg

SEQ ID NO: 1627451 - RNA, 23 nt, Human
cccauucugccugcccaggcccc

SEQ ID NO: 1627452 - RNA, 22 nt, Human
cccauaauuuuuuuuuuccuuu

SEQ ID NO: 1627453 - RNA, 23 nt, Human
cccauaauuuuuuuuuuccuuuu

SEQ ID NO: 1627454 - RNA, 23 nt, Human
ccucauggaauuggagcucgugg

SEQ ID NO: 1627455 - RNA, 17 nt, Human
ccucccaccucagccuc

SEQ ID NO: 1627456 - RNA, 15 nt, Human
ccucccaccucagcc

SEQ ID NO: 1627457 - RNA, 23 nt, Human
ccucauuuuugaauacaggcaua

SEQ ID NO: 1627458 - RNA, 13 nt, Human
ccucccaucucac

SEQ ID NO: 1627459 - RNA, 16 nt, Human
ccucccaucucacaca

SEQ ID NO: 1627460 - RNA, 14 nt, Human
ccggccccugcugg

SEQ ID NO: 1627461 - RNA, 15 nt, Human
ccggccccugcuggu

SEQ ID NO: 1627462 - RNA, 22 nt, Human
cccuucucuccagccccuggau

SEQ ID NO: 1627463 - RNA, 21 nt, Human
cccuucucuccagccccugga

SEQ ID NO: 1627464 - RNA, 15 nt, Human
cccuucgcuccugug

SEQ ID NO: 1627465 - RNA, 14 nt, Human
cccuucgcuccugu

SEQ ID NO: 1627466 - RNA, 13 nt, Human
ccggccccugcug

SEQ ID NO: 1627467 - RNA, 23 nt, Human
cccugucucaaaaaaagaaaaag

SEQ ID NO: 1627468 - RNA, 20 nt, Human
cccugucucaaaaaaagaaa

SEQ ID NO: 1627469 - RNA, 16 nt, Human
cccugucuaaugaaac

SEQ ID NO: 1627470 - RNA, 13 nt, Human
cccuucgcuccug

SEQ ID NO: 1627471 - RNA, 20 nt, Human
cccugugauggggcccugcc

SEQ ID NO: 1627472 - RNA, 19 nt, Human
cccugugauggggcccugc

SEQ ID NO: 1627473 - RNA, 18 nt, Human
cccugugauggggcccug

SEQ ID NO: 1627474 - RNA, 17 nt, Human
cccugugauggggcccu

SEQ ID NO: 1627475 - RNA, 15 nt, Human
ccuguaaucacagcu

SEQ ID NO: 1627476 - RNA, 17 nt, Human
ccuguccugccuaaggc

SEQ ID NO: 1627477 - RNA, 19 nt, Human
ccuguccugccuaaggcug

SEQ ID NO: 1627478 - RNA, 15 nt, Human
ccugguuuccugccc

SEQ ID NO: 1627479 - RNA, 16 nt, Human
ccugguuuccugcccu

SEQ ID NO: 1627480 - RNA, 14 nt, Human
ccugguuuccugcc

SEQ ID NO: 1627481 - RNA, 13 nt, Human
ccugguuuccugc

SEQ ID NO: 1627482 - RNA, 21 nt, Human
ccugguggcagugggagcugc

SEQ ID NO: 1627483 - RNA, 18 nt, Human
ccugggggcugggcagag

SEQ ID NO: 1627484 - RNA, 22 nt, Human
ccugucuaaugaaaccuguguc

SEQ ID NO: 1627485 - RNA, 15 nt, Human
ccugucuaaugaaac

SEQ ID NO: 1627486 - RNA, 17 nt, Human
ccugucuugccuuuuuc

SEQ ID NO: 1627487 - RNA, 20 nt, Human
ccugucuugccuuuuucauu

SEQ ID NO: 1627488 - RNA, 19 nt, Human
ccugucuugccuuuuucau

SEQ ID NO: 1627489 - RNA, 18 nt, Human
ccugugacuucagcucug

SEQ ID NO: 1627490 - RNA, 17 nt, Human
ccugugaacugaacucu

SEQ ID NO: 1627491 - RNA, 16 nt, Human
ccugugaacugaacuc

SEQ ID NO: 1627492 - RNA, 22 nt, Human
ccuggccucugcacuccccugc

SEQ ID NO: 1627493 - RNA, 20 nt, Human
ccugggccccaguuguauuu

SEQ ID NO: 1627494 - RNA, 21 nt, Human
ccuggccucugcacuccccug

SEQ ID NO: 1627495 - RNA, 20 nt, Human
ccuggccucugcacuccccu

SEQ ID NO: 1627496 - RNA, 22 nt, Human
ccuggccucaagugauucuccu

SEQ ID NO: 1627497 - RNA, 22 nt, Human
ccuggccuagcauacguacaca

SEQ ID NO: 1627498 - RNA, 13 nt, Human
ccucuuucccucc

SEQ ID NO: 1627499 - RNA, 16 nt, Human
ccucuuucccucccuu

SEQ ID NO: 1627500 - RNA, 21 nt, Human
ccugaguagcugggauuacag

SEQ ID NO: 1627501 - RNA, 19 nt, Human
ccugcacuugcagacucua

SEQ ID NO: 1627502 - RNA, 18 nt, Human
ccugcacuugcagacucu

SEQ ID NO: 1627503 - RNA, 17 nt, Human
ccugcacuugcagacuc

SEQ ID NO: 1627504 - RNA, 16 nt, Human
ccugcacuugcagacu

SEQ ID NO: 1627505 - RNA, 20 nt, Human
ccugcccaccuggccucugc

SEQ ID NO: 1627506 - RNA, 14 nt, Human
ccugcccaccuggc

SEQ ID NO: 1627507 - RNA, 13 nt, Human
ccugcccaccugg

SEQ ID NO: 1627508 - RNA, 12 nt, Human
ccugcccaccug

SEQ ID NO: 1627509 - RNA, 17 nt, Human
ccugccccagggcuccc

SEQ ID NO: 1627510 - RNA, 13 nt, Human
ccugcccaggccc

SEQ ID NO: 1627511 - RNA, 20 nt, Human
ccugcugcaguugccaguca

SEQ ID NO: 1627512 - RNA, 21 nt, Human
ccugcugcaguugccagucac

SEQ ID NO: 1627513 - RNA, 19 nt, Human
ccugcugcaguugccaguc

SEQ ID NO: 1627514 - RNA, 17 nt, Human
ccugcugcaguugccag

SEQ ID NO: 1627515 - RNA, 23 nt, Human
ccugccucgaacuggcugcaaag

SEQ ID NO: 1627516 - RNA, 21 nt, Human
ccugccucgaacuggcugcaa

SEQ ID NO: 1627517 - RNA, 19 nt, Human
ccugccucgaacuggcugc

SEQ ID NO: 1627518 - RNA, 11 nt, Human
ccucuuucccu

SEQ ID NO: 1627519 - RNA, 17 nt, Human
cgccagauucuuuccug

SEQ ID NO: 1627520 - RNA, 13 nt, Human
cgccucugcauuc

SEQ ID NO: 1627521 - RNA, 18 nt, Human
cgcaggcccccaggugcc

SEQ ID NO: 1627522 - RNA, 22 nt, Human
cgcaggauucuuccucccuccc

SEQ ID NO: 1627523 - RNA, 13 nt, Human
cgcaggcuggccc

SEQ ID NO: 1627524 - RNA, 14 nt, Human
cgauagugguggug

SEQ ID NO: 1627525 - RNA, 16 nt, Human
cgagucucuucuccac

SEQ ID NO: 1627526 - RNA, 17 nt, Human
ccuuuugagugccuuac

SEQ ID NO: 1627527 - RNA, 15 nt, Human
ccuuuugagugccuu

SEQ ID NO: 1627528 - RNA, 21 nt, Human
ccuuucaauaggaaaaacuga

SEQ ID NO: 1627529 - RNA, 15 nt, Human
ccuuucacaaccuuc

SEQ ID NO: 1627530 - RNA, 17 nt, Human
ccuugccgucuaccuga

SEQ ID NO: 1627531 - RNA, 16 nt, Human
ccuugccgucuaccug

SEQ ID NO: 1627532 - RNA, 12 nt, Human
cgacaaugcaaa

SEQ ID NO: 1627533 - RNA, 13 nt, Human
cgacaaugcaaac

SEQ ID NO: 1627534 - RNA, 13 nt, Human
cgacagccuggca

SEQ ID NO: 1627535 - RNA, 12 nt, Human
cgacagccuggc

SEQ ID NO: 1627536 - RNA, 14 nt, Human
cgacagccuggcac

SEQ ID NO: 1627537 - RNA, 21 nt, Human
ccuuuuuuagaguugauacua

SEQ ID NO: 1627538 - RNA, 16 nt, Human
ccuuuuuuaaauaaau

SEQ ID NO: 1627539 - RNA, 15 nt, Human
ccuuuuucauuauuu

SEQ ID NO: 1627540 - RNA, 17 nt, Human
cgacugcccggcagggu

SEQ ID NO: 1627541 - RNA, 20 nt, Human
cgacccuugccgucuaccug

SEQ ID NO: 1627542 - RNA, 19 nt, Human
cgacccuugccgucuaccu

SEQ ID NO: 1627543 - RNA, 16 nt, Human
cgguuuuacugcagcu

SEQ ID NO: 1627544 - RNA, 23 nt, Human
cgguguuuaagacauuuuuggaa

SEQ ID NO: 1627545 - RNA, 14 nt, Human
cguaaaauuaagaa

SEQ ID NO: 1627546 - RNA, 16 nt, Human
cgugaguccuggcaug

SEQ ID NO: 1627547 - RNA, 17 nt, Human
cgugaggccagagacac

SEQ ID NO: 1627548 - RNA, 17 nt, Human
cgugaguccuggcaugg

SEQ ID NO: 1627549 - RNA, 18 nt, Human
cgugaguccuggcauggg

SEQ ID NO: 1627550 - RNA, 20 nt, Human
cguguaaccauggacccaau

SEQ ID NO: 1627551 - RNA, 14 nt, Human
cgugcacacaccag

SEQ ID NO: 1627552 - RNA, 12 nt, Human
cggcuccaggcu

SEQ ID NO: 1627553 - RNA, 17 nt, Human
cggcucacugcagccuc

SEQ ID NO: 1627554 - RNA, 16 nt, Human
cggcucacugcagccu

SEQ ID NO: 1627555 - RNA, 15 nt, Human
cggcucacugcagcc

SEQ ID NO: 1627556 - RNA, 20 nt, Human
cggagucccaccuuggcugc

SEQ ID NO: 1627557 - RNA, 18 nt, Human
cggagucccaccuuggcu

SEQ ID NO: 1627558 - RNA, 16 nt, Human
cggcuccaggcuccuu

SEQ ID NO: 1627559 - RNA, 15 nt, Human
cggcuccaggcuccu

SEQ ID NO: 1627560 - RNA, 14 nt, Human
cggcuccaggcucc

SEQ ID NO: 1627561 - RNA, 13 nt, Human
cggcuccaggcuc

SEQ ID NO: 1627562 - RNA, 14 nt, Human
cgggccacagagaa

SEQ ID NO: 1627563 - RNA, 12 nt, Human
cgggccacagag

SEQ ID NO: 1627564 - RNA, 16 nt, Human
cgggcucugccuccca

SEQ ID NO: 1627565 - RNA, 14 nt, Human
cgggcucugccucc

SEQ ID NO: 1627566 - RNA, 15 nt, Human
cgggcucagcaaaag

SEQ ID NO: 1627567 - RNA, 11 nt, Human
cgggcucagca

SEQ ID NO: 1627568 - RNA, 17 nt, Human
cgggccacagagaaagu

SEQ ID NO: 1627569 - RNA, 18 nt, Human
cgguguggagaagcggcu

SEQ ID NO: 1627570 - RNA, 15 nt, Human
cggggacagcuccuu

SEQ ID NO: 1627571 - RNA, 17 nt, Human
cgggcucugccucccau

SEQ ID NO: 1627572 - RNA, 14 nt, Human
cggggacagcuccu

SEQ ID NO: 1627573 - RNA, 13 nt, Human
cgcugccccuggc

SEQ ID NO: 1627574 - RNA, 16 nt, Human
cggagucccaccuugg

SEQ ID NO: 1627575 - RNA, 17 nt, Human
cuacaaaaacacagcaa

SEQ ID NO: 1627576 - RNA, 16 nt, Human
cuacaaaaacacagca

SEQ ID NO: 1627577 - RNA, 18 nt, Human
cuacaaaaacacagcaag

SEQ ID NO: 1627578 - RNA, 19 nt, Human
cuacaguccucccaucuca

SEQ ID NO: 1627579 - RNA, 18 nt, Human
cuacauacuauggaauuu

SEQ ID NO: 1627580 - RNA, 22 nt, Human
cuacaguugaaaaacagcugag

SEQ ID NO: 1627581 - RNA, 21 nt, Human
cuacaguugaaaaacagcuga

SEQ ID NO: 1627582 - RNA, 20 nt, Human
cuacaguccucccaucucac

SEQ ID NO: 1627583 - RNA, 20 nt, Human
cuacaugagguacugagagu

SEQ ID NO: 1627584 - RNA, 17 nt, Human
cuaccuuuguauucucu

SEQ ID NO: 1627585 - RNA, 17 nt, Human
cuacguuaccaggcagg

SEQ ID NO: 1627586 - RNA, 20 nt, Human
cuaaguaaaaccacagcagu

SEQ ID NO: 1627587 - RNA, 11 nt, Human
cgugugugugu

SEQ ID NO: 1627588 - RNA, 23 nt, Human
cuaaguaaaaccacagcaguuga

SEQ ID NO: 1627589 - RNA, 22 nt, Human
cuaaguaaaaccacagcaguug

SEQ ID NO: 1627590 - RNA, 23 nt, Human
cuaagugauccucccaccucagc

SEQ ID NO: 1627591 - RNA, 21 nt, Human
cuaagugguacuaacuuuccu

SEQ ID NO: 1627592 - RNA, 20 nt, Human
cuaaguuuuuauggcuuuug

SEQ ID NO: 1627593 - RNA, 23 nt, Human
cuaaguuuuuauggcuuuugugc

SEQ ID NO: 1627594 - RNA, 13 nt, Human
cuagaacucccuu

SEQ ID NO: 1627595 - RNA, 12 nt, Human
cuagaacucccu

SEQ ID NO: 1627596 - RNA, 22 nt, Human
cuagaagauuuugaaauuuuua

SEQ ID NO: 1627597 - RNA, 21 nt, Human
cuagcauacguacacauuuua

SEQ ID NO: 1627598 - RNA, 23 nt, Human
cuagcauacguacacauuuuauu

SEQ ID NO: 1627599 - RNA, 23 nt, Human
cuagaauuugauaugugaacagu

SEQ ID NO: 1627600 - RNA, 23 nt, Human
cucaaaauaccaugccauuuaaa

SEQ ID NO: 1627601 - RNA, 18 nt, Human
cucaaaagcugggcaggu

SEQ ID NO: 1627602 - RNA, 17 nt, Human
cucaaaaaaagaaaaag

SEQ ID NO: 1627603 - RNA, 17 nt, Human
cuaucucccccagcccc

SEQ ID NO: 1627604 - RNA, 16 nt, Human
cuaucucccccagccc

SEQ ID NO: 1627605 - RNA, 18 nt, Human
cuaucucccccagcccca

SEQ ID NO: 1627606 - RNA, 15 nt, Human
cucaaugcacugaca

SEQ ID NO: 1627607 - RNA, 13 nt, Human
cucaaugcacuga

SEQ ID NO: 1627608 - RNA, 11 nt, Human
cucacaaaaga

SEQ ID NO: 1627609 - RNA, 20 nt, Human
cucaaacucuugaccucagg

SEQ ID NO: 1627610 - RNA, 14 nt, Human
cucaauaaaguaca

SEQ ID NO: 1627611 - RNA, 15 nt, Human
cuagccagaggagag

SEQ ID NO: 1627612 - RNA, 13 nt, Human
cuagccagaggag

SEQ ID NO: 1627613 - RNA, 12 nt, Human
cuagccagagga

SEQ ID NO: 1627614 - RNA, 23 nt, Human
cuaguuguuugauucagacagcu

SEQ ID NO: 1627615 - RNA, 22 nt, Human
cuaguuguuugauucagacagc

SEQ ID NO: 1627616 - RNA, 13 nt, Human
cuaguuugauuaa

SEQ ID NO: 1627617 - RNA, 15 nt, Human
cuaguuugauuaaau

SEQ ID NO: 1627618 - RNA, 22 nt, Human
cuaguuugauuaaauucuugca

SEQ ID NO: 1627619 - RNA, 15 nt, Human
cuaucucccccagcc

SEQ ID NO: 1627620 - RNA, 14 nt, Human
cuaucuaaauguug

SEQ ID NO: 1627621 - RNA, 17 nt, Human
cuaucguaaaauuaaga

SEQ ID NO: 1627622 - RNA, 18 nt, Human
cuaucguaaaauuaagaa

SEQ ID NO: 1627623 - RNA, 23 nt, Human
cuccacuuggucugugagaugcu

SEQ ID NO: 1627624 - RNA, 19 nt, Human
cuccacuuucuagccagag

SEQ ID NO: 1627625 - RNA, 16 nt, Human
cuccacuuucuagcca

SEQ ID NO: 1627626 - RNA, 20 nt, Human
cuccacuuucuagccagagg

SEQ ID NO: 1627627 - RNA, 22 nt, Human
cuccacuuggucugugagaugc

SEQ ID NO: 1627628 - RNA, 21 nt, Human
cuccacuuggucugugagaug

SEQ ID NO: 1627629 - RNA, 17 nt, Human
cuccacuuggucuguga

SEQ ID NO: 1627630 - RNA, 16 nt, Human
cuccacuuggucugug

SEQ ID NO: 1627631 - RNA, 15 nt, Human
cuccacuuggucugu

SEQ ID NO: 1627632 - RNA, 13 nt, Human
cuccacuuggucu

SEQ ID NO: 1627633 - RNA, 17 nt, Human
cuccaagcucccaggca

SEQ ID NO: 1627634 - RNA, 16 nt, Human
cuccacuggauggagg

SEQ ID NO: 1627635 - RNA, 16 nt, Human
cuccaagcucccaggc

SEQ ID NO: 1627636 - RNA, 15 nt, Human
cuccaagcucccagg

SEQ ID NO: 1627637 - RNA, 14 nt, Human
cuccaagcucccag

SEQ ID NO: 1627638 - RNA, 13 nt, Human
cuccaagcuccca

SEQ ID NO: 1627639 - RNA, 14 nt, Human
cuccaagcuccauc

SEQ ID NO: 1627640 - RNA, 19 nt, Human
cuccaagcuccaucuccac

SEQ ID NO: 1627641 - RNA, 18 nt, Human
cuccaagcuccaucucca

SEQ ID NO: 1627642 - RNA, 24 nt, Human
cuccaagcaggacauggacaagga

SEQ ID NO: 1627643 - RNA, 22 nt, Human
cuccaagcaggacauggacaag

SEQ ID NO: 1627644 - RNA, 14 nt, Human
cuccaagcaggaca

SEQ ID NO: 1627645 - RNA, 13 nt, Human
cuccaagcaggac

SEQ ID NO: 1627646 - RNA, 22 nt, Human
cuccaagaccuucuccuucacc

SEQ ID NO: 1627647 - RNA, 15 nt, Human
cuccaagaccuucuc

SEQ ID NO: 1627648 - RNA, 14 nt, Human
cuccaagaauuucu

SEQ ID NO: 1627649 - RNA, 13 nt, Human
cuccaagaauuuc

SEQ ID NO: 1627650 - RNA, 12 nt, Human
cucaugccucag

SEQ ID NO: 1627651 - RNA, 16 nt, Human
cucaugccucagccuc

SEQ ID NO: 1627652 - RNA, 17 nt, Human
cucagucucccucccuu

SEQ ID NO: 1627653 - RNA, 16 nt, Human
cucagucucccucccu

SEQ ID NO: 1627654 - RNA, 15 nt, Human
cucagucucccuccc

SEQ ID NO: 1627655 - RNA, 13 nt, Human
cucagucucccuc

SEQ ID NO: 1627656 - RNA, 12 nt, Human
cuccucugcuug

SEQ ID NO: 1627657 - RNA, 14 nt, Human
cuccucugcuugcc

SEQ ID NO: 1627658 - RNA, 18 nt, Human
cuccucugcugcuggcug

SEQ ID NO: 1627659 - RNA, 16 nt, Human
cuccucugcugcuggc

SEQ ID NO: 1627660 - RNA, 19 nt, Human
cuccucucugcccuaaugc

SEQ ID NO: 1627661 - RNA, 15 nt, Human
cuccucucugcccua

SEQ ID NO: 1627662 - RNA, 14 nt, Human
cuccucucugcccu

SEQ ID NO: 1627663 - RNA, 13 nt, Human
cuccucucugccc

SEQ ID NO: 1627664 - RNA, 12 nt, Human
cuccugggcagc

SEQ ID NO: 1627665 - RNA, 18 nt, Human
cuccuggcccacugcauc

SEQ ID NO: 1627666 - RNA, 16 nt, Human
cuccuggcccacugca

SEQ ID NO: 1627667 - RNA, 14 nt, Human
cuccugggcagcug

SEQ ID NO: 1627668 - RNA, 15 nt, Human
cuccugggcagcugc

SEQ ID NO: 1627669 - RNA, 16 nt, Human
cuccugggcagcugcc

SEQ ID NO: 1627670 - RNA, 17 nt, Human
cuccugggcagcugccu

SEQ ID NO: 1627671 - RNA, 18 nt, Human
cuccugggcagcugccuc

SEQ ID NO: 1627672 - RNA, 19 nt, Human
cuccugggcagcugccucc

SEQ ID NO: 1627673 - RNA, 22 nt, Human
cuccugggcagcugccuccccu

SEQ ID NO: 1627674 - RNA, 21 nt, Human
cuccucugcuugccaucccuc

SEQ ID NO: 1627675 - RNA, 22 nt, Human
cuccucugcuugccaucccucc

SEQ ID NO: 1627676 - RNA, 15 nt, Human
cuccucugcuugcca

SEQ ID NO: 1627677 - RNA, 16 nt, Human
cuccucugcuugccau

SEQ ID NO: 1627678 - RNA, 17 nt, Human
cuccucugcuugccauc

SEQ ID NO: 1627679 - RNA, 20 nt, Human
cuccucugcuugccaucccu

SEQ ID NO: 1627680 - RNA, 15 nt, Human
cuccuggacuccugc

SEQ ID NO: 1627681 - RNA, 23 nt, Human
cuccucuucaacugaccagccuc

SEQ ID NO: 1627682 - RNA, 18 nt, Human
cuccucuucaacugacca

SEQ ID NO: 1627683 - RNA, 20 nt, Human
cucccccagccccauccucu

SEQ ID NO: 1627684 - RNA, 15 nt, Human
cucccccagccccau

SEQ ID NO: 1627685 - RNA, 22 nt, Human
cucccccagccccauccucugu

SEQ ID NO: 1627686 - RNA, 13 nt, Human
cucccccaucucu

SEQ ID NO: 1627687 - RNA, 14 nt, Human
cucguuaauuugua

SEQ ID NO: 1627688 - RNA, 15 nt, Human
cucuaucaccaagga

SEQ ID NO: 1627689 - RNA, 16 nt, Human
cucgaacuggcugcaa

SEQ ID NO: 1627690 - RNA, 15 nt, Human
cucgaacuggcugca

SEQ ID NO: 1627691 - RNA, 14 nt, Human
cucgaacuggcugc

SEQ ID NO: 1627692 - RNA, 13 nt, Human
cucgaacuggcug

SEQ ID NO: 1627693 - RNA, 23 nt, Human
cuccuggggguucuuucuuccuc

SEQ ID NO: 1627694 - RNA, 18 nt, Human
cuccuggggguucuuucu

SEQ ID NO: 1627695 - RNA, 22 nt, Human
cuccuggggguucuuucuuccu

SEQ ID NO: 1627696 - RNA, 20 nt, Human
cuccuggggguucuuucuuc

SEQ ID NO: 1627697 - RNA, 15 nt, Human
cugagcuuucugcua

SEQ ID NO: 1627698 - RNA, 14 nt, Human
cugagcuuucugcu

SEQ ID NO: 1627699 - RNA, 21 nt, Human
cugagaucaaaacgguuuuac

SEQ ID NO: 1627700 - RNA, 20 nt, Human
cugaggaauccagacccggc

SEQ ID NO: 1627701 - RNA, 17 nt, Human
cugaggaauccagaccc

SEQ ID NO: 1627702 - RNA, 20 nt, Human
cugaggacacuaaccacgcu

SEQ ID NO: 1627703 - RNA, 21 nt, Human
cugaggaauccagacccggcu

SEQ ID NO: 1627704 - RNA, 23 nt, Human
cugaggacacuaaccacgcugga

SEQ ID NO: 1627705 - RNA, 12 nt, Human
cugaggugggag

SEQ ID NO: 1627706 - RNA, 21 nt, Human
cugaguacguugugcauuugg

SEQ ID NO: 1627707 - RNA, 18 nt, Human
cugaguacguugugcauu

SEQ ID NO: 1627708 - RNA, 17 nt, Human
cugaguacguugugcau

SEQ ID NO: 1627709 - RNA, 19 nt, Human
cugaguacguugugcauuu

SEQ ID NO: 1627710 - RNA, 20 nt, Human
cugaguacguugugcauuug

SEQ ID NO: 1627711 - RNA, 14 nt, Human
cugaggaccagcca

SEQ ID NO: 1627712 - RNA, 22 nt, Human
cugaggacuuaaaauauuccug

SEQ ID NO: 1627713 - RNA, 20 nt, Human
cugaguagcugggauuacag

SEQ ID NO: 1627714 - RNA, 15 nt, Human
cugaguagcugggau

SEQ ID NO: 1627715 - RNA, 14 nt, Human
cugaguagcuggga

SEQ ID NO: 1627716 - RNA, 19 nt, Human
cugacaacagacuucugaa

SEQ ID NO: 1627717 - RNA, 18 nt, Human
cugacaacagacuucuga

SEQ ID NO: 1627718 - RNA, 15 nt, Human
cugacaacagacuuc

SEQ ID NO: 1627719 - RNA, 22 nt, Human
cugacccaugcugcccugugag

SEQ ID NO: 1627720 - RNA, 21 nt, Human
cugacccaugcugcccuguga

SEQ ID NO: 1627721 - RNA, 23 nt, Human
cugagacagcccgggcucugccu

SEQ ID NO: 1627722 - RNA, 21 nt, Human
cugagacucgcgacaaugcaa

SEQ ID NO: 1627723 - RNA, 22 nt, Human
cugagacucgcgacaaugcaaa

SEQ ID NO: 1627724 - RNA, 22 nt, Human
cugagaggacuuuucuuugugg

SEQ ID NO: 1627725 - RNA, 21 nt, Human
cugagaggacuuuucuuugug

SEQ ID NO: 1627726 - RNA, 17 nt, Human
cugagaguagagucacu

SEQ ID NO: 1627727 - RNA, 22 nt, Human
cucuuagaugcaguucugaaga

SEQ ID NO: 1627728 - RNA, 13 nt, Human
cucuuauugccca

SEQ ID NO: 1627729 - RNA, 20 nt, Human
cucuuauugcccacgcugga

SEQ ID NO: 1627730 - RNA, 19 nt, Human
cucuuauugcccacgcugg

SEQ ID NO: 1627731 - RNA, 15 nt, Human
cucuuauugcccacg

SEQ ID NO: 1627732 - RNA, 14 nt, Human
cucuuauugcccac

SEQ ID NO: 1627733 - RNA, 18 nt, Human
cucuucagaucucuaacu

SEQ ID NO: 1627734 - RNA, 19 nt, Human
cucuucagaucucuaacuu

SEQ ID NO: 1627735 - RNA, 14 nt, Human
cucuucaaucucuu

SEQ ID NO: 1627736 - RNA, 20 nt, Human
cucuucaacugaccagccuc

SEQ ID NO: 1627737 - RNA, 17 nt, Human
cucuucaacugaccagc

SEQ ID NO: 1627738 - RNA, 16 nt, Human
cucuucaacugaccag

SEQ ID NO: 1627739 - RNA, 15 nt, Human
cucugguccauagag

SEQ ID NO: 1627740 - RNA, 15 nt, Human
cucugguuaucuaau

SEQ ID NO: 1627741 - RNA, 12 nt, Human
cucuguccaggc

SEQ ID NO: 1627742 - RNA, 16 nt, Human
cucugcugacagacac

SEQ ID NO: 1627743 - RNA, 14 nt, Human
cucugcugacagac

SEQ ID NO: 1627744 - RNA, 13 nt, Human
cucugcugacaga

SEQ ID NO: 1627745 - RNA, 14 nt, Human
cucugguccauaga

SEQ ID NO: 1627746 - RNA, 20 nt, Human
cucugcacuccccugcuggg

SEQ ID NO: 1627747 - RNA, 21 nt, Human
cucugcacuccccugcugggu

SEQ ID NO: 1627748 - RNA, 13 nt, Human
cucugcagcaaua

SEQ ID NO: 1627749 - RNA, 20 nt, Human
cucugcuccucuccccagca

SEQ ID NO: 1627750 - RNA, 18 nt, Human
cucugcuccucuccccag

SEQ ID NO: 1627751 - RNA, 13 nt, Human
cucugcuccucuc

SEQ ID NO: 1627752 - RNA, 18 nt, Human
cucugcaggucccuaaua

SEQ ID NO: 1627753 - RNA, 17 nt, Human
cucugcaggucccuaau

SEQ ID NO: 1627754 - RNA, 16 nt, Human
cucugcaggucccuaa

SEQ ID NO: 1627755 - RNA, 15 nt, Human
cucugcaggucccua

SEQ ID NO: 1627756 - RNA, 14 nt, Human
cucugcaggucccu

SEQ ID NO: 1627757 - RNA, 15 nt, Human
cugaaacaacaaaua

SEQ ID NO: 1627758 - RNA, 22 nt, Human
cugaaaauugaugggauuuggu

SEQ ID NO: 1627759 - RNA, 21 nt, Human
cucuugaugccuggcggggug

SEQ ID NO: 1627760 - RNA, 16 nt, Human
cucuugaugccuggcg

SEQ ID NO: 1627761 - RNA, 15 nt, Human
cucuugaugccuggc

SEQ ID NO: 1627762 - RNA, 13 nt, Human
cucuugaugccug

SEQ ID NO: 1627763 - RNA, 21 nt, Human
cugaaggccccgcccaggcuu

SEQ ID NO: 1627764 - RNA, 17 nt, Human
cugaaggcuggguucug

SEQ ID NO: 1627765 - RNA, 19 nt, Human
cugaaggccccgcccaggc

SEQ ID NO: 1627766 - RNA, 23 nt, Human
cugacaacacucauugaccugag

SEQ ID NO: 1627767 - RNA, 22 nt, Human
cugacaacacucauugaccuga

SEQ ID NO: 1627768 - RNA, 23 nt, Human
cugaaggacauugcggacagcca

SEQ ID NO: 1627769 - RNA, 22 nt, Human
cugaagcuaucguaaaauuaag

SEQ ID NO: 1627770 - RNA, 21 nt, Human
cugaagcuaucguaaaauuaa

SEQ ID NO: 1627771 - RNA, 16 nt, Human
cucuugagccuugaac

SEQ ID NO: 1627772 - RNA, 17 nt, Human
cucuugagccuugaacu

SEQ ID NO: 1627773 - RNA, 18 nt, Human
cucuugagccuugaacuu

SEQ ID NO: 1627774 - RNA, 23 nt, Human
cucuugagccuugaacuuugacc

SEQ ID NO: 1627775 - RNA, 22 nt, Human
guguaaauacaauuuuguuucu

SEQ ID NO: 1627776 - RNA, 21 nt, Human
guguaaauacaauuuuguuuc

SEQ ID NO: 1627777 - RNA, 18 nt, Human
guguaaauacaauuuugu

SEQ ID NO: 1627778 - RNA, 15 nt, Human
gugguuucagaaaug

SEQ ID NO: 1627779 - RNA, 23 nt, Human
gugcugcccugcccaccuggccu

SEQ ID NO: 1627780 - RNA, 18 nt, Human
gugcugcccugcccaccu

SEQ ID NO: 1627781 - RNA, 15 nt, Human
aagauagcagggcau

SEQ ID NO: 1627782 - RNA, 22 nt, Human
aagagggagggagggcuccaga

SEQ ID NO: 1627783 - RNA, 21 nt, Human
aagagggagggagggcuccag

SEQ ID NO: 1627784 - RNA, 14 nt, Human
aagaggcagggucu

SEQ ID NO: 1627785 - RNA, 11 nt, Human
aagaggcaggg

SEQ ID NO: 1627786 - RNA, 22 nt, Human
gugucuuaauuaaaagaauauu

SEQ ID NO: 1627787 - RNA, 19 nt, Human
gugucagguggggcagcuu

SEQ ID NO: 1627788 - RNA, 20 nt, Human
gugucagguggggcagcuug

SEQ ID NO: 1627789 - RNA, 23 nt, Human
gugugaaccaccacacccagccc

SEQ ID NO: 1627790 - RNA, 18 nt, Human
gugucagguggggcagcu

SEQ ID NO: 1627791 - RNA, 14 nt, Human
gugucagguggggc

SEQ ID NO: 1627792 - RNA, 22 nt, Human
gugucaccugaagacucauucu

SEQ ID NO: 1627793 - RNA, 14 nt, Human
gugucaccugaaga

SEQ ID NO: 1627794 - RNA, 17 nt, Human
aagcaacccaaauguuc

SEQ ID NO: 1627795 - RNA, 13 nt, Human
aagcaaaauguga

SEQ ID NO: 1627796 - RNA, 20 nt, Human
aagaucaaaagguuaauaaa

SEQ ID NO: 1627797 - RNA, 23 nt, Human
aagaucaaaagguuaauaaagua

SEQ ID NO: 1627798 - RNA, 18 nt, Human
aagauggcugugccucug

SEQ ID NO: 1627799 - RNA, 16 nt, Human
aagauggcugugccuc

SEQ ID NO: 1627800 - RNA, 19 nt, Human
aagcauuguaaaugugcuu

SEQ ID NO: 1627801 - RNA, 16 nt, Human
aagcauuuacuuugug

SEQ ID NO: 1627802 - RNA, 20 nt, Human
aagccaaagcuaggccuggc

SEQ ID NO: 1627803 - RNA, 18 nt, Human
aagccaaagcuaggccug

SEQ ID NO: 1627804 - RNA, 17 nt, Human
aagccaaagcuaggccu

SEQ ID NO: 1627805 - RNA, 17 nt, Human
aagccauguuuauuaca

SEQ ID NO: 1627806 - RNA, 16 nt, Human
aagccauguuuauuac

SEQ ID NO: 1627807 - RNA, 15 nt, Human
aagccauguuuauua

SEQ ID NO: 1627808 - RNA, 20 nt, Human
aagcacugacuucuaaguaa

SEQ ID NO: 1627809 - RNA, 19 nt, Human
aagcacugacuucuaagua

SEQ ID NO: 1627810 - RNA, 23 nt, Human
aagcauauauuuuuauauuuacu

SEQ ID NO: 1627811 - RNA, 12 nt, Human
aagcaugugaga

SEQ ID NO: 1627812 - RNA, 23 nt, Human
aagcaugcacaaauucugucucu

SEQ ID NO: 1627813 - RNA, 17 nt, Human
aagcacugacuucuaag

SEQ ID NO: 1627814 - RNA, 16 nt, Human
aagcacugacuucuaa

SEQ ID NO: 1627815 - RNA, 16 nt, Human
aagcacuaaacaaaga

SEQ ID NO: 1627816 - RNA, 17 nt, Human
aagcaccuccugccucg

SEQ ID NO: 1627817 - RNA, 16 nt, Human
aagcaccuccugccuc

SEQ ID NO: 1627818 - RNA, 15 nt, Human
aagcaccuccugccu

SEQ ID NO: 1627819 - RNA, 14 nt, Human
aagcaccuccugcc

SEQ ID NO: 1627820 - RNA, 13 nt, Human
aagcaccuccugc

SEQ ID NO: 1627821 - RNA, 21 nt, Human
aagcacaugccucucucaggc

SEQ ID NO: 1627822 - RNA, 20 nt, Human
aagcacaugccucucucagg

SEQ ID NO: 1627823 - RNA, 19 nt, Human
aagcacaugccucucucag

SEQ ID NO: 1627824 - RNA, 16 nt, Human
aagcacaugccucucu

SEQ ID NO: 1627825 - RNA, 15 nt, Human
aagcacaugccucuc

SEQ ID NO: 1627826 - RNA, 14 nt, Human
aagcacaugccucu

SEQ ID NO: 1627827 - RNA, 16 nt, Human
aagcacacuugacauc

SEQ ID NO: 1627828 - RNA, 12 nt, Human
guguuugaagca

SEQ ID NO: 1627829 - RNA, 20 nt, Human
guuauuauauuuacaaaugg

SEQ ID NO: 1627830 - RNA, 19 nt, Human
guuauuauauuuacaaaug

SEQ ID NO: 1627831 - RNA, 19 nt, Human
guuagagguucccuuugac

SEQ ID NO: 1627832 - RNA, 18 nt, Human
guuagagauuuuuuuguu

SEQ ID NO: 1627833 - RNA, 18 nt, Human
guuaaucauuagguguga

SEQ ID NO: 1627834 - RNA, 19 nt, Human
guuaauauuuauaggucac

SEQ ID NO: 1627835 - RNA, 23 nt, Human
guuacucuucaguuaagccuuug

SEQ ID NO: 1627836 - RNA, 23 nt, Human
aagccauguuuauuacaguauaa

SEQ ID NO: 1627837 - RNA, 22 nt, Human
aagccauguuuauuacaguaua

SEQ ID NO: 1627838 - RNA, 21 nt, Human
aagccauguuuauuacaguau

SEQ ID NO: 1627839 - RNA, 20 nt, Human
aagccauguuuauuacagua

SEQ ID NO: 1627840 - RNA, 13 nt, Human
aagcccagcuuga

SEQ ID NO: 1627841 - RNA, 21 nt, Human
aagccuuggggcugaugcagu

SEQ ID NO: 1627842 - RNA, 19 nt, Human
aagccuccuccagccgcca

SEQ ID NO: 1627843 - RNA, 15 nt, Human
aagccuccuccagcc

SEQ ID NO: 1627844 - RNA, 16 nt, Human
aagccucccacgacug

SEQ ID NO: 1627845 - RNA, 18 nt, Human
aagccuguuuaagagaca

SEQ ID NO: 1627846 - RNA, 15 nt, Human
aagccuguuuaagag

SEQ ID NO: 1627847 - RNA, 23 nt, Human
guucagcuuguaaauagcucagg

SEQ ID NO: 1627848 - RNA, 22 nt, Human
guucaggguuggccccugcccg

SEQ ID NO: 1627849 - RNA, 21 nt, Human
guucaggguuggccccugccc

SEQ ID NO: 1627850 - RNA, 20 nt, Human
guucaggguuggccccugcc

SEQ ID NO: 1627851 - RNA, 21 nt, Human
aagccgugauuuucauugcug

SEQ ID NO: 1627852 - RNA, 15 nt, Human
aagccguggcuuccc

SEQ ID NO: 1627853 - RNA, 14 nt, Human
aagccguggcuucc

SEQ ID NO: 1627854 - RNA, 13 nt, Human
aagccguggcuuc

SEQ ID NO: 1627855 - RNA, 18 nt, Human
guucagguaacaggcaga

SEQ ID NO: 1627856 - RNA, 17 nt, Human
guucagguaacaggcag

SEQ ID NO: 1627857 - RNA, 22 nt, Human
guucccuuuuuuggcugcugaa

SEQ ID NO: 1627858 - RNA, 21 nt, Human
guucccuuuuuuggcugcuga

SEQ ID NO: 1627859 - RNA, 18 nt, Human
guucccuugaugaagaag

SEQ ID NO: 1627860 - RNA, 21 nt, Human
aagcuuuuaugugaaacaugu

SEQ ID NO: 1627861 - RNA, 19 nt, Human
aagcuuuuaugugaaacau

SEQ ID NO: 1627862 - RNA, 15 nt, Human
guuccccaagacauu

SEQ ID NO: 1627863 - RNA, 18 nt, Human
aagcuuauuaaaacucau

SEQ ID NO: 1627864 - RNA, 23 nt, Human
aagcuuguauuccuuuuucucuc

SEQ ID NO: 1627865 - RNA, 14 nt, Human
guucuuaauucuua

SEQ ID NO: 1627866 - RNA, 17 nt, Human
guucuuaauucuuagcu

SEQ ID NO: 1627867 - RNA, 18 nt, Human
guucucugcccuccaaga

SEQ ID NO: 1627868 - RNA, 17 nt, Human
guucucugcccuccaag

SEQ ID NO: 1627869 - RNA, 13 nt, Human
guucuuaauucuu

SEQ ID NO: 1627870 - RNA, 15 nt, Human
guucucugcccucca

SEQ ID NO: 1627871 - RNA, 14 nt, Human
guucucugaggaca

SEQ ID NO: 1627872 - RNA, 12 nt, Human
guucucugagga

SEQ ID NO: 1627873 - RNA, 15 nt, Human
guucucucuucucca

SEQ ID NO: 1627874 - RNA, 19 nt, Human
guucuagcauggcugccaa

SEQ ID NO: 1627875 - RNA, 14 nt, Human
guucuugguuugua

SEQ ID NO: 1627876 - RNA, 15 nt, Human
guucuugguuuguaa

SEQ ID NO: 1627877 - RNA, 18 nt, Human
guucuugguuuguaaauu

SEQ ID NO: 1627878 - RNA, 19 nt, Human
guugauagcacagacccug

SEQ ID NO: 1627879 - RNA, 14 nt, Human
guugauagcacaga

SEQ ID NO: 1627880 - RNA, 22 nt, Human
guugauagcacagacccugccc

SEQ ID NO: 1627881 - RNA, 15 nt, Human
aaguauuauaccuuu

SEQ ID NO: 1627882 - RNA, 19 nt, Human
aaguauguuagugcaaauu

SEQ ID NO: 1627883 - RNA, 18 nt, Human
aaguauguuagugcaaau

SEQ ID NO: 1627884 - RNA, 20 nt, Human
aaguacuucuccacccugcu

SEQ ID NO: 1627885 - RNA, 19 nt, Human
aaguacuucuccacccugc

SEQ ID NO: 1627886 - RNA, 18 nt, Human
aaguacuucuccacccug

SEQ ID NO: 1627887 - RNA, 15 nt, Human
aaguacuauguauca

SEQ ID NO: 1627888 - RNA, 13 nt, Human
aaguacuauguau

SEQ ID NO: 1627889 - RNA, 17 nt, Human
aaguacuauaauuuacc

SEQ ID NO: 1627890 - RNA, 14 nt, Human
aaguacuauaauuu

SEQ ID NO: 1627891 - RNA, 21 nt, Human
aaguauucuuauuuaaugaaa

SEQ ID NO: 1627892 - RNA, 16 nt, Human
aaguauuauaccuuuu

SEQ ID NO: 1627893 - RNA, 19 nt, Human
aaguauuauaccuuuuuua

SEQ ID NO: 1627894 - RNA, 23 nt, Human
aaguauucuuauuuaaugaaaga

SEQ ID NO: 1627895 - RNA, 22 nt, Human
aagucagaucugccuaaggacu

SEQ ID NO: 1627896 - RNA, 21 nt, Human
aagucagaucugccuaaggac

SEQ ID NO: 1627897 - RNA, 18 nt, Human
aagucagaucugccuaag

SEQ ID NO: 1627898 - RNA, 22 nt, Human
aagucacugcacagugcaucuc

SEQ ID NO: 1627899 - RNA, 22 nt, Human
guuuuaaggaugcuuguacaua

SEQ ID NO: 1627900 - RNA, 14 nt, Human
guuuucuguucuuu

SEQ ID NO: 1627901 - RNA, 15 nt, Human
guuuucuguucuuuc

SEQ ID NO: 1627902 - RNA, 16 nt, Human
guuuucuguucuuucu

SEQ ID NO: 1627903 - RNA, 19 nt, Human
guuuucuguucuuucuggc

SEQ ID NO: 1627904 - RNA, 21 nt, Human
aaguaauaugcacacauuuuu

SEQ ID NO: 1627905 - RNA, 17 nt, Human
aaguaauaugcacacau

SEQ ID NO: 1627906 - RNA, 18 nt, Human
aaguaauaugcacacauu

SEQ ID NO: 1627907 - RNA, 20 nt, Human
aaguaauaugcacacauuuu

SEQ ID NO: 1627908 - RNA, 15 nt, Human
guuuuaaagcuucca

SEQ ID NO: 1627909 - RNA, 19 nt, Human
guuuggacaaaauggaaua

SEQ ID NO: 1627910 - RNA, 20 nt, Human
guuugcuuuguaugcacuuu

SEQ ID NO: 1627911 - RNA, 13 nt, Human
guuuggagacaga

SEQ ID NO: 1627912 - RNA, 18 nt, Human
guuuggaccaaaaaccag

SEQ ID NO: 1627913 - RNA, 14 nt, Human
guuuaugauuccac

SEQ ID NO: 1627914 - RNA, 19 nt, Human
guuuaauauuaaagccaug

SEQ ID NO: 1627915 - RNA, 18 nt, Human
guuuaauauuaaagccau

SEQ ID NO: 1627916 - RNA, 15 nt, Human
guuuaauauuaaagc

SEQ ID NO: 1627917 - RNA, 14 nt, Human
guuuaauauuaaag

SEQ ID NO: 1627918 - RNA, 13 nt, Human
guuuaauauuaaa

SEQ ID NO: 1627919 - RNA, 17 nt, Human
guuuauuacaguauaau

SEQ ID NO: 1627920 - RNA, 13 nt, Human
guuuauuacagua

SEQ ID NO: 1627921 - RNA, 23 nt, Human
guuguuugauucagacagcugcc

SEQ ID NO: 1627922 - RNA, 22 nt, Human
aaggaaacccagcucuggucca

SEQ ID NO: 1627923 - RNA, 17 nt, Human
aaggaaacccagcucug

SEQ ID NO: 1627924 - RNA, 12 nt, Human
aaggaaaaguuu

SEQ ID NO: 1627925 - RNA, 21 nt, Human
guuuaagugacugauggcuaa

SEQ ID NO: 1627926 - RNA, 12 nt, Human
guuguuuguuua

SEQ ID NO: 1627927 - RNA, 23 nt, Human
aagguuucagaaagaagugggga

SEQ ID NO: 1627928 - RNA, 23 nt, Human
aagggggcugggacaugggaaag

SEQ ID NO: 1627929 - RNA, 12 nt, Human
aagggggcuggg

SEQ ID NO: 1627930 - RNA, 13 nt, Human
aaggggagaguaa

SEQ ID NO: 1627931 - RNA, 17 nt, Human
aaggggaauugaggaca

SEQ ID NO: 1627932 - RNA, 17 nt, Human
aagggcuguuauaaucu

SEQ ID NO: 1627933 - RNA, 15 nt, Human
aagggcuguuauaau

SEQ ID NO: 1627934 - RNA, 20 nt, Human
aaggcugucaauuacaggaa

SEQ ID NO: 1627935 - RNA, 22 nt, Human
aaggcugggggaagaagcucuc

SEQ ID NO: 1627936 - RNA, 19 nt, Human
aaggcugggggaagaagcu

SEQ ID NO: 1627937 - RNA, 11 nt, Human
guuucagaaau

SEQ ID NO: 1627938 - RNA, 13 nt, Human
guuucagaaaugu

SEQ ID NO: 1627939 - RNA, 16 nt, Human
aaggcugggggaagaa

SEQ ID NO: 1627940 - RNA, 9 nt, Human
uaaaauggu

SEQ ID NO: 1627941 - RNA, 20 nt, Human
aaguuugagaucagccuggg

SEQ ID NO: 1627942 - RNA, 21 nt, Human
aaguuucugccgcagcccugc

SEQ ID NO: 1627943 - RNA, 19 nt, Human
aaguuucugccgcagcccu

SEQ ID NO: 1627944 - RNA, 19 nt, Human
aaguuauuuuuaauuuggu

SEQ ID NO: 1627945 - RNA, 20 nt, Human
aaguucccuacuuccuguga

SEQ ID NO: 1627946 - RNA, 17 nt, Human
aaguucccuacuuccug

SEQ ID NO: 1627947 - RNA, 14 nt, Human
aaguucccuacuuc

SEQ ID NO: 1627948 - RNA, 23 nt, Human
aaguguauuuuuuuacuaauaga

SEQ ID NO: 1627949 - RNA, 13 nt, Human
aagugugguagag

SEQ ID NO: 1627950 - RNA, 12 nt, Human
aaguguguguuu

SEQ ID NO: 1627951 - RNA, 21 nt, Human
aaguguguguuuuucauaaag

SEQ ID NO: 1627952 - RNA, 16 nt, Human
aaguguguguuuuuca

SEQ ID NO: 1627953 - RNA, 11 nt, Human
aaguuaagaau

SEQ ID NO: 1627954 - RNA, 23 nt, Human
aaguuaagaauguucuuauguug

SEQ ID NO: 1627955 - RNA, 22 nt, Human
uaaaaagcuccaaaugcagcuu

SEQ ID NO: 1627956 - RNA, 21 nt, Human
uaaaaaaaaaccugagcccca

SEQ ID NO: 1627957 - RNA, 18 nt, Human
uaaaaaaaaaauugggga

SEQ ID NO: 1627958 - RNA, 14 nt, Human
uaaaaaaaaaauug

SEQ ID NO: 1627959 - RNA, 23 nt, Human
aagucagaucugccuaaggacuu

SEQ ID NO: 1627960 - RNA, 23 nt, Human
uaaaaaucucaaauuucuaaauc

SEQ ID NO: 1627961 - RNA, 15 nt, Human
uaaaaaugagguacu

SEQ ID NO: 1627962 - RNA, 14 nt, Human
uaaaaccacagcag

SEQ ID NO: 1627963 - RNA, 22 nt, Human
uaaaaaugagguacucuccugg

SEQ ID NO: 1627964 - RNA, 15 nt, Human
uaaaaccacagcagu

SEQ ID NO: 1627965 - RNA, 12 nt, Human
uaaaacuuuuua

SEQ ID NO: 1627966 - RNA, 15 nt, Human
uaaaacuuuuuaaaa

SEQ ID NO: 1627967 - RNA, 13 nt, Human
uaaaacccaagug

SEQ ID NO: 1627968 - RNA, 16 nt, Human
uaaaagaauauuuuaa

SEQ ID NO: 1627969 - RNA, 13 nt, Human
uaaaagaauauuu

SEQ ID NO: 1627970 - RNA, 13 nt, Human
uaaaagucuugug

SEQ ID NO: 1627971 - RNA, 21 nt, Human
uaaaauacacacucaaaucaa

SEQ ID NO: 1627972 - RNA, 22 nt, Human
uaaaauaauuuuuauauuugaa

SEQ ID NO: 1627973 - RNA, 23 nt, Human
aagugauccucccaccucagccu

SEQ ID NO: 1627974 - RNA, 19 nt, Human
aagugauucucaugccuca

SEQ ID NO: 1627975 - RNA, 16 nt, Human
aagugauucucaugcc

SEQ ID NO: 1627976 - RNA, 13 nt, Human
aagugauucucau

SEQ ID NO: 1627977 - RNA, 17 nt, Human
aagugauucucaugccu

SEQ ID NO: 1627978 - RNA, 20 nt, Human
aagugauccucccaccucag

SEQ ID NO: 1627979 - RNA, 19 nt, Human
aagugauccucccaccuca

SEQ ID NO: 1627980 - RNA, 13 nt, Human
aagugauccuccc

SEQ ID NO: 1627981 - RNA, 21 nt, Human
uaaaauaccagccaguaaaug

SEQ ID NO: 1627982 - RNA, 18 nt, Human
guauucucuccuguaccu

SEQ ID NO: 1627983 - RNA, 21 nt, Human
guauucucuccuguaccucuu

SEQ ID NO: 1627984 - RNA, 11 nt, Human
aaaucauuucu

SEQ ID NO: 1627985 - RNA, 16 nt, Human
aaaucauucauuuucu

SEQ ID NO: 1627986 - RNA, 23 nt, Human
guauuguacaaaguauuaagcau

SEQ ID NO: 1627987 - RNA, 22 nt, Human
guauuguacaaaguauuaagca

SEQ ID NO: 1627988 - RNA, 21 nt, Human
guauuguacaaaguauuaagc

SEQ ID NO: 1627989 - RNA, 19 nt, Human
guauuguacaaaguauuaa

SEQ ID NO: 1627990 - RNA, 21 nt, Human
aaaugucucuuuaaugucaca

SEQ ID NO: 1627991 - RNA, 14 nt, Human
aaaugucuuccugg

SEQ ID NO: 1627992 - RNA, 11 nt, Human
guauuuauuca

SEQ ID NO: 1627993 - RNA, 17 nt, Human
aaauuccaagugauuga

SEQ ID NO: 1627994 - RNA, 16 nt, Human
aaauuccccacccuga

SEQ ID NO: 1627995 - RNA, 17 nt, Human
aaauuguauuacaaauc

SEQ ID NO: 1627996 - RNA, 18 nt, Human
aaauugucagaugcugug

SEQ ID NO: 1627997 - RNA, 15 nt, Human
aaaugugcuuuuaaa

SEQ ID NO: 1627998 - RNA, 18 nt, Human
aaaugugccuucauuuuu

SEQ ID NO: 1627999 - RNA, 14 nt, Human
aaauuaaucugggc

SEQ ID NO: 1628000 - RNA, 15 nt, Human
aaauguggcuccugg

SEQ ID NO: 1628001 - RNA, 23 nt, Human
aaauuaugugccagauuuaugca

SEQ ID NO: 1628002 - RNA, 19 nt, Human
aaauuaggauuucaugauu

SEQ ID NO: 1628003 - RNA, 18 nt, Human
aaauuaggauuucaugau

SEQ ID NO: 1628004 - RNA, 14 nt, Human
gucaggaaagagaa

SEQ ID NO: 1628005 - RNA, 21 nt, Human
gucagaaguuucugccgcagc

SEQ ID NO: 1628006 - RNA, 23 nt, Human
gucagaaguuucugccgcagccc

SEQ ID NO: 1628007 - RNA, 17 nt, Human
gucacuuuguuuuacug

SEQ ID NO: 1628008 - RNA, 15 nt, Human
gucacugcuuaacuu

SEQ ID NO: 1628009 - RNA, 21 nt, Human
gucacugcuuaacuucacaua

SEQ ID NO: 1628010 - RNA, 22 nt, Human
gucagguggggcagcuugaggg

SEQ ID NO: 1628011 - RNA, 18 nt, Human
gucagguggggcagcuug

SEQ ID NO: 1628012 - RNA, 17 nt, Human
gucagguggggcagcuu

SEQ ID NO: 1628013 - RNA, 16 nt, Human
gucagguggggcagcu

SEQ ID NO: 1628014 - RNA, 15 nt, Human
gucagugugacugau

SEQ ID NO: 1628015 - RNA, 13 nt, Human
aaauuucuaaauc

SEQ ID NO: 1628016 - RNA, 15 nt, Human
aaauuucuaaaucuc

SEQ ID NO: 1628017 - RNA, 15 nt, Human
gucacaggaaguaga

SEQ ID NO: 1628018 - RNA, 13 nt, Human
gucacaggaagua

SEQ ID NO: 1628019 - RNA, 21 nt, Human
gucaauuuuguuauguauauu

SEQ ID NO: 1628020 - RNA, 22 nt, Human
gucaauuacaggaaguacugga

SEQ ID NO: 1628021 - RNA, 20 nt, Human
gucacaggaaguagaggagg

SEQ ID NO: 1628022 - RNA, 18 nt, Human
gucacaggacucugccuc

SEQ ID NO: 1628023 - RNA, 17 nt, Human
gucacaggacucugccu

SEQ ID NO: 1628024 - RNA, 12 nt, Human
gucacaggcagg

SEQ ID NO: 1628025 - RNA, 16 nt, Human
gucacaggagggaggg

SEQ ID NO: 1628026 - RNA, 19 nt, Human
gucacaggacucugccucc

SEQ ID NO: 1628027 - RNA, 22 nt, Human
gucaccaaaucagcugcuacua

SEQ ID NO: 1628028 - RNA, 18 nt, Human
gucacauuccugaacagg

SEQ ID NO: 1628029 - RNA, 23 nt, Human
gucacucuggcagcucagagagg

SEQ ID NO: 1628030 - RNA, 15 nt, Human
gucaccaagcccagu

SEQ ID NO: 1628031 - RNA, 12 nt, Human
gucaccaagccc

SEQ ID NO: 1628032 - RNA, 16 nt, Human
gucacugagacagccc

SEQ ID NO: 1628033 - RNA, 15 nt, Human
gucacugagacagcc

SEQ ID NO: 1628034 - RNA, 14 nt, Human
gucacugagacagc

SEQ ID NO: 1628035 - RNA, 23 nt, Human
gucacugagacagcccgggcucu

SEQ ID NO: 1628036 - RNA, 21 nt, Human
gucacugagacagcccgggcu

SEQ ID NO: 1628037 - RNA, 18 nt, Human
gucacugagacagcccgg

SEQ ID NO: 1628038 - RNA, 17 nt, Human
gucacugagacagcccg

SEQ ID NO: 1628039 - RNA, 10 nt, Human
gucacugcuu

SEQ ID NO: 1628040 - RNA, 23 nt, Human
gucacugcacagugcaucucagc

SEQ ID NO: 1628041 - RNA, 20 nt, Human
gucacugcacagugcaucuc

SEQ ID NO: 1628042 - RNA, 23 nt, Human
guccaugaagauguagaggagaa

SEQ ID NO: 1628043 - RNA, 22 nt, Human
guccaugaagauguagaggaga

SEQ ID NO: 1628044 - RNA, 19 nt, Human
gucauuugagcagggcuca

SEQ ID NO: 1628045 - RNA, 18 nt, Human
guccccaccgcagacagg

SEQ ID NO: 1628046 - RNA, 20 nt, Human
gucccaccccacacacgcca

SEQ ID NO: 1628047 - RNA, 22 nt, Human
guccccaccgcagacaggacca

SEQ ID NO: 1628048 - RNA, 15 nt, Human
gucccaccccacaca

SEQ ID NO: 1628049 - RNA, 18 nt, Human
guccccuguuuguuucug

SEQ ID NO: 1628050 - RNA, 22 nt, Human
guccccuguuuguuucugaaag

SEQ ID NO: 1628051 - RNA, 12 nt, Human
gucccuaauaaa

SEQ ID NO: 1628052 - RNA, 19 nt, Human
gucccuuacgugaguccug

SEQ ID NO: 1628053 - RNA, 18 nt, Human
gucccuuacgugaguccu

SEQ ID NO: 1628054 - RNA, 19 nt, Human
gucccugguggcagcucac

SEQ ID NO: 1628055 - RNA, 18 nt, Human
gucccugguggcagcuca

SEQ ID NO: 1628056 - RNA, 15 nt, Human
gucccuaauaaagcu

SEQ ID NO: 1628057 - RNA, 20 nt, Human
aacacagcaagggugauggg

SEQ ID NO: 1628058 - RNA, 18 nt, Human
aacacagcaagggugaug

SEQ ID NO: 1628059 - RNA, 19 nt, Human
aaauuucuaaaucuccaaa

SEQ ID NO: 1628060 - RNA, 12 nt, Human
aaauuugaauuu

SEQ ID NO: 1628061 - RNA, 19 nt, Human
aacacaaacgggcucagca

SEQ ID NO: 1628062 - RNA, 22 nt, Human
aaauuugaauuuuguguuagag

SEQ ID NO: 1628063 - RNA, 15 nt, Human
aaauuugaauuuugu

SEQ ID NO: 1628064 - RNA, 18 nt, Human
aacacuguucucugcccu

SEQ ID NO: 1628065 - RNA, 17 nt, Human
aacacuguucucugccc

SEQ ID NO: 1628066 - RNA, 16 nt, Human
aacacuguucucugcc

SEQ ID NO: 1628067 - RNA, 19 nt, Human
aacacuguucucugcccuc

SEQ ID NO: 1628068 - RNA, 17 nt, Human
gucauuugagcagggcu

SEQ ID NO: 1628069 - RNA, 21 nt, Human
aacacucacauuuauucugcu

SEQ ID NO: 1628070 - RNA, 17 nt, Human
aacacucauugaccuga

SEQ ID NO: 1628071 - RNA, 21 nt, Human
aacacugggagaaaugaaaaa

SEQ ID NO: 1628072 - RNA, 13 nt, Human
aacagucucagga

SEQ ID NO: 1628073 - RNA, 18 nt, Human
aacaguccauugaaaggg

SEQ ID NO: 1628074 - RNA, 15 nt, Human
guccgugcuaaggac

SEQ ID NO: 1628075 - RNA, 17 nt, Human
guccgugcuaaggacuu

SEQ ID NO: 1628076 - RNA, 16 nt, Human
guccgugcuaaggacu

SEQ ID NO: 1628077 - RNA, 12 nt, Human
aacauauauaac

SEQ ID NO: 1628078 - RNA, 14 nt, Human
aacagucucaggaa

SEQ ID NO: 1628079 - RNA, 14 nt, Human
aacauaaaauacaa

SEQ ID NO: 1628080 - RNA, 15 nt, Human
aacauguuaaaccau

SEQ ID NO: 1628081 - RNA, 14 nt, Human
aacauguuaaacca

SEQ ID NO: 1628082 - RNA, 16 nt, Human
aacauguuaaaccaug

SEQ ID NO: 1628083 - RNA, 22 nt, Human
gucuaugggacucaaugcacug

SEQ ID NO: 1628084 - RNA, 20 nt, Human
gucuauuuacggaacucaaa

SEQ ID NO: 1628085 - RNA, 16 nt, Human
gucuaccugaggggcc

SEQ ID NO: 1628086 - RNA, 15 nt, Human
gucuaccugaggggc

SEQ ID NO: 1628087 - RNA, 14 nt, Human
gucuaccugagggg

SEQ ID NO: 1628088 - RNA, 12 nt, Human
gucgccucugca

SEQ ID NO: 1628089 - RNA, 16 nt, Human
guccuggcaugggaau

SEQ ID NO: 1628090 - RNA, 19 nt, Human
guccugcugcaguugccag

SEQ ID NO: 1628091 - RNA, 14 nt, Human
guccucuuuucuga

SEQ ID NO: 1628092 - RNA, 12 nt, Human
gucgaggcagga

SEQ ID NO: 1628093 - RNA, 16 nt, Human
gucgaggacagggagg

SEQ ID NO: 1628094 - RNA, 24 nt, Human
aacucauuuuuguuuucauuaucu

SEQ ID NO: 1628095 - RNA, 21 nt, Human
aacucauuuuuguuuucauua

SEQ ID NO: 1628096 - RNA, 15 nt, Human
aacuauguugauaaa

SEQ ID NO: 1628097 - RNA, 12 nt, Human
aacuauggccug

SEQ ID NO: 1628098 - RNA, 13 nt, Human
aacguggcugcuu

SEQ ID NO: 1628099 - RNA, 12 nt, Human
aacguggcugcu

SEQ ID NO: 1628100 - RNA, 17 nt, Human
aacuagggaagauaaua

SEQ ID NO: 1628101 - RNA, 21 nt, Human
aacuaggugcauauuuauaaa

SEQ ID NO: 1628102 - RNA, 23 nt, Human
aaccuggucacaggacucugccu

SEQ ID NO: 1628103 - RNA, 15 nt, Human
aacgucuuaaauauu

SEQ ID NO: 1628104 - RNA, 12 nt, Human
aacgugaaaaug

SEQ ID NO: 1628105 - RNA, 14 nt, Human
aacgucuuaaauau

SEQ ID NO: 1628106 - RNA, 12 nt, Human
aacgucuuaaau

SEQ ID NO: 1628107 - RNA, 21 nt, Human
aaccuucgccaccuggguucc

SEQ ID NO: 1628108 - RNA, 14 nt, Human
gucuuaauuaaaag

SEQ ID NO: 1628109 - RNA, 16 nt, Human
gucuggaaugcagugg

SEQ ID NO: 1628110 - RNA, 15 nt, Human
gucuggaaugcagug

SEQ ID NO: 1628111 - RNA, 18 nt, Human
gucuggaaugcaguggua

SEQ ID NO: 1628112 - RNA, 13 nt, Human
gucuucacaacag

SEQ ID NO: 1628113 - RNA, 23 nt, Human
gucuugucucagauuuuauuaug

SEQ ID NO: 1628114 - RNA, 22 nt, Human
gucuuguuuuuuuuuuccacuu

SEQ ID NO: 1628115 - RNA, 14 nt, Human
gucugacaggcaau

SEQ ID NO: 1628116 - RNA, 13 nt, Human
gucugacaggcaa

SEQ ID NO: 1628117 - RNA, 12 nt, Human
gucugacaggca

SEQ ID NO: 1628118 - RNA, 18 nt, Human
gucugacaggcaaugcug

SEQ ID NO: 1628119 - RNA, 15 nt, Human
gucugacaggcaaug

SEQ ID NO: 1628120 - RNA, 20 nt, Human
gucugacaggcaaugcuggc

SEQ ID NO: 1628121 - RNA, 19 nt, Human
gucucaaaaaaagaaaaag

SEQ ID NO: 1628122 - RNA, 17 nt, Human
gucucaaaaaaagaaaa

SEQ ID NO: 1628123 - RNA, 14 nt, Human
gucucaaaaaaaca

SEQ ID NO: 1628124 - RNA, 14 nt, Human
gucugaaggcuggg

SEQ ID NO: 1628125 - RNA, 23 nt, Human
gugaauaauacaguaucucaggg

SEQ ID NO: 1628126 - RNA, 12 nt, Human
aacuccuggccu

SEQ ID NO: 1628127 - RNA, 14 nt, Human
aacuccugaccuca

SEQ ID NO: 1628128 - RNA, 12 nt, Human
aacuccugaccu

SEQ ID NO: 1628129 - RNA, 22 nt, Human
gugacagagugagacucugucu

SEQ ID NO: 1628130 - RNA, 20 nt, Human
gugacagagugagacucugu

SEQ ID NO: 1628131 - RNA, 19 nt, Human
gugacaugucuuuucuugc

SEQ ID NO: 1628132 - RNA, 22 nt, Human
gugacauguguuggcagccucu

SEQ ID NO: 1628133 - RNA, 15 nt, Human
gugacuuuggauaau

SEQ ID NO: 1628134 - RNA, 12 nt, Human
gugacuuuggau

SEQ ID NO: 1628135 - RNA, 16 nt, Human
gugacuucagcucugu

SEQ ID NO: 1628136 - RNA, 16 nt, Human
gugagacucugucuca

SEQ ID NO: 1628137 - RNA, 14 nt, Human
gugagacucugucu

SEQ ID NO: 1628138 - RNA, 23 nt, Human
gugagaccugccccuccucucug

SEQ ID NO: 1628139 - RNA, 16 nt, Human
gugagaccugccccuc

SEQ ID NO: 1628140 - RNA, 22 nt, Human
gugagacccugucucaaaaaaa

SEQ ID NO: 1628141 - RNA, 15 nt, Human
gugagaccugccccu

SEQ ID NO: 1628142 - RNA, 14 nt, Human
gugagaccugcccc

SEQ ID NO: 1628143 - RNA, 13 nt, Human
gugagaccugccc

SEQ ID NO: 1628144 - RNA, 16 nt, Human
aacugcauuggcuuug

SEQ ID NO: 1628145 - RNA, 23 nt, Human
aacugauuuuuuuuuccuucagu

SEQ ID NO: 1628146 - RNA, 22 nt, Human
aacugauuuuuuuuuccuucag

SEQ ID NO: 1628147 - RNA, 21 nt, Human
aacugauuuuuuuuuccuuca

SEQ ID NO: 1628148 - RNA, 23 nt, Human
aacucuccucugcugcuggcugg

SEQ ID NO: 1628149 - RNA, 22 nt, Human
aacucuccucugcugcuggcug

SEQ ID NO: 1628150 - RNA, 16 nt, Human
aacucugacaacagac

SEQ ID NO: 1628151 - RNA, 17 nt, Human
gugaggcucugcccuug

SEQ ID NO: 1628152 - RNA, 16 nt, Human
gugaggcucugcccuu

SEQ ID NO: 1628153 - RNA, 15 nt, Human
gugaggcucugcccu

SEQ ID NO: 1628154 - RNA, 14 nt, Human
gugaggcucugccc

SEQ ID NO: 1628155 - RNA, 13 nt, Human
gugaggcucugcc

SEQ ID NO: 1628156 - RNA, 12 nt, Human
gugaggcucugc

SEQ ID NO: 1628157 - RNA, 18 nt, Human
gugagacucugucucaaa

SEQ ID NO: 1628158 - RNA, 21 nt, Human
aacucuccucugcugcuggcu

SEQ ID NO: 1628159 - RNA, 19 nt, Human
aacucuccucugcugcugg

SEQ ID NO: 1628160 - RNA, 19 nt, Human
gugagucaccaagcccagu

SEQ ID NO: 1628161 - RNA, 17 nt, Human
gugagucaccaagccca

SEQ ID NO: 1628162 - RNA, 23 nt, Human
gugaguacuacaguccucccauc

SEQ ID NO: 1628163 - RNA, 18 nt, Human
gugaggcucugcccuugg

SEQ ID NO: 1628164 - RNA, 14 nt, Human
aacuucacauauug

SEQ ID NO: 1628165 - RNA, 22 nt, Human
aacuucacauauugauuuccgu

SEQ ID NO: 1628166 - RNA, 22 nt, Human
aacuucaccauauuaccacaga

SEQ ID NO: 1628167 - RNA, 17 nt, Human
aacugcccccucugccc

SEQ ID NO: 1628168 - RNA, 16 nt, Human
aacugcccccucugcc

SEQ ID NO: 1628169 - RNA, 21 nt, Human
aacugcccccucugcccugcg

SEQ ID NO: 1628170 - RNA, 20 nt, Human
aacugcccccucugcccugc

SEQ ID NO: 1628171 - RNA, 19 nt, Human
aacugcccccucugcccug

SEQ ID NO: 1628172 - RNA, 18 nt, Human
aacugcccccucugcccu

SEQ ID NO: 1628173 - RNA, 23 nt, Human
aacuuccuuggacucauuuuaaa

SEQ ID NO: 1628174 - RNA, 21 nt, Human
aacuucagcgguuuauauaag

SEQ ID NO: 1628175 - RNA, 13 nt, Human
aacuucagacaua

SEQ ID NO: 1628176 - RNA, 18 nt, Human
aacuucagcgguuuauau

SEQ ID NO: 1628177 - RNA, 22 nt, Human
aacuuccuuggacucauuuuaa

SEQ ID NO: 1628178 - RNA, 12 nt, Human
aacuugaaauuu

SEQ ID NO: 1628179 - RNA, 19 nt, Human
aacuugaaauuugaauuuu

SEQ ID NO: 1628180 - RNA, 18 nt, Human
aacuugaaauuugaauuu

SEQ ID NO: 1628181 - RNA, 13 nt, Human
aacuugaaauuug

SEQ ID NO: 1628182 - RNA, 17 nt, Human
gugauuaccagggacug

SEQ ID NO: 1628183 - RNA, 16 nt, Human
gugauuaccagggacu

SEQ ID NO: 1628184 - RNA, 11 nt, Human
gugauuaccag

SEQ ID NO: 1628185 - RNA, 23 nt, Human
gugaugguuccccuguucacucu

SEQ ID NO: 1628186 - RNA, 17 nt, Human
gugcauuugaggucugu

SEQ ID NO: 1628187 - RNA, 19 nt, Human
gugcauuugaggucuguuc

SEQ ID NO: 1628188 - RNA, 23 nt, Human
gugccaaaaacaacaacaaaaug

SEQ ID NO: 1628189 - RNA, 21 nt, Human
gugcauuuggugguuucagaa

SEQ ID NO: 1628190 - RNA, 20 nt, Human
gugcauuugaggucuguucu

SEQ ID NO: 1628191 - RNA, 21 nt, Human
gugcacaagcuccaagcuccc

SEQ ID NO: 1628192 - RNA, 16 nt, Human
gugcacaagcuccaag

SEQ ID NO: 1628193 - RNA, 13 nt, Human
gugcacaagcucc

SEQ ID NO: 1628194 - RNA, 18 nt, Human
gugcaaugaccuuucaau

SEQ ID NO: 1628195 - RNA, 21 nt, Human
gugcacaugcacgugugugca

SEQ ID NO: 1628196 - RNA, 23 nt, Human
gugcacaagcuccaagcucccag

SEQ ID NO: 1628197 - RNA, 22 nt, Human
gugcaaugaccuuucaauagga

SEQ ID NO: 1628198 - RNA, 18 nt, Human
aagaaaaaugagccuggc

SEQ ID NO: 1628199 - RNA, 17 nt, Human
aagaaaaaugagccugg

SEQ ID NO: 1628200 - RNA, 18 nt, Human
aagaaaaagaaaaagaaa

SEQ ID NO: 1628201 - RNA, 13 nt, Human
aagaaaaagaaaa

SEQ ID NO: 1628202 - RNA, 19 nt, Human
aagaaaaaauauuuucccu

SEQ ID NO: 1628203 - RNA, 21 nt, Human
aacuuuaccuuuuuuauacau

SEQ ID NO: 1628204 - RNA, 22 nt, Human
aacuuuaccuuuuuuauacaua

SEQ ID NO: 1628205 - RNA, 23 nt, Human
aacuuuaccuuuuuuauacauaa

SEQ ID NO: 1628206 - RNA, 19 nt, Human
gugccagauuuaugcauau

SEQ ID NO: 1628207 - RNA, 11 nt, Human
aagaaacauuu

SEQ ID NO: 1628208 - RNA, 15 nt, Human
aagaaaauaguggug

SEQ ID NO: 1628209 - RNA, 21 nt, Human
aagaaaauaguggugugauuu

SEQ ID NO: 1628210 - RNA, 22 nt, Human
aagaaaauaguggugugauuug

SEQ ID NO: 1628211 - RNA, 16 nt, Human
aagaaagaaaaucagg

SEQ ID NO: 1628212 - RNA, 14 nt, Human
aagaaagaaaauca

SEQ ID NO: 1628213 - RNA, 22 nt, Human
gugcuacaaaaacacagcaagg

SEQ ID NO: 1628214 - RNA, 18 nt, Human
gugcuaucucccccagcc

SEQ ID NO: 1628215 - RNA, 15 nt, Human
gugcuaucuccccca

SEQ ID NO: 1628216 - RNA, 17 nt, Human
gugcuaggaacacuccu

SEQ ID NO: 1628217 - RNA, 15 nt, Human
gugcugcccugccca

SEQ ID NO: 1628218 - RNA, 14 nt, Human
gugcugcccugccc

SEQ ID NO: 1628219 - RNA, 13 nt, Human
gugcugcccugcc

SEQ ID NO: 1628220 - RNA, 14 nt, Human
gugcucuggacagg

SEQ ID NO: 1628221 - RNA, 13 nt, Human
gugcucuggacag

SEQ ID NO: 1628222 - RNA, 16 nt, Human
gugcucugaucaucca

SEQ ID NO: 1628223 - RNA, 19 nt, Human
gugcuaucucccccagccc

SEQ ID NO: 1628224 - RNA, 18 nt, Human
gugcucaggagcccuggg

SEQ ID NO: 1628225 - RNA, 19 nt, Human
gugcucaggagcccuggga

SEQ ID NO: 1628226 - RNA, 18 nt, Human
gugcuccauggcugccau

SEQ ID NO: 1628227 - RNA, 22 nt, Human
gugcuccauggcugccaucuca

SEQ ID NO: 1628228 - RNA, 23 nt, Human
uagagauuuuuuuguuguuuguu

SEQ ID NO: 1628229 - RNA, 22 nt, Human
uagaggagaaacuggaacucuc

SEQ ID NO: 1628230 - RNA, 15 nt, Human
uagauauaugcucug

SEQ ID NO: 1628231 - RNA, 19 nt, Human
uagauauaugcucugcaug

SEQ ID NO: 1628232 - RNA, 18 nt, Human
acaaaaggauaaugaaua

SEQ ID NO: 1628233 - RNA, 11 nt, Human
acaaaagcaug

SEQ ID NO: 1628234 - RNA, 22 nt, Human
acaaaagcaugugagacugguu

SEQ ID NO: 1628235 - RNA, 16 nt, Human
aauuguuacaaauugu

SEQ ID NO: 1628236 - RNA, 21 nt, Human
aauuguguuuauaauuuuaaa

SEQ ID NO: 1628237 - RNA, 22 nt, Human
acaaaggaugcccaaagaugca

SEQ ID NO: 1628238 - RNA, 19 nt, Human
uagcauggcugccaauggg

SEQ ID NO: 1628239 - RNA, 15 nt, Human
uagaugcaguucuga

SEQ ID NO: 1628240 - RNA, 14 nt, Human
uagaugcugacugu

SEQ ID NO: 1628241 - RNA, 23 nt, Human
uagaugcugacuguacuccuccc

SEQ ID NO: 1628242 - RNA, 18 nt, Human
uagcaugucgucaaagcu

SEQ ID NO: 1628243 - RNA, 16 nt, Human
uagcauuuugcuaaau

SEQ ID NO: 1628244 - RNA, 22 nt, Human
uagcauuuugcuaaaugugaau

SEQ ID NO: 1628245 - RNA, 21 nt, Human
uagccaaggccaaaggaagca

SEQ ID NO: 1628246 - RNA, 20 nt, Human
acaagacccaaaaggcagaa

SEQ ID NO: 1628247 - RNA, 19 nt, Human
acaagacccuugugguccc

SEQ ID NO: 1628248 - RNA, 19 nt, Human
acaagaccacguuucuaaa

SEQ ID NO: 1628249 - RNA, 21 nt, Human
acaacacucauugaccugagg

SEQ ID NO: 1628250 - RNA, 23 nt, Human
acaacacucauugaccugaggcc

SEQ ID NO: 1628251 - RNA, 18 nt, Human
acaaauuuacagagacag

SEQ ID NO: 1628252 - RNA, 19 nt, Human
acaaauuuacagagacaga

SEQ ID NO: 1628253 - RNA, 15 nt, Human
uagccagaggagaga

SEQ ID NO: 1628254 - RNA, 11 nt, Human
uagccagagga

SEQ ID NO: 1628255 - RNA, 22 nt, Human
uagcuagacuggugacugauuc

SEQ ID NO: 1628256 - RNA, 21 nt, Human
uagcuagacuggugacugauu

SEQ ID NO: 1628257 - RNA, 12 nt, Human
acaaugacuuac

SEQ ID NO: 1628258 - RNA, 17 nt, Human
acaaugacuuacuguac

SEQ ID NO: 1628259 - RNA, 18 nt, Human
acaaugacuuacuguaca

SEQ ID NO: 1628260 - RNA, 19 nt, Human
acaaugacuuacuguacau

SEQ ID NO: 1628261 - RNA, 23 nt, Human
acaauacaucccuuaccugggaa

SEQ ID NO: 1628262 - RNA, 14 nt, Human
acaagacugcacau

SEQ ID NO: 1628263 - RNA, 13 nt, Human
acaagacugcaca

SEQ ID NO: 1628264 - RNA, 19 nt, Human
acaaggacuaggguccugg

SEQ ID NO: 1628265 - RNA, 18 nt, Human
acaaggacuaggguccug

SEQ ID NO: 1628266 - RNA, 21 nt, Human
acaaggacagccccuccucca

SEQ ID NO: 1628267 - RNA, 22 nt, Human
acaaggacagccccuccuccau

SEQ ID NO: 1628268 - RNA, 15 nt, Human
uagggagagaagaua

SEQ ID NO: 1628269 - RNA, 14 nt, Human
uagggagagaagau

SEQ ID NO: 1628270 - RNA, 20 nt, Human
uaggcauuugcugaauacag

SEQ ID NO: 1628271 - RNA, 16 nt, Human
uaggcauuugcugaau

SEQ ID NO: 1628272 - RNA, 14 nt, Human
uaggcauuguggga

SEQ ID NO: 1628273 - RNA, 18 nt, Human
uaggaaauauuuauuuua

SEQ ID NO: 1628274 - RNA, 19 nt, Human
uaggaaauauuuauuuuaa

SEQ ID NO: 1628275 - RNA, 16 nt, Human
uaggaaauccagggug

SEQ ID NO: 1628276 - RNA, 18 nt, Human
acacaugauccugcaauu

SEQ ID NO: 1628277 - RNA, 21 nt, Human
acacaugagcaucaggccagg

SEQ ID NO: 1628278 - RNA, 15 nt, Human
acacaucagcuugcc

SEQ ID NO: 1628279 - RNA, 15 nt, Human
acacaugaaguccaa

SEQ ID NO: 1628280 - RNA, 18 nt, Human
acacaugcaaggucauuu

SEQ ID NO: 1628281 - RNA, 14 nt, Human
acacauuuuauuuu

SEQ ID NO: 1628282 - RNA, 19 nt, Human
acacauuuuauuuuauuau

SEQ ID NO: 1628283 - RNA, 20 nt, Human
acacauuuuauuuuauuaug

SEQ ID NO: 1628284 - RNA, 21 nt, Human
acacauuuuauuuuauuaugc

SEQ ID NO: 1628285 - RNA, 21 nt, Human
acaccauuaugugcgcugaua

SEQ ID NO: 1628286 - RNA, 17 nt, Human
acaccauuaugugcgcu

SEQ ID NO: 1628287 - RNA, 20 nt, Human
uaguuccaccaucaagccac

SEQ ID NO: 1628288 - RNA, 22 nt, Human
uauaaaagggacugagaaauuu

SEQ ID NO: 1628289 - RNA, 20 nt, Human
uauaaaagccuguuuaagag

SEQ ID NO: 1628290 - RNA, 19 nt, Human
uauaaaaauaaaaaacacu

SEQ ID NO: 1628291 - RNA, 19 nt, Human
acacucaaaucaagaaacu

SEQ ID NO: 1628292 - RNA, 15 nt, Human
acacucaaaagcugg

SEQ ID NO: 1628293 - RNA, 14 nt, Human
acacuaagagagaa

SEQ ID NO: 1628294 - RNA, 13 nt, Human
acacuaagagaga

SEQ ID NO: 1628295 - RNA, 22 nt, Human
acacucacauuuauucugcuca

SEQ ID NO: 1628296 - RNA, 20 nt, Human
acacucacauuuauucugcu

SEQ ID NO: 1628297 - RNA, 15 nt, Human
uauaaguguguguuu

SEQ ID NO: 1628298 - RNA, 16 nt, Human
acaccgggcacucaga

SEQ ID NO: 1628299 - RNA, 14 nt, Human
acaccgggccugga

SEQ ID NO: 1628300 - RNA, 21 nt, Human
acaccucugcacaagcugcac

SEQ ID NO: 1628301 - RNA, 16 nt, Human
acaccgggccuggaga

SEQ ID NO: 1628302 - RNA, 12 nt, Human
acacgaauauug

SEQ ID NO: 1628303 - RNA, 21 nt, Human
acaccuuagccugcccuccuu

SEQ ID NO: 1628304 - RNA, 23 nt, Human
uaguguuggagaagaacugaaau

SEQ ID NO: 1628305 - RNA, 22 nt, Human
uagugaaacucguuaauuugua

SEQ ID NO: 1628306 - RNA, 18 nt, Human
acacaguauuacuucugc

SEQ ID NO: 1628307 - RNA, 22 nt, Human
acacaguauuacuucugcuaca

SEQ ID NO: 1628308 - RNA, 19 nt, Human
acacaguauuacuucugcu

SEQ ID NO: 1628309 - RNA, 22 nt, Human
acaaugcuguauuuuaaaagaa

SEQ ID NO: 1628310 - RNA, 21 nt, Human
acaaugcugugcccuaaagug

SEQ ID NO: 1628311 - RNA, 22 nt, Human
acaaugcugugcccuaaagugu

SEQ ID NO: 1628312 - RNA, 23 nt, Human
acaaugcugugcccuaaagugua

SEQ ID NO: 1628313 - RNA, 24 nt, Human
acaaugcugugcccuaaaguguau

SEQ ID NO: 1628314 - RNA, 19 nt, Human
acaauggauaggcacagga

SEQ ID NO: 1628315 - RNA, 17 nt, Human
acaaugugaaaagaaaa

SEQ ID NO: 1628316 - RNA, 19 nt, Human
acaaugugaaaagaaaaau

SEQ ID NO: 1628317 - RNA, 15 nt, Human
acacacucaaaucaa

SEQ ID NO: 1628318 - RNA, 20 nt, Human
acacacucaaaucaagaaac

SEQ ID NO: 1628319 - RNA, 21 nt, Human
acacacugcauguuugugauu

SEQ ID NO: 1628320 - RNA, 21 nt, Human
acacacgcgugcacacaccag

SEQ ID NO: 1628321 - RNA, 20 nt, Human
acacaccagagcccaccuug

SEQ ID NO: 1628322 - RNA, 15 nt, Human
acacaccagagccca

SEQ ID NO: 1628323 - RNA, 14 nt, Human
acacaccagagccc

SEQ ID NO: 1628324 - RNA, 22 nt, Human
acacacacgcgugcacacacca

SEQ ID NO: 1628325 - RNA, 14 nt, Human
acacacagcucugu

SEQ ID NO: 1628326 - RNA, 13 nt, Human
acacacagcucug

SEQ ID NO: 1628327 - RNA, 17 nt, Human
acacacagcucuguccu

SEQ ID NO: 1628328 - RNA, 19 nt, Human
acacacagcucuguccugg

SEQ ID NO: 1628329 - RNA, 18 nt, Human
acagccguuuguucccca

SEQ ID NO: 1628330 - RNA, 18 nt, Human
acagcaagggugauggga

SEQ ID NO: 1628331 - RNA, 17 nt, Human
acagcccgggcucugcc

SEQ ID NO: 1628332 - RNA, 21 nt, Human
acagcaaggagauuuacaacu

SEQ ID NO: 1628333 - RNA, 20 nt, Human
acagcccgggcucugccucc

SEQ ID NO: 1628334 - RNA, 19 nt, Human
acagcccgggcucugccuc

SEQ ID NO: 1628335 - RNA, 18 nt, Human
acagcccgggcucugccu

SEQ ID NO: 1628336 - RNA, 17 nt, Human
acagcaaggagauuuac

SEQ ID NO: 1628337 - RNA, 15 nt, Human
acagauuugagcuca

SEQ ID NO: 1628338 - RNA, 14 nt, Human
acagauuugagcuc

SEQ ID NO: 1628339 - RNA, 19 nt, Human
acagagcccacgcccccac

SEQ ID NO: 1628340 - RNA, 18 nt, Human
acagagcccacgccccca

SEQ ID NO: 1628341 - RNA, 15 nt, Human
acagagcccacgccc

SEQ ID NO: 1628342 - RNA, 20 nt, Human
acagagcccacgcccccacu

SEQ ID NO: 1628343 - RNA, 17 nt, Human
acagauccccaagccug

SEQ ID NO: 1628344 - RNA, 18 nt, Human
acagauccccaagccugg

SEQ ID NO: 1628345 - RNA, 22 nt, Human
acagaucucugcuuuggaaauc

SEQ ID NO: 1628346 - RNA, 21 nt, Human
uaugauuaaguaaugauaacu

SEQ ID NO: 1628347 - RNA, 11 nt, Human
uaugcauuuga

SEQ ID NO: 1628348 - RNA, 23 nt, Human
uaugcauuugaaaauuuugaugu

SEQ ID NO: 1628349 - RNA, 24 nt, Human
uaugcauuugaaaauuuugauguu

SEQ ID NO: 1628350 - RNA, 20 nt, Human
uaugauuaaguaaugauaac

SEQ ID NO: 1628351 - RNA, 16 nt, Human
uaugauuaaguaauga

SEQ ID NO: 1628352 - RNA, 19 nt, Human
uaugccccauucaacaucu

SEQ ID NO: 1628353 - RNA, 17 nt, Human
uaugccugggcagaagg

SEQ ID NO: 1628354 - RNA, 16 nt, Human
acagccucuuagaugc

SEQ ID NO: 1628355 - RNA, 12 nt, Human
acagccuggcac

SEQ ID NO: 1628356 - RNA, 23 nt, Human
uauggcuuuugugcauuaucuag

SEQ ID NO: 1628357 - RNA, 15 nt, Human
uaugcuuauacacuu

SEQ ID NO: 1628358 - RNA, 18 nt, Human
uauggcuuuugugcauua

SEQ ID NO: 1628359 - RNA, 21 nt, Human
uauggcuuuugugcauuaucu

SEQ ID NO: 1628360 - RNA, 17 nt, Human
uauggcuuuugugcauu

SEQ ID NO: 1628361 - RNA, 18 nt, Human
uaucaaguauuauaccuu

SEQ ID NO: 1628362 - RNA, 17 nt, Human
uaucucaaaacugcacu

SEQ ID NO: 1628363 - RNA, 23 nt, Human
uaucuauauuuuacauaaauuua

SEQ ID NO: 1628364 - RNA, 14 nt, Human
uaucucccccagcc

SEQ ID NO: 1628365 - RNA, 16 nt, Human
uaucucccccagcccc

SEQ ID NO: 1628366 - RNA, 13 nt, Human
uaucucccccagc

SEQ ID NO: 1628367 - RNA, 18 nt, Human
acagagaaaguacuucuc

SEQ ID NO: 1628368 - RNA, 11 nt, Human
acagagaaagu

SEQ ID NO: 1628369 - RNA, 15 nt, Human
uauauuguuugcuaa

SEQ ID NO: 1628370 - RNA, 16 nt, Human
uauauuuaguaucuuu

SEQ ID NO: 1628371 - RNA, 21 nt, Human
uauauuuacuaaaauggacug

SEQ ID NO: 1628372 - RNA, 20 nt, Human
uauauuuacuaaaauggacu

SEQ ID NO: 1628373 - RNA, 15 nt, Human
acagacccugcccug

SEQ ID NO: 1628374 - RNA, 14 nt, Human
acagacccugcccu

SEQ ID NO: 1628375 - RNA, 13 nt, Human
acagacccugccc

SEQ ID NO: 1628376 - RNA, 18 nt, Human
acagaaaauucuucucca

SEQ ID NO: 1628377 - RNA, 17 nt, Human
acagaaaauucuucucc

SEQ ID NO: 1628378 - RNA, 20 nt, Human
acagaaaauggaagacagcu

SEQ ID NO: 1628379 - RNA, 14 nt, Human
acagaaauguacag

SEQ ID NO: 1628380 - RNA, 16 nt, Human
acagaaauguacagca

SEQ ID NO: 1628381 - RNA, 17 nt, Human
acagaaauguacagcaa

SEQ ID NO: 1628382 - RNA, 23 nt, Human
uauaaguguguguuuuucauaaa

SEQ ID NO: 1628383 - RNA, 17 nt, Human
uauaaguguguguuuuu

SEQ ID NO: 1628384 - RNA, 17 nt, Human
acaggaaguagaggagg

SEQ ID NO: 1628385 - RNA, 13 nt, Human
acaggaaguacug

SEQ ID NO: 1628386 - RNA, 18 nt, Human
acaggaaaagcugcugac

SEQ ID NO: 1628387 - RNA, 17 nt, Human
acaggaaaagcugcuga

SEQ ID NO: 1628388 - RNA, 16 nt, Human
acaggaaaagcugcug

SEQ ID NO: 1628389 - RNA, 15 nt, Human
acaggaaaagcugcu

SEQ ID NO: 1628390 - RNA, 13 nt, Human
acagcuaacaugg

SEQ ID NO: 1628391 - RNA, 11 nt, Human
acagccuggca

SEQ ID NO: 1628392 - RNA, 23 nt, Human
acaggaccagggauuuccaugau

SEQ ID NO: 1628393 - RNA, 14 nt, Human
acaggacucugccu

SEQ ID NO: 1628394 - RNA, 15 nt, Human
acaggaucagucuga

SEQ ID NO: 1628395 - RNA, 14 nt, Human
acaggaucagucug

SEQ ID NO: 1628396 - RNA, 16 nt, Human
acaggagugagcacua

SEQ ID NO: 1628397 - RNA, 16 nt, Human
acaggcagguccaggg

SEQ ID NO: 1628398 - RNA, 14 nt, Human
acaggcagguccag

SEQ ID NO: 1628399 - RNA, 14 nt, Human
acaggcauguucuc

SEQ ID NO: 1628400 - RNA, 20 nt, Human
acaggcauguucucugagga

SEQ ID NO: 1628401 - RNA, 19 nt, Human
acaggcauguucucugagg

SEQ ID NO: 1628402 - RNA, 18 nt, Human
acaggcauguucucugag

SEQ ID NO: 1628403 - RNA, 15 nt, Human
acaggcauguucucu

SEQ ID NO: 1628404 - RNA, 22 nt, Human
acaggcauguucucugaggaca

SEQ ID NO: 1628405 - RNA, 14 nt, Human
uaugugaaacaugu

SEQ ID NO: 1628406 - RNA, 20 nt, Human
uauguggaguucaucuugaa

SEQ ID NO: 1628407 - RNA, 23 nt, Human
uaugugccagauuuaugcauauu

SEQ ID NO: 1628408 - RNA, 22 nt, Human
uaugugaacaguuguguuugaa

SEQ ID NO: 1628409 - RNA, 12 nt, Human
uaugugaacagu

SEQ ID NO: 1628410 - RNA, 17 nt, Human
uaugugaaacauguuuc

SEQ ID NO: 1628411 - RNA, 12 nt, Human
uaugugugaagu

SEQ ID NO: 1628412 - RNA, 14 nt, Human
uaugugugaaguga

SEQ ID NO: 1628413 - RNA, 21 nt, Human
acagggaggacgcucucuggc

SEQ ID NO: 1628414 - RNA, 20 nt, Human
acagggaggacgcucucugg

SEQ ID NO: 1628415 - RNA, 23 nt, Human
acaggcugggcuucaguggcagc

SEQ ID NO: 1628416 - RNA, 22 nt, Human
acaggcugggcuucaguggcag

SEQ ID NO: 1628417 - RNA, 12 nt, Human
acaggcugggcu

SEQ ID NO: 1628418 - RNA, 22 nt, Human
acaggcuccugccaccacgccc

SEQ ID NO: 1628419 - RNA, 21 nt, Human
acaggcuccugccaccacgcc

SEQ ID NO: 1628420 - RNA, 15 nt, Human
acaggcuccugccac

SEQ ID NO: 1628421 - RNA, 13 nt, Human
acaggcuccugcc

SEQ ID NO: 1628422 - RNA, 18 nt, Human
acagucaccucauggaau

SEQ ID NO: 1628423 - RNA, 17 nt, Human
acagucaccucauggaa

SEQ ID NO: 1628424 - RNA, 16 nt, Human
acagucaccucaugga

SEQ ID NO: 1628425 - RNA, 20 nt, Human
acaguauaauuaacauguua

SEQ ID NO: 1628426 - RNA, 15 nt, Human
acaguauaauuaaca

SEQ ID NO: 1628427 - RNA, 13 nt, Human
acaguauaauuaa

SEQ ID NO: 1628428 - RNA, 20 nt, Human
acagggcacaccgggcacuc

SEQ ID NO: 1628429 - RNA, 12 nt, Human
acagggcacacc

SEQ ID NO: 1628430 - RNA, 14 nt, Human
uauuacuguaagaa

SEQ ID NO: 1628431 - RNA, 13 nt, Human
uauuacuucugcu

SEQ ID NO: 1628432 - RNA, 14 nt, Human
uauuacuucugcua

SEQ ID NO: 1628433 - RNA, 15 nt, Human
uauuagaauaccaca

SEQ ID NO: 1628434 - RNA, 15 nt, Human
uauucaaacagucuc

SEQ ID NO: 1628435 - RNA, 19 nt, Human
uauuagugaccucagcuuu

SEQ ID NO: 1628436 - RNA, 23 nt, Human
uauucaaacagucucaggaaauc

SEQ ID NO: 1628437 - RNA, 21 nt, Human
uauuagugaccucagcuuuga

SEQ ID NO: 1628438 - RNA, 20 nt, Human
uauucaguaauaacucuacc

SEQ ID NO: 1628439 - RNA, 14 nt, Human
uauucaggaagcuc

SEQ ID NO: 1628440 - RNA, 16 nt, Human
uauucaggaagcucag

SEQ ID NO: 1628441 - RNA, 14 nt, Human
uauucauaauuauu

SEQ ID NO: 1628442 - RNA, 22 nt, Human
acaggcgugagccaccgugccu

SEQ ID NO: 1628443 - RNA, 12 nt, Human
acaggcuccugc

SEQ ID NO: 1628444 - RNA, 21 nt, Human
uauucagcucauggacuucug

SEQ ID NO: 1628445 - RNA, 16 nt, Human
uauucaaaguugccua

SEQ ID NO: 1628446 - RNA, 13 nt, Human
uauucaaaguugc

SEQ ID NO: 1628447 - RNA, 12 nt, Human
uauucaaaguug

SEQ ID NO: 1628448 - RNA, 16 nt, Human
uacaggugugagucac

SEQ ID NO: 1628449 - RNA, 23 nt, Human
uacauaaugcgugcauaccacuu

SEQ ID NO: 1628450 - RNA, 24 nt, Human
uacauaaugcgugcauaccacuuu

SEQ ID NO: 1628451 - RNA, 20 nt, Human
uacaucccuuaccugggaaa

SEQ ID NO: 1628452 - RNA, 15 nt, Human
aaugugaaacuggau

SEQ ID NO: 1628453 - RNA, 19 nt, Human
aaugugaaaagaaaaauga

SEQ ID NO: 1628454 - RNA, 14 nt, Human
aaugugaaacugga

SEQ ID NO: 1628455 - RNA, 11 nt, Human
aaugugugugu

SEQ ID NO: 1628456 - RNA, 20 nt, Human
aauguauguguaaguauucu

SEQ ID NO: 1628457 - RNA, 22 nt, Human
aauguauuacaguggggaauga

SEQ ID NO: 1628458 - RNA, 19 nt, Human
aauguauguguaaguauuc

SEQ ID NO: 1628459 - RNA, 13 nt, Human
uacauucuguuaa

SEQ ID NO: 1628460 - RNA, 15 nt, Human
aauuaagagagucua

SEQ ID NO: 1628461 - RNA, 21 nt, Human
aauuaagaaaggauaaaguug

SEQ ID NO: 1628462 - RNA, 22 nt, Human
aauuaaucugggccagaauuuc

SEQ ID NO: 1628463 - RNA, 11 nt, Human
aauuaacuuuu

SEQ ID NO: 1628464 - RNA, 19 nt, Human
aauuaacauguuaaaccau

SEQ ID NO: 1628465 - RNA, 20 nt, Human
aauuaacauguuaaaccaug

SEQ ID NO: 1628466 - RNA, 16 nt, Human
aaugcuguauuuuaaa

SEQ ID NO: 1628467 - RNA, 22 nt, Human
aaugcuguauuagucacagaga

SEQ ID NO: 1628468 - RNA, 12 nt, Human
aaugcccagccc

SEQ ID NO: 1628469 - RNA, 11 nt, Human
aaugcccagcc

SEQ ID NO: 1628470 - RNA, 13 nt, Human
aaugcccagcccc

SEQ ID NO: 1628471 - RNA, 20 nt, Human
aauggacuaacuugucuuug

SEQ ID NO: 1628472 - RNA, 23 nt, Human
aauggacguguuaugacuccaga

SEQ ID NO: 1628473 - RNA, 14 nt, Human
aauggaaccacucu

SEQ ID NO: 1628474 - RNA, 21 nt, Human
aauggaaaugggcagagcaga

SEQ ID NO: 1628475 - RNA, 20 nt, Human
aauggaaaugggcagagcag

SEQ ID NO: 1628476 - RNA, 16 nt, Human
aaugcuucaucccuuu

SEQ ID NO: 1628477 - RNA, 21 nt, Human
aaugcacuuuguucuggcucu

SEQ ID NO: 1628478 - RNA, 20 nt, Human
aaugaccuuucaauaggaaa

SEQ ID NO: 1628479 - RNA, 17 nt, Human
aaugaccuuucaauagg

SEQ ID NO: 1628480 - RNA, 16 nt, Human
aaugaccuuucaauag

SEQ ID NO: 1628481 - RNA, 18 nt, Human
aaugaccuuucaauagga

SEQ ID NO: 1628482 - RNA, 21 nt, Human
uacaaugcugugcccuaaagu

SEQ ID NO: 1628483 - RNA, 22 nt, Human
aaugcacuuuguucuggcucuu

SEQ ID NO: 1628484 - RNA, 23 nt, Human
aaugccaucaauaaaaaauuaug

SEQ ID NO: 1628485 - RNA, 21 nt, Human
aaugccaucaauaaaaaauua

SEQ ID NO: 1628486 - RNA, 16 nt, Human
aaugccaucaauaaaa

SEQ ID NO: 1628487 - RNA, 18 nt, Human
uacacuaagagagaauga

SEQ ID NO: 1628488 - RNA, 14 nt, Human
uacacuaagagaga

SEQ ID NO: 1628489 - RNA, 15 nt, Human
uacacuaaaagguga

SEQ ID NO: 1628490 - RNA, 23 nt, Human
uacacauuuuauuuuauuaugca

SEQ ID NO: 1628491 - RNA, 21 nt, Human
uacacauuuuauuuuauuaug

SEQ ID NO: 1628492 - RNA, 22 nt, Human
uacacauuuuauuuuauuaugc

SEQ ID NO: 1628493 - RNA, 19 nt, Human
uacacauuuuauuuuauua

SEQ ID NO: 1628494 - RNA, 22 nt, Human
uacagacaacaaaccuguuucu

SEQ ID NO: 1628495 - RNA, 20 nt, Human
uacagauccccaagccuggc

SEQ ID NO: 1628496 - RNA, 12 nt, Human
aauggcagccuu

SEQ ID NO: 1628497 - RNA, 16 nt, Human
aauggcagccuuggca

SEQ ID NO: 1628498 - RNA, 16 nt, Human
aauggacuguggugac

SEQ ID NO: 1628499 - RNA, 23 nt, Human
aauggcacaaucucggcucacug

SEQ ID NO: 1628500 - RNA, 19 nt, Human
aauugaugggauuugguca

SEQ ID NO: 1628501 - RNA, 21 nt, Human
aauugacccacaagaaaugaa

SEQ ID NO: 1628502 - RNA, 22 nt, Human
aauugacccacaagaaaugaaa

SEQ ID NO: 1628503 - RNA, 23 nt, Human
uacuguaauuugugauacaaugc

SEQ ID NO: 1628504 - RNA, 21 nt, Human
uacuguacaugaaaacacauu

SEQ ID NO: 1628505 - RNA, 22 nt, Human
uacuguacaugaaaacacauuu

SEQ ID NO: 1628506 - RNA, 14 nt, Human
uacuguaagaaaau

SEQ ID NO: 1628507 - RNA, 18 nt, Human
uacuguaaggcaaucaug

SEQ ID NO: 1628508 - RNA, 19 nt, Human
uacuguaauuugugauaca

SEQ ID NO: 1628509 - RNA, 20 nt, Human
uacuguaauuugugauacaa

SEQ ID NO: 1628510 - RNA, 18 nt, Human
uacuguaauuugugauac

SEQ ID NO: 1628511 - RNA, 19 nt, Human
uacuguaaggcaaucaugg

SEQ ID NO: 1628512 - RNA, 16 nt, Human
uacuggagaaaaugga

SEQ ID NO: 1628513 - RNA, 14 nt, Human
uacuggauuguacu

SEQ ID NO: 1628514 - RNA, 12 nt, Human
uacucuguguca

SEQ ID NO: 1628515 - RNA, 21 nt, Human
uacucugugucagguggggca

SEQ ID NO: 1628516 - RNA, 22 nt, Human
uacgccaggggaaaaucagccu

SEQ ID NO: 1628517 - RNA, 12 nt, Human
uacguacacauu

SEQ ID NO: 1628518 - RNA, 13 nt, Human
uacguacacauuu

SEQ ID NO: 1628519 - RNA, 14 nt, Human
uacguacacauuuu

SEQ ID NO: 1628520 - RNA, 15 nt, Human
uacguugugcauuug

SEQ ID NO: 1628521 - RNA, 16 nt, Human
uacguugugcauuugg

SEQ ID NO: 1628522 - RNA, 23 nt, Human
uacucuccuggaaauauuaagaa

SEQ ID NO: 1628523 - RNA, 22 nt, Human
uacucuccuggaaauauuaaga

SEQ ID NO: 1628524 - RNA, 14 nt, Human
uacuauguaucaau

SEQ ID NO: 1628525 - RNA, 13 nt, Human
uacuauguaucaa

SEQ ID NO: 1628526 - RNA, 12 nt, Human
uacuauguauca

SEQ ID NO: 1628527 - RNA, 23 nt, Human
uacuauggcccuggccuagcaua

SEQ ID NO: 1628528 - RNA, 17 nt, Human
uacuacuccuguaggaa

SEQ ID NO: 1628529 - RNA, 20 nt, Human
uacuaucaugucaaacguga

SEQ ID NO: 1628530 - RNA, 20 nt, Human
uaccugccaggaagccagca

SEQ ID NO: 1628531 - RNA, 18 nt, Human
uaccugccaggaagccag

SEQ ID NO: 1628532 - RNA, 23 nt, Human
uaccugccaggaagccagcaggc

SEQ ID NO: 1628533 - RNA, 17 nt, Human
uaccugucccccugaca

SEQ ID NO: 1628534 - RNA, 16 nt, Human
uaccugucccccugac

SEQ ID NO: 1628535 - RNA, 14 nt, Human
uaccugucccccug

SEQ ID NO: 1628536 - RNA, 13 nt, Human
uaccugucccccu

SEQ ID NO: 1628537 - RNA, 10 nt, Human
uaccuguccc

SEQ ID NO: 1628538 - RNA, 15 nt, Human
aauuagccaagugug

SEQ ID NO: 1628539 - RNA, 11 nt, Human
aauuacaggaa

SEQ ID NO: 1628540 - RNA, 18 nt, Human
aauuccaagugauugaaa

SEQ ID NO: 1628541 - RNA, 22 nt, Human
aauuccacuuauaggaauugac

SEQ ID NO: 1628542 - RNA, 12 nt, Human
aauuccccagau

SEQ ID NO: 1628543 - RNA, 14 nt, Human
aauuccccacccug

SEQ ID NO: 1628544 - RNA, 16 nt, Human
aauuauuauuuggccc

SEQ ID NO: 1628545 - RNA, 17 nt, Human
aaugaaacauuuuguca

SEQ ID NO: 1628546 - RNA, 17 nt, Human
aaugaaaccugugucuc

SEQ ID NO: 1628547 - RNA, 17 nt, Human
aaugaaagacuguacaa

SEQ ID NO: 1628548 - RNA, 16 nt, Human
aaugaaagacuguaca

SEQ ID NO: 1628549 - RNA, 22 nt, Human
aaugaauggcuaagcaaaaugu

SEQ ID NO: 1628550 - RNA, 17 nt, Human
aaugaaugcauaaaaug

SEQ ID NO: 1628551 - RNA, 13 nt, Human
aaugaaugucagu

SEQ ID NO: 1628552 - RNA, 14 nt, Human
aaugaaugucagug

SEQ ID NO: 1628553 - RNA, 22 nt, Human
aaugaaugucagugugacugau

SEQ ID NO: 1628554 - RNA, 18 nt, Human
uaaugucacaggcagguc

SEQ ID NO: 1628555 - RNA, 13 nt, Human
uaauguacugcau

SEQ ID NO: 1628556 - RNA, 15 nt, Human
uaaugaaugcauaaa

SEQ ID NO: 1628557 - RNA, 16 nt, Human
aaucuuuaauuuuaca

SEQ ID NO: 1628558 - RNA, 15 nt, Human
aaucuuuaauuuuac

SEQ ID NO: 1628559 - RNA, 18 nt, Human
uaauagacaauuuauuau

SEQ ID NO: 1628560 - RNA, 22 nt, Human
uaauagacaauuuauuauggca

SEQ ID NO: 1628561 - RNA, 16 nt, Human
uaauacaccacuacau

SEQ ID NO: 1628562 - RNA, 18 nt, Human
uaauacaccacuacauuc

SEQ ID NO: 1628563 - RNA, 19 nt, Human
uaauacaccacuacauucu

SEQ ID NO: 1628564 - RNA, 21 nt, Human
uaauacaccacuacauucugu

SEQ ID NO: 1628565 - RNA, 16 nt, Human
uaauagacaauuuauu

SEQ ID NO: 1628566 - RNA, 17 nt, Human
uaaugaaugaaacauuu

SEQ ID NO: 1628567 - RNA, 16 nt, Human
uaaggaaaaguuuaau

SEQ ID NO: 1628568 - RNA, 19 nt, Human
uaaguaaugauaacuggaa

SEQ ID NO: 1628569 - RNA, 16 nt, Human
uaagcuuguauuccuu

SEQ ID NO: 1628570 - RNA, 19 nt, Human
uaaguauucuuauuuaaug

SEQ ID NO: 1628571 - RNA, 20 nt, Human
uaaguauucuuauuuaauga

SEQ ID NO: 1628572 - RNA, 21 nt, Human
uaaguauucuuauuuaaugaa

SEQ ID NO: 1628573 - RNA, 19 nt, Human
uaaguacuauguaucaaug

SEQ ID NO: 1628574 - RNA, 17 nt, Human
uaaguacuauguaucaa

SEQ ID NO: 1628575 - RNA, 16 nt, Human
uaaguacuauguauca

SEQ ID NO: 1628576 - RNA, 13 nt, Human
uaaguacuaugua

SEQ ID NO: 1628577 - RNA, 15 nt, Human
aaucaugaauuaguu

SEQ ID NO: 1628578 - RNA, 12 nt, Human
aaucaugaauua

SEQ ID NO: 1628579 - RNA, 18 nt, Human
uaauaaacacucuugaaa

SEQ ID NO: 1628580 - RNA, 12 nt, Human
uaauaaacacuc

SEQ ID NO: 1628581 - RNA, 19 nt, Human
aaucuacacuccagugaga

SEQ ID NO: 1628582 - RNA, 17 nt, Human
aaucugggccagaauuu

SEQ ID NO: 1628583 - RNA, 16 nt, Human
aaucugggccagaauu

SEQ ID NO: 1628584 - RNA, 18 nt, Human
aaucugggccagaauuuc

SEQ ID NO: 1628585 - RNA, 22 nt, Human
aaucugugaacuugaaauuuga

SEQ ID NO: 1628586 - RNA, 21 nt, Human
aaucugugaacuugaaauuug

SEQ ID NO: 1628587 - RNA, 20 nt, Human
aaucugugaacuugaaauuu

SEQ ID NO: 1628588 - RNA, 19 nt, Human
aaucuuauaauuuaaaaua

SEQ ID NO: 1628589 - RNA, 15 nt, Human
aaucauuagguguga

SEQ ID NO: 1628590 - RNA, 17 nt, Human
aaucauuaggugugacu

SEQ ID NO: 1628591 - RNA, 23 nt, Human
aaucauuaggugugacugaauuu

SEQ ID NO: 1628592 - RNA, 12 nt, Human
aauccgcccauc

SEQ ID NO: 1628593 - RNA, 15 nt, Human
aaucgaccugccucg

SEQ ID NO: 1628594 - RNA, 11 nt, Human
aauccuggcug

SEQ ID NO: 1628595 - RNA, 16 nt, Human
aauagucaaauugugu

SEQ ID NO: 1628596 - RNA, 16 nt, Human
aauaguggugugauuu

SEQ ID NO: 1628597 - RNA, 22 nt, Human
aauaguggugugauuuggggau

SEQ ID NO: 1628598 - RNA, 13 nt, Human
aauaguuggcuag

SEQ ID NO: 1628599 - RNA, 15 nt, Human
aauauauuuuaagac

SEQ ID NO: 1628600 - RNA, 14 nt, Human
aauauauuuuaaga

SEQ ID NO: 1628601 - RNA, 14 nt, Human
aauaguuguugauu

SEQ ID NO: 1628602 - RNA, 20 nt, Human
aauaucacuugucaauaaaa

SEQ ID NO: 1628603 - RNA, 18 nt, Human
aauauauuuuaagacgaa

SEQ ID NO: 1628604 - RNA, 22 nt, Human
aauaucacuugucaauaaaauc

SEQ ID NO: 1628605 - RNA, 17 nt, Human
uaacauguaauuaagua

SEQ ID NO: 1628606 - RNA, 23 nt, Human
uaacauggacaugaucuucuuua

SEQ ID NO: 1628607 - RNA, 18 nt, Human
uaacauggacaugaucuu

SEQ ID NO: 1628608 - RNA, 14 nt, Human
uaacauaaaucugu

SEQ ID NO: 1628609 - RNA, 12 nt, Human
uaacauaaaucu

SEQ ID NO: 1628610 - RNA, 18 nt, Human
uaagaagugaaaaucuac

SEQ ID NO: 1628611 - RNA, 16 nt, Human
uaacuuucugaaauaa

SEQ ID NO: 1628612 - RNA, 20 nt, Human
uaacgauaaaagacagugaa

SEQ ID NO: 1628613 - RNA, 21 nt, Human
uaacuucacauauugauuucc

SEQ ID NO: 1628614 - RNA, 17 nt, Human
uaacuuccaauuuacau

SEQ ID NO: 1628615 - RNA, 14 nt, Human
uaacuucaccauau

SEQ ID NO: 1628616 - RNA, 17 nt, Human
aauauugauaugcuuau

SEQ ID NO: 1628617 - RNA, 14 nt, Human
aauauuucagauaa

SEQ ID NO: 1628618 - RNA, 19 nt, Human
aauauuuauuuuaauaaug

SEQ ID NO: 1628619 - RNA, 18 nt, Human
aauauuuauuuuaauaau

SEQ ID NO: 1628620 - RNA, 12 nt, Human
aauauuuagugu

SEQ ID NO: 1628621 - RNA, 24 nt, Human
aauaugccccauucaacaucuagu

SEQ ID NO: 1628622 - RNA, 21 nt, Human
aauaugccccauucaacaucu

SEQ ID NO: 1628623 - RNA, 15 nt, Human
aauauuccugcauuu

SEQ ID NO: 1628624 - RNA, 22 nt, Human
aauaugcacacauuuuuuaaau

SEQ ID NO: 1628625 - RNA, 16 nt, Human
aauaugcacacauuuu

SEQ ID NO: 1628626 - RNA, 17 nt, Human
aauaugcacacauuuuu

SEQ ID NO: 1628627 - RNA, 15 nt, Human
uaagagaaaugagcu

SEQ ID NO: 1628628 - RNA, 22 nt, Human
uaagcuguuacugucuucagua

SEQ ID NO: 1628629 - RNA, 18 nt, Human
uaagcacacuugacauca

SEQ ID NO: 1628630 - RNA, 21 nt, Human
aaucaggguuaguauugucca

SEQ ID NO: 1628631 - RNA, 16 nt, Human
aaucaggguuaguauu

SEQ ID NO: 1628632 - RNA, 22 nt, Human
aaucaggguuaguauuguccag

SEQ ID NO: 1628633 - RNA, 14 nt, Human
uaagauuccagaga

SEQ ID NO: 1628634 - RNA, 21 nt, Human
uaagauuccagagaguggcuc

SEQ ID NO: 1628635 - RNA, 22 nt, Human
ucaccauguuggccaggcuggu

SEQ ID NO: 1628636 - RNA, 19 nt, Human
accacaucuugcucugcug

SEQ ID NO: 1628637 - RNA, 18 nt, Human
accacaucuugcucugcu

SEQ ID NO: 1628638 - RNA, 17 nt, Human
accacaucuugcucugc

SEQ ID NO: 1628639 - RNA, 18 nt, Human
accacaugugcacaugca

SEQ ID NO: 1628640 - RNA, 24 nt, Human
accacauuggagauguuuaguaau

SEQ ID NO: 1628641 - RNA, 20 nt, Human
accaccacacccagcccacu

SEQ ID NO: 1628642 - RNA, 15 nt, Human
accaccacacccagc

SEQ ID NO: 1628643 - RNA, 16 nt, Human
ucaauucuugccaaau

SEQ ID NO: 1628644 - RNA, 17 nt, Human
ucacaaaggaugcccaa

SEQ ID NO: 1628645 - RNA, 13 nt, Human
ucaauuuuaacaa

SEQ ID NO: 1628646 - RNA, 20 nt, Human
ucacaguucucuccuucuuc

SEQ ID NO: 1628647 - RNA, 16 nt, Human
ucacaguucucuccuu

SEQ ID NO: 1628648 - RNA, 13 nt, Human
ucacagccucuga

SEQ ID NO: 1628649 - RNA, 21 nt, Human
ucacagaugugugauucacag

SEQ ID NO: 1628650 - RNA, 23 nt, Human
ucacagaugugugauucacagug

SEQ ID NO: 1628651 - RNA, 20 nt, Human
ucacagaugggugcuuggag

SEQ ID NO: 1628652 - RNA, 14 nt, Human
ucacaaccuucugu

SEQ ID NO: 1628653 - RNA, 23 nt, Human
ucacuugaacccgggaggcagag

SEQ ID NO: 1628654 - RNA, 10 nt, Human
ucacuugagu

SEQ ID NO: 1628655 - RNA, 22 nt, Human
accaguauuguacaaaguauua

SEQ ID NO: 1628656 - RNA, 20 nt, Human
accaguauuguacaaaguau

SEQ ID NO: 1628657 - RNA, 15 nt, Human
accaguauuguacaa

SEQ ID NO: 1628658 - RNA, 14 nt, Human
accaguauuguaca

SEQ ID NO: 1628659 - RNA, 14 nt, Human
accagucugacugu

SEQ ID NO: 1628660 - RNA, 23 nt, Human
accaguauuguacaaaguauuaa

SEQ ID NO: 1628661 - RNA, 15 nt, Human
accaguguuguggau

SEQ ID NO: 1628662 - RNA, 17 nt, Human
accaguguuguggauuu

SEQ ID NO: 1628663 - RNA, 14 nt, Human
ucacugcagccuca

SEQ ID NO: 1628664 - RNA, 22 nt, Human
ucacugagacagcccgggcucu

SEQ ID NO: 1628665 - RNA, 21 nt, Human
ucacugagacagcccgggcuc

SEQ ID NO: 1628666 - RNA, 17 nt, Human
ucacugagacagcccgg

SEQ ID NO: 1628667 - RNA, 17 nt, Human
ucacuauguugcccagg

SEQ ID NO: 1628668 - RNA, 20 nt, Human
ucacuaucccggcugcccuu

SEQ ID NO: 1628669 - RNA, 19 nt, Human
ucacuaucccggcugcccu

SEQ ID NO: 1628670 - RNA, 15 nt, Human
ucacugcagccucaa

SEQ ID NO: 1628671 - RNA, 13 nt, Human
ucacugcauccuc

SEQ ID NO: 1628672 - RNA, 23 nt, Human
ucacuguugcccaggcuggcgug

SEQ ID NO: 1628673 - RNA, 14 nt, Human
ucaccucauggaau

SEQ ID NO: 1628674 - RNA, 13 nt, Human
ucaccucauggaa

SEQ ID NO: 1628675 - RNA, 12 nt, Human
ucaccucaugga

SEQ ID NO: 1628676 - RNA, 20 nt, Human
ucaccugucuugccuuuuuc

SEQ ID NO: 1628677 - RNA, 19 nt, Human
ucaccugucuugccuuuuu

SEQ ID NO: 1628678 - RNA, 16 nt, Human
ucacuaggcuucuggu

SEQ ID NO: 1628679 - RNA, 17 nt, Human
accacuacauucuguua

SEQ ID NO: 1628680 - RNA, 16 nt, Human
accacuacauucuguu

SEQ ID NO: 1628681 - RNA, 22 nt, Human
accagcgugugacuacuccccc

SEQ ID NO: 1628682 - RNA, 23 nt, Human
ucaaugaaugaaugaauggcuaa

SEQ ID NO: 1628683 - RNA, 19 nt, Human
ucaauauuucagauaauca

SEQ ID NO: 1628684 - RNA, 15 nt, Human
ucaauauuucagaua

SEQ ID NO: 1628685 - RNA, 22 nt, Human
ucaauaucuuuuuuuuaauaaa

SEQ ID NO: 1628686 - RNA, 18 nt, Human
acauuuuauuuuauuaug

SEQ ID NO: 1628687 - RNA, 14 nt, Human
acauuuuauuuuau

SEQ ID NO: 1628688 - RNA, 19 nt, Human
acauuuuauuuuauuaugc

SEQ ID NO: 1628689 - RNA, 20 nt, Human
acauuuuauuuuauuaugca

SEQ ID NO: 1628690 - RNA, 21 nt, Human
acauuuuuaagugcugcauuu

SEQ ID NO: 1628691 - RNA, 22 nt, Human
acauuuuuaagugcugcauuua

SEQ ID NO: 1628692 - RNA, 23 nt, Human
acauuuuuaagugcugcauuuaa

SEQ ID NO: 1628693 - RNA, 14 nt, Human
acauuuuuuaaaug

SEQ ID NO: 1628694 - RNA, 16 nt, Human
acauuuuuuaaaugca

SEQ ID NO: 1628695 - RNA, 17 nt, Human
acauuuuuuaaaugcac

SEQ ID NO: 1628696 - RNA, 21 nt, Human
acauuuuuuaaaugcaccugg

SEQ ID NO: 1628697 - RNA, 20 nt, Human
acaugagguacugagaguga

SEQ ID NO: 1628698 - RNA, 12 nt, Human
acagucccugcc

SEQ ID NO: 1628699 - RNA, 20 nt, Human
acaugaauauuuaguguuca

SEQ ID NO: 1628700 - RNA, 23 nt, Human
acaugagguacugagagugaaca

SEQ ID NO: 1628701 - RNA, 15 nt, Human
acaugcuacacacug

SEQ ID NO: 1628702 - RNA, 21 nt, Human
acaugcuacacacugcauguu

SEQ ID NO: 1628703 - RNA, 22 nt, Human
acaugcuacacacugcauguuu

SEQ ID NO: 1628704 - RNA, 14 nt, Human
acaugggacauuug

SEQ ID NO: 1628705 - RNA, 11 nt, Human
acaugggacau

SEQ ID NO: 1628706 - RNA, 14 nt, Human
acauggaaguacua

SEQ ID NO: 1628707 - RNA, 21 nt, Human
acaugggacauuugcucaugg

SEQ ID NO: 1628708 - RNA, 20 nt, Human
acaugggacauuugcucaug

SEQ ID NO: 1628709 - RNA, 15 nt, Human
acaugggacauuugc

SEQ ID NO: 1628710 - RNA, 22 nt, Human
acauguaauuaaguacuaugua

SEQ ID NO: 1628711 - RNA, 21 nt, Human
acauguaauuaaguacuaugu

SEQ ID NO: 1628712 - RNA, 19 nt, Human
acauguaauuaaguacuau

SEQ ID NO: 1628713 - RNA, 17 nt, Human
acauguaauuaaguacu

SEQ ID NO: 1628714 - RNA, 15 nt, Human
acauguaauuaagua

SEQ ID NO: 1628715 - RNA, 18 nt, Human
ucaaauugugugaaaggu

SEQ ID NO: 1628716 - RNA, 14 nt, Human
acauuccugaugcu

SEQ ID NO: 1628717 - RNA, 15 nt, Human
acauuccugaacagg

SEQ ID NO: 1628718 - RNA, 14 nt, Human
acauuccugaacag

SEQ ID NO: 1628719 - RNA, 23 nt, Human
acauguaauuaaguacuauguau

SEQ ID NO: 1628720 - RNA, 15 nt, Human
acauguccaagaagc

SEQ ID NO: 1628721 - RNA, 19 nt, Human
acauguccaagaagcccag

SEQ ID NO: 1628722 - RNA, 14 nt, Human
ucaaccagcagaug

SEQ ID NO: 1628723 - RNA, 18 nt, Human
ucaaccauuccccauggg

SEQ ID NO: 1628724 - RNA, 15 nt, Human
ucaaccauuccccau

SEQ ID NO: 1628725 - RNA, 20 nt, Human
ucaacugcaucaagauguga

SEQ ID NO: 1628726 - RNA, 14 nt, Human
ucaaauuucuaaau

SEQ ID NO: 1628727 - RNA, 13 nt, Human
ucaaauuucuaaa

SEQ ID NO: 1628728 - RNA, 15 nt, Human
accccugagcuugca

SEQ ID NO: 1628729 - RNA, 18 nt, Human
accccaucucuacaaaaa

SEQ ID NO: 1628730 - RNA, 23 nt, Human
ucagcggggacagcuccuucugu

SEQ ID NO: 1628731 - RNA, 21 nt, Human
ucagcggggacagcuccuucu

SEQ ID NO: 1628732 - RNA, 20 nt, Human
ucagcggggacagcuccuuc

SEQ ID NO: 1628733 - RNA, 19 nt, Human
ucagcggggacagcuccuu

SEQ ID NO: 1628734 - RNA, 12 nt, Human
ucagcuccagcu

SEQ ID NO: 1628735 - RNA, 21 nt, Human
accccuggcuuuucacugcug

SEQ ID NO: 1628736 - RNA, 20 nt, Human
accccuggcuuuucacugcu

SEQ ID NO: 1628737 - RNA, 19 nt, Human
accccuggcuuuucacugc

SEQ ID NO: 1628738 - RNA, 18 nt, Human
accccuggcuuuucacug

SEQ ID NO: 1628739 - RNA, 22 nt, Human
accccagccccaaaacucuccu

SEQ ID NO: 1628740 - RNA, 13 nt, Human
accccagccccaa

SEQ ID NO: 1628741 - RNA, 17 nt, Human
accccacacacgccaga

SEQ ID NO: 1628742 - RNA, 23 nt, Human
acccaggagccccgaggccuucu

SEQ ID NO: 1628743 - RNA, 19 nt, Human
acccaggagccccgaggcc

SEQ ID NO: 1628744 - RNA, 17 nt, Human
ucagcccucccugcccc

SEQ ID NO: 1628745 - RNA, 16 nt, Human
ucagcccucccugccc

SEQ ID NO: 1628746 - RNA, 15 nt, Human
ucagcccucccugcc

SEQ ID NO: 1628747 - RNA, 14 nt, Human
ucagcccucccugc

SEQ ID NO: 1628748 - RNA, 13 nt, Human
ucagcccucccug

SEQ ID NO: 1628749 - RNA, 15 nt, Human
ucagcaaaagaugcu

SEQ ID NO: 1628750 - RNA, 20 nt, Human
ucagcaaaaauauuuuauga

SEQ ID NO: 1628751 - RNA, 19 nt, Human
ucagcaaaaauauuuuaug

SEQ ID NO: 1628752 - RNA, 23 nt, Human
ucagauuuuauuauguaaauccc

SEQ ID NO: 1628753 - RNA, 18 nt, Human
accaguguuguggauuua

SEQ ID NO: 1628754 - RNA, 12 nt, Human
ucagauuugaac

SEQ ID NO: 1628755 - RNA, 21 nt, Human
ucagauuugaacucuucaauc

SEQ ID NO: 1628756 - RNA, 17 nt, Human
acccgggaggcagaggu

SEQ ID NO: 1628757 - RNA, 13 nt, Human
acccgggaagggg

SEQ ID NO: 1628758 - RNA, 12 nt, Human
acccgggaaggg

SEQ ID NO: 1628759 - RNA, 20 nt, Human
acccggccccugcugguuca

SEQ ID NO: 1628760 - RNA, 17 nt, Human
acccggccccugcuggu

SEQ ID NO: 1628761 - RNA, 22 nt, Human
acccggccccugcugguucagg

SEQ ID NO: 1628762 - RNA, 16 nt, Human
acccggccccugcugg

SEQ ID NO: 1628763 - RNA, 15 nt, Human
acccggccccugcug

SEQ ID NO: 1628764 - RNA, 14 nt, Human
acccggccccugcu

SEQ ID NO: 1628765 - RNA, 21 nt, Human
acccggaggggccuggcagcc

SEQ ID NO: 1628766 - RNA, 18 nt, Human
acccggaggggccuggca

SEQ ID NO: 1628767 - RNA, 22 nt, Human
ucagguaacaggcagauacagg

SEQ ID NO: 1628768 - RNA, 21 nt, Human
ucagguaacaggcagauacag

SEQ ID NO: 1628769 - RNA, 23 nt, Human
ucagguaacaggcagauacagga

SEQ ID NO: 1628770 - RNA, 17 nt, Human
ucaggguuggccccugc

SEQ ID NO: 1628771 - RNA, 16 nt, Human
ucaggguuggccccug

SEQ ID NO: 1628772 - RNA, 19 nt, Human
ucagggucccugguggcag

SEQ ID NO: 1628773 - RNA, 23 nt, Human
ucaggccaggcccucugcccacu

SEQ ID NO: 1628774 - RNA, 22 nt, Human
ucagcuuguaaauagcucaggu

SEQ ID NO: 1628775 - RNA, 21 nt, Human
ucagcuuguaaauagcucagg

SEQ ID NO: 1628776 - RNA, 15 nt, Human
ucagcuccagcucac

SEQ ID NO: 1628777 - RNA, 14 nt, Human
ucagcuccagcuca

SEQ ID NO: 1628778 - RNA, 22 nt, Human
ucaggccaggcccucugcccac

SEQ ID NO: 1628779 - RNA, 21 nt, Human
ucaggccaggcccucugccca

SEQ ID NO: 1628780 - RNA, 15 nt, Human
acccugcccuguggg

SEQ ID NO: 1628781 - RNA, 17 nt, Human
acccugaggcccagagg

SEQ ID NO: 1628782 - RNA, 16 nt, Human
acccugaggcccagag

SEQ ID NO: 1628783 - RNA, 15 nt, Human
acccugaggcccaga

SEQ ID NO: 1628784 - RNA, 22 nt, Human
acccugcccugugggcccccaa

SEQ ID NO: 1628785 - RNA, 17 nt, Human
acccugcccugugggcc

SEQ ID NO: 1628786 - RNA, 23 nt, Human
acccuuguggucccaccccacac

SEQ ID NO: 1628787 - RNA, 17 nt, Human
acccuugccgucuaccu

SEQ ID NO: 1628788 - RNA, 15 nt, Human
accgaaaacguggcu

SEQ ID NO: 1628789 - RNA, 14 nt, Human
acccugaggcccag

SEQ ID NO: 1628790 - RNA, 18 nt, Human
acccugaaagcccugagc

SEQ ID NO: 1628791 - RNA, 16 nt, Human
acccugaaagcccuga

SEQ ID NO: 1628792 - RNA, 16 nt, Human
accuagggugauauua

SEQ ID NO: 1628793 - RNA, 16 nt, Human
accgcagacaggacca

SEQ ID NO: 1628794 - RNA, 12 nt, Human
accgcagacagg

SEQ ID NO: 1628795 - RNA, 17 nt, Human
accgcagacaggaccag

SEQ ID NO: 1628796 - RNA, 20 nt, Human
accucccacaaaggagagcu

SEQ ID NO: 1628797 - RNA, 17 nt, Human
ucaugaaagauucaaug

SEQ ID NO: 1628798 - RNA, 16 nt, Human
ucaugaaagauucaau

SEQ ID NO: 1628799 - RNA, 14 nt, Human
ucaugcaaacuuua

SEQ ID NO: 1628800 - RNA, 11 nt, Human
ucaugauuuuu

SEQ ID NO: 1628801 - RNA, 13 nt, Human
ucaucuaggauuu

SEQ ID NO: 1628802 - RNA, 13 nt, Human
ucauccauccagg

SEQ ID NO: 1628803 - RNA, 23 nt, Human
ucaugcaaacuuuauuuuguguu

SEQ ID NO: 1628804 - RNA, 16 nt, Human
ucaugugaaaucauuc

SEQ ID NO: 1628805 - RNA, 17 nt, Human
ucaugugaaaucauuca

SEQ ID NO: 1628806 - RNA, 17 nt, Human
ucaguuuuugugaaaag

SEQ ID NO: 1628807 - RNA, 15 nt, Human
ucaguuuuugugaaa

SEQ ID NO: 1628808 - RNA, 20 nt, Human
ucaguggggcccauggaugu

SEQ ID NO: 1628809 - RNA, 11 nt, Human
ucaguggcagc

SEQ ID NO: 1628810 - RNA, 18 nt, Human
ucagugccuuauggaaca

SEQ ID NO: 1628811 - RNA, 16 nt, Human
ucagugccuuauggaa

SEQ ID NO: 1628812 - RNA, 13 nt, Human
ucaguggcagcug

SEQ ID NO: 1628813 - RNA, 12 nt, Human
ucaguggcagcu

SEQ ID NO: 1628814 - RNA, 16 nt, Human
ucaguggggaggggcu

SEQ ID NO: 1628815 - RNA, 15 nt, Human
ucagugccuuaugga

SEQ ID NO: 1628816 - RNA, 14 nt, Human
ucagugccuuaugg

SEQ ID NO: 1628817 - RNA, 12 nt, Human
ucagugccuuau

SEQ ID NO: 1628818 - RNA, 11 nt, Human
ucagugccuua

SEQ ID NO: 1628819 - RNA, 10 nt, Human
ucagugccuu

SEQ ID NO: 1628820 - RNA, 9 nt, Human
ucagugccu

SEQ ID NO: 1628821 - RNA, 20 nt, Human
ucagugcccuccaggauaga

SEQ ID NO: 1628822 - RNA, 19 nt, Human
accgaaaacguggcugcuu

SEQ ID NO: 1628823 - RNA, 17 nt, Human
accgaaaacguggcugc

SEQ ID NO: 1628824 - RNA, 12 nt, Human
ucagugccacua

SEQ ID NO: 1628825 - RNA, 19 nt, Human
ucauaguaugguggcuggg

SEQ ID NO: 1628826 - RNA, 18 nt, Human
ucauaguaugguggcugg

SEQ ID NO: 1628827 - RNA, 15 nt, Human
ucauaguaugguggc

SEQ ID NO: 1628828 - RNA, 14 nt, Human
ucauaaccuagccu

SEQ ID NO: 1628829 - RNA, 18 nt, Human
ucauauaagauucauauu

SEQ ID NO: 1628830 - RNA, 21 nt, Human
ucauaguaugguggcuggguu

SEQ ID NO: 1628831 - RNA, 23 nt, Human
ucauauuuacuucuuauacauuu

SEQ ID NO: 1628832 - RNA, 15 nt, Human
ucauauuuacuucuu

SEQ ID NO: 1628833 - RNA, 16 nt, Human
ucauauuuacuucuua

SEQ ID NO: 1628834 - RNA, 15 nt, Human
ucauauuuucaugcu

SEQ ID NO: 1628835 - RNA, 17 nt, Human
accgagucucuucucca

SEQ ID NO: 1628836 - RNA, 16 nt, Human
accgagucucuucucc

SEQ ID NO: 1628837 - RNA, 18 nt, Human
accuuuguccccaccgca

SEQ ID NO: 1628838 - RNA, 22 nt, Human
accuuuguuugcaucugaaaau

SEQ ID NO: 1628839 - RNA, 17 nt, Human
accuuuguccccaccgc

SEQ ID NO: 1628840 - RNA, 18 nt, Human
accuuugacaaagguaaa

SEQ ID NO: 1628841 - RNA, 17 nt, Human
accuuugacaaagguaa

SEQ ID NO: 1628842 - RNA, 19 nt, Human
accuugaaaacuuuaugcu

SEQ ID NO: 1628843 - RNA, 20 nt, Human
accuugaacuggguacuugu

SEQ ID NO: 1628844 - RNA, 22 nt, Human
uccacugguucuucuuggucuc

SEQ ID NO: 1628845 - RNA, 21 nt, Human
uccacugugccaugugccagg

SEQ ID NO: 1628846 - RNA, 18 nt, Human
uccagaauggucuuucua

SEQ ID NO: 1628847 - RNA, 20 nt, Human
accuuuuggucuggagggaa

SEQ ID NO: 1628848 - RNA, 13 nt, Human
accuuuuuuauac

SEQ ID NO: 1628849 - RNA, 21 nt, Human
uccaggcugggagagccuucc

SEQ ID NO: 1628850 - RNA, 20 nt, Human
uccaggcugggagagccuuc

SEQ ID NO: 1628851 - RNA, 22 nt, Human
uccaggcuccuuuagcgcccag

SEQ ID NO: 1628852 - RNA, 12 nt, Human
uccaggcuccuu

SEQ ID NO: 1628853 - RNA, 10 nt, Human
uccaggcucc

SEQ ID NO: 1628854 - RNA, 18 nt, Human
acgaauauugcugauggu

SEQ ID NO: 1628855 - RNA, 15 nt, Human
acgaauauugcugau

SEQ ID NO: 1628856 - RNA, 23 nt, Human
uccaggcugggagagccuuccag

SEQ ID NO: 1628857 - RNA, 14 nt, Human
uccaggcuguaucc

SEQ ID NO: 1628858 - RNA, 15 nt, Human
uccagaauuucccaa

SEQ ID NO: 1628859 - RNA, 14 nt, Human
uccagaauuuccca

SEQ ID NO: 1628860 - RNA, 16 nt, Human
uccagaauuucccaaa

SEQ ID NO: 1628861 - RNA, 13 nt, Human
uccagaccccugg

SEQ ID NO: 1628862 - RNA, 11 nt, Human
uccagccuggg

SEQ ID NO: 1628863 - RNA, 20 nt, Human
uccagccugcugccugcuuu

SEQ ID NO: 1628864 - RNA, 14 nt, Human
acgcucucuggccu

SEQ ID NO: 1628865 - RNA, 11 nt, Human
acgcucucugg

SEQ ID NO: 1628866 - RNA, 13 nt, Human
acgcuggaccuug

SEQ ID NO: 1628867 - RNA, 15 nt, Human
acgcuccuuccucug

SEQ ID NO: 1628868 - RNA, 14 nt, Human
acgcuccuuccucu

SEQ ID NO: 1628869 - RNA, 16 nt, Human
acgcuggagugcagug

SEQ ID NO: 1628870 - RNA, 15 nt, Human
acgcuggagugcagu

SEQ ID NO: 1628871 - RNA, 23 nt, Human
acgcuggaccuugaacuggguac

SEQ ID NO: 1628872 - RNA, 20 nt, Human
acgcuggaccuugaacuggg

SEQ ID NO: 1628873 - RNA, 18 nt, Human
acgcuggagugcagugag

SEQ ID NO: 1628874 - RNA, 17 nt, Human
acgcuggagugcaguga

SEQ ID NO: 1628875 - RNA, 23 nt, Human
acggagucccaccuuggcugcag

SEQ ID NO: 1628876 - RNA, 21 nt, Human
acgaauauugcugauggugca

SEQ ID NO: 1628877 - RNA, 21 nt, Human
acgcuacccgggaagggggcu

SEQ ID NO: 1628878 - RNA, 20 nt, Human
acgcgugcacacaccagagc

SEQ ID NO: 1628879 - RNA, 18 nt, Human
uccagugagacagcucug

SEQ ID NO: 1628880 - RNA, 15 nt, Human
uccagugaggcucug

SEQ ID NO: 1628881 - RNA, 17 nt, Human
uccagugaggcucugcc

SEQ ID NO: 1628882 - RNA, 16 nt, Human
uccagugaggcucugc

SEQ ID NO: 1628883 - RNA, 23 nt, Human
uccagugaggcucugcccuuggu

SEQ ID NO: 1628884 - RNA, 22 nt, Human
uccagugaggcucugcccuugg

SEQ ID NO: 1628885 - RNA, 18 nt, Human
uccaguaucuugaagacu

SEQ ID NO: 1628886 - RNA, 16 nt, Human
uccaguaucuugaaga

SEQ ID NO: 1628887 - RNA, 15 nt, Human
uccaguaucuugaag

SEQ ID NO: 1628888 - RNA, 14 nt, Human
uccaguaucuugaa

SEQ ID NO: 1628889 - RNA, 18 nt, Human
acggcuuuuacuuaaacc

SEQ ID NO: 1628890 - RNA, 18 nt, Human
acggcucacugcagccuc

SEQ ID NO: 1628891 - RNA, 17 nt, Human
acggcucacugcagccu

SEQ ID NO: 1628892 - RNA, 16 nt, Human
acggcucacugcagcc

SEQ ID NO: 1628893 - RNA, 13 nt, Human
acggccaggccag

SEQ ID NO: 1628894 - RNA, 12 nt, Human
acggccaggcca

SEQ ID NO: 1628895 - RNA, 14 nt, Human
acggaugauuucua

SEQ ID NO: 1628896 - RNA, 13 nt, Human
acggaugauuucu

SEQ ID NO: 1628897 - RNA, 15 nt, Human
acuaauuuuaaaaug

SEQ ID NO: 1628898 - RNA, 22 nt, Human
acguuucuaaaggcuaccuuug

SEQ ID NO: 1628899 - RNA, 18 nt, Human
ucccagauacuugggggg

SEQ ID NO: 1628900 - RNA, 16 nt, Human
ucccagauacuugggg

SEQ ID NO: 1628901 - RNA, 15 nt, Human
uccauccugaggcuc

SEQ ID NO: 1628902 - RNA, 12 nt, Human
uccauccugagg

SEQ ID NO: 1628903 - RNA, 19 nt, Human
uccauccugaggcuccacu

SEQ ID NO: 1628904 - RNA, 16 nt, Human
acggugaauggcuuug

SEQ ID NO: 1628905 - RNA, 20 nt, Human
acggugaauggcuuuguaua

SEQ ID NO: 1628906 - RNA, 19 nt, Human
acggugaauggcuuuguau

SEQ ID NO: 1628907 - RNA, 16 nt, Human
acguuucuaaaggcua

SEQ ID NO: 1628908 - RNA, 14 nt, Human
acguugugcauuug

SEQ ID NO: 1628909 - RNA, 15 nt, Human
acguugugcauuugg

SEQ ID NO: 1628910 - RNA, 13 nt, Human
acguugugcauuu

SEQ ID NO: 1628911 - RNA, 15 nt, Human
acguuaccaggcagg

SEQ ID NO: 1628912 - RNA, 21 nt, Human
acguggcugcuucaaggaucc

SEQ ID NO: 1628913 - RNA, 19 nt, Human
acguggcugcuucaaggau

SEQ ID NO: 1628914 - RNA, 18 nt, Human
acguggcugcuucaagga

SEQ ID NO: 1628915 - RNA, 22 nt, Human
acuauauuguuugcuaagcauu

SEQ ID NO: 1628916 - RNA, 17 nt, Human
acuauauuguuugcuaa

SEQ ID NO: 1628917 - RNA, 22 nt, Human
acuauagccuaggugacagagu

SEQ ID NO: 1628918 - RNA, 20 nt, Human
acuauagccuaggugacaga

SEQ ID NO: 1628919 - RNA, 15 nt, Human
acuaucucauuucca

SEQ ID NO: 1628920 - RNA, 21 nt, Human
acuaucuaaauguugaaagau

SEQ ID NO: 1628921 - RNA, 16 nt, Human
acuaucuaaauguuga

SEQ ID NO: 1628922 - RNA, 17 nt, Human
acuaucucauuuccaag

SEQ ID NO: 1628923 - RNA, 16 nt, Human
acuaucucauuuccaa

SEQ ID NO: 1628924 - RNA, 16 nt, Human
acucaaugcacugaca

SEQ ID NO: 1628925 - RNA, 15 nt, Human
acucaauuuuaacaa

SEQ ID NO: 1628926 - RNA, 12 nt, Human
acucaauuuuaa

SEQ ID NO: 1628927 - RNA, 14 nt, Human
acuauguugcccag

SEQ ID NO: 1628928 - RNA, 22 nt, Human
acuauggcccuggccuagcaua

SEQ ID NO: 1628929 - RNA, 16 nt, Human
acuauguugcccaggc

SEQ ID NO: 1628930 - RNA, 15 nt, Human
acuauguugcccagg

SEQ ID NO: 1628931 - RNA, 17 nt, Human
acuauguugcccaggca

SEQ ID NO: 1628932 - RNA, 18 nt, Human
uccccaggaggccagccu

SEQ ID NO: 1628933 - RNA, 16 nt, Human
uccccaccgcagacag

SEQ ID NO: 1628934 - RNA, 15 nt, Human
uccccaccgcagaca

SEQ ID NO: 1628935 - RNA, 23 nt, Human
uccccacccugaaagcccugagc

SEQ ID NO: 1628936 - RNA, 21 nt, Human
uccccaggaggccagccuuga

SEQ ID NO: 1628937 - RNA, 20 nt, Human
uccccaggaggccagccuug

SEQ ID NO: 1628938 - RNA, 23 nt, Human
uccccaggaggccagccuugacc

SEQ ID NO: 1628939 - RNA, 11 nt, Human
ucccccagccc

SEQ ID NO: 1628940 - RNA, 15 nt, Human
ucccccagccccauc

SEQ ID NO: 1628941 - RNA, 13 nt, Human
ucccccagcccca

SEQ ID NO: 1628942 - RNA, 16 nt, Human
ucccccagccccaucc

SEQ ID NO: 1628943 - RNA, 19 nt, Human
acuagacucccaagcugga

SEQ ID NO: 1628944 - RNA, 16 nt, Human
uccuggaaaucagggu

SEQ ID NO: 1628945 - RNA, 15 nt, Human
uccuggaaauauuaa

SEQ ID NO: 1628946 - RNA, 22 nt, Human
uccuggaauaucuccgucaacu

SEQ ID NO: 1628947 - RNA, 23 nt, Human
uccuggaagugcuaauuuugaaa

SEQ ID NO: 1628948 - RNA, 17 nt, Human
uccugggagugagcugg

SEQ ID NO: 1628949 - RNA, 14 nt, Human
uccugggagugagc

SEQ ID NO: 1628950 - RNA, 12 nt, Human
uccugggaguga

SEQ ID NO: 1628951 - RNA, 15 nt, Human
uccugggagcuuuug

SEQ ID NO: 1628952 - RNA, 15 nt, Human
uccugcaggcagcca

SEQ ID NO: 1628953 - RNA, 14 nt, Human
uccugcaggcagcc

SEQ ID NO: 1628954 - RNA, 13 nt, Human
uccugcaggcagc

SEQ ID NO: 1628955 - RNA, 12 nt, Human
uccugcaggcag

SEQ ID NO: 1628956 - RNA, 13 nt, Human
uccugcugggcag

SEQ ID NO: 1628957 - RNA, 20 nt, Human
acugcacuauagccuaggug

SEQ ID NO: 1628958 - RNA, 16 nt, Human
acugcaccgggccaca

SEQ ID NO: 1628959 - RNA, 14 nt, Human
acugcaccgggcca

SEQ ID NO: 1628960 - RNA, 23 nt, Human
acugcacagugcaucucagccca

SEQ ID NO: 1628961 - RNA, 13 nt, Human
acugauaaagaug

SEQ ID NO: 1628962 - RNA, 21 nt, Human
acugauaaagaugagugagca

SEQ ID NO: 1628963 - RNA, 20 nt, Human
acugcaacuuguaaaugugg

SEQ ID NO: 1628964 - RNA, 20 nt, Human
acugcacuccagccugggug

SEQ ID NO: 1628965 - RNA, 19 nt, Human
acugcacuccagccugggu

SEQ ID NO: 1628966 - RNA, 18 nt, Human
acugcacuccagccuggg

SEQ ID NO: 1628967 - RNA, 17 nt, Human
acugcacuccagccugg

SEQ ID NO: 1628968 - RNA, 14 nt, Human
acugcacuccagcc

SEQ ID NO: 1628969 - RNA, 21 nt, Human
acugcacuauagccuagguga

SEQ ID NO: 1628970 - RNA, 21 nt, Human
uccugaugcuucuucagagac

SEQ ID NO: 1628971 - RNA, 20 nt, Human
uccugaugcuucuucagaga

SEQ ID NO: 1628972 - RNA, 19 nt, Human
uccugaugcuucuucagag

SEQ ID NO: 1628973 - RNA, 13 nt, Human
acugcacuguuuu

SEQ ID NO: 1628974 - RNA, 22 nt, Human
uccugcacacgcuccuuccucu

SEQ ID NO: 1628975 - RNA, 21 nt, Human
uccugcacacgcuccuuccuc

SEQ ID NO: 1628976 - RNA, 14 nt, Human
uccugcacacgcuc

SEQ ID NO: 1628977 - RNA, 17 nt, Human
acugagaugugaacaca

SEQ ID NO: 1628978 - RNA, 22 nt, Human
acugagaugugaacacaucagc

SEQ ID NO: 1628979 - RNA, 18 nt, Human
acugagagugaacaaauu

SEQ ID NO: 1628980 - RNA, 23 nt, Human
acugagacagcccgggcucugcc

SEQ ID NO: 1628981 - RNA, 22 nt, Human
acugagacagcccgggcucugc

SEQ ID NO: 1628982 - RNA, 21 nt, Human
acugagacagcccgggcucug

SEQ ID NO: 1628983 - RNA, 18 nt, Human
acugagacagcccgggcu

SEQ ID NO: 1628984 - RNA, 15 nt, Human
acugagacagcccgg

SEQ ID NO: 1628985 - RNA, 21 nt, Human
acugagaaauuuauaaacuuu

SEQ ID NO: 1628986 - RNA, 17 nt, Human
acugagaaauuuauaaa

SEQ ID NO: 1628987 - RNA, 12 nt, Human
acugagaaauuu

SEQ ID NO: 1628988 - RNA, 22 nt, Human
acugacuucuaaguaaaaccac

SEQ ID NO: 1628989 - RNA, 16 nt, Human
acugacuucuaaguaa

SEQ ID NO: 1628990 - RNA, 15 nt, Human
acugacuucuaagua

SEQ ID NO: 1628991 - RNA, 13 nt, Human
acugacuucuaag

SEQ ID NO: 1628992 - RNA, 20 nt, Human
acugacucuuaagaagacug

SEQ ID NO: 1628993 - RNA, 18 nt, Human
acugacucuuaagaagac

SEQ ID NO: 1628994 - RNA, 17 nt, Human
acugacucuuaagaaga

SEQ ID NO: 1628995 - RNA, 16 nt, Human
acugacucuuaagaag

SEQ ID NO: 1628996 - RNA, 15 nt, Human
acugacucuuaagaa

SEQ ID NO: 1628997 - RNA, 14 nt, Human
acugacucuuaaga

SEQ ID NO: 1628998 - RNA, 13 nt, Human
acugacucuuaag

SEQ ID NO: 1628999 - RNA, 12 nt, Human
acugaagaagca

SEQ ID NO: 1629000 - RNA, 12 nt, Human
uccucuuuccau

SEQ ID NO: 1629001 - RNA, 11 nt, Human
uccucuuucca

SEQ ID NO: 1629002 - RNA, 14 nt, Human
uccucccucccucu

SEQ ID NO: 1629003 - RNA, 11 nt, Human
uccucccuccc

SEQ ID NO: 1629004 - RNA, 21 nt, Human
uccucuuuggucuacacugug

SEQ ID NO: 1629005 - RNA, 19 nt, Human
uccucuuuggucuacacug

SEQ ID NO: 1629006 - RNA, 19 nt, Human
uccucuuuccaucuacccu

SEQ ID NO: 1629007 - RNA, 23 nt, Human
uccucuuuggucuacacugugcu

SEQ ID NO: 1629008 - RNA, 22 nt, Human
uccucuuuggucuacacugugc

SEQ ID NO: 1629009 - RNA, 21 nt, Human
uccugaauuuuauuuuuuggg

SEQ ID NO: 1629010 - RNA, 19 nt, Human
acucuuucuauuguuucuu

SEQ ID NO: 1629011 - RNA, 15 nt, Human
acucuuguuuccuua

SEQ ID NO: 1629012 - RNA, 20 nt, Human
acugaacucugacaacagac

SEQ ID NO: 1629013 - RNA, 21 nt, Human
acucuuaagaagacugcauua

SEQ ID NO: 1629014 - RNA, 14 nt, Human
acucuugaccucag

SEQ ID NO: 1629015 - RNA, 22 nt, Human
acucuuauaucuauauuuuaca

SEQ ID NO: 1629016 - RNA, 18 nt, Human
acucuuauaucuauauuu

SEQ ID NO: 1629017 - RNA, 17 nt, Human
acucuuauaucuauauu

SEQ ID NO: 1629018 - RNA, 16 nt, Human
acucuuauaucuauau

SEQ ID NO: 1629019 - RNA, 16 nt, Human
acucuugaccucaggu

SEQ ID NO: 1629020 - RNA, 15 nt, Human
acucuugaccucagg

SEQ ID NO: 1629021 - RNA, 19 nt, Human
acucuuauaucuauauuuu

SEQ ID NO: 1629022 - RNA, 23 nt, Human
uccucauacccacccccacccaa

SEQ ID NO: 1629023 - RNA, 22 nt, Human
uccucauaguaugguggcuggg

SEQ ID NO: 1629024 - RNA, 13 nt, Human
uccucccaggcgc

SEQ ID NO: 1629025 - RNA, 21 nt, Human
uccucccaggcgccccuuccc

SEQ ID NO: 1629026 - RNA, 19 nt, Human
uccucccaggcgccccuuc

SEQ ID NO: 1629027 - RNA, 15 nt, Human
acucuccuugguguc

SEQ ID NO: 1629028 - RNA, 18 nt, Human
acucuccuggaaauauua

SEQ ID NO: 1629029 - RNA, 16 nt, Human
acucuccucugcugcu

SEQ ID NO: 1629030 - RNA, 14 nt, Human
acucuccucugcug

SEQ ID NO: 1629031 - RNA, 13 nt, Human
acucuccucugcu

SEQ ID NO: 1629032 - RNA, 12 nt, Human
acucuccucugc

SEQ ID NO: 1629033 - RNA, 17 nt, Human
acucuccuccagaguca

SEQ ID NO: 1629034 - RNA, 14 nt, Human
acucuccuccagag

SEQ ID NO: 1629035 - RNA, 24 nt, Human
acuccuugaaaacacuguucucug

SEQ ID NO: 1629036 - RNA, 23 nt, Human
acuccuugaaaacacuguucucu

SEQ ID NO: 1629037 - RNA, 15 nt, Human
acucuggcagcucag

SEQ ID NO: 1629038 - RNA, 13 nt, Human
acucuggcagcuc

SEQ ID NO: 1629039 - RNA, 16 nt, Human
acucugccuccucuuc

SEQ ID NO: 1629040 - RNA, 12 nt, Human
acucugccuccu

SEQ ID NO: 1629041 - RNA, 23 nt, Human
acucuccuuggugucgggcauga

SEQ ID NO: 1629042 - RNA, 16 nt, Human
acucuccuuggugucg

SEQ ID NO: 1629043 - RNA, 22 nt, Human
acucugagacucgcgacaaugc

SEQ ID NO: 1629044 - RNA, 11 nt, Human
acucugagacu

SEQ ID NO: 1629045 - RNA, 11 nt, Human
acuccuggccu

SEQ ID NO: 1629046 - RNA, 17 nt, Human
ucccugguggcagcuca

SEQ ID NO: 1629047 - RNA, 16 nt, Human
ucccugguggcagcuc

SEQ ID NO: 1629048 - RNA, 21 nt, Human
ucccugguggcagcucaccuc

SEQ ID NO: 1629049 - RNA, 20 nt, Human
ucccugguggcagcucaccu

SEQ ID NO: 1629050 - RNA, 19 nt, Human
ucccugguggcagcucacc

SEQ ID NO: 1629051 - RNA, 18 nt, Human
ucccugguggcagcucac

SEQ ID NO: 1629052 - RNA, 16 nt, Human
acuccugcaggcagcc

SEQ ID NO: 1629053 - RNA, 15 nt, Human
acuccugcaggcagc

SEQ ID NO: 1629054 - RNA, 22 nt, Human
acuccugcaggcagccaggcca

SEQ ID NO: 1629055 - RNA, 17 nt, Human
acuccugcaggcagcca

SEQ ID NO: 1629056 - RNA, 14 nt, Human
acuccugcaggcag

SEQ ID NO: 1629057 - RNA, 12 nt, Human
acuccucccagg

SEQ ID NO: 1629058 - RNA, 15 nt, Human
acucaccccagcccc

SEQ ID NO: 1629059 - RNA, 14 nt, Human
acucaccccagccc

SEQ ID NO: 1629060 - RNA, 16 nt, Human
acucaccccagcccca

SEQ ID NO: 1629061 - RNA, 15 nt, Human
acuccagaccccugg

SEQ ID NO: 1629062 - RNA, 13 nt, Human
acucaccccagcc

SEQ ID NO: 1629063 - RNA, 21 nt, Human
acuccagaccccuggcuuuuc

SEQ ID NO: 1629064 - RNA, 19 nt, Human
acuccagaccccuggcuuu

SEQ ID NO: 1629065 - RNA, 18 nt, Human
acuccagaccccuggcuu

SEQ ID NO: 1629066 - RNA, 14 nt, Human
acuccuggccucaa

SEQ ID NO: 1629067 - RNA, 13 nt, Human
acuccuggccuca

SEQ ID NO: 1629068 - RNA, 13 nt, Human
uccuaggcauuug

SEQ ID NO: 1629069 - RNA, 15 nt, Human
uccuacucuguguca

SEQ ID NO: 1629070 - RNA, 14 nt, Human
uccuacucuguguc

SEQ ID NO: 1629071 - RNA, 13 nt, Human
uccuacucugugu

SEQ ID NO: 1629072 - RNA, 21 nt, Human
ucccuuuuuuuaaguaaggaa

SEQ ID NO: 1629073 - RNA, 16 nt, Human
ucccuuuuuuuaagua

SEQ ID NO: 1629074 - RNA, 18 nt, Human
uccgguguuuaagacauu

SEQ ID NO: 1629075 - RNA, 20 nt, Human
ucccuuggauuguccccgac

SEQ ID NO: 1629076 - RNA, 19 nt, Human
ucccuuggauuguccccga

SEQ ID NO: 1629077 - RNA, 23 nt, Human
ucccugguggcagcucaccucuc

SEQ ID NO: 1629078 - RNA, 22 nt, Human
ucccugguggcagcucaccucu

SEQ ID NO: 1629079 - RNA, 18 nt, Human
ucccuuugacgccauccc

SEQ ID NO: 1629080 - RNA, 16 nt, Human
ucccuuugacgccauc

SEQ ID NO: 1629081 - RNA, 12 nt, Human
acuccuggccuc

SEQ ID NO: 1629082 - RNA, 19 nt, Human
ucccuuuuuuggcugcuga

SEQ ID NO: 1629083 - RNA, 17 nt, Human
ucccuuuuuuggcugcu

SEQ ID NO: 1629084 - RNA, 19 nt, Human
ucccuuugacgccauccca

SEQ ID NO: 1629085 - RNA, 21 nt, Human
ucccuuugacgccaucccagc

SEQ ID NO: 1629086 - RNA, 22 nt, Human
ucccuuuuuuggcugcugaagg

SEQ ID NO: 1629087 - RNA, 20 nt, Human
ucccuuuuuuggcugcugaa

SEQ ID NO: 1629088 - RNA, 23 nt, Human
ucccuuuuuuggcugcugaaggc

SEQ ID NO: 1629089 - RNA, 13 nt, Human
ucccuuuuuuuaa

SEQ ID NO: 1629090 - RNA, 16 nt, Human
agaauagaugcugacu

SEQ ID NO: 1629091 - RNA, 17 nt, Human
agaauaaaauuuuuaau

SEQ ID NO: 1629092 - RNA, 14 nt, Human
agaauaaaauuuuu

SEQ ID NO: 1629093 - RNA, 12 nt, Human
agaauaaaauuu

SEQ ID NO: 1629094 - RNA, 18 nt, Human
ucugcuuuccucuuccug

SEQ ID NO: 1629095 - RNA, 13 nt, Human
ucugcuuuccucu

SEQ ID NO: 1629096 - RNA, 12 nt, Human
ucugcuuuccuc

SEQ ID NO: 1629097 - RNA, 23 nt, Human
agaaguuucugccgcagcccugc

SEQ ID NO: 1629098 - RNA, 22 nt, Human
agaaguuucugccgcagcccug

SEQ ID NO: 1629099 - RNA, 21 nt, Human
agaaguuucugccgcagcccu

SEQ ID NO: 1629100 - RNA, 20 nt, Human
agaaguggggacagagcaga

SEQ ID NO: 1629101 - RNA, 15 nt, Human
agaauuaacacauga

SEQ ID NO: 1629102 - RNA, 23 nt, Human
agaauuaacacaugauccugcaa

SEQ ID NO: 1629103 - RNA, 23 nt, Human
agaaugguccgugcuaaggacuu

SEQ ID NO: 1629104 - RNA, 21 nt, Human
agaaugguccgugcuaaggac

SEQ ID NO: 1629105 - RNA, 15 nt, Human
ucugggccagaauuu

SEQ ID NO: 1629106 - RNA, 14 nt, Human
ucugggccagaauu

SEQ ID NO: 1629107 - RNA, 14 nt, Human
ucugugagaugcua

SEQ ID NO: 1629108 - RNA, 18 nt, Human
ucugugaacuugaaauuu

SEQ ID NO: 1629109 - RNA, 17 nt, Human
ucugugaacuugaaauu

SEQ ID NO: 1629110 - RNA, 14 nt, Human
ucugugaacuugaa

SEQ ID NO: 1629111 - RNA, 22 nt, Human
ucugugagaugcuagaacuccc

SEQ ID NO: 1629112 - RNA, 17 nt, Human
ucugugagaugcuagaa

SEQ ID NO: 1629113 - RNA, 23 nt, Human
ucugugagaugcuagaacucccu

SEQ ID NO: 1629114 - RNA, 13 nt, Human
ucuguuuagauaa

SEQ ID NO: 1629115 - RNA, 14 nt, Human
agaauucuguauag

SEQ ID NO: 1629116 - RNA, 17 nt, Human
ucuguuggccaguguga

SEQ ID NO: 1629117 - RNA, 12 nt, Human
ucuguuggccag

SEQ ID NO: 1629118 - RNA, 15 nt, Human
ucuguugcugccuca

SEQ ID NO: 1629119 - RNA, 22 nt, Human
ucuguucuuuccaaaguacacu

SEQ ID NO: 1629120 - RNA, 13 nt, Human
ucuguucuuucca

SEQ ID NO: 1629121 - RNA, 15 nt, Human
agacacacaugaagu

SEQ ID NO: 1629122 - RNA, 12 nt, Human
agacacacauga

SEQ ID NO: 1629123 - RNA, 16 nt, Human
agacacaggcccggcu

SEQ ID NO: 1629124 - RNA, 13 nt, Human
agacacaggcccg

SEQ ID NO: 1629125 - RNA, 12 nt, Human
agacacaggccc

SEQ ID NO: 1629126 - RNA, 21 nt, Human
agaauuugauaugugaacagu

SEQ ID NO: 1629127 - RNA, 22 nt, Human
agaauuugauaugugaacaguu

SEQ ID NO: 1629128 - RNA, 20 nt, Human
agacacauguccaagaagcc

SEQ ID NO: 1629129 - RNA, 16 nt, Human
agacacauguccaaga

SEQ ID NO: 1629130 - RNA, 17 nt, Human
agacaccuugacagggc

SEQ ID NO: 1629131 - RNA, 18 nt, Human
agacaccuugacagggca

SEQ ID NO: 1629132 - RNA, 19 nt, Human
agacaccuugacagggcac

SEQ ID NO: 1629133 - RNA, 13 nt, Human
agacagagcuaca

SEQ ID NO: 1629134 - RNA, 16 nt, Human
ucugcuugccaucccu

SEQ ID NO: 1629135 - RNA, 17 nt, Human
ucugcuugccaucccuc

SEQ ID NO: 1629136 - RNA, 20 nt, Human
ucugcuugccaucccucccu

SEQ ID NO: 1629137 - RNA, 23 nt, Human
ucugcuugccaucccucccucca

SEQ ID NO: 1629138 - RNA, 15 nt, Human
ucugcuucagccucc

SEQ ID NO: 1629139 - RNA, 14 nt, Human
ucugcuucagccuc

SEQ ID NO: 1629140 - RNA, 20 nt, Human
ucugcucacauaucugucau

SEQ ID NO: 1629141 - RNA, 19 nt, Human
ucugcucacauaucuguca

SEQ ID NO: 1629142 - RNA, 22 nt, Human
ucugccugcccaggccccugcc

SEQ ID NO: 1629143 - RNA, 21 nt, Human
ucugccugcccaggccccugc

SEQ ID NO: 1629144 - RNA, 22 nt, Human
ucugccgcagcccugcagaggg

SEQ ID NO: 1629145 - RNA, 23 nt, Human
ucugccgcagcccugcagagggc

SEQ ID NO: 1629146 - RNA, 19 nt, Human
ucugcccuccaagaccuuc

SEQ ID NO: 1629147 - RNA, 23 nt, Human
ucugcccacucccugcaaccuga

SEQ ID NO: 1629148 - RNA, 21 nt, Human
ucugcccacucccugcaaccu

SEQ ID NO: 1629149 - RNA, 18 nt, Human
ucugcccacucccugcaa

SEQ ID NO: 1629150 - RNA, 15 nt, Human
ucugccgcagcccug

SEQ ID NO: 1629151 - RNA, 14 nt, Human
ucugccgcagcccu

SEQ ID NO: 1629152 - RNA, 10 nt, Human
ucugcccugc

SEQ ID NO: 1629153 - RNA, 12 nt, Human
ucugcccugcgg

SEQ ID NO: 1629154 - RNA, 11 nt, Human
ucugcccugcg

SEQ ID NO: 1629155 - RNA, 19 nt, Human
agaagcaacccaaauguuc

SEQ ID NO: 1629156 - RNA, 18 nt, Human
agaagauuuugaaauuuu

SEQ ID NO: 1629157 - RNA, 17 nt, Human
ucugcccacucccugca

SEQ ID NO: 1629158 - RNA, 23 nt, Human
agaagcccaggaaaggcuccagg

SEQ ID NO: 1629159 - RNA, 22 nt, Human
agaagcccaggaaaggcuccag

SEQ ID NO: 1629160 - RNA, 21 nt, Human
agaagcccaggaaaggcucca

SEQ ID NO: 1629161 - RNA, 20 nt, Human
agaagcccaggaaaggcucc

SEQ ID NO: 1629162 - RNA, 18 nt, Human
agaagcccaggaaaggcu

SEQ ID NO: 1629163 - RNA, 16 nt, Human
agaagcccaggaaagg

SEQ ID NO: 1629164 - RNA, 12 nt, Human
agaagcccagga

SEQ ID NO: 1629165 - RNA, 14 nt, Human
agaagaacugaaau

SEQ ID NO: 1629166 - RNA, 13 nt, Human
agaagaacugaaa

SEQ ID NO: 1629167 - RNA, 18 nt, Human
agaagaugguaccaccag

SEQ ID NO: 1629168 - RNA, 20 nt, Human
agaaauugcauuuccugaca

SEQ ID NO: 1629169 - RNA, 17 nt, Human
agaaauugcauuuccug

SEQ ID NO: 1629170 - RNA, 18 nt, Human
ucugcagauaaacaguag

SEQ ID NO: 1629171 - RNA, 18 nt, Human
ucugcagcaauaaagcag

SEQ ID NO: 1629172 - RNA, 17 nt, Human
ucugcagcaauaaagca

SEQ ID NO: 1629173 - RNA, 15 nt, Human
ucugcacuccccugc

SEQ ID NO: 1629174 - RNA, 14 nt, Human
ucugcacuccccug

SEQ ID NO: 1629175 - RNA, 16 nt, Human
ucugcacuccccugcu

SEQ ID NO: 1629176 - RNA, 17 nt, Human
ucugcacuccccugcug

SEQ ID NO: 1629177 - RNA, 21 nt, Human
ucugaugcaagcaagaaacac

SEQ ID NO: 1629178 - RNA, 14 nt, Human
agaaauguacagca

SEQ ID NO: 1629179 - RNA, 15 nt, Human
agaaauguacagcaa

SEQ ID NO: 1629180 - RNA, 14 nt, Human
ucugcaggucccua

SEQ ID NO: 1629181 - RNA, 13 nt, Human
ucugcaggucccu

SEQ ID NO: 1629182 - RNA, 12 nt, Human
ucugcagguccc

SEQ ID NO: 1629183 - RNA, 11 nt, Human
ucugcaggucc

SEQ ID NO: 1629184 - RNA, 21 nt, Human
ucugaucauccacugugccau

SEQ ID NO: 1629185 - RNA, 11 nt, Human
ucugauccagu

SEQ ID NO: 1629186 - RNA, 17 nt, Human
ucugaucauccacugug

SEQ ID NO: 1629187 - RNA, 21 nt, Human
ucugauccaguuuuguuugga

SEQ ID NO: 1629188 - RNA, 14 nt, Human
ucugauccaguuuu

SEQ ID NO: 1629189 - RNA, 16 nt, Human
ucugaugcaagcaaga

SEQ ID NO: 1629190 - RNA, 21 nt, Human
ucugagacucgcgacaaugca

SEQ ID NO: 1629191 - RNA, 22 nt, Human
ucugagacucgcgacaaugcaa

SEQ ID NO: 1629192 - RNA, 21 nt, Human
ucugaaggacauugcggacag

SEQ ID NO: 1629193 - RNA, 22 nt, Human
ucugaaggacauugcggacagc

SEQ ID NO: 1629194 - RNA, 10 nt, Human
ucugaauuau

SEQ ID NO: 1629195 - RNA, 15 nt, Human
ucugacacacagcuc

SEQ ID NO: 1629196 - RNA, 14 nt, Human
ucugacacacagcu

SEQ ID NO: 1629197 - RNA, 13 nt, Human
ucugacacacagc

SEQ ID NO: 1629198 - RNA, 15 nt, Human
ucugaauuauuuucu

SEQ ID NO: 1629199 - RNA, 16 nt, Human
ucuccuuucacaaccu

SEQ ID NO: 1629200 - RNA, 13 nt, Human
ucuagauacugua

SEQ ID NO: 1629201 - RNA, 18 nt, Human
ucuagcauggcugccaau

SEQ ID NO: 1629202 - RNA, 16 nt, Human
acuucaucccucuggg

SEQ ID NO: 1629203 - RNA, 19 nt, Human
acuuccccuuccuaauucc

SEQ ID NO: 1629204 - RNA, 13 nt, Human
acuuccccuuccu

SEQ ID NO: 1629205 - RNA, 16 nt, Human
ucuaggaaauauuuau

SEQ ID NO: 1629206 - RNA, 13 nt, Human
ucuagccagagga

SEQ ID NO: 1629207 - RNA, 17 nt, Human
ucuaggaaauauuuauu

SEQ ID NO: 1629208 - RNA, 12 nt, Human
ucuaggaagacu

SEQ ID NO: 1629209 - RNA, 22 nt, Human
ucuaguuguuugauucagacag

SEQ ID NO: 1629210 - RNA, 22 nt, Human
ucuaguuugauuaaauucuugc

SEQ ID NO: 1629211 - RNA, 21 nt, Human
ucuaguuugauuaaauucuug

SEQ ID NO: 1629212 - RNA, 23 nt, Human
ucuaguuguuugauucagacagc

SEQ ID NO: 1629213 - RNA, 13 nt, Human
ucuauaaaccgaa

SEQ ID NO: 1629214 - RNA, 19 nt, Human
ucucacuauguugcccagg

SEQ ID NO: 1629215 - RNA, 17 nt, Human
ucucacuauguugccca

SEQ ID NO: 1629216 - RNA, 19 nt, Human
ucucaccuccugcugggca

SEQ ID NO: 1629217 - RNA, 17 nt, Human
ucucaccuccugcuggg

SEQ ID NO: 1629218 - RNA, 16 nt, Human
ucucaccuccugcugg

SEQ ID NO: 1629219 - RNA, 15 nt, Human
ucucaccuccugcug

SEQ ID NO: 1629220 - RNA, 14 nt, Human
ucucaccuccugcu

SEQ ID NO: 1629221 - RNA, 20 nt, Human
acuuaaauaaugugaaacug

SEQ ID NO: 1629222 - RNA, 13 nt, Human
acuuaagcacacu

SEQ ID NO: 1629223 - RNA, 17 nt, Human
acuuaaucuaaauggaa

SEQ ID NO: 1629224 - RNA, 19 nt, Human
acuuaaucuaaauggaacc

SEQ ID NO: 1629225 - RNA, 22 nt, Human
acuuaaucuaaauggaaccacu

SEQ ID NO: 1629226 - RNA, 16 nt, Human
acuuacacuuuaugca

SEQ ID NO: 1629227 - RNA, 22 nt, Human
acuuacuguacaugaaaacaca

SEQ ID NO: 1629228 - RNA, 14 nt, Human
acuuagcugggaga

SEQ ID NO: 1629229 - RNA, 17 nt, Human
acuuacacuuuaugcac

SEQ ID NO: 1629230 - RNA, 21 nt, Human
acuuacuguacaugaaaacac

SEQ ID NO: 1629231 - RNA, 15 nt, Human
acuuagguguggggg

SEQ ID NO: 1629232 - RNA, 15 nt, Human
ucuaaguaaaaccac

SEQ ID NO: 1629233 - RNA, 14 nt, Human
ucuaaguaaaacca

SEQ ID NO: 1629234 - RNA, 19 nt, Human
ucuaaguaaaaccacagca

SEQ ID NO: 1629235 - RNA, 20 nt, Human
ucuaaguaaaaccacagcag

SEQ ID NO: 1629236 - RNA, 12 nt, Human
uccugggcagcu

SEQ ID NO: 1629237 - RNA, 13 nt, Human
uccugggcagcug

SEQ ID NO: 1629238 - RNA, 14 nt, Human
uccugggcagcugc

SEQ ID NO: 1629239 - RNA, 18 nt, Human
uccugggagugagcuggu

SEQ ID NO: 1629240 - RNA, 21 nt, Human
ucuacagaggccaugggccuc

SEQ ID NO: 1629241 - RNA, 19 nt, Human
ucuacccagcgagcccugg

SEQ ID NO: 1629242 - RNA, 23 nt, Human
ucuacagcuaaucagcauucuca

SEQ ID NO: 1629243 - RNA, 20 nt, Human
ucuacagcuaaucagcauuc

SEQ ID NO: 1629244 - RNA, 18 nt, Human
acuguucucugcccucca

SEQ ID NO: 1629245 - RNA, 19 nt, Human
acuguucucugcccuccaa

SEQ ID NO: 1629246 - RNA, 17 nt, Human
acuguucucugcccucc

SEQ ID NO: 1629247 - RNA, 16 nt, Human
acuguucucugcccuc

SEQ ID NO: 1629248 - RNA, 19 nt, Human
ucuacccuggcacuauaau

SEQ ID NO: 1629249 - RNA, 14 nt, Human
ucuacccaggugcu

SEQ ID NO: 1629250 - RNA, 20 nt, Human
ucuacccagcgagcccuggu

SEQ ID NO: 1629251 - RNA, 21 nt, Human
ucuacccuggcacuauaaugu

SEQ ID NO: 1629252 - RNA, 15 nt, Human
acuugucaauaaaau

SEQ ID NO: 1629253 - RNA, 19 nt, Human
acuuguauuauguguguuu

SEQ ID NO: 1629254 - RNA, 18 nt, Human
acuuguauuauguguguu

SEQ ID NO: 1629255 - RNA, 14 nt, Human
acuugcuuuuaaaa

SEQ ID NO: 1629256 - RNA, 21 nt, Human
acuugucuuuggacccugagg

SEQ ID NO: 1629257 - RNA, 20 nt, Human
acuugucuuuggacccugag

SEQ ID NO: 1629258 - RNA, 22 nt, Human
acuuguggacacagcucuucuc

SEQ ID NO: 1629259 - RNA, 19 nt, Human
acuuguggacacagcucuu

SEQ ID NO: 1629260 - RNA, 13 nt, Human
acuuguguaaaua

SEQ ID NO: 1629261 - RNA, 18 nt, Human
ucucaccuccugcugggc

SEQ ID NO: 1629262 - RNA, 23 nt, Human
ucucacuauguugcccaggcagg

SEQ ID NO: 1629263 - RNA, 22 nt, Human
ucucacuauguugcccaggcag

SEQ ID NO: 1629264 - RNA, 21 nt, Human
ucucacuauguugcccaggca

SEQ ID NO: 1629265 - RNA, 20 nt, Human
ucucacuauguugcccaggc

SEQ ID NO: 1629266 - RNA, 22 nt, Human
acuugcagacucuacagaggcc

SEQ ID NO: 1629267 - RNA, 19 nt, Human
acuugcagacucuacagag

SEQ ID NO: 1629268 - RNA, 23 nt, Human
acuugcagacucuacagaggcca

SEQ ID NO: 1629269 - RNA, 16 nt, Human
acuugcucuugaugcc

SEQ ID NO: 1629270 - RNA, 20 nt, Human
acuugcucuugaugccuggc

SEQ ID NO: 1629271 - RNA, 18 nt, Human
acuugcucuugaugccug

SEQ ID NO: 1629272 - RNA, 17 nt, Human
acuugcucuugaugccu

SEQ ID NO: 1629273 - RNA, 21 nt, Human
ucucaggaaaucaaauaugca

SEQ ID NO: 1629274 - RNA, 14 nt, Human
ucucaggaaaucaa

SEQ ID NO: 1629275 - RNA, 23 nt, Human
ucucaggaaaucaaauaugcaaa

SEQ ID NO: 1629276 - RNA, 23 nt, Human
ucucagauuuuauuauguaaauc

SEQ ID NO: 1629277 - RNA, 22 nt, Human
ucucagauuuuauuauguaaau

SEQ ID NO: 1629278 - RNA, 13 nt, Human
ucucaggccagcu

SEQ ID NO: 1629279 - RNA, 12 nt, Human
ucucaggccagc

SEQ ID NO: 1629280 - RNA, 12 nt, Human
ucucaggccaaa

SEQ ID NO: 1629281 - RNA, 10 nt, Human
ucucaggcca

SEQ ID NO: 1629282 - RNA, 15 nt, Human
ucucauuuccaagca

SEQ ID NO: 1629283 - RNA, 14 nt, Human
ucucauuugucaca

SEQ ID NO: 1629284 - RNA, 19 nt, Human
ucucauuugccaauaauaa

SEQ ID NO: 1629285 - RNA, 16 nt, Human
ucuccaagcaggacau

SEQ ID NO: 1629286 - RNA, 13 nt, Human
ucuccaaaauaaa

SEQ ID NO: 1629287 - RNA, 16 nt, Human
ucucauuugucacaca

SEQ ID NO: 1629288 - RNA, 18 nt, Human
ucucaggccagcugcuug

SEQ ID NO: 1629289 - RNA, 17 nt, Human
ucucaggccagcugcuu

SEQ ID NO: 1629290 - RNA, 21 nt, Human
ucucaggccagcugcuugggc

SEQ ID NO: 1629291 - RNA, 20 nt, Human
ucucaugccucagccuccug

SEQ ID NO: 1629292 - RNA, 21 nt, Human
ucucaugccucagccuccuga

SEQ ID NO: 1629293 - RNA, 12 nt, Human
acuuugaccucu

SEQ ID NO: 1629294 - RNA, 13 nt, Human
acuuugaccucug

SEQ ID NO: 1629295 - RNA, 12 nt, Human
acuuuggauaau

SEQ ID NO: 1629296 - RNA, 19 nt, Human
acuuuggauaauaaggaaa

SEQ ID NO: 1629297 - RNA, 17 nt, Human
acuuuggauaauaagga

SEQ ID NO: 1629298 - RNA, 20 nt, Human
acuuuguuaguuucuccaag

SEQ ID NO: 1629299 - RNA, 14 nt, Human
acuuuguucuggcu

SEQ ID NO: 1629300 - RNA, 21 nt, Human
acuuuguuaguuucuccaagc

SEQ ID NO: 1629301 - RNA, 12 nt, Human
acuuuuguucuu

SEQ ID NO: 1629302 - RNA, 13 nt, Human
acuuuuguucuug

SEQ ID NO: 1629303 - RNA, 15 nt, Human
acuuuuguucuuggu

SEQ ID NO: 1629304 - RNA, 23 nt, Human
acuuuuguucuugguuuguaaau

SEQ ID NO: 1629305 - RNA, 15 nt, Human
ucuccuucaccuuug

SEQ ID NO: 1629306 - RNA, 14 nt, Human
ucuccuucaccuuu

SEQ ID NO: 1629307 - RNA, 17 nt, Human
agaaaaaauauuuuccc

SEQ ID NO: 1629308 - RNA, 18 nt, Human
ucuccuucaccuuugucc

SEQ ID NO: 1629309 - RNA, 16 nt, Human
ucuccuucaccuuugu

SEQ ID NO: 1629310 - RNA, 13 nt, Human
ucuccuuguguua

SEQ ID NO: 1629311 - RNA, 21 nt, Human
ucuccuuguguuacuaaguuu

SEQ ID NO: 1629312 - RNA, 23 nt, Human
ucuccgaccagacaccuugacag

SEQ ID NO: 1629313 - RNA, 17 nt, Human
ucuccgaccagacaccu

SEQ ID NO: 1629314 - RNA, 19 nt, Human
ucuccaagcaggacaugga

SEQ ID NO: 1629315 - RNA, 18 nt, Human
ucuccaagcaggacaugg

SEQ ID NO: 1629316 - RNA, 12 nt, Human
ucuccacccugc

SEQ ID NO: 1629317 - RNA, 23 nt, Human
ucuccccagcaagugagagcugg

SEQ ID NO: 1629318 - RNA, 16 nt, Human
ucuccucugcugcugg

SEQ ID NO: 1629319 - RNA, 15 nt, Human
ucuccuccagaguca

SEQ ID NO: 1629320 - RNA, 18 nt, Human
ucuccucugcugcuggcu

SEQ ID NO: 1629321 - RNA, 17 nt, Human
ucuccucugcugcuggc

SEQ ID NO: 1629322 - RNA, 20 nt, Human
acuuucugaaauaacauggc

SEQ ID NO: 1629323 - RNA, 12 nt, Human
acuuuaccuuuu

SEQ ID NO: 1629324 - RNA, 13 nt, Human
ugaccuuucaaua

SEQ ID NO: 1629325 - RNA, 12 nt, Human
ugaccuuucaau

SEQ ID NO: 1629326 - RNA, 21 nt, Human
ugacucguauaugucucaggu

SEQ ID NO: 1629327 - RNA, 17 nt, Human
agaugugaacacaucag

SEQ ID NO: 1629328 - RNA, 22 nt, Human
agauguauguacuucaugcugu

SEQ ID NO: 1629329 - RNA, 22 nt, Human
agaugugaacacaucagcuugc

SEQ ID NO: 1629330 - RNA, 15 nt, Human
ugaccuuuaagagaa

SEQ ID NO: 1629331 - RNA, 19 nt, Human
agauucauauuuacuucuu

SEQ ID NO: 1629332 - RNA, 21 nt, Human
agauuccagagaguggcuccu

SEQ ID NO: 1629333 - RNA, 22 nt, Human
agauuccagagaguggcuccuc

SEQ ID NO: 1629334 - RNA, 19 nt, Human
agauuucacucuccuuggu

SEQ ID NO: 1629335 - RNA, 16 nt, Human
agauucauauuuacuu

SEQ ID NO: 1629336 - RNA, 13 nt, Human
agauucauauuua

SEQ ID NO: 1629337 - RNA, 21 nt, Human
agauuagagaguguugaaacg

SEQ ID NO: 1629338 - RNA, 23 nt, Human
agauuagaauucuguauagauua

SEQ ID NO: 1629339 - RNA, 22 nt, Human
agauuagaauucuguauagauu

SEQ ID NO: 1629340 - RNA, 12 nt, Human
ugacuuacugua

SEQ ID NO: 1629341 - RNA, 20 nt, Human
ugacuuacuguacaugaaaa

SEQ ID NO: 1629342 - RNA, 16 nt, Human
agauuagaauucugua

SEQ ID NO: 1629343 - RNA, 15 nt, Human
agauuagaauucugu

SEQ ID NO: 1629344 - RNA, 16 nt, Human
ugacacuuaaaaaugg

SEQ ID NO: 1629345 - RNA, 15 nt, Human
ugacacuuaaaaaug

SEQ ID NO: 1629346 - RNA, 19 nt, Human
ugacacgaauauugcugau

SEQ ID NO: 1629347 - RNA, 16 nt, Human
ugacacgaauauugcu

SEQ ID NO: 1629348 - RNA, 22 nt, Human
ugacagggcacaccgggcacuc

SEQ ID NO: 1629349 - RNA, 19 nt, Human
ugacaggcaaugcuggcug

SEQ ID NO: 1629350 - RNA, 17 nt, Human
ugacaggcaaugcuggc

SEQ ID NO: 1629351 - RNA, 14 nt, Human
agauccuggaaauc

SEQ ID NO: 1629352 - RNA, 13 nt, Human
agauccuggaaau

SEQ ID NO: 1629353 - RNA, 18 nt, Human
agaucucuaacuucacca

SEQ ID NO: 1629354 - RNA, 18 nt, Human
agauccccaagccuggca

SEQ ID NO: 1629355 - RNA, 22 nt, Human
agaugcuagaacucccuuucaa

SEQ ID NO: 1629356 - RNA, 21 nt, Human
agaugcuagaacucccuuuca

SEQ ID NO: 1629357 - RNA, 22 nt, Human
agauguagccccucuccuggaa

SEQ ID NO: 1629358 - RNA, 19 nt, Human
agaugcuagaacucccuuu

SEQ ID NO: 1629359 - RNA, 21 nt, Human
agaugcaguucugaagaagau

SEQ ID NO: 1629360 - RNA, 16 nt, Human
agcaagggugauggga

SEQ ID NO: 1629361 - RNA, 17 nt, Human
agcaaggagauuuacaa

SEQ ID NO: 1629362 - RNA, 19 nt, Human
agcaaggagauuuacaacu

SEQ ID NO: 1629363 - RNA, 14 nt, Human
agcaaggagauuua

SEQ ID NO: 1629364 - RNA, 22 nt, Human
agcaagggugaugggaaagcau

SEQ ID NO: 1629365 - RNA, 20 nt, Human
agcaagggugaugggaaagc

SEQ ID NO: 1629366 - RNA, 15 nt, Human
agcaagucagaauag

SEQ ID NO: 1629367 - RNA, 16 nt, Human
agcaagugagagcugg

SEQ ID NO: 1629368 - RNA, 15 nt, Human
agcaagugagagcug

SEQ ID NO: 1629369 - RNA, 16 nt, Human
agcaagugagacccug

SEQ ID NO: 1629370 - RNA, 13 nt, Human
ugagccacugcac

SEQ ID NO: 1629371 - RNA, 12 nt, Human
ugagccacugca

SEQ ID NO: 1629372 - RNA, 14 nt, Human
ugagcauuagauuu

SEQ ID NO: 1629373 - RNA, 16 nt, Human
ugagcauuagauuucu

SEQ ID NO: 1629374 - RNA, 15 nt, Human
ugagcaaauguggcu

SEQ ID NO: 1629375 - RNA, 19 nt, Human
ugagccagauuucacucuc

SEQ ID NO: 1629376 - RNA, 18 nt, Human
ugagccagauuucacucu

SEQ ID NO: 1629377 - RNA, 18 nt, Human
ugagccacugcaccgggc

SEQ ID NO: 1629378 - RNA, 14 nt, Human
ugagccacugcacc

SEQ ID NO: 1629379 - RNA, 21 nt, Human
ugagccagauuucacucuccu

SEQ ID NO: 1629380 - RNA, 20 nt, Human
ugagccagauuucacucucc

SEQ ID NO: 1629381 - RNA, 18 nt, Human
agcaagugagagcugggu

SEQ ID NO: 1629382 - RNA, 17 nt, Human
agcaagugagagcuggg

SEQ ID NO: 1629383 - RNA, 21 nt, Human
agcacagcuucauuuccugug

SEQ ID NO: 1629384 - RNA, 22 nt, Human
agcacaugccucucucaggcca

SEQ ID NO: 1629385 - RNA, 21 nt, Human
agcacaugccucucucaggcc

SEQ ID NO: 1629386 - RNA, 20 nt, Human
agcacaugccucucucaggc

SEQ ID NO: 1629387 - RNA, 19 nt, Human
agcacaugccucucucagg

SEQ ID NO: 1629388 - RNA, 18 nt, Human
agcacaugccucucucag

SEQ ID NO: 1629389 - RNA, 16 nt, Human
agcaccaucucuccuc

SEQ ID NO: 1629390 - RNA, 23 nt, Human
agcacaugccucucucaggccaa

SEQ ID NO: 1629391 - RNA, 22 nt, Human
agcaccaaaagcuuaccaaggg

SEQ ID NO: 1629392 - RNA, 16 nt, Human
agcaccuccugccucg

SEQ ID NO: 1629393 - RNA, 14 nt, Human
agcaccuccugccu

SEQ ID NO: 1629394 - RNA, 13 nt, Human
agcaccuccugcc

SEQ ID NO: 1629395 - RNA, 17 nt, Human
agcaccuagccucgcuc

SEQ ID NO: 1629396 - RNA, 16 nt, Human
agauuuuccugaaaac

SEQ ID NO: 1629397 - RNA, 15 nt, Human
agauuuuccugaaaa

SEQ ID NO: 1629398 - RNA, 13 nt, Human
ugagacagcccgg

SEQ ID NO: 1629399 - RNA, 21 nt, Human
ugagacagaguuuucacucuu

SEQ ID NO: 1629400 - RNA, 11 nt, Human
ugagacagagu

SEQ ID NO: 1629401 - RNA, 20 nt, Human
ugagacagaaucucgcucug

SEQ ID NO: 1629402 - RNA, 12 nt, Human
ugagacagcucu

SEQ ID NO: 1629403 - RNA, 22 nt, Human
ugagacagcccgggcucugccu

SEQ ID NO: 1629404 - RNA, 20 nt, Human
ugagacucugucucagucca

SEQ ID NO: 1629405 - RNA, 20 nt, Human
ugagacucugucucaaaaaa

SEQ ID NO: 1629406 - RNA, 20 nt, Human
ugagacagcccgggcucugc

SEQ ID NO: 1629407 - RNA, 19 nt, Human
ugagacagcccgggcucug

SEQ ID NO: 1629408 - RNA, 18 nt, Human
ugagacagcccgggcucu

SEQ ID NO: 1629409 - RNA, 17 nt, Human
ugagacagcccgggcuc

SEQ ID NO: 1629410 - RNA, 20 nt, Human
ugagagacacacugaagaag

SEQ ID NO: 1629411 - RNA, 19 nt, Human
ugagagacacacugaagaa

SEQ ID NO: 1629412 - RNA, 17 nt, Human
ugagagacacacugaag

SEQ ID NO: 1629413 - RNA, 16 nt, Human
ugagagacacacugaa

SEQ ID NO: 1629414 - RNA, 13 nt, Human
ugagaugugaaca

SEQ ID NO: 1629415 - RNA, 23 nt, Human
ugagauguagccccucuccugga

SEQ ID NO: 1629416 - RNA, 23 nt, Human
ugagaggacuuuucuuuguggcu

SEQ ID NO: 1629417 - RNA, 17 nt, Human
ugagaggaaaucaccga

SEQ ID NO: 1629418 - RNA, 19 nt, Human
ugagaugugaacacaucag

SEQ ID NO: 1629419 - RNA, 18 nt, Human
ugagaugugaacacauca

SEQ ID NO: 1629420 - RNA, 24 nt, Human
ugagaugugaacacaucagcuugc

SEQ ID NO: 1629421 - RNA, 14 nt, Human
ugagauguguucac

SEQ ID NO: 1629422 - RNA, 22 nt, Human
ugagagacacacugaagaagca

SEQ ID NO: 1629423 - RNA, 21 nt, Human
ugagagacacacugaagaagc

SEQ ID NO: 1629424 - RNA, 14 nt, Human
ugagaggaaaucac

SEQ ID NO: 1629425 - RNA, 13 nt, Human
ugagaggaaauca

SEQ ID NO: 1629426 - RNA, 12 nt, Human
ugagaggaaauc

SEQ ID NO: 1629427 - RNA, 11 nt, Human
ugagaggaaau

SEQ ID NO: 1629428 - RNA, 10 nt, Human
ugagaggaaa

SEQ ID NO: 1629429 - RNA, 14 nt, Human
ugagagcugggugu

SEQ ID NO: 1629430 - RNA, 19 nt, Human
agagcugcccucuccuggg

SEQ ID NO: 1629431 - RNA, 20 nt, Human
agagcugcccucuccugggc

SEQ ID NO: 1629432 - RNA, 16 nt, Human
agagcugcccucuccu

SEQ ID NO: 1629433 - RNA, 17 nt, Human
agagcugcccucuccug

SEQ ID NO: 1629434 - RNA, 18 nt, Human
agagcugcccucuccugg

SEQ ID NO: 1629435 - RNA, 16 nt, Human
agagauugugguuuca

SEQ ID NO: 1629436 - RNA, 14 nt, Human
ugaaauaagccaga

SEQ ID NO: 1629437 - RNA, 16 nt, Human
ugaaauaacauggccu

SEQ ID NO: 1629438 - RNA, 17 nt, Human
ugaaauaacauggccuu

SEQ ID NO: 1629439 - RNA, 23 nt, Human
ugaaauaaacgucuuaaauauuc

SEQ ID NO: 1629440 - RNA, 22 nt, Human
ugaaauaaacgucuuaaauauu

SEQ ID NO: 1629441 - RNA, 18 nt, Human
ugaaauaaacgucuuaaa

SEQ ID NO: 1629442 - RNA, 13 nt, Human
ugaaauaaacguc

SEQ ID NO: 1629443 - RNA, 15 nt, Human
ugaaauuuccuggga

SEQ ID NO: 1629444 - RNA, 19 nt, Human
ugaaauuuuuauuaaauua

SEQ ID NO: 1629445 - RNA, 20 nt, Human
ugaaauuuuuauuaaauuau

SEQ ID NO: 1629446 - RNA, 21 nt, Human
ugaaauuuccugggagcuuuu

SEQ ID NO: 1629447 - RNA, 20 nt, Human
ugaaauuguaauuauaucug

SEQ ID NO: 1629448 - RNA, 19 nt, Human
ugaaauuguaauuauaucu

SEQ ID NO: 1629449 - RNA, 16 nt, Human
ugaaauuguaauuaua

SEQ ID NO: 1629450 - RNA, 15 nt, Human
ugaaauuguaauuau

SEQ ID NO: 1629451 - RNA, 14 nt, Human
ugaaauuguaauua

SEQ ID NO: 1629452 - RNA, 13 nt, Human
ugaaauuguaauu

SEQ ID NO: 1629453 - RNA, 23 nt, Human
ugaaauagacccacaagaggcag

SEQ ID NO: 1629454 - RNA, 13 nt, Human
ugaacaaauuuac

SEQ ID NO: 1629455 - RNA, 21 nt, Human
ugaaccaccacacccagccca

SEQ ID NO: 1629456 - RNA, 18 nt, Human
ugaacaaauuuacagaga

SEQ ID NO: 1629457 - RNA, 22 nt, Human
ugaaccaccacacccagcccac

SEQ ID NO: 1629458 - RNA, 18 nt, Human
ugaacccgggaggcagag

SEQ ID NO: 1629459 - RNA, 22 nt, Human
ugaacccauauuuguacaccaa

SEQ ID NO: 1629460 - RNA, 23 nt, Human
ugaacuagaguuuagcuggaaaa

SEQ ID NO: 1629461 - RNA, 22 nt, Human
ugaaccgaugagaaauaaaguu

SEQ ID NO: 1629462 - RNA, 11 nt, Human
ugaacuccugg

SEQ ID NO: 1629463 - RNA, 15 nt, Human
ugaacuccugaccuc

SEQ ID NO: 1629464 - RNA, 22 nt, Human
ugaagacaaugacuuacuguac

SEQ ID NO: 1629465 - RNA, 23 nt, Human
ugaagacaaugacuuacuguaca

SEQ ID NO: 1629466 - RNA, 13 nt, Human
ugaagacagagcu

SEQ ID NO: 1629467 - RNA, 20 nt, Human
ugaagauuuaccacuugugu

SEQ ID NO: 1629468 - RNA, 17 nt, Human
ugaagauuuaccacuug

SEQ ID NO: 1629469 - RNA, 15 nt, Human
ugaaguaauaugcac

SEQ ID NO: 1629470 - RNA, 14 nt, Human
ugaaguaagcaaag

SEQ ID NO: 1629471 - RNA, 13 nt, Human
ugaaguaagcaaa

SEQ ID NO: 1629472 - RNA, 16 nt, Human
ugaaguaauaugcaca

SEQ ID NO: 1629473 - RNA, 20 nt, Human
ugaaguaauaugcacacauu

SEQ ID NO: 1629474 - RNA, 21 nt, Human
ugaaguaauaugcacacauuu

SEQ ID NO: 1629475 - RNA, 22 nt, Human
ugaaguaauaugcacacauuuu

SEQ ID NO: 1629476 - RNA, 17 nt, Human
ugaaguacucauacaug

SEQ ID NO: 1629477 - RNA, 15 nt, Human
ugaaguaagcaaaga

SEQ ID NO: 1629478 - RNA, 12 nt, Human
ugaauaauacag

SEQ ID NO: 1629479 - RNA, 13 nt, Human
ugaagucacacag

SEQ ID NO: 1629480 - RNA, 13 nt, Human
ugaauaauacagu

SEQ ID NO: 1629481 - RNA, 23 nt, Human
ugaauaauguaagacaaauaugu

SEQ ID NO: 1629482 - RNA, 19 nt, Human
agagcuguucacagccaga

SEQ ID NO: 1629483 - RNA, 18 nt, Human
agagcuguucacagccag

SEQ ID NO: 1629484 - RNA, 23 nt, Human
agaggcagccccauucugccugc

SEQ ID NO: 1629485 - RNA, 22 nt, Human
agaggcagccccauucugccug

SEQ ID NO: 1629486 - RNA, 21 nt, Human
agaggcagccccauucugccu

SEQ ID NO: 1629487 - RNA, 24 nt, Human
agaggcagccccauucugccugcc

SEQ ID NO: 1629488 - RNA, 22 nt, Human
agaggcugccucucccaucacu

SEQ ID NO: 1629489 - RNA, 15 nt, Human
agagggagugacaga

SEQ ID NO: 1629490 - RNA, 20 nt, Human
agagggagugacagaggcag

SEQ ID NO: 1629491 - RNA, 13 nt, Human
agagguucaaaga

SEQ ID NO: 1629492 - RNA, 16 nt, Human
agagguucaaagauau

SEQ ID NO: 1629493 - RNA, 19 nt, Human
agagguucaaagauauuuu

SEQ ID NO: 1629494 - RNA, 20 nt, Human
agagguucaaagauauuuug

SEQ ID NO: 1629495 - RNA, 22 nt, Human
agaguaauccaagcaaauguga

SEQ ID NO: 1629496 - RNA, 20 nt, Human
agaguaauccaagcaaaugu

SEQ ID NO: 1629497 - RNA, 18 nt, Human
agaguaauccaagcaaau

SEQ ID NO: 1629498 - RNA, 17 nt, Human
ugaaagaggaaugaagu

SEQ ID NO: 1629499 - RNA, 22 nt, Human
ugaaagacuguacaaaguagaa

SEQ ID NO: 1629500 - RNA, 19 nt, Human
ugaaagacuguacaaagua

SEQ ID NO: 1629501 - RNA, 18 nt, Human
ugaaagacuguacaaagu

SEQ ID NO: 1629502 - RNA, 16 nt, Human
ugaaagacuguacaaa

SEQ ID NO: 1629503 - RNA, 22 nt, Human
ugaaagaaaauaccaaggaaca

SEQ ID NO: 1629504 - RNA, 18 nt, Human
ugaaagaggaaugaagua

SEQ ID NO: 1629505 - RNA, 21 nt, Human
agagaccaucccugaaggccc

SEQ ID NO: 1629506 - RNA, 19 nt, Human
agagaccaucccugaaggc

SEQ ID NO: 1629507 - RNA, 23 nt, Human
agagaccaucccugaaggccccg

SEQ ID NO: 1629508 - RNA, 22 nt, Human
agagaccaucccugaaggcccc

SEQ ID NO: 1629509 - RNA, 14 nt, Human
agagacuccugcag

SEQ ID NO: 1629510 - RNA, 13 nt, Human
agagacuccugca

SEQ ID NO: 1629511 - RNA, 12 nt, Human
agagacuccugc

SEQ ID NO: 1629512 - RNA, 15 nt, Human
agagacuccugcagg

SEQ ID NO: 1629513 - RNA, 15 nt, Human
agagaguguugaaac

SEQ ID NO: 1629514 - RNA, 17 nt, Human
agagaguggcuccuccc

SEQ ID NO: 1629515 - RNA, 16 nt, Human
agagaguguugaaacg

SEQ ID NO: 1629516 - RNA, 17 nt, Human
ugaaaauauuuguauca

SEQ ID NO: 1629517 - RNA, 15 nt, Human
ugaaaacacauuuuu

SEQ ID NO: 1629518 - RNA, 17 nt, Human
ugaaaacacauuuuucu

SEQ ID NO: 1629519 - RNA, 19 nt, Human
ugaaaacacauuuuucuua

SEQ ID NO: 1629520 - RNA, 20 nt, Human
ugaaaacacauuuuucuuag

SEQ ID NO: 1629521 - RNA, 14 nt, Human
ugaaaacacauuuu

SEQ ID NO: 1629522 - RNA, 12 nt, Human
ugaaaacacauu

SEQ ID NO: 1629523 - RNA, 13 nt, Human
ugaaaacacauuu

SEQ ID NO: 1629524 - RNA, 16 nt, Human
ucuuuuuuugugaugu

SEQ ID NO: 1629525 - RNA, 14 nt, Human
ucuuuuuuugugau

SEQ ID NO: 1629526 - RNA, 22 nt, Human
ugaaaauauuuguaucacaaau

SEQ ID NO: 1629527 - RNA, 21 nt, Human
ugaaaauauuuguaucacaaa

SEQ ID NO: 1629528 - RNA, 16 nt, Human
ugaaaaucgugacaac

SEQ ID NO: 1629529 - RNA, 13 nt, Human
ugaaagaaaauaa

SEQ ID NO: 1629530 - RNA, 17 nt, Human
ugaaacuggauuaaacu

SEQ ID NO: 1629531 - RNA, 18 nt, Human
ugaaacuggauuaaacuu

SEQ ID NO: 1629532 - RNA, 14 nt, Human
ugaaaauuaacaug

SEQ ID NO: 1629533 - RNA, 21 nt, Human
agacuggcacaguuuucugag

SEQ ID NO: 1629534 - RNA, 20 nt, Human
agacuggcacaguuuucuga

SEQ ID NO: 1629535 - RNA, 13 nt, Human
agacucugucuca

SEQ ID NO: 1629536 - RNA, 23 nt, Human
agacuggcacaguuuucugagaa

SEQ ID NO: 1629537 - RNA, 13 nt, Human
agacuccugcagg

SEQ ID NO: 1629538 - RNA, 21 nt, Human
agacuccagcuggguuggaaa

SEQ ID NO: 1629539 - RNA, 16 nt, Human
agacucccaagcugga

SEQ ID NO: 1629540 - RNA, 15 nt, Human
ucuuuaaugucacag

SEQ ID NO: 1629541 - RNA, 22 nt, Human
agacaggcaagcaccuccugcc

SEQ ID NO: 1629542 - RNA, 20 nt, Human
agacaggcaagcaccuccug

SEQ ID NO: 1629543 - RNA, 19 nt, Human
ucuuuaaugucacaggcag

SEQ ID NO: 1629544 - RNA, 18 nt, Human
ucuuuaaugucacaggca

SEQ ID NO: 1629545 - RNA, 12 nt, Human
ucuuuccugagg

SEQ ID NO: 1629546 - RNA, 22 nt, Human
agacuccaaagaaauguaaggg

SEQ ID NO: 1629547 - RNA, 15 nt, Human
agagacagaaagcag

SEQ ID NO: 1629548 - RNA, 14 nt, Human
agagacagaaagca

SEQ ID NO: 1629549 - RNA, 16 nt, Human
agagacacacugaaga

SEQ ID NO: 1629550 - RNA, 20 nt, Human
ucuuuguacagacaacaaac

SEQ ID NO: 1629551 - RNA, 15 nt, Human
ucuuuguacagacaa

SEQ ID NO: 1629552 - RNA, 14 nt, Human
ucuuuguacagaca

SEQ ID NO: 1629553 - RNA, 16 nt, Human
ucuuuguaaugaaaac

SEQ ID NO: 1629554 - RNA, 14 nt, Human
ucuuuguggcuucc

SEQ ID NO: 1629555 - RNA, 17 nt, Human
ucuuugucuacaccauu

SEQ ID NO: 1629556 - RNA, 22 nt, Human
ucuuuuuucuaaaguaaaaaca

SEQ ID NO: 1629557 - RNA, 21 nt, Human
ucuuuuuucuaaaguaaaaac

SEQ ID NO: 1629558 - RNA, 15 nt, Human
agacuuuggaaagag

SEQ ID NO: 1629559 - RNA, 17 nt, Human
agacuuuggaaagacuu

SEQ ID NO: 1629560 - RNA, 14 nt, Human
agacuguacaaagu

SEQ ID NO: 1629561 - RNA, 20 nt, Human
agacugguuccauggccucu

SEQ ID NO: 1629562 - RNA, 21 nt, Human
agacuggugacugauucuuca

SEQ ID NO: 1629563 - RNA, 20 nt, Human
agacuggugacugauucuuc

SEQ ID NO: 1629564 - RNA, 19 nt, Human
agagacacaagccuucggc

SEQ ID NO: 1629565 - RNA, 16 nt, Human
agagacacaagccuuc

SEQ ID NO: 1629566 - RNA, 19 nt, Human
agacuuuucuuucagccaa

SEQ ID NO: 1629567 - RNA, 19 nt, Human
agacuuuggaaagaguagg

SEQ ID NO: 1629568 - RNA, 12 nt, Human
agacuuuuauga

SEQ ID NO: 1629569 - RNA, 15 nt, Human
agacuuuuccaaccc

SEQ ID NO: 1629570 - RNA, 15 nt, Human
agacuuuuaugauac

SEQ ID NO: 1629571 - RNA, 20 nt, Human
agucagaucugccuaaggac

SEQ ID NO: 1629572 - RNA, 22 nt, Human
agucagaucugccuaaggacuu

SEQ ID NO: 1629573 - RNA, 21 nt, Human
agucagaucugccuaaggacu

SEQ ID NO: 1629574 - RNA, 21 nt, Human
agucagucauucagauaugau

SEQ ID NO: 1629575 - RNA, 15 nt, Human
agucagucauucaga

SEQ ID NO: 1629576 - RNA, 23 nt, Human
agucagaucugccuaaggacuuc

SEQ ID NO: 1629577 - RNA, 23 nt, Human
agucccaccuuggcugcagggag

SEQ ID NO: 1629578 - RNA, 21 nt, Human
agucccaccuuggcugcaggg

SEQ ID NO: 1629579 - RNA, 19 nt, Human
aguccccuguuuguuucug

SEQ ID NO: 1629580 - RNA, 14 nt, Human
aguccccuguuugu

SEQ ID NO: 1629581 - RNA, 21 nt, Human
ugucagcuccccucggagaag

SEQ ID NO: 1629582 - RNA, 20 nt, Human
ugucagcuccccucggagaa

SEQ ID NO: 1629583 - RNA, 23 nt, Human
ugucagcuccccucggagaagag

SEQ ID NO: 1629584 - RNA, 16 nt, Human
ugucagccauuccugu

SEQ ID NO: 1629585 - RNA, 18 nt, Human
agucacugagacagcccg

SEQ ID NO: 1629586 - RNA, 19 nt, Human
uguccaggcacugcugccc

SEQ ID NO: 1629587 - RNA, 21 nt, Human
uguccaggcacugcugcccag

SEQ ID NO: 1629588 - RNA, 20 nt, Human
uguccaggcacugcugccca

SEQ ID NO: 1629589 - RNA, 22 nt, Human
ugucccuaccgagucucuucuc

SEQ ID NO: 1629590 - RNA, 21 nt, Human
ugucccuaccgagucucuucu

SEQ ID NO: 1629591 - RNA, 20 nt, Human
ugucccuaccgagucucuuc

SEQ ID NO: 1629592 - RNA, 14 nt, Human
ugucccugcacuug

SEQ ID NO: 1629593 - RNA, 12 nt, Human
ugucccuuuucc

SEQ ID NO: 1629594 - RNA, 17 nt, Human
ugucccuuuuccuuuuu

SEQ ID NO: 1629595 - RNA, 21 nt, Human
aguauguuagugcaaauuguc

SEQ ID NO: 1629596 - RNA, 18 nt, Human
aguauguuagugcaaauu

SEQ ID NO: 1629597 - RNA, 21 nt, Human
aguauuagaauaccacaggaa

SEQ ID NO: 1629598 - RNA, 21 nt, Human
aguagcugggacuacaggcac

SEQ ID NO: 1629599 - RNA, 19 nt, Human
aguagcugggacuacaggc

SEQ ID NO: 1629600 - RNA, 22 nt, Human
aguagcugggacuacaggcacc

SEQ ID NO: 1629601 - RNA, 14 nt, Human
aguauuauaccuuu

SEQ ID NO: 1629602 - RNA, 15 nt, Human
aguauuauaccuuuu

SEQ ID NO: 1629603 - RNA, 11 nt, Human
aguauuguaca

SEQ ID NO: 1629604 - RNA, 23 nt, Human
aguauuguacaaaguauuaagca

SEQ ID NO: 1629605 - RNA, 22 nt, Human
aguauuguacaaaguauuaagc

SEQ ID NO: 1629606 - RNA, 20 nt, Human
aguauuguacaaaguauuaa

SEQ ID NO: 1629607 - RNA, 15 nt, Human
aguauuguacaaagu

SEQ ID NO: 1629608 - RNA, 20 nt, Human
agucacauuccaagccucau

SEQ ID NO: 1629609 - RNA, 15 nt, Human
ugucagcauagaagu

SEQ ID NO: 1629610 - RNA, 17 nt, Human
agucacugagacagccc

SEQ ID NO: 1629611 - RNA, 16 nt, Human
agucacugagacagcc

SEQ ID NO: 1629612 - RNA, 15 nt, Human
agucacugagacagc

SEQ ID NO: 1629613 - RNA, 16 nt, Human
aguauuguccaggucu

SEQ ID NO: 1629614 - RNA, 15 nt, Human
aguauuguccagguc

SEQ ID NO: 1629615 - RNA, 21 nt, Human
aguauuuaauucauguugccu

SEQ ID NO: 1629616 - RNA, 22 nt, Human
agucacagagauaauucuagcu

SEQ ID NO: 1629617 - RNA, 15 nt, Human
ugucaaaguggugag

SEQ ID NO: 1629618 - RNA, 14 nt, Human
ugucaaagugguga

SEQ ID NO: 1629619 - RNA, 11 nt, Human
uguauuaugug

SEQ ID NO: 1629620 - RNA, 15 nt, Human
uguauuagucacaga

SEQ ID NO: 1629621 - RNA, 19 nt, Human
ugucaaaguggugagaggc

SEQ ID NO: 1629622 - RNA, 16 nt, Human
ugucaaaguggugaga

SEQ ID NO: 1629623 - RNA, 14 nt, Human
aguagcugggacua

SEQ ID NO: 1629624 - RNA, 13 nt, Human
aguagcugggacu

SEQ ID NO: 1629625 - RNA, 14 nt, Human
uguauguguaagua

SEQ ID NO: 1629626 - RNA, 16 nt, Human
uguaucccaugagccu

SEQ ID NO: 1629627 - RNA, 15 nt, Human
uguaucccaugagcc

SEQ ID NO: 1629628 - RNA, 13 nt, Human
uguaugugugaag

SEQ ID NO: 1629629 - RNA, 12 nt, Human
uguaugugugaa

SEQ ID NO: 1629630 - RNA, 15 nt, Human
uguagagccaggguc

SEQ ID NO: 1629631 - RNA, 12 nt, Human
uguagagccagg

SEQ ID NO: 1629632 - RNA, 23 nt, Human
agguuuggacaaaauggaauacu

SEQ ID NO: 1629633 - RNA, 14 nt, Human
ugugaagcaaaauu

SEQ ID NO: 1629634 - RNA, 23 nt, Human
ugugaacugaacucugacaacag

SEQ ID NO: 1629635 - RNA, 14 nt, Human
ugugaacugaacuc

SEQ ID NO: 1629636 - RNA, 19 nt, Human
ugugagcacaaagguagcu

SEQ ID NO: 1629637 - RNA, 19 nt, Human
agucuccaaagucucugga

SEQ ID NO: 1629638 - RNA, 18 nt, Human
agucucccucccuugggg

SEQ ID NO: 1629639 - RNA, 14 nt, Human
agucucccucccuu

SEQ ID NO: 1629640 - RNA, 23 nt, Human
agugaaaaaggaggaagagaaaa

SEQ ID NO: 1629641 - RNA, 20 nt, Human
agugaaaaaggaggaagaga

SEQ ID NO: 1629642 - RNA, 17 nt, Human
agugaaaaaggaggaag

SEQ ID NO: 1629643 - RNA, 11 nt, Human
agugaaaaagg

SEQ ID NO: 1629644 - RNA, 16 nt, Human
agugaaagaggcagcu

SEQ ID NO: 1629645 - RNA, 22 nt, Human
agugaaagaggcagcuugaaac

SEQ ID NO: 1629646 - RNA, 14 nt, Human
agugagacagcucu

SEQ ID NO: 1629647 - RNA, 20 nt, Human
agugaaacucguuaauuugu

SEQ ID NO: 1629648 - RNA, 13 nt, Human
agugagacucugu

SEQ ID NO: 1629649 - RNA, 21 nt, Human
agugagacccugucucaaaaa

SEQ ID NO: 1629650 - RNA, 17 nt, Human
agugagacccugucuca

SEQ ID NO: 1629651 - RNA, 17 nt, Human
agugagacucugucuca

SEQ ID NO: 1629652 - RNA, 16 nt, Human
agugagacucugucuc

SEQ ID NO: 1629653 - RNA, 22 nt, Human
agugagacucugucucaaaaaa

SEQ ID NO: 1629654 - RNA, 16 nt, Human
agugagccgagauugu

SEQ ID NO: 1629655 - RNA, 16 nt, Human
ugugauggggcccugc

SEQ ID NO: 1629656 - RNA, 15 nt, Human
ugugauggggcccug

SEQ ID NO: 1629657 - RNA, 21 nt, Human
agugagcagucaggaaagaga

SEQ ID NO: 1629658 - RNA, 14 nt, Human
agugagagcugggu

SEQ ID NO: 1629659 - RNA, 18 nt, Human
ugugauggggcccugccu

SEQ ID NO: 1629660 - RNA, 17 nt, Human
ugugauggggcccugcc

SEQ ID NO: 1629661 - RNA, 14 nt, Human
ugucuucacaacag

SEQ ID NO: 1629662 - RNA, 21 nt, Human
ugucuugcaauggcagccuug

SEQ ID NO: 1629663 - RNA, 20 nt, Human
ugucuugcaauggcagccuu

SEQ ID NO: 1629664 - RNA, 18 nt, Human
ugucuugcaauggcagcc

SEQ ID NO: 1629665 - RNA, 17 nt, Human
ugucuugcaauggcagc

SEQ ID NO: 1629666 - RNA, 15 nt, Human
ugucuugcaauggca

SEQ ID NO: 1629667 - RNA, 23 nt, Human
ugugaaccaccacacccagccca

SEQ ID NO: 1629668 - RNA, 22 nt, Human
ugugaaccaccacacccagccc

SEQ ID NO: 1629669 - RNA, 17 nt, Human
ugugaaccaccacaccc

SEQ ID NO: 1629670 - RNA, 16 nt, Human
ugugaaccaccacacc

SEQ ID NO: 1629671 - RNA, 15 nt, Human
ugugaaccaccacac

SEQ ID NO: 1629672 - RNA, 22 nt, Human
ugugaacaguuguguuugaagc

SEQ ID NO: 1629673 - RNA, 17 nt, Human
ugucuuuaaaugcugcu

SEQ ID NO: 1629674 - RNA, 21 nt, Human
ugucuugccuuuuucauuauu

SEQ ID NO: 1629675 - RNA, 17 nt, Human
ugucuugccuuuuucau

SEQ ID NO: 1629676 - RNA, 16 nt, Human
ugucuugccuuuuuca

SEQ ID NO: 1629677 - RNA, 15 nt, Human
ugucuugccuuuuuc

SEQ ID NO: 1629678 - RNA, 14 nt, Human
ugucuuaauuaaaa

SEQ ID NO: 1629679 - RNA, 21 nt, Human
ugucucuuuaaugucacaggc

SEQ ID NO: 1629680 - RNA, 22 nt, Human
ugucucuugguccugcugcagu

SEQ ID NO: 1629681 - RNA, 22 nt, Human
ugucucuuuaaugucacaggca

SEQ ID NO: 1629682 - RNA, 21 nt, Human
ugucucuugguccugcugcag

SEQ ID NO: 1629683 - RNA, 20 nt, Human
ugucucuugguccugcugca

SEQ ID NO: 1629684 - RNA, 19 nt, Human
ugucucuugguccugcugc

SEQ ID NO: 1629685 - RNA, 18 nt, Human
ugucucuugguccugcug

SEQ ID NO: 1629686 - RNA, 17 nt, Human
ugucucuacuaaaaaua

SEQ ID NO: 1629687 - RNA, 13 nt, Human
ugucucugagagu

SEQ ID NO: 1629688 - RNA, 22 nt, Human
ugucucuggauuauauuaugaa

SEQ ID NO: 1629689 - RNA, 16 nt, Human
agucccugccaaugga

SEQ ID NO: 1629690 - RNA, 14 nt, Human
agucccugccaaug

SEQ ID NO: 1629691 - RNA, 13 nt, Human
agucccugccaau

SEQ ID NO: 1629692 - RNA, 23 nt, Human
aguccccuguuuguuucugaaag

SEQ ID NO: 1629693 - RNA, 17 nt, Human
uguacaugaaaacacau

SEQ ID NO: 1629694 - RNA, 18 nt, Human
uguacaugaaaacacauu

SEQ ID NO: 1629695 - RNA, 19 nt, Human
uguacaugaaaacacauuu

SEQ ID NO: 1629696 - RNA, 20 nt, Human
uguacaugaaaacacauuuu

SEQ ID NO: 1629697 - RNA, 21 nt, Human
uguagaagucacauuccugaa

SEQ ID NO: 1629698 - RNA, 19 nt, Human
uguacuugcucuugaugcc

SEQ ID NO: 1629699 - RNA, 15 nt, Human
uguacuugcucuuga

SEQ ID NO: 1629700 - RNA, 23 nt, Human
uguacaaaguagaagucuuagau

SEQ ID NO: 1629701 - RNA, 19 nt, Human
uguacaaaguagaagucuu

SEQ ID NO: 1629702 - RNA, 14 nt, Human
uguacaaaguauua

SEQ ID NO: 1629703 - RNA, 13 nt, Human
uguacaaaguauu

SEQ ID NO: 1629704 - RNA, 17 nt, Human
uguaauuugugauacaa

SEQ ID NO: 1629705 - RNA, 21 nt, Human
uguaauuugugauacaaugcu

SEQ ID NO: 1629706 - RNA, 18 nt, Human
uguaaggaaugauuaauu

SEQ ID NO: 1629707 - RNA, 16 nt, Human
uguaauuugugauaca

SEQ ID NO: 1629708 - RNA, 15 nt, Human
uguaaggcaaucaug

SEQ ID NO: 1629709 - RNA, 18 nt, Human
uguaagaaaauaucacuu

SEQ ID NO: 1629710 - RNA, 22 nt, Human
uguaagcucuacugaggugcua

SEQ ID NO: 1629711 - RNA, 15 nt, Human
uguaaggaaugauua

SEQ ID NO: 1629712 - RNA, 14 nt, Human
uguaaggaaugauu

SEQ ID NO: 1629713 - RNA, 13 nt, Human
uguaaggaaugau

SEQ ID NO: 1629714 - RNA, 20 nt, Human
agguugucugaagucacugc

SEQ ID NO: 1629715 - RNA, 16 nt, Human
agguugucugaaguca

SEQ ID NO: 1629716 - RNA, 20 nt, Human
aggugugagucaccaagccc

SEQ ID NO: 1629717 - RNA, 14 nt, Human
aggugugagucacc

SEQ ID NO: 1629718 - RNA, 20 nt, Human
aggugugacugaauuucuuu

SEQ ID NO: 1629719 - RNA, 20 nt, Human
aggugugagccaccacgccc

SEQ ID NO: 1629720 - RNA, 22 nt, Human
aggugugaaccaccacacccag

SEQ ID NO: 1629721 - RNA, 23 nt, Human
aggugugaaccaccacacccagc

SEQ ID NO: 1629722 - RNA, 18 nt, Human
aggugugacugaauuucu

SEQ ID NO: 1629723 - RNA, 13 nt, Human
agguggggcagcu

SEQ ID NO: 1629724 - RNA, 22 nt, Human
aggugauccacucgccuucauc

SEQ ID NO: 1629725 - RNA, 14 nt, Human
agguggggcagcuu

SEQ ID NO: 1629726 - RNA, 16 nt, Human
agguggggcagcuuga

SEQ ID NO: 1629727 - RNA, 16 nt, Human
uguaaaggaauuuaaa

SEQ ID NO: 1629728 - RNA, 19 nt, Human
uguaaauacaauuuuguuu

SEQ ID NO: 1629729 - RNA, 18 nt, Human
uguaaauacaauuuuguu

SEQ ID NO: 1629730 - RNA, 17 nt, Human
uguaaauacaauuuugu

SEQ ID NO: 1629731 - RNA, 16 nt, Human
uguaaauacaauuuug

SEQ ID NO: 1629732 - RNA, 13 nt, Human
ugguuuucuguuc

SEQ ID NO: 1629733 - RNA, 15 nt, Human
ugguuuucuguucuu

SEQ ID NO: 1629734 - RNA, 23 nt, Human
aggugauccacccaccucagccu

SEQ ID NO: 1629735 - RNA, 10 nt, Human
uguaaauccc

SEQ ID NO: 1629736 - RNA, 21 nt, Human
uguaaauacaauuuuguuucu

SEQ ID NO: 1629737 - RNA, 14 nt, Human
ugguuucagaaaug

SEQ ID NO: 1629738 - RNA, 15 nt, Human
ugguuucagaaaugu

SEQ ID NO: 1629739 - RNA, 12 nt, Human
ugguuuucuguu

SEQ ID NO: 1629740 - RNA, 18 nt, Human
ugguuuuaguugcaacuu

SEQ ID NO: 1629741 - RNA, 23 nt, Human
ugguucaggguuggccccugccc

SEQ ID NO: 1629742 - RNA, 22 nt, Human
ugguucaggguuggccccugcc

SEQ ID NO: 1629743 - RNA, 20 nt, Human
ugguucaggguuggccccug

SEQ ID NO: 1629744 - RNA, 17 nt, Human
ugguguuuccuggcacu

SEQ ID NO: 1629745 - RNA, 15 nt, Human
ugguguuuccuggca

SEQ ID NO: 1629746 - RNA, 13 nt, Human
ugguggcagcugc

SEQ ID NO: 1629747 - RNA, 12 nt, Human
ugguggcagcug

SEQ ID NO: 1629748 - RNA, 15 nt, Human
ugguguguguaugcg

SEQ ID NO: 1629749 - RNA, 23 nt, Human
ugguggcagcucaccucucccuu

SEQ ID NO: 1629750 - RNA, 20 nt, Human
ugguggcagcucaccucucc

SEQ ID NO: 1629751 - RNA, 19 nt, Human
ugguggcagcucaccucuc

SEQ ID NO: 1629752 - RNA, 16 nt, Human
ugguggcagcucaccu

SEQ ID NO: 1629753 - RNA, 12 nt, Human
ugguggcagcuc

SEQ ID NO: 1629754 - RNA, 15 nt, Human
ugguggcagagugga

SEQ ID NO: 1629755 - RNA, 17 nt, Human
agguccacaacacacag

SEQ ID NO: 1629756 - RNA, 21 nt, Human
aggucuugaacuccuggccuc

SEQ ID NO: 1629757 - RNA, 20 nt, Human
aggucuugaacuccuggccu

SEQ ID NO: 1629758 - RNA, 22 nt, Human
aggucuugaacuccuggccuca

SEQ ID NO: 1629759 - RNA, 15 nt, Human
aggucagugcaaaua

SEQ ID NO: 1629760 - RNA, 21 nt, Human
aggucaaggcugcagugagcc

SEQ ID NO: 1629761 - RNA, 22 nt, Human
aggucauuuuuuuuaagaaaaa

SEQ ID NO: 1629762 - RNA, 23 nt, Human
aggucauuuuuuuuaagaaaaag

SEQ ID NO: 1629763 - RNA, 20 nt, Human
aggguuuauguuuaggaugu

SEQ ID NO: 1629764 - RNA, 17 nt, Human
aggguugggcugguguc

SEQ ID NO: 1629765 - RNA, 17 nt, Human
agguaugcaaucaaauc

SEQ ID NO: 1629766 - RNA, 22 nt, Human
uggucugugagaugcuagaacu

SEQ ID NO: 1629767 - RNA, 12 nt, Human
uggucuguguga

SEQ ID NO: 1629768 - RNA, 16 nt, Human
uggucuuauuuguaaa

SEQ ID NO: 1629769 - RNA, 22 nt, Human
ugguccaugggccauaugaaaa

SEQ ID NO: 1629770 - RNA, 19 nt, Human
ugguccauagagagcaaga

SEQ ID NO: 1629771 - RNA, 13 nt, Human
uggucccacccca

SEQ ID NO: 1629772 - RNA, 19 nt, Human
uggucucgaacuccugacc

SEQ ID NO: 1629773 - RNA, 21 nt, Human
uggucucgaacuccugaccuu

SEQ ID NO: 1629774 - RNA, 20 nt, Human
uggucucgaacuccugaccu

SEQ ID NO: 1629775 - RNA, 15 nt, Human
aggguugggcuggug

SEQ ID NO: 1629776 - RNA, 17 nt, Human
aggguuggccccugccc

SEQ ID NO: 1629777 - RNA, 14 nt, Human
aggguuggccccug

SEQ ID NO: 1629778 - RNA, 13 nt, Human
aggguuggccccu

SEQ ID NO: 1629779 - RNA, 21 nt, Human
aggguggugaccucugccuga

SEQ ID NO: 1629780 - RNA, 19 nt, Human
aggguggugaccucugccu

SEQ ID NO: 1629781 - RNA, 18 nt, Human
aggguggugaccucugcc

SEQ ID NO: 1629782 - RNA, 17 nt, Human
aggguggugaccucugc

SEQ ID NO: 1629783 - RNA, 19 nt, Human
uggugaacagaacaaaagg

SEQ ID NO: 1629784 - RNA, 22 nt, Human
agggugaugggaaagcauugua

SEQ ID NO: 1629785 - RNA, 21 nt, Human
agggugaugggaaagcauugu

SEQ ID NO: 1629786 - RNA, 14 nt, Human
uggguggaugccug

SEQ ID NO: 1629787 - RNA, 22 nt, Human
ugggucuuguuuuuuuuuucca

SEQ ID NO: 1629788 - RNA, 23 nt, Human
uggguggaugccugguggcagcu

SEQ ID NO: 1629789 - RNA, 21 nt, Human
uggucaccaaaucagcugcua

SEQ ID NO: 1629790 - RNA, 23 nt, Human
uggucaccaaaucagcugcuacu

SEQ ID NO: 1629791 - RNA, 22 nt, Human
ugguaauuuaagauuccagaga

SEQ ID NO: 1629792 - RNA, 16 nt, Human
ugguccauagagagca

SEQ ID NO: 1629793 - RNA, 15 nt, Human
ugguccauagagagc

SEQ ID NO: 1629794 - RNA, 19 nt, Human
aggguacuaaggaaucuuu

SEQ ID NO: 1629795 - RNA, 16 nt, Human
aggguaucaggugcug

SEQ ID NO: 1629796 - RNA, 12 nt, Human
aggguagggugg

SEQ ID NO: 1629797 - RNA, 18 nt, Human
aggguaucaggugcugcc

SEQ ID NO: 1629798 - RNA, 16 nt, Human
aggggauagagagaga

SEQ ID NO: 1629799 - RNA, 15 nt, Human
agggggaaggcaggg

SEQ ID NO: 1629800 - RNA, 22 nt, Human
auaaguuaacuuccaauuuaca

SEQ ID NO: 1629801 - RNA, 23 nt, Human
auaauacaccacuacauucuguu

SEQ ID NO: 1629802 - RNA, 22 nt, Human
auaauaaggaaaaguuuaauau

SEQ ID NO: 1629803 - RNA, 19 nt, Human
auaauaaggaaaaguuuaa

SEQ ID NO: 1629804 - RNA, 18 nt, Human
auaauaaggaaaaguuua

SEQ ID NO: 1629805 - RNA, 17 nt, Human
auaauaaggaaaaguuu

SEQ ID NO: 1629806 - RNA, 16 nt, Human
auaauaaggaaaaguu

SEQ ID NO: 1629807 - RNA, 12 nt, Human
uuaccugggaaa

SEQ ID NO: 1629808 - RNA, 22 nt, Human
auaagaaccuuuugagugccuu

SEQ ID NO: 1629809 - RNA, 17 nt, Human
auaaguuaacuuccaau

SEQ ID NO: 1629810 - RNA, 23 nt, Human
auaagaaccuuuugagugccuua

SEQ ID NO: 1629811 - RNA, 21 nt, Human
auaaucuuucacaggggacag

SEQ ID NO: 1629812 - RNA, 19 nt, Human
auaauacaguaucucaggg

SEQ ID NO: 1629813 - RNA, 14 nt, Human
auaaugaauacuuu

SEQ ID NO: 1629814 - RNA, 19 nt, Human
auaauuauaugcuauuucu

SEQ ID NO: 1629815 - RNA, 17 nt, Human
auaauuauaugcuauuu

SEQ ID NO: 1629816 - RNA, 14 nt, Human
auaauucuacuuug

SEQ ID NO: 1629817 - RNA, 23 nt, Human
auaauuauaugcuauuucuauau

SEQ ID NO: 1629818 - RNA, 21 nt, Human
auaauuauaugcuauuucuau

SEQ ID NO: 1629819 - RNA, 22 nt, Human
uuagaugcaguucugaagaaga

SEQ ID NO: 1629820 - RNA, 23 nt, Human
uuagaugcaguucugaagaagau

SEQ ID NO: 1629821 - RNA, 16 nt, Human
uuacaggaaguacugg

SEQ ID NO: 1629822 - RNA, 15 nt, Human
uuacaggaaguacug

SEQ ID NO: 1629823 - RNA, 22 nt, Human
uuacaggaaguacuggagaaaa

SEQ ID NO: 1629824 - RNA, 18 nt, Human
uuacaggaaguacuggag

SEQ ID NO: 1629825 - RNA, 23 nt, Human
uuaccauuuugggguacccacug

SEQ ID NO: 1629826 - RNA, 12 nt, Human
auaacuggaaac

SEQ ID NO: 1629827 - RNA, 20 nt, Human
auaaccaguguuguggauuu

SEQ ID NO: 1629828 - RNA, 19 nt, Human
auaaaugugccuucauuuu

SEQ ID NO: 1629829 - RNA, 19 nt, Human
auaaauaaaguuuguugaa

SEQ ID NO: 1629830 - RNA, 13 nt, Human
auaaauaaaguuu

SEQ ID NO: 1629831 - RNA, 16 nt, Human
auaaaccgaacugaug

SEQ ID NO: 1629832 - RNA, 13 nt, Human
aguuuucugagaa

SEQ ID NO: 1629833 - RNA, 12 nt, Human
aguuuucugaga

SEQ ID NO: 1629834 - RNA, 17 nt, Human
aguuuucugagaaagac

SEQ ID NO: 1629835 - RNA, 14 nt, Human
aguuuucugagaaa

SEQ ID NO: 1629836 - RNA, 18 nt, Human
aguuuucugagaaagacu

SEQ ID NO: 1629837 - RNA, 23 nt, Human
auaaacacucuugaaaaaugcau

SEQ ID NO: 1629838 - RNA, 13 nt, Human
auaaacuuuaccu

SEQ ID NO: 1629839 - RNA, 15 nt, Human
auaaacuuuaccuuu

SEQ ID NO: 1629840 - RNA, 16 nt, Human
auaaacuuuaccuuuu

SEQ ID NO: 1629841 - RNA, 18 nt, Human
auaaacgucuuaaauauu

SEQ ID NO: 1629842 - RNA, 16 nt, Human
auaaacgucuuaaaua

SEQ ID NO: 1629843 - RNA, 15 nt, Human
auaaacgucuuaaau

SEQ ID NO: 1629844 - RNA, 18 nt, Human
uuauacccccugcaaagc

SEQ ID NO: 1629845 - RNA, 14 nt, Human
uuagccccauaauu

SEQ ID NO: 1629846 - RNA, 16 nt, Human
uuagcaguuugcuuug

SEQ ID NO: 1629847 - RNA, 18 nt, Human
uuauauaagcuuguauuc

SEQ ID NO: 1629848 - RNA, 22 nt, Human
uuauauauauuuuuuucugaaa

SEQ ID NO: 1629849 - RNA, 22 nt, Human
auacaaaaaaaaaaaaaaauua

SEQ ID NO: 1629850 - RNA, 12 nt, Human
auacaaaagcau

SEQ ID NO: 1629851 - RNA, 13 nt, Human
auacaaaagcaug

SEQ ID NO: 1629852 - RNA, 15 nt, Human
auacaaaagcaugug

SEQ ID NO: 1629853 - RNA, 22 nt, Human
auaauuuuuauauuugaaauau

SEQ ID NO: 1629854 - RNA, 21 nt, Human
auaauuuuuauauuugaaaua

SEQ ID NO: 1629855 - RNA, 19 nt, Human
auaauuuuuauauuugaaa

SEQ ID NO: 1629856 - RNA, 16 nt, Human
auaauuuuuauauuug

SEQ ID NO: 1629857 - RNA, 14 nt, Human
auaauuuuuauauu

SEQ ID NO: 1629858 - RNA, 20 nt, Human
auaauuuugugaagcaaaau

SEQ ID NO: 1629859 - RNA, 15 nt, Human
auaauuuugugaagc

SEQ ID NO: 1629860 - RNA, 14 nt, Human
auaauuuugugaag

SEQ ID NO: 1629861 - RNA, 13 nt, Human
auaauuuugugaa

SEQ ID NO: 1629862 - RNA, 22 nt, Human
uuaucaugugaaaucauucauu

SEQ ID NO: 1629863 - RNA, 20 nt, Human
uuaucaugugaaaucauuca

SEQ ID NO: 1629864 - RNA, 18 nt, Human
uuaucaugugaaaucauu

SEQ ID NO: 1629865 - RNA, 17 nt, Human
uuaucaugugaaaucau

SEQ ID NO: 1629866 - RNA, 22 nt, Human
auaccacaggaaccacaagacu

SEQ ID NO: 1629867 - RNA, 19 nt, Human
auaccagccaguaaauggg

SEQ ID NO: 1629868 - RNA, 21 nt, Human
auacuaaccagcagaaaugcc

SEQ ID NO: 1629869 - RNA, 13 nt, Human
auacuacaguuug

SEQ ID NO: 1629870 - RNA, 15 nt, Human
auacuacaguuuguu

SEQ ID NO: 1629871 - RNA, 16 nt, Human
auacuacaguuuguua

SEQ ID NO: 1629872 - RNA, 20 nt, Human
auacuacaguuuguuaguau

SEQ ID NO: 1629873 - RNA, 21 nt, Human
auacaguucggugagcuacaa

SEQ ID NO: 1629874 - RNA, 22 nt, Human
auacaggaaaagcugcugacag

SEQ ID NO: 1629875 - RNA, 20 nt, Human
auacaggaaaagcugcugac

SEQ ID NO: 1629876 - RNA, 19 nt, Human
auacaggaaaagcugcuga

SEQ ID NO: 1629877 - RNA, 14 nt, Human
auacaggaaaagcu

SEQ ID NO: 1629878 - RNA, 20 nt, Human
auacaucccuuaccugggaa

SEQ ID NO: 1629879 - RNA, 20 nt, Human
auacauaaacaagaccacgu

SEQ ID NO: 1629880 - RNA, 16 nt, Human
auacauuugauaaagu

SEQ ID NO: 1629881 - RNA, 19 nt, Human
aguuauggcuauaggugcu

SEQ ID NO: 1629882 - RNA, 20 nt, Human
aguuauuauauuuacaaaug

SEQ ID NO: 1629883 - RNA, 18 nt, Human
uguucuuuccaaaguaca

SEQ ID NO: 1629884 - RNA, 20 nt, Human
uguucuuuccaaaguacacu

SEQ ID NO: 1629885 - RNA, 18 nt, Human
aguuacccaaauuaagag

SEQ ID NO: 1629886 - RNA, 17 nt, Human
aguuacccaaauuaaga

SEQ ID NO: 1629887 - RNA, 16 nt, Human
uguugggccaggagcc

SEQ ID NO: 1629888 - RNA, 13 nt, Human
uguugggccagga

SEQ ID NO: 1629889 - RNA, 13 nt, Human
uguugucagcuga

SEQ ID NO: 1629890 - RNA, 21 nt, Human
uguuguacucaauuuuaacaa

SEQ ID NO: 1629891 - RNA, 15 nt, Human
aguucagagcugccc

SEQ ID NO: 1629892 - RNA, 16 nt, Human
aguucagagcugcccu

SEQ ID NO: 1629893 - RNA, 17 nt, Human
aguucagagcugcccuc

SEQ ID NO: 1629894 - RNA, 18 nt, Human
aguucagagcugcccucu

SEQ ID NO: 1629895 - RNA, 19 nt, Human
aguucagagcugcccucuc

SEQ ID NO: 1629896 - RNA, 21 nt, Human
aguuauuuuuauuuauuuaaa

SEQ ID NO: 1629897 - RNA, 17 nt, Human
aguucccuacuuccugu

SEQ ID NO: 1629898 - RNA, 22 nt, Human
aguguacauggaauaacaugua

SEQ ID NO: 1629899 - RNA, 21 nt, Human
aguguacauggaauaacaugu

SEQ ID NO: 1629900 - RNA, 19 nt, Human
agugggugaauaauacagu

SEQ ID NO: 1629901 - RNA, 21 nt, Human
agugguuccuaauccucuagg

SEQ ID NO: 1629902 - RNA, 16 nt, Human
aguggugcgaucuggg

SEQ ID NO: 1629903 - RNA, 13 nt, Human
aguggcagcugcu

SEQ ID NO: 1629904 - RNA, 12 nt, Human
aguggcagcugc

SEQ ID NO: 1629905 - RNA, 20 nt, Human
aguggcagcugcuuuugucu

SEQ ID NO: 1629906 - RNA, 14 nt, Human
aguggcagcugcuu

SEQ ID NO: 1629907 - RNA, 18 nt, Human
agugggugaauaauacag

SEQ ID NO: 1629908 - RNA, 13 nt, Human
agugggugaauaa

SEQ ID NO: 1629909 - RNA, 18 nt, Human
agugggggaucacagccu

SEQ ID NO: 1629910 - RNA, 20 nt, Human
agugggggaguggccacaga

SEQ ID NO: 1629911 - RNA, 19 nt, Human
agugggggaguggccacag

SEQ ID NO: 1629912 - RNA, 13 nt, Human
uguucugggacac

SEQ ID NO: 1629913 - RNA, 15 nt, Human
uguucugggacacag

SEQ ID NO: 1629914 - RNA, 14 nt, Human
uguucugggacaca

SEQ ID NO: 1629915 - RNA, 14 nt, Human
uguucuuaauucuu

SEQ ID NO: 1629916 - RNA, 16 nt, Human
uguucuuaauucuuag

SEQ ID NO: 1629917 - RNA, 19 nt, Human
uguucuugguuuguaaauu

SEQ ID NO: 1629918 - RNA, 13 nt, Human
uguucuuuccaaa

SEQ ID NO: 1629919 - RNA, 14 nt, Human
uguucuuuccaaag

SEQ ID NO: 1629920 - RNA, 17 nt, Human
uguucuugguuuguaaa

SEQ ID NO: 1629921 - RNA, 18 nt, Human
uguucuugguuuguaaau

SEQ ID NO: 1629922 - RNA, 23 nt, Human
aguguacauggaauaacauguaa

SEQ ID NO: 1629923 - RNA, 16 nt, Human
uguucccauucuugca

SEQ ID NO: 1629924 - RNA, 14 nt, Human
uuaaaaucauuucu

SEQ ID NO: 1629925 - RNA, 17 nt, Human
uuaaaccgccaaggcug

SEQ ID NO: 1629926 - RNA, 19 nt, Human
uuaaaauauuccugcauuu

SEQ ID NO: 1629927 - RNA, 16 nt, Human
uuaaaauauuccugca

SEQ ID NO: 1629928 - RNA, 15 nt, Human
uuaaauaaaucauaa

SEQ ID NO: 1629929 - RNA, 13 nt, Human
uuaaauaaaucau

SEQ ID NO: 1629930 - RNA, 20 nt, Human
uuaaauaaugugaaacugga

SEQ ID NO: 1629931 - RNA, 21 nt, Human
uuaaauaaugugaaacuggau

SEQ ID NO: 1629932 - RNA, 22 nt, Human
uuaaauaaugugaaacuggauu

SEQ ID NO: 1629933 - RNA, 18 nt, Human
uuaaaaaagaaacauuug

SEQ ID NO: 1629934 - RNA, 15 nt, Human
uuaaaaaagaaacau

SEQ ID NO: 1629935 - RNA, 20 nt, Human
aguugccagucaccccggcc

SEQ ID NO: 1629936 - RNA, 18 nt, Human
uuaaaaaguggaaaaaua

SEQ ID NO: 1629937 - RNA, 17 nt, Human
uuaaaacaacacucaca

SEQ ID NO: 1629938 - RNA, 19 nt, Human
aguuugugcugguguaugu

SEQ ID NO: 1629939 - RNA, 22 nt, Human
aguuuucacucuuauugcccac

SEQ ID NO: 1629940 - RNA, 13 nt, Human
uuaaauucuugca

SEQ ID NO: 1629941 - RNA, 16 nt, Human
uuaaauucuugcaaag

SEQ ID NO: 1629942 - RNA, 20 nt, Human
uuaaauucuugcaaaguauc

SEQ ID NO: 1629943 - RNA, 15 nt, Human
aguuucuccaagcag

SEQ ID NO: 1629944 - RNA, 13 nt, Human
aguuucuccaagc

SEQ ID NO: 1629945 - RNA, 21 nt, Human
aguuucuccaagcaggacaug

SEQ ID NO: 1629946 - RNA, 16 nt, Human
aguuucucagcuccca

SEQ ID NO: 1629947 - RNA, 16 nt, Human
aguuucguuuucaaaa

SEQ ID NO: 1629948 - RNA, 15 nt, Human
aguuucguuuucaaa

SEQ ID NO: 1629949 - RNA, 16 nt, Human
aguucugaagaagaug

SEQ ID NO: 1629950 - RNA, 15 nt, Human
aguucugaagaagau

SEQ ID NO: 1629951 - RNA, 14 nt, Human
aguucugaagaaga

SEQ ID NO: 1629952 - RNA, 13 nt, Human
aguucugaagaag

SEQ ID NO: 1629953 - RNA, 21 nt, Human
aguugauagcacagacccugc

SEQ ID NO: 1629954 - RNA, 20 nt, Human
aguugauagcacagacccug

SEQ ID NO: 1629955 - RNA, 19 nt, Human
aguugauagcacagacccu

SEQ ID NO: 1629956 - RNA, 15 nt, Human
aguugauagcacaga

SEQ ID NO: 1629957 - RNA, 21 nt, Human
aguugauaugccuuuucccaa

SEQ ID NO: 1629958 - RNA, 23 nt, Human
aguugauagcacagacccugccc

SEQ ID NO: 1629959 - RNA, 22 nt, Human
aguugauagcacagacccugcc

SEQ ID NO: 1629960 - RNA, 13 nt, Human
aguugauucagcu

SEQ ID NO: 1629961 - RNA, 18 nt, Human
aguugauucagcucugca

SEQ ID NO: 1629962 - RNA, 17 nt, Human
aguugauucagcucugc

SEQ ID NO: 1629963 - RNA, 15 nt, Human
aguugauucagcucu

SEQ ID NO: 1629964 - RNA, 14 nt, Human
aguugauucagcuc

SEQ ID NO: 1629965 - RNA, 23 nt, Human
aguugauucagcucugcaagaau

SEQ ID NO: 1629966 - RNA, 19 nt, Human
aguugcaacuuuguauaaa

SEQ ID NO: 1629967 - RNA, 15 nt, Human
uguuugcuaagcauu

SEQ ID NO: 1629968 - RNA, 16 nt, Human
uguuugccucugccuc

SEQ ID NO: 1629969 - RNA, 14 nt, Human
uguuugccucugcc

SEQ ID NO: 1629970 - RNA, 15 nt, Human
uguuugcaucugaaa

SEQ ID NO: 1629971 - RNA, 14 nt, Human
uguugucagcugaa

SEQ ID NO: 1629972 - RNA, 19 nt, Human
uguuugcuaagcauuccaa

SEQ ID NO: 1629973 - RNA, 15 nt, Human
uguuuggggaugaga

SEQ ID NO: 1629974 - RNA, 19 nt, Human
uguuuggggaugagaaagg

SEQ ID NO: 1629975 - RNA, 20 nt, Human
uguuuuauaauuuugugaag

SEQ ID NO: 1629976 - RNA, 13 nt, Human
uguuuuauaauuu

SEQ ID NO: 1629977 - RNA, 15 nt, Human
uguuuucaguguaca

SEQ ID NO: 1629978 - RNA, 17 nt, Human
uguuuucaguguacaug

SEQ ID NO: 1629979 - RNA, 15 nt, Human
uguuuucucuugaga

SEQ ID NO: 1629980 - RNA, 16 nt, Human
aguucucuccuucuuc

SEQ ID NO: 1629981 - RNA, 13 nt, Human
aguucucuccuuc

SEQ ID NO: 1629982 - RNA, 15 nt, Human
ugcagaagacaguau

SEQ ID NO: 1629983 - RNA, 22 nt, Human
ugcagacaggcaagcaccuccu

SEQ ID NO: 1629984 - RNA, 14 nt, Human
ugcagaagacagua

SEQ ID NO: 1629985 - RNA, 11 nt, Human
ugcacacauuu

SEQ ID NO: 1629986 - RNA, 12 nt, Human
ugcacacauuuu

SEQ ID NO: 1629987 - RNA, 13 nt, Human
ugcacacauuuuu

SEQ ID NO: 1629988 - RNA, 15 nt, Human
ugcacacauuuuuua

SEQ ID NO: 1629989 - RNA, 17 nt, Human
ugcacuccccugcuggg

SEQ ID NO: 1629990 - RNA, 16 nt, Human
ugcacuccccugcugg

SEQ ID NO: 1629991 - RNA, 19 nt, Human
ugcacuccccugcugggug

SEQ ID NO: 1629992 - RNA, 21 nt, Human
agcccugguggcagugggagc

SEQ ID NO: 1629993 - RNA, 17 nt, Human
agccgagaucacgccac

SEQ ID NO: 1629994 - RNA, 21 nt, Human
agccgagauagccaaggccaa

SEQ ID NO: 1629995 - RNA, 21 nt, Human
agcccuuagcagggaaacagc

SEQ ID NO: 1629996 - RNA, 16 nt, Human
agcccuuagcagggaa

SEQ ID NO: 1629997 - RNA, 17 nt, Human
ugcagacucuacagagg

SEQ ID NO: 1629998 - RNA, 16 nt, Human
ugcagacucuacagag

SEQ ID NO: 1629999 - RNA, 18 nt, Human
ugcagacucuacagaggc

SEQ ID NO: 1630000 - RNA, 23 nt, Human
agccucugaaaaccaauguucuc

SEQ ID NO: 1630001 - RNA, 21 nt, Human
agccuccaagcuccaucucca

SEQ ID NO: 1630002 - RNA, 17 nt, Human
agccuccaugcugccuc

SEQ ID NO: 1630003 - RNA, 23 nt, Human
ugcagccucaaccuccugggcua

SEQ ID NO: 1630004 - RNA, 22 nt, Human
ugcagccucaaccuccugggcu

SEQ ID NO: 1630005 - RNA, 21 nt, Human
ugcagccucaaccuccugggc

SEQ ID NO: 1630006 - RNA, 18 nt, Human
agccgagaucacgccacu

SEQ ID NO: 1630007 - RNA, 20 nt, Human
agccucaaccuccugggcua

SEQ ID NO: 1630008 - RNA, 18 nt, Human
agccucacaguccuuacc

SEQ ID NO: 1630009 - RNA, 17 nt, Human
agccucacaguccuuac

SEQ ID NO: 1630010 - RNA, 22 nt, Human
agccucagucucccucccuugg

SEQ ID NO: 1630011 - RNA, 20 nt, Human
agccucagucucccucccuu

SEQ ID NO: 1630012 - RNA, 19 nt, Human
agccucagucucccucccu

SEQ ID NO: 1630013 - RNA, 16 nt, Human
agccucagucucccuc

SEQ ID NO: 1630014 - RNA, 13 nt, Human
agccucagucucc

SEQ ID NO: 1630015 - RNA, 22 nt, Human
agccccauucugccugcccagg

SEQ ID NO: 1630016 - RNA, 21 nt, Human
agccccauucugccugcccag

SEQ ID NO: 1630017 - RNA, 18 nt, Human
agccccaaaacucuccuc

SEQ ID NO: 1630018 - RNA, 17 nt, Human
agccccaaaacucuccu

SEQ ID NO: 1630019 - RNA, 16 nt, Human
agccccaaaacucucc

SEQ ID NO: 1630020 - RNA, 21 nt, Human
ugcaaaccaucauugaaaucu

SEQ ID NO: 1630021 - RNA, 23 nt, Human
agccccauucugccugcccaggc

SEQ ID NO: 1630022 - RNA, 16 nt, Human
agcccugguggcagug

SEQ ID NO: 1630023 - RNA, 15 nt, Human
agcccugguggcagu

SEQ ID NO: 1630024 - RNA, 14 nt, Human
agcccugguggcag

SEQ ID NO: 1630025 - RNA, 18 nt, Human
ugcacacaccagagccca

SEQ ID NO: 1630026 - RNA, 17 nt, Human
ugcacacaccagagccc

SEQ ID NO: 1630027 - RNA, 21 nt, Human
ugcacacaccagagcccaccu

SEQ ID NO: 1630028 - RNA, 22 nt, Human
ugcacacaccagagcccaccuu

SEQ ID NO: 1630029 - RNA, 17 nt, Human
agcccugcuuugggcug

SEQ ID NO: 1630030 - RNA, 20 nt, Human
agcccugcuuugggcugccc

SEQ ID NO: 1630031 - RNA, 19 nt, Human
agcccugcuuugggcugcc

SEQ ID NO: 1630032 - RNA, 17 nt, Human
agccagcaguucagagc

SEQ ID NO: 1630033 - RNA, 19 nt, Human
agccagcaguucagagcug

SEQ ID NO: 1630034 - RNA, 15 nt, Human
agccagcaguucaga

SEQ ID NO: 1630035 - RNA, 11 nt, Human
agccagaggag

SEQ ID NO: 1630036 - RNA, 10 nt, Human
agccagagga

SEQ ID NO: 1630037 - RNA, 19 nt, Human
agccacugcaccgggccac

SEQ ID NO: 1630038 - RNA, 18 nt, Human
agccacugcaccgggcca

SEQ ID NO: 1630039 - RNA, 20 nt, Human
agccacugcaccgggccaca

SEQ ID NO: 1630040 - RNA, 22 nt, Human
agccagcaguucagagcugccc

SEQ ID NO: 1630041 - RNA, 20 nt, Human
agccagcaguucagagcugc

SEQ ID NO: 1630042 - RNA, 21 nt, Human
agccagcaguucagagcugcc

SEQ ID NO: 1630043 - RNA, 18 nt, Human
ugauuaaguaaugauaac

SEQ ID NO: 1630044 - RNA, 19 nt, Human
ugauuaaccacuucagcug

SEQ ID NO: 1630045 - RNA, 20 nt, Human
ugauuaaauucuugcaaagu

SEQ ID NO: 1630046 - RNA, 17 nt, Human
ugauggugaugaaaugu

SEQ ID NO: 1630047 - RNA, 13 nt, Human
ugauggugcaaug

SEQ ID NO: 1630048 - RNA, 16 nt, Human
ugauggugaugaaaug

SEQ ID NO: 1630049 - RNA, 15 nt, Human
ugauggugaugaaau

SEQ ID NO: 1630050 - RNA, 15 nt, Human
ugauggugcaaugac

SEQ ID NO: 1630051 - RNA, 19 nt, Human
ugauuaaauucuugcaaag

SEQ ID NO: 1630052 - RNA, 23 nt, Human
ugauuaaguaaugauaacuggaa

SEQ ID NO: 1630053 - RNA, 20 nt, Human
ugauuaaccacuucagcuga

SEQ ID NO: 1630054 - RNA, 15 nt, Human
ugauuaauuaaaaca

SEQ ID NO: 1630055 - RNA, 15 nt, Human
agccacgguguucug

SEQ ID NO: 1630056 - RNA, 17 nt, Human
ugauuaauggaaauguu

SEQ ID NO: 1630057 - RNA, 12 nt, Human
ugaugaagaagu

SEQ ID NO: 1630058 - RNA, 11 nt, Human
ugaugaagaag

SEQ ID NO: 1630059 - RNA, 21 nt, Human
ugauccucccaccucagccuc

SEQ ID NO: 1630060 - RNA, 16 nt, Human
ugauccucccaccuca

SEQ ID NO: 1630061 - RNA, 22 nt, Human
ugauccucccaccucagccucc

SEQ ID NO: 1630062 - RNA, 15 nt, Human
ugauccucccaccuc

SEQ ID NO: 1630063 - RNA, 16 nt, Human
ugauccuaguuccacc

SEQ ID NO: 1630064 - RNA, 19 nt, Human
ugaugggaaagcauuguaa

SEQ ID NO: 1630065 - RNA, 21 nt, Human
ugaugggcaacccccagccug

SEQ ID NO: 1630066 - RNA, 14 nt, Human
ugaugggauuuggu

SEQ ID NO: 1630067 - RNA, 19 nt, Human
ugauggggcccugccuccu

SEQ ID NO: 1630068 - RNA, 16 nt, Human
ugauggggcccugccu

SEQ ID NO: 1630069 - RNA, 15 nt, Human
ugauggggcccugcc

SEQ ID NO: 1630070 - RNA, 14 nt, Human
ugauggggcccugc

SEQ ID NO: 1630071 - RNA, 16 nt, Human
ugaugagaggaaauca

SEQ ID NO: 1630072 - RNA, 15 nt, Human
ugaugagaggaaauc

SEQ ID NO: 1630073 - RNA, 14 nt, Human
ugaugagaggaaau

SEQ ID NO: 1630074 - RNA, 13 nt, Human
ugaugagaggaaa

SEQ ID NO: 1630075 - RNA, 17 nt, Human
ugauuuggggauauuuu

SEQ ID NO: 1630076 - RNA, 16 nt, Human
ugauuucuaugcugag

SEQ ID NO: 1630077 - RNA, 15 nt, Human
ugauuucuaugcuga

SEQ ID NO: 1630078 - RNA, 12 nt, Human
ugauuucuaugc

SEQ ID NO: 1630079 - RNA, 22 nt, Human
ugauuuccguuaaaauaccagc

SEQ ID NO: 1630080 - RNA, 17 nt, Human
ugauuucagcucacugc

SEQ ID NO: 1630081 - RNA, 16 nt, Human
ugauucauaaugacuu

SEQ ID NO: 1630082 - RNA, 18 nt, Human
agcccaggaaaggcucca

SEQ ID NO: 1630083 - RNA, 21 nt, Human
ugauucauaaugacuuaagca

SEQ ID NO: 1630084 - RNA, 14 nt, Human
agcccaggaaaggc

SEQ ID NO: 1630085 - RNA, 23 nt, Human
agcccagcuugaaaccuucacuu

SEQ ID NO: 1630086 - RNA, 13 nt, Human
ugauucuccugcc

SEQ ID NO: 1630087 - RNA, 16 nt, Human
ugauucucaugccuca

SEQ ID NO: 1630088 - RNA, 15 nt, Human
ugauucucaugccuc

SEQ ID NO: 1630089 - RNA, 14 nt, Human
ugauucucaugccu

SEQ ID NO: 1630090 - RNA, 13 nt, Human
ugauucucaugcc

SEQ ID NO: 1630091 - RNA, 23 nt, Human
ugauucccaagcucugcuccucu

SEQ ID NO: 1630092 - RNA, 22 nt, Human
ugauucccaagcucugcuccuc

SEQ ID NO: 1630093 - RNA, 13 nt, Human
agccaguaaaugg

SEQ ID NO: 1630094 - RNA, 22 nt, Human
agccaguaaaugggggugcauu

SEQ ID NO: 1630095 - RNA, 21 nt, Human
agccaguaaaugggggugcau

SEQ ID NO: 1630096 - RNA, 22 nt, Human
agcccacuucugccauauucug

SEQ ID NO: 1630097 - RNA, 15 nt, Human
agcccacuucugcca

SEQ ID NO: 1630098 - RNA, 14 nt, Human
agcccacuucugcc

SEQ ID NO: 1630099 - RNA, 13 nt, Human
agcccacuucugc

SEQ ID NO: 1630100 - RNA, 16 nt, Human
agcccacuguacuugc

SEQ ID NO: 1630101 - RNA, 14 nt, Human
agcccacuguacuu

SEQ ID NO: 1630102 - RNA, 16 nt, Human
ugccccauucaacauc

SEQ ID NO: 1630103 - RNA, 23 nt, Human
ugccccgaacauguuuuucuucu

SEQ ID NO: 1630104 - RNA, 20 nt, Human
ugcccuaaaguguauuuuuu

SEQ ID NO: 1630105 - RNA, 18 nt, Human
ugcccccucugcccugcg

SEQ ID NO: 1630106 - RNA, 17 nt, Human
ugcccccucugcccugc

SEQ ID NO: 1630107 - RNA, 16 nt, Human
ugcccccucugcccug

SEQ ID NO: 1630108 - RNA, 15 nt, Human
ugcccccucugcccu

SEQ ID NO: 1630109 - RNA, 14 nt, Human
ugcccccucugccc

SEQ ID NO: 1630110 - RNA, 18 nt, Human
ugcccaggccccugccac

SEQ ID NO: 1630111 - RNA, 17 nt, Human
ugcccaggccccugcca

SEQ ID NO: 1630112 - RNA, 15 nt, Human
ugcccaggccccugc

SEQ ID NO: 1630113 - RNA, 20 nt, Human
ugcccagccccuucugaccc

SEQ ID NO: 1630114 - RNA, 17 nt, Human
ugcccagccccuucuga

SEQ ID NO: 1630115 - RNA, 16 nt, Human
ugcccagccccuucug

SEQ ID NO: 1630116 - RNA, 13 nt, Human
ugcccagccccuu

SEQ ID NO: 1630117 - RNA, 20 nt, Human
ugcccaaagaugcagccggu

SEQ ID NO: 1630118 - RNA, 17 nt, Human
ugcccaaagaugcagcc

SEQ ID NO: 1630119 - RNA, 22 nt, Human
ugccauuuaaagcuuauuaaaa

SEQ ID NO: 1630120 - RNA, 16 nt, Human
agcuccaagcucccag

SEQ ID NO: 1630121 - RNA, 15 nt, Human
agcuccaagcuccca

SEQ ID NO: 1630122 - RNA, 18 nt, Human
agcuccaagaauuucuag

SEQ ID NO: 1630123 - RNA, 17 nt, Human
agcucaggugucccugc

SEQ ID NO: 1630124 - RNA, 15 nt, Human
agcuccaagaauuuc

SEQ ID NO: 1630125 - RNA, 13 nt, Human
agcucagggccug

SEQ ID NO: 1630126 - RNA, 12 nt, Human
agcucagggccu

SEQ ID NO: 1630127 - RNA, 19 nt, Human
agcuauucaguaauaacuc

SEQ ID NO: 1630128 - RNA, 19 nt, Human
agcucagggccuggcucag

SEQ ID NO: 1630129 - RNA, 14 nt, Human
agcucagggccugg

SEQ ID NO: 1630130 - RNA, 20 nt, Human
agcucagggccuggcucagg

SEQ ID NO: 1630131 - RNA, 13 nt, Human
agcgugagccacu

SEQ ID NO: 1630132 - RNA, 21 nt, Human
agcuaggccuggccagaugca

SEQ ID NO: 1630133 - RNA, 17 nt, Human
agcuaucguaaaauuaa

SEQ ID NO: 1630134 - RNA, 20 nt, Human
agcggggacagcuccuucug

SEQ ID NO: 1630135 - RNA, 19 nt, Human
agcggggacagcuccuucu

SEQ ID NO: 1630136 - RNA, 23 nt, Human
agcggcuggcagcccaccccuca

SEQ ID NO: 1630137 - RNA, 22 nt, Human
agcggggacagcuccuucuguc

SEQ ID NO: 1630138 - RNA, 13 nt, Human
agcggcuggcagc

SEQ ID NO: 1630139 - RNA, 18 nt, Human
ugccagcuuaucucaggg

SEQ ID NO: 1630140 - RNA, 20 nt, Human
ugcauuugaggucuguucuu

SEQ ID NO: 1630141 - RNA, 21 nt, Human
ugcauuugaggucuguucuuu

SEQ ID NO: 1630142 - RNA, 17 nt, Human
ugccacugccucuuccu

SEQ ID NO: 1630143 - RNA, 13 nt, Human
ugccacugccucu

SEQ ID NO: 1630144 - RNA, 20 nt, Human
ugccacugccucuuccuccc

SEQ ID NO: 1630145 - RNA, 19 nt, Human
ugccacugccucuuccucc

SEQ ID NO: 1630146 - RNA, 18 nt, Human
ugccacugccucuuccuc

SEQ ID NO: 1630147 - RNA, 18 nt, Human
agccuuccagggguggga

SEQ ID NO: 1630148 - RNA, 15 nt, Human
agccuugaacuuuga

SEQ ID NO: 1630149 - RNA, 23 nt, Human
agccuugaacuuugaccucugca

SEQ ID NO: 1630150 - RNA, 16 nt, Human
agccuugaacuuugac

SEQ ID NO: 1630151 - RNA, 22 nt, Human
agccuugaacuuugaccucugc

SEQ ID NO: 1630152 - RNA, 22 nt, Human
agcgauucuucugcuucagccu

SEQ ID NO: 1630153 - RNA, 23 nt, Human
agccuugaccauucuccaccugc

SEQ ID NO: 1630154 - RNA, 20 nt, Human
ugcauuuaaaagauacaguu

SEQ ID NO: 1630155 - RNA, 19 nt, Human
ugcauuugaggucuguucu

SEQ ID NO: 1630156 - RNA, 13 nt, Human
ugcauuuccugac

SEQ ID NO: 1630157 - RNA, 23 nt, Human
agcucugcccauccugccccuga

SEQ ID NO: 1630158 - RNA, 21 nt, Human
agcucugcagagcaggaaaca

SEQ ID NO: 1630159 - RNA, 17 nt, Human
agcucuaucaccaagga

SEQ ID NO: 1630160 - RNA, 19 nt, Human
agcuccagcucaccagccc

SEQ ID NO: 1630161 - RNA, 18 nt, Human
agcuccagcucaccagcc

SEQ ID NO: 1630162 - RNA, 21 nt, Human
agcuccagcucaccagcccca

SEQ ID NO: 1630163 - RNA, 21 nt, Human
agcuccaucuccacuccagau

SEQ ID NO: 1630164 - RNA, 23 nt, Human
agcuccuucuguccuacucugug

SEQ ID NO: 1630165 - RNA, 12 nt, Human
ugcccucuccug

SEQ ID NO: 1630166 - RNA, 13 nt, Human
ugcccucuccugg

SEQ ID NO: 1630167 - RNA, 14 nt, Human
ugcccucuccuggg

SEQ ID NO: 1630168 - RNA, 15 nt, Human
ugcccucuccugggc

SEQ ID NO: 1630169 - RNA, 22 nt, Human
ugcccucuccugggcagcugcc

SEQ ID NO: 1630170 - RNA, 23 nt, Human
ugcccucuccugggcagcugccu

SEQ ID NO: 1630171 - RNA, 16 nt, Human
ugcccucuccugggca

SEQ ID NO: 1630172 - RNA, 17 nt, Human
ugcccucuccugggcag

SEQ ID NO: 1630173 - RNA, 18 nt, Human
ugcccucuccugggcagc

SEQ ID NO: 1630174 - RNA, 20 nt, Human
ugcccucuccugggcagcug

SEQ ID NO: 1630175 - RNA, 20 nt, Human
ugcccuaaugcgcaggcugg

SEQ ID NO: 1630176 - RNA, 23 nt, Human
ugcccuaaugcgcaggcuggccc

SEQ ID NO: 1630177 - RNA, 19 nt, Human
agcuccaagcucccaggca

SEQ ID NO: 1630178 - RNA, 18 nt, Human
agcuccaagcucccaggc

SEQ ID NO: 1630179 - RNA, 17 nt, Human
agcuccaagcucccagg

SEQ ID NO: 1630180 - RNA, 14 nt, Human
ugcccugcccaccu

SEQ ID NO: 1630181 - RNA, 17 nt, Human
agcuccagcucaccagc

SEQ ID NO: 1630182 - RNA, 13 nt, Human
agcuccagcucac

SEQ ID NO: 1630183 - RNA, 19 nt, Human
ugcccuguuaaaagaugaa

SEQ ID NO: 1630184 - RNA, 22 nt, Human
ugcccuuaccugccaggaagcc

SEQ ID NO: 1630185 - RNA, 18 nt, Human
ugcccugugggcccccaa

SEQ ID NO: 1630186 - RNA, 15 nt, Human
ugcccugugggcccc

SEQ ID NO: 1630187 - RNA, 17 nt, Human
agcucuucuccaggcug

SEQ ID NO: 1630188 - RNA, 16 nt, Human
agcucuucuccaggcu

SEQ ID NO: 1630189 - RNA, 15 nt, Human
agcucuucuccaggc

SEQ ID NO: 1630190 - RNA, 15 nt, Human
ugccucaccccuugc

SEQ ID NO: 1630191 - RNA, 20 nt, Human
ugccgcagcccugcagaggg

SEQ ID NO: 1630192 - RNA, 18 nt, Human
ugccucagaaaacaagga

SEQ ID NO: 1630193 - RNA, 15 nt, Human
ugccucagccucccg

SEQ ID NO: 1630194 - RNA, 15 nt, Human
ugccucagccuccug

SEQ ID NO: 1630195 - RNA, 22 nt, Human
ugccucccaucacccgcuaaga

SEQ ID NO: 1630196 - RNA, 16 nt, Human
ugccuccccuccucug

SEQ ID NO: 1630197 - RNA, 17 nt, Human
ugccucucucaggccaa

SEQ ID NO: 1630198 - RNA, 12 nt, Human
ugccucucugca

SEQ ID NO: 1630199 - RNA, 11 nt, Human
ugccucucugc

SEQ ID NO: 1630200 - RNA, 11 nt, Human
ugccuccccuc

SEQ ID NO: 1630201 - RNA, 12 nt, Human
ugccuccccucc

SEQ ID NO: 1630202 - RNA, 13 nt, Human
ugccuccccuccu

SEQ ID NO: 1630203 - RNA, 14 nt, Human
ugccuccccuccuc

SEQ ID NO: 1630204 - RNA, 15 nt, Human
ugccuccccuccucu

SEQ ID NO: 1630205 - RNA, 17 nt, Human
agcugcccucuccuggg

SEQ ID NO: 1630206 - RNA, 18 nt, Human
agcugcccucuccugggc

SEQ ID NO: 1630207 - RNA, 19 nt, Human
agcugcccucuccugggca

SEQ ID NO: 1630208 - RNA, 20 nt, Human
agcugcccucuccugggcag

SEQ ID NO: 1630209 - RNA, 21 nt, Human
agcugcccucuccugggcagc

SEQ ID NO: 1630210 - RNA, 13 nt, Human
agcugccuguuca

SEQ ID NO: 1630211 - RNA, 24 nt, Human
agcugcuuuugucuaugggacuca

SEQ ID NO: 1630212 - RNA, 23 nt, Human
agcugcuuuugucuaugggacuc

SEQ ID NO: 1630213 - RNA, 19 nt, Human
ugccugcccaggccccugc

SEQ ID NO: 1630214 - RNA, 18 nt, Human
ugccugcccaggccccug

SEQ ID NO: 1630215 - RNA, 17 nt, Human
ugccugcccaggccccu

SEQ ID NO: 1630216 - RNA, 12 nt, Human
ugccucugccuc

SEQ ID NO: 1630217 - RNA, 20 nt, Human
ugccugcccaggccccugcc

SEQ ID NO: 1630218 - RNA, 11 nt, Human
ugccucugccu

SEQ ID NO: 1630219 - RNA, 16 nt, Human
ugccucugacacacag

SEQ ID NO: 1630220 - RNA, 14 nt, Human
ugccucugacacac

SEQ ID NO: 1630221 - RNA, 23 nt, Human
ugccucucugcaggucccuaaua

SEQ ID NO: 1630222 - RNA, 15 nt, Human
ugccucucugcaggu

SEQ ID NO: 1630223 - RNA, 22 nt, Human
uggcacaguuuucugagaaaga

SEQ ID NO: 1630224 - RNA, 20 nt, Human
uggcacaucagcacgauuuc

SEQ ID NO: 1630225 - RNA, 12 nt, Human
uggauguucuga

SEQ ID NO: 1630226 - RNA, 22 nt, Human
uggauuaaacuuaaucuaaaug

SEQ ID NO: 1630227 - RNA, 22 nt, Human
uggcagaguugaagacagagcu

SEQ ID NO: 1630228 - RNA, 21 nt, Human
uggcagaguugaagacagagc

SEQ ID NO: 1630229 - RNA, 16 nt, Human
uggcacccggccccug

SEQ ID NO: 1630230 - RNA, 15 nt, Human
uggcacccggccccu

SEQ ID NO: 1630231 - RNA, 21 nt, Human
uggcacaucagcacgauuucu

SEQ ID NO: 1630232 - RNA, 12 nt, Human
uggcagccccug

SEQ ID NO: 1630233 - RNA, 16 nt, Human
uggcagccgugccuuc

SEQ ID NO: 1630234 - RNA, 20 nt, Human
aggccacaagacccuugugg

SEQ ID NO: 1630235 - RNA, 16 nt, Human
uggcagccucuucaaa

SEQ ID NO: 1630236 - RNA, 15 nt, Human
uggcagccucuucaa

SEQ ID NO: 1630237 - RNA, 23 nt, Human
uggcagccgugccuucagcucua

SEQ ID NO: 1630238 - RNA, 13 nt, Human
uggcagccuuggc

SEQ ID NO: 1630239 - RNA, 12 nt, Human
aggccagagaca

SEQ ID NO: 1630240 - RNA, 18 nt, Human
uggacgagaaaacaauaa

SEQ ID NO: 1630241 - RNA, 18 nt, Human
aggcauuuguuugaacug

SEQ ID NO: 1630242 - RNA, 16 nt, Human
aggccaaacucaccug

SEQ ID NO: 1630243 - RNA, 15 nt, Human
aggccaaaggaagca

SEQ ID NO: 1630244 - RNA, 14 nt, Human
aggccaaaggaagc

SEQ ID NO: 1630245 - RNA, 20 nt, Human
aggccaaacucaccugcccc

SEQ ID NO: 1630246 - RNA, 23 nt, Human
aggccaaaggaagcacaugccuc

SEQ ID NO: 1630247 - RNA, 20 nt, Human
uggaguucaucuugaauugu

SEQ ID NO: 1630248 - RNA, 17 nt, Human
uggaguucaucuugaau

SEQ ID NO: 1630249 - RNA, 16 nt, Human
uggaguucaucuugaa

SEQ ID NO: 1630250 - RNA, 19 nt, Human
uggaugccugguggcagcu

SEQ ID NO: 1630251 - RNA, 18 nt, Human
uggaugccugguggcagc

SEQ ID NO: 1630252 - RNA, 20 nt, Human
uggaugccugguggcagcug

SEQ ID NO: 1630253 - RNA, 16 nt, Human
aggccacaagacccuu

SEQ ID NO: 1630254 - RNA, 15 nt, Human
aggccacaagacccu

SEQ ID NO: 1630255 - RNA, 19 nt, Human
uggagucagacagaugugg

SEQ ID NO: 1630256 - RNA, 15 nt, Human
uggccgggagccuga

SEQ ID NO: 1630257 - RNA, 21 nt, Human
uggccccugcccggcugcgga

SEQ ID NO: 1630258 - RNA, 19 nt, Human
uggcccgacagccuggcac

SEQ ID NO: 1630259 - RNA, 18 nt, Human
uggcccgacagccuggca

SEQ ID NO: 1630260 - RNA, 17 nt, Human
uggcccgacagccuggc

SEQ ID NO: 1630261 - RNA, 16 nt, Human
uggcccgacagccugg

SEQ ID NO: 1630262 - RNA, 15 nt, Human
uggcccgacagccug

SEQ ID NO: 1630263 - RNA, 14 nt, Human
uggcccgacagccu

SEQ ID NO: 1630264 - RNA, 21 nt, Human
aggccuggccagaugcaccag

SEQ ID NO: 1630265 - RNA, 17 nt, Human
aggccuggccagaugca

SEQ ID NO: 1630266 - RNA, 16 nt, Human
aggccuggccagaugc

SEQ ID NO: 1630267 - RNA, 15 nt, Human
aggccuggccagaug

SEQ ID NO: 1630268 - RNA, 23 nt, Human
aggccuggccagaugcaccagcc

SEQ ID NO: 1630269 - RNA, 22 nt, Human
aggccuggccagaugcaccagc

SEQ ID NO: 1630270 - RNA, 23 nt, Human
aggccugggggcugggcagagga

SEQ ID NO: 1630271 - RNA, 12 nt, Human
uggccuggcccc

SEQ ID NO: 1630272 - RNA, 18 nt, Human
uggccucugcacuccccu

SEQ ID NO: 1630273 - RNA, 23 nt, Human
uggccgggcgcgguggcucacgc

SEQ ID NO: 1630274 - RNA, 17 nt, Human
uggccucugcacucccc

SEQ ID NO: 1630275 - RNA, 15 nt, Human
uggccucugcacucc

SEQ ID NO: 1630276 - RNA, 14 nt, Human
uggccucugcacuc

SEQ ID NO: 1630277 - RNA, 15 nt, Human
aggcccucugcccac

SEQ ID NO: 1630278 - RNA, 14 nt, Human
aggcccucugccca

SEQ ID NO: 1630279 - RNA, 13 nt, Human
aggcccucugccc

SEQ ID NO: 1630280 - RNA, 13 nt, Human
aggccugccuguu

SEQ ID NO: 1630281 - RNA, 15 nt, Human
uggcaugggaaugaa

SEQ ID NO: 1630282 - RNA, 12 nt, Human
uggcaugggaau

SEQ ID NO: 1630283 - RNA, 22 nt, Human
uggcaugggaaugaaugucagu

SEQ ID NO: 1630284 - RNA, 17 nt, Human
uggccaggcuggucuca

SEQ ID NO: 1630285 - RNA, 20 nt, Human
uggccaggcuggucucgaac

SEQ ID NO: 1630286 - RNA, 20 nt, Human
aggcucucaggccagcugcu

SEQ ID NO: 1630287 - RNA, 19 nt, Human
aggcucucaggccagcugc

SEQ ID NO: 1630288 - RNA, 18 nt, Human
aggcucucaggccagcug

SEQ ID NO: 1630289 - RNA, 16 nt, Human
aggcucucaggccagc

SEQ ID NO: 1630290 - RNA, 15 nt, Human
aggcucucaggccag

SEQ ID NO: 1630291 - RNA, 14 nt, Human
aggcucucaggcca

SEQ ID NO: 1630292 - RNA, 12 nt, Human
aggcucucaggc

SEQ ID NO: 1630293 - RNA, 11 nt, Human
aggcucucagg

SEQ ID NO: 1630294 - RNA, 15 nt, Human
aggcucugcccuugg

SEQ ID NO: 1630295 - RNA, 14 nt, Human
aggcucugcccuug

SEQ ID NO: 1630296 - RNA, 13 nt, Human
aggcucugcccuu

SEQ ID NO: 1630297 - RNA, 12 nt, Human
aggcucugcccu

SEQ ID NO: 1630298 - RNA, 11 nt, Human
aggcucugccc

SEQ ID NO: 1630299 - RNA, 21 nt, Human
aggcucucaggccagcugcuu

SEQ ID NO: 1630300 - RNA, 19 nt, Human
aggcucgagcaugccugga

SEQ ID NO: 1630301 - RNA, 18 nt, Human
aggcucgagcaugccugg

SEQ ID NO: 1630302 - RNA, 17 nt, Human
aggcucgagcaugccug

SEQ ID NO: 1630303 - RNA, 15 nt, Human
aggcucgagcaugcc

SEQ ID NO: 1630304 - RNA, 21 nt, Human
aggcucgagcaugccuggaug

SEQ ID NO: 1630305 - RNA, 12 nt, Human
aggcucgagcau

SEQ ID NO: 1630306 - RNA, 19 nt, Human
aggcuccuuuagcgcccag

SEQ ID NO: 1630307 - RNA, 20 nt, Human
aggcuccugccaccacgccc

SEQ ID NO: 1630308 - RNA, 14 nt, Human
aggcuccugccacc

SEQ ID NO: 1630309 - RNA, 17 nt, Human
aggcuggcgugcagugg

SEQ ID NO: 1630310 - RNA, 13 nt, Human
aggcuggcgugca

SEQ ID NO: 1630311 - RNA, 19 nt, Human
aggcuggcccugcccuggu

SEQ ID NO: 1630312 - RNA, 14 nt, Human
aggcuggcccugcc

SEQ ID NO: 1630313 - RNA, 12 nt, Human
aggcuggcccug

SEQ ID NO: 1630314 - RNA, 18 nt, Human
aggcuggcccugcccugg

SEQ ID NO: 1630315 - RNA, 17 nt, Human
aggcuggcccugcccug

SEQ ID NO: 1630316 - RNA, 16 nt, Human
aggcuggcccugcccu

SEQ ID NO: 1630317 - RNA, 15 nt, Human
aggcuggcccugccc

SEQ ID NO: 1630318 - RNA, 16 nt, Human
aggcucugcccuuggu

SEQ ID NO: 1630319 - RNA, 13 nt, Human
aggcucuggagcc

SEQ ID NO: 1630320 - RNA, 15 nt, Human
aggcucuggagccca

SEQ ID NO: 1630321 - RNA, 14 nt, Human
aggcucuggagccc

SEQ ID NO: 1630322 - RNA, 19 nt, Human
aggcucuggagcccacugu

SEQ ID NO: 1630323 - RNA, 18 nt, Human
aggcucuggagcccacug

SEQ ID NO: 1630324 - RNA, 23 nt, Human
aggcugcucuugaacuccugacc

SEQ ID NO: 1630325 - RNA, 11 nt, Human
uggcugcugaa

SEQ ID NO: 1630326 - RNA, 17 nt, Human
uggcuuaaaacaacacu

SEQ ID NO: 1630327 - RNA, 15 nt, Human
uggcuguuggcuggg

SEQ ID NO: 1630328 - RNA, 13 nt, Human
uggcuguuggcug

SEQ ID NO: 1630329 - RNA, 14 nt, Human
uggcugugucuccc

SEQ ID NO: 1630330 - RNA, 23 nt, Human
uggcuucacggaagagccuugcg

SEQ ID NO: 1630331 - RNA, 16 nt, Human
ugggaaaggggaaguu

SEQ ID NO: 1630332 - RNA, 16 nt, Human
uggcuucccgcucagc

SEQ ID NO: 1630333 - RNA, 15 nt, Human
uggcuucccgcucag

SEQ ID NO: 1630334 - RNA, 17 nt, Human
uggcuucccgcucagcc

SEQ ID NO: 1630335 - RNA, 18 nt, Human
uggcuucccgcucagccc

SEQ ID NO: 1630336 - RNA, 13 nt, Human
ugggaacuagacu

SEQ ID NO: 1630337 - RNA, 15 nt, Human
uggcuaugcauuuga

SEQ ID NO: 1630338 - RNA, 17 nt, Human
uggcuaugcauuugaaa

SEQ ID NO: 1630339 - RNA, 14 nt, Human
uggcuaugcauuug

SEQ ID NO: 1630340 - RNA, 19 nt, Human
uggcuaugcauuugaaaau

SEQ ID NO: 1630341 - RNA, 22 nt, Human
uggcuauuagagaucaaccccu

SEQ ID NO: 1630342 - RNA, 14 nt, Human
aggcugggagagcc

SEQ ID NO: 1630343 - RNA, 22 nt, Human
uggcuagagguucaaagauauu

SEQ ID NO: 1630344 - RNA, 20 nt, Human
aggcuggcgugcaguggugc

SEQ ID NO: 1630345 - RNA, 18 nt, Human
aggcuggcgugcaguggu

SEQ ID NO: 1630346 - RNA, 21 nt, Human
uggcucuuccaggcugggaga

SEQ ID NO: 1630347 - RNA, 20 nt, Human
uggcucuuccaggcugggag

SEQ ID NO: 1630348 - RNA, 18 nt, Human
uggcucaaguccucuuuu

SEQ ID NO: 1630349 - RNA, 12 nt, Human
uggcugcaaagg

SEQ ID NO: 1630350 - RNA, 14 nt, Human
uggcugcagggagu

SEQ ID NO: 1630351 - RNA, 13 nt, Human
uggcugcagggag

SEQ ID NO: 1630352 - RNA, 15 nt, Human
uggcugcagggaguc

SEQ ID NO: 1630353 - RNA, 20 nt, Human
uggcugccaaugggagcuca

SEQ ID NO: 1630354 - RNA, 18 nt, Human
uggcugccaaugggagcu

SEQ ID NO: 1630355 - RNA, 22 nt, Human
uggaauuucucccagucauuua

SEQ ID NO: 1630356 - RNA, 18 nt, Human
uggaauuggagcucgugg

SEQ ID NO: 1630357 - RNA, 19 nt, Human
aggcaacugcauuggcuuu

SEQ ID NO: 1630358 - RNA, 17 nt, Human
aggcaacucaucuuagg

SEQ ID NO: 1630359 - RNA, 19 nt, Human
aggauuuugauccaagcug

SEQ ID NO: 1630360 - RNA, 17 nt, Human
aggaugccccguccccc

SEQ ID NO: 1630361 - RNA, 14 nt, Human
aggaugcccaaaga

SEQ ID NO: 1630362 - RNA, 20 nt, Human
aggaugaucuaggaagacuu

SEQ ID NO: 1630363 - RNA, 19 nt, Human
aggaugcccaaagaugcag

SEQ ID NO: 1630364 - RNA, 13 nt, Human
uggacccugaggc

SEQ ID NO: 1630365 - RNA, 12 nt, Human
uggacccugagg

SEQ ID NO: 1630366 - RNA, 14 nt, Human
uggacccugaggcc

SEQ ID NO: 1630367 - RNA, 15 nt, Human
uggacccugaggccc

SEQ ID NO: 1630368 - RNA, 21 nt, Human
uggacacagcucuucuccagg

SEQ ID NO: 1630369 - RNA, 18 nt, Human
uggacacagcucuucucc

SEQ ID NO: 1630370 - RNA, 16 nt, Human
uggacacagcucuucu

SEQ ID NO: 1630371 - RNA, 15 nt, Human
uggacacagcucuuc

SEQ ID NO: 1630372 - RNA, 21 nt, Human
aggagggagcaucagugcccu

SEQ ID NO: 1630373 - RNA, 14 nt, Human
aggagggaggggga

SEQ ID NO: 1630374 - RNA, 16 nt, Human
aggauccugagccaga

SEQ ID NO: 1630375 - RNA, 15 nt, Human
aggauccugagccag

SEQ ID NO: 1630376 - RNA, 21 nt, Human
aggauacaaaagcaugugaga

SEQ ID NO: 1630377 - RNA, 17 nt, Human
aggaugaucuaggaaga

SEQ ID NO: 1630378 - RNA, 16 nt, Human
aggaugaucuaggaag

SEQ ID NO: 1630379 - RNA, 22 nt, Human
aggaucucuugagccugggagg

SEQ ID NO: 1630380 - RNA, 21 nt, Human
aggaucucuugagccugggag

SEQ ID NO: 1630381 - RNA, 18 nt, Human
aggauccugagccagauu

SEQ ID NO: 1630382 - RNA, 17 nt, Human
aggauccugagccagau

SEQ ID NO: 1630383 - RNA, 23 nt, Human
uggaaaugggcagagcagagacc

SEQ ID NO: 1630384 - RNA, 20 nt, Human
uggaaauauuaagaaagacu

SEQ ID NO: 1630385 - RNA, 13 nt, Human
uggaaaggcagcu

SEQ ID NO: 1630386 - RNA, 15 nt, Human
uggaaauauuaagaa

SEQ ID NO: 1630387 - RNA, 19 nt, Human
ugcuugggcuucauccucc

SEQ ID NO: 1630388 - RNA, 21 nt, Human
ugcuuugggcugcccuggugc

SEQ ID NO: 1630389 - RNA, 20 nt, Human
ugcuuugggcugcccuggug

SEQ ID NO: 1630390 - RNA, 19 nt, Human
ugcuuugggcugcccuggu

SEQ ID NO: 1630391 - RNA, 18 nt, Human
ugcuuugggcugcccugg

SEQ ID NO: 1630392 - RNA, 15 nt, Human
ugcuugccaucccuc

SEQ ID NO: 1630393 - RNA, 16 nt, Human
ugcuugccaucccucc

SEQ ID NO: 1630394 - RNA, 23 nt, Human
aggagcccugggaggcucuggag

SEQ ID NO: 1630395 - RNA, 19 nt, Human
aggagcccugggaggcucu

SEQ ID NO: 1630396 - RNA, 16 nt, Human
ugcuugggcuucaucc

SEQ ID NO: 1630397 - RNA, 12 nt, Human
ugcuugggcuuc

SEQ ID NO: 1630398 - RNA, 21 nt, Human
ugcuuggaggaaggaaaccca

SEQ ID NO: 1630399 - RNA, 17 nt, Human
aggagaaacuggaacuc

SEQ ID NO: 1630400 - RNA, 17 nt, Human
aggagauuggaaggaac

SEQ ID NO: 1630401 - RNA, 11 nt, Human
aggagaaacug

SEQ ID NO: 1630402 - RNA, 17 nt, Human
aggacuuguuagaucua

SEQ ID NO: 1630403 - RNA, 22 nt, Human
aggagccccgaggccuucucug

SEQ ID NO: 1630404 - RNA, 18 nt, Human
aggagcccugggaggcuc

SEQ ID NO: 1630405 - RNA, 18 nt, Human
aggacauugcggacagcc

SEQ ID NO: 1630406 - RNA, 17 nt, Human
aggacauugcggacagc

SEQ ID NO: 1630407 - RNA, 15 nt, Human
aggacauugcggaca

SEQ ID NO: 1630408 - RNA, 23 nt, Human
aggacauugcggacagccacggc

SEQ ID NO: 1630409 - RNA, 19 nt, Human
aggacauugcggacagcca

SEQ ID NO: 1630410 - RNA, 20 nt, Human
aggacugaauuaugaaacuu

SEQ ID NO: 1630411 - RNA, 19 nt, Human
aggacugaauuaugaaacu

SEQ ID NO: 1630412 - RNA, 16 nt, Human
aggacuuguuagaucu

SEQ ID NO: 1630413 - RNA, 14 nt, Human
aggacuuguuagau

SEQ ID NO: 1630414 - RNA, 11 nt, Human
aggaauuuaaa

SEQ ID NO: 1630415 - RNA, 23 nt, Human
aggaauugacccacaagaaauga

SEQ ID NO: 1630416 - RNA, 23 nt, Human
aggaauuguguuuauaauuuuaa

SEQ ID NO: 1630417 - RNA, 18 nt, Human
aggaagccagcaggcucu

SEQ ID NO: 1630418 - RNA, 17 nt, Human
aggaagccagcaggcuc

SEQ ID NO: 1630419 - RNA, 18 nt, Human
aggaaggaaacccagcuc

SEQ ID NO: 1630420 - RNA, 15 nt, Human
aggaaggagaggaga

SEQ ID NO: 1630421 - RNA, 19 nt, Human
aggaaggaaacccagcucu

SEQ ID NO: 1630422 - RNA, 19 nt, Human
aggaagacuucaucccucu

SEQ ID NO: 1630423 - RNA, 13 nt, Human
aggaagacuucau

SEQ ID NO: 1630424 - RNA, 23 nt, Human
ugcugagucugaaggcuggguuc

SEQ ID NO: 1630425 - RNA, 22 nt, Human
ugcugagucugaaggcuggguu

SEQ ID NO: 1630426 - RNA, 21 nt, Human
ugcugagucugaaggcugggu

SEQ ID NO: 1630427 - RNA, 18 nt, Human
ugcugagucugaaggcug

SEQ ID NO: 1630428 - RNA, 17 nt, Human
ugcugagucugaaggcu

SEQ ID NO: 1630429 - RNA, 16 nt, Human
ugcugagucugaaggc

SEQ ID NO: 1630430 - RNA, 24 nt, Human
aggaagcacaugccucucucaggc

SEQ ID NO: 1630431 - RNA, 23 nt, Human
aggaagcacaugccucucucagg

SEQ ID NO: 1630432 - RNA, 14 nt, Human
aggaagacuuugga

SEQ ID NO: 1630433 - RNA, 13 nt, Human
aggaagacuuugg

SEQ ID NO: 1630434 - RNA, 15 nt, Human
aggaagccagcaggc

SEQ ID NO: 1630435 - RNA, 14 nt, Human
aggaagccagcagg

SEQ ID NO: 1630436 - RNA, 15 nt, Human
ugcugagucugaagg

SEQ ID NO: 1630437 - RNA, 14 nt, Human
ugcugacuguacuc

SEQ ID NO: 1630438 - RNA, 22 nt, Human
ugcucugcugacagacacaggc

SEQ ID NO: 1630439 - RNA, 21 nt, Human
ugcucugcugacagacacagg

SEQ ID NO: 1630440 - RNA, 20 nt, Human
ugcuccagcuguucagcugg

SEQ ID NO: 1630441 - RNA, 19 nt, Human
ugcuccagcuguucagcug

SEQ ID NO: 1630442 - RNA, 16 nt, Human
ugcuccagcuguucag

SEQ ID NO: 1630443 - RNA, 18 nt, Human
agcugggacuacaggcac

SEQ ID NO: 1630444 - RNA, 16 nt, Human
agcugggacuacaggc

SEQ ID NO: 1630445 - RNA, 19 nt, Human
agcugggacuacaggcacc

SEQ ID NO: 1630446 - RNA, 13 nt, Human
ugcuauuucuaua

SEQ ID NO: 1630447 - RNA, 12 nt, Human
ugcuauuucuau

SEQ ID NO: 1630448 - RNA, 21 nt, Human
ugcuauuucuauauuuucauu

SEQ ID NO: 1630449 - RNA, 20 nt, Human
ugcuauuucuauauuuucau

SEQ ID NO: 1630450 - RNA, 14 nt, Human
ugcuauuucuauau

SEQ ID NO: 1630451 - RNA, 17 nt, Human
aggacacugauaugggu

SEQ ID NO: 1630452 - RNA, 22 nt, Human
aggacagggaggugaccccagg

SEQ ID NO: 1630453 - RNA, 14 nt, Human
aggacacugauaug

SEQ ID NO: 1630454 - RNA, 14 nt, Human
ugcuucaucccuuu

SEQ ID NO: 1630455 - RNA, 23 nt, Human
aggacacuaaccacgcuggaccu

SEQ ID NO: 1630456 - RNA, 13 nt, Human
ugcuuauacacuu

SEQ ID NO: 1630457 - RNA, 14 nt, Human
ugcuucagccuccc

SEQ ID NO: 1630458 - RNA, 13 nt, Human
ugcuucagccucc

SEQ ID NO: 1630459 - RNA, 20 nt, Human
ugcuucaaggauccugagcc

SEQ ID NO: 1630460 - RNA, 19 nt, Human
ugcuucaaggauccugagc

SEQ ID NO: 1630461 - RNA, 18 nt, Human
ugcuucaaggauccugag

SEQ ID NO: 1630462 - RNA, 16 nt, Human
ugcuucaaggauccug

SEQ ID NO: 1630463 - RNA, 14 nt, Human
ugcuggagcucugc

SEQ ID NO: 1630464 - RNA, 13 nt, Human
ugcuggagcucug

SEQ ID NO: 1630465 - RNA, 15 nt, Human
ugcugcccugugagu

SEQ ID NO: 1630466 - RNA, 20 nt, Human
aggaauuuuauuuuuuucug

SEQ ID NO: 1630467 - RNA, 14 nt, Human
ugcugcccugugag

SEQ ID NO: 1630468 - RNA, 13 nt, Human
ugcugcccuguga

SEQ ID NO: 1630469 - RNA, 18 nt, Human
ugcuggcuguuggcuggg

SEQ ID NO: 1630470 - RNA, 16 nt, Human
ugcuggcugguuagag

SEQ ID NO: 1630471 - RNA, 21 nt, Human
ugcuggcugccuuagaaccuu

SEQ ID NO: 1630472 - RNA, 14 nt, Human
ugcuggcugccuua

SEQ ID NO: 1630473 - RNA, 15 nt, Human
ugcuggcugccuuag

SEQ ID NO: 1630474 - RNA, 19 nt, Human
aucagucugauucccaagc

SEQ ID NO: 1630475 - RNA, 17 nt, Human
aucagugcccuccagga

SEQ ID NO: 1630476 - RNA, 15 nt, Human
aucagugcccuccag

SEQ ID NO: 1630477 - RNA, 13 nt, Human
aucagugcccucc

SEQ ID NO: 1630478 - RNA, 23 nt, Human
aucacuugaacccgggaggcaga

SEQ ID NO: 1630479 - RNA, 15 nt, Human
aucaggugcugccau

SEQ ID NO: 1630480 - RNA, 19 nt, Human
aucaggugcugccauccag

SEQ ID NO: 1630481 - RNA, 17 nt, Human
aucaggugcugccaucc

SEQ ID NO: 1630482 - RNA, 15 nt, Human
aucauaaaacuugau

SEQ ID NO: 1630483 - RNA, 23 nt, Human
aucauccacugugccaugugcca

SEQ ID NO: 1630484 - RNA, 21 nt, Human
aucauccacugugccaugugc

SEQ ID NO: 1630485 - RNA, 16 nt, Human
aucauuaggugugacu

SEQ ID NO: 1630486 - RNA, 16 nt, Human
uucugcaucagcugcu

SEQ ID NO: 1630487 - RNA, 21 nt, Human
uucucuaguuugauuaaauuc

SEQ ID NO: 1630488 - RNA, 22 nt, Human
uucuccuuucacaaccuucugu

SEQ ID NO: 1630489 - RNA, 18 nt, Human
uucuccuuucacaaccuu

SEQ ID NO: 1630490 - RNA, 12 nt, Human
aucauugaaauc

SEQ ID NO: 1630491 - RNA, 13 nt, Human
aucauugaaaucu

SEQ ID NO: 1630492 - RNA, 19 nt, Human
aucauugugaaauuauuca

SEQ ID NO: 1630493 - RNA, 15 nt, Human
aucauugugaaauua

SEQ ID NO: 1630494 - RNA, 13 nt, Human
aucauugugaaau

SEQ ID NO: 1630495 - RNA, 17 nt, Human
uucuguuuuauaauuuu

SEQ ID NO: 1630496 - RNA, 16 nt, Human
uucuguuuuauaauuu

SEQ ID NO: 1630497 - RNA, 13 nt, Human
uucuguuuagaua

SEQ ID NO: 1630498 - RNA, 18 nt, Human
uucuguuuagauaauaca

SEQ ID NO: 1630499 - RNA, 23 nt, Human
uucuuaaccagaucauugugaaa

SEQ ID NO: 1630500 - RNA, 22 nt, Human
uucuuaaccagaucauugugaa

SEQ ID NO: 1630501 - RNA, 13 nt, Human
uucuuaaaguuga

SEQ ID NO: 1630502 - RNA, 11 nt, Human
uucuucucccu

SEQ ID NO: 1630503 - RNA, 22 nt, Human
uucuucuccacuuucuagccag

SEQ ID NO: 1630504 - RNA, 17 nt, Human
uucuuucuggcuaugca

SEQ ID NO: 1630505 - RNA, 20 nt, Human
uucuuucuggcuaugcauuu

SEQ ID NO: 1630506 - RNA, 12 nt, Human
uucuuucuggcu

SEQ ID NO: 1630507 - RNA, 16 nt, Human
aucccucccuccaccu

SEQ ID NO: 1630508 - RNA, 17 nt, Human
aucccucccuccaccuc

SEQ ID NO: 1630509 - RNA, 18 nt, Human
aucccucccuccaccucc

SEQ ID NO: 1630510 - RNA, 18 nt, Human
aucccaugagccucagca

SEQ ID NO: 1630511 - RNA, 17 nt, Human
aucccaugagccucagc

SEQ ID NO: 1630512 - RNA, 20 nt, Human
aucccucccuccaccucccu

SEQ ID NO: 1630513 - RNA, 21 nt, Human
aucccucccuccaccucccug

SEQ ID NO: 1630514 - RNA, 17 nt, Human
aucccugaaggccccgc

SEQ ID NO: 1630515 - RNA, 22 nt, Human
aucccugaaggccccgcccagg

SEQ ID NO: 1630516 - RNA, 16 nt, Human
aucccaugagccucag

SEQ ID NO: 1630517 - RNA, 12 nt, Human
aucccagcccca

SEQ ID NO: 1630518 - RNA, 11 nt, Human
aucccagcccc

SEQ ID NO: 1630519 - RNA, 17 nt, Human
auccagguucagcuugu

SEQ ID NO: 1630520 - RNA, 15 nt, Human
auccaguaucuugaa

SEQ ID NO: 1630521 - RNA, 14 nt, Human
auccaguaucuuga

SEQ ID NO: 1630522 - RNA, 16 nt, Human
uucugccugcccaggc

SEQ ID NO: 1630523 - RNA, 15 nt, Human
uucugccugcccagg

SEQ ID NO: 1630524 - RNA, 16 nt, Human
auccaagcaaauguga

SEQ ID NO: 1630525 - RNA, 18 nt, Human
auccaagcaaaugugaau

SEQ ID NO: 1630526 - RNA, 15 nt, Human
aucuaaauguugaaa

SEQ ID NO: 1630527 - RNA, 15 nt, Human
aucuaaacugccccc

SEQ ID NO: 1630528 - RNA, 15 nt, Human
aucgugacaacacuu

SEQ ID NO: 1630529 - RNA, 14 nt, Human
aucgugacaacacu

SEQ ID NO: 1630530 - RNA, 18 nt, Human
aucgucacugcuuaacuu

SEQ ID NO: 1630531 - RNA, 14 nt, Human
aucgucacugcuua

SEQ ID NO: 1630532 - RNA, 17 nt, Human
uugacacuuaaaaaugg

SEQ ID NO: 1630533 - RNA, 16 nt, Human
uugaggucuguucuuu

SEQ ID NO: 1630534 - RNA, 15 nt, Human
uugagaucagccugg

SEQ ID NO: 1630535 - RNA, 12 nt, Human
uugauaaaguaa

SEQ ID NO: 1630536 - RNA, 14 nt, Human
uugacccacaagaa

SEQ ID NO: 1630537 - RNA, 24 nt, Human
uugaccauucuccaccugccaggg

SEQ ID NO: 1630538 - RNA, 19 nt, Human
uugacacuuaaaaaugguu

SEQ ID NO: 1630539 - RNA, 14 nt, Human
uugacauagucugg

SEQ ID NO: 1630540 - RNA, 19 nt, Human
uugaccauucuccaccugc

SEQ ID NO: 1630541 - RNA, 18 nt, Human
uugaccauucuccaccug

SEQ ID NO: 1630542 - RNA, 13 nt, Human
uugacaucaacug

SEQ ID NO: 1630543 - RNA, 17 nt, Human
uugacauagucuggcug

SEQ ID NO: 1630544 - RNA, 18 nt, Human
auccugaggcuccacuug

SEQ ID NO: 1630545 - RNA, 16 nt, Human
auccugaggcuccacu

SEQ ID NO: 1630546 - RNA, 13 nt, Human
auccugaggcucc

SEQ ID NO: 1630547 - RNA, 11 nt, Human
auccugaggcu

SEQ ID NO: 1630548 - RNA, 21 nt, Human
auccugagccagauuucacuc

SEQ ID NO: 1630549 - RNA, 17 nt, Human
auccugagccagauuuc

SEQ ID NO: 1630550 - RNA, 15 nt, Human
auccugagccagauu

SEQ ID NO: 1630551 - RNA, 14 nt, Human
auccugagccagau

SEQ ID NO: 1630552 - RNA, 13 nt, Human
auccugccccuga

SEQ ID NO: 1630553 - RNA, 22 nt, Human
auccugaggcuccacuuggucu

SEQ ID NO: 1630554 - RNA, 16 nt, Human
auccugcaauuccacu

SEQ ID NO: 1630555 - RNA, 20 nt, Human
uucuuuugccguuauuaaaa

SEQ ID NO: 1630556 - RNA, 20 nt, Human
auccucuguacagagcccac

SEQ ID NO: 1630557 - RNA, 18 nt, Human
auccucuguacagagccc

SEQ ID NO: 1630558 - RNA, 13 nt, Human
auccugagccaga

SEQ ID NO: 1630559 - RNA, 12 nt, Human
auccugagccag

SEQ ID NO: 1630560 - RNA, 11 nt, Human
auccugagcca

SEQ ID NO: 1630561 - RNA, 17 nt, Human
auccucuuugagugaag

SEQ ID NO: 1630562 - RNA, 23 nt, Human
auccuggcacccggccccugcug

SEQ ID NO: 1630563 - RNA, 22 nt, Human
auccuggcacccggccccugcu

SEQ ID NO: 1630564 - RNA, 20 nt, Human
auccuggcugucgagaaaca

SEQ ID NO: 1630565 - RNA, 21 nt, Human
auccuggcacccggccccugc

SEQ ID NO: 1630566 - RNA, 20 nt, Human
auccuggcacccggccccug

SEQ ID NO: 1630567 - RNA, 19 nt, Human
auccuggcacccggccccu

SEQ ID NO: 1630568 - RNA, 17 nt, Human
auccuggcacccggccc

SEQ ID NO: 1630569 - RNA, 15 nt, Human
auccuggaguucugg

SEQ ID NO: 1630570 - RNA, 17 nt, Human
aucguaaaauuaagaaa

SEQ ID NO: 1630571 - RNA, 14 nt, Human
aucguaaaauuaag

SEQ ID NO: 1630572 - RNA, 13 nt, Human
aucguaaaauuaa

SEQ ID NO: 1630573 - RNA, 12 nt, Human
aucguaaaauua

SEQ ID NO: 1630574 - RNA, 13 nt, Human
auauuuacaaaug

SEQ ID NO: 1630575 - RNA, 14 nt, Human
auauuguuugcuaa

SEQ ID NO: 1630576 - RNA, 17 nt, Human
auauuguuuucagugua

SEQ ID NO: 1630577 - RNA, 13 nt, Human
auauuguuuucag

SEQ ID NO: 1630578 - RNA, 22 nt, Human
auauugcugauggugcaaugac

SEQ ID NO: 1630579 - RNA, 15 nt, Human
auauugauaugcuua

SEQ ID NO: 1630580 - RNA, 21 nt, Human
auauucucacagcuccaagaa

SEQ ID NO: 1630581 - RNA, 19 nt, Human
auauuaccacagacauacu

SEQ ID NO: 1630582 - RNA, 21 nt, Human
auauuccugcauuugugaaau

SEQ ID NO: 1630583 - RNA, 18 nt, Human
auauucucacagcuccaa

SEQ ID NO: 1630584 - RNA, 22 nt, Human
auauuaagaaagacuaucuaaa

SEQ ID NO: 1630585 - RNA, 17 nt, Human
auauuaagaaagacuau

SEQ ID NO: 1630586 - RNA, 15 nt, Human
auauuaagaaagacu

SEQ ID NO: 1630587 - RNA, 16 nt, Human
auauuaagaaagacua

SEQ ID NO: 1630588 - RNA, 17 nt, Human
auauuaccacagacaua

SEQ ID NO: 1630589 - RNA, 14 nt, Human
auauuaaagccaug

SEQ ID NO: 1630590 - RNA, 12 nt, Human
auauuaaagcca

SEQ ID NO: 1630591 - RNA, 16 nt, Human
auauguucugacauaa

SEQ ID NO: 1630592 - RNA, 16 nt, Human
uuccagugaggcucug

SEQ ID NO: 1630593 - RNA, 15 nt, Human
uuccagugaggcucu

SEQ ID NO: 1630594 - RNA, 22 nt, Human
uuccagugaaaucaguuacucu

SEQ ID NO: 1630595 - RNA, 15 nt, Human
aucaaauaugcaaag

SEQ ID NO: 1630596 - RNA, 18 nt, Human
aucaaauaugcaaagcac

SEQ ID NO: 1630597 - RNA, 17 nt, Human
aucaaauaugcaaagca

SEQ ID NO: 1630598 - RNA, 16 nt, Human
aucaaauaugcaaagc

SEQ ID NO: 1630599 - RNA, 16 nt, Human
aucaaggguacacugc

SEQ ID NO: 1630600 - RNA, 21 nt, Human
aucaacugcaucaagauguga

SEQ ID NO: 1630601 - RNA, 13 nt, Human
aucaauuuaaaaa

SEQ ID NO: 1630602 - RNA, 21 nt, Human
aucaaggguacacugccuucu

SEQ ID NO: 1630603 - RNA, 19 nt, Human
aucaauuuuucuuauuuca

SEQ ID NO: 1630604 - RNA, 14 nt, Human
aucaauuuuucuua

SEQ ID NO: 1630605 - RNA, 17 nt, Human
aucacgccacugcacua

SEQ ID NO: 1630606 - RNA, 15 nt, Human
aucacgccacugcac

SEQ ID NO: 1630607 - RNA, 22 nt, Human
uuccuggcacugcuuccaguga

SEQ ID NO: 1630608 - RNA, 20 nt, Human
uuccuggcacugcuuccagu

SEQ ID NO: 1630609 - RNA, 22 nt, Human
uuccucuuuuuauuuaguuccu

SEQ ID NO: 1630610 - RNA, 12 nt, Human
uuccugaacagg

SEQ ID NO: 1630611 - RNA, 19 nt, Human
uuccuggcacugcuuccag

SEQ ID NO: 1630612 - RNA, 21 nt, Human
uuccuaaauauauuuuaagac

SEQ ID NO: 1630613 - RNA, 18 nt, Human
uuccucuccacugccuuc

SEQ ID NO: 1630614 - RNA, 19 nt, Human
uuccucuccacugccuucg

SEQ ID NO: 1630615 - RNA, 13 nt, Human
uuccucugagccu

SEQ ID NO: 1630616 - RNA, 15 nt, Human
uucccuuuuuuuaag

SEQ ID NO: 1630617 - RNA, 13 nt, Human
uucccuacuuccu

SEQ ID NO: 1630618 - RNA, 12 nt, Human
uucccgcucagc

SEQ ID NO: 1630619 - RNA, 15 nt, Human
uucccgcucagcccu

SEQ ID NO: 1630620 - RNA, 14 nt, Human
uucccgcucagccc

SEQ ID NO: 1630621 - RNA, 14 nt, Human
auaugcaaagcacu

SEQ ID NO: 1630622 - RNA, 13 nt, Human
auaugcaaagcac

SEQ ID NO: 1630623 - RNA, 15 nt, Human
auaugcaaagcacug

SEQ ID NO: 1630624 - RNA, 13 nt, Human
auauauuuuuaua

SEQ ID NO: 1630625 - RNA, 23 nt, Human
auauguaccuaacgaaguauccu

SEQ ID NO: 1630626 - RNA, 21 nt, Human
auauguggaguucaucuugaa

SEQ ID NO: 1630627 - RNA, 20 nt, Human
auauguggaguucaucuuga

SEQ ID NO: 1630628 - RNA, 22 nt, Human
uucaugcuguucaugaaagauu

SEQ ID NO: 1630629 - RNA, 20 nt, Human
uucauggaacgcguugaaau

SEQ ID NO: 1630630 - RNA, 19 nt, Human
uucauggaacgcguugaaa

SEQ ID NO: 1630631 - RNA, 22 nt, Human
uucauggaacgcguugaaauug

SEQ ID NO: 1630632 - RNA, 21 nt, Human
uucauggaacgcguugaaauu

SEQ ID NO: 1630633 - RNA, 14 nt, Human
uucauuaucucaaa

SEQ ID NO: 1630634 - RNA, 22 nt, Human
uucauuauuuuauuaugaaacu

SEQ ID NO: 1630635 - RNA, 22 nt, Human
uuccaauuuacauacucugcuu

SEQ ID NO: 1630636 - RNA, 21 nt, Human
uuccacaagagcccaggccuc

SEQ ID NO: 1630637 - RNA, 18 nt, Human
uuccaccaucaagccacc

SEQ ID NO: 1630638 - RNA, 15 nt, Human
uuccaccuucccaug

SEQ ID NO: 1630639 - RNA, 18 nt, Human
uuccagguuuaagcuguu

SEQ ID NO: 1630640 - RNA, 17 nt, Human
uuccaggcugggagagc

SEQ ID NO: 1630641 - RNA, 15 nt, Human
uuccaggcugggaga

SEQ ID NO: 1630642 - RNA, 22 nt, Human
auauauguuuuaagaggcaggg

SEQ ID NO: 1630643 - RNA, 21 nt, Human
auauauguuuuaagaggcagg

SEQ ID NO: 1630644 - RNA, 15 nt, Human
uucaucaaugaauga

SEQ ID NO: 1630645 - RNA, 13 nt, Human
auauaugcuaagu

SEQ ID NO: 1630646 - RNA, 16 nt, Human
uucagugccaaaaaca

SEQ ID NO: 1630647 - RNA, 14 nt, Human
uucaguaagccgug

SEQ ID NO: 1630648 - RNA, 17 nt, Human
uucagguaacaggcaga

SEQ ID NO: 1630649 - RNA, 17 nt, Human
uucagcgguuuauauaa

SEQ ID NO: 1630650 - RNA, 14 nt, Human
uucagccaagaauu

SEQ ID NO: 1630651 - RNA, 20 nt, Human
uucagccugccuucuuuucu

SEQ ID NO: 1630652 - RNA, 19 nt, Human
uucagcaaaaauauuuuau

SEQ ID NO: 1630653 - RNA, 16 nt, Human
uucagguaacaggcag

SEQ ID NO: 1630654 - RNA, 15 nt, Human
uucagguaacaggca

SEQ ID NO: 1630655 - RNA, 22 nt, Human
uucaggguuggccccugcccgg

SEQ ID NO: 1630656 - RNA, 19 nt, Human
uucaggguuggccccugcc

SEQ ID NO: 1630657 - RNA, 17 nt, Human
uucaggguuggccccug

SEQ ID NO: 1630658 - RNA, 16 nt, Human
uucaggguuggccccu

SEQ ID NO: 1630659 - RNA, 14 nt, Human
uucaggguuggccc

SEQ ID NO: 1630660 - RNA, 16 nt, Human
uucagaaauguguuau

SEQ ID NO: 1630661 - RNA, 19 nt, Human
uucagauaugauucaaaug

SEQ ID NO: 1630662 - RNA, 17 nt, Human
uucagcaaaaauauuuu

SEQ ID NO: 1630663 - RNA, 18 nt, Human
uucagauaugauucaaau

SEQ ID NO: 1630664 - RNA, 17 nt, Human
uucagauaugauucaaa

SEQ ID NO: 1630665 - RNA, 16 nt, Human
uucagauaugauucaa

SEQ ID NO: 1630666 - RNA, 19 nt, Human
uuuccagguuuaagcuguu

SEQ ID NO: 1630667 - RNA, 23 nt, Human
auggaauuggagcucgugggaca

SEQ ID NO: 1630668 - RNA, 12 nt, Human
uuucauaaagca

SEQ ID NO: 1630669 - RNA, 24 nt, Human
uuucacucuuauugcccacgcugg

SEQ ID NO: 1630670 - RNA, 15 nt, Human
uuucacucuccuugg

SEQ ID NO: 1630671 - RNA, 24 nt, Human
uuucacugcuggcugccuuagaac

SEQ ID NO: 1630672 - RNA, 14 nt, Human
uuucacucuccuug

SEQ ID NO: 1630673 - RNA, 17 nt, Human
uuuauuuuuuucugaau

SEQ ID NO: 1630674 - RNA, 16 nt, Human
uuuauuuuuugggaaa

SEQ ID NO: 1630675 - RNA, 19 nt, Human
uuuauuacuguaagaaaau

SEQ ID NO: 1630676 - RNA, 13 nt, Human
uuuauuaugaaac

SEQ ID NO: 1630677 - RNA, 22 nt, Human
augcuggcuguuggcugggggc

SEQ ID NO: 1630678 - RNA, 21 nt, Human
uuuauuaugaaacuuguguaa

SEQ ID NO: 1630679 - RNA, 23 nt, Human
augcugucuacacuaagagagaa

SEQ ID NO: 1630680 - RNA, 14 nt, Human
augcuguauuuuaa

SEQ ID NO: 1630681 - RNA, 14 nt, Human
augcuguauauguu

SEQ ID NO: 1630682 - RNA, 19 nt, Human
augcugugcccuaaagugu

SEQ ID NO: 1630683 - RNA, 16 nt, Human
auggaacauaaaauac

SEQ ID NO: 1630684 - RNA, 21 nt, Human
auggaaguacuauaauuuacc

SEQ ID NO: 1630685 - RNA, 17 nt, Human
auggaacacucugagac

SEQ ID NO: 1630686 - RNA, 18 nt, Human
auggaacacucugagacu

SEQ ID NO: 1630687 - RNA, 16 nt, Human
uuuauuuuaauaaugu

SEQ ID NO: 1630688 - RNA, 15 nt, Human
auggaauaacaugua

SEQ ID NO: 1630689 - RNA, 14 nt, Human
auggaauaacaugu

SEQ ID NO: 1630690 - RNA, 13 nt, Human
uuuauuuuuuggg

SEQ ID NO: 1630691 - RNA, 19 nt, Human
uuuauaugcuucuguuuua

SEQ ID NO: 1630692 - RNA, 17 nt, Human
uuuauaugcuucuguuu

SEQ ID NO: 1630693 - RNA, 19 nt, Human
uuuauuaaaugcccagccc

SEQ ID NO: 1630694 - RNA, 15 nt, Human
uuuaugugaaacaug

SEQ ID NO: 1630695 - RNA, 14 nt, Human
uuuaugugaaacau

SEQ ID NO: 1630696 - RNA, 15 nt, Human
uuuaguagagacagg

SEQ ID NO: 1630697 - RNA, 15 nt, Human
uuuagauaauacacc

SEQ ID NO: 1630698 - RNA, 18 nt, Human
uuuagaguugauacuaca

SEQ ID NO: 1630699 - RNA, 13 nt, Human
uuuagauaauaca

SEQ ID NO: 1630700 - RNA, 24 nt, Human
uuuaaagcuuauuaaaacucauuu

SEQ ID NO: 1630701 - RNA, 16 nt, Human
uuuaaagcuuccauug

SEQ ID NO: 1630702 - RNA, 16 nt, Human
augcgggccagugcuc

SEQ ID NO: 1630703 - RNA, 23 nt, Human
augcgcaggcuggcccugcccug

SEQ ID NO: 1630704 - RNA, 21 nt, Human
uuuaccuuuuuuauacauaaa

SEQ ID NO: 1630705 - RNA, 17 nt, Human
uuuacuaaaauggacug

SEQ ID NO: 1630706 - RNA, 15 nt, Human
uuuacuaaaauggac

SEQ ID NO: 1630707 - RNA, 14 nt, Human
uuuacuaauagaca

SEQ ID NO: 1630708 - RNA, 17 nt, Human
uuuacuaauagacaauu

SEQ ID NO: 1630709 - RNA, 18 nt, Human
uuuacuaauagacaauuu

SEQ ID NO: 1630710 - RNA, 14 nt, Human
uuuaccuuuuuuau

SEQ ID NO: 1630711 - RNA, 19 nt, Human
uuuaccuuuuuuauacaua

SEQ ID NO: 1630712 - RNA, 20 nt, Human
uuuaccuuuuuuauacauaa

SEQ ID NO: 1630713 - RNA, 17 nt, Human
augcuacacacugcaug

SEQ ID NO: 1630714 - RNA, 18 nt, Human
augcuacacacugcaugu

SEQ ID NO: 1630715 - RNA, 14 nt, Human
uuugaaauauugac

SEQ ID NO: 1630716 - RNA, 23 nt, Human
augggcuggguucuacccaggug

SEQ ID NO: 1630717 - RNA, 13 nt, Human
auggggcccugcc

SEQ ID NO: 1630718 - RNA, 14 nt, Human
auggggcccugccu

SEQ ID NO: 1630719 - RNA, 19 nt, Human
uuugaaacacuuugcauaa

SEQ ID NO: 1630720 - RNA, 17 nt, Human
uuugaaacacuuugcau

SEQ ID NO: 1630721 - RNA, 13 nt, Human
uuucuuuguggcu

SEQ ID NO: 1630722 - RNA, 14 nt, Human
uuucugcaucagcu

SEQ ID NO: 1630723 - RNA, 22 nt, Human
uuucucauuugccaauaauaau

SEQ ID NO: 1630724 - RNA, 16 nt, Human
uuucugccgcagcccu

SEQ ID NO: 1630725 - RNA, 14 nt, Human
uuucugccgcagcc

SEQ ID NO: 1630726 - RNA, 20 nt, Human
uuucuaugaaauauuauguu

SEQ ID NO: 1630727 - RNA, 14 nt, Human
uuucuaugaaauau

SEQ ID NO: 1630728 - RNA, 13 nt, Human
uuucuaugaaaua

SEQ ID NO: 1630729 - RNA, 21 nt, Human
uuucuaugcugaguuugugcu

SEQ ID NO: 1630730 - RNA, 15 nt, Human
uuucuaugacacaug

SEQ ID NO: 1630731 - RNA, 21 nt, Human
uuucuaugacacaugcaaggu

SEQ ID NO: 1630732 - RNA, 22 nt, Human
uuucuaggacugaauuaugaaa

SEQ ID NO: 1630733 - RNA, 17 nt, Human
uuucuaggacugaauua

SEQ ID NO: 1630734 - RNA, 21 nt, Human
uuucuaggacugaauuaugaa

SEQ ID NO: 1630735 - RNA, 13 nt, Human
uuucuauauuuuc

SEQ ID NO: 1630736 - RNA, 18 nt, Human
uuucuauauuuucauucu

SEQ ID NO: 1630737 - RNA, 15 nt, Human
uuucuauauuuucau

SEQ ID NO: 1630738 - RNA, 17 nt, Human
auggaauuucucccagu

SEQ ID NO: 1630739 - RNA, 21 nt, Human
auggacccaauauuuaccaga

SEQ ID NO: 1630740 - RNA, 19 nt, Human
auggcuauaggugcuacaa

SEQ ID NO: 1630741 - RNA, 16 nt, Human
auggcuauaggugcua

SEQ ID NO: 1630742 - RNA, 18 nt, Human
auggccucuucagaucuc

SEQ ID NO: 1630743 - RNA, 23 nt, Human
auggcuauaggugcuacaaaaac

SEQ ID NO: 1630744 - RNA, 21 nt, Human
auggcuauaggugcuacaaaa

SEQ ID NO: 1630745 - RNA, 21 nt, Human
augggacauuugcucauggaa

SEQ ID NO: 1630746 - RNA, 22 nt, Human
augggacauuugcucauggaau

SEQ ID NO: 1630747 - RNA, 15 nt, Human
augggccuccugugu

SEQ ID NO: 1630748 - RNA, 14 nt, Human
augggcagagcaga

SEQ ID NO: 1630749 - RNA, 13 nt, Human
augggcagagcag

SEQ ID NO: 1630750 - RNA, 15 nt, Human
augggcagagcagag

SEQ ID NO: 1630751 - RNA, 21 nt, Human
augggcaacccccagccugcu

SEQ ID NO: 1630752 - RNA, 19 nt, Human
augggcaacccccagccug

SEQ ID NO: 1630753 - RNA, 13 nt, Human
augggagcucaug

SEQ ID NO: 1630754 - RNA, 15 nt, Human
augggacuggccucu

SEQ ID NO: 1630755 - RNA, 18 nt, Human
uuucgcaggauucuuccu

SEQ ID NO: 1630756 - RNA, 22 nt, Human
uuucgcaggauucuuccucccu

SEQ ID NO: 1630757 - RNA, 21 nt, Human
uuuccuuuuaaaacacuucca

SEQ ID NO: 1630758 - RNA, 21 nt, Human
uuuccuucauucaacccaccu

SEQ ID NO: 1630759 - RNA, 22 nt, Human
uuuccuucagugccuuauggaa

SEQ ID NO: 1630760 - RNA, 21 nt, Human
uuuccuucagugccuuaugga

SEQ ID NO: 1630761 - RNA, 18 nt, Human
uuuccuucagugccuuau

SEQ ID NO: 1630762 - RNA, 23 nt, Human
uuuccuucauucaacccaccugc

SEQ ID NO: 1630763 - RNA, 12 nt, Human
uuuccugugucu

SEQ ID NO: 1630764 - RNA, 17 nt, Human
augggccuccugugugu

SEQ ID NO: 1630765 - RNA, 15 nt, Human
uuuccuucagugccu

SEQ ID NO: 1630766 - RNA, 12 nt, Human
uuuccuucagug

SEQ ID NO: 1630767 - RNA, 11 nt, Human
uuuccuucagu

SEQ ID NO: 1630768 - RNA, 13 nt, Human
augagaggaaauc

SEQ ID NO: 1630769 - RNA, 12 nt, Human
augagaggaaau

SEQ ID NO: 1630770 - RNA, 15 nt, Human
augagaggaaaucac

SEQ ID NO: 1630771 - RNA, 14 nt, Human
augagaggaaauca

SEQ ID NO: 1630772 - RNA, 16 nt, Human
augagaggaaaucacc

SEQ ID NO: 1630773 - RNA, 16 nt, Human
augagccucagcaucc

SEQ ID NO: 1630774 - RNA, 15 nt, Human
augagccucagcauc

SEQ ID NO: 1630775 - RNA, 12 nt, Human
augagccucagc

SEQ ID NO: 1630776 - RNA, 22 nt, Human
augagcaucaggccaggcccuc

SEQ ID NO: 1630777 - RNA, 21 nt, Human
augagcaucaggccaggcccu

SEQ ID NO: 1630778 - RNA, 20 nt, Human
augagcaucaggccaggccc

SEQ ID NO: 1630779 - RNA, 19 nt, Human
augagcaucaggccaggcc

SEQ ID NO: 1630780 - RNA, 18 nt, Human
augagcaucaggccaggc

SEQ ID NO: 1630781 - RNA, 17 nt, Human
augagcaucaggccagg

SEQ ID NO: 1630782 - RNA, 16 nt, Human
augagcaucaggccag

SEQ ID NO: 1630783 - RNA, 15 nt, Human
augagcaucaggcca

SEQ ID NO: 1630784 - RNA, 14 nt, Human
augauaacuggaaa

SEQ ID NO: 1630785 - RNA, 15 nt, Human
augauaaaacacaaa

SEQ ID NO: 1630786 - RNA, 19 nt, Human
augagccucagcauccugg

SEQ ID NO: 1630787 - RNA, 18 nt, Human
augagccucagcauccug

SEQ ID NO: 1630788 - RNA, 17 nt, Human
augagccucagcauccu

SEQ ID NO: 1630789 - RNA, 18 nt, Human
uugugaagcaaaauuuuu

SEQ ID NO: 1630790 - RNA, 18 nt, Human
uugugaagguggaaauaa

SEQ ID NO: 1630791 - RNA, 17 nt, Human
uugugaagguggaaaua

SEQ ID NO: 1630792 - RNA, 19 nt, Human
augaucacggcucacugca

SEQ ID NO: 1630793 - RNA, 18 nt, Human
augaucacggcucacugc

SEQ ID NO: 1630794 - RNA, 15 nt, Human
augaucacggcucac

SEQ ID NO: 1630795 - RNA, 14 nt, Human
augaucuucuuuau

SEQ ID NO: 1630796 - RNA, 15 nt, Human
augaucuaggaagac

SEQ ID NO: 1630797 - RNA, 15 nt, Human
augauccuaaugaau

SEQ ID NO: 1630798 - RNA, 16 nt, Human
augauccuaggcauuu

SEQ ID NO: 1630799 - RNA, 23 nt, Human
augaucacggcucacugcagccu

SEQ ID NO: 1630800 - RNA, 19 nt, Human
augcaccuggaauauauaa

SEQ ID NO: 1630801 - RNA, 18 nt, Human
uuguuuuuuuuuuccacu

SEQ ID NO: 1630802 - RNA, 21 nt, Human
uuuaaaaaauuaaucugggcc

SEQ ID NO: 1630803 - RNA, 17 nt, Human
uuuaaaaaauuaaucug

SEQ ID NO: 1630804 - RNA, 20 nt, Human
uuuaaaaaagaaacauuugg

SEQ ID NO: 1630805 - RNA, 19 nt, Human
uuguuuuuuuuuuccacuu

SEQ ID NO: 1630806 - RNA, 17 nt, Human
uuuaaaaaaaaaauugg

SEQ ID NO: 1630807 - RNA, 22 nt, Human
augcaaaccaucauugaaaucu

SEQ ID NO: 1630808 - RNA, 21 nt, Human
augcaaaccaucauugaaauc

SEQ ID NO: 1630809 - RNA, 20 nt, Human
augcaaaccaucauugaaau

SEQ ID NO: 1630810 - RNA, 19 nt, Human
augcaaaccaucauugaaa

SEQ ID NO: 1630811 - RNA, 18 nt, Human
augcaaaccaucauugaa

SEQ ID NO: 1630812 - RNA, 16 nt, Human
augcaaaccaucauug

SEQ ID NO: 1630813 - RNA, 18 nt, Human
augaucuucuuuauaauu

SEQ ID NO: 1630814 - RNA, 15 nt, Human
augaucuucuuuaua

SEQ ID NO: 1630815 - RNA, 22 nt, Human
augcaaggucauuuuuuuuaag

SEQ ID NO: 1630816 - RNA, 16 nt, Human
augcaccuggaauaua

SEQ ID NO: 1630817 - RNA, 14 nt, Human
augcaccuggaaua

SEQ ID NO: 1630818 - RNA, 14 nt, Human
augcaaggucauuu

SEQ ID NO: 1630819 - RNA, 16 nt, Human
augcaaggucauuuuu

SEQ ID NO: 1630820 - RNA, 22 nt, Human
augcaaacuuuauuuuguguuu

SEQ ID NO: 1630821 - RNA, 22 nt, Human
augaauuacauuuguauaaaau

SEQ ID NO: 1630822 - RNA, 19 nt, Human
augaauuacauuuguauaa

SEQ ID NO: 1630823 - RNA, 18 nt, Human
augaauuacauuuguaua

SEQ ID NO: 1630824 - RNA, 13 nt, Human
augaaccacaucu

SEQ ID NO: 1630825 - RNA, 22 nt, Human
augaaccacaucuugcucugcu

SEQ ID NO: 1630826 - RNA, 20 nt, Human
augaaccacaucuugcucug

SEQ ID NO: 1630827 - RNA, 17 nt, Human
uugggguacccacugcu

SEQ ID NO: 1630828 - RNA, 19 nt, Human
uuggggaagaacgaagcca

SEQ ID NO: 1630829 - RNA, 14 nt, Human
uuguaaggaaugau

SEQ ID NO: 1630830 - RNA, 22 nt, Human
uuguaaaaauuaaaaguuaugg

SEQ ID NO: 1630831 - RNA, 22 nt, Human
uugggguacccacugcucuggu

SEQ ID NO: 1630832 - RNA, 19 nt, Human
uugguuaggcauuguggga

SEQ ID NO: 1630833 - RNA, 23 nt, Human
augaauuaguuuuauaugcuucu

SEQ ID NO: 1630834 - RNA, 21 nt, Human
augaauuaguuuuauaugcuu

SEQ ID NO: 1630835 - RNA, 20 nt, Human
augacacgaauauugcugau

SEQ ID NO: 1630836 - RNA, 19 nt, Human
augacacgaauauugcuga

SEQ ID NO: 1630837 - RNA, 13 nt, Human
uuguauaaaauaa

SEQ ID NO: 1630838 - RNA, 19 nt, Human
uuguauaaaauaauuuuua

SEQ ID NO: 1630839 - RNA, 20 nt, Human
uuguaaggaaugauuaauua

SEQ ID NO: 1630840 - RNA, 13 nt, Human
uuguaaugaaaac

SEQ ID NO: 1630841 - RNA, 15 nt, Human
uuguaauuauaucug

SEQ ID NO: 1630842 - RNA, 20 nt, Human
augaaauauuauguuaaaac

SEQ ID NO: 1630843 - RNA, 21 nt, Human
augaaauauuauguuaaaacu

SEQ ID NO: 1630844 - RNA, 14 nt, Human
augaaaugagguca

SEQ ID NO: 1630845 - RNA, 20 nt, Human
augaaagacuguacaaagua

SEQ ID NO: 1630846 - RNA, 23 nt, Human
augaaagauggcugugccucugc

SEQ ID NO: 1630847 - RNA, 20 nt, Human
augaaagauggcugugccuc

SEQ ID NO: 1630848 - RNA, 19 nt, Human
augaaagauggcugugccu

SEQ ID NO: 1630849 - RNA, 16 nt, Human
uuggcugcugaaggcu

SEQ ID NO: 1630850 - RNA, 22 nt, Human
uuggcgcugccccuggcagccc

SEQ ID NO: 1630851 - RNA, 15 nt, Human
uuggcugcugaaggc

SEQ ID NO: 1630852 - RNA, 11 nt, Human
uuggcugcuga

SEQ ID NO: 1630853 - RNA, 14 nt, Human
uuggcugcagggag

SEQ ID NO: 1630854 - RNA, 23 nt, Human
uuggcuauuagagaucaaccccu

SEQ ID NO: 1630855 - RNA, 21 nt, Human
uuggcuagagguucaaagaua

SEQ ID NO: 1630856 - RNA, 22 nt, Human
uuggcuaggaccccuccaugug

SEQ ID NO: 1630857 - RNA, 22 nt, Human
uuggcuagagguucaaagauau

SEQ ID NO: 1630858 - RNA, 23 nt, Human
uuggaaagaguaggaagacuuug

SEQ ID NO: 1630859 - RNA, 18 nt, Human
uuggaaagaguaggaaga

SEQ ID NO: 1630860 - RNA, 12 nt, Human
uugcucauggaa

SEQ ID NO: 1630861 - RNA, 11 nt, Human
uugcucaugga

SEQ ID NO: 1630862 - RNA, 19 nt, Human
uugcugaauacagaggcaa

SEQ ID NO: 1630863 - RNA, 20 nt, Human
uugcuaagugaggaugaaaa

SEQ ID NO: 1630864 - RNA, 17 nt, Human
uuggaaagaguaggaag

SEQ ID NO: 1630865 - RNA, 19 nt, Human
uugcugauggugcaaugac

SEQ ID NO: 1630866 - RNA, 18 nt, Human
uugcugauggugcaauga

SEQ ID NO: 1630867 - RNA, 17 nt, Human
uugcugauggugcaaug

SEQ ID NO: 1630868 - RNA, 22 nt, Human
auuuucaguuauuauauuuaca

SEQ ID NO: 1630869 - RNA, 17 nt, Human
auuuuccuccuuucucu

SEQ ID NO: 1630870 - RNA, 13 nt, Human
auuuuccuccuuu

SEQ ID NO: 1630871 - RNA, 21 nt, Human
auuuuauuuuuuucugaauua

SEQ ID NO: 1630872 - RNA, 21 nt, Human
auuuuauuauguaaaucccau

SEQ ID NO: 1630873 - RNA, 20 nt, Human
auuuuauuauguaaauccca

SEQ ID NO: 1630874 - RNA, 19 nt, Human
auuuuauuauguaaauccc

SEQ ID NO: 1630875 - RNA, 18 nt, Human
auuuuauuauguaaaucc

SEQ ID NO: 1630876 - RNA, 17 nt, Human
auuuuauuauguaaauc

SEQ ID NO: 1630877 - RNA, 16 nt, Human
auuuuauuauguaaau

SEQ ID NO: 1630878 - RNA, 20 nt, Human
auuuucaacgcagcccugcu

SEQ ID NO: 1630879 - RNA, 18 nt, Human
auuuucaacgcagcccug

SEQ ID NO: 1630880 - RNA, 17 nt, Human
auuuuaaaagaaugauu

SEQ ID NO: 1630881 - RNA, 14 nt, Human
auuugugauacaau

SEQ ID NO: 1630882 - RNA, 15 nt, Human
auuugugauacaaug

SEQ ID NO: 1630883 - RNA, 21 nt, Human
auuuguauaaaauaauuuuua

SEQ ID NO: 1630884 - RNA, 19 nt, Human
auuuguauaaaauaauuuu

SEQ ID NO: 1630885 - RNA, 18 nt, Human
auuuguauaaaauaauuu

SEQ ID NO: 1630886 - RNA, 22 nt, Human
auuuuaaaagaaugauuaugaa

SEQ ID NO: 1630887 - RNA, 18 nt, Human
auuuuaaaagaaugauua

SEQ ID NO: 1630888 - RNA, 15 nt, Human
auuuuaauucaguug

SEQ ID NO: 1630889 - RNA, 17 nt, Human
auuuuacauaaauuuag

SEQ ID NO: 1630890 - RNA, 16 nt, Human
auuuuacauaaauuua

SEQ ID NO: 1630891 - RNA, 17 nt, Human
auuuuaccuuugacaaa

SEQ ID NO: 1630892 - RNA, 13 nt, Human
auuuagauguaua

SEQ ID NO: 1630893 - RNA, 18 nt, Human
auuuaguauuuuguuuca

SEQ ID NO: 1630894 - RNA, 20 nt, Human
auuuaguaucuuuuuauuca

SEQ ID NO: 1630895 - RNA, 13 nt, Human
auuuaguguucau

SEQ ID NO: 1630896 - RNA, 23 nt, Human
auuuauaaaaauaaaaaacacug

SEQ ID NO: 1630897 - RNA, 22 nt, Human
auuuauaaaaauaaaaaacacu

SEQ ID NO: 1630898 - RNA, 17 nt, Human
auuuauaaaaauaaaaa

SEQ ID NO: 1630899 - RNA, 15 nt, Human
auuuagaaauauaau

SEQ ID NO: 1630900 - RNA, 16 nt, Human
auuuacuucuuauaca

SEQ ID NO: 1630901 - RNA, 14 nt, Human
auuuacuucuuaua

SEQ ID NO: 1630902 - RNA, 17 nt, Human
auuuacuucuuauacau

SEQ ID NO: 1630903 - RNA, 15 nt, Human
auuuaacagaaaugu

SEQ ID NO: 1630904 - RNA, 14 nt, Human
auuuaacagaaaug

SEQ ID NO: 1630905 - RNA, 12 nt, Human
auuuaacagaaa

SEQ ID NO: 1630906 - RNA, 14 nt, Human
auuuauucugcuca

SEQ ID NO: 1630907 - RNA, 17 nt, Human
auuuauuuuaauaaugu

SEQ ID NO: 1630908 - RNA, 13 nt, Human
auuuauucugcuc

SEQ ID NO: 1630909 - RNA, 12 nt, Human
auuucauuucuu

SEQ ID NO: 1630910 - RNA, 16 nt, Human
auuucaaacggccuca

SEQ ID NO: 1630911 - RNA, 20 nt, Human
auuuauuuuaauaauguuuc

SEQ ID NO: 1630912 - RNA, 19 nt, Human
auuuauuuuaauaauguuu

SEQ ID NO: 1630913 - RNA, 17 nt, Human
auuuccagccaaagccu

SEQ ID NO: 1630914 - RNA, 22 nt, Human
auuucauuugugccagaaugcu

SEQ ID NO: 1630915 - RNA, 20 nt, Human
auuuccagugaaaucaguua

SEQ ID NO: 1630916 - RNA, 14 nt, Human
auuugaaauauuga

SEQ ID NO: 1630917 - RNA, 15 nt, Human
auuugaaaauuuuga

SEQ ID NO: 1630918 - RNA, 14 nt, Human
auuugaaaauuuug

SEQ ID NO: 1630919 - RNA, 15 nt, Human
auuuccguuaaaaua

SEQ ID NO: 1630920 - RNA, 16 nt, Human
auuuccguuaaaauac

SEQ ID NO: 1630921 - RNA, 17 nt, Human
auuuccguuaaaauacc

SEQ ID NO: 1630922 - RNA, 21 nt, Human
auugacccacaagaaaugaaa

SEQ ID NO: 1630923 - RNA, 18 nt, Human
auugacccacaagaaaug

SEQ ID NO: 1630924 - RNA, 13 nt, Human
auucuucuccacu

SEQ ID NO: 1630925 - RNA, 22 nt, Human
auucuuccucccucccucuuuc

SEQ ID NO: 1630926 - RNA, 13 nt, Human
auucuuauuuaau

SEQ ID NO: 1630927 - RNA, 18 nt, Human
auucuuaaaguugaauuu

SEQ ID NO: 1630928 - RNA, 18 nt, Human
auucuuauuuaaugaaag

SEQ ID NO: 1630929 - RNA, 14 nt, Human
auucuuauuuaaug

SEQ ID NO: 1630930 - RNA, 23 nt, Human
auucuucagcaaaaauauuuuau

SEQ ID NO: 1630931 - RNA, 15 nt, Human
auucuucagcaaaaa

SEQ ID NO: 1630932 - RNA, 17 nt, Human
auucuccuuguguuacu

SEQ ID NO: 1630933 - RNA, 24 nt, Human
auucugucucuggauuauauuaug

SEQ ID NO: 1630934 - RNA, 21 nt, Human
auucuguauagauuagaauuc

SEQ ID NO: 1630935 - RNA, 16 nt, Human
auucuuaaaguugaau

SEQ ID NO: 1630936 - RNA, 15 nt, Human
auucuuaaaguugaa

SEQ ID NO: 1630937 - RNA, 14 nt, Human
auucuuaaaguuga

SEQ ID NO: 1630938 - RNA, 13 nt, Human
auucuuaaaguug

SEQ ID NO: 1630939 - RNA, 14 nt, Human
auugugucucuugg

SEQ ID NO: 1630940 - RNA, 18 nt, Human
auugugucucuugguccu

SEQ ID NO: 1630941 - RNA, 20 nt, Human
auuguccccgacccuugccg

SEQ ID NO: 1630942 - RNA, 19 nt, Human
auuguccccgacccuugcc

SEQ ID NO: 1630943 - RNA, 17 nt, Human
auuguccccgacccuug

SEQ ID NO: 1630944 - RNA, 13 nt, Human
auuguauucagag

SEQ ID NO: 1630945 - RNA, 23 nt, Human
auugguguuguacucaauuuuaa

SEQ ID NO: 1630946 - RNA, 22 nt, Human
auugguguuguacucaauuuua

SEQ ID NO: 1630947 - RNA, 14 nt, Human
auugguguuguacu

SEQ ID NO: 1630948 - RNA, 20 nt, Human
auucuccaccugccagggac

SEQ ID NO: 1630949 - RNA, 19 nt, Human
auucuccaccugccaggga

SEQ ID NO: 1630950 - RNA, 15 nt, Human
auucucaugccucag

SEQ ID NO: 1630951 - RNA, 14 nt, Human
auucucaugccuca

SEQ ID NO: 1630952 - RNA, 21 nt, Human
auucuccaccugccagggaca

SEQ ID NO: 1630953 - RNA, 21 nt, Human
auucucaugccucagccuccu

SEQ ID NO: 1630954 - RNA, 21 nt, Human
auucuccuaucaccugucuug

SEQ ID NO: 1630955 - RNA, 13 nt, Human
auucuccugccuc

SEQ ID NO: 1630956 - RNA, 14 nt, Human
auucuccugccuca

SEQ ID NO: 1630957 - RNA, 11 nt, Human
auucuccugcc

SEQ ID NO: 1630958 - RNA, 12 nt, Human
auucuccugccu

SEQ ID NO: 1630959 - RNA, 16 nt, Human
auucuccuuguguuac

SEQ ID NO: 1630960 - RNA, 17 nt, Human
auucuccugccucagcc

SEQ ID NO: 1630961 - RNA, 15 nt, Human
auucuccugccucag

SEQ ID NO: 1630962 - RNA, 19 nt, Human
auucuccugccucagccuc

SEQ ID NO: 1630963 - RNA, 20 nt, Human
auucuccugccucagccucc

SEQ ID NO: 1630964 - RNA, 15 nt, Human
auucccaagcucugc

SEQ ID NO: 1630965 - RNA, 14 nt, Human
auucccaagcucug

SEQ ID NO: 1630966 - RNA, 16 nt, Human
auucccaagcucugcu

SEQ ID NO: 1630967 - RNA, 17 nt, Human
auucccaagcucugcuc

SEQ ID NO: 1630968 - RNA, 14 nt, Human
auucaggaagcuca

SEQ ID NO: 1630969 - RNA, 17 nt, Human
auucagaguugaugguu

SEQ ID NO: 1630970 - RNA, 19 nt, Human
auucaguaauaacucuacc

SEQ ID NO: 1630971 - RNA, 15 nt, Human
auucaguaauaacuc

SEQ ID NO: 1630972 - RNA, 19 nt, Human
auucaggaagcucagggcc

SEQ ID NO: 1630973 - RNA, 17 nt, Human
auucaggaagcucaggg

SEQ ID NO: 1630974 - RNA, 20 nt, Human
auucaggaagcucagggccu

SEQ ID NO: 1630975 - RNA, 18 nt, Human
auucagauaugauucaaa

SEQ ID NO: 1630976 - RNA, 12 nt, Human
auugaaaucuuu

SEQ ID NO: 1630977 - RNA, 20 nt, Human
auucagauaugauucaaaug

SEQ ID NO: 1630978 - RNA, 20 nt, Human
uuuucauuuaggugaggaag

SEQ ID NO: 1630979 - RNA, 18 nt, Human
uuuucugagaaagacuau

SEQ ID NO: 1630980 - RNA, 15 nt, Human
uuuucugagaaagac

SEQ ID NO: 1630981 - RNA, 15 nt, Human
uuuucugauccaguu

SEQ ID NO: 1630982 - RNA, 16 nt, Human
uuuucucuaggaaaua

SEQ ID NO: 1630983 - RNA, 14 nt, Human
uuuucucuaggaaa

SEQ ID NO: 1630984 - RNA, 13 nt, Human
uuuuauuaugcau

SEQ ID NO: 1630985 - RNA, 22 nt, Human
uuuuauuaugaaacuuguguaa

SEQ ID NO: 1630986 - RNA, 21 nt, Human
uuuuauuaugaaacuugugua

SEQ ID NO: 1630987 - RNA, 12 nt, Human
uuuuauuaugaa

SEQ ID NO: 1630988 - RNA, 11 nt, Human
uuuuauuuuau

SEQ ID NO: 1630989 - RNA, 15 nt, Human
auuaaaagaauauuu

SEQ ID NO: 1630990 - RNA, 15 nt, Human
auuaaaaaucucaaa

SEQ ID NO: 1630991 - RNA, 19 nt, Human
auuaaaaaucucaaauuuc

SEQ ID NO: 1630992 - RNA, 20 nt, Human
auuaaaaaucucaaauuucu

SEQ ID NO: 1630993 - RNA, 22 nt, Human
auuaaaaaucucaaauuucuaa

SEQ ID NO: 1630994 - RNA, 23 nt, Human
auuaaaacacaacaucuuuuucu

SEQ ID NO: 1630995 - RNA, 21 nt, Human
auguuuucaggcuagauguau

SEQ ID NO: 1630996 - RNA, 17 nt, Human
auguuuucaggcuagau

SEQ ID NO: 1630997 - RNA, 15 nt, Human
auguuuucaggcuag

SEQ ID NO: 1630998 - RNA, 17 nt, Human
auguuuaguaaucauau

SEQ ID NO: 1630999 - RNA, 18 nt, Human
auguucaucaaugaauga

SEQ ID NO: 1631000 - RNA, 18 nt, Human
auguugcauagaauaaaa

SEQ ID NO: 1631001 - RNA, 17 nt, Human
auguugcauagaauaaa

SEQ ID NO: 1631002 - RNA, 12 nt, Human
auguugcccagg

SEQ ID NO: 1631003 - RNA, 17 nt, Human
auguugcccaggcaggu

SEQ ID NO: 1631004 - RNA, 20 nt, Human
auguugcccaggcaggucuu

SEQ ID NO: 1631005 - RNA, 20 nt, Human
auguugcccuguugcugccu

SEQ ID NO: 1631006 - RNA, 20 nt, Human
auguuaaaccaugggauaaa

SEQ ID NO: 1631007 - RNA, 13 nt, Human
auguuaaaccaug

SEQ ID NO: 1631008 - RNA, 12 nt, Human
auguuaaaccau

SEQ ID NO: 1631009 - RNA, 14 nt, Human
uuuuaauaauguuu

SEQ ID NO: 1631010 - RNA, 13 nt, Human
uuuuaauaauguu

SEQ ID NO: 1631011 - RNA, 12 nt, Human
uuuuaauaaugu

SEQ ID NO: 1631012 - RNA, 12 nt, Human
auggggcugcac

SEQ ID NO: 1631013 - RNA, 20 nt, Human
auggggcccugccuccuuug

SEQ ID NO: 1631014 - RNA, 14 nt, Human
uuuuaauaaacacu

SEQ ID NO: 1631015 - RNA, 16 nt, Human
uuuuaauaauguuuca

SEQ ID NO: 1631016 - RNA, 22 nt, Human
augugccagguuuuuggucuga

SEQ ID NO: 1631017 - RNA, 19 nt, Human
augugcuaguaauuggaaa

SEQ ID NO: 1631018 - RNA, 20 nt, Human
augugcuaguaauuggaaag

SEQ ID NO: 1631019 - RNA, 20 nt, Human
auguggaguucaucuugaau

SEQ ID NO: 1631020 - RNA, 24 nt, Human
auguggaguucaucuugaauugua

SEQ ID NO: 1631021 - RNA, 23 nt, Human
auguguguuuuaaaaugagaaau

SEQ ID NO: 1631022 - RNA, 12 nt, Human
augugugugugc

SEQ ID NO: 1631023 - RNA, 23 nt, Human
auuaaguaaugauaacuggaaac

SEQ ID NO: 1631024 - RNA, 22 nt, Human
uuuuuguuccacaaguuaaaua

SEQ ID NO: 1631025 - RNA, 19 nt, Human
uuuuugugaaaagcuccau

SEQ ID NO: 1631026 - RNA, 20 nt, Human
uuuuuguagagccagggucu

SEQ ID NO: 1631027 - RNA, 19 nt, Human
uuuuuguagagccaggguc

SEQ ID NO: 1631028 - RNA, 20 nt, Human
uuuuuauggcuuuugugcau

SEQ ID NO: 1631029 - RNA, 21 nt, Human
uuuuuauggcuuuugugcauu

SEQ ID NO: 1631030 - RNA, 22 nt, Human
uuuuuauggcuuuugugcauua

SEQ ID NO: 1631031 - RNA, 20 nt, Human
auuacauuuguauaaaauaa

SEQ ID NO: 1631032 - RNA, 18 nt, Human
auuacauuuguauaaaau

SEQ ID NO: 1631033 - RNA, 17 nt, Human
auuacauuuguauaaaa

SEQ ID NO: 1631034 - RNA, 16 nt, Human
auuaaguacuauguau

SEQ ID NO: 1631035 - RNA, 14 nt, Human
auuaaguacuaugu

SEQ ID NO: 1631036 - RNA, 21 nt, Human
auuacaguggggaaugaagau

SEQ ID NO: 1631037 - RNA, 12 nt, Human
auuacuucugcu

SEQ ID NO: 1631038 - RNA, 12 nt, Human
auuagaauucug

SEQ ID NO: 1631039 - RNA, 14 nt, Human
auuagaauucugua

SEQ ID NO: 1631040 - RNA, 13 nt, Human
auuagaauucugu

SEQ ID NO: 1631041 - RNA, 18 nt, Human
auuagaauucuguauaga

SEQ ID NO: 1631042 - RNA, 17 nt, Human
auuagaauucuguauag

SEQ ID NO: 1631043 - RNA, 16 nt, Human
auuagaauucuguaua

SEQ ID NO: 1631044 - RNA, 15 nt, Human
auuagaauucuguau

SEQ ID NO: 1631045 - RNA, 21 nt, Human
auuagaauucuguauagauua

SEQ ID NO: 1631046 - RNA, 17 nt, Human
uuuugauccaagcuggu

SEQ ID NO: 1631047 - RNA, 17 nt, Human
uuuugagugccuuacac

SEQ ID NO: 1631048 - RNA, 11 nt, Human
auuaaagccau

SEQ ID NO: 1631049 - RNA, 21 nt, Human
auuaagcauauauuuuuauau

SEQ ID NO: 1631050 - RNA, 15 nt, Human
auuaagcauauauuu

SEQ ID NO: 1631051 - RNA, 14 nt, Human
auuaagcauauauu

SEQ ID NO: 1631052 - RNA, 23 nt, Human
uuuugccauguuggccaggcugg

SEQ ID NO: 1631053 - RNA, 23 nt, Human
uuuugugcauuaucuagauacug

SEQ ID NO: 1631054 - RNA, 17 nt, Human
uuuugugcauuaucuag

SEQ ID NO: 1631055 - RNA, 20 nt, Human
uuuugugcauuaucuagaua

SEQ ID NO: 1631056 - RNA, 21 nt, Human
uuuugugaugucccaacuugu

SEQ ID NO: 1631057 - RNA, 15 nt, Human
uuuuguuccacaagu

SEQ ID NO: 1631058 - RNA, 21 nt, Human
uuuuguuccacaaguuaaaua

SEQ ID NO: 1631059 - RNA, 18 nt, Human
uuuuguuguuuguuuagu

SEQ ID NO: 1631060 - RNA, 12 nt, Human
uuuuguuucugu

SEQ ID NO: 1631061 - RNA, 22 nt, Human
uuuuguuuggaccaaaaaccag

SEQ ID NO: 1631062 - RNA, 12 nt, Human
uuuuguuuggac

SEQ ID NO: 1631063 - RNA, 13 nt, Human
uuuuguuucugua

SEQ ID NO: 1631064 - RNA, 19 nt, Human
uuuuuauauuugaaauauu

SEQ ID NO: 1631065 - RNA, 23 nt, Human
uuuuuauacauaaacaagaccac

SEQ ID NO: 1631066 - RNA, 12 nt, Human
uuuuuauggcuu

SEQ ID NO: 1631067 - RNA, 20 nt, Human
uuuuuaucgucacugcuuaa

SEQ ID NO: 1631068 - RNA, 12 nt, Human
uuuuuaucaugu

SEQ ID NO: 1631069 - RNA, 11 nt, Human
uuuuuacuaau

SEQ ID NO: 1631070 - RNA, 23 nt, Human
uuuuguuuggaccaaaaaccagu

SEQ ID NO: 1631071 - RNA, 22 nt, Human
uuuuuagacagagucucacugu

SEQ ID NO: 1631072 - RNA, 19 nt, Human
caacugaccagccuccaug

SEQ ID NO: 1631073 - RNA, 17 nt, Human
caagacgcugugcugcc

SEQ ID NO: 1631074 - RNA, 16 nt, Human
caagacgcugugcugc

SEQ ID NO: 1631075 - RNA, 18 nt, Human
caagaccuucuccuucac

SEQ ID NO: 1631076 - RNA, 17 nt, Human
caagaccuucuccuuca

SEQ ID NO: 1631077 - RNA, 16 nt, Human
caagaccuucuccuuc

SEQ ID NO: 1631078 - RNA, 14 nt, Human
caagaccuucuccu

SEQ ID NO: 1631079 - RNA, 20 nt, Human
caagaacuuuccaggaaggc

SEQ ID NO: 1631080 - RNA, 19 nt, Human
caagacugcacaucaaaau

SEQ ID NO: 1631081 - RNA, 18 nt, Human
caagacucuuuggacacu

SEQ ID NO: 1631082 - RNA, 15 nt, Human
caagagcccaggccu

SEQ ID NO: 1631083 - RNA, 14 nt, Human
caagagcccaggcc

SEQ ID NO: 1631084 - RNA, 18 nt, Human
caagacgcugugcugccc

SEQ ID NO: 1631085 - RNA, 19 nt, Human
caagacgcugugcugcccu

SEQ ID NO: 1631086 - RNA, 17 nt, Human
caagcaccuccugccuc

SEQ ID NO: 1631087 - RNA, 16 nt, Human
caagcaccuccugccu

SEQ ID NO: 1631088 - RNA, 15 nt, Human
caagcaccuccugcc

SEQ ID NO: 1631089 - RNA, 15 nt, Human
caagagggcacuggu

SEQ ID NO: 1631090 - RNA, 14 nt, Human
caagagggcacugg

SEQ ID NO: 1631091 - RNA, 17 nt, Human
caagagcccaggccucc

SEQ ID NO: 1631092 - RNA, 16 nt, Human
caagagcccaggccuc

SEQ ID NO: 1631093 - RNA, 13 nt, Human
caagagggcacug

SEQ ID NO: 1631094 - RNA, 22 nt, Human
caacacucauugaccugaggcc

SEQ ID NO: 1631095 - RNA, 20 nt, Human
caacacucauugaccugagg

SEQ ID NO: 1631096 - RNA, 18 nt, Human
caacacucauugaccuga

SEQ ID NO: 1631097 - RNA, 18 nt, Human
caacccucagagccaccc

SEQ ID NO: 1631098 - RNA, 13 nt, Human
caacccucagagc

SEQ ID NO: 1631099 - RNA, 17 nt, Human
caacccuggcacccagg

SEQ ID NO: 1631100 - RNA, 14 nt, Human
caacgucugugcca

SEQ ID NO: 1631101 - RNA, 13 nt, Human
caacgucugugcc

SEQ ID NO: 1631102 - RNA, 17 nt, Human
caacugaccagccucca

SEQ ID NO: 1631103 - RNA, 15 nt, Human
caacugaccagccuc

SEQ ID NO: 1631104 - RNA, 19 nt, Human
caaccuucgccaccugggu

SEQ ID NO: 1631105 - RNA, 20 nt, Human
caaccuguucugcuuuccuc

SEQ ID NO: 1631106 - RNA, 14 nt, Human
caaccuccugggcu

SEQ ID NO: 1631107 - RNA, 15 nt, Human
caaccuccugggcua

SEQ ID NO: 1631108 - RNA, 17 nt, Human
caaggcugauuaaacca

SEQ ID NO: 1631109 - RNA, 22 nt, Human
caaggacugcagggacugccag

SEQ ID NO: 1631110 - RNA, 19 nt, Human
caagcuggucccacucagu

SEQ ID NO: 1631111 - RNA, 17 nt, Human
caagcuggucccacuca

SEQ ID NO: 1631112 - RNA, 15 nt, Human
caaggacugcaggga

SEQ ID NO: 1631113 - RNA, 18 nt, Human
caaggacagccccuccuc

SEQ ID NO: 1631114 - RNA, 21 nt, Human
caagccagauuuuccugaaaa

SEQ ID NO: 1631115 - RNA, 18 nt, Human
caagcaggacauggacaa

SEQ ID NO: 1631116 - RNA, 14 nt, Human
caagcaggacaugg

SEQ ID NO: 1631117 - RNA, 18 nt, Human
caagcaccuccugccucg

SEQ ID NO: 1631118 - RNA, 17 nt, Human
caagagggcacuggugg

SEQ ID NO: 1631119 - RNA, 22 nt, Human
caagcgauucuucugcuucagc

SEQ ID NO: 1631120 - RNA, 20 nt, Human
caagcgauucuucugcuuca

SEQ ID NO: 1631121 - RNA, 14 nt, Human
caagccuggcaagg

SEQ ID NO: 1631122 - RNA, 19 nt, Human
caagcgauucuucugcuuc

SEQ ID NO: 1631123 - RNA, 18 nt, Human
caagccguggcuucccgc

SEQ ID NO: 1631124 - RNA, 17 nt, Human
caagugagagcugggug

SEQ ID NO: 1631125 - RNA, 15 nt, Human
caagugagagcuggg

SEQ ID NO: 1631126 - RNA, 14 nt, Human
caagugagagcugg

SEQ ID NO: 1631127 - RNA, 21 nt, Human
caaguccucuuuucugagagg

SEQ ID NO: 1631128 - RNA, 18 nt, Human
caagugagagcugggugu

SEQ ID NO: 1631129 - RNA, 21 nt, Human
caagugauucucaugccucag

SEQ ID NO: 1631130 - RNA, 20 nt, Human
caagugauucucaugccuca

SEQ ID NO: 1631131 - RNA, 18 nt, Human
caagugauucucaugccu

SEQ ID NO: 1631132 - RNA, 17 nt, Human
caagugauucucaugcc

SEQ ID NO: 1631133 - RNA, 14 nt, Human
caaguuaaauaaau

SEQ ID NO: 1631134 - RNA, 19 nt, Human
caaguggcucccacacccu

SEQ ID NO: 1631135 - RNA, 23 nt, Human
caaggcugucaauuacaggaagu

SEQ ID NO: 1631136 - RNA, 15 nt, Human
caaggcugcagugag

SEQ ID NO: 1631137 - RNA, 12 nt, Human
caaggcugcagu

SEQ ID NO: 1631138 - RNA, 18 nt, Human
caaggggcccaaauucuu

SEQ ID NO: 1631139 - RNA, 14 nt, Human
caaggucauuuuuu

SEQ ID NO: 1631140 - RNA, 20 nt, Human
caaggucauuuuuuuuaaga

SEQ ID NO: 1631141 - RNA, 19 nt, Human
caaggguagggugggccuu

SEQ ID NO: 1631142 - RNA, 18 nt, Human
caaggguagggugggccu

SEQ ID NO: 1631143 - RNA, 14 nt, Human
caaguccucuuuuc

SEQ ID NO: 1631144 - RNA, 23 nt, Human
caauacaucccuuaccugggaaa

SEQ ID NO: 1631145 - RNA, 13 nt, Human
caauaggaaaaac

SEQ ID NO: 1631146 - RNA, 12 nt, Human
caauaggaaaaa

SEQ ID NO: 1631147 - RNA, 17 nt, Human
caauauucgcuguguca

SEQ ID NO: 1631148 - RNA, 15 nt, Human
caaugacuuacugua

SEQ ID NO: 1631149 - RNA, 17 nt, Human
caaugacuuacuguaca

SEQ ID NO: 1631150 - RNA, 18 nt, Human
caaugacuuacuguacau

SEQ ID NO: 1631151 - RNA, 23 nt, Human
caaugaccuuucaauaggaaaaa

SEQ ID NO: 1631152 - RNA, 21 nt, Human
caaugcacuuuguucuggcuc

SEQ ID NO: 1631153 - RNA, 20 nt, Human
caaugcacuuuguucuggcu

SEQ ID NO: 1631154 - RNA, 22 nt, Human
caaugcacuuuguucuggcucu

SEQ ID NO: 1631155 - RNA, 17 nt, Human
caaugcacuuuguucug

SEQ ID NO: 1631156 - RNA, 23 nt, Human
caauucucauuugucacacacuu

SEQ ID NO: 1631157 - RNA, 17 nt, Human
caauuacaggaaguacu

SEQ ID NO: 1631158 - RNA, 13 nt, Human
caauucuccugcc

SEQ ID NO: 1631159 - RNA, 16 nt, Human
caauuacaggaaguac

SEQ ID NO: 1631160 - RNA, 16 nt, Human
caauucuccugccuca

SEQ ID NO: 1631161 - RNA, 15 nt, Human
caauucuccugccuc

SEQ ID NO: 1631162 - RNA, 14 nt, Human
caauucuccugccu

SEQ ID NO: 1631163 - RNA, 17 nt, Human
caaugugauaaaacccc

SEQ ID NO: 1631164 - RNA, 15 nt, Human
caaugugauaaaacc

SEQ ID NO: 1631165 - RNA, 14 nt, Human
caauguucucucuu

SEQ ID NO: 1631166 - RNA, 14 nt, Human
caauaggaaaaacu

SEQ ID NO: 1631167 - RNA, 13 nt, Human
caaaggaagcaca

SEQ ID NO: 1631168 - RNA, 12 nt, Human
caaaggaagcac

SEQ ID NO: 1631169 - RNA, 15 nt, Human
caaagcuaggccugg

SEQ ID NO: 1631170 - RNA, 19 nt, Human
caaagcuaggccuggccag

SEQ ID NO: 1631171 - RNA, 14 nt, Human
caaagcuaggccug

SEQ ID NO: 1631172 - RNA, 13 nt, Human
caaagcuaggccu

SEQ ID NO: 1631173 - RNA, 18 nt, Human
caaaggguaucaggugcu

SEQ ID NO: 1631174 - RNA, 16 nt, Human
caaaggguaucaggug

SEQ ID NO: 1631175 - RNA, 14 nt, Human
caaaggaagcacau

SEQ ID NO: 1631176 - RNA, 17 nt, Human
caaacucaccugccccu

SEQ ID NO: 1631177 - RNA, 18 nt, Human
caaagccuccuccagccg

SEQ ID NO: 1631178 - RNA, 17 nt, Human
caaagccuccuccagcc

SEQ ID NO: 1631179 - RNA, 16 nt, Human
caaaauuguuacaaau

SEQ ID NO: 1631180 - RNA, 15 nt, Human
caaaauguaggguua

SEQ ID NO: 1631181 - RNA, 12 nt, Human
caaaauaaaacu

SEQ ID NO: 1631182 - RNA, 14 nt, Human
caaaauaaaacuuu

SEQ ID NO: 1631183 - RNA, 22 nt, Human
caaaauuuuuucucuaggaaau

SEQ ID NO: 1631184 - RNA, 21 nt, Human
caaaauuuuuucucuaggaaa

SEQ ID NO: 1631185 - RNA, 16 nt, Human
caaaauuuuuucucua

SEQ ID NO: 1631186 - RNA, 15 nt, Human
caaacacauacagga

SEQ ID NO: 1631187 - RNA, 20 nt, Human
caaacccuucagugccaaaa

SEQ ID NO: 1631188 - RNA, 15 nt, Human
caaauugugugaaag

SEQ ID NO: 1631189 - RNA, 21 nt, Human
caaauuguaagcaugcacaaa

SEQ ID NO: 1631190 - RNA, 11 nt, Human
caaauuucuaa

SEQ ID NO: 1631191 - RNA, 12 nt, Human
caaauuucuaaa

SEQ ID NO: 1631192 - RNA, 14 nt, Human
caaauuucuaaauc

SEQ ID NO: 1631193 - RNA, 14 nt, Human
caaaugucuauaaa

SEQ ID NO: 1631194 - RNA, 15 nt, Human
caaaugucuauaaac

SEQ ID NO: 1631195 - RNA, 21 nt, Human
caaauaugcaaagcacugacu

SEQ ID NO: 1631196 - RNA, 19 nt, Human
caaauaugcaaagcacuga

SEQ ID NO: 1631197 - RNA, 19 nt, Human
caaaggguaucaggugcug

SEQ ID NO: 1631198 - RNA, 19 nt, Human
caaagugcugggauuacag

SEQ ID NO: 1631199 - RNA, 23 nt, Human
caaagugcugggauuacaggugu

SEQ ID NO: 1631200 - RNA, 20 nt, Human
caaauacgugggcauucaaa

SEQ ID NO: 1631201 - RNA, 22 nt, Human
caaauacgugggcauucaaaug

SEQ ID NO: 1631202 - RNA, 21 nt, Human
caaauacgugggcauucaaau

SEQ ID NO: 1631203 - RNA, 13 nt, Human
auuuuccugaaaa

SEQ ID NO: 1631204 - RNA, 21 nt, Human
auuuugggguacccacugcuc

SEQ ID NO: 1631205 - RNA, 16 nt, Human
caaaaaaugcuugcuu

SEQ ID NO: 1631206 - RNA, 23 nt, Human
auuuugggguacccacugcucug

SEQ ID NO: 1631207 - RNA, 22 nt, Human
auuuugggguacccacugcucu

SEQ ID NO: 1631208 - RNA, 14 nt, Human
caaaaacacagcaa

SEQ ID NO: 1631209 - RNA, 13 nt, Human
caaaaacacagca

SEQ ID NO: 1631210 - RNA, 17 nt, Human
caaaaacacagcaaggg

SEQ ID NO: 1631211 - RNA, 15 nt, Human
caaaaacacagcaag

SEQ ID NO: 1631212 - RNA, 20 nt, Human
caaaaacauggccuuugcuu

SEQ ID NO: 1631213 - RNA, 13 nt, Human
caaaaaggcagga

SEQ ID NO: 1631214 - RNA, 18 nt, Human
caaaaaccaguauuguac

SEQ ID NO: 1631215 - RNA, 20 nt, Human
caaaaaccaguauuguacaa

SEQ ID NO: 1631216 - RNA, 19 nt, Human
caaaaaccaguauuguaca

SEQ ID NO: 1631217 - RNA, 23 nt, Human
caaaacuucagacauagaauuaa

SEQ ID NO: 1631218 - RNA, 17 nt, Human
caaaauaaaaaugaggu

SEQ ID NO: 1631219 - RNA, 21 nt, Human
caaaacucuccucugcugcug

SEQ ID NO: 1631220 - RNA, 20 nt, Human
caaaacucuccucugcugcu

SEQ ID NO: 1631221 - RNA, 22 nt, Human
caaaacucuccucugcugcugg

SEQ ID NO: 1631222 - RNA, 23 nt, Human
caaaacucuccucugcugcuggc

SEQ ID NO: 1631223 - RNA, 19 nt, Human
caaaaaucucaauauuuca

SEQ ID NO: 1631224 - RNA, 23 nt, Human
caaaaauauuuuaugauccagca

SEQ ID NO: 1631225 - RNA, 22 nt, Human
caaaaauauuuuaugauccagc

SEQ ID NO: 1631226 - RNA, 21 nt, Human
caaaaauauuuuaugauccag

SEQ ID NO: 1631227 - RNA, 17 nt, Human
caaaaauauuuuaugau

SEQ ID NO: 1631228 - RNA, 15 nt, Human
caaaaauauuuuaug

SEQ ID NO: 1631229 - RNA, 14 nt, Human
caaaaauauuuuau

SEQ ID NO: 1631230 - RNA, 20 nt, Human
cacaguuuucugagaaagac

SEQ ID NO: 1631231 - RNA, 19 nt, Human
cacaguuuucugagaaaga

SEQ ID NO: 1631232 - RNA, 17 nt, Human
cacaguuuucugagaaa

SEQ ID NO: 1631233 - RNA, 16 nt, Human
cacaguuuucugagaa

SEQ ID NO: 1631234 - RNA, 21 nt, Human
cacauagugaugguuccccug

SEQ ID NO: 1631235 - RNA, 23 nt, Human
cacagcugggguggggaccucag

SEQ ID NO: 1631236 - RNA, 22 nt, Human
cacagcugggguggggaccuca

SEQ ID NO: 1631237 - RNA, 22 nt, Human
cacagcuucauuuccugugucu

SEQ ID NO: 1631238 - RNA, 21 nt, Human
cacagcuucauuuccuguguc

SEQ ID NO: 1631239 - RNA, 15 nt, Human
cacaggcagguccag

SEQ ID NO: 1631240 - RNA, 14 nt, Human
cacaggcaggucca

SEQ ID NO: 1631241 - RNA, 11 nt, Human
cacaggcaggu

SEQ ID NO: 1631242 - RNA, 14 nt, Human
cacaggagggaggg

SEQ ID NO: 1631243 - RNA, 21 nt, Human
cacaggagggagggggaaggc

SEQ ID NO: 1631244 - RNA, 19 nt, Human
cacaggagggagggggaag

SEQ ID NO: 1631245 - RNA, 15 nt, Human
cacaguucucuccuu

SEQ ID NO: 1631246 - RNA, 14 nt, Human
cacaguucucuccu

SEQ ID NO: 1631247 - RNA, 17 nt, Human
cacagugcaucucagcc

SEQ ID NO: 1631248 - RNA, 22 nt, Human
cacaguccuuaccagcagagca

SEQ ID NO: 1631249 - RNA, 21 nt, Human
cacaguccuuaccagcagagc

SEQ ID NO: 1631250 - RNA, 15 nt, Human
cacaguccuuaccag

SEQ ID NO: 1631251 - RNA, 13 nt, Human
cacaguccuuacc

SEQ ID NO: 1631252 - RNA, 22 nt, Human
cacagugagucgaggacaggga

SEQ ID NO: 1631253 - RNA, 19 nt, Human
cacaggcagguccaggguu

SEQ ID NO: 1631254 - RNA, 19 nt, Human
cacagugaucaaguuauuu

SEQ ID NO: 1631255 - RNA, 14 nt, Human
cacagugcaucuca

SEQ ID NO: 1631256 - RNA, 20 nt, Human
cacucugucgcccagucugg

SEQ ID NO: 1631257 - RNA, 23 nt, Human
cacugacauuguuggccaaagcc

SEQ ID NO: 1631258 - RNA, 19 nt, Human
cacucugucgcccagucug

SEQ ID NO: 1631259 - RNA, 16 nt, Human
cacucugucgcccagu

SEQ ID NO: 1631260 - RNA, 15 nt, Human
cacucugucgcccag

SEQ ID NO: 1631261 - RNA, 19 nt, Human
cacucuggcagcucagaga

SEQ ID NO: 1631262 - RNA, 17 nt, Human
cacucuggcagcucaga

SEQ ID NO: 1631263 - RNA, 16 nt, Human
cacucuggcagcucag

SEQ ID NO: 1631264 - RNA, 15 nt, Human
cacucuggcagcuca

SEQ ID NO: 1631265 - RNA, 21 nt, Human
cacucuggcagcucagagagg

SEQ ID NO: 1631266 - RNA, 20 nt, Human
cacucuggcagcucagagag

SEQ ID NO: 1631267 - RNA, 23 nt, Human
cacucuggcagcucagagagggu

SEQ ID NO: 1631268 - RNA, 20 nt, Human
cacugacuucuaaguaaaac

SEQ ID NO: 1631269 - RNA, 16 nt, Human
cacugacuucuaagua

SEQ ID NO: 1631270 - RNA, 15 nt, Human
cacugacuucuaagu

SEQ ID NO: 1631271 - RNA, 14 nt, Human
cacugacuucuaag

SEQ ID NO: 1631272 - RNA, 21 nt, Human
cacugacuucuaaguaaaacc

SEQ ID NO: 1631273 - RNA, 13 nt, Human
cacugagacagcc

SEQ ID NO: 1631274 - RNA, 12 nt, Human
cacugagacagc

SEQ ID NO: 1631275 - RNA, 22 nt, Human
cacugagacagcccgggcucug

SEQ ID NO: 1631276 - RNA, 19 nt, Human
cacugagacagcccgggcu

SEQ ID NO: 1631277 - RNA, 17 nt, Human
cacugagacagcccggg

SEQ ID NO: 1631278 - RNA, 14 nt, Human
cacugagacagccc

SEQ ID NO: 1631279 - RNA, 23 nt, Human
cacugagacagcccgggcucugc

SEQ ID NO: 1631280 - RNA, 24 nt, Human
cacugaugggcaacccccagccug

SEQ ID NO: 1631281 - RNA, 18 nt, Human
cacugaugggcaaccccc

SEQ ID NO: 1631282 - RNA, 14 nt, Human
cacugaugggcaac

SEQ ID NO: 1631283 - RNA, 13 nt, Human
cacugcaaccucc

SEQ ID NO: 1631284 - RNA, 23 nt, Human
cacugauuugacauagucuggcu

SEQ ID NO: 1631285 - RNA, 21 nt, Human
cacugauuugacauagucugg

SEQ ID NO: 1631286 - RNA, 16 nt, Human
cacugcaaccuccgcc

SEQ ID NO: 1631287 - RNA, 14 nt, Human
cacugcaaccuccg

SEQ ID NO: 1631288 - RNA, 23 nt, Human
cacugcaaccuccgccucuuggg

SEQ ID NO: 1631289 - RNA, 22 nt, Human
cacugcacagugcaucucagcc

SEQ ID NO: 1631290 - RNA, 21 nt, Human
cacugcacagugcaucucagc

SEQ ID NO: 1631291 - RNA, 19 nt, Human
cacugcacagugcaucuca

SEQ ID NO: 1631292 - RNA, 18 nt, Human
cacugcacagugcaucuc

SEQ ID NO: 1631293 - RNA, 23 nt, Human
cacugcaaccuucgccaccuggg

SEQ ID NO: 1631294 - RNA, 22 nt, Human
cacugcaaccuucgccaccugg

SEQ ID NO: 1631295 - RNA, 14 nt, Human
cacugcaaccuucg

SEQ ID NO: 1631296 - RNA, 20 nt, Human
cacugccuucucaacuccaa

SEQ ID NO: 1631297 - RNA, 22 nt, Human
cacugccuucgauacaccgggc

SEQ ID NO: 1631298 - RNA, 20 nt, Human
cacugccuucgauacaccgg

SEQ ID NO: 1631299 - RNA, 12 nt, Human
cacugcucuggu

SEQ ID NO: 1631300 - RNA, 20 nt, Human
cacugcucugaugaagagga

SEQ ID NO: 1631301 - RNA, 17 nt, Human
cacugcugcccagccuc

SEQ ID NO: 1631302 - RNA, 15 nt, Human
cacugcugcccagcc

SEQ ID NO: 1631303 - RNA, 18 nt, Human
cacugcacuauagccuag

SEQ ID NO: 1631304 - RNA, 19 nt, Human
cacugcaccgggccacaga

SEQ ID NO: 1631305 - RNA, 18 nt, Human
cacugcaccgggccacag

SEQ ID NO: 1631306 - RNA, 16 nt, Human
cacugcaccgggccac

SEQ ID NO: 1631307 - RNA, 15 nt, Human
cacugcaccgggcca

SEQ ID NO: 1631308 - RNA, 14 nt, Human
cacugcaccgggcc

SEQ ID NO: 1631309 - RNA, 23 nt, Human
cacugcacagugcaucucagccc

SEQ ID NO: 1631310 - RNA, 19 nt, Human
cacugcacuauagccuagg

SEQ ID NO: 1631311 - RNA, 16 nt, Human
cacugccucuuccucc

SEQ ID NO: 1631312 - RNA, 16 nt, Human
cacugcuuccagugag

SEQ ID NO: 1631313 - RNA, 15 nt, Human
cacugcuuccaguga

SEQ ID NO: 1631314 - RNA, 14 nt, Human
cacugcuuccagug

SEQ ID NO: 1631315 - RNA, 13 nt, Human
cacugcuuaacuu

SEQ ID NO: 1631316 - RNA, 21 nt, Human
cacugcuggcugccuuagaac

SEQ ID NO: 1631317 - RNA, 16 nt, Human
cacugcuggcugccuu

SEQ ID NO: 1631318 - RNA, 15 nt, Human
cacugcuggcugccu

SEQ ID NO: 1631319 - RNA, 14 nt, Human
cacugcuggcugcc

SEQ ID NO: 1631320 - RNA, 13 nt, Human
cacugcuggcugc

SEQ ID NO: 1631321 - RNA, 12 nt, Human
cacugcuggcug

SEQ ID NO: 1631322 - RNA, 21 nt, Human
cacugcuuccagugaggcucu

SEQ ID NO: 1631323 - RNA, 20 nt, Human
cacugcuuccagugaggcuc

SEQ ID NO: 1631324 - RNA, 19 nt, Human
cacugcuuccagugaggcu

SEQ ID NO: 1631325 - RNA, 18 nt, Human
cacugcuuccagugaggc

SEQ ID NO: 1631326 - RNA, 20 nt, Human
cacugcuuuuggucugugug

SEQ ID NO: 1631327 - RNA, 22 nt, Human
cacugcuuccagugaggcucug

SEQ ID NO: 1631328 - RNA, 17 nt, Human
cacuggaacacuaauga

SEQ ID NO: 1631329 - RNA, 21 nt, Human
cacugcuuuuggucuguguga

SEQ ID NO: 1631330 - RNA, 15 nt, Human
cacuggacucaccuc

SEQ ID NO: 1631331 - RNA, 18 nt, Human
cacuggacucaccucccc

SEQ ID NO: 1631332 - RNA, 23 nt, Human
cacuugaacccgggaggcagagg

SEQ ID NO: 1631333 - RNA, 16 nt, Human
cacuugacaucaacug

SEQ ID NO: 1631334 - RNA, 21 nt, Human
cacuugaacccgggaggcaga

SEQ ID NO: 1631335 - RNA, 20 nt, Human
cacuugaacccgggaggcag

SEQ ID NO: 1631336 - RNA, 20 nt, Human
cacuugagaauuacccuuuu

SEQ ID NO: 1631337 - RNA, 17 nt, Human
cacuugagaauuacccu

SEQ ID NO: 1631338 - RNA, 19 nt, Human
cacuugacaucaacugcau

SEQ ID NO: 1631339 - RNA, 13 nt, Human
cacuugaguccag

SEQ ID NO: 1631340 - RNA, 19 nt, Human
cacuugaugacccccaacc

SEQ ID NO: 1631341 - RNA, 13 nt, Human
cacuugcagacuc

SEQ ID NO: 1631342 - RNA, 17 nt, Human
cacuuggucugugagau

SEQ ID NO: 1631343 - RNA, 15 nt, Human
cacuuggucugugag

SEQ ID NO: 1631344 - RNA, 20 nt, Human
cacuuucuagccagaggaga

SEQ ID NO: 1631345 - RNA, 19 nt, Human
cacuuucuagccagaggag

SEQ ID NO: 1631346 - RNA, 22 nt, Human
cacuugcagacucuacagaggc

SEQ ID NO: 1631347 - RNA, 19 nt, Human
cacuugcagacucuacaga

SEQ ID NO: 1631348 - RNA, 18 nt, Human
cacuugcagacucuacag

SEQ ID NO: 1631349 - RNA, 14 nt, Human
cacuugcagacucu

SEQ ID NO: 1631350 - RNA, 24 nt, Human
cacuugcagacucuacagaggcca

SEQ ID NO: 1631351 - RNA, 21 nt, Human
cacuucagcugacuuuucugu

SEQ ID NO: 1631352 - RNA, 12 nt, Human
cacuucagcuga

SEQ ID NO: 1631353 - RNA, 20 nt, Human
cacuucaggcucuucuccuu

SEQ ID NO: 1631354 - RNA, 16 nt, Human
cacuucaggcucuucu

SEQ ID NO: 1631355 - RNA, 15 nt, Human
cacuucaggcucuuc

SEQ ID NO: 1631356 - RNA, 14 nt, Human
cacuucaggcucuu

SEQ ID NO: 1631357 - RNA, 23 nt, Human
cacuucaggcucuucuccuuuca

SEQ ID NO: 1631358 - RNA, 14 nt, Human
cacuguugcccagg

SEQ ID NO: 1631359 - RNA, 16 nt, Human
cacuucccuacaugga

SEQ ID NO: 1631360 - RNA, 20 nt, Human
cacuuccauaaucuggacuc

SEQ ID NO: 1631361 - RNA, 23 nt, Human
cacuucgggaggucgaggcagga

SEQ ID NO: 1631362 - RNA, 21 nt, Human
cacuucgggaggucgaggcag

SEQ ID NO: 1631363 - RNA, 22 nt, Human
cacuucugccauauucuguugg

SEQ ID NO: 1631364 - RNA, 19 nt, Human
cacuguggguagacacaca

SEQ ID NO: 1631365 - RNA, 22 nt, Human
cacugugcugagucugaaggcu

SEQ ID NO: 1631366 - RNA, 21 nt, Human
cacugugcugagucugaaggc

SEQ ID NO: 1631367 - RNA, 20 nt, Human
cacugugcugagucugaagg

SEQ ID NO: 1631368 - RNA, 17 nt, Human
cacugugcugagucuga

SEQ ID NO: 1631369 - RNA, 15 nt, Human
cacugugcugagucu

SEQ ID NO: 1631370 - RNA, 13 nt, Human
cacugugcugagu

SEQ ID NO: 1631371 - RNA, 16 nt, Human
cacugugccaugugcc

SEQ ID NO: 1631372 - RNA, 15 nt, Human
cacugugccaugugc

SEQ ID NO: 1631373 - RNA, 18 nt, Human
cacugugccaugugccag

SEQ ID NO: 1631374 - RNA, 24 nt, Human
cacuguggguagacacacaugaag

SEQ ID NO: 1631375 - RNA, 22 nt, Human
cacuguggguagacacacauga

SEQ ID NO: 1631376 - RNA, 22 nt, Human
cacuguucucugcccuccaaga

SEQ ID NO: 1631377 - RNA, 21 nt, Human
cacuguucucugcccuccaag

SEQ ID NO: 1631378 - RNA, 19 nt, Human
cacuguucucugcccucca

SEQ ID NO: 1631379 - RNA, 17 nt, Human
cacuguucucugcccuc

SEQ ID NO: 1631380 - RNA, 16 nt, Human
cacuguucucugcccu

SEQ ID NO: 1631381 - RNA, 15 nt, Human
cacuguucucugccc

SEQ ID NO: 1631382 - RNA, 14 nt, Human
cacuguucucugcc

SEQ ID NO: 1631383 - RNA, 13 nt, Human
cacuguucucugc

SEQ ID NO: 1631384 - RNA, 14 nt, Human
cacugucaagauga

SEQ ID NO: 1631385 - RNA, 14 nt, Human
cacugugccaugug

SEQ ID NO: 1631386 - RNA, 13 nt, Human
cacugugaagaga

SEQ ID NO: 1631387 - RNA, 19 nt, Human
cacuguacuugcucuugau

SEQ ID NO: 1631388 - RNA, 18 nt, Human
cacuguacuugcucuuga

SEQ ID NO: 1631389 - RNA, 15 nt, Human
cacuguacuugcucu

SEQ ID NO: 1631390 - RNA, 22 nt, Human
cacgagcaggcuacugucagcu

SEQ ID NO: 1631391 - RNA, 20 nt, Human
cacgagcaggcuacugucag

SEQ ID NO: 1631392 - RNA, 19 nt, Human
cacgagcaggcuacuguca

SEQ ID NO: 1631393 - RNA, 17 nt, Human
cacgagcaggcuacugu

SEQ ID NO: 1631394 - RNA, 17 nt, Human
cacgcacuucgggaggu

SEQ ID NO: 1631395 - RNA, 12 nt, Human
cacgauuucugu

SEQ ID NO: 1631396 - RNA, 14 nt, Human
cacgauuucuguuu

SEQ ID NO: 1631397 - RNA, 16 nt, Human
cacgauuucuguuuag

SEQ ID NO: 1631398 - RNA, 18 nt, Human
cacgcccccacuggugac

SEQ ID NO: 1631399 - RNA, 17 nt, Human
cacgcccccacugguga

SEQ ID NO: 1631400 - RNA, 15 nt, Human
cacgcccccacuggu

SEQ ID NO: 1631401 - RNA, 13 nt, Human
cacgcccccacug

SEQ ID NO: 1631402 - RNA, 23 nt, Human
cacgccagauucuuuccugaggc

SEQ ID NO: 1631403 - RNA, 22 nt, Human
cacgccagauucuuuccugagg

SEQ ID NO: 1631404 - RNA, 20 nt, Human
cacgccagauucuuuccuga

SEQ ID NO: 1631405 - RNA, 19 nt, Human
cacgccagauucuuuccug

SEQ ID NO: 1631406 - RNA, 15 nt, Human
cacgccacugcacua

SEQ ID NO: 1631407 - RNA, 13 nt, Human
cacgccacugcac

SEQ ID NO: 1631408 - RNA, 22 nt, Human
cacgaauauugcugauggugca

SEQ ID NO: 1631409 - RNA, 19 nt, Human
cacgaauauugcugauggu

SEQ ID NO: 1631410 - RNA, 16 nt, Human
cacgaauauugcugau

SEQ ID NO: 1631411 - RNA, 17 nt, Human
cacgacugcccggcagg

SEQ ID NO: 1631412 - RNA, 16 nt, Human
cacgacugcccggcag

SEQ ID NO: 1631413 - RNA, 13 nt, Human
caccuugacaggg

SEQ ID NO: 1631414 - RNA, 14 nt, Human
caccuucccaugcc

SEQ ID NO: 1631415 - RNA, 13 nt, Human
caccuucccaugc

SEQ ID NO: 1631416 - RNA, 16 nt, Human
caccuugacagggcac

SEQ ID NO: 1631417 - RNA, 15 nt, Human
caccuugacagggca

SEQ ID NO: 1631418 - RNA, 18 nt, Human
caccuugacagggcacac

SEQ ID NO: 1631419 - RNA, 23 nt, Human
caccuuagacagucccugccaau

SEQ ID NO: 1631420 - RNA, 21 nt, Human
caccuuagacagucccugcca

SEQ ID NO: 1631421 - RNA, 22 nt, Human
caccuuagccugcccuccuuuc

SEQ ID NO: 1631422 - RNA, 19 nt, Human
caccuuagacagucccugc

SEQ ID NO: 1631423 - RNA, 18 nt, Human
caccuuagacagucccug

SEQ ID NO: 1631424 - RNA, 16 nt, Human
caccuuagacaguccc

SEQ ID NO: 1631425 - RNA, 14 nt, Human
caccuuagacaguc

SEQ ID NO: 1631426 - RNA, 17 nt, Human
caccugucuugccuuuu

SEQ ID NO: 1631427 - RNA, 20 nt, Human
caccugucuugccuuuuuca

SEQ ID NO: 1631428 - RNA, 22 nt, Human
cacguucuuacuaguuucccuu

SEQ ID NO: 1631429 - RNA, 19 nt, Human
cacgugguccuaaucuucu

SEQ ID NO: 1631430 - RNA, 16 nt, Human
cacgugguccuaaucu

SEQ ID NO: 1631431 - RNA, 13 nt, Human
cacuaaacaaaga

SEQ ID NO: 1631432 - RNA, 12 nt, Human
cacguuucuaaa

SEQ ID NO: 1631433 - RNA, 14 nt, Human
cacguuucuaaagg

SEQ ID NO: 1631434 - RNA, 23 nt, Human
cacguuucuaaaggcuaccuuug

SEQ ID NO: 1631435 - RNA, 14 nt, Human
cacguacacacaca

SEQ ID NO: 1631436 - RNA, 19 nt, Human
cacguacacacacauacac

SEQ ID NO: 1631437 - RNA, 18 nt, Human
cacguacacacacauaca

SEQ ID NO: 1631438 - RNA, 13 nt, Human
cacgugacagccg

SEQ ID NO: 1631439 - RNA, 20 nt, Human
cacggcucacugcagccuca

SEQ ID NO: 1631440 - RNA, 19 nt, Human
cacggcucacugcagccuc

SEQ ID NO: 1631441 - RNA, 17 nt, Human
cacggcucacugcagcc

SEQ ID NO: 1631442 - RNA, 16 nt, Human
cacggcucacugcagc

SEQ ID NO: 1631443 - RNA, 17 nt, Human
cacgcuggaccuugaac

SEQ ID NO: 1631444 - RNA, 14 nt, Human
cacgcuccuuccuc

SEQ ID NO: 1631445 - RNA, 20 nt, Human
cacgcuggaccuugaacugg

SEQ ID NO: 1631446 - RNA, 15 nt, Human
cacgggggccaagga

SEQ ID NO: 1631447 - RNA, 23 nt, Human
cacggugaauggcuuuguauaga

SEQ ID NO: 1631448 - RNA, 20 nt, Human
cacggugaauggcuuuguau

SEQ ID NO: 1631449 - RNA, 21 nt, Human
cacgcgugcacacaccagagc

SEQ ID NO: 1631450 - RNA, 16 nt, Human
cacgcgugcacacacc

SEQ ID NO: 1631451 - RNA, 15 nt, Human
cacgcgugcacacac

SEQ ID NO: 1631452 - RNA, 23 nt, Human
cacgcgugcacacaccagagccc

SEQ ID NO: 1631453 - RNA, 20 nt, Human
cacgccuguaauccuagcac

SEQ ID NO: 1631454 - RNA, 19 nt, Human
cacgccuguaauccuagca

SEQ ID NO: 1631455 - RNA, 16 nt, Human
cacucaaaucaagaaa

SEQ ID NO: 1631456 - RNA, 20 nt, Human
cacucaaaagcugggcaggu

SEQ ID NO: 1631457 - RNA, 19 nt, Human
cacucaaaagcugggcagg

SEQ ID NO: 1631458 - RNA, 18 nt, Human
cacucaaaagcugggcag

SEQ ID NO: 1631459 - RNA, 17 nt, Human
cacucaaaagcugggca

SEQ ID NO: 1631460 - RNA, 15 nt, Human
cacucaaaagcuggg

SEQ ID NO: 1631461 - RNA, 21 nt, Human
cacuauguugcccaggcaggu

SEQ ID NO: 1631462 - RNA, 20 nt, Human
cacuauguugcccaggcagg

SEQ ID NO: 1631463 - RNA, 17 nt, Human
cacucagaagacacuga

SEQ ID NO: 1631464 - RNA, 16 nt, Human
cacucagaagacacug

SEQ ID NO: 1631465 - RNA, 12 nt, Human
cacucagaagac

SEQ ID NO: 1631466 - RNA, 20 nt, Human
cacucacauuuauucugcuc

SEQ ID NO: 1631467 - RNA, 19 nt, Human
cacucacauuuauucugcu

SEQ ID NO: 1631468 - RNA, 19 nt, Human
cacucagaagacacugaug

SEQ ID NO: 1631469 - RNA, 18 nt, Human
cacucagaagacacugau

SEQ ID NO: 1631470 - RNA, 22 nt, Human
cacucagaagacacugaugggc

SEQ ID NO: 1631471 - RNA, 19 nt, Human
cacuaguauuucuaugaaa

SEQ ID NO: 1631472 - RNA, 14 nt, Human
cacuaguauuucua

SEQ ID NO: 1631473 - RNA, 14 nt, Human
cacuauaauguaag

SEQ ID NO: 1631474 - RNA, 21 nt, Human
cacuauagccuaggugacaga

SEQ ID NO: 1631475 - RNA, 14 nt, Human
cacuauagccuagg

SEQ ID NO: 1631476 - RNA, 18 nt, Human
cacuauaauguaagcucu

SEQ ID NO: 1631477 - RNA, 19 nt, Human
cacuauguugcccaggcag

SEQ ID NO: 1631478 - RNA, 18 nt, Human
cacuauguugcccaggca

SEQ ID NO: 1631479 - RNA, 17 nt, Human
cacuauguugcccaggc

SEQ ID NO: 1631480 - RNA, 16 nt, Human
cacuauguugcccagg

SEQ ID NO: 1631481 - RNA, 15 nt, Human
cacuauguugcccag

SEQ ID NO: 1631482 - RNA, 19 nt, Human
cacuaucccggcugcccuu

SEQ ID NO: 1631483 - RNA, 18 nt, Human
cacuaucccggcugcccu

SEQ ID NO: 1631484 - RNA, 21 nt, Human
cacuaaauugacacuuaaaaa

SEQ ID NO: 1631485 - RNA, 16 nt, Human
cacuaacaugauuugg

SEQ ID NO: 1631486 - RNA, 16 nt, Human
cacuaaccacgcugga

SEQ ID NO: 1631487 - RNA, 15 nt, Human
cacuaaccacgcugg

SEQ ID NO: 1631488 - RNA, 14 nt, Human
cacuaaccacgcug

SEQ ID NO: 1631489 - RNA, 17 nt, Human
cacuaagagagaaugag

SEQ ID NO: 1631490 - RNA, 18 nt, Human
cacuaaccacgcuggacc

SEQ ID NO: 1631491 - RNA, 18 nt, Human
cacuaaggugugcucuga

SEQ ID NO: 1631492 - RNA, 17 nt, Human
cacuaaggugugcucug

SEQ ID NO: 1631493 - RNA, 21 nt, Human
cacuccuucacagaugggugc

SEQ ID NO: 1631494 - RNA, 14 nt, Human
cacuccuucacaga

SEQ ID NO: 1631495 - RNA, 17 nt, Human
cacucccugcaaccuga

SEQ ID NO: 1631496 - RNA, 14 nt, Human
cacuccuaccuggu

SEQ ID NO: 1631497 - RNA, 13 nt, Human
cacuccuaccugg

SEQ ID NO: 1631498 - RNA, 16 nt, Human
cacucccugcaaccug

SEQ ID NO: 1631499 - RNA, 13 nt, Human
cacucccugcaac

SEQ ID NO: 1631500 - RNA, 12 nt, Human
cacucccugcaa

SEQ ID NO: 1631501 - RNA, 22 nt, Human
cacucauugaccugaggcccuu

SEQ ID NO: 1631502 - RNA, 20 nt, Human
cacucauugaccugaggccc

SEQ ID NO: 1631503 - RNA, 19 nt, Human
cacucauugaccugaggcc

SEQ ID NO: 1631504 - RNA, 18 nt, Human
cacucauugaccugaggc

SEQ ID NO: 1631505 - RNA, 16 nt, Human
cacucaguccauagca

SEQ ID NO: 1631506 - RNA, 15 nt, Human
cacucauugaccuga

SEQ ID NO: 1631507 - RNA, 14 nt, Human
cacucuggcagcuc

SEQ ID NO: 1631508 - RNA, 13 nt, Human
cacucuggcagcu

SEQ ID NO: 1631509 - RNA, 12 nt, Human
cacucuggcagc

SEQ ID NO: 1631510 - RNA, 23 nt, Human
cacucugagacucgcgacaaugc

SEQ ID NO: 1631511 - RNA, 12 nt, Human
cacucugagacu

SEQ ID NO: 1631512 - RNA, 12 nt, Human
cacucuccuugg

SEQ ID NO: 1631513 - RNA, 17 nt, Human
cacucuccauuuaauaa

SEQ ID NO: 1631514 - RNA, 15 nt, Human
cacucuccauuuaau

SEQ ID NO: 1631515 - RNA, 14 nt, Human
cacucuacuuagca

SEQ ID NO: 1631516 - RNA, 13 nt, Human
caccucccugcaa

SEQ ID NO: 1631517 - RNA, 14 nt, Human
caccucccugcaau

SEQ ID NO: 1631518 - RNA, 11 nt, Human
caccuccugcc

SEQ ID NO: 1631519 - RNA, 13 nt, Human
caccuccugccuc

SEQ ID NO: 1631520 - RNA, 14 nt, Human
caccuccugccucg

SEQ ID NO: 1631521 - RNA, 15 nt, Human
caccuccugcugggc

SEQ ID NO: 1631522 - RNA, 14 nt, Human
caccuccugcuggg

SEQ ID NO: 1631523 - RNA, 17 nt, Human
caccucucccuuggauu

SEQ ID NO: 1631524 - RNA, 14 nt, Human
caccucucccuugg

SEQ ID NO: 1631525 - RNA, 13 nt, Human
caccucucccuug

SEQ ID NO: 1631526 - RNA, 17 nt, Human
caccuccugcugggcag

SEQ ID NO: 1631527 - RNA, 14 nt, Human
caccucauggaauu

SEQ ID NO: 1631528 - RNA, 12 nt, Human
caccucauggaa

SEQ ID NO: 1631529 - RNA, 11 nt, Human
caccucaugga

SEQ ID NO: 1631530 - RNA, 10 nt, Human
caccucccug

SEQ ID NO: 1631531 - RNA, 21 nt, Human
caccucccccaucucuucugg

SEQ ID NO: 1631532 - RNA, 14 nt, Human
caccucccccaucu

SEQ ID NO: 1631533 - RNA, 18 nt, Human
caccgggccacagagaaa

SEQ ID NO: 1631534 - RNA, 15 nt, Human
caccgggccacagag

SEQ ID NO: 1631535 - RNA, 22 nt, Human
caccgggcacucagaagacacu

SEQ ID NO: 1631536 - RNA, 15 nt, Human
caccgggcacucaga

SEQ ID NO: 1631537 - RNA, 13 nt, Human
caccgggccugga

SEQ ID NO: 1631538 - RNA, 15 nt, Human
caccggggccucgga

SEQ ID NO: 1631539 - RNA, 20 nt, Human
caccgugccuggccacgccc

SEQ ID NO: 1631540 - RNA, 15 nt, Human
caccgugccuggcca

SEQ ID NO: 1631541 - RNA, 14 nt, Human
caccgggcacucag

SEQ ID NO: 1631542 - RNA, 20 nt, Human
caccggcuggccuggccccu

SEQ ID NO: 1631543 - RNA, 18 nt, Human
caccggcuggccuggccc

SEQ ID NO: 1631544 - RNA, 17 nt, Human
caccggcuggccuggcc

SEQ ID NO: 1631545 - RNA, 16 nt, Human
caccggcuggccuggc

SEQ ID NO: 1631546 - RNA, 15 nt, Human
caccggcuggccugg

SEQ ID NO: 1631547 - RNA, 14 nt, Human
caccggcuggccug

SEQ ID NO: 1631548 - RNA, 21 nt, Human
caccgcagacaggaccaggga

SEQ ID NO: 1631549 - RNA, 19 nt, Human
caccucugcacaagcugca

SEQ ID NO: 1631550 - RNA, 18 nt, Human
caccucugcacaagcugc

SEQ ID NO: 1631551 - RNA, 19 nt, Human
caccucucucacuccuuga

SEQ ID NO: 1631552 - RNA, 18 nt, Human
caccucucucacuccuug

SEQ ID NO: 1631553 - RNA, 17 nt, Human
caccucucucacuccuu

SEQ ID NO: 1631554 - RNA, 15 nt, Human
caccucucucacucc

SEQ ID NO: 1631555 - RNA, 15 nt, Human
caccugaagacucau

SEQ ID NO: 1631556 - RNA, 14 nt, Human
caccugaagacuca

SEQ ID NO: 1631557 - RNA, 23 nt, Human
caccugaagacucauucuucugu

SEQ ID NO: 1631558 - RNA, 23 nt, Human
caccugcggugcuaucuccccca

SEQ ID NO: 1631559 - RNA, 20 nt, Human
caccuggaauauauaaccag

SEQ ID NO: 1631560 - RNA, 15 nt, Human
caccuggccucugca

SEQ ID NO: 1631561 - RNA, 14 nt, Human
caccuggccucugc

SEQ ID NO: 1631562 - RNA, 13 nt, Human
caccuggccucug

SEQ ID NO: 1631563 - RNA, 12 nt, Human
caccuggccucu

SEQ ID NO: 1631564 - RNA, 20 nt, Human
caccuggccucugcacuccc

SEQ ID NO: 1631565 - RNA, 19 nt, Human
caccuggccucugcacucc

SEQ ID NO: 1631566 - RNA, 18 nt, Human
caccuggccucugcacuc

SEQ ID NO: 1631567 - RNA, 17 nt, Human
caccuggccucugcacu

SEQ ID NO: 1631568 - RNA, 23 nt, Human
caccuggccucugcacuccccug

SEQ ID NO: 1631569 - RNA, 20 nt, Human
cacauauugauuuccguuaa

SEQ ID NO: 1631570 - RNA, 20 nt, Human
caccccucaacaccucugca

SEQ ID NO: 1631571 - RNA, 13 nt, Human
cacauauugauuu

SEQ ID NO: 1631572 - RNA, 21 nt, Human
cacccggccccugcugguuca

SEQ ID NO: 1631573 - RNA, 18 nt, Human
cacccggccccugcuggu

SEQ ID NO: 1631574 - RNA, 17 nt, Human
cacccggccccugcugg

SEQ ID NO: 1631575 - RNA, 16 nt, Human
cacccggccccugcug

SEQ ID NO: 1631576 - RNA, 14 nt, Human
cacccggccccugc

SEQ ID NO: 1631577 - RNA, 13 nt, Human
cacccggccccug

SEQ ID NO: 1631578 - RNA, 12 nt, Human
cacccggccccu

SEQ ID NO: 1631579 - RNA, 19 nt, Human
cacccgcuaagagggaggg

SEQ ID NO: 1631580 - RNA, 23 nt, Human
cacccugugauggggcccugccu

SEQ ID NO: 1631581 - RNA, 22 nt, Human
cacccugugauggggcccugcc

SEQ ID NO: 1631582 - RNA, 21 nt, Human
cacccugugauggggcccugc

SEQ ID NO: 1631583 - RNA, 20 nt, Human
cacccugugauggggcccug

SEQ ID NO: 1631584 - RNA, 18 nt, Human
cacccugugauggggccc

SEQ ID NO: 1631585 - RNA, 15 nt, Human
cacccugugaugggg

SEQ ID NO: 1631586 - RNA, 12 nt, Human
cacccugugaug

SEQ ID NO: 1631587 - RNA, 11 nt, Human
cacccugugau

SEQ ID NO: 1631588 - RNA, 21 nt, Human
caccgaaaacguggcugcuuc

SEQ ID NO: 1631589 - RNA, 19 nt, Human
caccgaaaacguggcugcu

SEQ ID NO: 1631590 - RNA, 22 nt, Human
caccgaaaacguggcugcuuca

SEQ ID NO: 1631591 - RNA, 18 nt, Human
caccgaaaacguggcugc

SEQ ID NO: 1631592 - RNA, 15 nt, Human
caccgaaaacguggc

SEQ ID NO: 1631593 - RNA, 18 nt, Human
caccgcagacaggaccag

SEQ ID NO: 1631594 - RNA, 17 nt, Human
caccgcagacaggacca

SEQ ID NO: 1631595 - RNA, 15 nt, Human
caccgcagacaggac

SEQ ID NO: 1631596 - RNA, 14 nt, Human
caccgcagacagga

SEQ ID NO: 1631597 - RNA, 13 nt, Human
caccgcagacagg

SEQ ID NO: 1631598 - RNA, 12 nt, Human
caccgcagacag

SEQ ID NO: 1631599 - RNA, 16 nt, Human
cacgccagauucuuuc

SEQ ID NO: 1631600 - RNA, 14 nt, Human
cagauaaucacaau

SEQ ID NO: 1631601 - RNA, 14 nt, Human
cagauaaacaguag

SEQ ID NO: 1631602 - RNA, 23 nt, Human
cagauaaauaguuuaugauucca

SEQ ID NO: 1631603 - RNA, 22 nt, Human
cagauaaagguucaugcaaacu

SEQ ID NO: 1631604 - RNA, 15 nt, Human
cagaguuguuacauu

SEQ ID NO: 1631605 - RNA, 18 nt, Human
cagaguuguuacauuuuu

SEQ ID NO: 1631606 - RNA, 19 nt, Human
cagaguuguuacauuuuua

SEQ ID NO: 1631607 - RNA, 16 nt, Human
cagaguugaagacaga

SEQ ID NO: 1631608 - RNA, 15 nt, Human
cagaguugaagacag

SEQ ID NO: 1631609 - RNA, 14 nt, Human
cagaguugaagaca

SEQ ID NO: 1631610 - RNA, 20 nt, Human
cagaguugaagacagagcua

SEQ ID NO: 1631611 - RNA, 19 nt, Human
cagaguugaagacagagcu

SEQ ID NO: 1631612 - RNA, 18 nt, Human
cagaguugaagacagagc

SEQ ID NO: 1631613 - RNA, 17 nt, Human
cagaguugaagacagag

SEQ ID NO: 1631614 - RNA, 14 nt, Human
cagaguuguuacau

SEQ ID NO: 1631615 - RNA, 22 nt, Human
cagaguugaagacagagcuaca

SEQ ID NO: 1631616 - RNA, 14 nt, Human
cagauccuggaaau

SEQ ID NO: 1631617 - RNA, 20 nt, Human
cagaucucuaacuucaccau

SEQ ID NO: 1631618 - RNA, 22 nt, Human
cagauacaggaaaagcugcuga

SEQ ID NO: 1631619 - RNA, 21 nt, Human
cagauacaggaaaagcugcug

SEQ ID NO: 1631620 - RNA, 20 nt, Human
cagauacaggaaaagcugcu

SEQ ID NO: 1631621 - RNA, 14 nt, Human
cagaucugccuaag

SEQ ID NO: 1631622 - RNA, 17 nt, Human
cagaucugccuaaggac

SEQ ID NO: 1631623 - RNA, 16 nt, Human
cagaucugccuaagga

SEQ ID NO: 1631624 - RNA, 23 nt, Human
cagaucugccuaaggacuucuuu

SEQ ID NO: 1631625 - RNA, 21 nt, Human
cagaucugccuaaggacuucu

SEQ ID NO: 1631626 - RNA, 20 nt, Human
cagaucugccuaaggacuuc

SEQ ID NO: 1631627 - RNA, 19 nt, Human
cagaucugccuaaggacuu

SEQ ID NO: 1631628 - RNA, 16 nt, Human
cagaugcaccagcccu

SEQ ID NO: 1631629 - RNA, 14 nt, Human
cagaugcaccagcc

SEQ ID NO: 1631630 - RNA, 13 nt, Human
cagaugcaccagc

SEQ ID NO: 1631631 - RNA, 22 nt, Human
cagaugcaccagcccuuagcag

SEQ ID NO: 1631632 - RNA, 17 nt, Human
cagaugcaccagcccuu

SEQ ID NO: 1631633 - RNA, 20 nt, Human
cagagugagacucugucuca

SEQ ID NO: 1631634 - RNA, 19 nt, Human
cagagugagacucugucuc

SEQ ID NO: 1631635 - RNA, 18 nt, Human
cagagugagacucugucu

SEQ ID NO: 1631636 - RNA, 17 nt, Human
cagagugagacucuguc

SEQ ID NO: 1631637 - RNA, 16 nt, Human
cagagugagacucugu

SEQ ID NO: 1631638 - RNA, 23 nt, Human
cagagucucacuguugcccaggc

SEQ ID NO: 1631639 - RNA, 22 nt, Human
cagagucucacuguugcccagg

SEQ ID NO: 1631640 - RNA, 23 nt, Human
cagagggagugacagaggcagcc

SEQ ID NO: 1631641 - RNA, 22 nt, Human
cagagggagugacagaggcagc

SEQ ID NO: 1631642 - RNA, 21 nt, Human
cagagggagugacagaggcag

SEQ ID NO: 1631643 - RNA, 20 nt, Human
cagagggagugacagaggca

SEQ ID NO: 1631644 - RNA, 19 nt, Human
cagagggccugcaagggag

SEQ ID NO: 1631645 - RNA, 15 nt, Human
cagagggccugcaag

SEQ ID NO: 1631646 - RNA, 21 nt, Human
cagagucucacuguugcccag

SEQ ID NO: 1631647 - RNA, 20 nt, Human
cagagucucacuguugccca

SEQ ID NO: 1631648 - RNA, 19 nt, Human
cagagucucacuguugccc

SEQ ID NO: 1631649 - RNA, 17 nt, Human
cagagucucacuguugc

SEQ ID NO: 1631650 - RNA, 13 nt, Human
cagagucucacug

SEQ ID NO: 1631651 - RNA, 22 nt, Human
cagaggcagccccauucugccu

SEQ ID NO: 1631652 - RNA, 20 nt, Human
cagaggcagccccauucugc

SEQ ID NO: 1631653 - RNA, 19 nt, Human
cagaggcagccccauucug

SEQ ID NO: 1631654 - RNA, 18 nt, Human
cagaggcagccccauucu

SEQ ID NO: 1631655 - RNA, 15 nt, Human
cagaggcagccccau

SEQ ID NO: 1631656 - RNA, 14 nt, Human
cagaggcagcccca

SEQ ID NO: 1631657 - RNA, 13 nt, Human
cagaggcagcccc

SEQ ID NO: 1631658 - RNA, 12 nt, Human
cagaggcagccc

SEQ ID NO: 1631659 - RNA, 21 nt, Human
cagaggccaugggccuccugu

SEQ ID NO: 1631660 - RNA, 20 nt, Human
cagaggccaugggccuccug

SEQ ID NO: 1631661 - RNA, 19 nt, Human
cagaggccaugggccuccu

SEQ ID NO: 1631662 - RNA, 23 nt, Human
cagaggcagccccauucugccug

SEQ ID NO: 1631663 - RNA, 19 nt, Human
cagagggagugacagaggc

SEQ ID NO: 1631664 - RNA, 18 nt, Human
cagagggagugacagagg

SEQ ID NO: 1631665 - RNA, 16 nt, Human
cagagggagugacaga

SEQ ID NO: 1631666 - RNA, 14 nt, Human
cagagggagugaca

SEQ ID NO: 1631667 - RNA, 23 nt, Human
cagaggcugccucucccaucacu

SEQ ID NO: 1631668 - RNA, 13 nt, Human
cagaggcugccuc

SEQ ID NO: 1631669 - RNA, 23 nt, Human
cagaggcgcaugaauuugugaag

SEQ ID NO: 1631670 - RNA, 19 nt, Human
cagagacuccugcaggcag

SEQ ID NO: 1631671 - RNA, 18 nt, Human
cagagacuccugcaggca

SEQ ID NO: 1631672 - RNA, 17 nt, Human
cagagacuccugcaggc

SEQ ID NO: 1631673 - RNA, 16 nt, Human
cagagacuccugcagg

SEQ ID NO: 1631674 - RNA, 15 nt, Human
cagagacuccugcag

SEQ ID NO: 1631675 - RNA, 14 nt, Human
cagagacuccugca

SEQ ID NO: 1631676 - RNA, 13 nt, Human
cagagacuccugc

SEQ ID NO: 1631677 - RNA, 20 nt, Human
cagagaccaucccugaaggc

SEQ ID NO: 1631678 - RNA, 19 nt, Human
cagagaccaucccugaagg

SEQ ID NO: 1631679 - RNA, 18 nt, Human
cagagaccaucccugaag

SEQ ID NO: 1631680 - RNA, 17 nt, Human
cagagaccaucccugaa

SEQ ID NO: 1631681 - RNA, 21 nt, Human
cagagaccaucccugaaggcc

SEQ ID NO: 1631682 - RNA, 20 nt, Human
cagagcaagugagacccugu

SEQ ID NO: 1631683 - RNA, 14 nt, Human
cagagcaagugaga

SEQ ID NO: 1631684 - RNA, 16 nt, Human
cagagcaccuuagaca

SEQ ID NO: 1631685 - RNA, 18 nt, Human
cagagcacagcagccccu

SEQ ID NO: 1631686 - RNA, 18 nt, Human
cagagaguggcuccuccc

SEQ ID NO: 1631687 - RNA, 15 nt, Human
cagagaguggcuccu

SEQ ID NO: 1631688 - RNA, 14 nt, Human
cagagaguggcucc

SEQ ID NO: 1631689 - RNA, 13 nt, Human
cagagaguggcuc

SEQ ID NO: 1631690 - RNA, 16 nt, Human
cagagaccaucccuga

SEQ ID NO: 1631691 - RNA, 14 nt, Human
cagagaccaucccu

SEQ ID NO: 1631692 - RNA, 13 nt, Human
cagagaccauccc

SEQ ID NO: 1631693 - RNA, 15 nt, Human
cagagacacaagccu

SEQ ID NO: 1631694 - RNA, 14 nt, Human
cagagacacaagcc

SEQ ID NO: 1631695 - RNA, 17 nt, Human
cagagacacaagccuuc

SEQ ID NO: 1631696 - RNA, 16 nt, Human
cagagacacaagccuu

SEQ ID NO: 1631697 - RNA, 15 nt, Human
cagagaauucucuua

SEQ ID NO: 1631698 - RNA, 21 nt, Human
cagagaaugaaagggcccaga

SEQ ID NO: 1631699 - RNA, 20 nt, Human
cagagaaugaaagggcccag

SEQ ID NO: 1631700 - RNA, 19 nt, Human
cagagaaugaaagggccca

SEQ ID NO: 1631701 - RNA, 19 nt, Human
cagaggagagaggaccccc

SEQ ID NO: 1631702 - RNA, 15 nt, Human
cagaggagagaggac

SEQ ID NO: 1631703 - RNA, 13 nt, Human
cagaggagagagg

SEQ ID NO: 1631704 - RNA, 11 nt, Human
cagaggcagcc

SEQ ID NO: 1631705 - RNA, 20 nt, Human
cagaggagagaggacccccu

SEQ ID NO: 1631706 - RNA, 21 nt, Human
cagagcccacgcccccacugg

SEQ ID NO: 1631707 - RNA, 20 nt, Human
cagagcccacgcccccacug

SEQ ID NO: 1631708 - RNA, 19 nt, Human
cagagcccacgcccccacu

SEQ ID NO: 1631709 - RNA, 17 nt, Human
cagagcccacgccccca

SEQ ID NO: 1631710 - RNA, 23 nt, Human
cagagcccacgcccccacuggug

SEQ ID NO: 1631711 - RNA, 13 nt, Human
cagagccugcagu

SEQ ID NO: 1631712 - RNA, 13 nt, Human
cagaggaaggaga

SEQ ID NO: 1631713 - RNA, 12 nt, Human
cagagccugcag

SEQ ID NO: 1631714 - RNA, 21 nt, Human
cagagcagagaccaucccuga

SEQ ID NO: 1631715 - RNA, 19 nt, Human
cagagcagagaccaucccu

SEQ ID NO: 1631716 - RNA, 18 nt, Human
cagagcagagaccauccc

SEQ ID NO: 1631717 - RNA, 17 nt, Human
cagagcagagaccaucc

SEQ ID NO: 1631718 - RNA, 15 nt, Human
cagagcagagaccau

SEQ ID NO: 1631719 - RNA, 14 nt, Human
cagagcagagacca

SEQ ID NO: 1631720 - RNA, 13 nt, Human
cagagcagagacc

SEQ ID NO: 1631721 - RNA, 22 nt, Human
cagagcaccuuagacagucccu

SEQ ID NO: 1631722 - RNA, 21 nt, Human
cagagcaccuuagacaguccc

SEQ ID NO: 1631723 - RNA, 19 nt, Human
cagagcaccuuagacaguc

SEQ ID NO: 1631724 - RNA, 18 nt, Human
cagagcaccuuagacagu

SEQ ID NO: 1631725 - RNA, 12 nt, Human
cagagcagagac

SEQ ID NO: 1631726 - RNA, 11 nt, Human
cagagcagaga

SEQ ID NO: 1631727 - RNA, 23 nt, Human
cagagcaccuuagacagucccug

SEQ ID NO: 1631728 - RNA, 16 nt, Human
cagagcccacgccccc

SEQ ID NO: 1631729 - RNA, 20 nt, Human
cagagcccaccuuggcucaa

SEQ ID NO: 1631730 - RNA, 19 nt, Human
cagagcccaccuuggcuca

SEQ ID NO: 1631731 - RNA, 17 nt, Human
cagagcccaccuuggcu

SEQ ID NO: 1631732 - RNA, 15 nt, Human
cagagcccaccuugg

SEQ ID NO: 1631733 - RNA, 22 nt, Human
cagagccaccccuaaagagaua

SEQ ID NO: 1631734 - RNA, 16 nt, Human
cagaggccaugggccu

SEQ ID NO: 1631735 - RNA, 23 nt, Human
cagaaaauggaagacagcucuua

SEQ ID NO: 1631736 - RNA, 22 nt, Human
cagaaaauggaagacagcucuu

SEQ ID NO: 1631737 - RNA, 21 nt, Human
cagaaaauggaagacagcucu

SEQ ID NO: 1631738 - RNA, 20 nt, Human
cagaaaauggaagacagcuc

SEQ ID NO: 1631739 - RNA, 16 nt, Human
cagaaaauggaagaca

SEQ ID NO: 1631740 - RNA, 22 nt, Human
cagaaaaguugaauuuuacaug

SEQ ID NO: 1631741 - RNA, 20 nt, Human
cagaaaaguugaauuuuaca

SEQ ID NO: 1631742 - RNA, 17 nt, Human
cagaaaaguugaauuuu

SEQ ID NO: 1631743 - RNA, 21 nt, Human
cagaaaagaaaguucaugcuu

SEQ ID NO: 1631744 - RNA, 23 nt, Human
cagaacagugauuaccagggacu

SEQ ID NO: 1631745 - RNA, 19 nt, Human
cagaaagcagaacagugau

SEQ ID NO: 1631746 - RNA, 18 nt, Human
cagaaagcagaacaguga

SEQ ID NO: 1631747 - RNA, 24 nt, Human
cagaaagaaguggggacagagcag

SEQ ID NO: 1631748 - RNA, 22 nt, Human
cacuuuuguucuugguuuguaa

SEQ ID NO: 1631749 - RNA, 14 nt, Human
cacuuuuguucuug

SEQ ID NO: 1631750 - RNA, 18 nt, Human
cacuuuuauuuagcacca

SEQ ID NO: 1631751 - RNA, 23 nt, Human
cacuuuguucuggcucuuccagg

SEQ ID NO: 1631752 - RNA, 16 nt, Human
cacuuuguucuggcuc

SEQ ID NO: 1631753 - RNA, 14 nt, Human
cacuuuguucuggc

SEQ ID NO: 1631754 - RNA, 13 nt, Human
cacuuuguucugg

SEQ ID NO: 1631755 - RNA, 13 nt, Human
cacuuugggaggc

SEQ ID NO: 1631756 - RNA, 12 nt, Human
cacuuugggagg

SEQ ID NO: 1631757 - RNA, 16 nt, Human
cacuuugggaggccaa

SEQ ID NO: 1631758 - RNA, 22 nt, Human
cacuuucuagccagaggagaga

SEQ ID NO: 1631759 - RNA, 12 nt, Human
cacuuugcauaa

SEQ ID NO: 1631760 - RNA, 19 nt, Human
cagaaggaagacuucaucc

SEQ ID NO: 1631761 - RNA, 18 nt, Human
cagaaggaagacuucauc

SEQ ID NO: 1631762 - RNA, 17 nt, Human
cagaaggaagacuucau

SEQ ID NO: 1631763 - RNA, 16 nt, Human
cagaaggaagacuuca

SEQ ID NO: 1631764 - RNA, 18 nt, Human
cagaaucucaaauaacua

SEQ ID NO: 1631765 - RNA, 17 nt, Human
cagaaucucaaauaacu

SEQ ID NO: 1631766 - RNA, 20 nt, Human
cagaagcaacccaaauguuc

SEQ ID NO: 1631767 - RNA, 19 nt, Human
cagaagcaacccaaauguu

SEQ ID NO: 1631768 - RNA, 21 nt, Human
cagaagacacugaugggcaac

SEQ ID NO: 1631769 - RNA, 22 nt, Human
cagaacccuuggagccaaugga

SEQ ID NO: 1631770 - RNA, 19 nt, Human
cagacauagaauuaacaca

SEQ ID NO: 1631771 - RNA, 17 nt, Human
cagacauagaauuaaca

SEQ ID NO: 1631772 - RNA, 19 nt, Human
cagacauacuaaccagcag

SEQ ID NO: 1631773 - RNA, 22 nt, Human
cagacaccuugacagggcacac

SEQ ID NO: 1631774 - RNA, 20 nt, Human
cagacaccuugacagggcac

SEQ ID NO: 1631775 - RNA, 19 nt, Human
cagacaccuugacagggca

SEQ ID NO: 1631776 - RNA, 20 nt, Human
cagacaguuaagagaaauga

SEQ ID NO: 1631777 - RNA, 23 nt, Human
cagacacaggcccggcuccaggc

SEQ ID NO: 1631778 - RNA, 22 nt, Human
cagacacaggcccggcuccagg

SEQ ID NO: 1631779 - RNA, 21 nt, Human
cagacacaggcccggcuccag

SEQ ID NO: 1631780 - RNA, 18 nt, Human
cagacacaggcccggcuc

SEQ ID NO: 1631781 - RNA, 17 nt, Human
cagacacaggcccggcu

SEQ ID NO: 1631782 - RNA, 15 nt, Human
cagacacaggcccgg

SEQ ID NO: 1631783 - RNA, 14 nt, Human
cagacacaggcccg

SEQ ID NO: 1631784 - RNA, 13 nt, Human
cagacacaggccc

SEQ ID NO: 1631785 - RNA, 23 nt, Human
cagacacauguccaagaagccca

SEQ ID NO: 1631786 - RNA, 22 nt, Human
cagacacauguccaagaagccc

SEQ ID NO: 1631787 - RNA, 21 nt, Human
cagacacauguccaagaagcc

SEQ ID NO: 1631788 - RNA, 17 nt, Human
cagacacauguccaaga

SEQ ID NO: 1631789 - RNA, 14 nt, Human
cagacacaugucca

SEQ ID NO: 1631790 - RNA, 22 nt, Human
cagacaaagcgugguggacaug

SEQ ID NO: 1631791 - RNA, 20 nt, Human
cagacaacaaaccuguuucu

SEQ ID NO: 1631792 - RNA, 20 nt, Human
cagaauuucccaaagcagug

SEQ ID NO: 1631793 - RNA, 19 nt, Human
cagaauuucccaaagcagu

SEQ ID NO: 1631794 - RNA, 18 nt, Human
cagaauuucccaaagcag

SEQ ID NO: 1631795 - RNA, 17 nt, Human
cagaauuucccaaagca

SEQ ID NO: 1631796 - RNA, 12 nt, Human
cagacaaagcgu

SEQ ID NO: 1631797 - RNA, 24 nt, Human
cagaauuucccaaagcagugcaug

SEQ ID NO: 1631798 - RNA, 15 nt, Human
cagaauucucuaguu

SEQ ID NO: 1631799 - RNA, 18 nt, Human
cagaauucucuaguuuga

SEQ ID NO: 1631800 - RNA, 11 nt, Human
cagaauucuca

SEQ ID NO: 1631801 - RNA, 14 nt, Human
cagaauuucccaaa

SEQ ID NO: 1631802 - RNA, 15 nt, Human
cagaaucucgcucug

SEQ ID NO: 1631803 - RNA, 23 nt, Human
cagagaaaguacuucuccacccu

SEQ ID NO: 1631804 - RNA, 19 nt, Human
cagagaaaguacuucucca

SEQ ID NO: 1631805 - RNA, 20 nt, Human
cagacuuuuuuuaaauagua

SEQ ID NO: 1631806 - RNA, 21 nt, Human
cagacccugcccugugggccc

SEQ ID NO: 1631807 - RNA, 17 nt, Human
cagacccugcccugugg

SEQ ID NO: 1631808 - RNA, 16 nt, Human
cagacccugcccugug

SEQ ID NO: 1631809 - RNA, 15 nt, Human
cagacccugcccugu

SEQ ID NO: 1631810 - RNA, 22 nt, Human
cagacccugcccugugggcccc

SEQ ID NO: 1631811 - RNA, 14 nt, Human
cagacccggcugcg

SEQ ID NO: 1631812 - RNA, 12 nt, Human
cagacccggcug

SEQ ID NO: 1631813 - RNA, 23 nt, Human
cagaccccuggcuuuucacugcu

SEQ ID NO: 1631814 - RNA, 22 nt, Human
cagaccccuggcuuuucacugc

SEQ ID NO: 1631815 - RNA, 21 nt, Human
cagaccccuggcuuuucacug

SEQ ID NO: 1631816 - RNA, 12 nt, Human
cagacccugccc

SEQ ID NO: 1631817 - RNA, 16 nt, Human
cagacccggcugcgug

SEQ ID NO: 1631818 - RNA, 14 nt, Human
cagacccugcccug

SEQ ID NO: 1631819 - RNA, 13 nt, Human
cagacccugcccu

SEQ ID NO: 1631820 - RNA, 20 nt, Human
cagaccacaaaacuuuucua

SEQ ID NO: 1631821 - RNA, 14 nt, Human
cagaccacaaaacu

SEQ ID NO: 1631822 - RNA, 18 nt, Human
cagaccccuggcuuuuca

SEQ ID NO: 1631823 - RNA, 16 nt, Human
cagaccccuggcuuuu

SEQ ID NO: 1631824 - RNA, 15 nt, Human
cagaccccuggcuuu

SEQ ID NO: 1631825 - RNA, 14 nt, Human
cagaccccuggcuu

SEQ ID NO: 1631826 - RNA, 13 nt, Human
cagaccccuggcu

SEQ ID NO: 1631827 - RNA, 16 nt, Human
cagacaacaaaccugu

SEQ ID NO: 1631828 - RNA, 18 nt, Human
cagaugggugcuuggagg

SEQ ID NO: 1631829 - RNA, 15 nt, Human
cagaugcugugcaaa

SEQ ID NO: 1631830 - RNA, 23 nt, Human
cagaugggugcuuggaggaagga

SEQ ID NO: 1631831 - RNA, 23 nt, Human
cagauuauucacugauuugacau

SEQ ID NO: 1631832 - RNA, 18 nt, Human
cagauuauucacugauuu

SEQ ID NO: 1631833 - RNA, 12 nt, Human
cagauuauucac

SEQ ID NO: 1631834 - RNA, 15 nt, Human
cagauuuuccugaaa

SEQ ID NO: 1631835 - RNA, 14 nt, Human
cagauuuuccugaa

SEQ ID NO: 1631836 - RNA, 19 nt, Human
cagauuuuuuacagcugcc

SEQ ID NO: 1631837 - RNA, 22 nt, Human
cagauuuuuuacagcugccugc

SEQ ID NO: 1631838 - RNA, 17 nt, Human
cagcaaaaauauuuuau

SEQ ID NO: 1631839 - RNA, 14 nt, Human
cagauucuuuccug

SEQ ID NO: 1631840 - RNA, 22 nt, Human
cagauuuuauuauguaaauccc

SEQ ID NO: 1631841 - RNA, 21 nt, Human
cagauuuuauuauguaaaucc

SEQ ID NO: 1631842 - RNA, 20 nt, Human
cagauuuuauuauguaaauc

SEQ ID NO: 1631843 - RNA, 18 nt, Human
cagauuuuauuauguaaa

SEQ ID NO: 1631844 - RNA, 16 nt, Human
cagauuuuauuaugua

SEQ ID NO: 1631845 - RNA, 15 nt, Human
cagauuuuauuaugu

SEQ ID NO: 1631846 - RNA, 13 nt, Human
cagauuuuauuau

SEQ ID NO: 1631847 - RNA, 23 nt, Human
cagcaacgcaggcccccaggugc

SEQ ID NO: 1631848 - RNA, 18 nt, Human
cagcaaaagaugcuucuc

SEQ ID NO: 1631849 - RNA, 19 nt, Human
cagcaagggugaugggaaa

SEQ ID NO: 1631850 - RNA, 17 nt, Human
cagcaaggagauuuaca

SEQ ID NO: 1631851 - RNA, 18 nt, Human
cagcaaggagauuuacaa

SEQ ID NO: 1631852 - RNA, 23 nt, Human
cagcaagggugaugggaaagcau

SEQ ID NO: 1631853 - RNA, 22 nt, Human
cagcaagggugaugggaaagca

SEQ ID NO: 1631854 - RNA, 12 nt, Human
cagcaagugaga

SEQ ID NO: 1631855 - RNA, 17 nt, Human
cagcaagugagagcugg

SEQ ID NO: 1631856 - RNA, 16 nt, Human
cagcaagugagagcug

SEQ ID NO: 1631857 - RNA, 15 nt, Human
cagcaagugagagcu

SEQ ID NO: 1631858 - RNA, 14 nt, Human
cagcaagugagagc

SEQ ID NO: 1631859 - RNA, 21 nt, Human
cagcaagugagagcugggugu

SEQ ID NO: 1631860 - RNA, 19 nt, Human
cagcaagugagagcugggu

SEQ ID NO: 1631861 - RNA, 13 nt, Human
cagcaauaaagca

SEQ ID NO: 1631862 - RNA, 21 nt, Human
cagcaauaaagcagcguuucu

SEQ ID NO: 1631863 - RNA, 22 nt, Human
cagcaauaaagcagcguuucua

SEQ ID NO: 1631864 - RNA, 20 nt, Human
cagcaauucuccugccucag

SEQ ID NO: 1631865 - RNA, 19 nt, Human
cagcaauucuccugccuca

SEQ ID NO: 1631866 - RNA, 18 nt, Human
cagcaauucuccugccuc

SEQ ID NO: 1631867 - RNA, 17 nt, Human
cagcaauucuccugccu

SEQ ID NO: 1631868 - RNA, 16 nt, Human
cagcaauucuccugcc

SEQ ID NO: 1631869 - RNA, 15 nt, Human
cagcaauucuccugc

SEQ ID NO: 1631870 - RNA, 19 nt, Human
cagcagaaaugccuuaccc

SEQ ID NO: 1631871 - RNA, 22 nt, Human
cagcagaaaugccuuacccuca

SEQ ID NO: 1631872 - RNA, 13 nt, Human
cagcagagcaccu

SEQ ID NO: 1631873 - RNA, 11 nt, Human
cagcagagcac

SEQ ID NO: 1631874 - RNA, 15 nt, Human
cagcagaaaugccuu

SEQ ID NO: 1631875 - RNA, 17 nt, Human
cagcagaaaugccuuac

SEQ ID NO: 1631876 - RNA, 19 nt, Human
cagcagauuauucacugau

SEQ ID NO: 1631877 - RNA, 15 nt, Human
cagcagauuauucac

SEQ ID NO: 1631878 - RNA, 14 nt, Human
cagcagauuauuca

SEQ ID NO: 1631879 - RNA, 23 nt, Human
cagcagccccugcacaaagcccu

SEQ ID NO: 1631880 - RNA, 16 nt, Human
cagcagccccugcaca

SEQ ID NO: 1631881 - RNA, 13 nt, Human
cagcagccccugc

SEQ ID NO: 1631882 - RNA, 14 nt, Human
cagcauucucacuc

SEQ ID NO: 1631883 - RNA, 15 nt, Human
cagcauucucacucc

SEQ ID NO: 1631884 - RNA, 20 nt, Human
cagcauccuggcacccggcc

SEQ ID NO: 1631885 - RNA, 19 nt, Human
cagcauccuggcacccggc

SEQ ID NO: 1631886 - RNA, 21 nt, Human
cagcauccuggcacccggccc

SEQ ID NO: 1631887 - RNA, 16 nt, Human
cagccaaagccuccuc

SEQ ID NO: 1631888 - RNA, 15 nt, Human
cagccaaagccuccu

SEQ ID NO: 1631889 - RNA, 21 nt, Human
cagccaaagccuccuccagcc

SEQ ID NO: 1631890 - RNA, 18 nt, Human
cagccaaagccuccucca

SEQ ID NO: 1631891 - RNA, 18 nt, Human
cagccaacuauggccugu

SEQ ID NO: 1631892 - RNA, 15 nt, Human
cagcaggcucucagg

SEQ ID NO: 1631893 - RNA, 14 nt, Human
cagcaggcucucag

SEQ ID NO: 1631894 - RNA, 12 nt, Human
cagcaggcucuc

SEQ ID NO: 1631895 - RNA, 18 nt, Human
cagcagccuggacccugu

SEQ ID NO: 1631896 - RNA, 15 nt, Human
cagcagccuggaccc

SEQ ID NO: 1631897 - RNA, 14 nt, Human
cagcagccuggacc

SEQ ID NO: 1631898 - RNA, 12 nt, Human
cagcagccugga

SEQ ID NO: 1631899 - RNA, 22 nt, Human
cagcagccuggacccuguggau

SEQ ID NO: 1631900 - RNA, 19 nt, Human
cagcagccuggacccugug

SEQ ID NO: 1631901 - RNA, 18 nt, Human
cagcagggagggcuucug

SEQ ID NO: 1631902 - RNA, 22 nt, Human
cagcaggcucucaggccagcug

SEQ ID NO: 1631903 - RNA, 20 nt, Human
cagcaggcucucaggccagc

SEQ ID NO: 1631904 - RNA, 19 nt, Human
cagcaggcucucaggccag

SEQ ID NO: 1631905 - RNA, 18 nt, Human
cagcaggcucucaggcca

SEQ ID NO: 1631906 - RNA, 17 nt, Human
cagcaggcucucaggcc

SEQ ID NO: 1631907 - RNA, 16 nt, Human
cagcaggcucucaggc

SEQ ID NO: 1631908 - RNA, 17 nt, Human
cagcauccuggcacccg

SEQ ID NO: 1631909 - RNA, 16 nt, Human
cagcauccuggcaccc

SEQ ID NO: 1631910 - RNA, 15 nt, Human
cagcauccuggcacc

SEQ ID NO: 1631911 - RNA, 14 nt, Human
cagcauccuggcac

SEQ ID NO: 1631912 - RNA, 20 nt, Human
cagcagggagggcuucugcc

SEQ ID NO: 1631913 - RNA, 17 nt, Human
cagccacauuccugaug

SEQ ID NO: 1631914 - RNA, 15 nt, Human
cagccacauuccuga

SEQ ID NO: 1631915 - RNA, 19 nt, Human
cagccacauuccugaugcu

SEQ ID NO: 1631916 - RNA, 14 nt, Human
cagccacauuccug

SEQ ID NO: 1631917 - RNA, 22 nt, Human
cagccacggccaggccagaggg

SEQ ID NO: 1631918 - RNA, 21 nt, Human
cagccacggccaggccagagg

SEQ ID NO: 1631919 - RNA, 19 nt, Human
cagccacggccaggccaga

SEQ ID NO: 1631920 - RNA, 18 nt, Human
cagccacggccaggccag

SEQ ID NO: 1631921 - RNA, 17 nt, Human
cagccacggccaggcca

SEQ ID NO: 1631922 - RNA, 16 nt, Human
cagccacggccaggcc

SEQ ID NO: 1631923 - RNA, 15 nt, Human
cagccacggccaggc

SEQ ID NO: 1631924 - RNA, 14 nt, Human
cagccacggccagg

SEQ ID NO: 1631925 - RNA, 22 nt, Human
cagccaguaaaugggggugcau

SEQ ID NO: 1631926 - RNA, 23 nt, Human
cagccacggccaggccagaggga

SEQ ID NO: 1631927 - RNA, 18 nt, Human
cagcccacuucugccaua

SEQ ID NO: 1631928 - RNA, 21 nt, Human
cagccccaaaacucuccucug

SEQ ID NO: 1631929 - RNA, 20 nt, Human
cagccccaaaacucuccucu

SEQ ID NO: 1631930 - RNA, 22 nt, Human
cagccccaaaacucuccucugc

SEQ ID NO: 1631931 - RNA, 15 nt, Human
cagcccacuucugcc

SEQ ID NO: 1631932 - RNA, 15 nt, Human
cagcccaccccucaa

SEQ ID NO: 1631933 - RNA, 19 nt, Human
cagcccacauagugauggu

SEQ ID NO: 1631934 - RNA, 14 nt, Human
cagcucaccagccc

SEQ ID NO: 1631935 - RNA, 18 nt, Human
cagccuccaugcugccuc

SEQ ID NO: 1631936 - RNA, 15 nt, Human
caggaaguagaggag

SEQ ID NO: 1631937 - RNA, 20 nt, Human
caggaaguacuggagaaaau

SEQ ID NO: 1631938 - RNA, 18 nt, Human
caggaaguacuggagaaa

SEQ ID NO: 1631939 - RNA, 17 nt, Human
caggaaguacuggagaa

SEQ ID NO: 1631940 - RNA, 16 nt, Human
caggaaguagaggagg

SEQ ID NO: 1631941 - RNA, 15 nt, Human
caggaaggcuaaagg

SEQ ID NO: 1631942 - RNA, 19 nt, Human
caggaaggcugagaggaga

SEQ ID NO: 1631943 - RNA, 16 nt, Human
caggaaguacuggaga

SEQ ID NO: 1631944 - RNA, 14 nt, Human
caggaaguacugga

SEQ ID NO: 1631945 - RNA, 12 nt, Human
caggaaguacug

SEQ ID NO: 1631946 - RNA, 23 nt, Human
caggaauggagccugcacgguga

SEQ ID NO: 1631947 - RNA, 17 nt, Human
caggaauggagccugca

SEQ ID NO: 1631948 - RNA, 19 nt, Human
caggaagcucagggccugg

SEQ ID NO: 1631949 - RNA, 18 nt, Human
caggaagcucagggccug

SEQ ID NO: 1631950 - RNA, 17 nt, Human
caggaagcucagggccu

SEQ ID NO: 1631951 - RNA, 16 nt, Human
caggaagcucagggcc

SEQ ID NO: 1631952 - RNA, 15 nt, Human
caggaagcucagggc

SEQ ID NO: 1631953 - RNA, 14 nt, Human
caggaagcucaggg

SEQ ID NO: 1631954 - RNA, 13 nt, Human
caggaagcucagg

SEQ ID NO: 1631955 - RNA, 21 nt, Human
caggaagcucagggccuggcu

SEQ ID NO: 1631956 - RNA, 20 nt, Human
caggaagcucagggccuggc

SEQ ID NO: 1631957 - RNA, 23 nt, Human
caggaagcucagggccuggcuca

SEQ ID NO: 1631958 - RNA, 18 nt, Human
caggaagccagcaggcuc

SEQ ID NO: 1631959 - RNA, 17 nt, Human
caggaagccagcaggcu

SEQ ID NO: 1631960 - RNA, 16 nt, Human
caggaagccagcaggc

SEQ ID NO: 1631961 - RNA, 14 nt, Human
caggaagccagcag

SEQ ID NO: 1631962 - RNA, 21 nt, Human
caggaagccagcaggcucuca

SEQ ID NO: 1631963 - RNA, 19 nt, Human
caggaagccagcaggcucu

SEQ ID NO: 1631964 - RNA, 22 nt, Human
caggaagccagcaggcucucag

SEQ ID NO: 1631965 - RNA, 14 nt, Human
caggaagcagcuuu

SEQ ID NO: 1631966 - RNA, 23 nt, Human
cagcuuuccucaaaacuucagac

SEQ ID NO: 1631967 - RNA, 23 nt, Human
cagcuuuccccaugucucgacuc

SEQ ID NO: 1631968 - RNA, 22 nt, Human
cagcuuuaaaaaauuaaucugg

SEQ ID NO: 1631969 - RNA, 20 nt, Human
cagcuuguaaauagcucagg

SEQ ID NO: 1631970 - RNA, 19 nt, Human
cagcuuguaaauagcucag

SEQ ID NO: 1631971 - RNA, 18 nt, Human
cagcuuguaaauagcuca

SEQ ID NO: 1631972 - RNA, 22 nt, Human
cagcuuguaaauagcucaggug

SEQ ID NO: 1631973 - RNA, 21 nt, Human
cagcuuguaaauagcucaggu

SEQ ID NO: 1631974 - RNA, 18 nt, Human
caggaaccacaagacugc

SEQ ID NO: 1631975 - RNA, 23 nt, Human
cagcuuuguuuguugucagcuga

SEQ ID NO: 1631976 - RNA, 22 nt, Human
cagcuuuguuuguugucagcug

SEQ ID NO: 1631977 - RNA, 21 nt, Human
cagcuuuguuuguugucagcu

SEQ ID NO: 1631978 - RNA, 12 nt, Human
cagcuuuguuug

SEQ ID NO: 1631979 - RNA, 14 nt, Human
cagcuuugauauuu

SEQ ID NO: 1631980 - RNA, 18 nt, Human
cagcuugaaacugagaug

SEQ ID NO: 1631981 - RNA, 19 nt, Human
cagcuguaugauucccagc

SEQ ID NO: 1631982 - RNA, 21 nt, Human
cagcuucauuuccugugucuu

SEQ ID NO: 1631983 - RNA, 20 nt, Human
cagcuucauuuccugugucu

SEQ ID NO: 1631984 - RNA, 21 nt, Human
cagcuugaccgugaggccaga

SEQ ID NO: 1631985 - RNA, 20 nt, Human
cagcuugaccgugaggccag

SEQ ID NO: 1631986 - RNA, 19 nt, Human
cagcuugaccgugaggcca

SEQ ID NO: 1631987 - RNA, 18 nt, Human
cagcuugaccgugaggcc

SEQ ID NO: 1631988 - RNA, 15 nt, Human
cagcuugaggguugg

SEQ ID NO: 1631989 - RNA, 14 nt, Human
cagcuugaggguug

SEQ ID NO: 1631990 - RNA, 21 nt, Human
cagcuugaggguugggcuggu

SEQ ID NO: 1631991 - RNA, 20 nt, Human
cagcuugaggguugggcugg

SEQ ID NO: 1631992 - RNA, 19 nt, Human
cagcuugaggguugggcug

SEQ ID NO: 1631993 - RNA, 18 nt, Human
cagcuugaggguugggcu

SEQ ID NO: 1631994 - RNA, 21 nt, Human
cagcugcugaaacaacaaaua

SEQ ID NO: 1631995 - RNA, 20 nt, Human
cagcugcugaaacaacaaau

SEQ ID NO: 1631996 - RNA, 17 nt, Human
cagcugcuacuacuccu

SEQ ID NO: 1631997 - RNA, 21 nt, Human
cagcugcucaauaaaguacaa

SEQ ID NO: 1631998 - RNA, 22 nt, Human
cagcugcuugggcuucauccuc

SEQ ID NO: 1631999 - RNA, 21 nt, Human
cagcugcuugggcuucauccu

SEQ ID NO: 1632000 - RNA, 19 nt, Human
cagcugcuugggcuucauc

SEQ ID NO: 1632001 - RNA, 18 nt, Human
cagcugcuugggcuucau

SEQ ID NO: 1632002 - RNA, 16 nt, Human
cagcugcuugggcuuc

SEQ ID NO: 1632003 - RNA, 15 nt, Human
cagcugcuugggcuu

SEQ ID NO: 1632004 - RNA, 14 nt, Human
cagcugcuugggcu

SEQ ID NO: 1632005 - RNA, 13 nt, Human
cagcugcuugggc

SEQ ID NO: 1632006 - RNA, 24 nt, Human
cagcugcgguccacccaggagccc

SEQ ID NO: 1632007 - RNA, 23 nt, Human
cagcugcgguccacccaggagcc

SEQ ID NO: 1632008 - RNA, 22 nt, Human
cagcugcgguccacccaggagc

SEQ ID NO: 1632009 - RNA, 21 nt, Human
cagcugcgguccacccaggag

SEQ ID NO: 1632010 - RNA, 20 nt, Human
cagcugcgguccacccagga

SEQ ID NO: 1632011 - RNA, 19 nt, Human
cagcugcgguccacccagg

SEQ ID NO: 1632012 - RNA, 18 nt, Human
cagcugcgguccacccag

SEQ ID NO: 1632013 - RNA, 23 nt, Human
cagcugccugggaucccucaucc

SEQ ID NO: 1632014 - RNA, 18 nt, Human
cagcugccugggaucccu

SEQ ID NO: 1632015 - RNA, 18 nt, Human
cagcuguaugauucccag

SEQ ID NO: 1632016 - RNA, 18 nt, Human
cagcugguugagguuuca

SEQ ID NO: 1632017 - RNA, 16 nt, Human
cagcuggguuggaaaa

SEQ ID NO: 1632018 - RNA, 17 nt, Human
cagcuggguuggaaaac

SEQ ID NO: 1632019 - RNA, 18 nt, Human
cagcuggugcccugcuuu

SEQ ID NO: 1632020 - RNA, 23 nt, Human
cagcuggugcccugcuuucagau

SEQ ID NO: 1632021 - RNA, 21 nt, Human
cagcuggugcccugcuuucag

SEQ ID NO: 1632022 - RNA, 20 nt, Human
cagcuggugcccugcuuuca

SEQ ID NO: 1632023 - RNA, 19 nt, Human
cagcuggugcccugcuuuc

SEQ ID NO: 1632024 - RNA, 23 nt, Human
cagcugggguggggaccucaggc

SEQ ID NO: 1632025 - RNA, 22 nt, Human
cagcugggguggggaccucagg

SEQ ID NO: 1632026 - RNA, 21 nt, Human
cagcugggguggggaccucag

SEQ ID NO: 1632027 - RNA, 22 nt, Human
cagcuggggccaggcugggucg

SEQ ID NO: 1632028 - RNA, 21 nt, Human
cagcuggggccaggcuggguc

SEQ ID NO: 1632029 - RNA, 22 nt, Human
cagcugcuuuugucuaugggac

SEQ ID NO: 1632030 - RNA, 23 nt, Human
cagcugcuuuugucuaugggacu

SEQ ID NO: 1632031 - RNA, 19 nt, Human
cagcuggccgggagccuga

SEQ ID NO: 1632032 - RNA, 20 nt, Human
cagcuggggccaggcugggu

SEQ ID NO: 1632033 - RNA, 19 nt, Human
cagcuggggccaggcuggg

SEQ ID NO: 1632034 - RNA, 18 nt, Human
cagcuggggccaggcugg

SEQ ID NO: 1632035 - RNA, 23 nt, Human
cagcugggaucacauguggacuu

SEQ ID NO: 1632036 - RNA, 20 nt, Human
cagcucugcauacucauuag

SEQ ID NO: 1632037 - RNA, 21 nt, Human
cagcucugcaagaauugaagc

SEQ ID NO: 1632038 - RNA, 16 nt, Human
cagcucugcaagaauu

SEQ ID NO: 1632039 - RNA, 15 nt, Human
cagcucugcaagaau

SEQ ID NO: 1632040 - RNA, 23 nt, Human
cagcuccuucuguccuacucugu

SEQ ID NO: 1632041 - RNA, 21 nt, Human
cagcuccuucuguccuacucu

SEQ ID NO: 1632042 - RNA, 17 nt, Human
cagcuccuucuguccua

SEQ ID NO: 1632043 - RNA, 16 nt, Human
cagcuccuucuguccu

SEQ ID NO: 1632044 - RNA, 20 nt, Human
cagcucagagagggugggag

SEQ ID NO: 1632045 - RNA, 19 nt, Human
cagcucagagaggguggga

SEQ ID NO: 1632046 - RNA, 17 nt, Human
cagcucagagagggugg

SEQ ID NO: 1632047 - RNA, 13 nt, Human
cagcucagagagg

SEQ ID NO: 1632048 - RNA, 23 nt, Human
cagcucuucuccaggcuguaucc

SEQ ID NO: 1632049 - RNA, 19 nt, Human
cagcucuucuccaggcugu

SEQ ID NO: 1632050 - RNA, 18 nt, Human
cagcucuucuccaggcug

SEQ ID NO: 1632051 - RNA, 17 nt, Human
cagcucuucuccaggcu

SEQ ID NO: 1632052 - RNA, 16 nt, Human
cagcucuucuccaggc

SEQ ID NO: 1632053 - RNA, 15 nt, Human
cagcucuucuccagg

SEQ ID NO: 1632054 - RNA, 14 nt, Human
cagcucuucuccag

SEQ ID NO: 1632055 - RNA, 13 nt, Human
cagcucuucucca

SEQ ID NO: 1632056 - RNA, 21 nt, Human
cagcucuuauauugccauuuc

SEQ ID NO: 1632057 - RNA, 10 nt, Human
cagcucuuau

SEQ ID NO: 1632058 - RNA, 23 nt, Human
cagcucuguccugggagugagcu

SEQ ID NO: 1632059 - RNA, 18 nt, Human
cagcucuguccugggagu

SEQ ID NO: 1632060 - RNA, 17 nt, Human
cagcucuguccugggag

SEQ ID NO: 1632061 - RNA, 16 nt, Human
cagcucuguccuggga

SEQ ID NO: 1632062 - RNA, 14 nt, Human
cagcucuguccugg

SEQ ID NO: 1632063 - RNA, 13 nt, Human
cagcucuguccug

SEQ ID NO: 1632064 - RNA, 12 nt, Human
cagcucuguccu

SEQ ID NO: 1632065 - RNA, 23 nt, Human
cagcucugguccauagagagcaa

SEQ ID NO: 1632066 - RNA, 22 nt, Human
cagcucugguccauagagagca

SEQ ID NO: 1632067 - RNA, 21 nt, Human
cagcucugguccauagagagc

SEQ ID NO: 1632068 - RNA, 18 nt, Human
cagcucugguccauagag

SEQ ID NO: 1632069 - RNA, 17 nt, Human
cagcucugguccauaga

SEQ ID NO: 1632070 - RNA, 16 nt, Human
cagcucugguccauag

SEQ ID NO: 1632071 - RNA, 13 nt, Human
cagcucuggucca

SEQ ID NO: 1632072 - RNA, 10 nt, Human
cagcucuggu

SEQ ID NO: 1632073 - RNA, 22 nt, Human
caggaagcucagggccuggcuc

SEQ ID NO: 1632074 - RNA, 16 nt, Human
cagccuaguugaucag

SEQ ID NO: 1632075 - RNA, 18 nt, Human
cagccucaaccuccuggg

SEQ ID NO: 1632076 - RNA, 17 nt, Human
cagccucaaccuccugg

SEQ ID NO: 1632077 - RNA, 21 nt, Human
cagccucaaccuccugggcua

SEQ ID NO: 1632078 - RNA, 20 nt, Human
cagccucaaccuccugggcu

SEQ ID NO: 1632079 - RNA, 19 nt, Human
cagccucaaccuccugggc

SEQ ID NO: 1632080 - RNA, 20 nt, Human
cagccucacaguccuuacca

SEQ ID NO: 1632081 - RNA, 15 nt, Human
cagccucacaguccu

SEQ ID NO: 1632082 - RNA, 14 nt, Human
cagccucacagucc

SEQ ID NO: 1632083 - RNA, 20 nt, Human
cagccuccaagcuccaucuc

SEQ ID NO: 1632084 - RNA, 14 nt, Human
cagccuccaagcuc

SEQ ID NO: 1632085 - RNA, 22 nt, Human
cagccucccgaauagcugggac

SEQ ID NO: 1632086 - RNA, 21 nt, Human
cagccucccgaauagcuggga

SEQ ID NO: 1632087 - RNA, 20 nt, Human
cagccucccgaauagcuggg

SEQ ID NO: 1632088 - RNA, 23 nt, Human
cagccucccaaagugcugggauu

SEQ ID NO: 1632089 - RNA, 21 nt, Human
cagccucccaaagugcuggga

SEQ ID NO: 1632090 - RNA, 20 nt, Human
cagccucccaaagugcuggg

SEQ ID NO: 1632091 - RNA, 19 nt, Human
cagccucccaaagugcugg

SEQ ID NO: 1632092 - RNA, 14 nt, Human
cagccuccaugcug

SEQ ID NO: 1632093 - RNA, 20 nt, Human
cagccuccaugcugccucca

SEQ ID NO: 1632094 - RNA, 17 nt, Human
cagccuccaugcugccu

SEQ ID NO: 1632095 - RNA, 15 nt, Human
cagccuccaugcugc

SEQ ID NO: 1632096 - RNA, 21 nt, Human
cagccguguaaccauggaccc

SEQ ID NO: 1632097 - RNA, 20 nt, Human
cagccgugccuucagcucua

SEQ ID NO: 1632098 - RNA, 18 nt, Human
cagccgugccuucagcuc

SEQ ID NO: 1632099 - RNA, 16 nt, Human
cagccgugccuucagc

SEQ ID NO: 1632100 - RNA, 14 nt, Human
cagccgugccuuca

SEQ ID NO: 1632101 - RNA, 9 nt, Human
cagccgugc

SEQ ID NO: 1632102 - RNA, 23 nt, Human
cagcccugcuuugggcugcccug

SEQ ID NO: 1632103 - RNA, 22 nt, Human
cagcccugcuuugggcugcccu

SEQ ID NO: 1632104 - RNA, 21 nt, Human
cagcccugcuuugggcugccc

SEQ ID NO: 1632105 - RNA, 20 nt, Human
cagcccugcuuugggcugcc

SEQ ID NO: 1632106 - RNA, 19 nt, Human
cagcccugcuuugggcugc

SEQ ID NO: 1632107 - RNA, 13 nt, Human
cagcccugcuuug

SEQ ID NO: 1632108 - RNA, 11 nt, Human
cagcccugcuu

SEQ ID NO: 1632109 - RNA, 16 nt, Human
cagcccugcagagggc

SEQ ID NO: 1632110 - RNA, 15 nt, Human
cagcccugcagaggg

SEQ ID NO: 1632111 - RNA, 14 nt, Human
cagcccugcagagg

SEQ ID NO: 1632112 - RNA, 13 nt, Human
cagcccugcagag

SEQ ID NO: 1632113 - RNA, 20 nt, Human
cagcccugcagagggcacag

SEQ ID NO: 1632114 - RNA, 18 nt, Human
cagcccugcagagggcac

SEQ ID NO: 1632115 - RNA, 22 nt, Human
cagcccucccugccccucccuu

SEQ ID NO: 1632116 - RNA, 18 nt, Human
cagcccucccugccccuc

SEQ ID NO: 1632117 - RNA, 17 nt, Human
cagcccucccugccccu

SEQ ID NO: 1632118 - RNA, 16 nt, Human
cagcccucccugcccc

SEQ ID NO: 1632119 - RNA, 14 nt, Human
cagccccauucugc

SEQ ID NO: 1632120 - RNA, 13 nt, Human
cagccccauucug

SEQ ID NO: 1632121 - RNA, 22 nt, Human
cagccccauccucuguacagag

SEQ ID NO: 1632122 - RNA, 16 nt, Human
cagccccauccucugu

SEQ ID NO: 1632123 - RNA, 14 nt, Human
cagccccauccucu

SEQ ID NO: 1632124 - RNA, 13 nt, Human
cagccccauccuc

SEQ ID NO: 1632125 - RNA, 12 nt, Human
cagccccauccu

SEQ ID NO: 1632126 - RNA, 22 nt, Human
cagccccaucccaaacccuuca

SEQ ID NO: 1632127 - RNA, 23 nt, Human
cagccccuggaugcagccucaca

SEQ ID NO: 1632128 - RNA, 18 nt, Human
cagccccauucugccugc

SEQ ID NO: 1632129 - RNA, 17 nt, Human
cagccccauucugccug

SEQ ID NO: 1632130 - RNA, 16 nt, Human
cagccccauucugccu

SEQ ID NO: 1632131 - RNA, 21 nt, Human
cagccccuguucuggcagagu

SEQ ID NO: 1632132 - RNA, 20 nt, Human
cagccccuguucuggcagag

SEQ ID NO: 1632133 - RNA, 21 nt, Human
cagccccaucccaaacccuuc

SEQ ID NO: 1632134 - RNA, 11 nt, Human
cagccccaucc

SEQ ID NO: 1632135 - RNA, 18 nt, Human
cagccccagugcccacag

SEQ ID NO: 1632136 - RNA, 17 nt, Human
cagccccagugcccaca

SEQ ID NO: 1632137 - RNA, 16 nt, Human
cagccccagugcccac

SEQ ID NO: 1632138 - RNA, 15 nt, Human
cagccccagugccca

SEQ ID NO: 1632139 - RNA, 14 nt, Human
cagccccagugccc

SEQ ID NO: 1632140 - RNA, 13 nt, Human
cagccccagugcc

SEQ ID NO: 1632141 - RNA, 16 nt, Human
cagcccgggcucugcc

SEQ ID NO: 1632142 - RNA, 15 nt, Human
cagcccgggcucugc

SEQ ID NO: 1632143 - RNA, 14 nt, Human
cagcccgggcucug

SEQ ID NO: 1632144 - RNA, 13 nt, Human
cagcccgggcucu

SEQ ID NO: 1632145 - RNA, 21 nt, Human
cagccccuucugacccaugcu

SEQ ID NO: 1632146 - RNA, 19 nt, Human
cagccccuucugacccaug

SEQ ID NO: 1632147 - RNA, 17 nt, Human
cagccccuucugaccca

SEQ ID NO: 1632148 - RNA, 16 nt, Human
cagccccuucugaccc

SEQ ID NO: 1632149 - RNA, 23 nt, Human
cagccccuucugacccaugcugc

SEQ ID NO: 1632150 - RNA, 22 nt, Human
cagccccuucugacccaugcug

SEQ ID NO: 1632151 - RNA, 24 nt, Human
cagccccuucugacccaugcugcc

SEQ ID NO: 1632152 - RNA, 22 nt, Human
cagcccuccaucuaaacugccc

SEQ ID NO: 1632153 - RNA, 23 nt, Human
cagcccuccaucuaaacugcccc

SEQ ID NO: 1632154 - RNA, 15 nt, Human
cagcccucccugccc

SEQ ID NO: 1632155 - RNA, 13 nt, Human
cagcccucccugc

SEQ ID NO: 1632156 - RNA, 20 nt, Human
cagcccgggcucugccuccc

SEQ ID NO: 1632157 - RNA, 19 nt, Human
cagcccgggcucugccucc

SEQ ID NO: 1632158 - RNA, 18 nt, Human
cagcccgggcucugccuc

SEQ ID NO: 1632159 - RNA, 17 nt, Human
cagcccgggcucugccu

SEQ ID NO: 1632160 - RNA, 22 nt, Human
cagcccgggcucugccucccau

SEQ ID NO: 1632161 - RNA, 21 nt, Human
cagcccgggcucugccuccca

SEQ ID NO: 1632162 - RNA, 19 nt, Human
cagcuacuugggaggcuga

SEQ ID NO: 1632163 - RNA, 16 nt, Human
cagcuaaugggacacu

SEQ ID NO: 1632164 - RNA, 15 nt, Human
cagcuaaugggacac

SEQ ID NO: 1632165 - RNA, 19 nt, Human
cagcuaaucagcauucuca

SEQ ID NO: 1632166 - RNA, 20 nt, Human
cagcuaacauggaaguacua

SEQ ID NO: 1632167 - RNA, 20 nt, Human
cagcgagcccugguggcagu

SEQ ID NO: 1632168 - RNA, 19 nt, Human
cagcgagcccugguggcag

SEQ ID NO: 1632169 - RNA, 17 nt, Human
cagcgagcccugguggc

SEQ ID NO: 1632170 - RNA, 16 nt, Human
cagcgagcccuggugg

SEQ ID NO: 1632171 - RNA, 13 nt, Human
cagcgagcccugg

SEQ ID NO: 1632172 - RNA, 18 nt, Human
cagcuaacauggaaguac

SEQ ID NO: 1632173 - RNA, 19 nt, Human
cagcuaacauggaaguacu

SEQ ID NO: 1632174 - RNA, 21 nt, Human
cagcgagcccugguggcagug

SEQ ID NO: 1632175 - RNA, 19 nt, Human
cagcucaccagccccagug

SEQ ID NO: 1632176 - RNA, 17 nt, Human
cagcucaccagccccag

SEQ ID NO: 1632177 - RNA, 16 nt, Human
cagcucaccagcccca

SEQ ID NO: 1632178 - RNA, 15 nt, Human
cagcucaccagcccc

SEQ ID NO: 1632179 - RNA, 13 nt, Human
cagcucaccagcc

SEQ ID NO: 1632180 - RNA, 17 nt, Human
cagcucaccucucccuu

SEQ ID NO: 1632181 - RNA, 16 nt, Human
cagcucaccucucccu

SEQ ID NO: 1632182 - RNA, 15 nt, Human
cagcucaccucuccc

SEQ ID NO: 1632183 - RNA, 13 nt, Human
cagcucaccucuc

SEQ ID NO: 1632184 - RNA, 21 nt, Human
cagcucaccagccccagugcc

SEQ ID NO: 1632185 - RNA, 20 nt, Human
cagcucaccagccccagugc

SEQ ID NO: 1632186 - RNA, 22 nt, Human
cagcucaccagccccagugccc

SEQ ID NO: 1632187 - RNA, 20 nt, Human
cagcucaccucucccuugga

SEQ ID NO: 1632188 - RNA, 19 nt, Human
cagcucaccucucccuugg

SEQ ID NO: 1632189 - RNA, 14 nt, Human
cagcucacugcaac

SEQ ID NO: 1632190 - RNA, 12 nt, Human
cagcucacugca

SEQ ID NO: 1632191 - RNA, 12 nt, Human
cagcucagagag

SEQ ID NO: 1632192 - RNA, 15 nt, Human
cagcucacugcaacc

SEQ ID NO: 1632193 - RNA, 21 nt, Human
cagcucacugcaaccuucgcc

SEQ ID NO: 1632194 - RNA, 23 nt, Human
cagccucccgaguagcugggacu

SEQ ID NO: 1632195 - RNA, 22 nt, Human
cagccucccgaguagcugggac

SEQ ID NO: 1632196 - RNA, 21 nt, Human
cagccucccgaguagcuggga

SEQ ID NO: 1632197 - RNA, 20 nt, Human
cagccucccgaguagcuggg

SEQ ID NO: 1632198 - RNA, 19 nt, Human
cagccucccgaguagcugg

SEQ ID NO: 1632199 - RNA, 23 nt, Human
cagccucccgaauagcugggacu

SEQ ID NO: 1632200 - RNA, 20 nt, Human
cagccugcuccagcuguuca

SEQ ID NO: 1632201 - RNA, 15 nt, Human
cagccuccugaguag

SEQ ID NO: 1632202 - RNA, 19 nt, Human
cagccuggacccuguggau

SEQ ID NO: 1632203 - RNA, 15 nt, Human
cagccuggacccugu

SEQ ID NO: 1632204 - RNA, 10 nt, Human
cagccuggca

SEQ ID NO: 1632205 - RNA, 21 nt, Human
cagccuggcacagggcagugg

SEQ ID NO: 1632206 - RNA, 20 nt, Human
cagccuggcacagggcagug

SEQ ID NO: 1632207 - RNA, 13 nt, Human
cagccuggcacag

SEQ ID NO: 1632208 - RNA, 19 nt, Human
cagccugggcaaugugaua

SEQ ID NO: 1632209 - RNA, 16 nt, Human
cagccugggcaaugug

SEQ ID NO: 1632210 - RNA, 24 nt, Human
cagccuugaccauucuccaccugc

SEQ ID NO: 1632211 - RNA, 23 nt, Human
cagccuugaccauucuccaccug

SEQ ID NO: 1632212 - RNA, 22 nt, Human
cagccuugaccauucuccaccu

SEQ ID NO: 1632213 - RNA, 21 nt, Human
cagccuugaccauucuccacc

SEQ ID NO: 1632214 - RNA, 20 nt, Human
cagccuugaccauucuccac

SEQ ID NO: 1632215 - RNA, 17 nt, Human
cagccuugaccauucuc

SEQ ID NO: 1632216 - RNA, 14 nt, Human
cagccugugucuuu

SEQ ID NO: 1632217 - RNA, 23 nt, Human
cagccugugucuuuaaaugcugc

SEQ ID NO: 1632218 - RNA, 18 nt, Human
caggucccuaauaaagcu

SEQ ID NO: 1632219 - RNA, 17 nt, Human
caggucccuaauaaagc

SEQ ID NO: 1632220 - RNA, 16 nt, Human
caggucccuaauaaag

SEQ ID NO: 1632221 - RNA, 15 nt, Human
caggucccuaauaaa

SEQ ID NO: 1632222 - RNA, 14 nt, Human
caggucccuaauaa

SEQ ID NO: 1632223 - RNA, 13 nt, Human
caggucccuaaua

SEQ ID NO: 1632224 - RNA, 12 nt, Human
caggucccuaau

SEQ ID NO: 1632225 - RNA, 11 nt, Human
caggucccuaa

SEQ ID NO: 1632226 - RNA, 21 nt, Human
cagguaacaggcagauacagg

SEQ ID NO: 1632227 - RNA, 20 nt, Human
cagguaacaggcagauacag

SEQ ID NO: 1632228 - RNA, 20 nt, Human
cagguaaucgaccugccucg

SEQ ID NO: 1632229 - RNA, 19 nt, Human
cagguaaucgaccugccuc

SEQ ID NO: 1632230 - RNA, 18 nt, Human
cagguaaucgaccugccu

SEQ ID NO: 1632231 - RNA, 17 nt, Human
cagguaaucgaccugcc

SEQ ID NO: 1632232 - RNA, 20 nt, Human
caggugagaagcagaggaag

SEQ ID NO: 1632233 - RNA, 13 nt, Human
caggugagaagca

SEQ ID NO: 1632234 - RNA, 21 nt, Human
caggugagaagcagaggaagg

SEQ ID NO: 1632235 - RNA, 21 nt, Human
cagguggccacuccagacccc

SEQ ID NO: 1632236 - RNA, 19 nt, Human
cagguggccacuccagacc

SEQ ID NO: 1632237 - RNA, 16 nt, Human
cagguggccacuccag

SEQ ID NO: 1632238 - RNA, 15 nt, Human
cagguggccacucca

SEQ ID NO: 1632239 - RNA, 23 nt, Human
caggucuugaacuccuggccuca

SEQ ID NO: 1632240 - RNA, 22 nt, Human
caggucuugaacuccuggccuc

SEQ ID NO: 1632241 - RNA, 21 nt, Human
caggucuugaacuccuggccu

SEQ ID NO: 1632242 - RNA, 20 nt, Human
caggucuugaacuccuggcc

SEQ ID NO: 1632243 - RNA, 19 nt, Human
caggucuugaacuccuggc

SEQ ID NO: 1632244 - RNA, 18 nt, Human
caggucuugaacuccugg

SEQ ID NO: 1632245 - RNA, 22 nt, Human
caggucccuaauaaagcugugu

SEQ ID NO: 1632246 - RNA, 21 nt, Human
caggucccuaauaaagcugug

SEQ ID NO: 1632247 - RNA, 20 nt, Human
caggucccuaauaaagcugu

SEQ ID NO: 1632248 - RNA, 19 nt, Human
caggucccuaauaaagcug

SEQ ID NO: 1632249 - RNA, 22 nt, Human
cagggucccugguggcagcuca

SEQ ID NO: 1632250 - RNA, 19 nt, Human
cagggucccugguggcagc

SEQ ID NO: 1632251 - RNA, 18 nt, Human
cagggucccugguggcag

SEQ ID NO: 1632252 - RNA, 15 nt, Human
cagggucccuggugg

SEQ ID NO: 1632253 - RNA, 14 nt, Human
cagggucccuggug

SEQ ID NO: 1632254 - RNA, 12 nt, Human
cagggucccugg

SEQ ID NO: 1632255 - RNA, 20 nt, Human
caggguauuccagagugggg

SEQ ID NO: 1632256 - RNA, 21 nt, Human
caggguauuccagagugggga

SEQ ID NO: 1632257 - RNA, 15 nt, Human
cagggucucacucug

SEQ ID NO: 1632258 - RNA, 23 nt, Human
cagggucucacuauguugcccag

SEQ ID NO: 1632259 - RNA, 22 nt, Human
cagggucucacuauguugccca

SEQ ID NO: 1632260 - RNA, 21 nt, Human
cagggucucacuauguugccc

SEQ ID NO: 1632261 - RNA, 18 nt, Human
caggguccuguagcccua

SEQ ID NO: 1632262 - RNA, 23 nt, Human
cagggucccugguggcagcucac

SEQ ID NO: 1632263 - RNA, 17 nt, Human
cagguaacaggcagaua

SEQ ID NO: 1632264 - RNA, 16 nt, Human
cagguaacaggcagau

SEQ ID NO: 1632265 - RNA, 15 nt, Human
cagguaacaggcaga

SEQ ID NO: 1632266 - RNA, 14 nt, Human
cagguaacaggcag

SEQ ID NO: 1632267 - RNA, 16 nt, Human
cagggucucacucugu

SEQ ID NO: 1632268 - RNA, 17 nt, Human
cagggucucacucuguc

SEQ ID NO: 1632269 - RNA, 16 nt, Human
caggguuuugccaugu

SEQ ID NO: 1632270 - RNA, 21 nt, Human
caggggugggacacccuguga

SEQ ID NO: 1632271 - RNA, 20 nt, Human
caggggugggacacccugug

SEQ ID NO: 1632272 - RNA, 15 nt, Human
caggggugggacacc

SEQ ID NO: 1632273 - RNA, 14 nt, Human
caggggugggacac

SEQ ID NO: 1632274 - RNA, 14 nt, Human
caggugucccugca

SEQ ID NO: 1632275 - RNA, 11 nt, Human
caggugucccu

SEQ ID NO: 1632276 - RNA, 20 nt, Human
caggugguuauggagagggu

SEQ ID NO: 1632277 - RNA, 22 nt, Human
cagguggggucacucuggcagc

SEQ ID NO: 1632278 - RNA, 21 nt, Human
cagguggggucacucuggcag

SEQ ID NO: 1632279 - RNA, 20 nt, Human
cagguggggucacucuggca

SEQ ID NO: 1632280 - RNA, 19 nt, Human
cagguggggucacucuggc

SEQ ID NO: 1632281 - RNA, 18 nt, Human
caggugguuauggagagg

SEQ ID NO: 1632282 - RNA, 23 nt, Human
cagguggggucacucuggcagcu

SEQ ID NO: 1632283 - RNA, 18 nt, Human
cagguggggucacucugg

SEQ ID NO: 1632284 - RNA, 17 nt, Human
cagguggggcagcuuga

SEQ ID NO: 1632285 - RNA, 16 nt, Human
cagguggggcagcuug

SEQ ID NO: 1632286 - RNA, 15 nt, Human
cagguggggcagcuu

SEQ ID NO: 1632287 - RNA, 14 nt, Human
cagguggggcagcu

SEQ ID NO: 1632288 - RNA, 13 nt, Human
cagguggggcagc

SEQ ID NO: 1632289 - RNA, 12 nt, Human
caggugugaacc

SEQ ID NO: 1632290 - RNA, 19 nt, Human
caggugucccugcacuugc

SEQ ID NO: 1632291 - RNA, 18 nt, Human
caggugucccugcacuug

SEQ ID NO: 1632292 - RNA, 16 nt, Human
caggugucccugcacu

SEQ ID NO: 1632293 - RNA, 15 nt, Human
caggugucccugcac

SEQ ID NO: 1632294 - RNA, 23 nt, Human
caggugugaaccaccacacccag

SEQ ID NO: 1632295 - RNA, 22 nt, Human
caggugugaaccaccacaccca

SEQ ID NO: 1632296 - RNA, 19 nt, Human
caggugugaaccaccacac

SEQ ID NO: 1632297 - RNA, 16 nt, Human
caggugugaaccacca

SEQ ID NO: 1632298 - RNA, 21 nt, Human
caggugugagucaccaagccc

SEQ ID NO: 1632299 - RNA, 20 nt, Human
caggugugagucaccaagcc

SEQ ID NO: 1632300 - RNA, 16 nt, Human
caggugugagucacca

SEQ ID NO: 1632301 - RNA, 18 nt, Human
caggugugagccaccacg

SEQ ID NO: 1632302 - RNA, 23 nt, Human
caggugugagucaccaagcccag

SEQ ID NO: 1632303 - RNA, 22 nt, Human
caggugugagucaccaagccca

SEQ ID NO: 1632304 - RNA, 21 nt, Human
caggugugagccaccacgccc

SEQ ID NO: 1632305 - RNA, 13 nt, Human
caguaauaacucu

SEQ ID NO: 1632306 - RNA, 12 nt, Human
caguaauaacuc

SEQ ID NO: 1632307 - RNA, 13 nt, Human
cagguucagcuug

SEQ ID NO: 1632308 - RNA, 12 nt, Human
cagguucagcuu

SEQ ID NO: 1632309 - RNA, 22 nt, Human
caguaaaugggggugcauuuga

SEQ ID NO: 1632310 - RNA, 21 nt, Human
caguaaaugggggugcauuug

SEQ ID NO: 1632311 - RNA, 15 nt, Human
cagugagacagcucu

SEQ ID NO: 1632312 - RNA, 20 nt, Human
cagugaggcucugcccuugg

SEQ ID NO: 1632313 - RNA, 19 nt, Human
cagugaggcucugcccuug

SEQ ID NO: 1632314 - RNA, 18 nt, Human
cagugaggcucugcccuu

SEQ ID NO: 1632315 - RNA, 17 nt, Human
cagugaggcucugcccu

SEQ ID NO: 1632316 - RNA, 18 nt, Human
cagugagucgaggacagg

SEQ ID NO: 1632317 - RNA, 17 nt, Human
cagugagucgaggacag

SEQ ID NO: 1632318 - RNA, 21 nt, Human
cagugaggcucugcccuuggu

SEQ ID NO: 1632319 - RNA, 16 nt, Human
cagugaggcucugccc

SEQ ID NO: 1632320 - RNA, 15 nt, Human
cagugaggcucugcc

SEQ ID NO: 1632321 - RNA, 14 nt, Human
cagugaggcucugc

SEQ ID NO: 1632322 - RNA, 13 nt, Human
cagugaggcucug

SEQ ID NO: 1632323 - RNA, 12 nt, Human
cagugaggcucu

SEQ ID NO: 1632324 - RNA, 24 nt, Human
cagugagccgagauugcaccacug

SEQ ID NO: 1632325 - RNA, 16 nt, Human
cagugaaagaaaauaa

SEQ ID NO: 1632326 - RNA, 20 nt, Human
cagugaaagaaaauaacaau

SEQ ID NO: 1632327 - RNA, 19 nt, Human
cagucuggaaugcaguggu

SEQ ID NO: 1632328 - RNA, 21 nt, Human
caguccuuaccagcagagcac

SEQ ID NO: 1632329 - RNA, 20 nt, Human
caguccuuaccagcagagca

SEQ ID NO: 1632330 - RNA, 19 nt, Human
caguccuuaccagcagagc

SEQ ID NO: 1632331 - RNA, 18 nt, Human
caguccuuaccagcagag

SEQ ID NO: 1632332 - RNA, 15 nt, Human
caguccuuaccagca

SEQ ID NO: 1632333 - RNA, 17 nt, Human
caguccucccaucucac

SEQ ID NO: 1632334 - RNA, 16 nt, Human
caguccucccaucuca

SEQ ID NO: 1632335 - RNA, 18 nt, Human
cagugauuaccagggacu

SEQ ID NO: 1632336 - RNA, 17 nt, Human
cagugauuaccagggac

SEQ ID NO: 1632337 - RNA, 15 nt, Human
cagugcccuccagga

SEQ ID NO: 1632338 - RNA, 23 nt, Human
cagugagucgaggacagggaggu

SEQ ID NO: 1632339 - RNA, 22 nt, Human
cagugagucgaggacagggagg

SEQ ID NO: 1632340 - RNA, 20 nt, Human
cagugagucgaggacaggga

SEQ ID NO: 1632341 - RNA, 19 nt, Human
cagugagucgaggacaggg

SEQ ID NO: 1632342 - RNA, 22 nt, Human
cagugccuuauggaacacucug

SEQ ID NO: 1632343 - RNA, 21 nt, Human
cagugccuuauggaacacucu

SEQ ID NO: 1632344 - RNA, 20 nt, Human
cagugccuuauggaacacuc

SEQ ID NO: 1632345 - RNA, 19 nt, Human
cagugccuuauggaacacu

SEQ ID NO: 1632346 - RNA, 18 nt, Human
cagugccuuauggaacac

SEQ ID NO: 1632347 - RNA, 17 nt, Human
cagugccuuauggaaca

SEQ ID NO: 1632348 - RNA, 16 nt, Human
cagugccuuauggaac

SEQ ID NO: 1632349 - RNA, 15 nt, Human
cagugccuuauggaa

SEQ ID NO: 1632350 - RNA, 13 nt, Human
cagugccuuaugg

SEQ ID NO: 1632351 - RNA, 11 nt, Human
cagugccuuau

SEQ ID NO: 1632352 - RNA, 18 nt, Human
cagugccgagaaggaagc

SEQ ID NO: 1632353 - RNA, 15 nt, Human
cagugccgagaagga

SEQ ID NO: 1632354 - RNA, 23 nt, Human
cagugccuuauggaacacucuga

SEQ ID NO: 1632355 - RNA, 13 nt, Human
cagugcuccagcc

SEQ ID NO: 1632356 - RNA, 12 nt, Human
caguauggcagc

SEQ ID NO: 1632357 - RNA, 21 nt, Human
caguaucuugaagacuuuucu

SEQ ID NO: 1632358 - RNA, 18 nt, Human
caguaucuugaagacuuu

SEQ ID NO: 1632359 - RNA, 12 nt, Human
caguaucuugaa

SEQ ID NO: 1632360 - RNA, 15 nt, Human
caguaucucagggcc

SEQ ID NO: 1632361 - RNA, 13 nt, Human
caguaucucaggg

SEQ ID NO: 1632362 - RNA, 12 nt, Human
caguagugauag

SEQ ID NO: 1632363 - RNA, 21 nt, Human
caguauaauuaacauguuaaa

SEQ ID NO: 1632364 - RNA, 17 nt, Human
caguauaauuaacaugu

SEQ ID NO: 1632365 - RNA, 15 nt, Human
caguauaauuaacau

SEQ ID NO: 1632366 - RNA, 14 nt, Human
caguauaauuaaca

SEQ ID NO: 1632367 - RNA, 13 nt, Human
caguccaugaaga

SEQ ID NO: 1632368 - RNA, 14 nt, Human
caguccauugaaag

SEQ ID NO: 1632369 - RNA, 16 nt, Human
caguccauagcagaga

SEQ ID NO: 1632370 - RNA, 20 nt, Human
cagucauucagauaugauuc

SEQ ID NO: 1632371 - RNA, 17 nt, Human
cagucauucagauauga

SEQ ID NO: 1632372 - RNA, 22 nt, Human
cagucaggaaagagaacuucca

SEQ ID NO: 1632373 - RNA, 18 nt, Human
cagucaggaaagagaacu

SEQ ID NO: 1632374 - RNA, 15 nt, Human
cagucaggaaagaga

SEQ ID NO: 1632375 - RNA, 19 nt, Human
caguauuacuucugcuaca

SEQ ID NO: 1632376 - RNA, 18 nt, Human
caguauuacuucugcuac

SEQ ID NO: 1632377 - RNA, 16 nt, Human
caguauuacuucugcu

SEQ ID NO: 1632378 - RNA, 16 nt, Human
cagucccugccaaugg

SEQ ID NO: 1632379 - RNA, 15 nt, Human
cagucccugccaaug

SEQ ID NO: 1632380 - RNA, 14 nt, Human
cagucccugccaau

SEQ ID NO: 1632381 - RNA, 13 nt, Human
cagucccugccaa

SEQ ID NO: 1632382 - RNA, 12 nt, Human
cagucccugcca

SEQ ID NO: 1632383 - RNA, 15 nt, Human
caguccucccaucuc

SEQ ID NO: 1632384 - RNA, 14 nt, Human
caguccucccaucu

SEQ ID NO: 1632385 - RNA, 13 nt, Human
caguccucccauc

SEQ ID NO: 1632386 - RNA, 12 nt, Human
caguccucccau

SEQ ID NO: 1632387 - RNA, 17 nt, Human
cagucccugccaaugga

SEQ ID NO: 1632388 - RNA, 17 nt, Human
cagucccccugccccag

SEQ ID NO: 1632389 - RNA, 16 nt, Human
cagucccccugcccca

SEQ ID NO: 1632390 - RNA, 23 nt, Human
caguccccgugaaggagagcccu

SEQ ID NO: 1632391 - RNA, 16 nt, Human
caggacucugccuccu

SEQ ID NO: 1632392 - RNA, 15 nt, Human
caggacucugccucc

SEQ ID NO: 1632393 - RNA, 13 nt, Human
caggacucugccu

SEQ ID NO: 1632394 - RNA, 12 nt, Human
caggacucugcc

SEQ ID NO: 1632395 - RNA, 21 nt, Human
caggagcccugggaggcucug

SEQ ID NO: 1632396 - RNA, 17 nt, Human
caggagccuccugcccu

SEQ ID NO: 1632397 - RNA, 14 nt, Human
caggagccuccugc

SEQ ID NO: 1632398 - RNA, 20 nt, Human
caggagccuccugcccuuac

SEQ ID NO: 1632399 - RNA, 12 nt, Human
caggagugagca

SEQ ID NO: 1632400 - RNA, 19 nt, Human
caggagcagccacauuccu

SEQ ID NO: 1632401 - RNA, 14 nt, Human
caggagcagccaca

SEQ ID NO: 1632402 - RNA, 13 nt, Human
caggagcagccac

SEQ ID NO: 1632403 - RNA, 12 nt, Human
caggagcagcca

SEQ ID NO: 1632404 - RNA, 18 nt, Human
caggagccccgaggccuu

SEQ ID NO: 1632405 - RNA, 16 nt, Human
caggagccccgaggcc

SEQ ID NO: 1632406 - RNA, 15 nt, Human
caggagccccgaggc

SEQ ID NO: 1632407 - RNA, 22 nt, Human
caggagccccgaggccuucucu

SEQ ID NO: 1632408 - RNA, 20 nt, Human
caggagccccgaggccuucu

SEQ ID NO: 1632409 - RNA, 23 nt, Human
caggagccccgaggccuucucug

SEQ ID NO: 1632410 - RNA, 11 nt, Human
caggagcccug

SEQ ID NO: 1632411 - RNA, 19 nt, Human
caggagcccugggaggcuc

SEQ ID NO: 1632412 - RNA, 18 nt, Human
caggagcccugggaggcu

SEQ ID NO: 1632413 - RNA, 16 nt, Human
caggagcccugggagg

SEQ ID NO: 1632414 - RNA, 14 nt, Human
caggagcccuggga

SEQ ID NO: 1632415 - RNA, 23 nt, Human
caggaguuugagaccaaccuggg

SEQ ID NO: 1632416 - RNA, 22 nt, Human
caggaguuugagaccaaccugg

SEQ ID NO: 1632417 - RNA, 13 nt, Human
caggauagacuuu

SEQ ID NO: 1632418 - RNA, 21 nt, Human
caggaguuugagaccaaccug

SEQ ID NO: 1632419 - RNA, 19 nt, Human
caggaguuucguuuucaaa

SEQ ID NO: 1632420 - RNA, 16 nt, Human
caggaguuggaagugu

SEQ ID NO: 1632421 - RNA, 20 nt, Human
caggcccccaggugccaguu

SEQ ID NO: 1632422 - RNA, 13 nt, Human
caggccccugcca

SEQ ID NO: 1632423 - RNA, 19 nt, Human
caggcccccaggugccagu

SEQ ID NO: 1632424 - RNA, 14 nt, Human
caggcccccaggug

SEQ ID NO: 1632425 - RNA, 21 nt, Human
caggccauuccccgucucugg

SEQ ID NO: 1632426 - RNA, 22 nt, Human
caggccaggcccucugcccacu

SEQ ID NO: 1632427 - RNA, 21 nt, Human
caggccaggcccucugcccac

SEQ ID NO: 1632428 - RNA, 20 nt, Human
caggccacaagacccuugug

SEQ ID NO: 1632429 - RNA, 18 nt, Human
caggccauuccccgucuc

SEQ ID NO: 1632430 - RNA, 18 nt, Human
caggccacaagacccuug

SEQ ID NO: 1632431 - RNA, 17 nt, Human
caggccacaagacccuu

SEQ ID NO: 1632432 - RNA, 13 nt, Human
caggccacaagac

SEQ ID NO: 1632433 - RNA, 23 nt, Human
caggccaaacucaccugccccuc

SEQ ID NO: 1632434 - RNA, 18 nt, Human
caggccaaacucaccugc

SEQ ID NO: 1632435 - RNA, 16 nt, Human
caggcccggcuccagg

SEQ ID NO: 1632436 - RNA, 20 nt, Human
caggccccugccacccuggg

SEQ ID NO: 1632437 - RNA, 19 nt, Human
caggccccugccacccugg

SEQ ID NO: 1632438 - RNA, 17 nt, Human
caggccccugccacccu

SEQ ID NO: 1632439 - RNA, 15 nt, Human
caggccccugccacc

SEQ ID NO: 1632440 - RNA, 15 nt, Human
caggcccggcuccag

SEQ ID NO: 1632441 - RNA, 14 nt, Human
caggcccggcucca

SEQ ID NO: 1632442 - RNA, 13 nt, Human
caggcccggcucc

SEQ ID NO: 1632443 - RNA, 23 nt, Human
caggaugguucccuugaugaaga

SEQ ID NO: 1632444 - RNA, 21 nt, Human
caggaugguucccuugaugaa

SEQ ID NO: 1632445 - RNA, 18 nt, Human
caggauucuuccucccuc

SEQ ID NO: 1632446 - RNA, 17 nt, Human
caggauucuuccucccu

SEQ ID NO: 1632447 - RNA, 19 nt, Human
caggauguacaaggacagc

SEQ ID NO: 1632448 - RNA, 23 nt, Human
caggauggccgggcgcgguggcu

SEQ ID NO: 1632449 - RNA, 22 nt, Human
caggaugaugacuauggaaaga

SEQ ID NO: 1632450 - RNA, 20 nt, Human
caggaugaugacuauggaaa

SEQ ID NO: 1632451 - RNA, 18 nt, Human
caggaugaugacuaugga

SEQ ID NO: 1632452 - RNA, 14 nt, Human
caggaucagucuga

SEQ ID NO: 1632453 - RNA, 13 nt, Human
caggaucagucug

SEQ ID NO: 1632454 - RNA, 21 nt, Human
caggauauucucacagcucca

SEQ ID NO: 1632455 - RNA, 16 nt, Human
caggauuuuaaucuuu

SEQ ID NO: 1632456 - RNA, 20 nt, Human
caggauucuuccucccuccc

SEQ ID NO: 1632457 - RNA, 21 nt, Human
caggcaagcaccuccugccuc

SEQ ID NO: 1632458 - RNA, 16 nt, Human
caggcaagcaccuccu

SEQ ID NO: 1632459 - RNA, 15 nt, Human
caggcaagcaccucc

SEQ ID NO: 1632460 - RNA, 14 nt, Human
caggcaagcaccuc

SEQ ID NO: 1632461 - RNA, 15 nt, Human
caggcagccaggcca

SEQ ID NO: 1632462 - RNA, 14 nt, Human
caggcagccaggcc

SEQ ID NO: 1632463 - RNA, 14 nt, Human
caggcaaugcuggc

SEQ ID NO: 1632464 - RNA, 17 nt, Human
caggcagccaggccaca

SEQ ID NO: 1632465 - RNA, 16 nt, Human
caggcagccaggccac

SEQ ID NO: 1632466 - RNA, 20 nt, Human
caggcaggaaggcugagagg

SEQ ID NO: 1632467 - RNA, 13 nt, Human
caggcagguccag

SEQ ID NO: 1632468 - RNA, 17 nt, Human
caggcauuccccaggag

SEQ ID NO: 1632469 - RNA, 16 nt, Human
caggcauuccccagga

SEQ ID NO: 1632470 - RNA, 15 nt, Human
caggcauuccccagg

SEQ ID NO: 1632471 - RNA, 13 nt, Human
caggcauucccca

SEQ ID NO: 1632472 - RNA, 20 nt, Human
caggcauguucucugaggac

SEQ ID NO: 1632473 - RNA, 19 nt, Human
caggcauguucucugagga

SEQ ID NO: 1632474 - RNA, 18 nt, Human
caggcauguucucugagg

SEQ ID NO: 1632475 - RNA, 15 nt, Human
caggcauguucucug

SEQ ID NO: 1632476 - RNA, 21 nt, Human
caggcauuccccaggaggcca

SEQ ID NO: 1632477 - RNA, 20 nt, Human
caggcauuccccaggaggcc

SEQ ID NO: 1632478 - RNA, 19 nt, Human
caggcauuccccaggaggc

SEQ ID NO: 1632479 - RNA, 18 nt, Human
caggcauuccccaggagg

SEQ ID NO: 1632480 - RNA, 23 nt, Human
caggcauuccccaggaggccagc

SEQ ID NO: 1632481 - RNA, 22 nt, Human
caggcauuccccaggaggccag

SEQ ID NO: 1632482 - RNA, 24 nt, Human
caggcauuccccaggaggccagcc

SEQ ID NO: 1632483 - RNA, 15 nt, Human
caggcaggugggaug

SEQ ID NO: 1632484 - RNA, 23 nt, Human
caggcaggucuugaacuccuggc

SEQ ID NO: 1632485 - RNA, 22 nt, Human
caggcaggucuugaacuccugg

SEQ ID NO: 1632486 - RNA, 13 nt, Human
caggcaggucuug

SEQ ID NO: 1632487 - RNA, 12 nt, Human
caggcaggucuu

SEQ ID NO: 1632488 - RNA, 19 nt, Human
caggcagguccaggguuug

SEQ ID NO: 1632489 - RNA, 15 nt, Human
caggcagguccaggg

SEQ ID NO: 1632490 - RNA, 14 nt, Human
caggcagguccagg

SEQ ID NO: 1632491 - RNA, 17 nt, Human
caggcaugguggcccac

SEQ ID NO: 1632492 - RNA, 16 nt, Human
caggggacaggauggu

SEQ ID NO: 1632493 - RNA, 11 nt, Human
caggggacagg

SEQ ID NO: 1632494 - RNA, 15 nt, Human
cagggccuggcucag

SEQ ID NO: 1632495 - RNA, 14 nt, Human
cagggccuggcuca

SEQ ID NO: 1632496 - RNA, 13 nt, Human
cagggccuggcuc

SEQ ID NO: 1632497 - RNA, 19 nt, Human
cagggccuggcucaggugg

SEQ ID NO: 1632498 - RNA, 16 nt, Human
cagggccuggcucagg

SEQ ID NO: 1632499 - RNA, 19 nt, Human
caggggaggguagagcgga

SEQ ID NO: 1632500 - RNA, 17 nt, Human
cagggcauggcugggaa

SEQ ID NO: 1632501 - RNA, 20 nt, Human
cagggcauggccagguggcc

SEQ ID NO: 1632502 - RNA, 18 nt, Human
cagggacaggauaagagg

SEQ ID NO: 1632503 - RNA, 23 nt, Human
cagggacagaggggguggccucc

SEQ ID NO: 1632504 - RNA, 14 nt, Human
cagggcacaccggg

SEQ ID NO: 1632505 - RNA, 21 nt, Human
cagggcacaccgggcacucag

SEQ ID NO: 1632506 - RNA, 19 nt, Human
cagggcacaccgggcacuc

SEQ ID NO: 1632507 - RNA, 17 nt, Human
cagggcacaccgggcac

SEQ ID NO: 1632508 - RNA, 15 nt, Human
cagggcacaccgggc

SEQ ID NO: 1632509 - RNA, 23 nt, Human
cagggcacaccgggcacucagaa

SEQ ID NO: 1632510 - RNA, 22 nt, Human
cagggcacaccgggcacucaga

SEQ ID NO: 1632511 - RNA, 22 nt, Human
cagggaaacagcuaaugggaca

SEQ ID NO: 1632512 - RNA, 20 nt, Human
cagggacagaggggguggcc

SEQ ID NO: 1632513 - RNA, 14 nt, Human
cagggacagagggg

SEQ ID NO: 1632514 - RNA, 13 nt, Human
cagggacagaggg

SEQ ID NO: 1632515 - RNA, 17 nt, Human
cagggaaggggacaagg

SEQ ID NO: 1632516 - RNA, 15 nt, Human
cagggaaggggacaa

SEQ ID NO: 1632517 - RNA, 14 nt, Human
caggcuacugucag

SEQ ID NO: 1632518 - RNA, 19 nt, Human
caggcuagauguauguacu

SEQ ID NO: 1632519 - RNA, 13 nt, Human
caggcuagaugua

SEQ ID NO: 1632520 - RNA, 20 nt, Human
caggcuccuuuagcgcccag

SEQ ID NO: 1632521 - RNA, 19 nt, Human
caggcuccuuuagcgccca

SEQ ID NO: 1632522 - RNA, 14 nt, Human
caggcuccuuuagc

SEQ ID NO: 1632523 - RNA, 18 nt, Human
caggcuccugccaccacg

SEQ ID NO: 1632524 - RNA, 16 nt, Human
caggcuccugccacca

SEQ ID NO: 1632525 - RNA, 15 nt, Human
caggcuccugccacc

SEQ ID NO: 1632526 - RNA, 14 nt, Human
caggcuccugccac

SEQ ID NO: 1632527 - RNA, 13 nt, Human
caggcuccugcca

SEQ ID NO: 1632528 - RNA, 20 nt, Human
caggcucucaggccagcugc

SEQ ID NO: 1632529 - RNA, 19 nt, Human
caggcucucaggccagcug

SEQ ID NO: 1632530 - RNA, 18 nt, Human
caggcucucaggccagcu

SEQ ID NO: 1632531 - RNA, 17 nt, Human
caggcucucaggccagc

SEQ ID NO: 1632532 - RNA, 23 nt, Human
caggcucucaggccagcugcuug

SEQ ID NO: 1632533 - RNA, 21 nt, Human
caggcucucaggccagcugcu

SEQ ID NO: 1632534 - RNA, 16 nt, Human
caggcucucaggccag

SEQ ID NO: 1632535 - RNA, 15 nt, Human
caggcucucaggcca

SEQ ID NO: 1632536 - RNA, 14 nt, Human
caggcucucaggcc

SEQ ID NO: 1632537 - RNA, 13 nt, Human
caggcucucaggc

SEQ ID NO: 1632538 - RNA, 12 nt, Human
caggcucucagg

SEQ ID NO: 1632539 - RNA, 20 nt, Human
caggcucgggcuccccagcc

SEQ ID NO: 1632540 - RNA, 21 nt, Human
caggcuccuuuagcgcccagu

SEQ ID NO: 1632541 - RNA, 19 nt, Human
caggcccggcuccaggcuc

SEQ ID NO: 1632542 - RNA, 18 nt, Human
caggcccggcuccaggcu

SEQ ID NO: 1632543 - RNA, 17 nt, Human
caggcccggcuccaggc

SEQ ID NO: 1632544 - RNA, 15 nt, Human
caggcccucugccca

SEQ ID NO: 1632545 - RNA, 14 nt, Human
caggcccucugccc

SEQ ID NO: 1632546 - RNA, 13 nt, Human
caggcccucugcc

SEQ ID NO: 1632547 - RNA, 21 nt, Human
caggcccggcuccaggcuccu

SEQ ID NO: 1632548 - RNA, 20 nt, Human
caggcccggcuccaggcucc

SEQ ID NO: 1632549 - RNA, 22 nt, Human
caggcccggcuccaggcuccuu

SEQ ID NO: 1632550 - RNA, 22 nt, Human
caggcccucugcccacucccug

SEQ ID NO: 1632551 - RNA, 21 nt, Human
caggcccucugcccacucccu

SEQ ID NO: 1632552 - RNA, 20 nt, Human
caggcccucugcccacuccc

SEQ ID NO: 1632553 - RNA, 19 nt, Human
caggcccucugcccacucc

SEQ ID NO: 1632554 - RNA, 17 nt, Human
caggcccucugcccacu

SEQ ID NO: 1632555 - RNA, 16 nt, Human
caggcccucugcccac

SEQ ID NO: 1632556 - RNA, 15 nt, Human
caggcccuuccucuc

SEQ ID NO: 1632557 - RNA, 17 nt, Human
caggcccuuccucucca

SEQ ID NO: 1632558 - RNA, 16 nt, Human
caggcccuuccucucc

SEQ ID NO: 1632559 - RNA, 23 nt, Human
caggcccuuccucuccacugccu

SEQ ID NO: 1632560 - RNA, 21 nt, Human
caggcccuuccucuccacugc

SEQ ID NO: 1632561 - RNA, 20 nt, Human
caggcccuuccucuccacug

SEQ ID NO: 1632562 - RNA, 19 nt, Human
caggcccuuccucuccacu

SEQ ID NO: 1632563 - RNA, 23 nt, Human
caggcuuagucacugagacagcc

SEQ ID NO: 1632564 - RNA, 22 nt, Human
caggcuuagucacugagacagc

SEQ ID NO: 1632565 - RNA, 23 nt, Human
caggcuuuuuuaucaugugaaau

SEQ ID NO: 1632566 - RNA, 16 nt, Human
cagggaaacagcuaau

SEQ ID NO: 1632567 - RNA, 21 nt, Human
caggcuguaucccaugagccu

SEQ ID NO: 1632568 - RNA, 20 nt, Human
caggcuguaucccaugagcc

SEQ ID NO: 1632569 - RNA, 14 nt, Human
caggcuguauccca

SEQ ID NO: 1632570 - RNA, 23 nt, Human
caggcuggucucgaacuccugac

SEQ ID NO: 1632571 - RNA, 19 nt, Human
caggcuggucucaaacucu

SEQ ID NO: 1632572 - RNA, 22 nt, Human
caggcuggucucgaacuccuga

SEQ ID NO: 1632573 - RNA, 20 nt, Human
caggcuggucucgaacuccu

SEQ ID NO: 1632574 - RNA, 12 nt, Human
caggcuggucuc

SEQ ID NO: 1632575 - RNA, 21 nt, Human
caggcuuagucacugagacag

SEQ ID NO: 1632576 - RNA, 20 nt, Human
caggcuuagucacugagaca

SEQ ID NO: 1632577 - RNA, 17 nt, Human
caggcuuagucacugag

SEQ ID NO: 1632578 - RNA, 16 nt, Human
caggcuuagucacuga

SEQ ID NO: 1632579 - RNA, 23 nt, Human
caggcuguaucccaugagccuca

SEQ ID NO: 1632580 - RNA, 22 nt, Human
caggcuguaucccaugagccuc

SEQ ID NO: 1632581 - RNA, 14 nt, Human
caggcugugaguuu

SEQ ID NO: 1632582 - RNA, 21 nt, Human
caggcugggucgcccuggacu

SEQ ID NO: 1632583 - RNA, 23 nt, Human
caggcugggcuucaguggcagcu

SEQ ID NO: 1632584 - RNA, 23 nt, Human
caggcugggucgcccuggacugu

SEQ ID NO: 1632585 - RNA, 17 nt, Human
caggcuggcccugcccu

SEQ ID NO: 1632586 - RNA, 16 nt, Human
caggcuggcccugccc

SEQ ID NO: 1632587 - RNA, 15 nt, Human
caggcuggcccugcc

SEQ ID NO: 1632588 - RNA, 14 nt, Human
caggcuggcccugc

SEQ ID NO: 1632589 - RNA, 12 nt, Human
caggcuggcccu

SEQ ID NO: 1632590 - RNA, 20 nt, Human
caggcugcucuugaacuccu

SEQ ID NO: 1632591 - RNA, 12 nt, Human
caggcugcucuu

SEQ ID NO: 1632592 - RNA, 23 nt, Human
caggcugcucuugaacuccugac

SEQ ID NO: 1632593 - RNA, 21 nt, Human
caggcugagccucagucuccc

SEQ ID NO: 1632594 - RNA, 17 nt, Human
caggcugagccucaguc

SEQ ID NO: 1632595 - RNA, 16 nt, Human
caggcugagccucagu

SEQ ID NO: 1632596 - RNA, 15 nt, Human
caggcugagccucag

SEQ ID NO: 1632597 - RNA, 14 nt, Human
caggcugagccuca

SEQ ID NO: 1632598 - RNA, 13 nt, Human
caggcugagccuc

SEQ ID NO: 1632599 - RNA, 12 nt, Human
caggcucuucuc

SEQ ID NO: 1632600 - RNA, 15 nt, Human
caggcucuucuccuu

SEQ ID NO: 1632601 - RNA, 14 nt, Human
caggcucuucuccu

SEQ ID NO: 1632602 - RNA, 22 nt, Human
caggcucuucuccuuucacaac

SEQ ID NO: 1632603 - RNA, 18 nt, Human
caggcucuucuccuuuca

SEQ ID NO: 1632604 - RNA, 12 nt, Human
caggcugagccu

SEQ ID NO: 1632605 - RNA, 15 nt, Human
caucucuccuccuuu

SEQ ID NO: 1632606 - RNA, 16 nt, Human
caucucuacaaaaagc

SEQ ID NO: 1632607 - RNA, 19 nt, Human
cauccuacaagacacagug

SEQ ID NO: 1632608 - RNA, 18 nt, Human
cauccuacaagacacagu

SEQ ID NO: 1632609 - RNA, 21 nt, Human
caucuugaauuguaaggaaug

SEQ ID NO: 1632610 - RNA, 16 nt, Human
caucuugaauuguaag

SEQ ID NO: 1632611 - RNA, 17 nt, Human
caucuugcucugcugac

SEQ ID NO: 1632612 - RNA, 16 nt, Human
caucuugcucugcuga

SEQ ID NO: 1632613 - RNA, 19 nt, Human
caucuugcucugcugacag

SEQ ID NO: 1632614 - RNA, 19 nt, Human
caugaagauguagaggaga

SEQ ID NO: 1632615 - RNA, 18 nt, Human
caugaagauguagaggag

SEQ ID NO: 1632616 - RNA, 20 nt, Human
caugacucguauaugucuca

SEQ ID NO: 1632617 - RNA, 23 nt, Human
caugacucguauaugucucaggu

SEQ ID NO: 1632618 - RNA, 13 nt, Human
caugagcaucagg

SEQ ID NO: 1632619 - RNA, 21 nt, Human
caugagccucagcauccuggc

SEQ ID NO: 1632620 - RNA, 20 nt, Human
caugagccucagcauccugg

SEQ ID NO: 1632621 - RNA, 19 nt, Human
caugagccucagcauccug

SEQ ID NO: 1632622 - RNA, 18 nt, Human
caugagccucagcauccu

SEQ ID NO: 1632623 - RNA, 17 nt, Human
caugagccucagcaucc

SEQ ID NO: 1632624 - RNA, 15 nt, Human
caugagccucagcau

SEQ ID NO: 1632625 - RNA, 12 nt, Human
caugagccucag

SEQ ID NO: 1632626 - RNA, 23 nt, Human
caugagcaucaggccaggcccuc

SEQ ID NO: 1632627 - RNA, 22 nt, Human
caugagcaucaggccaggcccu

SEQ ID NO: 1632628 - RNA, 21 nt, Human
caugagcaucaggccaggccc

SEQ ID NO: 1632629 - RNA, 20 nt, Human
caugagcaucaggccaggcc

SEQ ID NO: 1632630 - RNA, 18 nt, Human
caugagcaucaggccagg

SEQ ID NO: 1632631 - RNA, 17 nt, Human
caugagcaucaggccag

SEQ ID NO: 1632632 - RNA, 16 nt, Human
caugagcaucaggcca

SEQ ID NO: 1632633 - RNA, 15 nt, Human
caugagcaucaggcc

SEQ ID NO: 1632634 - RNA, 16 nt, Human
caugagguacugagag

SEQ ID NO: 1632635 - RNA, 23 nt, Human
caugaggaacaaggcaaggcugu

SEQ ID NO: 1632636 - RNA, 21 nt, Human
caugaggaacaaggcaaggcu

SEQ ID NO: 1632637 - RNA, 20 nt, Human
caugaggaacaaggcaaggc

SEQ ID NO: 1632638 - RNA, 17 nt, Human
caugaggaacaaggcaa

SEQ ID NO: 1632639 - RNA, 16 nt, Human
caugaggaacaaggca

SEQ ID NO: 1632640 - RNA, 23 nt, Human
caugagccucagcauccuggcac

SEQ ID NO: 1632641 - RNA, 22 nt, Human
caugagccucagcauccuggca

SEQ ID NO: 1632642 - RNA, 19 nt, Human
caugagguacugagaguga

SEQ ID NO: 1632643 - RNA, 13 nt, Human
caugaguccccug

SEQ ID NO: 1632644 - RNA, 15 nt, Human
caugaguccccuguu

SEQ ID NO: 1632645 - RNA, 14 nt, Human
caugaguccccugu

SEQ ID NO: 1632646 - RNA, 23 nt, Human
caugaguccccuguuuguuucug

SEQ ID NO: 1632647 - RNA, 13 nt, Human
caugaaaacacau

SEQ ID NO: 1632648 - RNA, 14 nt, Human
caugaaaacacauu

SEQ ID NO: 1632649 - RNA, 15 nt, Human
caugaaaacacauuu

SEQ ID NO: 1632650 - RNA, 16 nt, Human
caugaaaacacauuuu

SEQ ID NO: 1632651 - RNA, 17 nt, Human
caugaaaacacauuuuu

SEQ ID NO: 1632652 - RNA, 12 nt, Human
caugaagacaga

SEQ ID NO: 1632653 - RNA, 19 nt, Human
caugaaaacacauuuuucu

SEQ ID NO: 1632654 - RNA, 21 nt, Human
caugaaaacacauuuuucuua

SEQ ID NO: 1632655 - RNA, 14 nt, Human
caugaaagauucaa

SEQ ID NO: 1632656 - RNA, 22 nt, Human
cauauucuguuggccaguguga

SEQ ID NO: 1632657 - RNA, 17 nt, Human
cauauugauuuccguua

SEQ ID NO: 1632658 - RNA, 21 nt, Human
cauauugauuuccguuaaaau

SEQ ID NO: 1632659 - RNA, 19 nt, Human
cauauuguuacugguacca

SEQ ID NO: 1632660 - RNA, 13 nt, Human
cauauuguuacug

SEQ ID NO: 1632661 - RNA, 22 nt, Human
cauauauuuuuauauuuacuaa

SEQ ID NO: 1632662 - RNA, 21 nt, Human
cauauauuuuuauauuuacua

SEQ ID NO: 1632663 - RNA, 20 nt, Human
cauauauuuuuauauuuacu

SEQ ID NO: 1632664 - RNA, 20 nt, Human
cauauauaacaaugcuguau

SEQ ID NO: 1632665 - RNA, 15 nt, Human
cauauauaacaaugc

SEQ ID NO: 1632666 - RNA, 18 nt, Human
cauauauuuuuauauuua

SEQ ID NO: 1632667 - RNA, 13 nt, Human
cauauauaacaau

SEQ ID NO: 1632668 - RNA, 23 nt, Human
cauauaagauucauauuuacuuc

SEQ ID NO: 1632669 - RNA, 16 nt, Human
cauauaagugauugcu

SEQ ID NO: 1632670 - RNA, 22 nt, Human
cauagugaugguuccccuguuc

SEQ ID NO: 1632671 - RNA, 19 nt, Human
cauagugaugguuccccug

SEQ ID NO: 1632672 - RNA, 18 nt, Human
cauagugaugguuccccu

SEQ ID NO: 1632673 - RNA, 19 nt, Human
cauagucuggcuguaccca

SEQ ID NO: 1632674 - RNA, 15 nt, Human
cauaguaugguggcu

SEQ ID NO: 1632675 - RNA, 17 nt, Human
cauaguaugguggcugg

SEQ ID NO: 1632676 - RNA, 16 nt, Human
cauaguaugguggcug

SEQ ID NO: 1632677 - RNA, 14 nt, Human
caucaacaucuugg

SEQ ID NO: 1632678 - RNA, 22 nt, Human
caucccucccuccaccucccug

SEQ ID NO: 1632679 - RNA, 23 nt, Human
caucccucccuccaccucccugc

SEQ ID NO: 1632680 - RNA, 13 nt, Human
caucccuccuggg

SEQ ID NO: 1632681 - RNA, 15 nt, Human
caucccucuggggcu

SEQ ID NO: 1632682 - RNA, 18 nt, Human
caucccuuaccugggaaa

SEQ ID NO: 1632683 - RNA, 23 nt, Human
cauccacugugccaugugccagg

SEQ ID NO: 1632684 - RNA, 17 nt, Human
cauccacugugccaugu

SEQ ID NO: 1632685 - RNA, 14 nt, Human
cauccacugugcca

SEQ ID NO: 1632686 - RNA, 12 nt, Human
cauccauccagg

SEQ ID NO: 1632687 - RNA, 12 nt, Human
caucacccgcua

SEQ ID NO: 1632688 - RNA, 20 nt, Human
caucaccaacgucugugcca

SEQ ID NO: 1632689 - RNA, 15 nt, Human
caucaugucuggcua

SEQ ID NO: 1632690 - RNA, 14 nt, Human
caucaugucuggcu

SEQ ID NO: 1632691 - RNA, 13 nt, Human
caucaugucuggc

SEQ ID NO: 1632692 - RNA, 16 nt, Human
caucauccuaagcuau

SEQ ID NO: 1632693 - RNA, 15 nt, Human
cauguuugugauuga

SEQ ID NO: 1632694 - RNA, 20 nt, Human
cauguuuuucuucucccuca

SEQ ID NO: 1632695 - RNA, 19 nt, Human
cauguuuuucuucucccuc

SEQ ID NO: 1632696 - RNA, 12 nt, Human
cauguuugugau

SEQ ID NO: 1632697 - RNA, 14 nt, Human
cauguuugugauug

SEQ ID NO: 1632698 - RNA, 20 nt, Human
cauguuucuuuguaaugaaa

SEQ ID NO: 1632699 - RNA, 20 nt, Human
caugugcuaguaauuggaaa

SEQ ID NO: 1632700 - RNA, 14 nt, Human
caugugcacaugca

SEQ ID NO: 1632701 - RNA, 18 nt, Human
cauguguuggcagccucu

SEQ ID NO: 1632702 - RNA, 13 nt, Human
cauguuaaaccau

SEQ ID NO: 1632703 - RNA, 23 nt, Human
cauguuuauuacaguauaauuaa

SEQ ID NO: 1632704 - RNA, 22 nt, Human
cauguuaaaccaugggauaaau

SEQ ID NO: 1632705 - RNA, 21 nt, Human
caugugaugagaggaaaucac

SEQ ID NO: 1632706 - RNA, 20 nt, Human
caugugaugagaggaaauca

SEQ ID NO: 1632707 - RNA, 18 nt, Human
caugugaugagaggaaau

SEQ ID NO: 1632708 - RNA, 17 nt, Human
caugugaugagaggaaa

SEQ ID NO: 1632709 - RNA, 16 nt, Human
caugugaugagaggaa

SEQ ID NO: 1632710 - RNA, 15 nt, Human
caugugaugagagga

SEQ ID NO: 1632711 - RNA, 12 nt, Human
caugucuggcua

SEQ ID NO: 1632712 - RNA, 14 nt, Human
caugucucgacuca

SEQ ID NO: 1632713 - RNA, 17 nt, Human
cauggucggaaaacaug

SEQ ID NO: 1632714 - RNA, 19 nt, Human
cauggucggaaaacaugcu

SEQ ID NO: 1632715 - RNA, 23 nt, Human
cauggucggaaaacaugcuacac

SEQ ID NO: 1632716 - RNA, 18 nt, Human
caugggccuccugugugu

SEQ ID NO: 1632717 - RNA, 17 nt, Human
caugggauaaaugccau

SEQ ID NO: 1632718 - RNA, 16 nt, Human
caugggauaaaugcca

SEQ ID NO: 1632719 - RNA, 23 nt, Human
caugggauaaaugccaucaauaa

SEQ ID NO: 1632720 - RNA, 18 nt, Human
caugggauaaaugccauc

SEQ ID NO: 1632721 - RNA, 20 nt, Human
cauggaauuggagcucgugg

SEQ ID NO: 1632722 - RNA, 18 nt, Human
caugcuguucaugaaaga

SEQ ID NO: 1632723 - RNA, 16 nt, Human
caugcuguucaugaaa

SEQ ID NO: 1632724 - RNA, 15 nt, Human
cauggacuuccacug

SEQ ID NO: 1632725 - RNA, 22 nt, Human
cauggacuucugccagcauaau

SEQ ID NO: 1632726 - RNA, 17 nt, Human
caugcgggcuuccuccu

SEQ ID NO: 1632727 - RNA, 15 nt, Human
caugcugucccuuac

SEQ ID NO: 1632728 - RNA, 13 nt, Human
caugcugucccuu

SEQ ID NO: 1632729 - RNA, 17 nt, Human
caugcugucccuuacgu

SEQ ID NO: 1632730 - RNA, 15 nt, Human
caugcuguucaugaa

SEQ ID NO: 1632731 - RNA, 14 nt, Human
caugcagcaucuaa

SEQ ID NO: 1632732 - RNA, 15 nt, Human
cauugugggaagggg

SEQ ID NO: 1632733 - RNA, 21 nt, Human
cauuguaaaugugcuuuuaaa

SEQ ID NO: 1632734 - RNA, 15 nt, Human
cauuuaaaaaaaauc

SEQ ID NO: 1632735 - RNA, 17 nt, Human
cauugaccugaggcccu

SEQ ID NO: 1632736 - RNA, 15 nt, Human
cauugaccugaggcc

SEQ ID NO: 1632737 - RNA, 14 nt, Human
cauugaccugaggc

SEQ ID NO: 1632738 - RNA, 18 nt, Human
cauugaccugaggcccuu

SEQ ID NO: 1632739 - RNA, 17 nt, Human
cauuugaaaauuuugau

SEQ ID NO: 1632740 - RNA, 19 nt, Human
cauuugaaaauuuugaugu

SEQ ID NO: 1632741 - RNA, 17 nt, Human
cauuuuuaguagagaca

SEQ ID NO: 1632742 - RNA, 18 nt, Human
cauuuuuaguagagacag

SEQ ID NO: 1632743 - RNA, 21 nt, Human
cauuuuuaagugcugcauuua

SEQ ID NO: 1632744 - RNA, 16 nt, Human
ccaaacccuucagugc

SEQ ID NO: 1632745 - RNA, 23 nt, Human
cauuuuauuuuauuaugcaugaa

SEQ ID NO: 1632746 - RNA, 23 nt, Human
cauuuuaccuuugacaaagguaa

SEQ ID NO: 1632747 - RNA, 22 nt, Human
cauuuggaaaucuuuaaaaaaa

SEQ ID NO: 1632748 - RNA, 11 nt, Human
cauuuggaaau

SEQ ID NO: 1632749 - RNA, 18 nt, Human
cauuuggaaaucuuuaaa

SEQ ID NO: 1632750 - RNA, 17 nt, Human
cauuuggaaaucuuuaa

SEQ ID NO: 1632751 - RNA, 22 nt, Human
cauuccaacuaucucauuucca

SEQ ID NO: 1632752 - RNA, 17 nt, Human
cauuccaccuucccaug

SEQ ID NO: 1632753 - RNA, 22 nt, Human
cauuccaccuucccaugcccug

SEQ ID NO: 1632754 - RNA, 19 nt, Human
cauucauuuucuggguguu

SEQ ID NO: 1632755 - RNA, 21 nt, Human
cauucagauaugauucaaaug

SEQ ID NO: 1632756 - RNA, 19 nt, Human
cauuccccaggaggccagc

SEQ ID NO: 1632757 - RNA, 18 nt, Human
cauuccccaggaggccag

SEQ ID NO: 1632758 - RNA, 20 nt, Human
cauuccccaggaggccagcc

SEQ ID NO: 1632759 - RNA, 13 nt, Human
cauuccccauggg

SEQ ID NO: 1632760 - RNA, 17 nt, Human
cauuccccgucucuggu

SEQ ID NO: 1632761 - RNA, 17 nt, Human
cauuccccaggaggcca

SEQ ID NO: 1632762 - RNA, 15 nt, Human
cauuccccaggaggc

SEQ ID NO: 1632763 - RNA, 13 nt, Human
cauuccccaggag

SEQ ID NO: 1632764 - RNA, 20 nt, Human
cauucaaauguauuacagug

SEQ ID NO: 1632765 - RNA, 22 nt, Human
cauuauucaaaguugccuaaau

SEQ ID NO: 1632766 - RNA, 21 nt, Human
cauuauucaaaguugccuaaa

SEQ ID NO: 1632767 - RNA, 18 nt, Human
cauuauucaaaguugccu

SEQ ID NO: 1632768 - RNA, 13 nt, Human
cauucuggaauaa

SEQ ID NO: 1632769 - RNA, 17 nt, Human
cauucuguuaaucauua

SEQ ID NO: 1632770 - RNA, 20 nt, Human
cauucugccugcccaggccc

SEQ ID NO: 1632771 - RNA, 19 nt, Human
cauucugccugcccaggcc

SEQ ID NO: 1632772 - RNA, 18 nt, Human
cauucugccugcccaggc

SEQ ID NO: 1632773 - RNA, 17 nt, Human
cauucugccugcccagg

SEQ ID NO: 1632774 - RNA, 16 nt, Human
cauucugccugcccag

SEQ ID NO: 1632775 - RNA, 15 nt, Human
cauucugccugccca

SEQ ID NO: 1632776 - RNA, 13 nt, Human
cauucugccugcc

SEQ ID NO: 1632777 - RNA, 12 nt, Human
cauucugccugc

SEQ ID NO: 1632778 - RNA, 23 nt, Human
cauuccugaugcuucuucagaga

SEQ ID NO: 1632779 - RNA, 22 nt, Human
cauuccugaugcuucuucagag

SEQ ID NO: 1632780 - RNA, 19 nt, Human
cauuccugaugcuucuuca

SEQ ID NO: 1632781 - RNA, 16 nt, Human
cauuccugaugcuucu

SEQ ID NO: 1632782 - RNA, 14 nt, Human
cauuccugaugcuu

SEQ ID NO: 1632783 - RNA, 14 nt, Human
cauuccugaacagg

SEQ ID NO: 1632784 - RNA, 23 nt, Human
cauucuucuguacgucugacagg

SEQ ID NO: 1632785 - RNA, 19 nt, Human
ccaugggacagggaggacg

SEQ ID NO: 1632786 - RNA, 16 nt, Human
ccaugggacagggagg

SEQ ID NO: 1632787 - RNA, 13 nt, Human
ccaugggauaaau

SEQ ID NO: 1632788 - RNA, 17 nt, Human
ccauguuggccaggcug

SEQ ID NO: 1632789 - RNA, 17 nt, Human
ccaugggauaaaugcca

SEQ ID NO: 1632790 - RNA, 18 nt, Human
ccauguuggccaggcugg

SEQ ID NO: 1632791 - RNA, 21 nt, Human
ccauguuggccaggcugcucu

SEQ ID NO: 1632792 - RNA, 18 nt, Human
ccauguuggccaggcugc

SEQ ID NO: 1632793 - RNA, 22 nt, Human
ccauuauucaaaguugccuaaa

SEQ ID NO: 1632794 - RNA, 17 nt, Human
ccauuauucaaaguugc

SEQ ID NO: 1632795 - RNA, 20 nt, Human
ccauguuuauuacaguauaa

SEQ ID NO: 1632796 - RNA, 13 nt, Human
ccauguuuauuac

SEQ ID NO: 1632797 - RNA, 14 nt, Human
ccauuauucaaagu

SEQ ID NO: 1632798 - RNA, 16 nt, Human
ccaucuaaacugcccc

SEQ ID NO: 1632799 - RNA, 15 nt, Human
ccaucuaaacugccc

SEQ ID NO: 1632800 - RNA, 21 nt, Human
ccaugggaaaugucaacaagu

SEQ ID NO: 1632801 - RNA, 14 nt, Human
ccaucuaaacugcc

SEQ ID NO: 1632802 - RNA, 22 nt, Human
cccaaauggaaaugggcagagc

SEQ ID NO: 1632803 - RNA, 18 nt, Human
cccaaauggaaaugggca

SEQ ID NO: 1632804 - RNA, 23 nt, Human
cccaaauggaaaugggcagagca

SEQ ID NO: 1632805 - RNA, 16 nt, Human
cccaaagugcugggau

SEQ ID NO: 1632806 - RNA, 15 nt, Human
cccaacccuggcacc

SEQ ID NO: 1632807 - RNA, 17 nt, Human
cccaaggcucugagcaa

SEQ ID NO: 1632808 - RNA, 18 nt, Human
cccaaaacucuccucugc

SEQ ID NO: 1632809 - RNA, 16 nt, Human
cccaaaacucuccucu

SEQ ID NO: 1632810 - RNA, 20 nt, Human
cccaaaacucuccucugcug

SEQ ID NO: 1632811 - RNA, 15 nt, Human
cccaaagugcuggga

SEQ ID NO: 1632812 - RNA, 13 nt, Human
cccaaagugcugg

SEQ ID NO: 1632813 - RNA, 14 nt, Human
ccauuuguguuuau

SEQ ID NO: 1632814 - RNA, 20 nt, Human
ccauucuccaccugccaggg

SEQ ID NO: 1632815 - RNA, 19 nt, Human
ccauucuccaccugccagg

SEQ ID NO: 1632816 - RNA, 14 nt, Human
ccaguuauggcuau

SEQ ID NO: 1632817 - RNA, 21 nt, Human
ccaguuauggcuauaggugcu

SEQ ID NO: 1632818 - RNA, 23 nt, Human
ccauauucuguuggccaguguga

SEQ ID NO: 1632819 - RNA, 21 nt, Human
ccauaguaugggacuggccuc

SEQ ID NO: 1632820 - RNA, 12 nt, Human
ccauaggucacc

SEQ ID NO: 1632821 - RNA, 22 nt, Human
ccaguguuguggauuuaacaga

SEQ ID NO: 1632822 - RNA, 17 nt, Human
ccagugaggcucugccc

SEQ ID NO: 1632823 - RNA, 20 nt, Human
ccagugccgagaaggaagcc

SEQ ID NO: 1632824 - RNA, 22 nt, Human
ccagugguuccuaauccucuag

SEQ ID NO: 1632825 - RNA, 15 nt, Human
ccagugaggcucugc

SEQ ID NO: 1632826 - RNA, 14 nt, Human
ccagugaggcucug

SEQ ID NO: 1632827 - RNA, 16 nt, Human
ccagugaggcucugcc

SEQ ID NO: 1632828 - RNA, 13 nt, Human
ccaucuacccucc

SEQ ID NO: 1632829 - RNA, 21 nt, Human
ccaggcccucugcccacuccc

SEQ ID NO: 1632830 - RNA, 23 nt, Human
ccaggcccucugcccacucccug

SEQ ID NO: 1632831 - RNA, 22 nt, Human
ccaggcccucugcccacucccu

SEQ ID NO: 1632832 - RNA, 24 nt, Human
ccaggcuguaucccaugagccuca

SEQ ID NO: 1632833 - RNA, 17 nt, Human
ccaggcuuagucacuga

SEQ ID NO: 1632834 - RNA, 19 nt, Human
ccaggcgccccuucccccu

SEQ ID NO: 1632835 - RNA, 18 nt, Human
ccaggcgccccuuccccc

SEQ ID NO: 1632836 - RNA, 21 nt, Human
ccaggcauuccccaggaggcc

SEQ ID NO: 1632837 - RNA, 19 nt, Human
ccaggcauuccccaggagg

SEQ ID NO: 1632838 - RNA, 22 nt, Human
ccaggcauuccccaggaggcca

SEQ ID NO: 1632839 - RNA, 18 nt, Human
ccaggcauuccccaggag

SEQ ID NO: 1632840 - RNA, 12 nt, Human
ccaggagccucc

SEQ ID NO: 1632841 - RNA, 20 nt, Human
ccaggagccccgaggccuuc

SEQ ID NO: 1632842 - RNA, 19 nt, Human
ccaggagccccgaggccuu

SEQ ID NO: 1632843 - RNA, 16 nt, Human
ccagccuccaugcugc

SEQ ID NO: 1632844 - RNA, 15 nt, Human
ccagccuccaugcug

SEQ ID NO: 1632845 - RNA, 22 nt, Human
ccagggacagaggggguggccu

SEQ ID NO: 1632846 - RNA, 21 nt, Human
ccagggacagaggggguggcc

SEQ ID NO: 1632847 - RNA, 15 nt, Human
ccagggacagagggg

SEQ ID NO: 1632848 - RNA, 14 nt, Human
ccagggacagaggg

SEQ ID NO: 1632849 - RNA, 20 nt, Human
ccaggcuuagucacugagac

SEQ ID NO: 1632850 - RNA, 20 nt, Human
ccaggugcacaagcuccaag

SEQ ID NO: 1632851 - RNA, 19 nt, Human
ccaggugcacaagcuccaa

SEQ ID NO: 1632852 - RNA, 21 nt, Human
ccagggcuggaaugauuucag

SEQ ID NO: 1632853 - RNA, 20 nt, Human
ccagucuggaaugcaguggu

SEQ ID NO: 1632854 - RNA, 19 nt, Human
ccagucuggaaugcagugg

SEQ ID NO: 1632855 - RNA, 18 nt, Human
ccagucuggaaugcagug

SEQ ID NO: 1632856 - RNA, 24 nt, Human
ccaggugcacaagcuccaagcucc

SEQ ID NO: 1632857 - RNA, 17 nt, Human
ccagguuuuuggucuga

SEQ ID NO: 1632858 - RNA, 23 nt, Human
ccagcaguucagagcugcccucu

SEQ ID NO: 1632859 - RNA, 23 nt, Human
ccagcauaauacuugcuuuggaa

SEQ ID NO: 1632860 - RNA, 13 nt, Human
ccagcaguucaga

SEQ ID NO: 1632861 - RNA, 18 nt, Human
ccagcaguucagagcugc

SEQ ID NO: 1632862 - RNA, 19 nt, Human
ccagcaguucagagcugcc

SEQ ID NO: 1632863 - RNA, 20 nt, Human
ccagcaguucagagcugccc

SEQ ID NO: 1632864 - RNA, 21 nt, Human
ccagcaguucagagcugcccu

SEQ ID NO: 1632865 - RNA, 22 nt, Human
ccagcaguucagagcugcccuc

SEQ ID NO: 1632866 - RNA, 22 nt, Human
ccagccagcaguucagagcugc

SEQ ID NO: 1632867 - RNA, 19 nt, Human
ccagccaaagccuccucca

SEQ ID NO: 1632868 - RNA, 18 nt, Human
ccagccaaagccuccucc

SEQ ID NO: 1632869 - RNA, 15 nt, Human
ccagccaaagccucc

SEQ ID NO: 1632870 - RNA, 15 nt, Human
ccagccccagugccc

SEQ ID NO: 1632871 - RNA, 13 nt, Human
ccagccccagugc

SEQ ID NO: 1632872 - RNA, 23 nt, Human
ccagccccaaaacucuccucugc

SEQ ID NO: 1632873 - RNA, 17 nt, Human
ccagcccuuagcaggga

SEQ ID NO: 1632874 - RNA, 16 nt, Human
ccagcccuuagcaggg

SEQ ID NO: 1632875 - RNA, 21 nt, Human
ccagcccuccuuaucaaagga

SEQ ID NO: 1632876 - RNA, 16 nt, Human
ccagccccagugccca

SEQ ID NO: 1632877 - RNA, 19 nt, Human
ccagccgccaugcuccugg

SEQ ID NO: 1632878 - RNA, 18 nt, Human
ccagccgccaugcuccug

SEQ ID NO: 1632879 - RNA, 14 nt, Human
ccagccgccaugcu

SEQ ID NO: 1632880 - RNA, 21 nt, Human
ccagccuccaagcuccaucuc

SEQ ID NO: 1632881 - RNA, 15 nt, Human
ccagauuucacucuc

SEQ ID NO: 1632882 - RNA, 15 nt, Human
ccagcaagugagagc

SEQ ID NO: 1632883 - RNA, 14 nt, Human
ccagauuucacucu

SEQ ID NO: 1632884 - RNA, 22 nt, Human
ccagcaagugagagcugggugu

SEQ ID NO: 1632885 - RNA, 21 nt, Human
ccagcaagugagagcugggug

SEQ ID NO: 1632886 - RNA, 16 nt, Human
ccagcaagugagagcu

SEQ ID NO: 1632887 - RNA, 18 nt, Human
ccagcaauucuccugccu

SEQ ID NO: 1632888 - RNA, 16 nt, Human
ccagcaauucuccugc

SEQ ID NO: 1632889 - RNA, 21 nt, Human
ccagcaauucuccugccucag

SEQ ID NO: 1632890 - RNA, 20 nt, Human
ccagcaauucuccugccuca

SEQ ID NO: 1632891 - RNA, 19 nt, Human
ccagcaauucuccugccuc

SEQ ID NO: 1632892 - RNA, 22 nt, Human
ccagauucuuuccugaggcugg

SEQ ID NO: 1632893 - RNA, 21 nt, Human
ccagauucuuuccugaggcug

SEQ ID NO: 1632894 - RNA, 20 nt, Human
ccagauucuuuccugaggcu

SEQ ID NO: 1632895 - RNA, 19 nt, Human
ccagauucuuuccugaggc

SEQ ID NO: 1632896 - RNA, 18 nt, Human
ccagauucuuuccugagg

SEQ ID NO: 1632897 - RNA, 23 nt, Human
ccagagggagugacagaggcagc

SEQ ID NO: 1632898 - RNA, 22 nt, Human
ccagagggagugacagaggcag

SEQ ID NO: 1632899 - RNA, 13 nt, Human
ccagagggccugc

SEQ ID NO: 1632900 - RNA, 16 nt, Human
ccagagggccugcaag

SEQ ID NO: 1632901 - RNA, 15 nt, Human
ccagagggccugcaa

SEQ ID NO: 1632902 - RNA, 20 nt, Human
ccagauugcaacaggcuggg

SEQ ID NO: 1632903 - RNA, 19 nt, Human
ccagauugcaacaggcugg

SEQ ID NO: 1632904 - RNA, 23 nt, Human
ccagauucuuuccugaggcuggg

SEQ ID NO: 1632905 - RNA, 21 nt, Human
ccagauugcaacaggcugggc

SEQ ID NO: 1632906 - RNA, 13 nt, Human
ccagauuuaugca

SEQ ID NO: 1632907 - RNA, 12 nt, Human
ccagauuucacu

SEQ ID NO: 1632908 - RNA, 22 nt, Human
ccagauuuaugcauauuauuuu

SEQ ID NO: 1632909 - RNA, 22 nt, Human
ccagaggagagaggacccccug

SEQ ID NO: 1632910 - RNA, 21 nt, Human
ccagaggagagaggacccccu

SEQ ID NO: 1632911 - RNA, 21 nt, Human
ccagagggagugacagaggca

SEQ ID NO: 1632912 - RNA, 20 nt, Human
ccagagggagugacagaggc

SEQ ID NO: 1632913 - RNA, 19 nt, Human
ccagagggagugacagagg

SEQ ID NO: 1632914 - RNA, 18 nt, Human
ccagagggagugacagag

SEQ ID NO: 1632915 - RNA, 17 nt, Human
ccagagggagugacaga

SEQ ID NO: 1632916 - RNA, 16 nt, Human
ccagagggagugacag

SEQ ID NO: 1632917 - RNA, 19 nt, Human
ccagagcugccaccugccu

SEQ ID NO: 1632918 - RNA, 16 nt, Human
ccagagcugccaccug

SEQ ID NO: 1632919 - RNA, 15 nt, Human
ccagagcugccaccu

SEQ ID NO: 1632920 - RNA, 14 nt, Human
ccagagcugccacc

SEQ ID NO: 1632921 - RNA, 13 nt, Human
ccagagcugccac

SEQ ID NO: 1632922 - RNA, 12 nt, Human
ccagagcugcca

SEQ ID NO: 1632923 - RNA, 11 nt, Human
ccagagcugcc

SEQ ID NO: 1632924 - RNA, 19 nt, Human
ccagacaccuugacagggc

SEQ ID NO: 1632925 - RNA, 17 nt, Human
ccagacaccuugacagg

SEQ ID NO: 1632926 - RNA, 20 nt, Human
ccacuguacuugcucuugau

SEQ ID NO: 1632927 - RNA, 19 nt, Human
ccacuguacuugcucuuga

SEQ ID NO: 1632928 - RNA, 18 nt, Human
ccacuguacuugcucuug

SEQ ID NO: 1632929 - RNA, 17 nt, Human
ccacuguacuugcucuu

SEQ ID NO: 1632930 - RNA, 14 nt, Human
ccagagaggguggu

SEQ ID NO: 1632931 - RNA, 23 nt, Human
ccagagaggguggugaccucugc

SEQ ID NO: 1632932 - RNA, 21 nt, Human
ccagagaggguggugaccucu

SEQ ID NO: 1632933 - RNA, 20 nt, Human
ccagacaccuugacagggca

SEQ ID NO: 1632934 - RNA, 14 nt, Human
ccaccucccugcaa

SEQ ID NO: 1632935 - RNA, 17 nt, Human
ccaccucccacaaagga

SEQ ID NO: 1632936 - RNA, 20 nt, Human
ccaccugccuguugggccag

SEQ ID NO: 1632937 - RNA, 17 nt, Human
ccaccugccuguugggc

SEQ ID NO: 1632938 - RNA, 12 nt, Human
ccaccugccagg

SEQ ID NO: 1632939 - RNA, 14 nt, Human
ccaccugcccaacc

SEQ ID NO: 1632940 - RNA, 15 nt, Human
ccacggccaggccag

SEQ ID NO: 1632941 - RNA, 14 nt, Human
ccacggccaggcca

SEQ ID NO: 1632942 - RNA, 13 nt, Human
ccacggccaggcc

SEQ ID NO: 1632943 - RNA, 12 nt, Human
ccacggccaggc

SEQ ID NO: 1632944 - RNA, 18 nt, Human
ccaccuggccucugcacu

SEQ ID NO: 1632945 - RNA, 17 nt, Human
ccaccuggccucugcac

SEQ ID NO: 1632946 - RNA, 16 nt, Human
ccaccuggccucugca

SEQ ID NO: 1632947 - RNA, 15 nt, Human
ccaccuggccucugc

SEQ ID NO: 1632948 - RNA, 22 nt, Human
ccaccugcggugcuaucucccc

SEQ ID NO: 1632949 - RNA, 14 nt, Human
ccacccaggagccc

SEQ ID NO: 1632950 - RNA, 12 nt, Human
ccacccaggagc

SEQ ID NO: 1632951 - RNA, 15 nt, Human
ccaccucagccuccc

SEQ ID NO: 1632952 - RNA, 14 nt, Human
ccaccucagccucc

SEQ ID NO: 1632953 - RNA, 13 nt, Human
ccaccucagccuc

SEQ ID NO: 1632954 - RNA, 12 nt, Human
ccaccucagccu

SEQ ID NO: 1632955 - RNA, 18 nt, Human
ccacccugaaagcccuga

SEQ ID NO: 1632956 - RNA, 17 nt, Human
ccacccugaaagcccug

SEQ ID NO: 1632957 - RNA, 16 nt, Human
ccacccugaaagcccu

SEQ ID NO: 1632958 - RNA, 19 nt, Human
ccaccccucaacaccucug

SEQ ID NO: 1632959 - RNA, 13 nt, Human
ccacguuucuaaa

SEQ ID NO: 1632960 - RNA, 22 nt, Human
ccacuacggaauaguuggcuag

SEQ ID NO: 1632961 - RNA, 18 nt, Human
ccacuacauucuguuaau

SEQ ID NO: 1632962 - RNA, 23 nt, Human
ccacuacggaauaguuggcuagg

SEQ ID NO: 1632963 - RNA, 13 nt, Human
ccacucccugcaa

SEQ ID NO: 1632964 - RNA, 12 nt, Human
ccacucccugca

SEQ ID NO: 1632965 - RNA, 20 nt, Human
ccacuccagaccccuggcuu

SEQ ID NO: 1632966 - RNA, 19 nt, Human
ccacuccagaccccuggcu

SEQ ID NO: 1632967 - RNA, 17 nt, Human
ccacuccagaccccugg

SEQ ID NO: 1632968 - RNA, 20 nt, Human
ccacugcacuccagccuggg

SEQ ID NO: 1632969 - RNA, 19 nt, Human
ccacugcacuccagccugg

SEQ ID NO: 1632970 - RNA, 15 nt, Human
ccacucccugcaacc

SEQ ID NO: 1632971 - RNA, 23 nt, Human
ccacugcacuccagccuggguga

SEQ ID NO: 1632972 - RNA, 11 nt, Human
ccacugcucug

SEQ ID NO: 1632973 - RNA, 16 nt, Human
ccacugcgaccacaag

SEQ ID NO: 1632974 - RNA, 11 nt, Human
ccacugccucu

SEQ ID NO: 1632975 - RNA, 21 nt, Human
ccacccaggagccccgaggcc

SEQ ID NO: 1632976 - RNA, 23 nt, Human
ccacaucuugcucugcugacaga

SEQ ID NO: 1632977 - RNA, 22 nt, Human
ccacaucuugcucugcugacag

SEQ ID NO: 1632978 - RNA, 17 nt, Human
ccacaucuugcucugcu

SEQ ID NO: 1632979 - RNA, 16 nt, Human
ccacaucuugcucugc

SEQ ID NO: 1632980 - RNA, 18 nt, Human
ccaccaacauacucccau

SEQ ID NO: 1632981 - RNA, 14 nt, Human
ccaccaacauacuc

SEQ ID NO: 1632982 - RNA, 14 nt, Human
ccacaucuugcucu

SEQ ID NO: 1632983 - RNA, 23 nt, Human
ccacauagugaugguuccccugu

SEQ ID NO: 1632984 - RNA, 22 nt, Human
ccacauagugaugguuccccug

SEQ ID NO: 1632985 - RNA, 21 nt, Human
ccacauagugaugguuccccu

SEQ ID NO: 1632986 - RNA, 19 nt, Human
ccacauagugaugguuccc

SEQ ID NO: 1632987 - RNA, 13 nt, Human
ccacccaccucag

SEQ ID NO: 1632988 - RNA, 22 nt, Human
ccacccaagggccuggccugag

SEQ ID NO: 1632989 - RNA, 21 nt, Human
ccacccaagggccuggccuga

SEQ ID NO: 1632990 - RNA, 20 nt, Human
ccacccaagggccuggccug

SEQ ID NO: 1632991 - RNA, 15 nt, Human
ccacccaccucagcc

SEQ ID NO: 1632992 - RNA, 14 nt, Human
ccacccaccucagc

SEQ ID NO: 1632993 - RNA, 16 nt, Human
ccacccaccucagccu

SEQ ID NO: 1632994 - RNA, 16 nt, Human
ccaccacacccagccc

SEQ ID NO: 1632995 - RNA, 14 nt, Human
ccaccacacccagc

SEQ ID NO: 1632996 - RNA, 20 nt, Human
ccaccaacauacucccaucu

SEQ ID NO: 1632997 - RNA, 19 nt, Human
ccacccaagggccuggccu

SEQ ID NO: 1632998 - RNA, 17 nt, Human
ccacccaagggccuggc

SEQ ID NO: 1632999 - RNA, 16 nt, Human
ccacccaagggccugg

SEQ ID NO: 1633000 - RNA, 14 nt, Human
ccacacccagccca

SEQ ID NO: 1633001 - RNA, 13 nt, Human
ccacacccagccc

SEQ ID NO: 1633002 - RNA, 15 nt, Human
ccacacccagcccac

SEQ ID NO: 1633003 - RNA, 13 nt, Human
ccacacuccagcu

SEQ ID NO: 1633004 - RNA, 17 nt, Human
ccacacuccagcuggga

SEQ ID NO: 1633005 - RNA, 14 nt, Human
ccacacuccagcug

SEQ ID NO: 1633006 - RNA, 12 nt, Human
ccacacccagcc

SEQ ID NO: 1633007 - RNA, 21 nt, Human
ccugcacggugaauggcuuug

SEQ ID NO: 1633008 - RNA, 20 nt, Human
ccugcacggugaauggcuuu

SEQ ID NO: 1633009 - RNA, 16 nt, Human
ccugcaauaaaauggg

SEQ ID NO: 1633010 - RNA, 14 nt, Human
ccugcaagaacaag

SEQ ID NO: 1633011 - RNA, 20 nt, Human
ccugcaguacuuuaccuccu

SEQ ID NO: 1633012 - RNA, 18 nt, Human
ccugcaguacuuuaccuc

SEQ ID NO: 1633013 - RNA, 15 nt, Human
ccugcagggccaagc

SEQ ID NO: 1633014 - RNA, 15 nt, Human
ccugauugugucucu

SEQ ID NO: 1633015 - RNA, 14 nt, Human
ccugaggcccuucu

SEQ ID NO: 1633016 - RNA, 22 nt, Human
ccugaugcuucuucagagacuc

SEQ ID NO: 1633017 - RNA, 21 nt, Human
ccugaugcuucuucagagacu

SEQ ID NO: 1633018 - RNA, 20 nt, Human
ccugaugcuucuucagagac

SEQ ID NO: 1633019 - RNA, 19 nt, Human
ccugaugcuucuucagaga

SEQ ID NO: 1633020 - RNA, 12 nt, Human
ccugaggcccuu

SEQ ID NO: 1633021 - RNA, 11 nt, Human
ccugaggcccu

SEQ ID NO: 1633022 - RNA, 21 nt, Human
ccugcaaccugauugugucuc

SEQ ID NO: 1633023 - RNA, 22 nt, Human
ccugcaaccugauugugucucu

SEQ ID NO: 1633024 - RNA, 19 nt, Human
ccugauugugucucuuggu

SEQ ID NO: 1633025 - RNA, 17 nt, Human
ccugauugugucucuug

SEQ ID NO: 1633026 - RNA, 22 nt, Human
ccugccaggaagccagcaggcu

SEQ ID NO: 1633027 - RNA, 21 nt, Human
ccugccaggaagccagcaggc

SEQ ID NO: 1633028 - RNA, 19 nt, Human
ccugccaggaagccagcag

SEQ ID NO: 1633029 - RNA, 18 nt, Human
ccugccaggaagccagca

SEQ ID NO: 1633030 - RNA, 11 nt, Human
ccugccaggga

SEQ ID NO: 1633031 - RNA, 16 nt, Human
ccugccaggcauggug

SEQ ID NO: 1633032 - RNA, 23 nt, Human
ccugccaggaagccagcaggcuc

SEQ ID NO: 1633033 - RNA, 15 nt, Human
ccugccagggacaga

SEQ ID NO: 1633034 - RNA, 14 nt, Human
ccugccagggacag

SEQ ID NO: 1633035 - RNA, 13 nt, Human
ccugccagggaca

SEQ ID NO: 1633036 - RNA, 12 nt, Human
ccugccagggac

SEQ ID NO: 1633037 - RNA, 16 nt, Human
ccugccagggacagag

SEQ ID NO: 1633038 - RNA, 22 nt, Human
ccugccagggacagagggggug

SEQ ID NO: 1633039 - RNA, 17 nt, Human
ccugccaggaagccagc

SEQ ID NO: 1633040 - RNA, 15 nt, Human
ccugccaggaagcca

SEQ ID NO: 1633041 - RNA, 14 nt, Human
ccugccaggaagcc

SEQ ID NO: 1633042 - RNA, 13 nt, Human
ccugccaggaagc

SEQ ID NO: 1633043 - RNA, 11 nt, Human
ccugagcccca

SEQ ID NO: 1633044 - RNA, 14 nt, Human
ccugagcuuucugc

SEQ ID NO: 1633045 - RNA, 12 nt, Human
ccugagccagau

SEQ ID NO: 1633046 - RNA, 16 nt, Human
ccugagcuuucugcua

SEQ ID NO: 1633047 - RNA, 21 nt, Human
ccugaggcccagagggccugc

SEQ ID NO: 1633048 - RNA, 16 nt, Human
ccugacagaaggacuc

SEQ ID NO: 1633049 - RNA, 23 nt, Human
ccuggaaaucaggguuaguauug

SEQ ID NO: 1633050 - RNA, 14 nt, Human
ccugcuucaaauau

SEQ ID NO: 1633051 - RNA, 15 nt, Human
ccugcugagucccag

SEQ ID NO: 1633052 - RNA, 23 nt, Human
ccugcuuugggcugcccuggugc

SEQ ID NO: 1633053 - RNA, 22 nt, Human
ccugcuuugggcugcccuggug

SEQ ID NO: 1633054 - RNA, 21 nt, Human
ccugcuuugggcugcccuggu

SEQ ID NO: 1633055 - RNA, 20 nt, Human
ccugcuuugggcugcccugg

SEQ ID NO: 1633056 - RNA, 22 nt, Human
ccugcucuccgaccagacaccu

SEQ ID NO: 1633057 - RNA, 21 nt, Human
ccugcucuccucuugccacug

SEQ ID NO: 1633058 - RNA, 19 nt, Human
ccugcucuccucuugccac

SEQ ID NO: 1633059 - RNA, 18 nt, Human
ccugcucuccucuugcca

SEQ ID NO: 1633060 - RNA, 16 nt, Human
ccugcucuccucuugc

SEQ ID NO: 1633061 - RNA, 22 nt, Human
ccugcucuccucuugccacugc

SEQ ID NO: 1633062 - RNA, 21 nt, Human
ccugcucuccgaccagacacc

SEQ ID NO: 1633063 - RNA, 22 nt, Human
ccugcggugcuaucucccccag

SEQ ID NO: 1633064 - RNA, 17 nt, Human
ccugcggugcuaucucc

SEQ ID NO: 1633065 - RNA, 16 nt, Human
ccugcggugcuaucuc

SEQ ID NO: 1633066 - RNA, 22 nt, Human
ccugcgggucacaggagggagg

SEQ ID NO: 1633067 - RNA, 18 nt, Human
ccugcgggucacaggagg

SEQ ID NO: 1633068 - RNA, 14 nt, Human
ccugccccccagcc

SEQ ID NO: 1633069 - RNA, 22 nt, Human
ccugccccucaacucuccucca

SEQ ID NO: 1633070 - RNA, 23 nt, Human
ccugccuguugggccaggagccu

SEQ ID NO: 1633071 - RNA, 11 nt, Human
ccugccucagc

SEQ ID NO: 1633072 - RNA, 21 nt, Human
ccuggucacaggacucugccu

SEQ ID NO: 1633073 - RNA, 23 nt, Human
ccuggucacaggacucugccucc

SEQ ID NO: 1633074 - RNA, 22 nt, Human
ccuggucacaggacucugccuc

SEQ ID NO: 1633075 - RNA, 18 nt, Human
ccuggggguucuuucuuc

SEQ ID NO: 1633076 - RNA, 23 nt, Human
ccuggggguucuuucuuccucug

SEQ ID NO: 1633077 - RNA, 22 nt, Human
ccuggggguucuuucuuccucu

SEQ ID NO: 1633078 - RNA, 21 nt, Human
ccuggggguucuuucuuccuc

SEQ ID NO: 1633079 - RNA, 24 nt, Human
ccuggcuuuucacugcuggcugcc

SEQ ID NO: 1633080 - RNA, 23 nt, Human
ccuggcuuuucacugcuggcugc

SEQ ID NO: 1633081 - RNA, 22 nt, Human
ccuggcuuuucacugcuggcug

SEQ ID NO: 1633082 - RNA, 21 nt, Human
ccuggcuuuucacugcuggcu

SEQ ID NO: 1633083 - RNA, 20 nt, Human
ccuggcuuuucacugcuggc

SEQ ID NO: 1633084 - RNA, 20 nt, Human
ccuggccagaugcaccagcc

SEQ ID NO: 1633085 - RNA, 15 nt, Human
ccuggccagaugcac

SEQ ID NO: 1633086 - RNA, 22 nt, Human
ccuggcagccgugccuucagcu

SEQ ID NO: 1633087 - RNA, 23 nt, Human
ccuggcucccacaggcccuuccu

SEQ ID NO: 1633088 - RNA, 17 nt, Human
ccuggcucccacaggcc

SEQ ID NO: 1633089 - RNA, 13 nt, Human
ccuggcagccccu

SEQ ID NO: 1633090 - RNA, 14 nt, Human
ccuggcagccccug

SEQ ID NO: 1633091 - RNA, 12 nt, Human
ccuggcagcccc

SEQ ID NO: 1633092 - RNA, 22 nt, Human
ccuggcacuauaauguaagcuc

SEQ ID NO: 1633093 - RNA, 23 nt, Human
ccuggcacccggccccugcuggu

SEQ ID NO: 1633094 - RNA, 22 nt, Human
ccuggcacccggccccugcugg

SEQ ID NO: 1633095 - RNA, 18 nt, Human
ccuggaauauauaaccag

SEQ ID NO: 1633096 - RNA, 14 nt, Human
cgaacuggcugcaa

SEQ ID NO: 1633097 - RNA, 12 nt, Human
cgaacuggcugc

SEQ ID NO: 1633098 - RNA, 14 nt, Human
cgaacuccugaccu

SEQ ID NO: 1633099 - RNA, 19 nt, Human
cgaaagggacuuggaagcu

SEQ ID NO: 1633100 - RNA, 20 nt, Human
cgaaaggaugaaagugacca

SEQ ID NO: 1633101 - RNA, 22 nt, Human
cgaaagggacuuggaagcuccg

SEQ ID NO: 1633102 - RNA, 12 nt, Human
cgaaagaacagu

SEQ ID NO: 1633103 - RNA, 21 nt, Human
cgaaagaacaguccauugaaa

SEQ ID NO: 1633104 - RNA, 19 nt, Human
cgaaaacguggcugcuuca

SEQ ID NO: 1633105 - RNA, 18 nt, Human
cgaaaacguggcugcuuc

SEQ ID NO: 1633106 - RNA, 15 nt, Human
cgaaaacguggcugc

SEQ ID NO: 1633107 - RNA, 20 nt, Human
cgaaaacguggcugcuucaa

SEQ ID NO: 1633108 - RNA, 21 nt, Human
ccuuugacgccaucccagccc

SEQ ID NO: 1633109 - RNA, 20 nt, Human
ccuuugacgccaucccagcc

SEQ ID NO: 1633110 - RNA, 22 nt, Human
ccuuugacgccaucccagcccc

SEQ ID NO: 1633111 - RNA, 23 nt, Human
ccuuugacgccaucccagcccca

SEQ ID NO: 1633112 - RNA, 18 nt, Human
cgagcaggcuacugucag

SEQ ID NO: 1633113 - RNA, 20 nt, Human
cgagcaggcuucuucccccc

SEQ ID NO: 1633114 - RNA, 17 nt, Human
cgagcaugccuggaugg

SEQ ID NO: 1633115 - RNA, 16 nt, Human
cgagcaugccuggaug

SEQ ID NO: 1633116 - RNA, 13 nt, Human
cgagcaugccugg

SEQ ID NO: 1633117 - RNA, 20 nt, Human
cgagauugcaccacugcacu

SEQ ID NO: 1633118 - RNA, 20 nt, Human
cgagaucacgccacugcacu

SEQ ID NO: 1633119 - RNA, 18 nt, Human
cgagaucacgccacugca

SEQ ID NO: 1633120 - RNA, 14 nt, Human
cgaauagcugggac

SEQ ID NO: 1633121 - RNA, 13 nt, Human
cgaauagcuggga

SEQ ID NO: 1633122 - RNA, 15 nt, Human
cgaauagcugggacu

SEQ ID NO: 1633123 - RNA, 17 nt, Human
cgagaaacagccugugu

SEQ ID NO: 1633124 - RNA, 17 nt, Human
cgagaucacgccacugc

SEQ ID NO: 1633125 - RNA, 18 nt, Human
cgagauagccaaggccaa

SEQ ID NO: 1633126 - RNA, 17 nt, Human
cgccaugcuccuggccc

SEQ ID NO: 1633127 - RNA, 14 nt, Human
cgcagcccugcaga

SEQ ID NO: 1633128 - RNA, 10 nt, Human
cgcagcccug

SEQ ID NO: 1633129 - RNA, 16 nt, Human
cgcagacaggaccagg

SEQ ID NO: 1633130 - RNA, 15 nt, Human
cgcagacaggaccag

SEQ ID NO: 1633131 - RNA, 21 nt, Human
cgccagauucuuuccugaggc

SEQ ID NO: 1633132 - RNA, 20 nt, Human
cgccagauucuuuccugagg

SEQ ID NO: 1633133 - RNA, 19 nt, Human
cgccagauucuuuccugag

SEQ ID NO: 1633134 - RNA, 15 nt, Human
cgcagcccugcagag

SEQ ID NO: 1633135 - RNA, 22 nt, Human
cgccaggggaaaaucagccugc

SEQ ID NO: 1633136 - RNA, 16 nt, Human
cgagcccugguggcag

SEQ ID NO: 1633137 - RNA, 15 nt, Human
cgagcccugguggca

SEQ ID NO: 1633138 - RNA, 18 nt, Human
cgagcaugccuggauggg

SEQ ID NO: 1633139 - RNA, 18 nt, Human
cgagcccugguggcagug

SEQ ID NO: 1633140 - RNA, 20 nt, Human
cgauuucuguuuagauaaua

SEQ ID NO: 1633141 - RNA, 14 nt, Human
cgagcaugccugga

SEQ ID NO: 1633142 - RNA, 14 nt, Human
ccuucuguggcuca

SEQ ID NO: 1633143 - RNA, 21 nt, Human
ccuucuguggcucacagaacc

SEQ ID NO: 1633144 - RNA, 16 nt, Human
ccuucggccuccaucc

SEQ ID NO: 1633145 - RNA, 15 nt, Human
ccuucggcgccuuaa

SEQ ID NO: 1633146 - RNA, 19 nt, Human
ccuucuccuucaccuuugu

SEQ ID NO: 1633147 - RNA, 15 nt, Human
ccuucuccuucaccu

SEQ ID NO: 1633148 - RNA, 13 nt, Human
ccuugacucuuuc

SEQ ID NO: 1633149 - RNA, 23 nt, Human
ccuugaccauucuccaccugcca

SEQ ID NO: 1633150 - RNA, 20 nt, Human
ccuugaguugauucagcucu

SEQ ID NO: 1633151 - RNA, 13 nt, Human
ccuugaacuagga

SEQ ID NO: 1633152 - RNA, 19 nt, Human
ccuuggggcugaugcaguu

SEQ ID NO: 1633153 - RNA, 22 nt, Human
ccuugguuaggcauugugggaa

SEQ ID NO: 1633154 - RNA, 21 nt, Human
ccuugguuaggcauuguggga

SEQ ID NO: 1633155 - RNA, 22 nt, Human
ccuuggugucgggcaugacacg

SEQ ID NO: 1633156 - RNA, 12 nt, Human
ccuugggacccc

SEQ ID NO: 1633157 - RNA, 18 nt, Human
ccuuugacgccaucccag

SEQ ID NO: 1633158 - RNA, 17 nt, Human
ccuuugacgccauccca

SEQ ID NO: 1633159 - RNA, 16 nt, Human
ccuuugacgccauccc

SEQ ID NO: 1633160 - RNA, 20 nt, Human
ccuucggccuccauccugag

SEQ ID NO: 1633161 - RNA, 19 nt, Human
ccuucggccuccauccuga

SEQ ID NO: 1633162 - RNA, 14 nt, Human
ccuucggccuccau

SEQ ID NO: 1633163 - RNA, 15 nt, Human
ccuucgauacaccgg

SEQ ID NO: 1633164 - RNA, 22 nt, Human
ccuucauuuggcauuccccacu

SEQ ID NO: 1633165 - RNA, 14 nt, Human
ccuuccucugaggc

SEQ ID NO: 1633166 - RNA, 13 nt, Human
ccuuccucugagg

SEQ ID NO: 1633167 - RNA, 20 nt, Human
ccuuccucugagccuuggga

SEQ ID NO: 1633168 - RNA, 21 nt, Human
ccuuccucuccacugccuucg

SEQ ID NO: 1633169 - RNA, 16 nt, Human
ccuuccucugagccuu

SEQ ID NO: 1633170 - RNA, 15 nt, Human
ccuuccucugagccu

SEQ ID NO: 1633171 - RNA, 12 nt, Human
ccuucagccuga

SEQ ID NO: 1633172 - RNA, 14 nt, Human
ccuucagugccaaa

SEQ ID NO: 1633173 - RNA, 11 nt, Human
ccuucagugcc

SEQ ID NO: 1633174 - RNA, 20 nt, Human
ccuucaccuuuguccccacc

SEQ ID NO: 1633175 - RNA, 19 nt, Human
ccuucaccuuuguccccac

SEQ ID NO: 1633176 - RNA, 17 nt, Human
ccuucacagaugggugc

SEQ ID NO: 1633177 - RNA, 14 nt, Human
ccuuagacaguccc

SEQ ID NO: 1633178 - RNA, 21 nt, Human
ccuucaccuuuguccccaccg

SEQ ID NO: 1633179 - RNA, 14 nt, Human
ccuucacuuaggaa

SEQ ID NO: 1633180 - RNA, 21 nt, Human
ccuguuaaaagaugaaaauau

SEQ ID NO: 1633181 - RNA, 20 nt, Human
ccuguuaaaagaugaaaaua

SEQ ID NO: 1633182 - RNA, 15 nt, Human
ccuguuuaagagaca

SEQ ID NO: 1633183 - RNA, 12 nt, Human
ccuguuuaagag

SEQ ID NO: 1633184 - RNA, 23 nt, Human
ccuguugggccaggagccuccug

SEQ ID NO: 1633185 - RNA, 18 nt, Human
ccuguuuguuucugaaag

SEQ ID NO: 1633186 - RNA, 14 nt, Human
ccuguuuguuucug

SEQ ID NO: 1633187 - RNA, 16 nt, Human
ccuguuucugcagcca

SEQ ID NO: 1633188 - RNA, 21 nt, Human
ccugugucuugcaauggcagc

SEQ ID NO: 1633189 - RNA, 19 nt, Human
ccugugucuugcaauggca

SEQ ID NO: 1633190 - RNA, 17 nt, Human
ccugugucuugcaaugg

SEQ ID NO: 1633191 - RNA, 22 nt, Human
ccugugucuugcaauggcagcc

SEQ ID NO: 1633192 - RNA, 22 nt, Human
ccugugucuuuaaaugcugcuu

SEQ ID NO: 1633193 - RNA, 21 nt, Human
ccugugugugcgccuacagga

SEQ ID NO: 1633194 - RNA, 20 nt, Human
ccugugugugcgccuacagg

SEQ ID NO: 1633195 - RNA, 20 nt, Human
ccuuaccagcagagcaccuu

SEQ ID NO: 1633196 - RNA, 20 nt, Human
ccuuaccacugcucugauga

SEQ ID NO: 1633197 - RNA, 15 nt, Human
ccuuacccucauguu

SEQ ID NO: 1633198 - RNA, 13 nt, Human
ccuuaccagcaga

SEQ ID NO: 1633199 - RNA, 17 nt, Human
ccuuaccacugcucuga

SEQ ID NO: 1633200 - RNA, 19 nt, Human
ccuuaccugccaggaagcc

SEQ ID NO: 1633201 - RNA, 19 nt, Human
ccuuacccucauguucuua

SEQ ID NO: 1633202 - RNA, 18 nt, Human
ccuuagaagucacacagu

SEQ ID NO: 1633203 - RNA, 17 nt, Human
ccuuagaagucacacag

SEQ ID NO: 1633204 - RNA, 20 nt, Human
ccuuacacaaugguuuucuu

SEQ ID NO: 1633205 - RNA, 14 nt, Human
ccuuacacaauggu

SEQ ID NO: 1633206 - RNA, 17 nt, Human
ccuuaaagaguguggca

SEQ ID NO: 1633207 - RNA, 12 nt, Human
ccuucagugccu

SEQ ID NO: 1633208 - RNA, 16 nt, Human
ccgggcguggugguga

SEQ ID NO: 1633209 - RNA, 20 nt, Human
ccgggcgcgguggcucacgc

SEQ ID NO: 1633210 - RNA, 13 nt, Human
ccgggcucugccu

SEQ ID NO: 1633211 - RNA, 19 nt, Human
ccgggcugggagcucugca

SEQ ID NO: 1633212 - RNA, 18 nt, Human
ccgggcugggagcucugc

SEQ ID NO: 1633213 - RNA, 13 nt, Human
ccgggcugggagc

SEQ ID NO: 1633214 - RNA, 16 nt, Human
ccgugcuaaggacuug

SEQ ID NO: 1633215 - RNA, 15 nt, Human
ccgugcuaaggacuu

SEQ ID NO: 1633216 - RNA, 12 nt, Human
ccgcuuucuacc

SEQ ID NO: 1633217 - RNA, 22 nt, Human
ccgcucagcccucccugccccu

SEQ ID NO: 1633218 - RNA, 21 nt, Human
ccgcucagcccucccugcccc

SEQ ID NO: 1633219 - RNA, 19 nt, Human
ccgcucagcccucccugcc

SEQ ID NO: 1633220 - RNA, 15 nt, Human
ccgcucagcccuccc

SEQ ID NO: 1633221 - RNA, 18 nt, Human
ccggcuggccuggccccu

SEQ ID NO: 1633222 - RNA, 17 nt, Human
ccggcuggccuggcccc

SEQ ID NO: 1633223 - RNA, 23 nt, Human
ccgcuuucuacccagcgagcccu

SEQ ID NO: 1633224 - RNA, 19 nt, Human
ccgcuuucuacccagcgag

SEQ ID NO: 1633225 - RNA, 20 nt, Human
ccgggaagggggcugggaca

SEQ ID NO: 1633226 - RNA, 19 nt, Human
ccgcacugggcuuggggac

SEQ ID NO: 1633227 - RNA, 14 nt, Human
ccgcacugggcuug

SEQ ID NO: 1633228 - RNA, 23 nt, Human
ccgcuaagagggagggagggcuc

SEQ ID NO: 1633229 - RNA, 13 nt, Human
ccgcucagcccuc

SEQ ID NO: 1633230 - RNA, 12 nt, Human
ccgcucagcccu

SEQ ID NO: 1633231 - RNA, 11 nt, Human
ccgcucagccc

SEQ ID NO: 1633232 - RNA, 21 nt, Human
ccgcuaagagggagggagggc

SEQ ID NO: 1633233 - RNA, 17 nt, Human
ccgaguagcugggacua

SEQ ID NO: 1633234 - RNA, 17 nt, Human
ccgaggccuucucugaa

SEQ ID NO: 1633235 - RNA, 20 nt, Human
ccgaguagcugggacuacag

SEQ ID NO: 1633236 - RNA, 17 nt, Human
cccugguuuccugcccu

SEQ ID NO: 1633237 - RNA, 16 nt, Human
cccugguuuccugccc

SEQ ID NO: 1633238 - RNA, 20 nt, Human
cccugguggcagcucaccuc

SEQ ID NO: 1633239 - RNA, 14 nt, Human
ccgaggccuucucu

SEQ ID NO: 1633240 - RNA, 19 nt, Human
cccugguuuccugcccugg

SEQ ID NO: 1633241 - RNA, 18 nt, Human
cccugguuuccugcccug

SEQ ID NO: 1633242 - RNA, 15 nt, Human
ccuaaaauucagugg

SEQ ID NO: 1633243 - RNA, 16 nt, Human
ccuaaauauauuuuaa

SEQ ID NO: 1633244 - RNA, 18 nt, Human
ccuaaauauauuuuaaga

SEQ ID NO: 1633245 - RNA, 12 nt, Human
ccuaaauccauu

SEQ ID NO: 1633246 - RNA, 15 nt, Human
ccuacaagacacagu

SEQ ID NO: 1633247 - RNA, 18 nt, Human
ccuaaauccauuuggaaa

SEQ ID NO: 1633248 - RNA, 17 nt, Human
ccuaaauccauuuggaa

SEQ ID NO: 1633249 - RNA, 18 nt, Human
ccuauauuguuuucagug

SEQ ID NO: 1633250 - RNA, 22 nt, Human
ccuauauuguuuucaguguaca

SEQ ID NO: 1633251 - RNA, 23 nt, Human
ccuaguuccaccaucaagccacc

SEQ ID NO: 1633252 - RNA, 21 nt, Human
ccuaguuccaccaucaagcca

SEQ ID NO: 1633253 - RNA, 13 nt, Human
ccuaguuccacca

SEQ ID NO: 1633254 - RNA, 15 nt, Human
ccuacuuccugugac

SEQ ID NO: 1633255 - RNA, 13 nt, Human
ccuacuuccugug

SEQ ID NO: 1633256 - RNA, 23 nt, Human
ccuaccgagucucuucuccacug

SEQ ID NO: 1633257 - RNA, 22 nt, Human
ccuaccgagucucuucuccacu

SEQ ID NO: 1633258 - RNA, 13 nt, Human
ccuccaccucccu

SEQ ID NO: 1633259 - RNA, 14 nt, Human
ccuccaccucccug

SEQ ID NO: 1633260 - RNA, 15 nt, Human
ccuccaccucccugc

SEQ ID NO: 1633261 - RNA, 17 nt, Human
ccuccaccucccugcaa

SEQ ID NO: 1633262 - RNA, 22 nt, Human
ccuccaccucccugcaauaaaa

SEQ ID NO: 1633263 - RNA, 21 nt, Human
ccuccaggugcacaagcucca

SEQ ID NO: 1633264 - RNA, 19 nt, Human
ccuccaggugcacaagcuc

SEQ ID NO: 1633265 - RNA, 22 nt, Human
ccuccaggugcacaagcuccaa

SEQ ID NO: 1633266 - RNA, 18 nt, Human
ccuccaucuaaacugccc

SEQ ID NO: 1633267 - RNA, 16 nt, Human
ccucccaaagugcugg

SEQ ID NO: 1633268 - RNA, 15 nt, Human
ccucccaaagugcug

SEQ ID NO: 1633269 - RNA, 16 nt, Human
ccuccaugcugccucc

SEQ ID NO: 1633270 - RNA, 15 nt, Human
ccuccaugcugccuc

SEQ ID NO: 1633271 - RNA, 23 nt, Human
ccuccaugugggcuaguugggcu

SEQ ID NO: 1633272 - RNA, 14 nt, Human
ccuccaugcugccu

SEQ ID NO: 1633273 - RNA, 14 nt, Human
ccucaucaccaacg

SEQ ID NO: 1633274 - RNA, 13 nt, Human
ccucaucaccaac

SEQ ID NO: 1633275 - RNA, 22 nt, Human
ccucauaguaugguggcugggu

SEQ ID NO: 1633276 - RNA, 21 nt, Human
ccucauaguaugguggcuggg

SEQ ID NO: 1633277 - RNA, 13 nt, Human
ccucauacccacc

SEQ ID NO: 1633278 - RNA, 18 nt, Human
ccucauagcccucacccu

SEQ ID NO: 1633279 - RNA, 17 nt, Human
ccucauagcccucaccc

SEQ ID NO: 1633280 - RNA, 20 nt, Human
ccucauaguaugguggcugg

SEQ ID NO: 1633281 - RNA, 22 nt, Human
ccucauagcccucacccugggg

SEQ ID NO: 1633282 - RNA, 21 nt, Human
ccucauagcccucacccuggg

SEQ ID NO: 1633283 - RNA, 11 nt, Human
ccucagugcca

SEQ ID NO: 1633284 - RNA, 20 nt, Human
ccucagucuggcccuuccuu

SEQ ID NO: 1633285 - RNA, 19 nt, Human
ccuaugcagagguccacaa

SEQ ID NO: 1633286 - RNA, 20 nt, Human
ccucauccucauacccaccc

SEQ ID NO: 1633287 - RNA, 13 nt, Human
ccucauccucaua

SEQ ID NO: 1633288 - RNA, 21 nt, Human
ccucaucuccccaucauuggu

SEQ ID NO: 1633289 - RNA, 23 nt, Human
ccuccaaucccaccaacccucag

SEQ ID NO: 1633290 - RNA, 17 nt, Human
ccucccuccaccucccu

SEQ ID NO: 1633291 - RNA, 10 nt, Human
ccucccuccc

SEQ ID NO: 1633292 - RNA, 20 nt, Human
ccucccuccaccucccugca

SEQ ID NO: 1633293 - RNA, 21 nt, Human
ccucccugccccucccuucaa

SEQ ID NO: 1633294 - RNA, 18 nt, Human
ccucccugccccucccuu

SEQ ID NO: 1633295 - RNA, 14 nt, Human
ccuccucagaucuu

SEQ ID NO: 1633296 - RNA, 24 nt, Human
ccucccugccccucccuucaacca

SEQ ID NO: 1633297 - RNA, 22 nt, Human
ccucccugccccucccuucaac

SEQ ID NO: 1633298 - RNA, 21 nt, Human
ccucccgaguagcugggacua

SEQ ID NO: 1633299 - RNA, 20 nt, Human
ccucccgaguagcugggacu

SEQ ID NO: 1633300 - RNA, 16 nt, Human
ccuccucugcuugcca

SEQ ID NO: 1633301 - RNA, 13 nt, Human
ccuccucugcuug

SEQ ID NO: 1633302 - RNA, 18 nt, Human
ccuccucugcuugccauc

SEQ ID NO: 1633303 - RNA, 14 nt, Human
ccuccugggcuaag

SEQ ID NO: 1633304 - RNA, 13 nt, Human
ccuccugcugggc

SEQ ID NO: 1633305 - RNA, 23 nt, Human
ccuccugccucgaacuggcugca

SEQ ID NO: 1633306 - RNA, 18 nt, Human
ccucgguguggagaagcg

SEQ ID NO: 1633307 - RNA, 14 nt, Human
ccucgguguggaga

SEQ ID NO: 1633308 - RNA, 16 nt, Human
ccucggugccuuccuc

SEQ ID NO: 1633309 - RNA, 16 nt, Human
ccucuaggaggucucu

SEQ ID NO: 1633310 - RNA, 17 nt, Human
ccucccgaauagcuggg

SEQ ID NO: 1633311 - RNA, 15 nt, Human
cccgugggguuccuc

SEQ ID NO: 1633312 - RNA, 22 nt, Human
cccgucucugguuccuccccuc

SEQ ID NO: 1633313 - RNA, 18 nt, Human
cccggugcccaagaauag

SEQ ID NO: 1633314 - RNA, 16 nt, Human
cccgggcucugccucc

SEQ ID NO: 1633315 - RNA, 20 nt, Human
cccuacaguugaaaaacagc

SEQ ID NO: 1633316 - RNA, 23 nt, Human
cccuaaugcgcaggcuggcccug

SEQ ID NO: 1633317 - RNA, 17 nt, Human
cccuaaugcgcaggcug

SEQ ID NO: 1633318 - RNA, 22 nt, Human
cccuaaugcgcaggcuggcccu

SEQ ID NO: 1633319 - RNA, 21 nt, Human
cccuaaugcgcaggcuggccc

SEQ ID NO: 1633320 - RNA, 18 nt, Human
cccuaccgagucucuucu

SEQ ID NO: 1633321 - RNA, 21 nt, Human
cccuaccgagucucuucucca

SEQ ID NO: 1633322 - RNA, 22 nt, Human
cccgaguagcugggacuacagg

SEQ ID NO: 1633323 - RNA, 20 nt, Human
cccgcugucagccauuccug

SEQ ID NO: 1633324 - RNA, 19 nt, Human
cccgcugucagccauuccu

SEQ ID NO: 1633325 - RNA, 15 nt, Human
cccgggcucugccuc

SEQ ID NO: 1633326 - RNA, 14 nt, Human
cccgggcucugccu

SEQ ID NO: 1633327 - RNA, 12 nt, Human
cccgggcucugc

SEQ ID NO: 1633328 - RNA, 21 nt, Human
cccgaguagcugggacuacag

SEQ ID NO: 1633329 - RNA, 18 nt, Human
cccgaguagcugggacua

SEQ ID NO: 1633330 - RNA, 17 nt, Human
cccgaguagcugggacu

SEQ ID NO: 1633331 - RNA, 16 nt, Human
cccgaguagcugggac

SEQ ID NO: 1633332 - RNA, 15 nt, Human
cccgaguagcuggga

SEQ ID NO: 1633333 - RNA, 14 nt, Human
cccgaguagcuggg

SEQ ID NO: 1633334 - RNA, 13 nt, Human
cccgaguagcugg

SEQ ID NO: 1633335 - RNA, 18 nt, Human
cccagagggccugcaagg

SEQ ID NO: 1633336 - RNA, 15 nt, Human
cccagagggccugca

SEQ ID NO: 1633337 - RNA, 14 nt, Human
cccagagggccugc

SEQ ID NO: 1633338 - RNA, 14 nt, Human
cccucuccugggca

SEQ ID NO: 1633339 - RNA, 15 nt, Human
cccucuccugggcag

SEQ ID NO: 1633340 - RNA, 11 nt, Human
cccucuccugg

SEQ ID NO: 1633341 - RNA, 12 nt, Human
cccucuccuggg

SEQ ID NO: 1633342 - RNA, 13 nt, Human
cccucuccugggc

SEQ ID NO: 1633343 - RNA, 14 nt, Human
cccuccaccucccu

SEQ ID NO: 1633344 - RNA, 12 nt, Human
cccuccaccucc

SEQ ID NO: 1633345 - RNA, 22 nt, Human
cccuauccuacuuccccuuccu

SEQ ID NO: 1633346 - RNA, 19 nt, Human
cccuccaccucccugcaau

SEQ ID NO: 1633347 - RNA, 15 nt, Human
cccuccaccucccug

SEQ ID NO: 1633348 - RNA, 17 nt, Human
cccuccaccucccugca

SEQ ID NO: 1633349 - RNA, 23 nt, Human
cccugaggcccagagggccugca

SEQ ID NO: 1633350 - RNA, 20 nt, Human
cccugaggcccagagggccu

SEQ ID NO: 1633351 - RNA, 19 nt, Human
cccugaggcccagagggcc

SEQ ID NO: 1633352 - RNA, 18 nt, Human
cccugaggcccagagggc

SEQ ID NO: 1633353 - RNA, 17 nt, Human
cccugaggcccagaggg

SEQ ID NO: 1633354 - RNA, 16 nt, Human
cccugaggcccagagg

SEQ ID NO: 1633355 - RNA, 15 nt, Human
cccugaggcccagag

SEQ ID NO: 1633356 - RNA, 14 nt, Human
cccugaggcccaga

SEQ ID NO: 1633357 - RNA, 16 nt, Human
cccugaaagcccugag

SEQ ID NO: 1633358 - RNA, 13 nt, Human
cccugaggcccag

SEQ ID NO: 1633359 - RNA, 15 nt, Human
cccugaaagcccuga

SEQ ID NO: 1633360 - RNA, 16 nt, Human
cccucuggggcuguuc

SEQ ID NO: 1633361 - RNA, 12 nt, Human
cccugcacuugc

SEQ ID NO: 1633362 - RNA, 19 nt, Human
cccugcacuugcagacucu

SEQ ID NO: 1633363 - RNA, 22 nt, Human
cccugcacuugcagacucuaca

SEQ ID NO: 1633364 - RNA, 15 nt, Human
cccugcaaagcccag

SEQ ID NO: 1633365 - RNA, 23 nt, Human
cccugcacaaagcccuuccaugu

SEQ ID NO: 1633366 - RNA, 20 nt, Human
cccugcaaagcccagcuuga

SEQ ID NO: 1633367 - RNA, 19 nt, Human
cccugcaaagcccagcuug

SEQ ID NO: 1633368 - RNA, 17 nt, Human
cccugcaaagcccagcu

SEQ ID NO: 1633369 - RNA, 16 nt, Human
cccugcaaagcccagc

SEQ ID NO: 1633370 - RNA, 17 nt, Human
cccugguggcagcucac

SEQ ID NO: 1633371 - RNA, 16 nt, Human
cccugguggcagcuca

SEQ ID NO: 1633372 - RNA, 15 nt, Human
cccugguggcagcuc

SEQ ID NO: 1633373 - RNA, 15 nt, Human
cccugggaggcucug

SEQ ID NO: 1633374 - RNA, 15 nt, Human
cccuggacugugugc

SEQ ID NO: 1633375 - RNA, 21 nt, Human
cccuggacugugugcucagga

SEQ ID NO: 1633376 - RNA, 18 nt, Human
cccuggcuuuucacugcu

SEQ ID NO: 1633377 - RNA, 18 nt, Human
cccugggaggcagugaug

SEQ ID NO: 1633378 - RNA, 22 nt, Human
cccuggcuuuucacugcuggcu

SEQ ID NO: 1633379 - RNA, 19 nt, Human
cccuggcuuuucacugcug

SEQ ID NO: 1633380 - RNA, 22 nt, Human
cccugcuggguguggcgcagca

SEQ ID NO: 1633381 - RNA, 19 nt, Human
cccugcuuugggcugcccu

SEQ ID NO: 1633382 - RNA, 18 nt, Human
cccugcuuugggcugccc

SEQ ID NO: 1633383 - RNA, 17 nt, Human
cccugcuuugggcugcc

SEQ ID NO: 1633384 - RNA, 17 nt, Human
cccugcuuucagauacu

SEQ ID NO: 1633385 - RNA, 22 nt, Human
cccugcuuugggcugcccuggu

SEQ ID NO: 1633386 - RNA, 20 nt, Human
cccugcuuugggcugcccug

SEQ ID NO: 1633387 - RNA, 17 nt, Human
cccugcccaccuggccu

SEQ ID NO: 1633388 - RNA, 14 nt, Human
cccugcccaccugg

SEQ ID NO: 1633389 - RNA, 21 nt, Human
cccugcuggguguggcgcagc

SEQ ID NO: 1633390 - RNA, 16 nt, Human
cccugcuggguguggc

SEQ ID NO: 1633391 - RNA, 18 nt, Human
cccugcccaccuggccuc

SEQ ID NO: 1633392 - RNA, 13 nt, Human
cccacaagaaaug

SEQ ID NO: 1633393 - RNA, 23 nt, Human
cccaaugcacuuuguucuggcuc

SEQ ID NO: 1633394 - RNA, 20 nt, Human
cccaaugcacuuuguucugg

SEQ ID NO: 1633395 - RNA, 16 nt, Human
cccaaugcacuuuguu

SEQ ID NO: 1633396 - RNA, 20 nt, Human
cccacaagaaaugaaagcag

SEQ ID NO: 1633397 - RNA, 21 nt, Human
cccacgacugcccggcagggu

SEQ ID NO: 1633398 - RNA, 20 nt, Human
cccacgacugcccggcaggg

SEQ ID NO: 1633399 - RNA, 21 nt, Human
cccaccuggccucugcacucc

SEQ ID NO: 1633400 - RNA, 19 nt, Human
cccaccuggccucugcacu

SEQ ID NO: 1633401 - RNA, 17 nt, Human
cccaccuggccucugca

SEQ ID NO: 1633402 - RNA, 12 nt, Human
cccacuucugcc

SEQ ID NO: 1633403 - RNA, 23 nt, Human
cccacuugagaauuacccuuuug

SEQ ID NO: 1633404 - RNA, 21 nt, Human
cccacgcuggagugcagugag

SEQ ID NO: 1633405 - RNA, 20 nt, Human
cccacgcuggagugcaguga

SEQ ID NO: 1633406 - RNA, 19 nt, Human
cccacgcuggagugcagug

SEQ ID NO: 1633407 - RNA, 20 nt, Human
cccaccgcagacaggaccag

SEQ ID NO: 1633408 - RNA, 19 nt, Human
cccaccgcagacaggacca

SEQ ID NO: 1633409 - RNA, 18 nt, Human
cccaccaucaugucuggc

SEQ ID NO: 1633410 - RNA, 22 nt, Human
cccaccucucucacuccuugaa

SEQ ID NO: 1633411 - RNA, 23 nt, Human
cccaccgggcugggagcucugca

SEQ ID NO: 1633412 - RNA, 22 nt, Human
cugugaaaggaaagagggaggu

SEQ ID NO: 1633413 - RNA, 16 nt, Human
cugugaaaggaaagag

SEQ ID NO: 1633414 - RNA, 21 nt, Human
cugugauggggcccugccucc

SEQ ID NO: 1633415 - RNA, 16 nt, Human
cugugauggggcccug

SEQ ID NO: 1633416 - RNA, 23 nt, Human
cugugauggggcccugccuccuu

SEQ ID NO: 1633417 - RNA, 15 nt, Human
cugugauggggcccu

SEQ ID NO: 1633418 - RNA, 15 nt, Human
cugugccaugugcca

SEQ ID NO: 1633419 - RNA, 19 nt, Human
cugugcccuaaaguguauu

SEQ ID NO: 1633420 - RNA, 14 nt, Human
cugugccaugugcc

SEQ ID NO: 1633421 - RNA, 18 nt, Human
cugucuucacaacagauu

SEQ ID NO: 1633422 - RNA, 18 nt, Human
cugucuucaguaagccgu

SEQ ID NO: 1633423 - RNA, 15 nt, Human
cugugaaaggaaaga

SEQ ID NO: 1633424 - RNA, 21 nt, Human
cugucuuuuuucuaaaguaaa

SEQ ID NO: 1633425 - RNA, 23 nt, Human
cugucuugccuuuuucauuauuu

SEQ ID NO: 1633426 - RNA, 21 nt, Human
cugucuugccuuuuucauuau

SEQ ID NO: 1633427 - RNA, 22 nt, Human
cugucauuugagcagggcucag

SEQ ID NO: 1633428 - RNA, 21 nt, Human
cugucauuugagcagggcuca

SEQ ID NO: 1633429 - RNA, 19 nt, Human
cugucaauuacaggaagua

SEQ ID NO: 1633430 - RNA, 18 nt, Human
cugucaauuacaggaagu

SEQ ID NO: 1633431 - RNA, 23 nt, Human
cugucauuugagcagggcucagc

SEQ ID NO: 1633432 - RNA, 16 nt, Human
cuguuaaaagaugaaa

SEQ ID NO: 1633433 - RNA, 15 nt, Human
cuguuaaaagaugaa

SEQ ID NO: 1633434 - RNA, 19 nt, Human
cuguuaaaagaugaaaaua

SEQ ID NO: 1633435 - RNA, 18 nt, Human
cugugugugcgccuacag

SEQ ID NO: 1633436 - RNA, 20 nt, Human
cugugucuuuuuucacuaca

SEQ ID NO: 1633437 - RNA, 21 nt, Human
cugugucuuuaaaugcugcuu

SEQ ID NO: 1633438 - RNA, 20 nt, Human
cugugucuuuaaaugcugcu

SEQ ID NO: 1633439 - RNA, 19 nt, Human
cugugucuuuaaaugcugc

SEQ ID NO: 1633440 - RNA, 14 nt, Human
cugugugcucagga

SEQ ID NO: 1633441 - RNA, 22 nt, Human
cuguggguuucuaaagcugcca

SEQ ID NO: 1633442 - RNA, 12 nt, Human
cuguggugacuu

SEQ ID NO: 1633443 - RNA, 14 nt, Human
cuguggugacuuug

SEQ ID NO: 1633444 - RNA, 13 nt, Human
cuguggugacuuu

SEQ ID NO: 1633445 - RNA, 23 nt, Human
cuguggugacuuuggauaauaag

SEQ ID NO: 1633446 - RNA, 20 nt, Human
cuguggugacuuuggauaau

SEQ ID NO: 1633447 - RNA, 18 nt, Human
cuguggugacuuuggaua

SEQ ID NO: 1633448 - RNA, 17 nt, Human
cuguggugacuuuggau

SEQ ID NO: 1633449 - RNA, 15 nt, Human
cuguggugacuuugg

SEQ ID NO: 1633450 - RNA, 21 nt, Human
cuguggguuucuaaagcugcc

SEQ ID NO: 1633451 - RNA, 17 nt, Human
cugugccucugccuguc

SEQ ID NO: 1633452 - RNA, 16 nt, Human
cugugccucugccugu

SEQ ID NO: 1633453 - RNA, 15 nt, Human
cugugccucugccug

SEQ ID NO: 1633454 - RNA, 14 nt, Human
cugugccucugccu

SEQ ID NO: 1633455 - RNA, 13 nt, Human
cugugccucugcc

SEQ ID NO: 1633456 - RNA, 12 nt, Human
cugugccucugc

SEQ ID NO: 1633457 - RNA, 24 nt, Human
cuguggaucaaauccagccugcug

SEQ ID NO: 1633458 - RNA, 14 nt, Human
cuguggaucaaauc

SEQ ID NO: 1633459 - RNA, 21 nt, Human
cugggauuacaagcgugagcc

SEQ ID NO: 1633460 - RNA, 18 nt, Human
cugggauuacaggcguga

SEQ ID NO: 1633461 - RNA, 23 nt, Human
cugggccccugccucucugcagg

SEQ ID NO: 1633462 - RNA, 20 nt, Human
cugggccccugccucucugc

SEQ ID NO: 1633463 - RNA, 20 nt, Human
cuggguaacuagggaagaua

SEQ ID NO: 1633464 - RNA, 13 nt, Human
cugggucgcccug

SEQ ID NO: 1633465 - RNA, 23 nt, Human
cuggggguucuuucuuccucugc

SEQ ID NO: 1633466 - RNA, 20 nt, Human
cuggggguucuuucuuccuc

SEQ ID NO: 1633467 - RNA, 14 nt, Human
cugggguuaucuga

SEQ ID NO: 1633468 - RNA, 16 nt, Human
cugggucgcccuggac

SEQ ID NO: 1633469 - RNA, 15 nt, Human
cugggucgcccugga

SEQ ID NO: 1633470 - RNA, 18 nt, Human
cugggcuugucuguagau

SEQ ID NO: 1633471 - RNA, 22 nt, Human
cugggcuuggggaccagagcug

SEQ ID NO: 1633472 - RNA, 15 nt, Human
cugggcuucaguggc

SEQ ID NO: 1633473 - RNA, 17 nt, Human
cugggcuucaguggcag

SEQ ID NO: 1633474 - RNA, 14 nt, Human
cugggggcugggca

SEQ ID NO: 1633475 - RNA, 18 nt, Human
cugggggcugggcagagg

SEQ ID NO: 1633476 - RNA, 16 nt, Human
cugggggccucuucug

SEQ ID NO: 1633477 - RNA, 18 nt, Human
cuguacgucugacaggca

SEQ ID NO: 1633478 - RNA, 16 nt, Human
cuguacgucugacagg

SEQ ID NO: 1633479 - RNA, 15 nt, Human
cuguacgucugacag

SEQ ID NO: 1633480 - RNA, 14 nt, Human
cuguacgucugaca

SEQ ID NO: 1633481 - RNA, 17 nt, Human
cuguacaugaaaacaca

SEQ ID NO: 1633482 - RNA, 20 nt, Human
cuguacaugaaaacacauuu

SEQ ID NO: 1633483 - RNA, 21 nt, Human
cuguacaugaaaacacauuuu

SEQ ID NO: 1633484 - RNA, 20 nt, Human
cuguacgucugacaggcaau

SEQ ID NO: 1633485 - RNA, 19 nt, Human
cuguacgucugacaggcaa

SEQ ID NO: 1633486 - RNA, 14 nt, Human
cuguacuccuccca

SEQ ID NO: 1633487 - RNA, 21 nt, Human
cuguacuccucccaggcgccc

SEQ ID NO: 1633488 - RNA, 19 nt, Human
cuguacuccucccaggcgc

SEQ ID NO: 1633489 - RNA, 16 nt, Human
cuguacuccucccagg

SEQ ID NO: 1633490 - RNA, 15 nt, Human
cuguacuccucccag

SEQ ID NO: 1633491 - RNA, 16 nt, Human
cugucaauuacaggaa

SEQ ID NO: 1633492 - RNA, 15 nt, Human
cugucaauuacagga

SEQ ID NO: 1633493 - RNA, 20 nt, Human
cuguauuuuguuuuugucuu

SEQ ID NO: 1633494 - RNA, 20 nt, Human
cuguaucccaugagccucag

SEQ ID NO: 1633495 - RNA, 22 nt, Human
cuguaucccaugagccucagca

SEQ ID NO: 1633496 - RNA, 21 nt, Human
cuguaucccaugagccucagc

SEQ ID NO: 1633497 - RNA, 19 nt, Human
cuguauuagucacagagau

SEQ ID NO: 1633498 - RNA, 17 nt, Human
cuguauuagucacagag

SEQ ID NO: 1633499 - RNA, 21 nt, Human
cugguuagagguucccuuuga

SEQ ID NO: 1633500 - RNA, 22 nt, Human
cugguuagagguucccuuugac

SEQ ID NO: 1633501 - RNA, 19 nt, Human
cuguaauccuagcacuuug

SEQ ID NO: 1633502 - RNA, 22 nt, Human
cuguacagagcccacgccccca

SEQ ID NO: 1633503 - RNA, 18 nt, Human
cuguacagagcccacgcc

SEQ ID NO: 1633504 - RNA, 15 nt, Human
cuguacagagcccac

SEQ ID NO: 1633505 - RNA, 14 nt, Human
cuguacagagccca

SEQ ID NO: 1633506 - RNA, 14 nt, Human
cuguaauuugugau

SEQ ID NO: 1633507 - RNA, 15 nt, Human
cuguaauuugugaua

SEQ ID NO: 1633508 - RNA, 19 nt, Human
cugguggcagugggagcug

SEQ ID NO: 1633509 - RNA, 21 nt, Human
cugguggcagcucaccucucc

SEQ ID NO: 1633510 - RNA, 15 nt, Human
cugguguauguguga

SEQ ID NO: 1633511 - RNA, 18 nt, Human
cugguggcagugggagcu

SEQ ID NO: 1633512 - RNA, 14 nt, Human
cugguggcaguggg

SEQ ID NO: 1633513 - RNA, 15 nt, Human
cugguggcagcugcg

SEQ ID NO: 1633514 - RNA, 20 nt, Human
cugguggcagcucaccucuc

SEQ ID NO: 1633515 - RNA, 18 nt, Human
cugguggcagcucaccuc

SEQ ID NO: 1633516 - RNA, 17 nt, Human
cugguggcagcucaccu

SEQ ID NO: 1633517 - RNA, 15 nt, Human
cuguuuuauaauuuu

SEQ ID NO: 1633518 - RNA, 14 nt, Human
cuguuuuauaauuu

SEQ ID NO: 1633519 - RNA, 22 nt, Human
cuguuuuacaaaaaagaaaaga

SEQ ID NO: 1633520 - RNA, 13 nt, Human
cuguuuucucuug

SEQ ID NO: 1633521 - RNA, 17 nt, Human
cuuaaaaaguggaaaaa

SEQ ID NO: 1633522 - RNA, 16 nt, Human
cuuaaaaaguggaaaa

SEQ ID NO: 1633523 - RNA, 19 nt, Human
cuguuugcuaagugaggau

SEQ ID NO: 1633524 - RNA, 17 nt, Human
cuguuugcuaagugagg

SEQ ID NO: 1633525 - RNA, 18 nt, Human
cuguuuagauaauacacc

SEQ ID NO: 1633526 - RNA, 15 nt, Human
cuguuucaaacuuua

SEQ ID NO: 1633527 - RNA, 17 nt, Human
cuguuucaaacuuuacu

SEQ ID NO: 1633528 - RNA, 17 nt, Human
cuguuuagauaauacac

SEQ ID NO: 1633529 - RNA, 17 nt, Human
cuguugcccaggcuggc

SEQ ID NO: 1633530 - RNA, 18 nt, Human
cuguugcccaggcuggcg

SEQ ID NO: 1633531 - RNA, 15 nt, Human
cuguucuuuccaaag

SEQ ID NO: 1633532 - RNA, 16 nt, Human
cuguucuuuccaaagu

SEQ ID NO: 1633533 - RNA, 19 nt, Human
cuguucuuuccaaaguaca

SEQ ID NO: 1633534 - RNA, 21 nt, Human
cuguucuuuccaaaguacacu

SEQ ID NO: 1633535 - RNA, 13 nt, Human
cuguucuuucugg

SEQ ID NO: 1633536 - RNA, 14 nt, Human
cuguucuuucuggc

SEQ ID NO: 1633537 - RNA, 21 nt, Human
cuguucuuucuggcuaugcau

SEQ ID NO: 1633538 - RNA, 16 nt, Human
cuguuaauaguucagg

SEQ ID NO: 1633539 - RNA, 16 nt, Human
cuguugcccaggcugg

SEQ ID NO: 1633540 - RNA, 15 nt, Human
cuguugcccaggcug

SEQ ID NO: 1633541 - RNA, 14 nt, Human
cuguugcccaggcu

SEQ ID NO: 1633542 - RNA, 13 nt, Human
cuguugcccaggc

SEQ ID NO: 1633543 - RNA, 12 nt, Human
cuguugcccagg

SEQ ID NO: 1633544 - RNA, 23 nt, Human
cuguucuuucuggcuaugcauuu

SEQ ID NO: 1633545 - RNA, 17 nt, Human
cuuaauuaaaagaauau

SEQ ID NO: 1633546 - RNA, 16 nt, Human
cuuaauuaaaagaaua

SEQ ID NO: 1633547 - RNA, 20 nt, Human
cuuaauuaaaagaauauuuu

SEQ ID NO: 1633548 - RNA, 19 nt, Human
cuuaauuaaaagaauauuu

SEQ ID NO: 1633549 - RNA, 20 nt, Human
cuuaauucuuagcucauucu

SEQ ID NO: 1633550 - RNA, 12 nt, Human
cuuaaaaauggu

SEQ ID NO: 1633551 - RNA, 23 nt, Human
cuuaagaagacugcauuauauuu

SEQ ID NO: 1633552 - RNA, 18 nt, Human
cuuaagaauuuugagcag

SEQ ID NO: 1633553 - RNA, 17 nt, Human
cuuaaccagaucauugu

SEQ ID NO: 1633554 - RNA, 20 nt, Human
cuuagaagucacacaguauu

SEQ ID NO: 1633555 - RNA, 17 nt, Human
cuuagaagucacacagu

SEQ ID NO: 1633556 - RNA, 16 nt, Human
cuuagaaauugcauuu

SEQ ID NO: 1633557 - RNA, 20 nt, Human
cuuagaaaaaccaccaccau

SEQ ID NO: 1633558 - RNA, 13 nt, Human
cuuacuguacaug

SEQ ID NO: 1633559 - RNA, 20 nt, Human
cuuaccugccaggaagccag

SEQ ID NO: 1633560 - RNA, 23 nt, Human
cuuagguuggcaaaaaggcagga

SEQ ID NO: 1633561 - RNA, 14 nt, Human
cuuagucacugaga

SEQ ID NO: 1633562 - RNA, 11 nt, Human
cuuagacaguc

SEQ ID NO: 1633563 - RNA, 19 nt, Human
cuuagaauuaguggcacuu

SEQ ID NO: 1633564 - RNA, 18 nt, Human
cuuagaaguuuguuguga

SEQ ID NO: 1633565 - RNA, 20 nt, Human
cuucggccuccauccugagg

SEQ ID NO: 1633566 - RNA, 19 nt, Human
cuucgggaggucgaggcag

SEQ ID NO: 1633567 - RNA, 21 nt, Human
cuucucacugccaugccagcu

SEQ ID NO: 1633568 - RNA, 16 nt, Human
cuucucacugccaugc

SEQ ID NO: 1633569 - RNA, 17 nt, Human
cuucgcuccugugucuu

SEQ ID NO: 1633570 - RNA, 15 nt, Human
cuucgccaccugggu

SEQ ID NO: 1633571 - RNA, 21 nt, Human
cuucgauacaccgggccugga

SEQ ID NO: 1633572 - RNA, 14 nt, Human
cuucgccaccuggg

SEQ ID NO: 1633573 - RNA, 16 nt, Human
cuuccacaagagccca

SEQ ID NO: 1633574 - RNA, 15 nt, Human
cuucccccuccaauc

SEQ ID NO: 1633575 - RNA, 12 nt, Human
cuucccccucca

SEQ ID NO: 1633576 - RNA, 16 nt, Human
cuuccugugacuucag

SEQ ID NO: 1633577 - RNA, 13 nt, Human
cuuccugugacuu

SEQ ID NO: 1633578 - RNA, 14 nt, Human
cuucacaacagauu

SEQ ID NO: 1633579 - RNA, 12 nt, Human
cuucacaacaga

SEQ ID NO: 1633580 - RNA, 22 nt, Human
cuucaaggauccugagccagau

SEQ ID NO: 1633581 - RNA, 21 nt, Human
cuucaaggauccugagccaga

SEQ ID NO: 1633582 - RNA, 23 nt, Human
cuucaaggauccugagccagauu

SEQ ID NO: 1633583 - RNA, 14 nt, Human
cuucacauauugau

SEQ ID NO: 1633584 - RNA, 23 nt, Human
cuucacauauugauuuccguuaa

SEQ ID NO: 1633585 - RNA, 17 nt, Human
cuucagcaaaaauauuu

SEQ ID NO: 1633586 - RNA, 17 nt, Human
cuucaaauccuugaaga

SEQ ID NO: 1633587 - RNA, 21 nt, Human
cuuagucacugagacagcccg

SEQ ID NO: 1633588 - RNA, 22 nt, Human
cuuagucacugagacagcccgg

SEQ ID NO: 1633589 - RNA, 20 nt, Human
cuucaaggauccugagccag

SEQ ID NO: 1633590 - RNA, 19 nt, Human
cuucaaggauccugagcca

SEQ ID NO: 1633591 - RNA, 18 nt, Human
cuucaaggauccugagcc

SEQ ID NO: 1633592 - RNA, 17 nt, Human
cuucaaggauccugagc

SEQ ID NO: 1633593 - RNA, 17 nt, Human
cuucaacugaccagccu

SEQ ID NO: 1633594 - RNA, 23 nt, Human
cuucaacugaccagccuccaugc

SEQ ID NO: 1633595 - RNA, 20 nt, Human
cuucaacugaccagccucca

SEQ ID NO: 1633596 - RNA, 15 nt, Human
cuucagccugaaaga

SEQ ID NO: 1633597 - RNA, 20 nt, Human
cuucagccucccgaguagcu

SEQ ID NO: 1633598 - RNA, 16 nt, Human
cuucagccucccgagu

SEQ ID NO: 1633599 - RNA, 14 nt, Human
cuucagccucccga

SEQ ID NO: 1633600 - RNA, 23 nt, Human
cuucagcaaaaauauuuuaugau

SEQ ID NO: 1633601 - RNA, 20 nt, Human
cuucagcaaaaauauuuuau

SEQ ID NO: 1633602 - RNA, 16 nt, Human
cuucagcgguuuauau

SEQ ID NO: 1633603 - RNA, 19 nt, Human
cuucagcugacuuuucugu

SEQ ID NO: 1633604 - RNA, 15 nt, Human
cuucagcugacuuuu

SEQ ID NO: 1633605 - RNA, 14 nt, Human
cuucaguaagccgu

SEQ ID NO: 1633606 - RNA, 15 nt, Human
cuuccacaagagccc

SEQ ID NO: 1633607 - RNA, 14 nt, Human
cuuccacaagagcc

SEQ ID NO: 1633608 - RNA, 13 nt, Human
cuuccacaagagc

SEQ ID NO: 1633609 - RNA, 20 nt, Human
cuucauucaacccaccugcg

SEQ ID NO: 1633610 - RNA, 15 nt, Human
cuucaguaagccgug

SEQ ID NO: 1633611 - RNA, 14 nt, Human
cuucagugccaaaa

SEQ ID NO: 1633612 - RNA, 21 nt, Human
cuuguguguuuauugucaaag

SEQ ID NO: 1633613 - RNA, 18 nt, Human
cuuuaaagggauggcaag

SEQ ID NO: 1633614 - RNA, 20 nt, Human
cuuuaaagggauggcaagau

SEQ ID NO: 1633615 - RNA, 14 nt, Human
cuuguuuucuggga

SEQ ID NO: 1633616 - RNA, 21 nt, Human
cuuguuuuuuuuuuccacuua

SEQ ID NO: 1633617 - RNA, 17 nt, Human
cuuuaaaaaaaaaauug

SEQ ID NO: 1633618 - RNA, 20 nt, Human
cuuguuuuuuuuuuccacuu

SEQ ID NO: 1633619 - RNA, 19 nt, Human
cuuguuuuuuuuuuccacu

SEQ ID NO: 1633620 - RNA, 21 nt, Human
cuuuauuuucuauaauuuaaa

SEQ ID NO: 1633621 - RNA, 13 nt, Human
cuuuauaauucua

SEQ ID NO: 1633622 - RNA, 20 nt, Human
cuuuauucuggcagaggagg

SEQ ID NO: 1633623 - RNA, 13 nt, Human
cuuuccacagaag

SEQ ID NO: 1633624 - RNA, 22 nt, Human
cuuuccaaaugcccagcuuaaa

SEQ ID NO: 1633625 - RNA, 19 nt, Human
cuuuccaaaugcccagcuu

SEQ ID NO: 1633626 - RNA, 18 nt, Human
cuuuccaaaugcccagcu

SEQ ID NO: 1633627 - RNA, 21 nt, Human
cuugccaucccucccuccacc

SEQ ID NO: 1633628 - RNA, 15 nt, Human
cuugccacugccucu

SEQ ID NO: 1633629 - RNA, 14 nt, Human
cuugccacugccuc

SEQ ID NO: 1633630 - RNA, 21 nt, Human
cuucuccacccugcucuccga

SEQ ID NO: 1633631 - RNA, 18 nt, Human
cuucuccacccugcucuc

SEQ ID NO: 1633632 - RNA, 17 nt, Human
cuucuccacccugcucu

SEQ ID NO: 1633633 - RNA, 22 nt, Human
cuugccaucccucccuccaccu

SEQ ID NO: 1633634 - RNA, 14 nt, Human
cuugcucugcugac

SEQ ID NO: 1633635 - RNA, 13 nt, Human
cuuggaggaagga

SEQ ID NO: 1633636 - RNA, 14 nt, Human
cuuggaagcuccgc

SEQ ID NO: 1633637 - RNA, 13 nt, Human
cuuggaagcuccg

SEQ ID NO: 1633638 - RNA, 16 nt, Human
cuuggaaaugggagac

SEQ ID NO: 1633639 - RNA, 20 nt, Human
cuugcuucaaccccaugaga

SEQ ID NO: 1633640 - RNA, 17 nt, Human
cuugcucugcugacaga

SEQ ID NO: 1633641 - RNA, 16 nt, Human
cuugcucugcugacag

SEQ ID NO: 1633642 - RNA, 19 nt, Human
cuuguaaaggaauuuaaaa

SEQ ID NO: 1633643 - RNA, 22 nt, Human
cuuggggggcugaggugggagg

SEQ ID NO: 1633644 - RNA, 16 nt, Human
cuuggggggcugaggu

SEQ ID NO: 1633645 - RNA, 15 nt, Human
cuuggggggcugagg

SEQ ID NO: 1633646 - RNA, 22 nt, Human
cuuggggaccagagcugccacc

SEQ ID NO: 1633647 - RNA, 16 nt, Human
cuuggggaccagagcu

SEQ ID NO: 1633648 - RNA, 22 nt, Human
cuugggcuucauccuccucaga

SEQ ID NO: 1633649 - RNA, 21 nt, Human
cuuggggaccagagcugccac

SEQ ID NO: 1633650 - RNA, 20 nt, Human
cuuggggaccagagcugcca

SEQ ID NO: 1633651 - RNA, 14 nt, Human
cuugggccacugug

SEQ ID NO: 1633652 - RNA, 13 nt, Human
cuugggcuucauc

SEQ ID NO: 1633653 - RNA, 18 nt, Human
cuugggccacugugaaga

SEQ ID NO: 1633654 - RNA, 17 nt, Human
cuuggcugcagggaguc

SEQ ID NO: 1633655 - RNA, 16 nt, Human
cuuggcugcagggagu

SEQ ID NO: 1633656 - RNA, 12 nt, Human
cuuggagggcau

SEQ ID NO: 1633657 - RNA, 23 nt, Human
cuuggagggcaugaagacagaua

SEQ ID NO: 1633658 - RNA, 22 nt, Human
cuuggaggaaggaaacccagcu

SEQ ID NO: 1633659 - RNA, 14 nt, Human
gaaaaucagccugc

SEQ ID NO: 1633660 - RNA, 12 nt, Human
gaaaauaucacu

SEQ ID NO: 1633661 - RNA, 19 nt, Human
gaaaaucuuauaauuuaaa

SEQ ID NO: 1633662 - RNA, 18 nt, Human
gaaaaucagccugcucca

SEQ ID NO: 1633663 - RNA, 16 nt, Human
gaaaaucagccugcuc

SEQ ID NO: 1633664 - RNA, 19 nt, Human
gaaaauaacgauaaaagac

SEQ ID NO: 1633665 - RNA, 17 nt, Human
gaaaagcugcugacagu

SEQ ID NO: 1633666 - RNA, 13 nt, Human
gaaaagcugcuga

SEQ ID NO: 1633667 - RNA, 19 nt, Human
gaaaagcugcugacagugu

SEQ ID NO: 1633668 - RNA, 20 nt, Human
gaaaaucuuauaauuuaaaa

SEQ ID NO: 1633669 - RNA, 22 nt, Human
gaaacacugggcuucuagaacc

SEQ ID NO: 1633670 - RNA, 18 nt, Human
gaaacagcuaaugggaca

SEQ ID NO: 1633671 - RNA, 20 nt, Human
gaaacagcucgacuuuaaaa

SEQ ID NO: 1633672 - RNA, 15 nt, Human
gaaacagcucgacuu

SEQ ID NO: 1633673 - RNA, 17 nt, Human
gaaacagccugugucuu

SEQ ID NO: 1633674 - RNA, 16 nt, Human
gaaacagccugugucu

SEQ ID NO: 1633675 - RNA, 16 nt, Human
gaaacacuuugcauaa

SEQ ID NO: 1633676 - RNA, 22 nt, Human
gaaaacaauaacgauaaaagac

SEQ ID NO: 1633677 - RNA, 13 nt, Human
gaaaacacauuuu

SEQ ID NO: 1633678 - RNA, 14 nt, Human
gaaaacacauuuuu

SEQ ID NO: 1633679 - RNA, 12 nt, Human
gaaaacaugcua

SEQ ID NO: 1633680 - RNA, 14 nt, Human
gaaaacaugcuaca

SEQ ID NO: 1633681 - RNA, 15 nt, Human
gaaaacaugcuacac

SEQ ID NO: 1633682 - RNA, 16 nt, Human
gaaaacaugcuacaca

SEQ ID NO: 1633683 - RNA, 19 nt, Human
gaaaaccaagccguggcuu

SEQ ID NO: 1633684 - RNA, 18 nt, Human
gaaaaccaagccguggcu

SEQ ID NO: 1633685 - RNA, 21 nt, Human
gaaaaccaagccguggcuucc

SEQ ID NO: 1633686 - RNA, 16 nt, Human
gaaaacguggcugcuu

SEQ ID NO: 1633687 - RNA, 15 nt, Human
gaaaacguggcugcu

SEQ ID NO: 1633688 - RNA, 18 nt, Human
gaaaacguggcugcuuca

SEQ ID NO: 1633689 - RNA, 19 nt, Human
gaaaacguggcugcuucaa

SEQ ID NO: 1633690 - RNA, 16 nt, Human
cuuuuuuggcugcuga

SEQ ID NO: 1633691 - RNA, 23 nt, Human
gaaaaaggaugcacagaguuguu

SEQ ID NO: 1633692 - RNA, 17 nt, Human
gaaaaaggaugcacaga

SEQ ID NO: 1633693 - RNA, 15 nt, Human
cuuuuuuggcugcug

SEQ ID NO: 1633694 - RNA, 14 nt, Human
cuuuuuuggcugcu

SEQ ID NO: 1633695 - RNA, 22 nt, Human
cuuuuuucucugauacagaaaa

SEQ ID NO: 1633696 - RNA, 21 nt, Human
cuuuugagugccuuacacaau

SEQ ID NO: 1633697 - RNA, 16 nt, Human
cuuuugagcauuuaga

SEQ ID NO: 1633698 - RNA, 20 nt, Human
cuuuuuucucugauacagaa

SEQ ID NO: 1633699 - RNA, 14 nt, Human
cuuuuuucuaaagu

SEQ ID NO: 1633700 - RNA, 15 nt, Human
cuuuguucuggcucu

SEQ ID NO: 1633701 - RNA, 14 nt, Human
cuuuguucuggcuc

SEQ ID NO: 1633702 - RNA, 17 nt, Human
cuuugugauuuuuguaa

SEQ ID NO: 1633703 - RNA, 18 nt, Human
cuuugugauuuuuguaau

SEQ ID NO: 1633704 - RNA, 19 nt, Human
cuuugugauuuuuguaauu

SEQ ID NO: 1633705 - RNA, 18 nt, Human
cuuuguccccaccgcaga

SEQ ID NO: 1633706 - RNA, 13 nt, Human
cuuugggaggcca

SEQ ID NO: 1633707 - RNA, 22 nt, Human
cuuuguccccaccgcagacagg

SEQ ID NO: 1633708 - RNA, 23 nt, Human
cuuugggaggccaaggugggagg

SEQ ID NO: 1633709 - RNA, 14 nt, Human
cuuugugauuuuug

SEQ ID NO: 1633710 - RNA, 16 nt, Human
cuuucccaucuuccaa

SEQ ID NO: 1633711 - RNA, 16 nt, Human
cuuuggacccugaggc

SEQ ID NO: 1633712 - RNA, 15 nt, Human
cuuuggacccugagg

SEQ ID NO: 1633713 - RNA, 18 nt, Human
cuuuggacccugaggccc

SEQ ID NO: 1633714 - RNA, 17 nt, Human
cuuuggacccugaggcc

SEQ ID NO: 1633715 - RNA, 19 nt, Human
cuuuggacccugaggccca

SEQ ID NO: 1633716 - RNA, 23 nt, Human
cuuuucuugcaugaggcuagugu

SEQ ID NO: 1633717 - RNA, 18 nt, Human
cuuuucuugcaugaggcu

SEQ ID NO: 1633718 - RNA, 16 nt, Human
cuuuucuuucagccaa

SEQ ID NO: 1633719 - RNA, 23 nt, Human
cuuuucuguccgagcuuugaaaa

SEQ ID NO: 1633720 - RNA, 18 nt, Human
cuuuucuguccgagcuuu

SEQ ID NO: 1633721 - RNA, 14 nt, Human
cuuuucugauagag

SEQ ID NO: 1633722 - RNA, 11 nt, Human
cuuuucugaua

SEQ ID NO: 1633723 - RNA, 20 nt, Human
cuuuucauaaccuagccuua

SEQ ID NO: 1633724 - RNA, 17 nt, Human
cuuuucacugcuggcug

SEQ ID NO: 1633725 - RNA, 20 nt, Human
cuuuucacugcuggcugccu

SEQ ID NO: 1633726 - RNA, 18 nt, Human
cuuuucacugcuggcugc

SEQ ID NO: 1633727 - RNA, 22 nt, Human
cuuuucauaaccuagccuuaga

SEQ ID NO: 1633728 - RNA, 20 nt, Human
cuuuguuuguugucagcuga

SEQ ID NO: 1633729 - RNA, 18 nt, Human
cuuuguuuguugucagcu

SEQ ID NO: 1633730 - RNA, 20 nt, Human
cuuuuacguccaucucuugu

SEQ ID NO: 1633731 - RNA, 18 nt, Human
gaaggaaacccagcucug

SEQ ID NO: 1633732 - RNA, 17 nt, Human
gaaggaaacccagcucu

SEQ ID NO: 1633733 - RNA, 14 nt, Human
gaaggaaacccagc

SEQ ID NO: 1633734 - RNA, 12 nt, Human
gaaggauacaaa

SEQ ID NO: 1633735 - RNA, 19 nt, Human
gaaggauacaaaagcaugu

SEQ ID NO: 1633736 - RNA, 21 nt, Human
gaaggauacaaaagcauguga

SEQ ID NO: 1633737 - RNA, 15 nt, Human
gaaggccccgcccag

SEQ ID NO: 1633738 - RNA, 14 nt, Human
gaaggccccgccca

SEQ ID NO: 1633739 - RNA, 16 nt, Human
gaaggccccgcccagg

SEQ ID NO: 1633740 - RNA, 17 nt, Human
gaaggccccgcccaggc

SEQ ID NO: 1633741 - RNA, 14 nt, Human
gaaggcagggaggg

SEQ ID NO: 1633742 - RNA, 13 nt, Human
gaaggcagggagg

SEQ ID NO: 1633743 - RNA, 21 nt, Human
gaagccuuggggcugaugcag

SEQ ID NO: 1633744 - RNA, 14 nt, Human
gaagcggcuggcag

SEQ ID NO: 1633745 - RNA, 11 nt, Human
gaagccuuugu

SEQ ID NO: 1633746 - RNA, 10 nt, Human
gaagccuuug

SEQ ID NO: 1633747 - RNA, 18 nt, Human
gaagcuuuuaugugaaac

SEQ ID NO: 1633748 - RNA, 22 nt, Human
gaagcccaggaaaggcuccagg

SEQ ID NO: 1633749 - RNA, 21 nt, Human
gaagcccaggaaaggcuccag

SEQ ID NO: 1633750 - RNA, 20 nt, Human
gaagcccaggaaaggcucca

SEQ ID NO: 1633751 - RNA, 23 nt, Human
gaagcccaggaaaggcuccagga

SEQ ID NO: 1633752 - RNA, 17 nt, Human
gaagacugcauuauauu

SEQ ID NO: 1633753 - RNA, 14 nt, Human
gaagaagcucucuc

SEQ ID NO: 1633754 - RNA, 21 nt, Human
gaagacucauucuucuguacg

SEQ ID NO: 1633755 - RNA, 19 nt, Human
gaagacucauucuucugua

SEQ ID NO: 1633756 - RNA, 16 nt, Human
gaagccagcaggcucu

SEQ ID NO: 1633757 - RNA, 15 nt, Human
gaagccagcaggcuc

SEQ ID NO: 1633758 - RNA, 22 nt, Human
gaagccacgguguucugugaua

SEQ ID NO: 1633759 - RNA, 23 nt, Human
gaagccagcaggcucucaggcca

SEQ ID NO: 1633760 - RNA, 19 nt, Human
gaagccagcaggcucucag

SEQ ID NO: 1633761 - RNA, 12 nt, Human
gaaguuucugcc

SEQ ID NO: 1633762 - RNA, 20 nt, Human
gaaguuucugccgcagcccu

SEQ ID NO: 1633763 - RNA, 12 nt, Human
gaauaaaauuuu

SEQ ID NO: 1633764 - RNA, 14 nt, Human
gaauaaagacaccu

SEQ ID NO: 1633765 - RNA, 20 nt, Human
gaauaauccuaaacauauga

SEQ ID NO: 1633766 - RNA, 14 nt, Human
gaauaacauguaau

SEQ ID NO: 1633767 - RNA, 15 nt, Human
gaauaaauugcuccu

SEQ ID NO: 1633768 - RNA, 14 nt, Human
gaauacuuuauaaa

SEQ ID NO: 1633769 - RNA, 16 nt, Human
gaaucucaaauaacua

SEQ ID NO: 1633770 - RNA, 21 nt, Human
gaaugaaagggcccagagagg

SEQ ID NO: 1633771 - RNA, 19 nt, Human
gaaugaaagggcccagaga

SEQ ID NO: 1633772 - RNA, 14 nt, Human
gaaugaaagggccc

SEQ ID NO: 1633773 - RNA, 14 nt, Human
gaauagcugggacu

SEQ ID NO: 1633774 - RNA, 15 nt, Human
gaauagaugcugacu

SEQ ID NO: 1633775 - RNA, 15 nt, Human
gaauagcugggacua

SEQ ID NO: 1633776 - RNA, 18 nt, Human
gaauccagacccggcugc

SEQ ID NO: 1633777 - RNA, 22 nt, Human
gaacuagaguuuagcuggaaaa

SEQ ID NO: 1633778 - RNA, 21 nt, Human
gaacuagaguuuagcuggaaa

SEQ ID NO: 1633779 - RNA, 16 nt, Human
gaacgcguugaaauug

SEQ ID NO: 1633780 - RNA, 11 nt, Human
gaaccugaccc

SEQ ID NO: 1633781 - RNA, 12 nt, Human
gaaccugacccc

SEQ ID NO: 1633782 - RNA, 17 nt, Human
gaaccaccacacccagc

SEQ ID NO: 1633783 - RNA, 16 nt, Human
gaaccaccacacccag

SEQ ID NO: 1633784 - RNA, 21 nt, Human
gaaccacaucuugcucugcug

SEQ ID NO: 1633785 - RNA, 19 nt, Human
gaacagacuggaagcacag

SEQ ID NO: 1633786 - RNA, 16 nt, Human
gaacagacuggaagca

SEQ ID NO: 1633787 - RNA, 15 nt, Human
gaacagacuggaagc

SEQ ID NO: 1633788 - RNA, 22 nt, Human
gaacuuccagauccuggaaauc

SEQ ID NO: 1633789 - RNA, 14 nt, Human
gaacucccuuucaa

SEQ ID NO: 1633790 - RNA, 15 nt, Human
gaacucccuuucaac

SEQ ID NO: 1633791 - RNA, 22 nt, Human
gaacuggguacuuguggacaca

SEQ ID NO: 1633792 - RNA, 21 nt, Human
gaacuuguaaaggaauuuaaa

SEQ ID NO: 1633793 - RNA, 23 nt, Human
gaacuugguucccauuugcuccu

SEQ ID NO: 1633794 - RNA, 17 nt, Human
gaacuuggcgcugcccc

SEQ ID NO: 1633795 - RNA, 16 nt, Human
gaacuuggcgcugccc

SEQ ID NO: 1633796 - RNA, 15 nt, Human
gaacuuggcgcugcc

SEQ ID NO: 1633797 - RNA, 13 nt, Human
gaacuuggcgcug

SEQ ID NO: 1633798 - RNA, 21 nt, Human
gaagaagcaccaaucaugaau

SEQ ID NO: 1633799 - RNA, 11 nt, Human
gaaacauuugg

SEQ ID NO: 1633800 - RNA, 20 nt, Human
gaaacaugacucguauaugu

SEQ ID NO: 1633801 - RNA, 20 nt, Human
gaaacagccugugucuuuaa

SEQ ID NO: 1633802 - RNA, 13 nt, Human
gaaauauaauuga

SEQ ID NO: 1633803 - RNA, 17 nt, Human
gaaauauaggaacuuaa

SEQ ID NO: 1633804 - RNA, 21 nt, Human
gaaauaucugaaaauguaugu

SEQ ID NO: 1633805 - RNA, 22 nt, Human
gaaauguaagggaaacugccag

SEQ ID NO: 1633806 - RNA, 16 nt, Human
gaaauauuauguuaaa

SEQ ID NO: 1633807 - RNA, 13 nt, Human
gaaauauuauguu

SEQ ID NO: 1633808 - RNA, 20 nt, Human
gaaaugggcagagcagagac

SEQ ID NO: 1633809 - RNA, 14 nt, Human
gaaaugggcagagc

SEQ ID NO: 1633810 - RNA, 17 nt, Human
gaaauuuguuauaauga

SEQ ID NO: 1633811 - RNA, 19 nt, Human
gaaauugcauuuccugaca

SEQ ID NO: 1633812 - RNA, 17 nt, Human
gaaauuguaauuauauc

SEQ ID NO: 1633813 - RNA, 22 nt, Human
cugcaauaaaauggguuuuacu

SEQ ID NO: 1633814 - RNA, 18 nt, Human
cugcaauaaggggagagu

SEQ ID NO: 1633815 - RNA, 15 nt, Human
cugcaauaaaauggg

SEQ ID NO: 1633816 - RNA, 17 nt, Human
cugcaaagcccagcuug

SEQ ID NO: 1633817 - RNA, 22 nt, Human
cugcacaagcugcacccucagg

SEQ ID NO: 1633818 - RNA, 13 nt, Human
cugcacacagcac

SEQ ID NO: 1633819 - RNA, 22 nt, Human
cugcacacgcuccuuccucuga

SEQ ID NO: 1633820 - RNA, 20 nt, Human
cugcacacgcuccuuccucu

SEQ ID NO: 1633821 - RNA, 14 nt, Human
cugcacacagcacg

SEQ ID NO: 1633822 - RNA, 15 nt, Human
cugcacuccccugcu

SEQ ID NO: 1633823 - RNA, 12 nt, Human
cugcaccgggcc

SEQ ID NO: 1633824 - RNA, 23 nt, Human
cugcaccggcuggccuggccccu

SEQ ID NO: 1633825 - RNA, 22 nt, Human
cugcaccggcuggccuggcccc

SEQ ID NO: 1633826 - RNA, 16 nt, Human
cugcacccucaggcag

SEQ ID NO: 1633827 - RNA, 14 nt, Human
cugcacccucaggc

SEQ ID NO: 1633828 - RNA, 13 nt, Human
cugcacccucagg

SEQ ID NO: 1633829 - RNA, 18 nt, Human
cugcacuccccugcuggg

SEQ ID NO: 1633830 - RNA, 17 nt, Human
cugcacuccccugcugg

SEQ ID NO: 1633831 - RNA, 16 nt, Human
cugcacuccccugcug

SEQ ID NO: 1633832 - RNA, 18 nt, Human
cugcacuugcagacucua

SEQ ID NO: 1633833 - RNA, 21 nt, Human
cugauggugcaaugaccuuuc

SEQ ID NO: 1633834 - RNA, 20 nt, Human
cugauggugcaaugaccuuu

SEQ ID NO: 1633835 - RNA, 19 nt, Human
cugauggugcaaugaccuu

SEQ ID NO: 1633836 - RNA, 17 nt, Human
cugauggugcaaugacc

SEQ ID NO: 1633837 - RNA, 17 nt, Human
cugauugugucucuugg

SEQ ID NO: 1633838 - RNA, 21 nt, Human
cugauugugucucuugguccu

SEQ ID NO: 1633839 - RNA, 21 nt, Human
cugauuugacauagucuggcu

SEQ ID NO: 1633840 - RNA, 23 nt, Human
cugauuugacauagucuggcugu

SEQ ID NO: 1633841 - RNA, 22 nt, Human
cugauuugacauagucuggcug

SEQ ID NO: 1633842 - RNA, 22 nt, Human
cugauuuuuuuuuccuucagug

SEQ ID NO: 1633843 - RNA, 21 nt, Human
cugauuuuuuuuuccuucagu

SEQ ID NO: 1633844 - RNA, 23 nt, Human
cugauuuuuuuuuccuucagugc

SEQ ID NO: 1633845 - RNA, 15 nt, Human
cugcaaagcccagcu

SEQ ID NO: 1633846 - RNA, 13 nt, Human
cugcaaagcccag

SEQ ID NO: 1633847 - RNA, 20 nt, Human
cugauuuuuuuuuccuucag

SEQ ID NO: 1633848 - RNA, 19 nt, Human
cugauuuuuuuuuccuuca

SEQ ID NO: 1633849 - RNA, 18 nt, Human
cugauuuuuuuuuccuuc

SEQ ID NO: 1633850 - RNA, 16 nt, Human
cugauuuuuuuuuccu

SEQ ID NO: 1633851 - RNA, 21 nt, Human
cugaggcuccacuuggucugu

SEQ ID NO: 1633852 - RNA, 15 nt, Human
cugaggcuccacuug

SEQ ID NO: 1633853 - RNA, 24 nt, Human
cugaggcccuucucuccagccccu

SEQ ID NO: 1633854 - RNA, 22 nt, Human
cugaggcugggcucccuuccca

SEQ ID NO: 1633855 - RNA, 17 nt, Human
cugaggcugggcucccu

SEQ ID NO: 1633856 - RNA, 16 nt, Human
cugaggcugggcuccc

SEQ ID NO: 1633857 - RNA, 15 nt, Human
cugaggcugggcucc

SEQ ID NO: 1633858 - RNA, 13 nt, Human
cugaggcugggcu

SEQ ID NO: 1633859 - RNA, 18 nt, Human
cugaguuugugcuggugu

SEQ ID NO: 1633860 - RNA, 13 nt, Human
cugaguuugugcu

SEQ ID NO: 1633861 - RNA, 19 nt, Human
cugagucugaaggcugggu

SEQ ID NO: 1633862 - RNA, 18 nt, Human
cugagucugaaggcuggg

SEQ ID NO: 1633863 - RNA, 20 nt, Human
cugagucccaggcugagccu

SEQ ID NO: 1633864 - RNA, 16 nt, Human
cugauggugcaaugac

SEQ ID NO: 1633865 - RNA, 15 nt, Human
cugauggugcaauga

SEQ ID NO: 1633866 - RNA, 14 nt, Human
cugauggugcaaug

SEQ ID NO: 1633867 - RNA, 21 nt, Human
cugauccuaguuccaccauca

SEQ ID NO: 1633868 - RNA, 20 nt, Human
cugauccuaguuccaccauc

SEQ ID NO: 1633869 - RNA, 22 nt, Human
cugauacagaaaaguugaauuu

SEQ ID NO: 1633870 - RNA, 15 nt, Human
cugaucaccugcccu

SEQ ID NO: 1633871 - RNA, 18 nt, Human
cugcgguccacccaggag

SEQ ID NO: 1633872 - RNA, 20 nt, Human
cugcgguccacccaggagcc

SEQ ID NO: 1633873 - RNA, 19 nt, Human
cugcgguccacccaggagc

SEQ ID NO: 1633874 - RNA, 22 nt, Human
cugccugcccaggccccugcca

SEQ ID NO: 1633875 - RNA, 21 nt, Human
cugccugcccaggccccugcc

SEQ ID NO: 1633876 - RNA, 21 nt, Human
cugccucugacacacagcucu

SEQ ID NO: 1633877 - RNA, 18 nt, Human
cugccucugacacacagc

SEQ ID NO: 1633878 - RNA, 17 nt, Human
cugccucugacacacag

SEQ ID NO: 1633879 - RNA, 19 nt, Human
cugccucucugcagguccc

SEQ ID NO: 1633880 - RNA, 22 nt, Human
cugccgcagcccugcagagggc

SEQ ID NO: 1633881 - RNA, 21 nt, Human
cugccgcagcccugcagaggg

SEQ ID NO: 1633882 - RNA, 20 nt, Human
cugccgcagcccugcagagg

SEQ ID NO: 1633883 - RNA, 19 nt, Human
cugccgcagcccugcagag

SEQ ID NO: 1633884 - RNA, 14 nt, Human
cugccgcagcccug

SEQ ID NO: 1633885 - RNA, 23 nt, Human
cugccgcagcccugcagagggca

SEQ ID NO: 1633886 - RNA, 13 nt, Human
cugccgcagcccu

SEQ ID NO: 1633887 - RNA, 12 nt, Human
cugccgcagccc

SEQ ID NO: 1633888 - RNA, 21 nt, Human
cugccccuccucucugcccua

SEQ ID NO: 1633889 - RNA, 19 nt, Human
cugccucagccucccaaag

SEQ ID NO: 1633890 - RNA, 17 nt, Human
cugccucagccucccga

SEQ ID NO: 1633891 - RNA, 15 nt, Human
cugccucagccuccc

SEQ ID NO: 1633892 - RNA, 13 nt, Human
cugccuauuuuaa

SEQ ID NO: 1633893 - RNA, 22 nt, Human
cugccuccagaauggucuuucu

SEQ ID NO: 1633894 - RNA, 14 nt, Human
cugccuccagaaug

SEQ ID NO: 1633895 - RNA, 18 nt, Human
cugccucucugcaggucc

SEQ ID NO: 1633896 - RNA, 17 nt, Human
cugccucucugcagguc

SEQ ID NO: 1633897 - RNA, 16 nt, Human
cugccucucugcaggu

SEQ ID NO: 1633898 - RNA, 15 nt, Human
cugccucucugcagg

SEQ ID NO: 1633899 - RNA, 19 nt, Human
cugcaguugccagucaccc

SEQ ID NO: 1633900 - RNA, 23 nt, Human
cugcacuugcagacucuacagag

SEQ ID NO: 1633901 - RNA, 22 nt, Human
cugcaguugccagucaccccgg

SEQ ID NO: 1633902 - RNA, 21 nt, Human
cugcaguugccagucaccccg

SEQ ID NO: 1633903 - RNA, 22 nt, Human
cugcaucguuucaucuuccaac

SEQ ID NO: 1633904 - RNA, 16 nt, Human
cugcaucguuucaucu

SEQ ID NO: 1633905 - RNA, 20 nt, Human
cugcauccuccgccucccgg

SEQ ID NO: 1633906 - RNA, 19 nt, Human
cugcauccuccgccucccg

SEQ ID NO: 1633907 - RNA, 22 nt, Human
cugcaugcgggcuuccuccugg

SEQ ID NO: 1633908 - RNA, 18 nt, Human
cugcaugcgggcuuccuc

SEQ ID NO: 1633909 - RNA, 19 nt, Human
cugccaaugggagcucaug

SEQ ID NO: 1633910 - RNA, 18 nt, Human
cugccaaugggagcucau

SEQ ID NO: 1633911 - RNA, 16 nt, Human
cugcccacucccugca

SEQ ID NO: 1633912 - RNA, 15 nt, Human
cugcccacucccugc

SEQ ID NO: 1633913 - RNA, 14 nt, Human
cugcccacucccug

SEQ ID NO: 1633914 - RNA, 22 nt, Human
cugcccaccuggccucugcacu

SEQ ID NO: 1633915 - RNA, 20 nt, Human
cugcccaccuggccucugca

SEQ ID NO: 1633916 - RNA, 19 nt, Human
cugcccaccuggccucugc

SEQ ID NO: 1633917 - RNA, 18 nt, Human
cugcccaccuggccucug

SEQ ID NO: 1633918 - RNA, 17 nt, Human
cugcccaccuggccucu

SEQ ID NO: 1633919 - RNA, 18 nt, Human
cugcccacucccugcaac

SEQ ID NO: 1633920 - RNA, 17 nt, Human
cugcccagccuccaagc

SEQ ID NO: 1633921 - RNA, 15 nt, Human
cugcccaccuggccu

SEQ ID NO: 1633922 - RNA, 14 nt, Human
cugcccaccuggcc

SEQ ID NO: 1633923 - RNA, 15 nt, Human
cugccaugccagcuu

SEQ ID NO: 1633924 - RNA, 14 nt, Human
cugccaugccagcu

SEQ ID NO: 1633925 - RNA, 21 nt, Human
cugccaucucaccuccugcug

SEQ ID NO: 1633926 - RNA, 23 nt, Human
cugccaucucaccuccugcuggg

SEQ ID NO: 1633927 - RNA, 13 nt, Human
cugccaggcaugg

SEQ ID NO: 1633928 - RNA, 11 nt, Human
cugccaggcau

SEQ ID NO: 1633929 - RNA, 14 nt, Human
cugaagaagauggu

SEQ ID NO: 1633930 - RNA, 17 nt, Human
cugaagucacacaguga

SEQ ID NO: 1633931 - RNA, 19 nt, Human
cugaagucacacagugagu

SEQ ID NO: 1633932 - RNA, 18 nt, Human
cugaagucacacagugag

SEQ ID NO: 1633933 - RNA, 21 nt, Human
cugaagucacacagugagucg

SEQ ID NO: 1633934 - RNA, 15 nt, Human
cugaagucacugcac

SEQ ID NO: 1633935 - RNA, 14 nt, Human
cugaagucacugca

SEQ ID NO: 1633936 - RNA, 13 nt, Human
cugaagucacugc

SEQ ID NO: 1633937 - RNA, 20 nt, Human
cugaagucuuuguacagaca

SEQ ID NO: 1633938 - RNA, 17 nt, Human
cugaagucuuuguacag

SEQ ID NO: 1633939 - RNA, 22 nt, Human
cugaagucccagauacuugggg

SEQ ID NO: 1633940 - RNA, 17 nt, Human
cugaaguucagcugcau

SEQ ID NO: 1633941 - RNA, 20 nt, Human
cugaaugguuuucaaaauaa

SEQ ID NO: 1633942 - RNA, 19 nt, Human
cugaaugguuuucaaaaua

SEQ ID NO: 1633943 - RNA, 12 nt, Human
cugaauuucuuu

SEQ ID NO: 1633944 - RNA, 12 nt, Human
cugaauuauuuu

SEQ ID NO: 1633945 - RNA, 15 nt, Human
cugaauuaugaaacu

SEQ ID NO: 1633946 - RNA, 14 nt, Human
cugaauuaugaaac

SEQ ID NO: 1633947 - RNA, 13 nt, Human
cugaauuaugaaa

SEQ ID NO: 1633948 - RNA, 23 nt, Human
cugaaagggacgcuacccgggaa

SEQ ID NO: 1633949 - RNA, 14 nt, Human
cucuuuucaaaaca

SEQ ID NO: 1633950 - RNA, 23 nt, Human
cucuuugucuacaccauuaugug

SEQ ID NO: 1633951 - RNA, 23 nt, Human
cucuuuggucuacacugugcuga

SEQ ID NO: 1633952 - RNA, 22 nt, Human
cucuuuggucuacacugugcug

SEQ ID NO: 1633953 - RNA, 16 nt, Human
cucuucuccaggcugu

SEQ ID NO: 1633954 - RNA, 20 nt, Human
cugaaauaaacgucuuaaau

SEQ ID NO: 1633955 - RNA, 20 nt, Human
cugagaugugaacacaucag

SEQ ID NO: 1633956 - RNA, 16 nt, Human
cugagaugugaacaca

SEQ ID NO: 1633957 - RNA, 22 nt, Human
cugagacagcccgggcucugcc

SEQ ID NO: 1633958 - RNA, 21 nt, Human
cugagacagcccgggcucugc

SEQ ID NO: 1633959 - RNA, 20 nt, Human
cugagaaagacuauucaaac

SEQ ID NO: 1633960 - RNA, 19 nt, Human
cugagaaagacuauucaaa

SEQ ID NO: 1633961 - RNA, 19 nt, Human
cugagacagcccgggcucu

SEQ ID NO: 1633962 - RNA, 20 nt, Human
cugagacagcccgggcucug

SEQ ID NO: 1633963 - RNA, 21 nt, Human
cugagaugugaacacaucagc

SEQ ID NO: 1633964 - RNA, 23 nt, Human
cugagauuauaggcaccuaccac

SEQ ID NO: 1633965 - RNA, 21 nt, Human
cugagcaaauguggcuccugg

SEQ ID NO: 1633966 - RNA, 20 nt, Human
cugagcaaauguggcuccug

SEQ ID NO: 1633967 - RNA, 17 nt, Human
cugagcaaauguggcuc

SEQ ID NO: 1633968 - RNA, 15 nt, Human
cugagcaaauguggc

SEQ ID NO: 1633969 - RNA, 16 nt, Human
cugagcaggauuuuaa

SEQ ID NO: 1633970 - RNA, 14 nt, Human
cugagccagauuuc

SEQ ID NO: 1633971 - RNA, 13 nt, Human
cugagccagauuu

SEQ ID NO: 1633972 - RNA, 15 nt, Human
cugagccagauuuca

SEQ ID NO: 1633973 - RNA, 18 nt, Human
cugagaaagacuauucaa

SEQ ID NO: 1633974 - RNA, 15 nt, Human
cugagaaagacuauu

SEQ ID NO: 1633975 - RNA, 13 nt, Human
cugagaaagacua

SEQ ID NO: 1633976 - RNA, 12 nt, Human
cugagaaagacu

SEQ ID NO: 1633977 - RNA, 17 nt, Human
cugacuguacuccuccc

SEQ ID NO: 1633978 - RNA, 18 nt, Human
cugacagacacaggcccg

SEQ ID NO: 1633979 - RNA, 17 nt, Human
cugacagacacaggccc

SEQ ID NO: 1633980 - RNA, 17 nt, Human
cugaccagccuccaugc

SEQ ID NO: 1633981 - RNA, 16 nt, Human
cugacagacacaggcc

SEQ ID NO: 1633982 - RNA, 14 nt, Human
cugaauuucuuuug

SEQ ID NO: 1633983 - RNA, 16 nt, Human
cugaauuaugaaacuu

SEQ ID NO: 1633984 - RNA, 23 nt, Human
cugaccagccuccaugcugccuc

SEQ ID NO: 1633985 - RNA, 21 nt, Human
cugaccagccuccaugcugcc

SEQ ID NO: 1633986 - RNA, 22 nt, Human
cucuggccuucggccuccaucc

SEQ ID NO: 1633987 - RNA, 21 nt, Human
cucuggccuucggccuccauc

SEQ ID NO: 1633988 - RNA, 23 nt, Human
cucuggcagcucagagagggugg

SEQ ID NO: 1633989 - RNA, 20 nt, Human
cucugccucugacacacagc

SEQ ID NO: 1633990 - RNA, 19 nt, Human
cucugccucugacacacag

SEQ ID NO: 1633991 - RNA, 21 nt, Human
cucugccucccaucacccgcu

SEQ ID NO: 1633992 - RNA, 10 nt, Human
cucugccuga

SEQ ID NO: 1633993 - RNA, 20 nt, Human
cucuggauuauauuaugaag

SEQ ID NO: 1633994 - RNA, 19 nt, Human
cucuggauuauauuaugaa

SEQ ID NO: 1633995 - RNA, 22 nt, Human
cucuguccugggagugagcugg

SEQ ID NO: 1633996 - RNA, 15 nt, Human
cucuguccugggagu

SEQ ID NO: 1633997 - RNA, 14 nt, Human
cucuguccugggag

SEQ ID NO: 1633998 - RNA, 13 nt, Human
cucugucgcccag

SEQ ID NO: 1633999 - RNA, 15 nt, Human
cucugucgcccaggc

SEQ ID NO: 1634000 - RNA, 17 nt, Human
cucugucgcccagucug

SEQ ID NO: 1634001 - RNA, 22 nt, Human
cucugucgcccaggcuggagug

SEQ ID NO: 1634002 - RNA, 18 nt, Human
cucugucgcccaggcugg

SEQ ID NO: 1634003 - RNA, 19 nt, Human
cucugucgcccagucugga

SEQ ID NO: 1634004 - RNA, 18 nt, Human
cucugucgcccagucugg

SEQ ID NO: 1634005 - RNA, 19 nt, Human
cucuuaagaagacugcauu

SEQ ID NO: 1634006 - RNA, 23 nt, Human
cucugugucagguggggcagcuu

SEQ ID NO: 1634007 - RNA, 22 nt, Human
cucugugucagguggggcagcu

SEQ ID NO: 1634008 - RNA, 21 nt, Human
cucugugucagguggggcagc

SEQ ID NO: 1634009 - RNA, 20 nt, Human
cucugugucagguggggcag

SEQ ID NO: 1634010 - RNA, 15 nt, Human
cucuucuccaggcug

SEQ ID NO: 1634011 - RNA, 13 nt, Human
cucuucuccacug

SEQ ID NO: 1634012 - RNA, 12 nt, Human
cucuucuccacu

SEQ ID NO: 1634013 - RNA, 21 nt, Human
cucugagacucgcgacaaugc

SEQ ID NO: 1634014 - RNA, 14 nt, Human
cucugaggacacua

SEQ ID NO: 1634015 - RNA, 12 nt, Human
cucugaggacac

SEQ ID NO: 1634016 - RNA, 16 nt, Human
cucugaggacacuaac

SEQ ID NO: 1634017 - RNA, 23 nt, Human
cucugagacucgcgacaaugcaa

SEQ ID NO: 1634018 - RNA, 23 nt, Human
cucugacagaagaaccccagggu

SEQ ID NO: 1634019 - RNA, 19 nt, Human
cucugacacacagcucugu

SEQ ID NO: 1634020 - RNA, 18 nt, Human
cucugacacacagcucug

SEQ ID NO: 1634021 - RNA, 17 nt, Human
cucugacacacagcucu

SEQ ID NO: 1634022 - RNA, 16 nt, Human
cucugacacacagcuc

SEQ ID NO: 1634023 - RNA, 15 nt, Human
cucugacacacagcu

SEQ ID NO: 1634024 - RNA, 14 nt, Human
cucugacacacagc

SEQ ID NO: 1634025 - RNA, 22 nt, Human
cucugacaacagacuucugaaa

SEQ ID NO: 1634026 - RNA, 21 nt, Human
cucugacaacagacuucugaa

SEQ ID NO: 1634027 - RNA, 22 nt, Human
cucugaaggacauugcggacag

SEQ ID NO: 1634028 - RNA, 16 nt, Human
cucugacaacagacuu

SEQ ID NO: 1634029 - RNA, 19 nt, Human
cucugaaggguaauuauau

SEQ ID NO: 1634030 - RNA, 17 nt, Human
cucugccucccaucacc

SEQ ID NO: 1634031 - RNA, 16 nt, Human
cucugccucccaucac

SEQ ID NO: 1634032 - RNA, 14 nt, Human
cucugccucccauc

SEQ ID NO: 1634033 - RNA, 13 nt, Human
cucugccucccau

SEQ ID NO: 1634034 - RNA, 20 nt, Human
cucugcccuaaugcgcaggc

SEQ ID NO: 1634035 - RNA, 22 nt, Human
cucugcccuaaugcgcaggcug

SEQ ID NO: 1634036 - RNA, 17 nt, Human
cucugcccacucccugc

SEQ ID NO: 1634037 - RNA, 16 nt, Human
cucugcccacucccug

SEQ ID NO: 1634038 - RNA, 15 nt, Human
cucugcccacucccu

SEQ ID NO: 1634039 - RNA, 13 nt, Human
cucugcccacucc

SEQ ID NO: 1634040 - RNA, 20 nt, Human
cucugcccacucccugcaac

SEQ ID NO: 1634041 - RNA, 18 nt, Human
cucugcccacucccugca

SEQ ID NO: 1634042 - RNA, 22 nt, Human
cucugcaggucccuaauaaagc

SEQ ID NO: 1634043 - RNA, 21 nt, Human
cucugcaggucccuaauaaag

SEQ ID NO: 1634044 - RNA, 15 nt, Human
cucugcacaagcugc

SEQ ID NO: 1634045 - RNA, 14 nt, Human
cucugcacaagcug

SEQ ID NO: 1634046 - RNA, 20 nt, Human
cucugcaggucccuaauaaa

SEQ ID NO: 1634047 - RNA, 19 nt, Human
cucugcaggucccuaauaa

SEQ ID NO: 1634048 - RNA, 13 nt, Human
cucugcacaagcu

SEQ ID NO: 1634049 - RNA, 15 nt, Human
cucugauacagaaaa

SEQ ID NO: 1634050 - RNA, 12 nt, Human
cucccuuucaac

SEQ ID NO: 1634051 - RNA, 19 nt, Human
cucccuuggggccuaugca

SEQ ID NO: 1634052 - RNA, 18 nt, Human
cuccucagaucuucugug

SEQ ID NO: 1634053 - RNA, 15 nt, Human
cuccuccagagucag

SEQ ID NO: 1634054 - RNA, 13 nt, Human
cuccuccagaguc

SEQ ID NO: 1634055 - RNA, 15 nt, Human
cuccuccagccgcca

SEQ ID NO: 1634056 - RNA, 22 nt, Human
cuccuccagccgccaugcuccu

SEQ ID NO: 1634057 - RNA, 23 nt, Human
cuccucccaggcgccccuucccc

SEQ ID NO: 1634058 - RNA, 22 nt, Human
cuccucccaggcgccccuuccc

SEQ ID NO: 1634059 - RNA, 17 nt, Human
cuccucccaggcgcccc

SEQ ID NO: 1634060 - RNA, 19 nt, Human
cuccuccuggacuccugca

SEQ ID NO: 1634061 - RNA, 15 nt, Human
cuccuccuggacucc

SEQ ID NO: 1634062 - RNA, 14 nt, Human
cuccuccuggacuc

SEQ ID NO: 1634063 - RNA, 20 nt, Human
cuccccuccucugcuugcca

SEQ ID NO: 1634064 - RNA, 13 nt, Human
cuccauccugagg

SEQ ID NO: 1634065 - RNA, 14 nt, Human
cuccauccugaggc

SEQ ID NO: 1634066 - RNA, 23 nt, Human
cuccccagcaagugagagcuggg

SEQ ID NO: 1634067 - RNA, 22 nt, Human
cuccccagcaagugagagcugg

SEQ ID NO: 1634068 - RNA, 11 nt, Human
cuccccuccuc

SEQ ID NO: 1634069 - RNA, 13 nt, Human
cuccccuccucug

SEQ ID NO: 1634070 - RNA, 20 nt, Human
cuccccuccuccuggacucc

SEQ ID NO: 1634071 - RNA, 12 nt, Human
cuccccuccucc

SEQ ID NO: 1634072 - RNA, 20 nt, Human
cucccgaguagcugggacua

SEQ ID NO: 1634073 - RNA, 19 nt, Human
cucccgaguagcugggacu

SEQ ID NO: 1634074 - RNA, 16 nt, Human
cucccgaauagcuggg

SEQ ID NO: 1634075 - RNA, 21 nt, Human
cucccggugcccaagaauaga

SEQ ID NO: 1634076 - RNA, 15 nt, Human
cucccggugcccaag

SEQ ID NO: 1634077 - RNA, 21 nt, Human
cucccugccccucccuucaac

SEQ ID NO: 1634078 - RNA, 20 nt, Human
cucccugccccucccuucaa

SEQ ID NO: 1634079 - RNA, 18 nt, Human
cucccugccccucccuuc

SEQ ID NO: 1634080 - RNA, 17 nt, Human
cucccugccccucccuu

SEQ ID NO: 1634081 - RNA, 14 nt, Human
cucccugccccucc

SEQ ID NO: 1634082 - RNA, 13 nt, Human
cucccugccccuc

SEQ ID NO: 1634083 - RNA, 23 nt, Human
cucccugccccccagcccuccuu

SEQ ID NO: 1634084 - RNA, 17 nt, Human
cucccugccccccagcc

SEQ ID NO: 1634085 - RNA, 21 nt, Human
cuccugccucgaacuggcugc

SEQ ID NO: 1634086 - RNA, 20 nt, Human
cuccugccucgaacuggcug

SEQ ID NO: 1634087 - RNA, 18 nt, Human
cuccugccucgaacuggc

SEQ ID NO: 1634088 - RNA, 19 nt, Human
cuccugccucagccucccg

SEQ ID NO: 1634089 - RNA, 22 nt, Human
cuccugccucgaacuggcugca

SEQ ID NO: 1634090 - RNA, 15 nt, Human
cuccucuccccagca

SEQ ID NO: 1634091 - RNA, 13 nt, Human
cuccucuccccag

SEQ ID NO: 1634092 - RNA, 11 nt, Human
cuccugccuca

SEQ ID NO: 1634093 - RNA, 12 nt, Human
cuccugccucag

SEQ ID NO: 1634094 - RNA, 17 nt, Human
cuccugccucagccucc

SEQ ID NO: 1634095 - RNA, 14 nt, Human
cuccuggaaauauu

SEQ ID NO: 1634096 - RNA, 13 nt, Human
cuccugcugggca

SEQ ID NO: 1634097 - RNA, 24 nt, Human
cuccugugugugcgccuacaggag

SEQ ID NO: 1634098 - RNA, 23 nt, Human
cuccugugugugcgccuacagga

SEQ ID NO: 1634099 - RNA, 21 nt, Human
cuccugugugugcgccuacag

SEQ ID NO: 1634100 - RNA, 11 nt, Human
cuccuggacuc

SEQ ID NO: 1634101 - RNA, 22 nt, Human
cuccuuaucaaaggacaccauu

SEQ ID NO: 1634102 - RNA, 17 nt, Human
cuccuuaucaaaggaca

SEQ ID NO: 1634103 - RNA, 12 nt, Human
cuccuggacucc

SEQ ID NO: 1634104 - RNA, 23 nt, Human
cuccuuggugucgggcaugacac

SEQ ID NO: 1634105 - RNA, 19 nt, Human
cucgagcaugccuggaugg

SEQ ID NO: 1634106 - RNA, 16 nt, Human
cucgagcaugccugga

SEQ ID NO: 1634107 - RNA, 15 nt, Human
cucgagcaugccugg

SEQ ID NO: 1634108 - RNA, 13 nt, Human
cucgagcaugccu

SEQ ID NO: 1634109 - RNA, 22 nt, Human
cucgagcaugccuggauggggc

SEQ ID NO: 1634110 - RNA, 13 nt, Human
cucgcgacaaugc

SEQ ID NO: 1634111 - RNA, 23 nt, Human
cucgcucugucgcccaggcugga

SEQ ID NO: 1634112 - RNA, 15 nt, Human
cucgccuucaucucc

SEQ ID NO: 1634113 - RNA, 12 nt, Human
cuccauccugag

SEQ ID NO: 1634114 - RNA, 23 nt, Human
cuccaggagcagccacauuccug

SEQ ID NO: 1634115 - RNA, 18 nt, Human
cuccaggagcagccacau

SEQ ID NO: 1634116 - RNA, 17 nt, Human
cuccaggagcagccaca

SEQ ID NO: 1634117 - RNA, 16 nt, Human
cuccaggagcagccac

SEQ ID NO: 1634118 - RNA, 15 nt, Human
cuccaggagcagcca

SEQ ID NO: 1634119 - RNA, 14 nt, Human
cuccaggagcagcc

SEQ ID NO: 1634120 - RNA, 13 nt, Human
cuccaggagcagc

SEQ ID NO: 1634121 - RNA, 11 nt, Human
cuccaggagca

SEQ ID NO: 1634122 - RNA, 12 nt, Human
cuccagccuggg

SEQ ID NO: 1634123 - RNA, 14 nt, Human
cuccagcucaccag

SEQ ID NO: 1634124 - RNA, 17 nt, Human
cuccagccccuggaugc

SEQ ID NO: 1634125 - RNA, 16 nt, Human
cuccagccccuggaug

SEQ ID NO: 1634126 - RNA, 20 nt, Human
cuccagccccuggaugcagc

SEQ ID NO: 1634127 - RNA, 13 nt, Human
cuccaccugccag

SEQ ID NO: 1634128 - RNA, 12 nt, Human
cuccaccugcca

SEQ ID NO: 1634129 - RNA, 14 nt, Human
cuccaccugccagg

SEQ ID NO: 1634130 - RNA, 15 nt, Human
cuccaccugccaggg

SEQ ID NO: 1634131 - RNA, 21 nt, Human
cucauuuccaagcaaguauua

SEQ ID NO: 1634132 - RNA, 17 nt, Human
cucauuugucacacacu

SEQ ID NO: 1634133 - RNA, 13 nt, Human
cuccaaagaaaug

SEQ ID NO: 1634134 - RNA, 18 nt, Human
cuccaaaauaaaacuuuu

SEQ ID NO: 1634135 - RNA, 12 nt, Human
cuccaaagaaau

SEQ ID NO: 1634136 - RNA, 21 nt, Human
cuccaaacugacucuuaagaa

SEQ ID NO: 1634137 - RNA, 18 nt, Human
cucauuugucacacacuu

SEQ ID NO: 1634138 - RNA, 15 nt, Human
cuccaaaauaaaacu

SEQ ID NO: 1634139 - RNA, 16 nt, Human
cuccaaaauaaaacuu

SEQ ID NO: 1634140 - RNA, 22 nt, Human
cuccaaucccaccaacccucag

SEQ ID NO: 1634141 - RNA, 13 nt, Human
cuccacccugcuc

SEQ ID NO: 1634142 - RNA, 15 nt, Human
cuccacccugcucuc

SEQ ID NO: 1634143 - RNA, 20 nt, Human
cucaggugagaagcagagga

SEQ ID NO: 1634144 - RNA, 19 nt, Human
cucaggugagaagcagagg

SEQ ID NO: 1634145 - RNA, 16 nt, Human
cucaggugagaagcag

SEQ ID NO: 1634146 - RNA, 18 nt, Human
cucagggucccugguggc

SEQ ID NO: 1634147 - RNA, 17 nt, Human
cucagggucccuggugg

SEQ ID NO: 1634148 - RNA, 16 nt, Human
cucagggucccuggug

SEQ ID NO: 1634149 - RNA, 15 nt, Human
cucagggucccuggu

SEQ ID NO: 1634150 - RNA, 15 nt, Human
cucagggccuggucg

SEQ ID NO: 1634151 - RNA, 16 nt, Human
cucagggccuggcuca

SEQ ID NO: 1634152 - RNA, 15 nt, Human
cucagggccuggcuc

SEQ ID NO: 1634153 - RNA, 14 nt, Human
cucagggccuggcu

SEQ ID NO: 1634154 - RNA, 18 nt, Human
cucagcauccuggcaccc

SEQ ID NO: 1634155 - RNA, 23 nt, Human
cucaggaguuugagaccaaccug

SEQ ID NO: 1634156 - RNA, 18 nt, Human
cucaggaguuugagacca

SEQ ID NO: 1634157 - RNA, 21 nt, Human
cucagcccacauagugauggu

SEQ ID NO: 1634158 - RNA, 19 nt, Human
cucagcccacauagugaug

SEQ ID NO: 1634159 - RNA, 15 nt, Human
cucauccucauaccc

SEQ ID NO: 1634160 - RNA, 23 nt, Human
cucauaguaugguggcuggguug

SEQ ID NO: 1634161 - RNA, 21 nt, Human
cucaucaccaacgucugugcc

SEQ ID NO: 1634162 - RNA, 22 nt, Human
cucaucaccaacgucugugcca

SEQ ID NO: 1634163 - RNA, 21 nt, Human
cucauacccacccccacccaa

SEQ ID NO: 1634164 - RNA, 19 nt, Human
cucauacccacccccaccc

SEQ ID NO: 1634165 - RNA, 18 nt, Human
cucauacccacccccacc

SEQ ID NO: 1634166 - RNA, 16 nt, Human
cucauacccaccccca

SEQ ID NO: 1634167 - RNA, 19 nt, Human
cucaggugauccacccacc

SEQ ID NO: 1634168 - RNA, 18 nt, Human
cucaggugauccacccac

SEQ ID NO: 1634169 - RNA, 20 nt, Human
cucaggugauccacccaccu

SEQ ID NO: 1634170 - RNA, 22 nt, Human
cucaggugauccacccaccuca

SEQ ID NO: 1634171 - RNA, 21 nt, Human
cucauaguaugguggcugggu

SEQ ID NO: 1634172 - RNA, 21 nt, Human
cucauagcccucacccugggg

SEQ ID NO: 1634173 - RNA, 20 nt, Human
cucauagcccucacccuggg

SEQ ID NO: 1634174 - RNA, 17 nt, Human
cucauagcccucacccu

SEQ ID NO: 1634175 - RNA, 13 nt, Human
cucauagcccuca

SEQ ID NO: 1634176 - RNA, 14 nt, Human
cucauacucaccuc

SEQ ID NO: 1634177 - RNA, 22 nt, Human
cucauacucaccucaccccacu

SEQ ID NO: 1634178 - RNA, 21 nt, Human
cuagugagcagucaggaaaga

SEQ ID NO: 1634179 - RNA, 19 nt, Human
cuagugaaagaggcagcuu

SEQ ID NO: 1634180 - RNA, 18 nt, Human
cuagugaaagaggcagcu

SEQ ID NO: 1634181 - RNA, 20 nt, Human
cuagugaaacucguuaauuu

SEQ ID NO: 1634182 - RNA, 16 nt, Human
cuaguaauuggaaagg

SEQ ID NO: 1634183 - RNA, 24 nt, Human
cuaggugacagagugagacucugu

SEQ ID NO: 1634184 - RNA, 18 nt, Human
cuaggugacagagugaga

SEQ ID NO: 1634185 - RNA, 14 nt, Human
cuaggugacagagu

SEQ ID NO: 1634186 - RNA, 22 nt, Human
cgcccaguuggguggaugccug

SEQ ID NO: 1634187 - RNA, 15 nt, Human
cgccaugcuccuggc

SEQ ID NO: 1634188 - RNA, 20 nt, Human
cgccaucccagccccaauga

SEQ ID NO: 1634189 - RNA, 23 nt, Human
cgcccaguuggguggaugccugg

SEQ ID NO: 1634190 - RNA, 22 nt, Human
cuagguaaauuacaguuccuag

SEQ ID NO: 1634191 - RNA, 22 nt, Human
cuauaggugcuacaaaaacaca

SEQ ID NO: 1634192 - RNA, 21 nt, Human
cuauaggugcuacaaaaacac

SEQ ID NO: 1634193 - RNA, 20 nt, Human
cuauaggugcuacaaaaaca

SEQ ID NO: 1634194 - RNA, 17 nt, Human
cuauagccuaggugaca

SEQ ID NO: 1634195 - RNA, 18 nt, Human
cuauauuguuugcuaagc

SEQ ID NO: 1634196 - RNA, 17 nt, Human
cuauauuuuacauaaau

SEQ ID NO: 1634197 - RNA, 15 nt, Human
cuauauuuucauucu

SEQ ID NO: 1634198 - RNA, 19 nt, Human
cuauauuuucauucuccua

SEQ ID NO: 1634199 - RNA, 16 nt, Human
cuauaauguaagcucu

SEQ ID NO: 1634200 - RNA, 22 nt, Human
cuauaauuuaccugaagucuuu

SEQ ID NO: 1634201 - RNA, 21 nt, Human
cuauaauguaagcucuacuga

SEQ ID NO: 1634202 - RNA, 16 nt, Human
cuauucaaacagucuc

SEQ ID NO: 1634203 - RNA, 18 nt, Human
cuauucaaacagucucag

SEQ ID NO: 1634204 - RNA, 23 nt, Human
cuauucaaacagucucaggaaau

SEQ ID NO: 1634205 - RNA, 15 nt, Human
cuauuagagaagaga

SEQ ID NO: 1634206 - RNA, 23 nt, Human
cuaugggacucaaugcacugaca

SEQ ID NO: 1634207 - RNA, 22 nt, Human
cuaugggacucaaugcacugac

SEQ ID NO: 1634208 - RNA, 18 nt, Human
cuaugggacucaaugcac

SEQ ID NO: 1634209 - RNA, 13 nt, Human
cuauggccugugg

SEQ ID NO: 1634210 - RNA, 20 nt, Human
cuaugcagagguccacaaca

SEQ ID NO: 1634211 - RNA, 21 nt, Human
cucacucugucgcccagucug

SEQ ID NO: 1634212 - RNA, 13 nt, Human
cucacucugucgc

SEQ ID NO: 1634213 - RNA, 22 nt, Human
cucacucugucgcccagucugg

SEQ ID NO: 1634214 - RNA, 12 nt, Human
cucacugcagcc

SEQ ID NO: 1634215 - RNA, 13 nt, Human
cucacugcagccu

SEQ ID NO: 1634216 - RNA, 14 nt, Human
cucacugcagccuc

SEQ ID NO: 1634217 - RNA, 12 nt, Human
cucacucugucg

SEQ ID NO: 1634218 - RNA, 11 nt, Human
cucacucuguc

SEQ ID NO: 1634219 - RNA, 13 nt, Human
cucacuccuugaa

SEQ ID NO: 1634220 - RNA, 19 nt, Human
cucacuccuaccugguaau

SEQ ID NO: 1634221 - RNA, 17 nt, Human
cucacuccuaccuggua

SEQ ID NO: 1634222 - RNA, 16 nt, Human
cucacuccuaccuggu

SEQ ID NO: 1634223 - RNA, 22 nt, Human
cucacuauguugcccaggcagg

SEQ ID NO: 1634224 - RNA, 21 nt, Human
cucacuauguugcccaggcag

SEQ ID NO: 1634225 - RNA, 23 nt, Human
cucacuauguugcccaggcaggu

SEQ ID NO: 1634226 - RNA, 15 nt, Human
cucacuccuaccugg

SEQ ID NO: 1634227 - RNA, 13 nt, Human
cucacuccuaccu

SEQ ID NO: 1634228 - RNA, 15 nt, Human
cucaccccagcccca

SEQ ID NO: 1634229 - RNA, 20 nt, Human
cucacuauguugcccaggca

SEQ ID NO: 1634230 - RNA, 19 nt, Human
cucacuauguugcccaggc

SEQ ID NO: 1634231 - RNA, 20 nt, Human
cucacuguugcccaggcugg

SEQ ID NO: 1634232 - RNA, 22 nt, Human
cucacugccaugccagcuuauc

SEQ ID NO: 1634233 - RNA, 19 nt, Human
cucacugccaugccagcuu

SEQ ID NO: 1634234 - RNA, 22 nt, Human
cucacuguugcccaggcuggcg

SEQ ID NO: 1634235 - RNA, 21 nt, Human
cucacuguugcccaggcuggc

SEQ ID NO: 1634236 - RNA, 14 nt, Human
cucagagagggugg

SEQ ID NO: 1634237 - RNA, 18 nt, Human
cucagagagggugggagu

SEQ ID NO: 1634238 - RNA, 17 nt, Human
cucagcauccuggcacc

SEQ ID NO: 1634239 - RNA, 16 nt, Human
cucagcauccuggcac

SEQ ID NO: 1634240 - RNA, 15 nt, Human
cucagaucuucugug

SEQ ID NO: 1634241 - RNA, 13 nt, Human
cucagauuuuauu

SEQ ID NO: 1634242 - RNA, 22 nt, Human
cucagauuuuauuauguaaauc

SEQ ID NO: 1634243 - RNA, 18 nt, Human
cucagauuuuauuaugua

SEQ ID NO: 1634244 - RNA, 17 nt, Human
cucagauuuuauuaugu

SEQ ID NO: 1634245 - RNA, 15 nt, Human
cucagauuuuauuau

SEQ ID NO: 1634246 - RNA, 23 nt, Human
cucacaguccuuaccagcagagc

SEQ ID NO: 1634247 - RNA, 22 nt, Human
cucacaguccuuaccagcagag

SEQ ID NO: 1634248 - RNA, 19 nt, Human
cucacaguccuuaccagca

SEQ ID NO: 1634249 - RNA, 17 nt, Human
cucacaguccuuaccag

SEQ ID NO: 1634250 - RNA, 19 nt, Human
cucacauuuauucugcuca

SEQ ID NO: 1634251 - RNA, 15 nt, Human
cucacauuuauucug

SEQ ID NO: 1634252 - RNA, 22 nt, Human
cucacauuuauucugcucacau

SEQ ID NO: 1634253 - RNA, 15 nt, Human
cucaccagccccagu

SEQ ID NO: 1634254 - RNA, 14 nt, Human
cucaccagccccag

SEQ ID NO: 1634255 - RNA, 13 nt, Human
cucaccagcccca

SEQ ID NO: 1634256 - RNA, 18 nt, Human
cucaccagccccagugcc

SEQ ID NO: 1634257 - RNA, 17 nt, Human
cucaccagccccagugc

SEQ ID NO: 1634258 - RNA, 15 nt, Human
cucacaguccuuacc

SEQ ID NO: 1634259 - RNA, 24 nt, Human
cucacacaugagcaucaggccagg

SEQ ID NO: 1634260 - RNA, 22 nt, Human
cucacacaugagcaucaggcca

SEQ ID NO: 1634261 - RNA, 21 nt, Human
cucaaguccucuuuucugaga

SEQ ID NO: 1634262 - RNA, 17 nt, Human
cucaagugauucuccug

SEQ ID NO: 1634263 - RNA, 18 nt, Human
cuauuguuagucucuuga

SEQ ID NO: 1634264 - RNA, 19 nt, Human
cuauugucaccagggcugg

SEQ ID NO: 1634265 - RNA, 22 nt, Human
cuauuuaugugauccuuuugga

SEQ ID NO: 1634266 - RNA, 17 nt, Human
cucaaccuccugggcua

SEQ ID NO: 1634267 - RNA, 15 nt, Human
cucaaccuccugggc

SEQ ID NO: 1634268 - RNA, 13 nt, Human
cucaaccuccugg

SEQ ID NO: 1634269 - RNA, 21 nt, Human
cucaacaccucugcacaagcu

SEQ ID NO: 1634270 - RNA, 23 nt, Human
cucaaauacgugggcauucaaau

SEQ ID NO: 1634271 - RNA, 18 nt, Human
cuauuucuauauuuucau

SEQ ID NO: 1634272 - RNA, 16 nt, Human
cuauuucuauauuuuc

SEQ ID NO: 1634273 - RNA, 14 nt, Human
cuauuucuauauuu

SEQ ID NO: 1634274 - RNA, 19 nt, Human
gagcaaaaucgaugcagug

SEQ ID NO: 1634275 - RNA, 23 nt, Human
gagcaagacgcugugcugcccug

SEQ ID NO: 1634276 - RNA, 22 nt, Human
gagcaagacgcugugcugcccu

SEQ ID NO: 1634277 - RNA, 18 nt, Human
gagcaagacgcugugcug

SEQ ID NO: 1634278 - RNA, 21 nt, Human
gagcaagacgcugugcugccc

SEQ ID NO: 1634279 - RNA, 17 nt, Human
gagcaccuuagacaguc

SEQ ID NO: 1634280 - RNA, 19 nt, Human
gagcaccuuagacaguccc

SEQ ID NO: 1634281 - RNA, 20 nt, Human
gagaucaaccccuucgcucc

SEQ ID NO: 1634282 - RNA, 16 nt, Human
gagaucagccugggca

SEQ ID NO: 1634283 - RNA, 14 nt, Human
gagaucagccuggg

SEQ ID NO: 1634284 - RNA, 13 nt, Human
gagaucagccugg

SEQ ID NO: 1634285 - RNA, 21 nt, Human
gagcaggcuacugucagcucc

SEQ ID NO: 1634286 - RNA, 13 nt, Human
gagccacugcacc

SEQ ID NO: 1634287 - RNA, 20 nt, Human
gagccaccgugccuggccac

SEQ ID NO: 1634288 - RNA, 14 nt, Human
gagccaccgugccu

SEQ ID NO: 1634289 - RNA, 18 nt, Human
gagcagccacauuccuga

SEQ ID NO: 1634290 - RNA, 12 nt, Human
gagcccaggccu

SEQ ID NO: 1634291 - RNA, 16 nt, Human
gagcccacgcccccac

SEQ ID NO: 1634292 - RNA, 15 nt, Human
gagcccacgccccca

SEQ ID NO: 1634293 - RNA, 12 nt, Human
gagcccacgccc

SEQ ID NO: 1634294 - RNA, 14 nt, Human
gagcccaggccucc

SEQ ID NO: 1634295 - RNA, 13 nt, Human
gagcccaggccuc

SEQ ID NO: 1634296 - RNA, 18 nt, Human
gagcccacgcccccacug

SEQ ID NO: 1634297 - RNA, 13 nt, Human
gagccagauuuca

SEQ ID NO: 1634298 - RNA, 22 nt, Human
gagccacugcaccgggccacag

SEQ ID NO: 1634299 - RNA, 12 nt, Human
gagcuacaaaug

SEQ ID NO: 1634300 - RNA, 13 nt, Human
gagcuacaaaugc

SEQ ID NO: 1634301 - RNA, 21 nt, Human
gagccugggaggucaaggcug

SEQ ID NO: 1634302 - RNA, 13 nt, Human
gagccugggaggu

SEQ ID NO: 1634303 - RNA, 10 nt, Human
gagccuggca

SEQ ID NO: 1634304 - RNA, 15 nt, Human
gagccuggcaagaau

SEQ ID NO: 1634305 - RNA, 17 nt, Human
gagcccugguggcagug

SEQ ID NO: 1634306 - RNA, 19 nt, Human
gagccucagcauccuggca

SEQ ID NO: 1634307 - RNA, 16 nt, Human
gagcccugguggcagu

SEQ ID NO: 1634308 - RNA, 15 nt, Human
gagcccugguggcag

SEQ ID NO: 1634309 - RNA, 21 nt, Human
gagccucagcauccuggcacc

SEQ ID NO: 1634310 - RNA, 20 nt, Human
gagccucagcauccuggcac

SEQ ID NO: 1634311 - RNA, 14 nt, Human
gagccuccugcccu

SEQ ID NO: 1634312 - RNA, 18 nt, Human
gagcccugguggcagugg

SEQ ID NO: 1634313 - RNA, 18 nt, Human
gagccucagucucccucc

SEQ ID NO: 1634314 - RNA, 22 nt, Human
gagccuccugcccuuaccugcc

SEQ ID NO: 1634315 - RNA, 20 nt, Human
gagccuccugcccuuaccug

SEQ ID NO: 1634316 - RNA, 22 nt, Human
gagccugcacggugaauggcuu

SEQ ID NO: 1634317 - RNA, 17 nt, Human
gagccugcacggugaau

SEQ ID NO: 1634318 - RNA, 23 nt, Human
gagccugcacggugaauggcuuu

SEQ ID NO: 1634319 - RNA, 14 nt, Human
gagcugcccucucc

SEQ ID NO: 1634320 - RNA, 16 nt, Human
gagcugccaccugccu

SEQ ID NO: 1634321 - RNA, 15 nt, Human
gagcugccaccugcc

SEQ ID NO: 1634322 - RNA, 13 nt, Human
gagcugccaccug

SEQ ID NO: 1634323 - RNA, 16 nt, Human
gagcucugcagagcag

SEQ ID NO: 1634324 - RNA, 15 nt, Human
gagcugcccucuccu

SEQ ID NO: 1634325 - RNA, 16 nt, Human
gagcugcccucuccug

SEQ ID NO: 1634326 - RNA, 17 nt, Human
gagcugcccucuccugg

SEQ ID NO: 1634327 - RNA, 15 nt, Human
gagcuuaacagugug

SEQ ID NO: 1634328 - RNA, 18 nt, Human
gagcuucuguugcugccu

SEQ ID NO: 1634329 - RNA, 14 nt, Human
gagcuucuggcacu

SEQ ID NO: 1634330 - RNA, 14 nt, Human
gagcuacaaaugca

SEQ ID NO: 1634331 - RNA, 23 nt, Human
gagcuacacaggggaaaagagga

SEQ ID NO: 1634332 - RNA, 19 nt, Human
gaggcccccaucuccuuaa

SEQ ID NO: 1634333 - RNA, 13 nt, Human
gaggcccggccuc

SEQ ID NO: 1634334 - RNA, 23 nt, Human
gaggcccuucucuccagccccug

SEQ ID NO: 1634335 - RNA, 14 nt, Human
gaggcccuucucuc

SEQ ID NO: 1634336 - RNA, 24 nt, Human
gaggcccuucucuccagccccugg

SEQ ID NO: 1634337 - RNA, 14 nt, Human
gaggccuucucuga

SEQ ID NO: 1634338 - RNA, 15 nt, Human
gaggcugggcucccu

SEQ ID NO: 1634339 - RNA, 16 nt, Human
gaggcugggcucccuu

SEQ ID NO: 1634340 - RNA, 14 nt, Human
gaggcugggcuccc

SEQ ID NO: 1634341 - RNA, 13 nt, Human
gaggcugggcucc

SEQ ID NO: 1634342 - RNA, 18 nt, Human
gaggcuacuguaaggcaa

SEQ ID NO: 1634343 - RNA, 16 nt, Human
gagggagugacagagg

SEQ ID NO: 1634344 - RNA, 16 nt, Human
gagggagggcuccaga

SEQ ID NO: 1634345 - RNA, 14 nt, Human
gagggagugacaga

SEQ ID NO: 1634346 - RNA, 13 nt, Human
gagggagugacag

SEQ ID NO: 1634347 - RNA, 22 nt, Human
gagggcacagaaaauggaagac

SEQ ID NO: 1634348 - RNA, 14 nt, Human
gagggcacagaaaa

SEQ ID NO: 1634349 - RNA, 23 nt, Human
gagggcacagaaaauggaagaca

SEQ ID NO: 1634350 - RNA, 12 nt, Human
gagggcacuggu

SEQ ID NO: 1634351 - RNA, 18 nt, Human
gagggcacugguggcccg

SEQ ID NO: 1634352 - RNA, 16 nt, Human
gagggcacugguggcc

SEQ ID NO: 1634353 - RNA, 22 nt, Human
gaggggccucuuaugggcuggg

SEQ ID NO: 1634354 - RNA, 20 nt, Human
gaggggccuggcagccgugc

SEQ ID NO: 1634355 - RNA, 18 nt, Human
gaggggccuggcagccgu

SEQ ID NO: 1634356 - RNA, 14 nt, Human
gaggggccuggcag

SEQ ID NO: 1634357 - RNA, 13 nt, Human
gaggggccuggca

SEQ ID NO: 1634358 - RNA, 15 nt, Human
gagggagggcuccag

SEQ ID NO: 1634359 - RNA, 15 nt, Human
gagggagggagggcu

SEQ ID NO: 1634360 - RNA, 14 nt, Human
gagggagggagggc

SEQ ID NO: 1634361 - RNA, 13 nt, Human
gaggccagccuug

SEQ ID NO: 1634362 - RNA, 12 nt, Human
gaggccagccuu

SEQ ID NO: 1634363 - RNA, 22 nt, Human
gaggcagccccauucugccugc

SEQ ID NO: 1634364 - RNA, 18 nt, Human
gaggcagccccauucugc

SEQ ID NO: 1634365 - RNA, 23 nt, Human
gaggcagccccauucugccugcc

SEQ ID NO: 1634366 - RNA, 13 nt, Human
gaggcagccccau

SEQ ID NO: 1634367 - RNA, 23 nt, Human
gaggaguuugggguaugggagag

SEQ ID NO: 1634368 - RNA, 16 nt, Human
gaggauugcuugagcu

SEQ ID NO: 1634369 - RNA, 20 nt, Human
gaggauguucugggacacag

SEQ ID NO: 1634370 - RNA, 17 nt, Human
gaggauguucugggaca

SEQ ID NO: 1634371 - RNA, 12 nt, Human
gaggauguucug

SEQ ID NO: 1634372 - RNA, 14 nt, Human
gaggaauccagacc

SEQ ID NO: 1634373 - RNA, 22 nt, Human
gaggaaggaaacccagcucugg

SEQ ID NO: 1634374 - RNA, 21 nt, Human
gagcuucuguugcugccucau

SEQ ID NO: 1634375 - RNA, 22 nt, Human
gagcuugaaacccguggcgcuu

SEQ ID NO: 1634376 - RNA, 15 nt, Human
gaggaauccagaccc

SEQ ID NO: 1634377 - RNA, 14 nt, Human
gaggaauucuguau

SEQ ID NO: 1634378 - RNA, 17 nt, Human
gaggaauucuguauaga

SEQ ID NO: 1634379 - RNA, 16 nt, Human
gaggaauucuguauag

SEQ ID NO: 1634380 - RNA, 23 nt, Human
gaggacagggaggugaccccagg

SEQ ID NO: 1634381 - RNA, 22 nt, Human
gaggacagggaggugaccccag

SEQ ID NO: 1634382 - RNA, 13 nt, Human
gaggacagggagg

SEQ ID NO: 1634383 - RNA, 14 nt, Human
gaucuuuaaaauac

SEQ ID NO: 1634384 - RNA, 16 nt, Human
gaucuuugcagacagg

SEQ ID NO: 1634385 - RNA, 15 nt, Human
gaugaaaaaauaaca

SEQ ID NO: 1634386 - RNA, 17 nt, Human
gaucuuugcagacaggc

SEQ ID NO: 1634387 - RNA, 17 nt, Human
gauccuuuuggagucag

SEQ ID NO: 1634388 - RNA, 15 nt, Human
gauccuuuuggaguc

SEQ ID NO: 1634389 - RNA, 19 nt, Human
gauccugagccagauuuca

SEQ ID NO: 1634390 - RNA, 15 nt, Human
gauccugagccagau

SEQ ID NO: 1634391 - RNA, 14 nt, Human
gauccugagccaga

SEQ ID NO: 1634392 - RNA, 21 nt, Human
gauccucccaccucagccucc

SEQ ID NO: 1634393 - RNA, 20 nt, Human
gauccucccaccucagccuc

SEQ ID NO: 1634394 - RNA, 19 nt, Human
gauccucccaccucagccu

SEQ ID NO: 1634395 - RNA, 12 nt, Human
gauccuccaggu

SEQ ID NO: 1634396 - RNA, 14 nt, Human
gaucacgccacugc

SEQ ID NO: 1634397 - RNA, 13 nt, Human
gaucacgccacug

SEQ ID NO: 1634398 - RNA, 23 nt, Human
gaucaaccccuucgcuccugugu

SEQ ID NO: 1634399 - RNA, 18 nt, Human
gauccuaguuccaccauc

SEQ ID NO: 1634400 - RNA, 15 nt, Human
gaucacgccacugca

SEQ ID NO: 1634401 - RNA, 11 nt, Human
gauccuccagg

SEQ ID NO: 1634402 - RNA, 16 nt, Human
gaucacgccacugcac

SEQ ID NO: 1634403 - RNA, 16 nt, Human
gaugggaaagcauugu

SEQ ID NO: 1634404 - RNA, 22 nt, Human
gaugggcaacccccagccugcu

SEQ ID NO: 1634405 - RNA, 14 nt, Human
gaugccugguggca

SEQ ID NO: 1634406 - RNA, 21 nt, Human
gaugccuggcgggguggggug

SEQ ID NO: 1634407 - RNA, 18 nt, Human
gaugcaguucugaagaag

SEQ ID NO: 1634408 - RNA, 21 nt, Human
gaugcacagaguuguuacauu

SEQ ID NO: 1634409 - RNA, 23 nt, Human
gaugagaaauaaaguuucuguug

SEQ ID NO: 1634410 - RNA, 22 nt, Human
gaugagaaagguugaagcacca

SEQ ID NO: 1634411 - RNA, 11 nt, Human
gaugagaaagg

SEQ ID NO: 1634412 - RNA, 14 nt, Human
gaugacuauggaaa

SEQ ID NO: 1634413 - RNA, 13 nt, Human
gauugugccccug

SEQ ID NO: 1634414 - RNA, 20 nt, Human
gauuguccccgacccuugcc

SEQ ID NO: 1634415 - RNA, 15 nt, Human
gauuguccccgaccc

SEQ ID NO: 1634416 - RNA, 23 nt, Human
gauugacgggacuguugguauug

SEQ ID NO: 1634417 - RNA, 22 nt, Human
gauucccaagcucugcuccucu

SEQ ID NO: 1634418 - RNA, 12 nt, Human
gauucagacagc

SEQ ID NO: 1634419 - RNA, 19 nt, Human
gauguugaaaaaguucugc

SEQ ID NO: 1634420 - RNA, 21 nt, Human
gauguucuuucacccuuuucu

SEQ ID NO: 1634421 - RNA, 14 nt, Human
gauguuuuccauga

SEQ ID NO: 1634422 - RNA, 23 nt, Human
gauguuuuccaugaguccccugu

SEQ ID NO: 1634423 - RNA, 15 nt, Human
gauguuuuccaugag

SEQ ID NO: 1634424 - RNA, 12 nt, Human
gauuaaauucuu

SEQ ID NO: 1634425 - RNA, 19 nt, Human
gauuaaauucuugcaaagu

SEQ ID NO: 1634426 - RNA, 21 nt, Human
gauuaaccacuucagcugacu

SEQ ID NO: 1634427 - RNA, 19 nt, Human
gauuaaccacuucagcuga

SEQ ID NO: 1634428 - RNA, 18 nt, Human
gauuaaccacuucagcug

SEQ ID NO: 1634429 - RNA, 19 nt, Human
gauucaacagguuuuccug

SEQ ID NO: 1634430 - RNA, 20 nt, Human
gauggugcaaugaccuuuca

SEQ ID NO: 1634431 - RNA, 23 nt, Human
gauggugcaaugaccuuucaaua

SEQ ID NO: 1634432 - RNA, 19 nt, Human
gaugugcuuguuaacugag

SEQ ID NO: 1634433 - RNA, 16 nt, Human
gauguucugggacaca

SEQ ID NO: 1634434 - RNA, 20 nt, Human
gaugugcuuguuaacugagu

SEQ ID NO: 1634435 - RNA, 14 nt, Human
gauagaggaagccu

SEQ ID NO: 1634436 - RNA, 13 nt, Human
gauacaaugcugu

SEQ ID NO: 1634437 - RNA, 18 nt, Human
gauacaaugcugugcccu

SEQ ID NO: 1634438 - RNA, 18 nt, Human
gauagcacagacccugcc

SEQ ID NO: 1634439 - RNA, 17 nt, Human
gauagcacagacccugc

SEQ ID NO: 1634440 - RNA, 22 nt, Human
gauagaggaagccugauuaaag

SEQ ID NO: 1634441 - RNA, 21 nt, Human
gauagaggaagccugauuaaa

SEQ ID NO: 1634442 - RNA, 15 nt, Human
gauagaggaagccug

SEQ ID NO: 1634443 - RNA, 23 nt, Human
gauauaugcucugcauguuacau

SEQ ID NO: 1634444 - RNA, 22 nt, Human
gaucaaccccuucgcuccugug

SEQ ID NO: 1634445 - RNA, 20 nt, Human
gauagcacagacccugcccu

SEQ ID NO: 1634446 - RNA, 19 nt, Human
gauagcacagacccugccc

SEQ ID NO: 1634447 - RNA, 12 nt, Human
gauagccaaggc

SEQ ID NO: 1634448 - RNA, 14 nt, Human
gauagccaaggcca

SEQ ID NO: 1634449 - RNA, 13 nt, Human
gauagccaaggcc

SEQ ID NO: 1634450 - RNA, 21 nt, Human
gauauaaguguguguuuuuca

SEQ ID NO: 1634451 - RNA, 19 nt, Human
gagugaacaaauuuacaga

SEQ ID NO: 1634452 - RNA, 23 nt, Human
gagugaacaaauuuacagagaca

SEQ ID NO: 1634453 - RNA, 22 nt, Human
gagugaacaaauuuacagagac

SEQ ID NO: 1634454 - RNA, 23 nt, Human
gagugggggaucacagccucuga

SEQ ID NO: 1634455 - RNA, 12 nt, Human
gagugggcccaa

SEQ ID NO: 1634456 - RNA, 15 nt, Human
gaguggcuccucccg

SEQ ID NO: 1634457 - RNA, 13 nt, Human
gaguggcuccucc

SEQ ID NO: 1634458 - RNA, 21 nt, Human
gaguugaaaaucuuauaauuu

SEQ ID NO: 1634459 - RNA, 14 nt, Human
gaguugaagacaga

SEQ ID NO: 1634460 - RNA, 23 nt, Human
gaguucaucuugaauuguaagga

SEQ ID NO: 1634461 - RNA, 17 nt, Human
gagugugccugaagucc

SEQ ID NO: 1634462 - RNA, 14 nt, Human
gaguagcugggacu

SEQ ID NO: 1634463 - RNA, 12 nt, Human
gaguagcuggga

SEQ ID NO: 1634464 - RNA, 12 nt, Human
gaguccccuguu

SEQ ID NO: 1634465 - RNA, 19 nt, Human
gagucccaggcugagccuc

SEQ ID NO: 1634466 - RNA, 18 nt, Human
gagucccaggcugagccu

SEQ ID NO: 1634467 - RNA, 23 nt, Human
gaguccccuguuuguuucugaaa

SEQ ID NO: 1634468 - RNA, 14 nt, Human
gaguccccuguuug

SEQ ID NO: 1634469 - RNA, 17 nt, Human
gagucgaggacagggag

SEQ ID NO: 1634470 - RNA, 21 nt, Human
gagucucacuguugcccaggc

SEQ ID NO: 1634471 - RNA, 20 nt, Human
gagucucacuguugcccagg

SEQ ID NO: 1634472 - RNA, 19 nt, Human
gagucucacuguugcccag

SEQ ID NO: 1634473 - RNA, 23 nt, Human
gagucucacuguugcccaggcug

SEQ ID NO: 1634474 - RNA, 22 nt, Human
gagucucacuguugcccaggcu

SEQ ID NO: 1634475 - RNA, 12 nt, Human
gagucucuucuc

SEQ ID NO: 1634476 - RNA, 23 nt, Human
gagucucgcuauugucaccaggg

SEQ ID NO: 1634477 - RNA, 21 nt, Human
gagucugaaggcuggguucug

SEQ ID NO: 1634478 - RNA, 18 nt, Human
gagucucuucuccacugg

SEQ ID NO: 1634479 - RNA, 17 nt, Human
gagucucuucuccacug

SEQ ID NO: 1634480 - RNA, 16 nt, Human
gagucucuucuccacu

SEQ ID NO: 1634481 - RNA, 15 nt, Human
gagucucuucuccac

SEQ ID NO: 1634482 - RNA, 14 nt, Human
gagucucuucucca

SEQ ID NO: 1634483 - RNA, 18 nt, Human
gaggugggauccuccagg

SEQ ID NO: 1634484 - RNA, 22 nt, Human
gaggugggauccuccaggugca

SEQ ID NO: 1634485 - RNA, 21 nt, Human
gaggugggauccuccaggugc

SEQ ID NO: 1634486 - RNA, 15 nt, Human
gaggggggagguggg

SEQ ID NO: 1634487 - RNA, 15 nt, Human
gaggggguggccucc

SEQ ID NO: 1634488 - RNA, 18 nt, Human
gagguccacaacacacag

SEQ ID NO: 1634489 - RNA, 22 nt, Human
gaggggggaggugggauccucc

SEQ ID NO: 1634490 - RNA, 19 nt, Human
gaguacuacaguccuccca

SEQ ID NO: 1634491 - RNA, 18 nt, Human
gaguacuacaguccuccc

SEQ ID NO: 1634492 - RNA, 17 nt, Human
gaguacguugugcauuu

SEQ ID NO: 1634493 - RNA, 18 nt, Human
gaguacguugugcauuug

SEQ ID NO: 1634494 - RNA, 15 nt, Human
gaguacuacaguccu

SEQ ID NO: 1634495 - RNA, 20 nt, Human
gaguacguugugcauuuggu

SEQ ID NO: 1634496 - RNA, 14 nt, Human
gagguucccuuuga

SEQ ID NO: 1634497 - RNA, 19 nt, Human
gagguucaaagauauuuug

SEQ ID NO: 1634498 - RNA, 19 nt, Human
gagguuuuaaaaaaauccc

SEQ ID NO: 1634499 - RNA, 16 nt, Human
gaguacguugugcauu

SEQ ID NO: 1634500 - RNA, 21 nt, Human
gcaguugaaaagacuccaaag

SEQ ID NO: 1634501 - RNA, 19 nt, Human
gcauacguacacauuuuau

SEQ ID NO: 1634502 - RNA, 19 nt, Human
gcaguugaaaagacuccaa

SEQ ID NO: 1634503 - RNA, 16 nt, Human
gcaguugaaaagacuc

SEQ ID NO: 1634504 - RNA, 22 nt, Human
gcaguggugguuuucuguucuu

SEQ ID NO: 1634505 - RNA, 19 nt, Human
gcaguucagagcugcccuc

SEQ ID NO: 1634506 - RNA, 20 nt, Human
gcaguucagagcugcccucu

SEQ ID NO: 1634507 - RNA, 22 nt, Human
gcaguucagagcugcccucucc

SEQ ID NO: 1634508 - RNA, 23 nt, Human
gcaguucagagcugcccucuccu

SEQ ID NO: 1634509 - RNA, 20 nt, Human
gcaguggugguuuucuguuc

SEQ ID NO: 1634510 - RNA, 21 nt, Human
gcaguggugguuuucuguucu

SEQ ID NO: 1634511 - RNA, 21 nt, Human
gcaguggugcgaucuggguuc

SEQ ID NO: 1634512 - RNA, 20 nt, Human
gcaguggugcgaucuggguu

SEQ ID NO: 1634513 - RNA, 22 nt, Human
gcaguggugcgaucuggguuca

SEQ ID NO: 1634514 - RNA, 19 nt, Human
gcaguggugguuuucuguu

SEQ ID NO: 1634515 - RNA, 19 nt, Human
gcaguggugcgaucugggu

SEQ ID NO: 1634516 - RNA, 18 nt, Human
gcaguggugcgaucuggg

SEQ ID NO: 1634517 - RNA, 12 nt, Human
gcagugggagcu

SEQ ID NO: 1634518 - RNA, 11 nt, Human
gcagugggagc

SEQ ID NO: 1634519 - RNA, 21 nt, Human
gcagugggacagggcauggcc

SEQ ID NO: 1634520 - RNA, 23 nt, Human
gcaggucccuaauaaagcugugu

SEQ ID NO: 1634521 - RNA, 21 nt, Human
gcaggucccuaauaaagcugu

SEQ ID NO: 1634522 - RNA, 20 nt, Human
gcaggucccuaauaaagcug

SEQ ID NO: 1634523 - RNA, 19 nt, Human
gcaggucccuaauaaagcu

SEQ ID NO: 1634524 - RNA, 18 nt, Human
gcaggucccuaauaaagc

SEQ ID NO: 1634525 - RNA, 17 nt, Human
gcaggucccuaauaaag

SEQ ID NO: 1634526 - RNA, 16 nt, Human
gcaggucccuaauaaa

SEQ ID NO: 1634527 - RNA, 22 nt, Human
gcaggggaggguagagcggaga

SEQ ID NO: 1634528 - RNA, 16 nt, Human
gcagggucucacucug

SEQ ID NO: 1634529 - RNA, 19 nt, Human
gcaggguccuagaaauucc

SEQ ID NO: 1634530 - RNA, 15 nt, Human
gcaggucccuaauaa

SEQ ID NO: 1634531 - RNA, 14 nt, Human
gcaggucccuaaua

SEQ ID NO: 1634532 - RNA, 18 nt, Human
gcaggcagccaggccaca

SEQ ID NO: 1634533 - RNA, 22 nt, Human
gcaucagcugcugaaacaacaa

SEQ ID NO: 1634534 - RNA, 23 nt, Human
gcaucagcugcugaaacaacaaa

SEQ ID NO: 1634535 - RNA, 12 nt, Human
gcaucaggccag

SEQ ID NO: 1634536 - RNA, 13 nt, Human
gcaucaggccagg

SEQ ID NO: 1634537 - RNA, 18 nt, Human
gcaucaggccaggcccuc

SEQ ID NO: 1634538 - RNA, 23 nt, Human
gcaucaggccaggcccucugccc

SEQ ID NO: 1634539 - RNA, 15 nt, Human
gcaucagugcccucc

SEQ ID NO: 1634540 - RNA, 23 nt, Human
gcaucagugcccuccaggauaga

SEQ ID NO: 1634541 - RNA, 14 nt, Human
gcaucucagcccac

SEQ ID NO: 1634542 - RNA, 13 nt, Human
gcaucucagccca

SEQ ID NO: 1634543 - RNA, 12 nt, Human
gcaucucagccc

SEQ ID NO: 1634544 - RNA, 22 nt, Human
gcaugacacgaauauugcugau

SEQ ID NO: 1634545 - RNA, 21 nt, Human
gcaugacacgaauauugcuga

SEQ ID NO: 1634546 - RNA, 23 nt, Human
gcaugaaguaauaugcacacauu

SEQ ID NO: 1634547 - RNA, 20 nt, Human
gcaugaaguaauaugcacac

SEQ ID NO: 1634548 - RNA, 21 nt, Human
gcaugaaguaauaugcacaca

SEQ ID NO: 1634549 - RNA, 22 nt, Human
gcaugaaguaauaugcacacau

SEQ ID NO: 1634550 - RNA, 15 nt, Human
gcaucucagcccaca

SEQ ID NO: 1634551 - RNA, 14 nt, Human
gcaugccuggaugg

SEQ ID NO: 1634552 - RNA, 14 nt, Human
gcauguucucugag

SEQ ID NO: 1634553 - RNA, 13 nt, Human
gcauguuacauaa

SEQ ID NO: 1634554 - RNA, 15 nt, Human
gcaugccuggauggg

SEQ ID NO: 1634555 - RNA, 22 nt, Human
gcauuaucuagauacuguauca

SEQ ID NO: 1634556 - RNA, 24 nt, Human
gcauuaucuagauacuguaucaug

SEQ ID NO: 1634557 - RNA, 21 nt, Human
gcauuccccaggaggccagcc

SEQ ID NO: 1634558 - RNA, 20 nt, Human
gcauuccccaggaggccagc

SEQ ID NO: 1634559 - RNA, 19 nt, Human
gcauuccccaggaggccag

SEQ ID NO: 1634560 - RNA, 18 nt, Human
gcauuccccaggaggcca

SEQ ID NO: 1634561 - RNA, 17 nt, Human
gcauuccccaggaggcc

SEQ ID NO: 1634562 - RNA, 16 nt, Human
gcauuccccaggaggc

SEQ ID NO: 1634563 - RNA, 15 nt, Human
gcauuccccaggagg

SEQ ID NO: 1634564 - RNA, 14 nt, Human
gcauuccccaggag

SEQ ID NO: 1634565 - RNA, 22 nt, Human
gcauuccccaggaggccagccu

SEQ ID NO: 1634566 - RNA, 18 nt, Human
gcauuugaggucuguucu

SEQ ID NO: 1634567 - RNA, 18 nt, Human
gcacagccucuuagaugc

SEQ ID NO: 1634568 - RNA, 23 nt, Human
gcacagcuucauuuccugugucu

SEQ ID NO: 1634569 - RNA, 16 nt, Human
gcacagggcaguggga

SEQ ID NO: 1634570 - RNA, 15 nt, Human
gcacagccucuuaga

SEQ ID NO: 1634571 - RNA, 20 nt, Human
gauugugucucuugguccug

SEQ ID NO: 1634572 - RNA, 15 nt, Human
gcaccaucucuccuc

SEQ ID NO: 1634573 - RNA, 14 nt, Human
gcaccaucucuccu

SEQ ID NO: 1634574 - RNA, 13 nt, Human
gcaccagcagccu

SEQ ID NO: 1634575 - RNA, 14 nt, Human
gcaccagcagccug

SEQ ID NO: 1634576 - RNA, 17 nt, Human
gcaccaucucuccuccu

SEQ ID NO: 1634577 - RNA, 20 nt, Human
gcacuaaggugugcucugau

SEQ ID NO: 1634578 - RNA, 14 nt, Human
gcacgugugugcac

SEQ ID NO: 1634579 - RNA, 19 nt, Human
gcacccucaggcagguggg

SEQ ID NO: 1634580 - RNA, 16 nt, Human
gcacccucaggcaggu

SEQ ID NO: 1634581 - RNA, 15 nt, Human
gcacugcuuccagug

SEQ ID NO: 1634582 - RNA, 14 nt, Human
gcacugcuuccagu

SEQ ID NO: 1634583 - RNA, 13 nt, Human
gcacugcuuccag

SEQ ID NO: 1634584 - RNA, 12 nt, Human
gcacugcuucca

SEQ ID NO: 1634585 - RNA, 15 nt, Human
gcacuauaauguaag

SEQ ID NO: 1634586 - RNA, 14 nt, Human
gcacuauaauguaa

SEQ ID NO: 1634587 - RNA, 20 nt, Human
gcacuauaauguaagcucua

SEQ ID NO: 1634588 - RNA, 22 nt, Human
gcacuauaauguaagcucuacu

SEQ ID NO: 1634589 - RNA, 14 nt, Human
gcacugggcuuggg

SEQ ID NO: 1634590 - RNA, 19 nt, Human
gcacuguuuuauuuuaauu

SEQ ID NO: 1634591 - RNA, 12 nt, Human
gcacugggcuug

SEQ ID NO: 1634592 - RNA, 18 nt, Human
gcagagguugcagugagc

SEQ ID NO: 1634593 - RNA, 21 nt, Human
gcagagguccacaacacacag

SEQ ID NO: 1634594 - RNA, 23 nt, Human
gcagagguugcagugagccgaga

SEQ ID NO: 1634595 - RNA, 18 nt, Human
gcagauggagaccccuug

SEQ ID NO: 1634596 - RNA, 18 nt, Human
gcagauguccuugaugcu

SEQ ID NO: 1634597 - RNA, 16 nt, Human
gcagauuauucacuga

SEQ ID NO: 1634598 - RNA, 13 nt, Human
gcagauuauucac

SEQ ID NO: 1634599 - RNA, 22 nt, Human
gcagacucuacagaggccaugg

SEQ ID NO: 1634600 - RNA, 19 nt, Human
gcagacucuacagaggcca

SEQ ID NO: 1634601 - RNA, 18 nt, Human
gcagacucuacagaggcc

SEQ ID NO: 1634602 - RNA, 17 nt, Human
gcagacucuacagaggc

SEQ ID NO: 1634603 - RNA, 16 nt, Human
gcacuugcagacucua

SEQ ID NO: 1634604 - RNA, 14 nt, Human
gcacuugcagacuc

SEQ ID NO: 1634605 - RNA, 22 nt, Human
gcacuucgggaggucgaggcag

SEQ ID NO: 1634606 - RNA, 21 nt, Human
gcagagaccaucccugaaggc

SEQ ID NO: 1634607 - RNA, 20 nt, Human
gcagagaccaucccugaagg

SEQ ID NO: 1634608 - RNA, 22 nt, Human
gcagagaccaucccugaaggcc

SEQ ID NO: 1634609 - RNA, 19 nt, Human
gcagccucacaguccuuac

SEQ ID NO: 1634610 - RNA, 17 nt, Human
gcagccucacaguccuu

SEQ ID NO: 1634611 - RNA, 15 nt, Human
gcagccucacagucc

SEQ ID NO: 1634612 - RNA, 19 nt, Human
gcagcagggagggcuucug

SEQ ID NO: 1634613 - RNA, 18 nt, Human
gcagcagggagggcuucu

SEQ ID NO: 1634614 - RNA, 20 nt, Human
gcagcagggagggcuucugc

SEQ ID NO: 1634615 - RNA, 14 nt, Human
gcagcccugcuuug

SEQ ID NO: 1634616 - RNA, 24 nt, Human
gcagcccugcuuugggcugcccug

SEQ ID NO: 1634617 - RNA, 14 nt, Human
gcagcucagagagg

SEQ ID NO: 1634618 - RNA, 21 nt, Human
gcagcucaccucucccuugga

SEQ ID NO: 1634619 - RNA, 20 nt, Human
gcagcucaccucucccuugg

SEQ ID NO: 1634620 - RNA, 17 nt, Human
gcagcucaccucucccu

SEQ ID NO: 1634621 - RNA, 16 nt, Human
gcagcucaccucuccc

SEQ ID NO: 1634622 - RNA, 19 nt, Human
gcagcucagagaggguggg

SEQ ID NO: 1634623 - RNA, 18 nt, Human
gcagcucagagagggugg

SEQ ID NO: 1634624 - RNA, 19 nt, Human
gccagauuuuccugaaaac

SEQ ID NO: 1634625 - RNA, 14 nt, Human
gccaggcugcucuu

SEQ ID NO: 1634626 - RNA, 13 nt, Human
gccaggcugcucu

SEQ ID NO: 1634627 - RNA, 13 nt, Human
gccaggcuggguc

SEQ ID NO: 1634628 - RNA, 22 nt, Human
gccaggcugcucuugaacuccu

SEQ ID NO: 1634629 - RNA, 21 nt, Human
gccagauuucacucuccuugg

SEQ ID NO: 1634630 - RNA, 18 nt, Human
gccagauuucacucuccu

SEQ ID NO: 1634631 - RNA, 16 nt, Human
gccagauuucacucuc

SEQ ID NO: 1634632 - RNA, 23 nt, Human
gccagggacagaggggguggccu

SEQ ID NO: 1634633 - RNA, 18 nt, Human
gccagggacagagggggu

SEQ ID NO: 1634634 - RNA, 16 nt, Human
gccagggacagagggg

SEQ ID NO: 1634635 - RNA, 13 nt, Human
gccagggacagag

SEQ ID NO: 1634636 - RNA, 22 nt, Human
gccaggcuggucucgaacuccu

SEQ ID NO: 1634637 - RNA, 18 nt, Human
gccagucaccccggccac

SEQ ID NO: 1634638 - RNA, 17 nt, Human
gccagucaccccggcca

SEQ ID NO: 1634639 - RNA, 20 nt, Human
gccagucaccccggccaccu

SEQ ID NO: 1634640 - RNA, 21 nt, Human
gccagucaccccggccaccug

SEQ ID NO: 1634641 - RNA, 17 nt, Human
gccagguuuuuggucug

SEQ ID NO: 1634642 - RNA, 12 nt, Human
gccaguaaaugg

SEQ ID NO: 1634643 - RNA, 23 nt, Human
gccaugggacagggaggacgcuc

SEQ ID NO: 1634644 - RNA, 19 nt, Human
gccaugggcacugugggua

SEQ ID NO: 1634645 - RNA, 15 nt, Human
gcccaaagaugcagc

SEQ ID NO: 1634646 - RNA, 14 nt, Human
gcccaaccugcucu

SEQ ID NO: 1634647 - RNA, 21 nt, Human
gccaucucaccuccugcuggg

SEQ ID NO: 1634648 - RNA, 20 nt, Human
gccaucucaccuccugcugg

SEQ ID NO: 1634649 - RNA, 19 nt, Human
gccaucucaccuccugcug

SEQ ID NO: 1634650 - RNA, 20 nt, Human
gccaugaggaacaaggcaag

SEQ ID NO: 1634651 - RNA, 18 nt, Human
gccaugaggaacaaggca

SEQ ID NO: 1634652 - RNA, 18 nt, Human
gccaugccagcuuaucuc

SEQ ID NO: 1634653 - RNA, 13 nt, Human
gccaugccagcuu

SEQ ID NO: 1634654 - RNA, 19 nt, Human
gccaugccagcuuaucuca

SEQ ID NO: 1634655 - RNA, 20 nt, Human
gcccagucuggaaugcagug

SEQ ID NO: 1634656 - RNA, 19 nt, Human
gcccagucuggaaugcagu

SEQ ID NO: 1634657 - RNA, 21 nt, Human
gcccaggcuuagucacugaga

SEQ ID NO: 1634658 - RNA, 19 nt, Human
gcccaggcuuagucacuga

SEQ ID NO: 1634659 - RNA, 23 nt, Human
gcccaggcuuagucacugagaca

SEQ ID NO: 1634660 - RNA, 21 nt, Human
gcccaggaaaggcuccaggag

SEQ ID NO: 1634661 - RNA, 20 nt, Human
gcccaggaaaggcuccagga

SEQ ID NO: 1634662 - RNA, 19 nt, Human
gcccaggaaaggcuccagg

SEQ ID NO: 1634663 - RNA, 18 nt, Human
gcccaggaaaggcuccag

SEQ ID NO: 1634664 - RNA, 20 nt, Human
gcccaggcuggcgugcagug

SEQ ID NO: 1634665 - RNA, 19 nt, Human
gcccaggcuggcgugcagu

SEQ ID NO: 1634666 - RNA, 22 nt, Human
gcccaggcuggcgugcaguggu

SEQ ID NO: 1634667 - RNA, 17 nt, Human
gcccagccccuucugac

SEQ ID NO: 1634668 - RNA, 16 nt, Human
gcccagccccuucuga

SEQ ID NO: 1634669 - RNA, 14 nt, Human
gcccagccccuucu

SEQ ID NO: 1634670 - RNA, 13 nt, Human
gcccagccccuuc

SEQ ID NO: 1634671 - RNA, 24 nt, Human
gcccagccccuucugacccaugcu

SEQ ID NO: 1634672 - RNA, 20 nt, Human
gcccagccccuucugaccca

SEQ ID NO: 1634673 - RNA, 21 nt, Human
gcccagcuugaaaccuucacu

SEQ ID NO: 1634674 - RNA, 12 nt, Human
gcccagccccuu

SEQ ID NO: 1634675 - RNA, 11 nt, Human
gcccagccccu

SEQ ID NO: 1634676 - RNA, 9 nt, Human
gcccagccc

SEQ ID NO: 1634677 - RNA, 21 nt, Human
gcccagagggccugcaaggga

SEQ ID NO: 1634678 - RNA, 20 nt, Human
gcccagagggccugcaaggg

SEQ ID NO: 1634679 - RNA, 22 nt, Human
gcccagagggccugcaagggag

SEQ ID NO: 1634680 - RNA, 19 nt, Human
gcccagagggccugcaagg

SEQ ID NO: 1634681 - RNA, 18 nt, Human
gcccagagggccugcaag

SEQ ID NO: 1634682 - RNA, 15 nt, Human
gcccagagggccugc

SEQ ID NO: 1634683 - RNA, 14 nt, Human
gcccagagggccug

SEQ ID NO: 1634684 - RNA, 12 nt, Human
gcccagagggcc

SEQ ID NO: 1634685 - RNA, 15 nt, Human
gcccagagagggugg

SEQ ID NO: 1634686 - RNA, 21 nt, Human
gcccaaugcacuuuguucugg

SEQ ID NO: 1634687 - RNA, 18 nt, Human
gccagacuggcacaguuu

SEQ ID NO: 1634688 - RNA, 15 nt, Human
gccagacuggcacag

SEQ ID NO: 1634689 - RNA, 20 nt, Human
gccacuauuguuagucucuu

SEQ ID NO: 1634690 - RNA, 19 nt, Human
gccagacuggcacaguuuu

SEQ ID NO: 1634691 - RNA, 16 nt, Human
gccagagacacaagcc

SEQ ID NO: 1634692 - RNA, 19 nt, Human
gccagagacacaagccuuc

SEQ ID NO: 1634693 - RNA, 17 nt, Human
gccagagacacaagccu

SEQ ID NO: 1634694 - RNA, 10 nt, Human
gccagaggag

SEQ ID NO: 1634695 - RNA, 20 nt, Human
gccagagacacaagccuucg

SEQ ID NO: 1634696 - RNA, 18 nt, Human
gccagaugcaccagcccu

SEQ ID NO: 1634697 - RNA, 17 nt, Human
gccagaugcaccagccc

SEQ ID NO: 1634698 - RNA, 16 nt, Human
gccagaugcaccagcc

SEQ ID NO: 1634699 - RNA, 23 nt, Human
gccagagggagugacagaggcag

SEQ ID NO: 1634700 - RNA, 22 nt, Human
gccagagggagugacagaggca

SEQ ID NO: 1634701 - RNA, 21 nt, Human
gccagagggagugacagaggc

SEQ ID NO: 1634702 - RNA, 22 nt, Human
gccagaggagagaggacccccu

SEQ ID NO: 1634703 - RNA, 19 nt, Human
gccagaggagagaggaccc

SEQ ID NO: 1634704 - RNA, 17 nt, Human
gccagaggagagaggac

SEQ ID NO: 1634705 - RNA, 15 nt, Human
gccagaggagagagg

SEQ ID NO: 1634706 - RNA, 13 nt, Human
gccagaggagaga

SEQ ID NO: 1634707 - RNA, 12 nt, Human
gccagaggagag

SEQ ID NO: 1634708 - RNA, 17 nt, Human
gccaccugccuguuggg

SEQ ID NO: 1634709 - RNA, 22 nt, Human
gccaccgugccuggccacgccc

SEQ ID NO: 1634710 - RNA, 17 nt, Human
gccaccgugccuggcca

SEQ ID NO: 1634711 - RNA, 18 nt, Human
gccacggccaggccagag

SEQ ID NO: 1634712 - RNA, 20 nt, Human
gccacgcccaacuaauuuuu

SEQ ID NO: 1634713 - RNA, 19 nt, Human
gccacggccaggccagagg

SEQ ID NO: 1634714 - RNA, 20 nt, Human
gccaccugcggugcuaucuc

SEQ ID NO: 1634715 - RNA, 14 nt, Human
gccaccugcggugc

SEQ ID NO: 1634716 - RNA, 22 nt, Human
gccaccugcggugcuaucuccc

SEQ ID NO: 1634717 - RNA, 11 nt, Human
gccaccugggu

SEQ ID NO: 1634718 - RNA, 21 nt, Human
gccaaggcugggggaagaagc

SEQ ID NO: 1634719 - RNA, 12 nt, Human
gcauuugugaaa

SEQ ID NO: 1634720 - RNA, 21 nt, Human
gcauuugaggucuguucuuuc

SEQ ID NO: 1634721 - RNA, 19 nt, Human
gcauuugaggucuguucuu

SEQ ID NO: 1634722 - RNA, 20 nt, Human
gcauuugaggucuguucuuu

SEQ ID NO: 1634723 - RNA, 22 nt, Human
gcauuuggugguuucagaaaug

SEQ ID NO: 1634724 - RNA, 23 nt, Human
gcauuuggugguuucagaaaugu

SEQ ID NO: 1634725 - RNA, 23 nt, Human
gccaaggugggaggauugcuuga

SEQ ID NO: 1634726 - RNA, 15 nt, Human
gccaaggugggagga

SEQ ID NO: 1634727 - RNA, 14 nt, Human
gccaaggugggagg

SEQ ID NO: 1634728 - RNA, 21 nt, Human
gccaauggagacugucucaag

SEQ ID NO: 1634729 - RNA, 19 nt, Human
gccaauggagacugucuca

SEQ ID NO: 1634730 - RNA, 16 nt, Human
gccaauggagacuguc

SEQ ID NO: 1634731 - RNA, 20 nt, Human
gccaauaauaauaccucccu

SEQ ID NO: 1634732 - RNA, 20 nt, Human
gccacagagaaaguacuucu

SEQ ID NO: 1634733 - RNA, 14 nt, Human
gccacagagaaagu

SEQ ID NO: 1634734 - RNA, 13 nt, Human
gccacagagaaag

SEQ ID NO: 1634735 - RNA, 23 nt, Human
gccacacuucaggcucuucuccu

SEQ ID NO: 1634736 - RNA, 22 nt, Human
gccacacuucaggcucuucucc

SEQ ID NO: 1634737 - RNA, 20 nt, Human
gccacacuucaggcucuucu

SEQ ID NO: 1634738 - RNA, 23 nt, Human
gccacagagaaaguacuucucca

SEQ ID NO: 1634739 - RNA, 22 nt, Human
gccacaagacccuugugguccc

SEQ ID NO: 1634740 - RNA, 16 nt, Human
gccacaagacccuugu

SEQ ID NO: 1634741 - RNA, 15 nt, Human
gcugugucucccuuc

SEQ ID NO: 1634742 - RNA, 16 nt, Human
gcuguguggcagucug

SEQ ID NO: 1634743 - RNA, 16 nt, Human
gcugucccuuuuccuu

SEQ ID NO: 1634744 - RNA, 23 nt, Human
gcugucccuuacgugaguccugg

SEQ ID NO: 1634745 - RNA, 15 nt, Human
gcuggugucaccuga

SEQ ID NO: 1634746 - RNA, 14 nt, Human
gcuggugucaccug

SEQ ID NO: 1634747 - RNA, 21 nt, Human
gcugguguaugugugaaguga

SEQ ID NO: 1634748 - RNA, 17 nt, Human
gcugucagccauuccug

SEQ ID NO: 1634749 - RNA, 16 nt, Human
gcuggugucaccugaa

SEQ ID NO: 1634750 - RNA, 13 nt, Human
gcugucaucucag

SEQ ID NO: 1634751 - RNA, 23 nt, Human
gcuggucccagccagcaguucag

SEQ ID NO: 1634752 - RNA, 14 nt, Human
gcuggucccacuca

SEQ ID NO: 1634753 - RNA, 23 nt, Human
gcuggucucgaacuccugaccuu

SEQ ID NO: 1634754 - RNA, 22 nt, Human
gcuggucucgaacuccugaccu

SEQ ID NO: 1634755 - RNA, 19 nt, Human
gcuggucucgaacuccuga

SEQ ID NO: 1634756 - RNA, 18 nt, Human
gcugggggccucagugcc

SEQ ID NO: 1634757 - RNA, 15 nt, Human
gcugggggccucagu

SEQ ID NO: 1634758 - RNA, 14 nt, Human
gcugggggccucag

SEQ ID NO: 1634759 - RNA, 15 nt, Human
gcuggccuggccccu

SEQ ID NO: 1634760 - RNA, 14 nt, Human
gcuggccuggcccc

SEQ ID NO: 1634761 - RNA, 13 nt, Human
gcuggccuggccc

SEQ ID NO: 1634762 - RNA, 21 nt, Human
gcugggcucccuucccaccuc

SEQ ID NO: 1634763 - RNA, 19 nt, Human
gcugggaugauuggagggg

SEQ ID NO: 1634764 - RNA, 20 nt, Human
gcugggcuucaguggcagcu

SEQ ID NO: 1634765 - RNA, 21 nt, Human
gcugggaugauuggagggggg

SEQ ID NO: 1634766 - RNA, 22 nt, Human
gcugggcuucaguggcagcugc

SEQ ID NO: 1634767 - RNA, 21 nt, Human
gcugggcuucaguggcagcug

SEQ ID NO: 1634768 - RNA, 15 nt, Human
gcuuuuaugugaaac

SEQ ID NO: 1634769 - RNA, 13 nt, Human
gcuuuuaugugaa

SEQ ID NO: 1634770 - RNA, 20 nt, Human
gcuuuguauagaaccucuuu

SEQ ID NO: 1634771 - RNA, 14 nt, Human
gcuuuguauagaac

SEQ ID NO: 1634772 - RNA, 19 nt, Human
gcuuugggcugcccuggug

SEQ ID NO: 1634773 - RNA, 13 nt, Human
gcuuuguauagaa

SEQ ID NO: 1634774 - RNA, 12 nt, Human
gcuuuguauaga

SEQ ID NO: 1634775 - RNA, 19 nt, Human
gcuucuguuuuauaauuuu

SEQ ID NO: 1634776 - RNA, 19 nt, Human
gcuucuguugcugccucau

SEQ ID NO: 1634777 - RNA, 18 nt, Human
gcuucuguugcugccuca

SEQ ID NO: 1634778 - RNA, 17 nt, Human
gcuucuguugcugccuc

SEQ ID NO: 1634779 - RNA, 22 nt, Human
gcuucucacugccaugccagcu

SEQ ID NO: 1634780 - RNA, 13 nt, Human
gcuuaucucaggg

SEQ ID NO: 1634781 - RNA, 20 nt, Human
gcuucaguggcagcugcuuu

SEQ ID NO: 1634782 - RNA, 19 nt, Human
gcuucaguggcagcugcuu

SEQ ID NO: 1634783 - RNA, 23 nt, Human
gcugcccucuccugggcagcugc

SEQ ID NO: 1634784 - RNA, 12 nt, Human
gcugcccugccc

SEQ ID NO: 1634785 - RNA, 14 nt, Human
gcugcccugcccac

SEQ ID NO: 1634786 - RNA, 13 nt, Human
gcugcccugccca

SEQ ID NO: 1634787 - RNA, 13 nt, Human
gcugcccucuccu

SEQ ID NO: 1634788 - RNA, 14 nt, Human
gcugcccucuccug

SEQ ID NO: 1634789 - RNA, 15 nt, Human
gcugcccucuccugg

SEQ ID NO: 1634790 - RNA, 16 nt, Human
gcugcccucuccuggg

SEQ ID NO: 1634791 - RNA, 17 nt, Human
gcugcccucuccugggc

SEQ ID NO: 1634792 - RNA, 18 nt, Human
gcugcccucuccugggca

SEQ ID NO: 1634793 - RNA, 20 nt, Human
gcugcccucuccugggcagc

SEQ ID NO: 1634794 - RNA, 22 nt, Human
gcugcccucuccugggcagcug

SEQ ID NO: 1634795 - RNA, 24 nt, Human
gcugcccugcccaccuggccucug

SEQ ID NO: 1634796 - RNA, 23 nt, Human
gcugcccugcccaccuggccucu

SEQ ID NO: 1634797 - RNA, 22 nt, Human
gcugcccugcccaccuggccuc

SEQ ID NO: 1634798 - RNA, 21 nt, Human
gcugcccugcccaccuggccu

SEQ ID NO: 1634799 - RNA, 20 nt, Human
gcugcccugcccaccuggcc

SEQ ID NO: 1634800 - RNA, 18 nt, Human
gcugcccugcccaccugg

SEQ ID NO: 1634801 - RNA, 16 nt, Human
gcugcccugcccaccu

SEQ ID NO: 1634802 - RNA, 21 nt, Human
gcugcgguccacccaggagcc

SEQ ID NO: 1634803 - RNA, 16 nt, Human
gcugcgguccacccag

SEQ ID NO: 1634804 - RNA, 22 nt, Human
gcugcgguccacccaggagccc

SEQ ID NO: 1634805 - RNA, 15 nt, Human
gcugcgguccaccca

SEQ ID NO: 1634806 - RNA, 14 nt, Human
gcugcgguccaccc

SEQ ID NO: 1634807 - RNA, 19 nt, Human
gcugccuguucagcuccag

SEQ ID NO: 1634808 - RNA, 18 nt, Human
gcugccuguucagcucca

SEQ ID NO: 1634809 - RNA, 15 nt, Human
gcugcccuggugcug

SEQ ID NO: 1634810 - RNA, 14 nt, Human
gcugcccuggugcu

SEQ ID NO: 1634811 - RNA, 13 nt, Human
gcugcccuggugc

SEQ ID NO: 1634812 - RNA, 12 nt, Human
gcugcccuggug

SEQ ID NO: 1634813 - RNA, 22 nt, Human
gcugccuguucagcuccagcuc

SEQ ID NO: 1634814 - RNA, 20 nt, Human
gcugccuguucagcuccagc

SEQ ID NO: 1634815 - RNA, 20 nt, Human
gcugccuuagaaccuuucuu

SEQ ID NO: 1634816 - RNA, 15 nt, Human
gcugccuuagaaccu

SEQ ID NO: 1634817 - RNA, 17 nt, Human
gcugcccuggugcugcc

SEQ ID NO: 1634818 - RNA, 23 nt, Human
gcuggaaaaguauguuagugcaa

SEQ ID NO: 1634819 - RNA, 21 nt, Human
gcuggaaaaguauguuagugc

SEQ ID NO: 1634820 - RNA, 23 nt, Human
gcuggaaugauuucagcucacug

SEQ ID NO: 1634821 - RNA, 22 nt, Human
gcugcuuuugucuaugggacuc

SEQ ID NO: 1634822 - RNA, 15 nt, Human
gcuggaccuugaacu

SEQ ID NO: 1634823 - RNA, 16 nt, Human
gcuggaccuugaacug

SEQ ID NO: 1634824 - RNA, 19 nt, Human
gcuggcccuggcucccaca

SEQ ID NO: 1634825 - RNA, 16 nt, Human
gcuggcccugcccugg

SEQ ID NO: 1634826 - RNA, 15 nt, Human
gcuggcccugcccug

SEQ ID NO: 1634827 - RNA, 14 nt, Human
gcuggcccugcccu

SEQ ID NO: 1634828 - RNA, 12 nt, Human
gcugcccucucc

SEQ ID NO: 1634829 - RNA, 13 nt, Human
gcugccaccugcc

SEQ ID NO: 1634830 - RNA, 12 nt, Human
gcugccaccugc

SEQ ID NO: 1634831 - RNA, 23 nt, Human
gcugccacacuucaggcucuucu

SEQ ID NO: 1634832 - RNA, 22 nt, Human
gcugccacacuucaggcucuuc

SEQ ID NO: 1634833 - RNA, 21 nt, Human
gcugccacacuucaggcucuu

SEQ ID NO: 1634834 - RNA, 18 nt, Human
gcugccacacuucaggcu

SEQ ID NO: 1634835 - RNA, 17 nt, Human
gcugccacacuucaggc

SEQ ID NO: 1634836 - RNA, 15 nt, Human
gcugccacacuucag

SEQ ID NO: 1634837 - RNA, 14 nt, Human
gcugcaguugccag

SEQ ID NO: 1634838 - RNA, 13 nt, Human
gcugcaguugcca

SEQ ID NO: 1634839 - RNA, 17 nt, Human
gcugcaguugccaguca

SEQ ID NO: 1634840 - RNA, 18 nt, Human
gcugcauuuaaaagauac

SEQ ID NO: 1634841 - RNA, 19 nt, Human
gcugcauuuaaaagauaca

SEQ ID NO: 1634842 - RNA, 21 nt, Human
gcugauuaaaccaaggcuaga

SEQ ID NO: 1634843 - RNA, 23 nt, Human
gcugcaaaggguaucaggugcug

SEQ ID NO: 1634844 - RNA, 22 nt, Human
gcugcaaaggguaucaggugcu

SEQ ID NO: 1634845 - RNA, 16 nt, Human
gcugagaggagagaga

SEQ ID NO: 1634846 - RNA, 19 nt, Human
gcugacagacacaggcccg

SEQ ID NO: 1634847 - RNA, 18 nt, Human
gcugacagacacaggccc

SEQ ID NO: 1634848 - RNA, 20 nt, Human
gcugacagacacaggcccgg

SEQ ID NO: 1634849 - RNA, 22 nt, Human
gcugacuguuuucucuugagag

SEQ ID NO: 1634850 - RNA, 21 nt, Human
gcucucaggccagcugcuugg

SEQ ID NO: 1634851 - RNA, 21 nt, Human
gcucuugaacuccugaccuca

SEQ ID NO: 1634852 - RNA, 19 nt, Human
gcucuugaacuccugaccu

SEQ ID NO: 1634853 - RNA, 16 nt, Human
gcucuugaacuccuga

SEQ ID NO: 1634854 - RNA, 14 nt, Human
gcucuugaacuccu

SEQ ID NO: 1634855 - RNA, 19 nt, Human
gcucuugaugccuggcggg

SEQ ID NO: 1634856 - RNA, 19 nt, Human
gcucuuggcagguacucag

SEQ ID NO: 1634857 - RNA, 20 nt, Human
gccugagcgacagugagacu

SEQ ID NO: 1634858 - RNA, 17 nt, Human
gccugagcgacagugag

SEQ ID NO: 1634859 - RNA, 18 nt, Human
gccugaagucacacagug

SEQ ID NO: 1634860 - RNA, 17 nt, Human
gccugaagucacacagu

SEQ ID NO: 1634861 - RNA, 16 nt, Human
gccugaagucacacag

SEQ ID NO: 1634862 - RNA, 22 nt, Human
gcccaguuggguggaugccugg

SEQ ID NO: 1634863 - RNA, 21 nt, Human
gcccaguuggguggaugccug

SEQ ID NO: 1634864 - RNA, 19 nt, Human
gcccaguuggguggaugcc

SEQ ID NO: 1634865 - RNA, 12 nt, Human
gccugagcuggg

SEQ ID NO: 1634866 - RNA, 20 nt, Human
gccuggauggggcugcaccg

SEQ ID NO: 1634867 - RNA, 14 nt, Human
gccuggcacagggc

SEQ ID NO: 1634868 - RNA, 13 nt, Human
gccuggcacaggg

SEQ ID NO: 1634869 - RNA, 18 nt, Human
gccuggauggggcugcac

SEQ ID NO: 1634870 - RNA, 16 nt, Human
gccuggauggggcugc

SEQ ID NO: 1634871 - RNA, 15 nt, Human
gccuguaauccuagc

SEQ ID NO: 1634872 - RNA, 20 nt, Human
gccuguaauccuagcacuuu

SEQ ID NO: 1634873 - RNA, 22 nt, Human
gccuggccagaugcaccagccc

SEQ ID NO: 1634874 - RNA, 21 nt, Human
gccuggccagaugcaccagcc

SEQ ID NO: 1634875 - RNA, 20 nt, Human
gccuggccagaugcaccagc

SEQ ID NO: 1634876 - RNA, 22 nt, Human
gccuggcagccgugccuucagc

SEQ ID NO: 1634877 - RNA, 21 nt, Human
gccuggcagccgugccuucag

SEQ ID NO: 1634878 - RNA, 20 nt, Human
gccuggcagccgugccuuca

SEQ ID NO: 1634879 - RNA, 12 nt, Human
gccuggcagccg

SEQ ID NO: 1634880 - RNA, 19 nt, Human
gccuggcacagggcagugg

SEQ ID NO: 1634881 - RNA, 18 nt, Human
gccuggcacagggcagug

SEQ ID NO: 1634882 - RNA, 14 nt, Human
gccuggccccucag

SEQ ID NO: 1634883 - RNA, 13 nt, Human
gccuggccccuca

SEQ ID NO: 1634884 - RNA, 21 nt, Human
gcgacaaugcaaaccaucauu

SEQ ID NO: 1634885 - RNA, 20 nt, Human
gcgacaaugcaaaccaucau

SEQ ID NO: 1634886 - RNA, 13 nt, Human
gcgacaaugcaaa

SEQ ID NO: 1634887 - RNA, 12 nt, Human
gcgacaaugcaa

SEQ ID NO: 1634888 - RNA, 22 nt, Human
gcgcaggcuggcccugcccugg

SEQ ID NO: 1634889 - RNA, 21 nt, Human
gcgcaggcuggcccugcccug

SEQ ID NO: 1634890 - RNA, 20 nt, Human
gcgcaggcuggcccugcccu

SEQ ID NO: 1634891 - RNA, 17 nt, Human
gcgcaggcuggcccugc

SEQ ID NO: 1634892 - RNA, 19 nt, Human
gcgcaggcuggcccugccc

SEQ ID NO: 1634893 - RNA, 18 nt, Human
gcgcaggcuggcccugcc

SEQ ID NO: 1634894 - RNA, 16 nt, Human
gccuuacacaaugguu

SEQ ID NO: 1634895 - RNA, 15 nt, Human
gccuuacacaauggu

SEQ ID NO: 1634896 - RNA, 14 nt, Human
gcgguccacccagg

SEQ ID NO: 1634897 - RNA, 13 nt, Human
gcgguccacccag

SEQ ID NO: 1634898 - RNA, 19 nt, Human
gcggugagaggggaacaga

SEQ ID NO: 1634899 - RNA, 17 nt, Human
gcggggacagcuccuuc

SEQ ID NO: 1634900 - RNA, 15 nt, Human
gcggggacagcuccu

SEQ ID NO: 1634901 - RNA, 18 nt, Human
gcggggacagcuccuucu

SEQ ID NO: 1634902 - RNA, 21 nt, Human
gcgcugccccuggcagccccu

SEQ ID NO: 1634903 - RNA, 18 nt, Human
gcgcugccccuggcagcc

SEQ ID NO: 1634904 - RNA, 14 nt, Human
gcggggacagcucc

SEQ ID NO: 1634905 - RNA, 19 nt, Human
gcggagacggagucccacc

SEQ ID NO: 1634906 - RNA, 16 nt, Human
gcggagaaaggaaggg

SEQ ID NO: 1634907 - RNA, 23 nt, Human
gcgcccaguuggguggaugccug

SEQ ID NO: 1634908 - RNA, 13 nt, Human
gcgccccuucccc

SEQ ID NO: 1634909 - RNA, 21 nt, Human
gcgccuuaaggauguucuagc

SEQ ID NO: 1634910 - RNA, 13 nt, Human
gcuagauguaugu

SEQ ID NO: 1634911 - RNA, 22 nt, Human
gcggugcuaucucccccagccc

SEQ ID NO: 1634912 - RNA, 19 nt, Human
gcggugcuaucucccccag

SEQ ID NO: 1634913 - RNA, 16 nt, Human
gcuagauguauguacu

SEQ ID NO: 1634914 - RNA, 14 nt, Human
gcuagauguaugua

SEQ ID NO: 1634915 - RNA, 21 nt, Human
gcuauaggugcuacaaaaaca

SEQ ID NO: 1634916 - RNA, 20 nt, Human
gcuauaacuauguugauaaa

SEQ ID NO: 1634917 - RNA, 22 nt, Human
gcucaaguccucuuuucugaga

SEQ ID NO: 1634918 - RNA, 19 nt, Human
gcucaaguccucuuuucug

SEQ ID NO: 1634919 - RNA, 15 nt, Human
gcuaucucccccagc

SEQ ID NO: 1634920 - RNA, 14 nt, Human
gcuaucucccccag

SEQ ID NO: 1634921 - RNA, 18 nt, Human
gcucaaguccucuuuucu

SEQ ID NO: 1634922 - RNA, 13 nt, Human
gcuaucuccccca

SEQ ID NO: 1634923 - RNA, 17 nt, Human
gcuaucguaaaauuaag

SEQ ID NO: 1634924 - RNA, 16 nt, Human
gcuaucguaaaauuaa

SEQ ID NO: 1634925 - RNA, 15 nt, Human
gcuaucguaaaauua

SEQ ID NO: 1634926 - RNA, 18 nt, Human
gcucaccagccccagugc

SEQ ID NO: 1634927 - RNA, 15 nt, Human
gcucaccagccccag

SEQ ID NO: 1634928 - RNA, 14 nt, Human
gcucaccagcccca

SEQ ID NO: 1634929 - RNA, 13 nt, Human
gcucaccagcccc

SEQ ID NO: 1634930 - RNA, 12 nt, Human
gcucaccagccc

SEQ ID NO: 1634931 - RNA, 16 nt, Human
gcucacauaucuguca

SEQ ID NO: 1634932 - RNA, 22 nt, Human
gcucacagaacccuuggagcca

SEQ ID NO: 1634933 - RNA, 18 nt, Human
gcucaccucucccuugga

SEQ ID NO: 1634934 - RNA, 17 nt, Human
gcucaccucucccuugg

SEQ ID NO: 1634935 - RNA, 16 nt, Human
gcucaccucucccuug

SEQ ID NO: 1634936 - RNA, 12 nt, Human
gcucagcccucc

SEQ ID NO: 1634937 - RNA, 16 nt, Human
gcucagcccucccugc

SEQ ID NO: 1634938 - RNA, 15 nt, Human
gcucagcccucccug

SEQ ID NO: 1634939 - RNA, 23 nt, Human
gcucagcggggacagcuccuucu

SEQ ID NO: 1634940 - RNA, 19 nt, Human
gcucagcggggacagcucc

SEQ ID NO: 1634941 - RNA, 18 nt, Human
gcucagcggggacagcuc

SEQ ID NO: 1634942 - RNA, 17 nt, Human
gcucagcggggacagcu

SEQ ID NO: 1634943 - RNA, 21 nt, Human
gcucagcccucccugccccuc

SEQ ID NO: 1634944 - RNA, 19 nt, Human
gcucagcccucccugcccc

SEQ ID NO: 1634945 - RNA, 18 nt, Human
gcucagcccucccugccc

SEQ ID NO: 1634946 - RNA, 17 nt, Human
gcucagcccucccugcc

SEQ ID NO: 1634947 - RNA, 18 nt, Human
gcucauggacuucugcca

SEQ ID NO: 1634948 - RNA, 23 nt, Human
gcuccgcuuucuacccagcgagc

SEQ ID NO: 1634949 - RNA, 22 nt, Human
gcuccgcuuucuacccagcgag

SEQ ID NO: 1634950 - RNA, 21 nt, Human
gcuccgcuuucuacccagcga

SEQ ID NO: 1634951 - RNA, 18 nt, Human
gcuccgcuuucuacccag

SEQ ID NO: 1634952 - RNA, 20 nt, Human
gcucccuucccaccucucuc

SEQ ID NO: 1634953 - RNA, 15 nt, Human
gcucccacaggcccu

SEQ ID NO: 1634954 - RNA, 13 nt, Human
gcuccaggcuccu

SEQ ID NO: 1634955 - RNA, 12 nt, Human
gcuccaggcucc

SEQ ID NO: 1634956 - RNA, 18 nt, Human
gcuccaggagcagccaca

SEQ ID NO: 1634957 - RNA, 17 nt, Human
gcuccaggagcagccac

SEQ ID NO: 1634958 - RNA, 16 nt, Human
gcuccaggagcagcca

SEQ ID NO: 1634959 - RNA, 15 nt, Human
gcuccaggagcagcc

SEQ ID NO: 1634960 - RNA, 21 nt, Human
gcuccagcuguucagcugguu

SEQ ID NO: 1634961 - RNA, 14 nt, Human
gcuccaggagcagc

SEQ ID NO: 1634962 - RNA, 12 nt, Human
gcuccaggagca

SEQ ID NO: 1634963 - RNA, 11 nt, Human
gcuccaggagc

SEQ ID NO: 1634964 - RNA, 21 nt, Human
gcucgagcaugccuggauggg

SEQ ID NO: 1634965 - RNA, 19 nt, Human
gcucgagcaugccuggaug

SEQ ID NO: 1634966 - RNA, 17 nt, Human
gcuccuuuagcgcccag

SEQ ID NO: 1634967 - RNA, 13 nt, Human
gcuccuucugucc

SEQ ID NO: 1634968 - RNA, 15 nt, Human
gcuccuucuguccua

SEQ ID NO: 1634969 - RNA, 13 nt, Human
gcuccugugucuu

SEQ ID NO: 1634970 - RNA, 12 nt, Human
gcuccugugucu

SEQ ID NO: 1634971 - RNA, 18 nt, Human
gcuccuuccucugaggcu

SEQ ID NO: 1634972 - RNA, 22 nt, Human
gcuccuuccucugaggcugaaa

SEQ ID NO: 1634973 - RNA, 20 nt, Human
gcuccuuccucugaggcuga

SEQ ID NO: 1634974 - RNA, 24 nt, Human
gcuccgcuuucuacccagcgagcc

SEQ ID NO: 1634975 - RNA, 16 nt, Human
gcuccucccggugccc

SEQ ID NO: 1634976 - RNA, 14 nt, Human
gcuccucccggugc

SEQ ID NO: 1634977 - RNA, 23 nt, Human
gcuccuggggguucuuucuuccu

SEQ ID NO: 1634978 - RNA, 21 nt, Human
gggacugaggggaggggagca

SEQ ID NO: 1634979 - RNA, 23 nt, Human
gggacucaaugcacugacauugu

SEQ ID NO: 1634980 - RNA, 15 nt, Human
gggacugagaaauuu

SEQ ID NO: 1634981 - RNA, 23 nt, Human
gggacugccagucccccugcccc

SEQ ID NO: 1634982 - RNA, 19 nt, Human
gggacucaaugcacugaca

SEQ ID NO: 1634983 - RNA, 17 nt, Human
gggacucaaugcacuga

SEQ ID NO: 1634984 - RNA, 14 nt, Human
gggaauugaggaca

SEQ ID NO: 1634985 - RNA, 21 nt, Human
gggaauguuugccucugccuc

SEQ ID NO: 1634986 - RNA, 19 nt, Human
gggaauguuugccucugcc

SEQ ID NO: 1634987 - RNA, 14 nt, Human
gggacacccuguga

SEQ ID NO: 1634988 - RNA, 15 nt, Human
ggcuuuguauagaac

SEQ ID NO: 1634989 - RNA, 13 nt, Human
ggcuuuucacugc

SEQ ID NO: 1634990 - RNA, 11 nt, Human
gggaggcagag

SEQ ID NO: 1634991 - RNA, 20 nt, Human
gggaggugggauccuccagg

SEQ ID NO: 1634992 - RNA, 23 nt, Human
gggaggauugcuugagcucagga

SEQ ID NO: 1634993 - RNA, 17 nt, Human
gggagugacagaggcag

SEQ ID NO: 1634994 - RNA, 21 nt, Human
gggagugaguugauagcacag

SEQ ID NO: 1634995 - RNA, 20 nt, Human
gggaggacgcucucuggccu

SEQ ID NO: 1634996 - RNA, 17 nt, Human
gggaggacgcucucugg

SEQ ID NO: 1634997 - RNA, 21 nt, Human
gggaggauugcuugagcucag

SEQ ID NO: 1634998 - RNA, 22 nt, Human
gggaggauguucugggacacag

SEQ ID NO: 1634999 - RNA, 23 nt, Human
gggaggaucucuugagccuggga

SEQ ID NO: 1635000 - RNA, 22 nt, Human
gggagcugccuguucagcucca

SEQ ID NO: 1635001 - RNA, 21 nt, Human
gggagcugccuguucagcucc

SEQ ID NO: 1635002 - RNA, 13 nt, Human
gggagcugccugu

SEQ ID NO: 1635003 - RNA, 12 nt, Human
gggagcucugca

SEQ ID NO: 1635004 - RNA, 21 nt, Human
gggagccugaucaccugcccu

SEQ ID NO: 1635005 - RNA, 12 nt, Human
ggcuucacagau

SEQ ID NO: 1635006 - RNA, 21 nt, Human
ggcuucacggaagagccuugc

SEQ ID NO: 1635007 - RNA, 20 nt, Human
ggcuucacggaagagccuug

SEQ ID NO: 1635008 - RNA, 15 nt, Human
ggcuuagucacugag

SEQ ID NO: 1635009 - RNA, 14 nt, Human
ggcuuagucacuga

SEQ ID NO: 1635010 - RNA, 19 nt, Human
ggcuuggggaccagagcug

SEQ ID NO: 1635011 - RNA, 18 nt, Human
ggcuuggggaccagagcu

SEQ ID NO: 1635012 - RNA, 17 nt, Human
ggcuuggggaccagagc

SEQ ID NO: 1635013 - RNA, 11 nt, Human
ggcuugcugcc

SEQ ID NO: 1635014 - RNA, 15 nt, Human
ggcuuaaaacaacac

SEQ ID NO: 1635015 - RNA, 20 nt, Human
ggcuguuggcugggggccuc

SEQ ID NO: 1635016 - RNA, 16 nt, Human
ggcuguuggcuggggg

SEQ ID NO: 1635017 - RNA, 15 nt, Human
ggcuguuggcugggg

SEQ ID NO: 1635018 - RNA, 14 nt, Human
ggcuguuggcuggg

SEQ ID NO: 1635019 - RNA, 16 nt, Human
ggcugugccucugccu

SEQ ID NO: 1635020 - RNA, 13 nt, Human
ggcugugccucug

SEQ ID NO: 1635021 - RNA, 19 nt, Human
ggcugcuucaaggauccug

SEQ ID NO: 1635022 - RNA, 15 nt, Human
ggcugcuucaaggau

SEQ ID NO: 1635023 - RNA, 17 nt, Human
ggcucugccucccauca

SEQ ID NO: 1635024 - RNA, 23 nt, Human
ggcucuggagcccacuguacuug

SEQ ID NO: 1635025 - RNA, 20 nt, Human
ggcugcuucaaggauccuga

SEQ ID NO: 1635026 - RNA, 21 nt, Human
ggcugcuucaaggauccugag

SEQ ID NO: 1635027 - RNA, 18 nt, Human
ggcuggagcuagaauuug

SEQ ID NO: 1635028 - RNA, 14 nt, Human
ggcugggggccuca

SEQ ID NO: 1635029 - RNA, 16 nt, Human
ggcugggggaagaagc

SEQ ID NO: 1635030 - RNA, 22 nt, Human
ggcugggcuucaguggcagcug

SEQ ID NO: 1635031 - RNA, 21 nt, Human
ggcugggcuucaguggcagcu

SEQ ID NO: 1635032 - RNA, 11 nt, Human
ggcugggcuuc

SEQ ID NO: 1635033 - RNA, 21 nt, Human
ggcugggcucccuucccaccu

SEQ ID NO: 1635034 - RNA, 20 nt, Human
ggcugggcucccuucccacc

SEQ ID NO: 1635035 - RNA, 15 nt, Human
ggcugggagcucugc

SEQ ID NO: 1635036 - RNA, 23 nt, Human
ggcuauaggugcuacaaaaacac

SEQ ID NO: 1635037 - RNA, 20 nt, Human
ggcuaguaucaaaagaaaga

SEQ ID NO: 1635038 - RNA, 11 nt, Human
ggcgcugcccc

SEQ ID NO: 1635039 - RNA, 17 nt, Human
ggcgcugccccuggcag

SEQ ID NO: 1635040 - RNA, 16 nt, Human
ggcuccacuuggucug

SEQ ID NO: 1635041 - RNA, 9 nt, Human
ggcuccaga

SEQ ID NO: 1635042 - RNA, 12 nt, Human
ggcuaugcauuu

SEQ ID NO: 1635043 - RNA, 13 nt, Human
ggcuaugcauuug

SEQ ID NO: 1635044 - RNA, 14 nt, Human
ggcuaugcauuuga

SEQ ID NO: 1635045 - RNA, 13 nt, Human
ggcuccaggcucc

SEQ ID NO: 1635046 - RNA, 12 nt, Human
ggcuccaggcuc

SEQ ID NO: 1635047 - RNA, 17 nt, Human
ggcuccaggagcagcca

SEQ ID NO: 1635048 - RNA, 18 nt, Human
ggcuccaggagcagccac

SEQ ID NO: 1635049 - RNA, 16 nt, Human
ggcuccaggagcagcc

SEQ ID NO: 1635050 - RNA, 14 nt, Human
ggcuccaggagcag

SEQ ID NO: 1635051 - RNA, 10 nt, Human
ggcuccagac

SEQ ID NO: 1635052 - RNA, 14 nt, Human
ggcuccaggcuccu

SEQ ID NO: 1635053 - RNA, 15 nt, Human
ggcuccaggcuccuu

SEQ ID NO: 1635054 - RNA, 16 nt, Human
ggcucucaggccagcu

SEQ ID NO: 1635055 - RNA, 15 nt, Human
ggcucucaggccagc

SEQ ID NO: 1635056 - RNA, 20 nt, Human
ggcucucaggccagcugcuu

SEQ ID NO: 1635057 - RNA, 19 nt, Human
ggcucucaggccagcugcu

SEQ ID NO: 1635058 - RNA, 18 nt, Human
ggcucucaggccagcugc

SEQ ID NO: 1635059 - RNA, 17 nt, Human
ggcucucaggccagcug

SEQ ID NO: 1635060 - RNA, 12 nt, Human
ggcucugcccuu

SEQ ID NO: 1635061 - RNA, 15 nt, Human
ggcucugccucccau

SEQ ID NO: 1635062 - RNA, 13 nt, Human
ggcucugccuccc

SEQ ID NO: 1635063 - RNA, 15 nt, Human
ggcucugcccuuggu

SEQ ID NO: 1635064 - RNA, 14 nt, Human
ggcucugcccuugg

SEQ ID NO: 1635065 - RNA, 16 nt, Human
ggcucugccucccauc

SEQ ID NO: 1635066 - RNA, 16 nt, Human
ggcucuggagcccacu

SEQ ID NO: 1635067 - RNA, 19 nt, Human
ggcucuggagcccacugua

SEQ ID NO: 1635068 - RNA, 17 nt, Human
ggcucuggagcccacug

SEQ ID NO: 1635069 - RNA, 24 nt, Human
ggcgcagcauauucaggaagcuca

SEQ ID NO: 1635070 - RNA, 23 nt, Human
ggcgcagcauauucaggaagcuc

SEQ ID NO: 1635071 - RNA, 23 nt, Human
ggccugggggcugggcagaggaa

SEQ ID NO: 1635072 - RNA, 11 nt, Human
ggccugggccc

SEQ ID NO: 1635073 - RNA, 16 nt, Human
ggccuggccugagcug

SEQ ID NO: 1635074 - RNA, 15 nt, Human
ggccuggccugagcu

SEQ ID NO: 1635075 - RNA, 19 nt, Human
ggccuggccugagcuggga

SEQ ID NO: 1635076 - RNA, 14 nt, Human
ggccuggccugagc

SEQ ID NO: 1635077 - RNA, 13 nt, Human
ggccuggccugag

SEQ ID NO: 1635078 - RNA, 10 nt, Human
ggccuggccu

SEQ ID NO: 1635079 - RNA, 23 nt, Human
ggccuggccccucagggucccug

SEQ ID NO: 1635080 - RNA, 18 nt, Human
ggccuggccccucagggu

SEQ ID NO: 1635081 - RNA, 17 nt, Human
ggccuggccccucaggg

SEQ ID NO: 1635082 - RNA, 15 nt, Human
ggccuggccccucag

SEQ ID NO: 1635083 - RNA, 14 nt, Human
ggccuggccccuca

SEQ ID NO: 1635084 - RNA, 19 nt, Human
ggccucugcacuccccugc

SEQ ID NO: 1635085 - RNA, 18 nt, Human
ggccucugcacuccccug

SEQ ID NO: 1635086 - RNA, 22 nt, Human
ggccucugcacuccccugcugg

SEQ ID NO: 1635087 - RNA, 13 nt, Human
ggccuggccccuc

SEQ ID NO: 1635088 - RNA, 12 nt, Human
ggccugagcugg

SEQ ID NO: 1635089 - RNA, 14 nt, Human
ggccuccugugugu

SEQ ID NO: 1635090 - RNA, 17 nt, Human
ggccucggacuuagcug

SEQ ID NO: 1635091 - RNA, 23 nt, Human
ggccucaagugauucuccugccu

SEQ ID NO: 1635092 - RNA, 22 nt, Human
ggccucaagugauucuccugcc

SEQ ID NO: 1635093 - RNA, 14 nt, Human
ggccucaagugauu

SEQ ID NO: 1635094 - RNA, 20 nt, Human
ggccuagcauacguacacau

SEQ ID NO: 1635095 - RNA, 22 nt, Human
ggccuagcauacguacacauuu

SEQ ID NO: 1635096 - RNA, 23 nt, Human
ggccuagcauacguacacauuuu

SEQ ID NO: 1635097 - RNA, 20 nt, Human
ggcccagagggccugcaagg

SEQ ID NO: 1635098 - RNA, 19 nt, Human
ggcccagagggccugcaag

SEQ ID NO: 1635099 - RNA, 17 nt, Human
ggcccagagggccugca

SEQ ID NO: 1635100 - RNA, 14 nt, Human
ggcccagagggccu

SEQ ID NO: 1635101 - RNA, 15 nt, Human
ggccgggagccugau

SEQ ID NO: 1635102 - RNA, 11 nt, Human
ggcagcugccu

SEQ ID NO: 1635103 - RNA, 12 nt, Human
ggcagcugccuc

SEQ ID NO: 1635104 - RNA, 13 nt, Human
ggcagcugccucc

SEQ ID NO: 1635105 - RNA, 21 nt, Human
ggcagaguugaagacagagcu

SEQ ID NO: 1635106 - RNA, 19 nt, Human
ggcagaguugaagacagag

SEQ ID NO: 1635107 - RNA, 17 nt, Human
ggcagaguugaagacag

SEQ ID NO: 1635108 - RNA, 16 nt, Human
ggcagcugccuccccu

SEQ ID NO: 1635109 - RNA, 22 nt, Human
ggcagcugcuuuugucuauggg

SEQ ID NO: 1635110 - RNA, 12 nt, Human
ggcaggguccua

SEQ ID NO: 1635111 - RNA, 24 nt, Human
ggcagcugcgguccacccaggagc

SEQ ID NO: 1635112 - RNA, 23 nt, Human
ggcagcugcgguccacccaggag

SEQ ID NO: 1635113 - RNA, 18 nt, Human
ggcagggucucacucugu

SEQ ID NO: 1635114 - RNA, 17 nt, Human
ggcagggucucacucug

SEQ ID NO: 1635115 - RNA, 23 nt, Human
ggcaugugaugagaggaaaucac

SEQ ID NO: 1635116 - RNA, 18 nt, Human
ggcaugugaugagaggaa

SEQ ID NO: 1635117 - RNA, 15 nt, Human
ggcaugaugcgggcc

SEQ ID NO: 1635118 - RNA, 22 nt, Human
ggcaugacacgaauauugcuga

SEQ ID NO: 1635119 - RNA, 16 nt, Human
ggccaggcccucugcc

SEQ ID NO: 1635120 - RNA, 15 nt, Human
ggccaggcccucugc

SEQ ID NO: 1635121 - RNA, 17 nt, Human
ggccaggcccucugccc

SEQ ID NO: 1635122 - RNA, 14 nt, Human
ggccaggcccucug

SEQ ID NO: 1635123 - RNA, 13 nt, Human
ggccaggagccuc

SEQ ID NO: 1635124 - RNA, 11 nt, Human
ggccaggagcc

SEQ ID NO: 1635125 - RNA, 20 nt, Human
ggccacugugaagagaacca

SEQ ID NO: 1635126 - RNA, 20 nt, Human
ggcauguucucugaggacac

SEQ ID NO: 1635127 - RNA, 22 nt, Human
ggccacagaaaauucuucucca

SEQ ID NO: 1635128 - RNA, 21 nt, Human
ggcagagguugcagugagccg

SEQ ID NO: 1635129 - RNA, 20 nt, Human
ggcacucagaagacacugau

SEQ ID NO: 1635130 - RNA, 19 nt, Human
ggcacucagaagacacuga

SEQ ID NO: 1635131 - RNA, 18 nt, Human
ggcacucagaagacacug

SEQ ID NO: 1635132 - RNA, 20 nt, Human
ggcacccggccccugcuggu

SEQ ID NO: 1635133 - RNA, 19 nt, Human
ggcacccggccccugcugg

SEQ ID NO: 1635134 - RNA, 18 nt, Human
ggcacccggccccugcug

SEQ ID NO: 1635135 - RNA, 20 nt, Human
ggcacccaccaucaugucug

SEQ ID NO: 1635136 - RNA, 19 nt, Human
ggcaagcaccuccugccuc

SEQ ID NO: 1635137 - RNA, 18 nt, Human
ggcaagcaccuccugccu

SEQ ID NO: 1635138 - RNA, 17 nt, Human
ggcaccagcagccugga

SEQ ID NO: 1635139 - RNA, 15 nt, Human
ggcaaggcugucaau

SEQ ID NO: 1635140 - RNA, 21 nt, Human
ggauucuuccucccucccucu

SEQ ID NO: 1635141 - RNA, 13 nt, Human
ggauucuuaaagu

SEQ ID NO: 1635142 - RNA, 17 nt, Human
ggcaagcaccuccugcc

SEQ ID NO: 1635143 - RNA, 23 nt, Human
ggagucccaccuuggcugcaggg

SEQ ID NO: 1635144 - RNA, 22 nt, Human
ggaugaucuaggaagacuuugg

SEQ ID NO: 1635145 - RNA, 18 nt, Human
ggaugaucuaggaagacu

SEQ ID NO: 1635146 - RNA, 16 nt, Human
ggaugaucuaggaaga

SEQ ID NO: 1635147 - RNA, 17 nt, Human
ggaugccugguggcagc

SEQ ID NO: 1635148 - RNA, 13 nt, Human
ggaugccuggugg

SEQ ID NO: 1635149 - RNA, 19 nt, Human
ggaugcccaaagaugcagc

SEQ ID NO: 1635150 - RNA, 17 nt, Human
ggaugccccgucccccu

SEQ ID NO: 1635151 - RNA, 18 nt, Human
ggaugcccaaagaugcag

SEQ ID NO: 1635152 - RNA, 18 nt, Human
ggaugaugacuauggaaa

SEQ ID NO: 1635153 - RNA, 21 nt, Human
ggaugccugguggcagcugcg

SEQ ID NO: 1635154 - RNA, 20 nt, Human
ggaugccugguggcagcugc

SEQ ID NO: 1635155 - RNA, 19 nt, Human
ggaugccugguggcagcug

SEQ ID NO: 1635156 - RNA, 18 nt, Human
ggaugccugguggcagcu

SEQ ID NO: 1635157 - RNA, 12 nt, Human
ggauuauauuau

SEQ ID NO: 1635158 - RNA, 20 nt, Human
ggacauuugcucauggaauu

SEQ ID NO: 1635159 - RNA, 14 nt, Human
ggaccaaaaaccag

SEQ ID NO: 1635160 - RNA, 17 nt, Human
ggacauuugcucaugga

SEQ ID NO: 1635161 - RNA, 19 nt, Human
ggaccagagcugccaccug

SEQ ID NO: 1635162 - RNA, 17 nt, Human
ggacagcuccuucuguc

SEQ ID NO: 1635163 - RNA, 16 nt, Human
ggacagcuccuucugu

SEQ ID NO: 1635164 - RNA, 15 nt, Human
ggacagcuccuucug

SEQ ID NO: 1635165 - RNA, 11 nt, Human
ggacagcuccu

SEQ ID NO: 1635166 - RNA, 20 nt, Human
ggacagaggggguggccucc

SEQ ID NO: 1635167 - RNA, 16 nt, Human
ggacagccccuccucc

SEQ ID NO: 1635168 - RNA, 15 nt, Human
ggacagccccuccuc

SEQ ID NO: 1635169 - RNA, 16 nt, Human
ggacagaggggguggc

SEQ ID NO: 1635170 - RNA, 21 nt, Human
gcuuuuaugugaaacauguuu

SEQ ID NO: 1635171 - RNA, 20 nt, Human
gcuuuuaugugaaacauguu

SEQ ID NO: 1635172 - RNA, 19 nt, Human
gcuuuuaugugaaacaugu

SEQ ID NO: 1635173 - RNA, 12 nt, Human
gcuuuucacugc

SEQ ID NO: 1635174 - RNA, 19 nt, Human
ggacgcucucuggccuucg

SEQ ID NO: 1635175 - RNA, 16 nt, Human
ggacgcucucuggccu

SEQ ID NO: 1635176 - RNA, 19 nt, Human
ggacugaauuaugaaacuu

SEQ ID NO: 1635177 - RNA, 17 nt, Human
ggacugaauuaugaaac

SEQ ID NO: 1635178 - RNA, 14 nt, Human
ggacugagaaauuu

SEQ ID NO: 1635179 - RNA, 18 nt, Human
ggaccuugaacuggguac

SEQ ID NO: 1635180 - RNA, 23 nt, Human
ggagaagagcuguucacagccag

SEQ ID NO: 1635181 - RNA, 15 nt, Human
ggagaagagcuguuc

SEQ ID NO: 1635182 - RNA, 14 nt, Human
ggagaagaacugaa

SEQ ID NO: 1635183 - RNA, 11 nt, Human
ggagaagaacu

SEQ ID NO: 1635184 - RNA, 18 nt, Human
ggacugagaaauuuauaa

SEQ ID NO: 1635185 - RNA, 19 nt, Human
ggaggggagcaugggaagu

SEQ ID NO: 1635186 - RNA, 13 nt, Human
ggagggccugggc

SEQ ID NO: 1635187 - RNA, 13 nt, Human
ggaggggccuggc

SEQ ID NO: 1635188 - RNA, 22 nt, Human
ggagucccaccuuggcugcagg

SEQ ID NO: 1635189 - RNA, 21 nt, Human
ggaggggccuggcagccgugc

SEQ ID NO: 1635190 - RNA, 18 nt, Human
ggaggggccuggcagccg

SEQ ID NO: 1635191 - RNA, 14 nt, Human
ggaggggccuggca

SEQ ID NO: 1635192 - RNA, 16 nt, Human
ggaggacgcucucugg

SEQ ID NO: 1635193 - RNA, 21 nt, Human
ggaggauguucugggacacag

SEQ ID NO: 1635194 - RNA, 18 nt, Human
ggaggauguucugggaca

SEQ ID NO: 1635195 - RNA, 16 nt, Human
ggagggagggcuccag

SEQ ID NO: 1635196 - RNA, 13 nt, Human
ggagggagggcuc

SEQ ID NO: 1635197 - RNA, 17 nt, Human
ggagggagggcuccaga

SEQ ID NO: 1635198 - RNA, 17 nt, Human
ggaggcaggaguuucgu

SEQ ID NO: 1635199 - RNA, 19 nt, Human
ggagcccugggaggcucug

SEQ ID NO: 1635200 - RNA, 16 nt, Human
ggagcccugggaggcu

SEQ ID NO: 1635201 - RNA, 14 nt, Human
ggagccuccugccc

SEQ ID NO: 1635202 - RNA, 20 nt, Human
ggagcccugggaggcucugg

SEQ ID NO: 1635203 - RNA, 15 nt, Human
ggagccuccugcccu

SEQ ID NO: 1635204 - RNA, 14 nt, Human
ggagcuagaauuug

SEQ ID NO: 1635205 - RNA, 19 nt, Human
ucaucuugaauuguaagga

SEQ ID NO: 1635206 - RNA, 23 nt, Human
ucaucuuagguuggcaaaaaggc

SEQ ID NO: 1635207 - RNA, 18 nt, Human
ucauaccuaucaucuuaa

SEQ ID NO: 1635208 - RNA, 15 nt, Human
ucaggugcugccauc

SEQ ID NO: 1635209 - RNA, 14 nt, Human
ucaggugcugccau

SEQ ID NO: 1635210 - RNA, 13 nt, Human
ucaggugcugcca

SEQ ID NO: 1635211 - RNA, 21 nt, Human
ucaggugagaagcagaggaag

SEQ ID NO: 1635212 - RNA, 21 nt, Human
ucaucaccaacgucugugcca

SEQ ID NO: 1635213 - RNA, 20 nt, Human
ucaucaccaacgucugugcc

SEQ ID NO: 1635214 - RNA, 19 nt, Human
ucaucaccaacgucugugc

SEQ ID NO: 1635215 - RNA, 15 nt, Human
ucauacucaccucac

SEQ ID NO: 1635216 - RNA, 21 nt, Human
ucauagcccucacccuggggc

SEQ ID NO: 1635217 - RNA, 16 nt, Human
ucauuuccaagcaagu

SEQ ID NO: 1635218 - RNA, 13 nt, Human
ucauuuccaagca

SEQ ID NO: 1635219 - RNA, 16 nt, Human
ucauuuccugugucuu

SEQ ID NO: 1635220 - RNA, 13 nt, Human
ucauuuccugugu

SEQ ID NO: 1635221 - RNA, 18 nt, Human
ucauugugaaauuauuca

SEQ ID NO: 1635222 - RNA, 17 nt, Human
ucauugugaaauuauuc

SEQ ID NO: 1635223 - RNA, 15 nt, Human
ucauugugaaauuau

SEQ ID NO: 1635224 - RNA, 12 nt, Human
ucauugugaaau

SEQ ID NO: 1635225 - RNA, 13 nt, Human
ucauuaucucaaa

SEQ ID NO: 1635226 - RNA, 20 nt, Human
ucauuaucucaaaacugcac

SEQ ID NO: 1635227 - RNA, 19 nt, Human
ucauuaucucaaaacugca

SEQ ID NO: 1635228 - RNA, 21 nt, Human
ucauucaacccaccugcgucu

SEQ ID NO: 1635229 - RNA, 23 nt, Human
ucauuauuuuauuaugaaacuug

SEQ ID NO: 1635230 - RNA, 23 nt, Human
ucauuccaccuucccaugcccug

SEQ ID NO: 1635231 - RNA, 20 nt, Human
uccaaaauaaaacuuuuuaa

SEQ ID NO: 1635232 - RNA, 18 nt, Human
uccaaaauaaaacuuuuu

SEQ ID NO: 1635233 - RNA, 18 nt, Human
uccaauuuacauacucug

SEQ ID NO: 1635234 - RNA, 17 nt, Human
uccaauuuacauacucu

SEQ ID NO: 1635235 - RNA, 19 nt, Human
uccacaagagcccaggccu

SEQ ID NO: 1635236 - RNA, 18 nt, Human
uccacaagagcccaggcc

SEQ ID NO: 1635237 - RNA, 17 nt, Human
uccacaagagcccaggc

SEQ ID NO: 1635238 - RNA, 16 nt, Human
uccacaagagcccagg

SEQ ID NO: 1635239 - RNA, 18 nt, Human
uccacaaguuaaauaaau

SEQ ID NO: 1635240 - RNA, 17 nt, Human
uccacaaguuaaauaaa

SEQ ID NO: 1635241 - RNA, 15 nt, Human
uccaccucccugcaa

SEQ ID NO: 1635242 - RNA, 16 nt, Human
uccaccucccugcaau

SEQ ID NO: 1635243 - RNA, 17 nt, Human
uccaccucccugcaaua

SEQ ID NO: 1635244 - RNA, 15 nt, Human
uccaccugccaggga

SEQ ID NO: 1635245 - RNA, 17 nt, Human
uccaccugccagggaca

SEQ ID NO: 1635246 - RNA, 21 nt, Human
uccaccugccagggacagagg

SEQ ID NO: 1635247 - RNA, 18 nt, Human
uccaccugccagggacag

SEQ ID NO: 1635248 - RNA, 13 nt, Human
uccaccucccugc

SEQ ID NO: 1635249 - RNA, 14 nt, Human
uccaccucccugca

SEQ ID NO: 1635250 - RNA, 13 nt, Human
uccacccugcucu

SEQ ID NO: 1635251 - RNA, 12 nt, Human
uccacccugcuc

SEQ ID NO: 1635252 - RNA, 19 nt, Human
uccacagaagcuccaggua

SEQ ID NO: 1635253 - RNA, 16 nt, Human
uccacuuggucuguga

SEQ ID NO: 1635254 - RNA, 15 nt, Human
uccacuuggucugug

SEQ ID NO: 1635255 - RNA, 15 nt, Human
uccaccuucccaugc

SEQ ID NO: 1635256 - RNA, 17 nt, Human
uccacuuggucugugag

SEQ ID NO: 1635257 - RNA, 17 nt, Human
uccagccacagaaaaga

SEQ ID NO: 1635258 - RNA, 16 nt, Human
uccaggagcagccaca

SEQ ID NO: 1635259 - RNA, 17 nt, Human
uccagcuguucagcugg

SEQ ID NO: 1635260 - RNA, 17 nt, Human
uccagcucaccagcccc

SEQ ID NO: 1635261 - RNA, 16 nt, Human
uccagcucaccagccc

SEQ ID NO: 1635262 - RNA, 18 nt, Human
uccagcucaccagcccca

SEQ ID NO: 1635263 - RNA, 22 nt, Human
uccaggugcacaagcuccaagc

SEQ ID NO: 1635264 - RNA, 21 nt, Human
uccaggugcacaagcuccaag

SEQ ID NO: 1635265 - RNA, 20 nt, Human
uccaggugcacaagcuccaa

SEQ ID NO: 1635266 - RNA, 18 nt, Human
uccaggugcacaagcucc

SEQ ID NO: 1635267 - RNA, 16 nt, Human
uccagguucagcuugu

SEQ ID NO: 1635268 - RNA, 15 nt, Human
uccagguucagcuug

SEQ ID NO: 1635269 - RNA, 11 nt, Human
uccaggguggu

SEQ ID NO: 1635270 - RNA, 18 nt, Human
uccaggagcagccacauu

SEQ ID NO: 1635271 - RNA, 17 nt, Human
uccaggagcagccacau

SEQ ID NO: 1635272 - RNA, 22 nt, Human
uccaggagcagccacauuccug

SEQ ID NO: 1635273 - RNA, 23 nt, Human
uccaggggugggacacccuguga

SEQ ID NO: 1635274 - RNA, 15 nt, Human
uccaggugcacaagc

SEQ ID NO: 1635275 - RNA, 17 nt, Human
ucaggcuagauguaugu

SEQ ID NO: 1635276 - RNA, 13 nt, Human
ucaggcuagaugu

SEQ ID NO: 1635277 - RNA, 23 nt, Human
ucaggagcccugggaggcucugg

SEQ ID NO: 1635278 - RNA, 20 nt, Human
ucaggagcccugggaggcuc

SEQ ID NO: 1635279 - RNA, 18 nt, Human
ucaggagcccugggaggc

SEQ ID NO: 1635280 - RNA, 19 nt, Human
ucaggagcccugggaggcu

SEQ ID NO: 1635281 - RNA, 16 nt, Human
ucaggugagaagcaga

SEQ ID NO: 1635282 - RNA, 15 nt, Human
ucaggugagaagcag

SEQ ID NO: 1635283 - RNA, 16 nt, Human
ucagggccuggcucag

SEQ ID NO: 1635284 - RNA, 14 nt, Human
ucagggccuggcuc

SEQ ID NO: 1635285 - RNA, 21 nt, Human
ucagcuccccucggagaagag

SEQ ID NO: 1635286 - RNA, 18 nt, Human
ucagcuccccucggagaa

SEQ ID NO: 1635287 - RNA, 16 nt, Human
ucagcugaaccugggu

SEQ ID NO: 1635288 - RNA, 15 nt, Human
ucagcugaaccuggg

SEQ ID NO: 1635289 - RNA, 17 nt, Human
ucagcuccccucggaga

SEQ ID NO: 1635290 - RNA, 19 nt, Human
ucagccugcuccagcuguu

SEQ ID NO: 1635291 - RNA, 18 nt, Human
ucagccugcuccagcugu

SEQ ID NO: 1635292 - RNA, 22 nt, Human
ucagccuccugaguagcuggga

SEQ ID NO: 1635293 - RNA, 22 nt, Human
ucagccucccgaguagcuggga

SEQ ID NO: 1635294 - RNA, 21 nt, Human
ucagccucccgaguagcuggg

SEQ ID NO: 1635295 - RNA, 20 nt, Human
ucagccuccugaguagcugg

SEQ ID NO: 1635296 - RNA, 21 nt, Human
ucagccucccaaagugcuggg

SEQ ID NO: 1635297 - RNA, 19 nt, Human
ucagccucccaaagugcug

SEQ ID NO: 1635298 - RNA, 14 nt, Human
ucagccucccaaag

SEQ ID NO: 1635299 - RNA, 23 nt, Human
ucagcauucucacuccuaccugg

SEQ ID NO: 1635300 - RNA, 22 nt, Human
ucagccucccgaauagcuggga

SEQ ID NO: 1635301 - RNA, 21 nt, Human
ucagccucccgaauagcuggg

SEQ ID NO: 1635302 - RNA, 18 nt, Human
ucagccucccgaguagcu

SEQ ID NO: 1635303 - RNA, 20 nt, Human
ucagccucccgaguagcugg

SEQ ID NO: 1635304 - RNA, 15 nt, Human
ucagauaugauucaa

SEQ ID NO: 1635305 - RNA, 20 nt, Human
ucagcauucucacuccuacc

SEQ ID NO: 1635306 - RNA, 17 nt, Human
ucagcauucucacuccu

SEQ ID NO: 1635307 - RNA, 22 nt, Human
ucagagcugcccucuccugggc

SEQ ID NO: 1635308 - RNA, 23 nt, Human
ucagagcugcccucuccugggca

SEQ ID NO: 1635309 - RNA, 22 nt, Human
ucagaguaauccaagcaaaugu

SEQ ID NO: 1635310 - RNA, 21 nt, Human
ucagaguaauccaagcaaaug

SEQ ID NO: 1635311 - RNA, 19 nt, Human
ucagagcugcccucuccug

SEQ ID NO: 1635312 - RNA, 20 nt, Human
ucagagcugcccucuccugg

SEQ ID NO: 1635313 - RNA, 21 nt, Human
ucagagcugcccucuccuggg

SEQ ID NO: 1635314 - RNA, 14 nt, Human
ucagacagcugccu

SEQ ID NO: 1635315 - RNA, 13 nt, Human
ucagacagcugcc

SEQ ID NO: 1635316 - RNA, 15 nt, Human
ucagaaauguguuau

SEQ ID NO: 1635317 - RNA, 23 nt, Human
ucagaauucucuaguuugauuaa

SEQ ID NO: 1635318 - RNA, 10 nt, Human
ucagaaaugu

SEQ ID NO: 1635319 - RNA, 20 nt, Human
ucacuuguuuuauuuaaccu

SEQ ID NO: 1635320 - RNA, 14 nt, Human
ucacugcuuaacuu

SEQ ID NO: 1635321 - RNA, 22 nt, Human
ucacugcuggcugccuuagaac

SEQ ID NO: 1635322 - RNA, 18 nt, Human
ucacugcuggcugccuua

SEQ ID NO: 1635323 - RNA, 17 nt, Human
ucacugcuggcugccuu

SEQ ID NO: 1635324 - RNA, 12 nt, Human
ucacugcuggcu

SEQ ID NO: 1635325 - RNA, 16 nt, Human
ucacugcuggcugccu

SEQ ID NO: 1635326 - RNA, 15 nt, Human
ucacugcuggcugcc

SEQ ID NO: 1635327 - RNA, 14 nt, Human
ucacugcuggcugc

SEQ ID NO: 1635328 - RNA, 13 nt, Human
ucacugcuggcug

SEQ ID NO: 1635329 - RNA, 16 nt, Human
ucaccagccccagugc

SEQ ID NO: 1635330 - RNA, 13 nt, Human
ucaccagccccag

SEQ ID NO: 1635331 - RNA, 17 nt, Human
ucacucuuauugcccac

SEQ ID NO: 1635332 - RNA, 18 nt, Human
ucacugccaugccagcuu

SEQ ID NO: 1635333 - RNA, 20 nt, Human
ucacucuuauugcccacgcu

SEQ ID NO: 1635334 - RNA, 18 nt, Human
ucacugcauccuccgccu

SEQ ID NO: 1635335 - RNA, 19 nt, Human
ucacugcauccuccgccuc

SEQ ID NO: 1635336 - RNA, 20 nt, Human
uauguugcccaggcaggucu

SEQ ID NO: 1635337 - RNA, 19 nt, Human
uauguugcccaggcagguc

SEQ ID NO: 1635338 - RNA, 16 nt, Human
uauguugcccaggcag

SEQ ID NO: 1635339 - RNA, 13 nt, Human
uauguugcccagg

SEQ ID NO: 1635340 - RNA, 16 nt, Human
uauguugcauagaaua

SEQ ID NO: 1635341 - RNA, 12 nt, Human
uauguugcauag

SEQ ID NO: 1635342 - RNA, 14 nt, Human
uauguugauaaaag

SEQ ID NO: 1635343 - RNA, 12 nt, Human
uauuaaauuaug

SEQ ID NO: 1635344 - RNA, 17 nt, Human
uauguacuucaugcugu

SEQ ID NO: 1635345 - RNA, 13 nt, Human
uauguacuucaug

SEQ ID NO: 1635346 - RNA, 15 nt, Human
gggaguggccacaga

SEQ ID NO: 1635347 - RNA, 13 nt, Human
gggaguggccaca

SEQ ID NO: 1635348 - RNA, 12 nt, Human
uauguaaauccc

SEQ ID NO: 1635349 - RNA, 23 nt, Human
uauguaaaucccauuauucaaag

SEQ ID NO: 1635350 - RNA, 21 nt, Human
uauguaaaucccauuauucaa

SEQ ID NO: 1635351 - RNA, 20 nt, Human
uauguaaaucccauuauuca

SEQ ID NO: 1635352 - RNA, 19 nt, Human
uauguaaaucccauuauuc

SEQ ID NO: 1635353 - RNA, 15 nt, Human
uauguaaaucccauu

SEQ ID NO: 1635354 - RNA, 21 nt, Human
uauuccugcauuugugaaaug

SEQ ID NO: 1635355 - RNA, 20 nt, Human
uauuccugcauuugugaaau

SEQ ID NO: 1635356 - RNA, 19 nt, Human
uauuccugcauuugugaaa

SEQ ID NO: 1635357 - RNA, 17 nt, Human
uauuccugcauuuguga

SEQ ID NO: 1635358 - RNA, 16 nt, Human
uauuauucccauucua

SEQ ID NO: 1635359 - RNA, 14 nt, Human
uauuacaguauaau

SEQ ID NO: 1635360 - RNA, 13 nt, Human
uauuacaguauaa

SEQ ID NO: 1635361 - RNA, 12 nt, Human
uauuacaguaua

SEQ ID NO: 1635362 - RNA, 22 nt, Human
uauuggaaauuuguuauaauga

SEQ ID NO: 1635363 - RNA, 22 nt, Human
uauugcugauggugcaaugacc

SEQ ID NO: 1635364 - RNA, 17 nt, Human
uauugcugauggugcaa

SEQ ID NO: 1635365 - RNA, 18 nt, Human
uauucucuccuguaccuc

SEQ ID NO: 1635366 - RNA, 17 nt, Human
uauucucuccuguaccu

SEQ ID NO: 1635367 - RNA, 12 nt, Human
uauuguuuucag

SEQ ID NO: 1635368 - RNA, 20 nt, Human
uauuguuuucaguguacaug

SEQ ID NO: 1635369 - RNA, 18 nt, Human
uauuguuuucaguguaca

SEQ ID NO: 1635370 - RNA, 22 nt, Human
uauuguuuucaguguacaugga

SEQ ID NO: 1635371 - RNA, 24 nt, Human
uauuuauaaaaauaaaaaacacug

SEQ ID NO: 1635372 - RNA, 16 nt, Human
ucacagucacauucca

SEQ ID NO: 1635373 - RNA, 19 nt, Human
ucacaguccuuaccagcag

SEQ ID NO: 1635374 - RNA, 23 nt, Human
ucacaguccuuaccagcagagca

SEQ ID NO: 1635375 - RNA, 22 nt, Human
ucacaguccuuaccagcagagc

SEQ ID NO: 1635376 - RNA, 19 nt, Human
ucacaggcagguccagggu

SEQ ID NO: 1635377 - RNA, 18 nt, Human
ucacaggcagguccaggg

SEQ ID NO: 1635378 - RNA, 17 nt, Human
ucacaggcagguccagg

SEQ ID NO: 1635379 - RNA, 16 nt, Human
ucacaggcagguccag

SEQ ID NO: 1635380 - RNA, 18 nt, Human
ucacaagacccaaaaggc

SEQ ID NO: 1635381 - RNA, 17 nt, Human
ucacaagacccaaaagg

SEQ ID NO: 1635382 - RNA, 13 nt, Human
ucacaagacccaa

SEQ ID NO: 1635383 - RNA, 14 nt, Human
ucaccaaggcugau

SEQ ID NO: 1635384 - RNA, 21 nt, Human
ucaccaaaucagcugcuacua

SEQ ID NO: 1635385 - RNA, 20 nt, Human
ucaccaaaucagcugcuacu

SEQ ID NO: 1635386 - RNA, 19 nt, Human
ucaccaaaucagcugcuac

SEQ ID NO: 1635387 - RNA, 16 nt, Human
ucaccacaugugcaca

SEQ ID NO: 1635388 - RNA, 17 nt, Human
ucacauuuauucugcuc

SEQ ID NO: 1635389 - RNA, 19 nt, Human
ucacauuuauucugcucac

SEQ ID NO: 1635390 - RNA, 18 nt, Human
ucacauuuauucugcuca

SEQ ID NO: 1635391 - RNA, 21 nt, Human
ucaauaaaauccauacauuug

SEQ ID NO: 1635392 - RNA, 21 nt, Human
ucaagugauucuccugccuca

SEQ ID NO: 1635393 - RNA, 20 nt, Human
ucaagugauucuccugccuc

SEQ ID NO: 1635394 - RNA, 18 nt, Human
ucaacgcagcccugcuuu

SEQ ID NO: 1635395 - RNA, 15 nt, Human
ucaacgcagcccugc

SEQ ID NO: 1635396 - RNA, 14 nt, Human
ucaacgcagcccug

SEQ ID NO: 1635397 - RNA, 23 nt, Human
ucaauuacaggaaguacuggaga

SEQ ID NO: 1635398 - RNA, 21 nt, Human
ucaauuacaggaaguacugga

SEQ ID NO: 1635399 - RNA, 22 nt, Human
ucaaugccccugaauuuaaaua

SEQ ID NO: 1635400 - RNA, 20 nt, Human
ucaaugccccugaauuuaaa

SEQ ID NO: 1635401 - RNA, 18 nt, Human
ucaaugccccugaauuua

SEQ ID NO: 1635402 - RNA, 17 nt, Human
ucaaugccccugaauuu

SEQ ID NO: 1635403 - RNA, 15 nt, Human
ucaaauugugugaaa

SEQ ID NO: 1635404 - RNA, 23 nt, Human
ucaaccccuucgcuccugugucu

SEQ ID NO: 1635405 - RNA, 14 nt, Human
ucaaauugugugaa

SEQ ID NO: 1635406 - RNA, 20 nt, Human
ucaaauuguaagcaugcaca

SEQ ID NO: 1635407 - RNA, 17 nt, Human
ucaaauuguaagcaugc

SEQ ID NO: 1635408 - RNA, 15 nt, Human
ucaaauccuugaaga

SEQ ID NO: 1635409 - RNA, 20 nt, Human
ucaaaucaagaaacuuaagg

SEQ ID NO: 1635410 - RNA, 14 nt, Human
ucaaauaugcaaag

SEQ ID NO: 1635411 - RNA, 16 nt, Human
ucaaauaugcaaagca

SEQ ID NO: 1635412 - RNA, 23 nt, Human
ucaaauauauucagccuggcuuc

SEQ ID NO: 1635413 - RNA, 22 nt, Human
ucaaauauauucagccuggcuu

SEQ ID NO: 1635414 - RNA, 21 nt, Human
ucaaauauauucagccuggcu

SEQ ID NO: 1635415 - RNA, 14 nt, Human
uauuuuauuaugca

SEQ ID NO: 1635416 - RNA, 17 nt, Human
uauuuuauuaugcauga

SEQ ID NO: 1635417 - RNA, 15 nt, Human
uauuuucauucuccu

SEQ ID NO: 1635418 - RNA, 19 nt, Human
uauuuucaacgcagcccug

SEQ ID NO: 1635419 - RNA, 17 nt, Human
uauuuuauguugcauag

SEQ ID NO: 1635420 - RNA, 13 nt, Human
uauuuuauuauga

SEQ ID NO: 1635421 - RNA, 23 nt, Human
uauuuuauuaugaaacuugugua

SEQ ID NO: 1635422 - RNA, 18 nt, Human
uauuuuauuaugaaacuu

SEQ ID NO: 1635423 - RNA, 15 nt, Human
ucaaaaaaagaaaaa

SEQ ID NO: 1635424 - RNA, 14 nt, Human
ucaaaaaaagaaaa

SEQ ID NO: 1635425 - RNA, 14 nt, Human
uauuuuuuuacuaa

SEQ ID NO: 1635426 - RNA, 17 nt, Human
uauuuuuuucuuuucuu

SEQ ID NO: 1635427 - RNA, 22 nt, Human
uauuuucccuauuagagaagag

SEQ ID NO: 1635428 - RNA, 17 nt, Human
ucuuccuggauuauuca

SEQ ID NO: 1635429 - RNA, 18 nt, Human
ucuucagaucucuaacuu

SEQ ID NO: 1635430 - RNA, 23 nt, Human
ucuucagaucucuaacuucacca

SEQ ID NO: 1635431 - RNA, 23 nt, Human
ucuucagcaaaaauauuuuauga

SEQ ID NO: 1635432 - RNA, 22 nt, Human
ucuucagcaaaaauauuuuaug

SEQ ID NO: 1635433 - RNA, 21 nt, Human
ucuucagcaaaaauauuuuau

SEQ ID NO: 1635434 - RNA, 12 nt, Human
ucuugaacuccu

SEQ ID NO: 1635435 - RNA, 19 nt, Human
ucuugaacuccugaccuca

SEQ ID NO: 1635436 - RNA, 17 nt, Human
ucuugaacuccugaccu

SEQ ID NO: 1635437 - RNA, 13 nt, Human
ucuugaaaaaugc

SEQ ID NO: 1635438 - RNA, 13 nt, Human
ucuucuccuuuca

SEQ ID NO: 1635439 - RNA, 14 nt, Human
ucuucuccuuucac

SEQ ID NO: 1635440 - RNA, 18 nt, Human
ucuucuuuuuuugugaug

SEQ ID NO: 1635441 - RNA, 17 nt, Human
ucuucuuuuuuugugau

SEQ ID NO: 1635442 - RNA, 16 nt, Human
ucuucuuuuuuuguga

SEQ ID NO: 1635443 - RNA, 12 nt, Human
ucuucuccacug

SEQ ID NO: 1635444 - RNA, 15 nt, Human
ucugucuucacaaca

SEQ ID NO: 1635445 - RNA, 13 nt, Human
ucuuaaaaagugg

SEQ ID NO: 1635446 - RNA, 12 nt, Human
ucuuaaaguuga

SEQ ID NO: 1635447 - RNA, 14 nt, Human
ucuuaaaguugaau

SEQ ID NO: 1635448 - RNA, 13 nt, Human
ucuuaaaguugaa

SEQ ID NO: 1635449 - RNA, 18 nt, Human
ucuuaagaagacugcauu

SEQ ID NO: 1635450 - RNA, 12 nt, Human
ucuuaagaagac

SEQ ID NO: 1635451 - RNA, 22 nt, Human
ucuuaaccagaucauugugaaa

SEQ ID NO: 1635452 - RNA, 22 nt, Human
ucuuaaauauguggaguucauc

SEQ ID NO: 1635453 - RNA, 17 nt, Human
ucuuaaccagaucauug

SEQ ID NO: 1635454 - RNA, 16 nt, Human
ucuuaaccagaucauu

SEQ ID NO: 1635455 - RNA, 22 nt, Human
ucuuaaaguugaauuuauuggc

SEQ ID NO: 1635456 - RNA, 21 nt, Human
ucuuaaaguugaauuuauugg

SEQ ID NO: 1635457 - RNA, 20 nt, Human
ucuuaaaguugaauuuauug

SEQ ID NO: 1635458 - RNA, 19 nt, Human
ucuuaaaguugaauuuauu

SEQ ID NO: 1635459 - RNA, 16 nt, Human
ucuuaaaguugaauuu

SEQ ID NO: 1635460 - RNA, 23 nt, Human
ucuggccuucggccuccauccug

SEQ ID NO: 1635461 - RNA, 18 nt, Human
ucuggccuucggccucca

SEQ ID NO: 1635462 - RNA, 17 nt, Human
ucuggccuucggccucc

SEQ ID NO: 1635463 - RNA, 19 nt, Human
ucuggcuaugcauuugaaa

SEQ ID NO: 1635464 - RNA, 22 nt, Human
ucuggcuaugcauuugaaaauu

SEQ ID NO: 1635465 - RNA, 15 nt, Human
ucuggcuccagcugg

SEQ ID NO: 1635466 - RNA, 14 nt, Human
ucugggacacaguu

SEQ ID NO: 1635467 - RNA, 23 nt, Human
ucuggugacuuuccucuuugguc

SEQ ID NO: 1635468 - RNA, 23 nt, Human
ucuggcucuuccaggcugggaga

SEQ ID NO: 1635469 - RNA, 18 nt, Human
ucuggcucuuccaggcug

SEQ ID NO: 1635470 - RNA, 19 nt, Human
ucuguccuacucuguguca

SEQ ID NO: 1635471 - RNA, 15 nt, Human
ucuguccuacucugu

SEQ ID NO: 1635472 - RNA, 20 nt, Human
ucuguccuacucugugucag

SEQ ID NO: 1635473 - RNA, 14 nt, Human
ucugucgcccaguc

SEQ ID NO: 1635474 - RNA, 16 nt, Human
ucugucgcccagucug

SEQ ID NO: 1635475 - RNA, 22 nt, Human
ucugucucuggauuauauuaug

SEQ ID NO: 1635476 - RNA, 13 nt, Human
ucugguuccuccc

SEQ ID NO: 1635477 - RNA, 21 nt, Human
ucugguuccuccccuccuccu

SEQ ID NO: 1635478 - RNA, 20 nt, Human
ucugguuccuccccuccucc

SEQ ID NO: 1635479 - RNA, 22 nt, Human
ucugcugacagacacaggcccg

SEQ ID NO: 1635480 - RNA, 21 nt, Human
ucugcugacagacacaggccc

SEQ ID NO: 1635481 - RNA, 20 nt, Human
ucugcugacagacacaggcc

SEQ ID NO: 1635482 - RNA, 19 nt, Human
ucugcugacagacacaggc

SEQ ID NO: 1635483 - RNA, 22 nt, Human
ucugcugauccucccaggcuuc

SEQ ID NO: 1635484 - RNA, 19 nt, Human
ucuggaauaaggagaauga

SEQ ID NO: 1635485 - RNA, 15 nt, Human
ucuggaaugcagugg

SEQ ID NO: 1635486 - RNA, 14 nt, Human
ucuggacaggcaug

SEQ ID NO: 1635487 - RNA, 16 nt, Human
ucuggaaugcaguggu

SEQ ID NO: 1635488 - RNA, 21 nt, Human
ucuggacaggcauguucucug

SEQ ID NO: 1635489 - RNA, 18 nt, Human
ucugcugacagacacagg

SEQ ID NO: 1635490 - RNA, 21 nt, Human
ucugcuccucuccccagcaag

SEQ ID NO: 1635491 - RNA, 18 nt, Human
ucugcuccucuccccagc

SEQ ID NO: 1635492 - RNA, 16 nt, Human
ucugccugcccaggcc

SEQ ID NO: 1635493 - RNA, 15 nt, Human
ucugccugcccaggc

SEQ ID NO: 1635494 - RNA, 14 nt, Human
ucugccugcccagg

SEQ ID NO: 1635495 - RNA, 18 nt, Human
ucugccauauucuguugg

SEQ ID NO: 1635496 - RNA, 21 nt, Human
ucugcaucagcugcugaaaca

SEQ ID NO: 1635497 - RNA, 19 nt, Human
ucugcaucagcugcugaaa

SEQ ID NO: 1635498 - RNA, 14 nt, Human
ucugcaucagcugc

SEQ ID NO: 1635499 - RNA, 17 nt, Human
ucugcauucaggaucaa

SEQ ID NO: 1635500 - RNA, 15 nt, Human
ucugacccacugcuu

SEQ ID NO: 1635501 - RNA, 14 nt, Human
ucugacccacugcu

SEQ ID NO: 1635502 - RNA, 14 nt, Human
ucugaggaauucug

SEQ ID NO: 1635503 - RNA, 19 nt, Human
ucugaggaauucuguauag

SEQ ID NO: 1635504 - RNA, 18 nt, Human
ucugaggaauucuguaua

SEQ ID NO: 1635505 - RNA, 17 nt, Human
ucugaggaauucuguau

SEQ ID NO: 1635506 - RNA, 16 nt, Human
ucugaggaauucugua

SEQ ID NO: 1635507 - RNA, 15 nt, Human
ucugaggaauucugu

SEQ ID NO: 1635508 - RNA, 21 nt, Human
ucugcaagaauugaagcagga

SEQ ID NO: 1635509 - RNA, 20 nt, Human
ucugcaagaauugaagcagg

SEQ ID NO: 1635510 - RNA, 14 nt, Human
ucugcacacagcac

SEQ ID NO: 1635511 - RNA, 15 nt, Human
ucugcaacucugaag

SEQ ID NO: 1635512 - RNA, 14 nt, Human
ucugcaacucugaa

SEQ ID NO: 1635513 - RNA, 23 nt, Human
ucugaggcugaaauucagaauau

SEQ ID NO: 1635514 - RNA, 11 nt, Human
ucugaggcuga

SEQ ID NO: 1635515 - RNA, 13 nt, Human
ucugaaaauguau

SEQ ID NO: 1635516 - RNA, 14 nt, Human
ucugaaaauugaug

SEQ ID NO: 1635517 - RNA, 14 nt, Human
ucugaaaauguaug

SEQ ID NO: 1635518 - RNA, 22 nt, Human
ucugaaaauugaugggauuugg

SEQ ID NO: 1635519 - RNA, 22 nt, Human
ucugacaggcaaugcuggcugu

SEQ ID NO: 1635520 - RNA, 21 nt, Human
ucugacaggcaaugcuggcug

SEQ ID NO: 1635521 - RNA, 12 nt, Human
ucugacaggcaa

SEQ ID NO: 1635522 - RNA, 13 nt, Human
ucugacccacugc

SEQ ID NO: 1635523 - RNA, 15 nt, Human
ucugacauaaguauu

SEQ ID NO: 1635524 - RNA, 19 nt, Human
ucugacacacagcucuguc

SEQ ID NO: 1635525 - RNA, 18 nt, Human
ucugacacacagcucugu

SEQ ID NO: 1635526 - RNA, 17 nt, Human
ucugacacacagcucug

SEQ ID NO: 1635527 - RNA, 16 nt, Human
ucugacacacagcucu

SEQ ID NO: 1635528 - RNA, 20 nt, Human
ucugaaauuuccugggagcu

SEQ ID NO: 1635529 - RNA, 18 nt, Human
ucugaaauuuccugggag

SEQ ID NO: 1635530 - RNA, 17 nt, Human
ucugaaauuuccuggga

SEQ ID NO: 1635531 - RNA, 19 nt, Human
ucucuaacuucaccauauu

SEQ ID NO: 1635532 - RNA, 12 nt, Human
ucucuaacuuca

SEQ ID NO: 1635533 - RNA, 22 nt, Human
ucucgugauugauaagaaccuu

SEQ ID NO: 1635534 - RNA, 14 nt, Human
ucucgugauugaua

SEQ ID NO: 1635535 - RNA, 19 nt, Human
ucuccuguaccucuugagc

SEQ ID NO: 1635536 - RNA, 16 nt, Human
ucuccuguaccucuug

SEQ ID NO: 1635537 - RNA, 17 nt, Human
ucuccuguaccucuuga

SEQ ID NO: 1635538 - RNA, 15 nt, Human
ucuccugccucagcc

SEQ ID NO: 1635539 - RNA, 17 nt, Human
ucuccugccucagccuc

SEQ ID NO: 1635540 - RNA, 19 nt, Human
ucuccugccucagccuccc

SEQ ID NO: 1635541 - RNA, 15 nt, Human
ucuccuguaccucuu

SEQ ID NO: 1635542 - RNA, 21 nt, Human
ucuccuggaaauauuaagaaa

SEQ ID NO: 1635543 - RNA, 21 nt, Human
ucuccuggaagugcuaauuuu

SEQ ID NO: 1635544 - RNA, 12 nt, Human
ucuccugccuca

SEQ ID NO: 1635545 - RNA, 18 nt, Human
ucucaagagggcacuggu

SEQ ID NO: 1635546 - RNA, 17 nt, Human
ucucaagagggcacugg

SEQ ID NO: 1635547 - RNA, 19 nt, Human
ucucaagagggcacuggug

SEQ ID NO: 1635548 - RNA, 16 nt, Human
ucucuaguuugauuaa

SEQ ID NO: 1635549 - RNA, 15 nt, Human
ucucuaguuugauua

SEQ ID NO: 1635550 - RNA, 17 nt, Human
ucucugaggacacuaac

SEQ ID NO: 1635551 - RNA, 15 nt, Human
ucucugauacagaaa

SEQ ID NO: 1635552 - RNA, 14 nt, Human
ucucugcagguccc

SEQ ID NO: 1635553 - RNA, 13 nt, Human
ucucugcaggucc

SEQ ID NO: 1635554 - RNA, 18 nt, Human
ucucugcaggucccuaau

SEQ ID NO: 1635555 - RNA, 16 nt, Human
ucucugcaggucccua

SEQ ID NO: 1635556 - RNA, 15 nt, Human
ucucugcaggucccu

SEQ ID NO: 1635557 - RNA, 22 nt, Human
ucgugggacagucaccucaugg

SEQ ID NO: 1635558 - RNA, 21 nt, Human
ucguggaacaguuaccucugc

SEQ ID NO: 1635559 - RNA, 18 nt, Human
ucggccuccauccugagg

SEQ ID NO: 1635560 - RNA, 16 nt, Human
ucgugauugauaagaa

SEQ ID NO: 1635561 - RNA, 22 nt, Human
ucggccucccaaagugcuggga

SEQ ID NO: 1635562 - RNA, 13 nt, Human
ucguuaauuugua

SEQ ID NO: 1635563 - RNA, 21 nt, Human
ucuaaaucuccaaaauaaaac

SEQ ID NO: 1635564 - RNA, 22 nt, Human
ucuaaaucuccaaaauaaaacu

SEQ ID NO: 1635565 - RNA, 17 nt, Human
ucuaugaaauauuaugu

SEQ ID NO: 1635566 - RNA, 14 nt, Human
ucuaugaaauauua

SEQ ID NO: 1635567 - RNA, 13 nt, Human
ucuaugaaauauu

SEQ ID NO: 1635568 - RNA, 21 nt, Human
ucuaucaaguauuauaccuuu

SEQ ID NO: 1635569 - RNA, 22 nt, Human
ucuaucaaguauuauaccuuuu

SEQ ID NO: 1635570 - RNA, 15 nt, Human
ucuaucaaguauuau

SEQ ID NO: 1635571 - RNA, 17 nt, Human
ucucaaauaacuaaaag

SEQ ID NO: 1635572 - RNA, 15 nt, Human
ucucaacuccaaacu

SEQ ID NO: 1635573 - RNA, 16 nt, Human
ucuaugcugaguuugu

SEQ ID NO: 1635574 - RNA, 20 nt, Human
ucuaugcugaguuugugcug

SEQ ID NO: 1635575 - RNA, 19 nt, Human
ucuagugagcagucaggaa

SEQ ID NO: 1635576 - RNA, 18 nt, Human
ucuaggaggucucuaaga

SEQ ID NO: 1635577 - RNA, 22 nt, Human
ucuagugagcagucaggaaaga

SEQ ID NO: 1635578 - RNA, 16 nt, Human
ucuaggacugaauuau

SEQ ID NO: 1635579 - RNA, 23 nt, Human
ucuaggacugaauuaugaaacuu

SEQ ID NO: 1635580 - RNA, 14 nt, Human
ucuaauauguaaca

SEQ ID NO: 1635581 - RNA, 14 nt, Human
ucuaaugugugaau

SEQ ID NO: 1635582 - RNA, 20 nt, Human
uccugccuaagugcagcccc

SEQ ID NO: 1635583 - RNA, 14 nt, Human
uccugagccagauu

SEQ ID NO: 1635584 - RNA, 14 nt, Human
uccugccucagccu

SEQ ID NO: 1635585 - RNA, 13 nt, Human
uccugagccagau

SEQ ID NO: 1635586 - RNA, 19 nt, Human
uccuggcacccggccccug

SEQ ID NO: 1635587 - RNA, 16 nt, Human
uccuggcacccggccc

SEQ ID NO: 1635588 - RNA, 14 nt, Human
uccuggcacccggc

SEQ ID NO: 1635589 - RNA, 15 nt, Human
uccugccucagccuc

SEQ ID NO: 1635590 - RNA, 13 nt, Human
uccugccucagcc

SEQ ID NO: 1635591 - RNA, 16 nt, Human
uccugccucagccucc

SEQ ID NO: 1635592 - RNA, 17 nt, Human
uccugccucagccuccc

SEQ ID NO: 1635593 - RNA, 22 nt, Human
uccuggcacccggccccugcug

SEQ ID NO: 1635594 - RNA, 21 nt, Human
uccuggcacccggccccugcu

SEQ ID NO: 1635595 - RNA, 20 nt, Human
uccuggcacccggccccugc

SEQ ID NO: 1635596 - RNA, 22 nt, Human
uccuggcacugcuuccagugag

SEQ ID NO: 1635597 - RNA, 18 nt, Human
uccuggcacugcuuccag

SEQ ID NO: 1635598 - RNA, 22 nt, Human
uccuguaccucuugagccuuga

SEQ ID NO: 1635599 - RNA, 20 nt, Human
uccuguaccucuugagccuu

SEQ ID NO: 1635600 - RNA, 16 nt, Human
uccuuggacucauuuu

SEQ ID NO: 1635601 - RNA, 23 nt, Human
uccuuuucacaguucucuccuuc

SEQ ID NO: 1635602 - RNA, 19 nt, Human
uccuuuuaaaacacuucca

SEQ ID NO: 1635603 - RNA, 18 nt, Human
uccuuuucgcaggauucu

SEQ ID NO: 1635604 - RNA, 13 nt, Human
ucgaacuggcugc

SEQ ID NO: 1635605 - RNA, 15 nt, Human
ucgaacuccugaccu

SEQ ID NO: 1635606 - RNA, 20 nt, Human
uccuucaccuuuguccccac

SEQ ID NO: 1635607 - RNA, 18 nt, Human
uccuucaccuuugucccc

SEQ ID NO: 1635608 - RNA, 20 nt, Human
uccuuaccagcagagcaccu

SEQ ID NO: 1635609 - RNA, 19 nt, Human
uccuucacagaugggugcu

SEQ ID NO: 1635610 - RNA, 18 nt, Human
uccuucacagaugggugc

SEQ ID NO: 1635611 - RNA, 18 nt, Human
uccuuaccagcagagcac

SEQ ID NO: 1635612 - RNA, 17 nt, Human
uccuuaccagcagagca

SEQ ID NO: 1635613 - RNA, 16 nt, Human
uccuuaccagcagagc

SEQ ID NO: 1635614 - RNA, 22 nt, Human
uccuucaccuuuguccccaccg

SEQ ID NO: 1635615 - RNA, 21 nt, Human
uccuucaccuuuguccccacc

SEQ ID NO: 1635616 - RNA, 20 nt, Human
uccucugcuugccaucccuc

SEQ ID NO: 1635617 - RNA, 17 nt, Human
uccucugcugcuggcug

SEQ ID NO: 1635618 - RNA, 21 nt, Human
uccucugcuugccaucccucc

SEQ ID NO: 1635619 - RNA, 22 nt, Human
uccucugcuugccaucccuccc

SEQ ID NO: 1635620 - RNA, 16 nt, Human
uccucugcugcuggcu

SEQ ID NO: 1635621 - RNA, 15 nt, Human
uccucugcugcuggc

SEQ ID NO: 1635622 - RNA, 14 nt, Human
uccucugcugcugg

SEQ ID NO: 1635623 - RNA, 17 nt, Human
uccucuaggaggucucu

SEQ ID NO: 1635624 - RNA, 19 nt, Human
uccucuguacagagcccac

SEQ ID NO: 1635625 - RNA, 18 nt, Human
uccucuguacagagccca

SEQ ID NO: 1635626 - RNA, 17 nt, Human
uccucuguacagagccc

SEQ ID NO: 1635627 - RNA, 16 nt, Human
uccucuguacagagcc

SEQ ID NO: 1635628 - RNA, 21 nt, Human
uccucuuccugaauuuuauuu

SEQ ID NO: 1635629 - RNA, 14 nt, Human
uccucuaggagguc

SEQ ID NO: 1635630 - RNA, 19 nt, Human
uccuccuuuucacaguucu

SEQ ID NO: 1635631 - RNA, 18 nt, Human
uccuauauuguuuucagu

SEQ ID NO: 1635632 - RNA, 21 nt, Human
uccuauauuguuuucagugua

SEQ ID NO: 1635633 - RNA, 17 nt, Human
uccucauuagcauuuug

SEQ ID NO: 1635634 - RNA, 18 nt, Human
uccuacccacccuccuuu

SEQ ID NO: 1635635 - RNA, 15 nt, Human
uccuacaagacacag

SEQ ID NO: 1635636 - RNA, 18 nt, Human
uccuaauuccacagcugc

SEQ ID NO: 1635637 - RNA, 17 nt, Human
uccuaauuccacagcug

SEQ ID NO: 1635638 - RNA, 16 nt, Human
uccuaauuccacagcu

SEQ ID NO: 1635639 - RNA, 15 nt, Human
uccuaauuccacagc

SEQ ID NO: 1635640 - RNA, 22 nt, Human
uccuaaugaaugcauaaaaugu

SEQ ID NO: 1635641 - RNA, 17 nt, Human
uccgaccagacaccuug

SEQ ID NO: 1635642 - RNA, 13 nt, Human
uccgaccagacac

SEQ ID NO: 1635643 - RNA, 16 nt, Human
uccuaaucuucugaac

SEQ ID NO: 1635644 - RNA, 16 nt, Human
ucccuugaugaagaag

SEQ ID NO: 1635645 - RNA, 15 nt, Human
ucccuugaugaagaa

SEQ ID NO: 1635646 - RNA, 13 nt, Human
ucccuucccaccu

SEQ ID NO: 1635647 - RNA, 14 nt, Human
ucccuucccaccuc

SEQ ID NO: 1635648 - RNA, 14 nt, Human
ucccugcacuugca

SEQ ID NO: 1635649 - RNA, 13 nt, Human
ucccugcacuugc

SEQ ID NO: 1635650 - RNA, 20 nt, Human
ucccugccccucccuucaac

SEQ ID NO: 1635651 - RNA, 21 nt, Human
uccccuguuuguuucugaaag

SEQ ID NO: 1635652 - RNA, 20 nt, Human
uccccuguuuguuucugaaa

SEQ ID NO: 1635653 - RNA, 18 nt, Human
uccagguuuaagcuguua

SEQ ID NO: 1635654 - RNA, 17 nt, Human
uccagguuuaagcuguu

SEQ ID NO: 1635655 - RNA, 15 nt, Human
ucccuaauaaagcug

SEQ ID NO: 1635656 - RNA, 16 nt, Human
ucccuauuagagaaga

SEQ ID NO: 1635657 - RNA, 16 nt, Human
ucccuaauaaagcugu

SEQ ID NO: 1635658 - RNA, 19 nt, Human
ucccuccugggaaugaagc

SEQ ID NO: 1635659 - RNA, 11 nt, Human
ucccuccuggg

SEQ ID NO: 1635660 - RNA, 17 nt, Human
uguaacaagccacccca

SEQ ID NO: 1635661 - RNA, 14 nt, Human
uguaacaagccacc

SEQ ID NO: 1635662 - RNA, 11 nt, Human
uguacagagcc

SEQ ID NO: 1635663 - RNA, 14 nt, Human
uguacagacaacaa

SEQ ID NO: 1635664 - RNA, 21 nt, Human
uguacaaaguauuaagcauau

SEQ ID NO: 1635665 - RNA, 17 nt, Human
uguaaugaaaaccacau

SEQ ID NO: 1635666 - RNA, 15 nt, Human
uguacaaaguauuaa

SEQ ID NO: 1635667 - RNA, 20 nt, Human
uguacaaaguauuaagcaua

SEQ ID NO: 1635668 - RNA, 19 nt, Human
uguacaaaguauuaagcau

SEQ ID NO: 1635669 - RNA, 18 nt, Human
uguacaaaguauuaagca

SEQ ID NO: 1635670 - RNA, 17 nt, Human
uguacaaaguauuaagc

SEQ ID NO: 1635671 - RNA, 13 nt, Human
uguaaugaaaacc

SEQ ID NO: 1635672 - RNA, 12 nt, Human
uguaaugaaaac

SEQ ID NO: 1635673 - RNA, 11 nt, Human
uguaaugaaaa

SEQ ID NO: 1635674 - RNA, 12 nt, Human
uguaaaauggug

SEQ ID NO: 1635675 - RNA, 11 nt, Human
uguaaaauggu

SEQ ID NO: 1635676 - RNA, 23 nt, Human
ugguuuuuaaaaaacugcugacu

SEQ ID NO: 1635677 - RNA, 21 nt, Human
ugguuuuuaaaaaacugcuga

SEQ ID NO: 1635678 - RNA, 19 nt, Human
ugguuuucuuguguguuua

SEQ ID NO: 1635679 - RNA, 16 nt, Human
ugguuuucuguucuuu

SEQ ID NO: 1635680 - RNA, 20 nt, Human
ugguuguacauauaagugau

SEQ ID NO: 1635681 - RNA, 13 nt, Human
ugguugcauccua

SEQ ID NO: 1635682 - RNA, 14 nt, Human
uggguagacacaca

SEQ ID NO: 1635683 - RNA, 23 nt, Human
uggguacuuguggacacagcucu

SEQ ID NO: 1635684 - RNA, 20 nt, Human
uggguacuuguggacacagc

SEQ ID NO: 1635685 - RNA, 14 nt, Human
uggugagaggcauc

SEQ ID NO: 1635686 - RNA, 23 nt, Human
uggugacuuuggauaauaaggaa

SEQ ID NO: 1635687 - RNA, 19 nt, Human
uggugacuuuggauaauaa

SEQ ID NO: 1635688 - RNA, 18 nt, Human
uggugacuuuggauaaua

SEQ ID NO: 1635689 - RNA, 16 nt, Human
uggugacuuuggauaa

SEQ ID NO: 1635690 - RNA, 20 nt, Human
uggugcaaugaccuuucaau

SEQ ID NO: 1635691 - RNA, 19 nt, Human
uggugcaaugaccuuucaa

SEQ ID NO: 1635692 - RNA, 14 nt, Human
uggugcaaugaccu

SEQ ID NO: 1635693 - RNA, 18 nt, Human
ugguggcagugggagcug

SEQ ID NO: 1635694 - RNA, 13 nt, Human
ugguggcaguggg

SEQ ID NO: 1635695 - RNA, 20 nt, Human
ugguggcagugggagcugcc

SEQ ID NO: 1635696 - RNA, 19 nt, Human
ugguggcccgacagccugg

SEQ ID NO: 1635697 - RNA, 18 nt, Human
uggugggggccucggugu

SEQ ID NO: 1635698 - RNA, 16 nt, Human
uggugggggccucggu

SEQ ID NO: 1635699 - RNA, 13 nt, Human
ugguggcuggguu

SEQ ID NO: 1635700 - RNA, 21 nt, Human
ugguggcccgacagccuggca

SEQ ID NO: 1635701 - RNA, 19 nt, Human
uggugguuuucuguucuuu

SEQ ID NO: 1635702 - RNA, 17 nt, Human
uggugguuucagaaaug

SEQ ID NO: 1635703 - RNA, 18 nt, Human
uggugguuucagaaaugu

SEQ ID NO: 1635704 - RNA, 20 nt, Human
ugguucccuugaugaagaag

SEQ ID NO: 1635705 - RNA, 17 nt, Human
ugguucccuugaugaag

SEQ ID NO: 1635706 - RNA, 16 nt, Human
ugguucccuugaugaa

SEQ ID NO: 1635707 - RNA, 23 nt, Human
ugguuccccuguucacucuacuu

SEQ ID NO: 1635708 - RNA, 23 nt, Human
ugguuccuccccuccuccuggac

SEQ ID NO: 1635709 - RNA, 18 nt, Human
ugguuccuccccuccucc

SEQ ID NO: 1635710 - RNA, 12 nt, Human
ugguuccucccc

SEQ ID NO: 1635711 - RNA, 18 nt, Human
ugguugaugaucuuugca

SEQ ID NO: 1635712 - RNA, 19 nt, Human
uggugucgggcaugacacg

SEQ ID NO: 1635713 - RNA, 18 nt, Human
uggugucgggcaugacac

SEQ ID NO: 1635714 - RNA, 20 nt, Human
ugguuccccuguucacucua

SEQ ID NO: 1635715 - RNA, 19 nt, Human
ugguuccccuguucacucu

SEQ ID NO: 1635716 - RNA, 18 nt, Human
ugguuccccuguucacuc

SEQ ID NO: 1635717 - RNA, 11 nt, Human
ugguuccccug

SEQ ID NO: 1635718 - RNA, 15 nt, Human
uggugucgggcauga

SEQ ID NO: 1635719 - RNA, 16 nt, Human
uggugucaccugaaga

SEQ ID NO: 1635720 - RNA, 23 nt, Human
uguacagcaaggagauuuacaac

SEQ ID NO: 1635721 - RNA, 12 nt, Human
uguacagagccc

SEQ ID NO: 1635722 - RNA, 13 nt, Human
uguacagagccca

SEQ ID NO: 1635723 - RNA, 22 nt, Human
uguacagcaaggagauuuacaa

SEQ ID NO: 1635724 - RNA, 13 nt, Human
uguauaaaauaau

SEQ ID NO: 1635725 - RNA, 18 nt, Human
uguaggaagguuaauguu

SEQ ID NO: 1635726 - RNA, 14 nt, Human
uguauaaaauaauu

SEQ ID NO: 1635727 - RNA, 19 nt, Human
uguaguguuggagaagaac

SEQ ID NO: 1635728 - RNA, 21 nt, Human
uguaguguuggagaagaacug

SEQ ID NO: 1635729 - RNA, 20 nt, Human
uguaguguuggagaagaacu

SEQ ID NO: 1635730 - RNA, 13 nt, Human
uguaucugagcag

SEQ ID NO: 1635731 - RNA, 22 nt, Human
uguaugaaagauggcugugccu

SEQ ID NO: 1635732 - RNA, 23 nt, Human
uguauagauuagagaguguugaa

SEQ ID NO: 1635733 - RNA, 21 nt, Human
uguauagauuagaauucugua

SEQ ID NO: 1635734 - RNA, 15 nt, Human
uguauagauuagaau

SEQ ID NO: 1635735 - RNA, 23 nt, Human
uguauagaaccucuuugucuaca

SEQ ID NO: 1635736 - RNA, 19 nt, Human
uguauuuuaaaagaaugau

SEQ ID NO: 1635737 - RNA, 18 nt, Human
uguauuuuaaaagaauga

SEQ ID NO: 1635738 - RNA, 19 nt, Human
uguauuuuacuaauaaaau

SEQ ID NO: 1635739 - RNA, 14 nt, Human
ugucacaggcaggu

SEQ ID NO: 1635740 - RNA, 13 nt, Human
ugucacacacuuu

SEQ ID NO: 1635741 - RNA, 21 nt, Human
ugucaauuacaggaaguacug

SEQ ID NO: 1635742 - RNA, 13 nt, Human
uguaugcgugugu

SEQ ID NO: 1635743 - RNA, 14 nt, Human
ugucagugugacug

SEQ ID NO: 1635744 - RNA, 15 nt, Human
ugucagugugacuga

SEQ ID NO: 1635745 - RNA, 19 nt, Human
ugucagugugacugaucuc

SEQ ID NO: 1635746 - RNA, 16 nt, Human
ugucagugugacugau

SEQ ID NO: 1635747 - RNA, 21 nt, Human
ugucacaggcagguccagggu

SEQ ID NO: 1635748 - RNA, 17 nt, Human
ugucacaggcaggucca

SEQ ID NO: 1635749 - RNA, 16 nt, Human
ugucacaggcaggucc

SEQ ID NO: 1635750 - RNA, 15 nt, Human
ugucacaggcagguc

SEQ ID NO: 1635751 - RNA, 12 nt, Human
ugucuuaauuaa

SEQ ID NO: 1635752 - RNA, 23 nt, Human
ugucuuuggacccugaggcccag

SEQ ID NO: 1635753 - RNA, 16 nt, Human
ugucuuuucuugcaug

SEQ ID NO: 1635754 - RNA, 21 nt, Human
ugucucaaaaaaagaaaaaga

SEQ ID NO: 1635755 - RNA, 18 nt, Human
ugucucaagagggcacug

SEQ ID NO: 1635756 - RNA, 17 nt, Human
ugucucaagagggcacu

SEQ ID NO: 1635757 - RNA, 22 nt, Human
ugucucagauuuuauuauguaa

SEQ ID NO: 1635758 - RNA, 19 nt, Human
ugucucaagagggcacugg

SEQ ID NO: 1635759 - RNA, 20 nt, Human
ugucucagauuuuauuaugu

SEQ ID NO: 1635760 - RNA, 16 nt, Human
ugucucagauuuuauu

SEQ ID NO: 1635761 - RNA, 23 nt, Human
ugucuaguuguuugauucagaca

SEQ ID NO: 1635762 - RNA, 15 nt, Human
ugucuaguuguuuga

SEQ ID NO: 1635763 - RNA, 16 nt, Human
ugucuaugggacucaa

SEQ ID NO: 1635764 - RNA, 15 nt, Human
ugucuaugggacuca

SEQ ID NO: 1635765 - RNA, 14 nt, Human
ugucuaugggacuc

SEQ ID NO: 1635766 - RNA, 22 nt, Human
ugucuacacuaagagagaauga

SEQ ID NO: 1635767 - RNA, 18 nt, Human
ugucuacaccauuaugug

SEQ ID NO: 1635768 - RNA, 17 nt, Human
ugucuacacuaagagag

SEQ ID NO: 1635769 - RNA, 17 nt, Human
ugucuacaccauuaugu

SEQ ID NO: 1635770 - RNA, 14 nt, Human
ugucuaaugaaacc

SEQ ID NO: 1635771 - RNA, 20 nt, Human
uguccugggagugagcuggu

SEQ ID NO: 1635772 - RNA, 19 nt, Human
uguccugggagugagcugg

SEQ ID NO: 1635773 - RNA, 12 nt, Human
uguccugggagu

SEQ ID NO: 1635774 - RNA, 22 nt, Human
uguccugccuaaggcugaacuu

SEQ ID NO: 1635775 - RNA, 19 nt, Human
uguccccgcacugggcuug

SEQ ID NO: 1635776 - RNA, 17 nt, Human
uguccccgcacugggcu

SEQ ID NO: 1635777 - RNA, 13 nt, Human
ugucaucucagcu

SEQ ID NO: 1635778 - RNA, 13 nt, Human
uguccccuauccu

SEQ ID NO: 1635779 - RNA, 18 nt, Human
ugcuugugaaaggaaaga

SEQ ID NO: 1635780 - RNA, 22 nt, Human
ugcuucuguuuuauaauuuugu

SEQ ID NO: 1635781 - RNA, 13 nt, Human
ugcuucuucagag

SEQ ID NO: 1635782 - RNA, 14 nt, Human
ugcuuguuaacuga

SEQ ID NO: 1635783 - RNA, 16 nt, Human
ugcuuguuaacugagu

SEQ ID NO: 1635784 - RNA, 17 nt, Human
ugcuuuggaaaacccag

SEQ ID NO: 1635785 - RNA, 13 nt, Human
ugcuuuggaaauc

SEQ ID NO: 1635786 - RNA, 22 nt, Human
uggaaaaguauguuagugcaaa

SEQ ID NO: 1635787 - RNA, 17 nt, Human
uggaacacucugagacu

SEQ ID NO: 1635788 - RNA, 15 nt, Human
uggaacacucugaga

SEQ ID NO: 1635789 - RNA, 17 nt, Human
uggaacgcguugaaauu

SEQ ID NO: 1635790 - RNA, 16 nt, Human
uggaacgcguugaaau

SEQ ID NO: 1635791 - RNA, 15 nt, Human
uggaacgcguugaaa

SEQ ID NO: 1635792 - RNA, 14 nt, Human
uggaacgcguugaa

SEQ ID NO: 1635793 - RNA, 17 nt, Human
ugcuucuguuuuauaau

SEQ ID NO: 1635794 - RNA, 23 nt, Human
ugcuuccagugaggcucugcccu

SEQ ID NO: 1635795 - RNA, 22 nt, Human
ugcuuccagugaggcucugccc

SEQ ID NO: 1635796 - RNA, 13 nt, Human
ugcuuaacuucac

SEQ ID NO: 1635797 - RNA, 14 nt, Human
ugcuuaacuucaca

SEQ ID NO: 1635798 - RNA, 17 nt, Human
ugcuuaacuucacauau

SEQ ID NO: 1635799 - RNA, 18 nt, Human
ugcuuaacuucacauauu

SEQ ID NO: 1635800 - RNA, 19 nt, Human
ugcuuaacuucacauauug

SEQ ID NO: 1635801 - RNA, 23 nt, Human
uggacaggcauguucucugagga

SEQ ID NO: 1635802 - RNA, 15 nt, Human
uggaccaaaaaccag

SEQ ID NO: 1635803 - RNA, 22 nt, Human
uggacaggcauguucucugagg

SEQ ID NO: 1635804 - RNA, 18 nt, Human
uggacaggcauguucucu

SEQ ID NO: 1635805 - RNA, 23 nt, Human
uggacguguuaugacuccagaau

SEQ ID NO: 1635806 - RNA, 19 nt, Human
uggacguguuaugacucca

SEQ ID NO: 1635807 - RNA, 17 nt, Human
uggaccaaaaaccagua

SEQ ID NO: 1635808 - RNA, 20 nt, Human
uggacuaacuugucuuugga

SEQ ID NO: 1635809 - RNA, 19 nt, Human
uggacuaacuugucuuugg

SEQ ID NO: 1635810 - RNA, 22 nt, Human
uggcacugcuuccagugaggcu

SEQ ID NO: 1635811 - RNA, 22 nt, Human
uggcacuauaauguaagcucua

SEQ ID NO: 1635812 - RNA, 19 nt, Human
uggcacugcuuccagugag

SEQ ID NO: 1635813 - RNA, 21 nt, Human
uggcacuauaauguaagcucu

SEQ ID NO: 1635814 - RNA, 15 nt, Human
uggauuuaacagaaa

SEQ ID NO: 1635815 - RNA, 17 nt, Human
uggauuuaacagaaaug

SEQ ID NO: 1635816 - RNA, 23 nt, Human
uggaggggggaggugggauccuc

SEQ ID NO: 1635817 - RNA, 21 nt, Human
uggaugcagccucacaguccu

SEQ ID NO: 1635818 - RNA, 13 nt, Human
uggaugcagccuc

SEQ ID NO: 1635819 - RNA, 22 nt, Human
uggaugcagccucacaguccuu

SEQ ID NO: 1635820 - RNA, 19 nt, Human
uggaucaaauccagccugc

SEQ ID NO: 1635821 - RNA, 22 nt, Human
uggccuucggccuccauccuga

SEQ ID NO: 1635822 - RNA, 23 nt, Human
uggccuucggccuccauccugag

SEQ ID NO: 1635823 - RNA, 13 nt, Human
uggccucugcacu

SEQ ID NO: 1635824 - RNA, 17 nt, Human
uggcuccagcuggccgg

SEQ ID NO: 1635825 - RNA, 16 nt, Human
uggcugcugaaggcuc

SEQ ID NO: 1635826 - RNA, 14 nt, Human
uggcugcugaaggc

SEQ ID NO: 1635827 - RNA, 13 nt, Human
uggcugcugaagg

SEQ ID NO: 1635828 - RNA, 22 nt, Human
uggcuuccuaaaauucagugga

SEQ ID NO: 1635829 - RNA, 22 nt, Human
uggcuucccgcucagcccuccc

SEQ ID NO: 1635830 - RNA, 21 nt, Human
uggcuucccgcucagcccucc

SEQ ID NO: 1635831 - RNA, 20 nt, Human
uggcuucccgcucagcccuc

SEQ ID NO: 1635832 - RNA, 19 nt, Human
uggcuucccgcucagcccu

SEQ ID NO: 1635833 - RNA, 13 nt, Human
uggcuuuucugau

SEQ ID NO: 1635834 - RNA, 14 nt, Human
ugggaaugaagcaa

SEQ ID NO: 1635835 - RNA, 22 nt, Human
uggcuuuucacugcuggcugcc

SEQ ID NO: 1635836 - RNA, 21 nt, Human
uggcuuuucacugcuggcugc

SEQ ID NO: 1635837 - RNA, 19 nt, Human
uggcuuuucacugcuggcu

SEQ ID NO: 1635838 - RNA, 18 nt, Human
uggcuuuucacugcuggc

SEQ ID NO: 1635839 - RNA, 16 nt, Human
uggcuuuucacugcug

SEQ ID NO: 1635840 - RNA, 22 nt, Human
uggccucccaacucaccccagc

SEQ ID NO: 1635841 - RNA, 21 nt, Human
uggccucccaacucaccccag

SEQ ID NO: 1635842 - RNA, 20 nt, Human
uggccucccaacucacccca

SEQ ID NO: 1635843 - RNA, 19 nt, Human
uggccucccaacucacccc

SEQ ID NO: 1635844 - RNA, 14 nt, Human
uggccucccaacuc

SEQ ID NO: 1635845 - RNA, 11 nt, Human
uggccucccaa

SEQ ID NO: 1635846 - RNA, 23 nt, Human
uggccucaagugauucuccugcc

SEQ ID NO: 1635847 - RNA, 18 nt, Human
uggccucaagugauucuc

SEQ ID NO: 1635848 - RNA, 23 nt, Human
uggccuagcauacguacacauuu

SEQ ID NO: 1635849 - RNA, 20 nt, Human
uggccccucagggucccugg

SEQ ID NO: 1635850 - RNA, 13 nt, Human
uggccccucaggg

SEQ ID NO: 1635851 - RNA, 19 nt, Human
uggcagcugcgguccaccc

SEQ ID NO: 1635852 - RNA, 17 nt, Human
uggcagcugcgguccac

SEQ ID NO: 1635853 - RNA, 22 nt, Human
uggccccucagggucccuggug

SEQ ID NO: 1635854 - RNA, 21 nt, Human
uggccccucagggucccuggu

SEQ ID NO: 1635855 - RNA, 14 nt, Human
uggccccugcccgg

SEQ ID NO: 1635856 - RNA, 20 nt, Human
uggccuagcauacguacaca

SEQ ID NO: 1635857 - RNA, 14 nt, Human
ugggacagggagga

SEQ ID NO: 1635858 - RNA, 16 nt, Human
ugggaggaucucuuga

SEQ ID NO: 1635859 - RNA, 15 nt, Human
ugggacacccuguga

SEQ ID NO: 1635860 - RNA, 14 nt, Human
ugggacacccugug

SEQ ID NO: 1635861 - RNA, 21 nt, Human
ugggaaugaaugucaguguga

SEQ ID NO: 1635862 - RNA, 16 nt, Human
ugggaaugaaugucag

SEQ ID NO: 1635863 - RNA, 18 nt, Human
ugggaugauuggaggggg

SEQ ID NO: 1635864 - RNA, 18 nt, Human
ugggaggaucucuugagc

SEQ ID NO: 1635865 - RNA, 12 nt, Human
ugggauaaaugc

SEQ ID NO: 1635866 - RNA, 14 nt, Human
ugggauaaaugcca

SEQ ID NO: 1635867 - RNA, 13 nt, Human
ugggauaaaugcc

SEQ ID NO: 1635868 - RNA, 12 nt, Human
ugggcagcugcc

SEQ ID NO: 1635869 - RNA, 20 nt, Human
ugggcagcugccuccccucc

SEQ ID NO: 1635870 - RNA, 22 nt, Human
ugggcagcugccuccccuccuc

SEQ ID NO: 1635871 - RNA, 23 nt, Human
ugggcagcugccuccccuccucu

SEQ ID NO: 1635872 - RNA, 17 nt, Human
ugggcagagcagagacc

SEQ ID NO: 1635873 - RNA, 15 nt, Human
ugggcagagcagaga

SEQ ID NO: 1635874 - RNA, 14 nt, Human
ugggcagagcagag

SEQ ID NO: 1635875 - RNA, 18 nt, Human
ugggcagagcagagacca

SEQ ID NO: 1635876 - RNA, 21 nt, Human
ugggcuugucuguagauuuua

SEQ ID NO: 1635877 - RNA, 17 nt, Human
ugggcuugucuguagau

SEQ ID NO: 1635878 - RNA, 23 nt, Human
ugggcuuggggaccagagcugcc

SEQ ID NO: 1635879 - RNA, 13 nt, Human
uggggcagcuuga

SEQ ID NO: 1635880 - RNA, 22 nt, Human
ugggcuucaguggcagcugcuu

SEQ ID NO: 1635881 - RNA, 15 nt, Human
ugggcuucauccucc

SEQ ID NO: 1635882 - RNA, 22 nt, Human
ugggcuucauccuccucagauc

SEQ ID NO: 1635883 - RNA, 16 nt, Human
ugggggccucagugcc

SEQ ID NO: 1635884 - RNA, 20 nt, Human
uggggccaggcugggucgcc

SEQ ID NO: 1635885 - RNA, 17 nt, Human
uggggccaggcuggguc

SEQ ID NO: 1635886 - RNA, 19 nt, Human
uggggggcugaggugggag

SEQ ID NO: 1635887 - RNA, 23 nt, Human
ugggguuaucugaagucagaucu

SEQ ID NO: 1635888 - RNA, 23 nt, Human
ugaugcuucuucagagacuccug

SEQ ID NO: 1635889 - RNA, 13 nt, Human
ugauguacaugua

SEQ ID NO: 1635890 - RNA, 22 nt, Human
ugaugcuucuucagagacuccu

SEQ ID NO: 1635891 - RNA, 21 nt, Human
ugaugcuucuucagagacucc

SEQ ID NO: 1635892 - RNA, 19 nt, Human
ugaugcuucuucagagacu

SEQ ID NO: 1635893 - RNA, 20 nt, Human
ugaucuuugcagacaggcaa

SEQ ID NO: 1635894 - RNA, 19 nt, Human
ugaucuuugcagacaggca

SEQ ID NO: 1635895 - RNA, 21 nt, Human
ugaucugaugcaagcaagaaa

SEQ ID NO: 1635896 - RNA, 23 nt, Human
ugaucuuugcagacaggcaagca

SEQ ID NO: 1635897 - RNA, 21 nt, Human
ugaucuuugcagacaggcaag

SEQ ID NO: 1635898 - RNA, 14 nt, Human
ugaugccaugagga

SEQ ID NO: 1635899 - RNA, 20 nt, Human
ugaugaugaaaugaggucag

SEQ ID NO: 1635900 - RNA, 23 nt, Human
ugaugaucuuugcagacaggcaa

SEQ ID NO: 1635901 - RNA, 22 nt, Human
ugaugaucuuugcagacaggca

SEQ ID NO: 1635902 - RNA, 24 nt, Human
ugauaguuguaccgcaaugugacu

SEQ ID NO: 1635903 - RNA, 23 nt, Human
ugauauaaguguguguuuuucau

SEQ ID NO: 1635904 - RNA, 17 nt, Human
ugauauaaguguguguu

SEQ ID NO: 1635905 - RNA, 22 nt, Human
ugaucacggcucacugcagccu

SEQ ID NO: 1635906 - RNA, 20 nt, Human
ugauccacccaccucagccu

SEQ ID NO: 1635907 - RNA, 16 nt, Human
ugauccacccaccuca

SEQ ID NO: 1635908 - RNA, 15 nt, Human
ugauccacccaccuc

SEQ ID NO: 1635909 - RNA, 21 nt, Human
ugauccaagcuggucccacuc

SEQ ID NO: 1635910 - RNA, 24 nt, Human
ugaucauccacugugccaugugcc

SEQ ID NO: 1635911 - RNA, 13 nt, Human
ugaucauccacug

SEQ ID NO: 1635912 - RNA, 21 nt, Human
ugaucuaggaagacuuuggaa

SEQ ID NO: 1635913 - RNA, 19 nt, Human
ugaucuaggaagacuuugg

SEQ ID NO: 1635914 - RNA, 22 nt, Human
ugauccacccaccucagccucc

SEQ ID NO: 1635915 - RNA, 21 nt, Human
ugauccacccaccucagccuc

SEQ ID NO: 1635916 - RNA, 20 nt, Human
ugaucugaugcaagcaagaa

SEQ ID NO: 1635917 - RNA, 16 nt, Human
ugaggugcuauguucu

SEQ ID NO: 1635918 - RNA, 21 nt, Human
ugaguccccuguuuguuucug

SEQ ID NO: 1635919 - RNA, 19 nt, Human
ugagguuucaaaccucccu

SEQ ID NO: 1635920 - RNA, 18 nt, Human
ugaguccuggcaugggaa

SEQ ID NO: 1635921 - RNA, 11 nt, Human
ugaguccuggc

SEQ ID NO: 1635922 - RNA, 22 nt, Human
ugaguccuggcaugggaaugaa

SEQ ID NO: 1635923 - RNA, 19 nt, Human
ugaguccuggcaugggaau

SEQ ID NO: 1635924 - RNA, 14 nt, Human
ugagucgaggacag

SEQ ID NO: 1635925 - RNA, 20 nt, Human
ugaggucuguucuuuccaaa

SEQ ID NO: 1635926 - RNA, 14 nt, Human
ugaggucuguucuu

SEQ ID NO: 1635927 - RNA, 15 nt, Human
ugaggucuguucuuu

SEQ ID NO: 1635928 - RNA, 11 nt, Human
ugaggcugggc

SEQ ID NO: 1635929 - RNA, 23 nt, Human
ugaggacuuaaaauauuccugca

SEQ ID NO: 1635930 - RNA, 21 nt, Human
ugauagcacagacccugcccu

SEQ ID NO: 1635931 - RNA, 20 nt, Human
ugauagcacagacccugccc

SEQ ID NO: 1635932 - RNA, 18 nt, Human
ugauagcacagacccugc

SEQ ID NO: 1635933 - RNA, 17 nt, Human
ugauagcacagacccug

SEQ ID NO: 1635934 - RNA, 16 nt, Human
ugauagcacagacccu

SEQ ID NO: 1635935 - RNA, 15 nt, Human
ugauagcacagaccc

SEQ ID NO: 1635936 - RNA, 23 nt, Human
ugauagcacagacccugcccugu

SEQ ID NO: 1635937 - RNA, 22 nt, Human
ugauagcacagacccugcccug

SEQ ID NO: 1635938 - RNA, 18 nt, Human
ugauagguauaaguggug

SEQ ID NO: 1635939 - RNA, 18 nt, Human
ugagucgaggacagggag

SEQ ID NO: 1635940 - RNA, 19 nt, Human
ugaguugauucagcucugc

SEQ ID NO: 1635941 - RNA, 16 nt, Human
ugaguugauucagcuc

SEQ ID NO: 1635942 - RNA, 23 nt, Human
ugaguugauagcacagacccugc

SEQ ID NO: 1635943 - RNA, 16 nt, Human
ugagucgaggacaggg

SEQ ID NO: 1635944 - RNA, 15 nt, Human
ugagucgaggacagg

SEQ ID NO: 1635945 - RNA, 12 nt, Human
ugacucuuaaga

SEQ ID NO: 1635946 - RNA, 13 nt, Human
ugacugaauuucu

SEQ ID NO: 1635947 - RNA, 13 nt, Human
ugacucuuaagaa

SEQ ID NO: 1635948 - RNA, 14 nt, Human
ugacugaauuucuu

SEQ ID NO: 1635949 - RNA, 15 nt, Human
ugacugaauuucuuu

SEQ ID NO: 1635950 - RNA, 17 nt, Human
ugacugauucuucagca

SEQ ID NO: 1635951 - RNA, 16 nt, Human
ugacugauucuucagc

SEQ ID NO: 1635952 - RNA, 15 nt, Human
ugacugauucuucag

SEQ ID NO: 1635953 - RNA, 14 nt, Human
ugacugauucuuca

SEQ ID NO: 1635954 - RNA, 13 nt, Human
ugacugauucuuc

SEQ ID NO: 1635955 - RNA, 20 nt, Human
ugacgccaucccagccccaa

SEQ ID NO: 1635956 - RNA, 19 nt, Human
ugacgccaucccagcccca

SEQ ID NO: 1635957 - RNA, 18 nt, Human
ugacgccaucccagcccc

SEQ ID NO: 1635958 - RNA, 17 nt, Human
ugacgccaucccagccc

SEQ ID NO: 1635959 - RNA, 16 nt, Human
ugacgccaucccagcc

SEQ ID NO: 1635960 - RNA, 15 nt, Human
ugacgccaucccagc

SEQ ID NO: 1635961 - RNA, 14 nt, Human
ugacgccaucccag

SEQ ID NO: 1635962 - RNA, 13 nt, Human
ugacgccauccca

SEQ ID NO: 1635963 - RNA, 22 nt, Human
ugaccuuucaauaggaaaaacu

SEQ ID NO: 1635964 - RNA, 18 nt, Human
ugaccuuucaauaggaaa

SEQ ID NO: 1635965 - RNA, 16 nt, Human
ugaccuuucaauagga

SEQ ID NO: 1635966 - RNA, 15 nt, Human
ugaccuuucaauagg

SEQ ID NO: 1635967 - RNA, 14 nt, Human
ugaccuuucaauag

SEQ ID NO: 1635968 - RNA, 18 nt, Human
ugaccucugcagcaauaa

SEQ ID NO: 1635969 - RNA, 21 nt, Human
ugaccucugcagcaauaaagc

SEQ ID NO: 1635970 - RNA, 12 nt, Human
ugaccucugccu

SEQ ID NO: 1635971 - RNA, 23 nt, Human
ugaccucugcagcaauaaagcag

SEQ ID NO: 1635972 - RNA, 22 nt, Human
ugaccucaggugauccacccac

SEQ ID NO: 1635973 - RNA, 16 nt, Human
ugaccucagcuuugau

SEQ ID NO: 1635974 - RNA, 13 nt, Human
ugaccucugcagc

SEQ ID NO: 1635975 - RNA, 16 nt, Human
ugaccucugcagcaau

SEQ ID NO: 1635976 - RNA, 23 nt, Human
ugaccauucuccaccugccaggg

SEQ ID NO: 1635977 - RNA, 22 nt, Human
ugaccauucuccaccugccagg

SEQ ID NO: 1635978 - RNA, 21 nt, Human
ugaccauucuccaccugccag

SEQ ID NO: 1635979 - RNA, 20 nt, Human
ugaccauucuccaccugcca

SEQ ID NO: 1635980 - RNA, 17 nt, Human
ucuugaauuguaaggaa

SEQ ID NO: 1635981 - RNA, 15 nt, Human
ucuugaacuccuggc

SEQ ID NO: 1635982 - RNA, 16 nt, Human
ucuugaauaauguaag

SEQ ID NO: 1635983 - RNA, 16 nt, Human
ugagacagcucugcau

SEQ ID NO: 1635984 - RNA, 14 nt, Human
ugagacagcucugc

SEQ ID NO: 1635985 - RNA, 12 nt, Human
ugagacccuguc

SEQ ID NO: 1635986 - RNA, 17 nt, Human
ugagaaagacuauucaa

SEQ ID NO: 1635987 - RNA, 16 nt, Human
ugagaaagacuauuca

SEQ ID NO: 1635988 - RNA, 22 nt, Human
ugacuguacuccucccaggcgc

SEQ ID NO: 1635989 - RNA, 18 nt, Human
ugacuguacuccucccag

SEQ ID NO: 1635990 - RNA, 17 nt, Human
ugacuguacuccuccca

SEQ ID NO: 1635991 - RNA, 16 nt, Human
ugacuguacuccuccc

SEQ ID NO: 1635992 - RNA, 18 nt, Human
ugagaaagacuauucaaa

SEQ ID NO: 1635993 - RNA, 20 nt, Human
ugagaaagacuauucaaaca

SEQ ID NO: 1635994 - RNA, 13 nt, Human
ugagaaaucuaaa

SEQ ID NO: 1635995 - RNA, 17 nt, Human
ugagaaaucuaaaaaac

SEQ ID NO: 1635996 - RNA, 17 nt, Human
ugagaguagagucacug

SEQ ID NO: 1635997 - RNA, 22 nt, Human
ugagaggcauccaguaucuuga

SEQ ID NO: 1635998 - RNA, 23 nt, Human
ugagaggcauccaguaucuugaa

SEQ ID NO: 1635999 - RNA, 14 nt, Human
ugagacucugucuc

SEQ ID NO: 1636000 - RNA, 13 nt, Human
ugagacucugucu

SEQ ID NO: 1636001 - RNA, 12 nt, Human
ugagacucuguc

SEQ ID NO: 1636002 - RNA, 13 nt, Human
ugagccccaaaag

SEQ ID NO: 1636003 - RNA, 15 nt, Human
ugagcaucaggccag

SEQ ID NO: 1636004 - RNA, 14 nt, Human
ugagcaucaggcca

SEQ ID NO: 1636005 - RNA, 16 nt, Human
ugagcaucaggccagg

SEQ ID NO: 1636006 - RNA, 20 nt, Human
ugagaugcuagaacucccuu

SEQ ID NO: 1636007 - RNA, 16 nt, Human
ugagaugcuagaacuc

SEQ ID NO: 1636008 - RNA, 14 nt, Human
ugagaugcuagaac

SEQ ID NO: 1636009 - RNA, 20 nt, Human
ugagcagucaggaaagagaa

SEQ ID NO: 1636010 - RNA, 13 nt, Human
ugagcaucaggcc

SEQ ID NO: 1636011 - RNA, 15 nt, Human
ugagcagucaggaaa

SEQ ID NO: 1636012 - RNA, 17 nt, Human
ugagcagucaggaaaga

SEQ ID NO: 1636013 - RNA, 15 nt, Human
ugagccucagcaucc

SEQ ID NO: 1636014 - RNA, 13 nt, Human
ugagccucagcau

SEQ ID NO: 1636015 - RNA, 16 nt, Human
ugcacaaacagaggcc

SEQ ID NO: 1636016 - RNA, 15 nt, Human
ugcacaaacagaggc

SEQ ID NO: 1636017 - RNA, 19 nt, Human
ugcacaaacagaggccgcc

SEQ ID NO: 1636018 - RNA, 17 nt, Human
ugcacaaacagaggccg

SEQ ID NO: 1636019 - RNA, 20 nt, Human
ugcacaaacagaggccgcca

SEQ ID NO: 1636020 - RNA, 17 nt, Human
ugcacagaguuguuaca

SEQ ID NO: 1636021 - RNA, 17 nt, Human
ugcacaaagcccuucca

SEQ ID NO: 1636022 - RNA, 15 nt, Human
ugcacaaagcccuuc

SEQ ID NO: 1636023 - RNA, 18 nt, Human
ugcacagaguuguuacau

SEQ ID NO: 1636024 - RNA, 19 nt, Human
ugcacagaguuguuacauu

SEQ ID NO: 1636025 - RNA, 23 nt, Human
ugcaaugaccuuucaauaggaaa

SEQ ID NO: 1636026 - RNA, 22 nt, Human
ugcaaugaccuuucaauaggaa

SEQ ID NO: 1636027 - RNA, 19 nt, Human
ugcaaugaccuuucaauag

SEQ ID NO: 1636028 - RNA, 17 nt, Human
ugcaaugaccuuucaau

SEQ ID NO: 1636029 - RNA, 16 nt, Human
ugcaaugaccuuucaa

SEQ ID NO: 1636030 - RNA, 13 nt, Human
ugcaaugaccuuu

SEQ ID NO: 1636031 - RNA, 16 nt, Human
ugcaauggcagccuug

SEQ ID NO: 1636032 - RNA, 15 nt, Human
ugcaauggcagccuu

SEQ ID NO: 1636033 - RNA, 14 nt, Human
ugcaauggcagccu

SEQ ID NO: 1636034 - RNA, 13 nt, Human
ugcaauggcagcc

SEQ ID NO: 1636035 - RNA, 16 nt, Human
ugcacuugcagacucu

SEQ ID NO: 1636036 - RNA, 19 nt, Human
ugcagagguccacaacaca

SEQ ID NO: 1636037 - RNA, 21 nt, Human
ugcacugacauuguuggccaa

SEQ ID NO: 1636038 - RNA, 18 nt, Human
ugcacugacauuguuggc

SEQ ID NO: 1636039 - RNA, 21 nt, Human
ugcaccggcuggccuggcccc

SEQ ID NO: 1636040 - RNA, 17 nt, Human
ugcaccuggaauauaua

SEQ ID NO: 1636041 - RNA, 20 nt, Human
ugcaccuggaauauauaacc

SEQ ID NO: 1636042 - RNA, 22 nt, Human
ugcaccuggaauauauaaccag

SEQ ID NO: 1636043 - RNA, 20 nt, Human
ugcaccggcuggccuggccc

SEQ ID NO: 1636044 - RNA, 19 nt, Human
ugcaccggcuggccuggcc

SEQ ID NO: 1636045 - RNA, 17 nt, Human
ugcacagugcaucucag

SEQ ID NO: 1636046 - RNA, 16 nt, Human
ugcacagugcaucuca

SEQ ID NO: 1636047 - RNA, 20 nt, Human
ugcacagaguuguuacauuu

SEQ ID NO: 1636048 - RNA, 15 nt, Human
ugcacagugcaucuc

SEQ ID NO: 1636049 - RNA, 17 nt, Human
ugcaacaggcugggcuu

SEQ ID NO: 1636050 - RNA, 16 nt, Human
ugcaacaggcugggcu

SEQ ID NO: 1636051 - RNA, 15 nt, Human
ugcaacaggcugggc

SEQ ID NO: 1636052 - RNA, 14 nt, Human
ugcaacaggcuggg

SEQ ID NO: 1636053 - RNA, 20 nt, Human
ugcaacaggcugggcuucag

SEQ ID NO: 1636054 - RNA, 19 nt, Human
ugcaacaggcugggcuuca

SEQ ID NO: 1636055 - RNA, 14 nt, Human
ugcaaccuccgccu

SEQ ID NO: 1636056 - RNA, 13 nt, Human
ugcaaccuccgcc

SEQ ID NO: 1636057 - RNA, 21 nt, Human
ugcaaccuccgccucuugggu

SEQ ID NO: 1636058 - RNA, 20 nt, Human
ugcaaccuccgccucuuggg

SEQ ID NO: 1636059 - RNA, 18 nt, Human
ugcaaccuccgccucuug

SEQ ID NO: 1636060 - RNA, 20 nt, Human
ugcaaccugauugugucucu

SEQ ID NO: 1636061 - RNA, 19 nt, Human
ugcaaccugauugugucuc

SEQ ID NO: 1636062 - RNA, 22 nt, Human
ugcaaccugauugugucucuug

SEQ ID NO: 1636063 - RNA, 21 nt, Human
ugcaaccuucgccaccugggu

SEQ ID NO: 1636064 - RNA, 18 nt, Human
ugcaaccuucgccaccug

SEQ ID NO: 1636065 - RNA, 22 nt, Human
ugcaacucugaaggguaauuau

SEQ ID NO: 1636066 - RNA, 18 nt, Human
ugcaacuuuguauaaaag

SEQ ID NO: 1636067 - RNA, 18 nt, Human
ugcaacuuguaaaugugg

SEQ ID NO: 1636068 - RNA, 16 nt, Human
ugcaacuuguaaaugu

SEQ ID NO: 1636069 - RNA, 13 nt, Human
ugauuuucauugc

SEQ ID NO: 1636070 - RNA, 15 nt, Human
ugauuuucauugcug

SEQ ID NO: 1636071 - RNA, 20 nt, Human
ugauuuuuuuuuccuucagu

SEQ ID NO: 1636072 - RNA, 19 nt, Human
ugauuuuuuuuuccuucag

SEQ ID NO: 1636073 - RNA, 17 nt, Human
ugauuuuuuuuuccuuc

SEQ ID NO: 1636074 - RNA, 16 nt, Human
ugauuuuuuuuuccuu

SEQ ID NO: 1636075 - RNA, 23 nt, Human
ugauuuuuuuuuccuucagugcc

SEQ ID NO: 1636076 - RNA, 22 nt, Human
ugauuuuuuuuuccuucagugc

SEQ ID NO: 1636077 - RNA, 16 nt, Human
ugauuuuuuuuuuuca

SEQ ID NO: 1636078 - RNA, 14 nt, Human
ugcauuauauuuau

SEQ ID NO: 1636079 - RNA, 12 nt, Human
ugcauuaucuag

SEQ ID NO: 1636080 - RNA, 17 nt, Human
ugcauuaucuagauacu

SEQ ID NO: 1636081 - RNA, 18 nt, Human
ugcauuaucuagauacug

SEQ ID NO: 1636082 - RNA, 15 nt, Human
ugccaccacgcccgg

SEQ ID NO: 1636083 - RNA, 19 nt, Human
ugcagauaaacaguaguga

SEQ ID NO: 1636084 - RNA, 14 nt, Human
ugcauccuccgccu

SEQ ID NO: 1636085 - RNA, 15 nt, Human
ugcauguuugugauu

SEQ ID NO: 1636086 - RNA, 15 nt, Human
ugcauccuccgccuc

SEQ ID NO: 1636087 - RNA, 12 nt, Human
ugccauccaggu

SEQ ID NO: 1636088 - RNA, 20 nt, Human
ugccauccagguucagcuug

SEQ ID NO: 1636089 - RNA, 15 nt, Human
ugccauccagguuca

SEQ ID NO: 1636090 - RNA, 17 nt, Human
ugccagguuuuuggucu

SEQ ID NO: 1636091 - RNA, 19 nt, Human
ugccaggaagccagcaggc

SEQ ID NO: 1636092 - RNA, 18 nt, Human
ugccaggaagccagcagg

SEQ ID NO: 1636093 - RNA, 16 nt, Human
ugccaggaagccagca

SEQ ID NO: 1636094 - RNA, 12 nt, Human
ugccaggaagcc

SEQ ID NO: 1636095 - RNA, 20 nt, Human
ugcccaccuggccucugcac

SEQ ID NO: 1636096 - RNA, 16 nt, Human
ugccauguuggccagg

SEQ ID NO: 1636097 - RNA, 15 nt, Human
ugccauguuggccag

SEQ ID NO: 1636098 - RNA, 12 nt, Human
ugccauguuggc

SEQ ID NO: 1636099 - RNA, 13 nt, Human
ugcccacucccug

SEQ ID NO: 1636100 - RNA, 18 nt, Human
ugcccacgcuggagugca

SEQ ID NO: 1636101 - RNA, 20 nt, Human
ugccaugaggaacaaggcaa

SEQ ID NO: 1636102 - RNA, 23 nt, Human
ugccaugaggaacaaggcaaggc

SEQ ID NO: 1636103 - RNA, 15 nt, Human
ugccaugugccaggu

SEQ ID NO: 1636104 - RNA, 14 nt, Human
ugccaugugccagg

SEQ ID NO: 1636105 - RNA, 19 nt, Human
ugccgucuaccugaggggc

SEQ ID NO: 1636106 - RNA, 17 nt, Human
ugccgucuaccugaggg

SEQ ID NO: 1636107 - RNA, 16 nt, Human
ugccgucuaccugagg

SEQ ID NO: 1636108 - RNA, 15 nt, Human
ugccgucuaccugag

SEQ ID NO: 1636109 - RNA, 15 nt, Human
ugcccugguuuccug

SEQ ID NO: 1636110 - RNA, 18 nt, Human
ugcccuggauccaucagg

SEQ ID NO: 1636111 - RNA, 17 nt, Human
ugcccugcuuucagaua

SEQ ID NO: 1636112 - RNA, 16 nt, Human
ugcccugcuuucagau

SEQ ID NO: 1636113 - RNA, 12 nt, Human
ugcccugcuuuc

SEQ ID NO: 1636114 - RNA, 18 nt, Human
ugcccuggugcugccaca

SEQ ID NO: 1636115 - RNA, 20 nt, Human
ugcccuggugcugccacacu

SEQ ID NO: 1636116 - RNA, 21 nt, Human
ugcccuggugcugccacacuu

SEQ ID NO: 1636117 - RNA, 23 nt, Human
ugcccugcccaccuggccucugc

SEQ ID NO: 1636118 - RNA, 22 nt, Human
ugcccugcccaccuggccucug

SEQ ID NO: 1636119 - RNA, 17 nt, Human
ugcccuaaaguguauuu

SEQ ID NO: 1636120 - RNA, 19 nt, Human
ugcccuaaaguguauuuuu

SEQ ID NO: 1636121 - RNA, 23 nt, Human
ugcccugcugagucccaggcuga

SEQ ID NO: 1636122 - RNA, 22 nt, Human
ugcccugcugagucccaggcug

SEQ ID NO: 1636123 - RNA, 18 nt, Human
ugcccugcugagucccag

SEQ ID NO: 1636124 - RNA, 19 nt, Human
ugcccugcgggucacagga

SEQ ID NO: 1636125 - RNA, 13 nt, Human
ugccucugggacu

SEQ ID NO: 1636126 - RNA, 14 nt, Human
ugccucugggacug

SEQ ID NO: 1636127 - RNA, 18 nt, Human
ugccucugccugucuccc

SEQ ID NO: 1636128 - RNA, 14 nt, Human
ugccucugccuguc

SEQ ID NO: 1636129 - RNA, 13 nt, Human
ugccucugccugu

SEQ ID NO: 1636130 - RNA, 20 nt, Human
ugccuccuuugugaggaagc

SEQ ID NO: 1636131 - RNA, 21 nt, Human
ugccuccuuugugaggaagcc

SEQ ID NO: 1636132 - RNA, 22 nt, Human
ugccuccuuugugaggaagccg

SEQ ID NO: 1636133 - RNA, 21 nt, Human
ugccuaaggacuucuuuaauu

SEQ ID NO: 1636134 - RNA, 13 nt, Human
ugccuaaggacuu

SEQ ID NO: 1636135 - RNA, 12 nt, Human
ugccuaaggacu

SEQ ID NO: 1636136 - RNA, 20 nt, Human
ugccuaaggacuucuuuaau

SEQ ID NO: 1636137 - RNA, 16 nt, Human
ugccuaaggacuucuu

SEQ ID NO: 1636138 - RNA, 15 nt, Human
ugccuaaggacuucu

SEQ ID NO: 1636139 - RNA, 14 nt, Human
ugccuaaggacuuc

SEQ ID NO: 1636140 - RNA, 19 nt, Human
ugccugguggcagcugcgg

SEQ ID NO: 1636141 - RNA, 18 nt, Human
ugccugguggcagcugcg

SEQ ID NO: 1636142 - RNA, 17 nt, Human
ugccugguggcagcugc

SEQ ID NO: 1636143 - RNA, 13 nt, Human
ugccugcccaggc

SEQ ID NO: 1636144 - RNA, 21 nt, Human
ugccucuucucuacucuaggg

SEQ ID NO: 1636145 - RNA, 13 nt, Human
ugccucuuccucc

SEQ ID NO: 1636146 - RNA, 16 nt, Human
uuuucacauuggaaac

SEQ ID NO: 1636147 - RNA, 21 nt, Human
uuuucaaaauuguuacaaauu

SEQ ID NO: 1636148 - RNA, 22 nt, Human
uuuucccuauuagagaagagau

SEQ ID NO: 1636149 - RNA, 18 nt, Human
uuuucccuauuagagaag

SEQ ID NO: 1636150 - RNA, 13 nt, Human
uuuucuuauuuca

SEQ ID NO: 1636151 - RNA, 23 nt, Human
uuuucuacucgaguuacagacaa

SEQ ID NO: 1636152 - RNA, 22 nt, Human
uuuucuacucgaguuacagaca

SEQ ID NO: 1636153 - RNA, 20 nt, Human
uuuucuacucgaguuacaga

SEQ ID NO: 1636154 - RNA, 13 nt, Human
uuuucuacucgag

SEQ ID NO: 1636155 - RNA, 13 nt, Human
uuuucuucucccu

SEQ ID NO: 1636156 - RNA, 22 nt, Human
uuuucuuguguguuuauuguca

SEQ ID NO: 1636157 - RNA, 14 nt, Human
uuuucuucucccuc

SEQ ID NO: 1636158 - RNA, 16 nt, Human
uuuucuuucagccaag

SEQ ID NO: 1636159 - RNA, 21 nt, Human
uuuuauaauuuugugaagcaa

SEQ ID NO: 1636160 - RNA, 15 nt, Human
uuuuacuaauagaca

SEQ ID NO: 1636161 - RNA, 23 nt, Human
uuuuauaauuuugugaagcaaaa

SEQ ID NO: 1636162 - RNA, 19 nt, Human
uuuuacguccaucucuugu

SEQ ID NO: 1636163 - RNA, 21 nt, Human
uuuuaaaguaacccuacaaaa

SEQ ID NO: 1636164 - RNA, 17 nt, Human
uuuuacaauaaaaucuu

SEQ ID NO: 1636165 - RNA, 19 nt, Human
uuuuacaaaaaagaaaaga

SEQ ID NO: 1636166 - RNA, 18 nt, Human
uuuuauauuugaaauauu

SEQ ID NO: 1636167 - RNA, 13 nt, Human
uuuuauauuugaa

SEQ ID NO: 1636168 - RNA, 13 nt, Human
uuuuauauuuacu

SEQ ID NO: 1636169 - RNA, 13 nt, Human
uuuuauacauaaa

SEQ ID NO: 1636170 - RNA, 21 nt, Human
uuuuauacauaaacaagacca

SEQ ID NO: 1636171 - RNA, 18 nt, Human
uuuuauuuuuagacagag

SEQ ID NO: 1636172 - RNA, 17 nt, Human
uuuucaaaauaaaaaug

SEQ ID NO: 1636173 - RNA, 21 nt, Human
uuugagugccuuacacaaugg

SEQ ID NO: 1636174 - RNA, 15 nt, Human
uuuccacagaagcuc

SEQ ID NO: 1636175 - RNA, 15 nt, Human
uuuccguuaaaauac

SEQ ID NO: 1636176 - RNA, 17 nt, Human
uuuccguuaaaauacca

SEQ ID NO: 1636177 - RNA, 13 nt, Human
uuuggacccugag

SEQ ID NO: 1636178 - RNA, 22 nt, Human
uuuggaccaaaaaccaguauug

SEQ ID NO: 1636179 - RNA, 21 nt, Human
uuuggaccaaaaaccaguauu

SEQ ID NO: 1636180 - RNA, 18 nt, Human
uuuggaccaaaaaccagu

SEQ ID NO: 1636181 - RNA, 15 nt, Human
uuuggaaaucuuuaa

SEQ ID NO: 1636182 - RNA, 18 nt, Human
uuugcauaacguauaaaa

SEQ ID NO: 1636183 - RNA, 17 nt, Human
uuuguauaaaauaauuu

SEQ ID NO: 1636184 - RNA, 17 nt, Human
uuuggucuacacugugc

SEQ ID NO: 1636185 - RNA, 19 nt, Human
uuuguauaaaauaauuuuu

SEQ ID NO: 1636186 - RNA, 18 nt, Human
uuuguauaaaauaauuuu

SEQ ID NO: 1636187 - RNA, 15 nt, Human
uuuggucaacacuaa

SEQ ID NO: 1636188 - RNA, 24 nt, Human
uuuggaccaaaaaccaguauugua

SEQ ID NO: 1636189 - RNA, 14 nt, Human
uuuguauuuuuagu

SEQ ID NO: 1636190 - RNA, 22 nt, Human
uuuguuaguaugaggcauuugu

SEQ ID NO: 1636191 - RNA, 15 nt, Human
uuuguugucagcuga

SEQ ID NO: 1636192 - RNA, 16 nt, Human
uuuguugucagcugaa

SEQ ID NO: 1636193 - RNA, 14 nt, Human
uuuuaaaauccacu

SEQ ID NO: 1636194 - RNA, 23 nt, Human
uuuuaaaauccacuuuaucuuga

SEQ ID NO: 1636195 - RNA, 20 nt, Human
uuuuaaacccuauugguaaa

SEQ ID NO: 1636196 - RNA, 12 nt, Human
uuuuuaagaaaa

SEQ ID NO: 1636197 - RNA, 23 nt, Human
uuuuuaagaaaaaggaugcacag

SEQ ID NO: 1636198 - RNA, 16 nt, Human
uuuuuaagugcugcau

SEQ ID NO: 1636199 - RNA, 17 nt, Human
uuuuuaagugcugcauu

SEQ ID NO: 1636200 - RNA, 18 nt, Human
uuuuuaagugcugcauuu

SEQ ID NO: 1636201 - RNA, 19 nt, Human
uuuuuaagugcugcauuua

SEQ ID NO: 1636202 - RNA, 22 nt, Human
uuuuuaagugcugcauuuaaaa

SEQ ID NO: 1636203 - RNA, 23 nt, Human
uuuuuaagugcugcauuuaaaag

SEQ ID NO: 1636204 - RNA, 22 nt, Human
uuuuucauuauuuuauuaugaa

SEQ ID NO: 1636205 - RNA, 13 nt, Human
uuuuucauuauuu

SEQ ID NO: 1636206 - RNA, 13 nt, Human
uuuuuaaucuuua

SEQ ID NO: 1636207 - RNA, 11 nt, Human
uuuuuuuacua

SEQ ID NO: 1636208 - RNA, 17 nt, Human
uuuuuuccuucagugcc

SEQ ID NO: 1636209 - RNA, 13 nt, Human
uuuuuuccacuua

SEQ ID NO: 1636210 - RNA, 12 nt, Human
uuuuuuuuaaga

SEQ ID NO: 1636211 - RNA, 13 nt, Human
uuuuuuuugacaa

SEQ ID NO: 1636212 - RNA, 20 nt, Human
uuguguugaagagguuuuaa

SEQ ID NO: 1636213 - RNA, 21 nt, Human
uuguguuuauauauaagccaa

SEQ ID NO: 1636214 - RNA, 22 nt, Human
uuguggauuuaacagaaaugua

SEQ ID NO: 1636215 - RNA, 23 nt, Human
uuguggauuuaacagaaauguac

SEQ ID NO: 1636216 - RNA, 20 nt, Human
uuguggauuuaacagaaaug

SEQ ID NO: 1636217 - RNA, 21 nt, Human
uuguggauuuaacagaaaugu

SEQ ID NO: 1636218 - RNA, 16 nt, Human
uuguggacacagcucu

SEQ ID NO: 1636219 - RNA, 21 nt, Human
uuguggaaaaugaaaauuagg

SEQ ID NO: 1636220 - RNA, 17 nt, Human
uuguggacacagcucuu

SEQ ID NO: 1636221 - RNA, 12 nt, Human
uugugccccugc

SEQ ID NO: 1636222 - RNA, 21 nt, Human
uugugccagaaugcuuuagga

SEQ ID NO: 1636223 - RNA, 16 nt, Human
uugugccagaaugcuu

SEQ ID NO: 1636224 - RNA, 23 nt, Human
uugugcgcuaaacuuuucugaua

SEQ ID NO: 1636225 - RNA, 22 nt, Human
uugugcgcuaaacuuuucugau

SEQ ID NO: 1636226 - RNA, 19 nt, Human
uugugcugggguuaucuga

SEQ ID NO: 1636227 - RNA, 17 nt, Human
uugugcauuaucuagau

SEQ ID NO: 1636228 - RNA, 22 nt, Human
uugugcauuaucuagauacugu

SEQ ID NO: 1636229 - RNA, 23 nt, Human
uugugcauuaucuagauacugua

SEQ ID NO: 1636230 - RNA, 12 nt, Human
uugugcauuugg

SEQ ID NO: 1636231 - RNA, 14 nt, Human
uuguuuaaaaucau

SEQ ID NO: 1636232 - RNA, 20 nt, Human
uuguuagugugucuuagugu

SEQ ID NO: 1636233 - RNA, 22 nt, Human
uuguuaguaugaggcauuuguu

SEQ ID NO: 1636234 - RNA, 17 nt, Human
uuguuguuuguuuaguc

SEQ ID NO: 1636235 - RNA, 18 nt, Human
uuguguuuugcaagccag

SEQ ID NO: 1636236 - RNA, 19 nt, Human
uuguuaguaugaggcauuu

SEQ ID NO: 1636237 - RNA, 21 nt, Human
uuguuaguaugaggcauuugu

SEQ ID NO: 1636238 - RNA, 17 nt, Human
uuguuagaucuaguuca

SEQ ID NO: 1636239 - RNA, 14 nt, Human
uuguuacauuuuua

SEQ ID NO: 1636240 - RNA, 14 nt, Human
uuguacucaauuuu

SEQ ID NO: 1636241 - RNA, 15 nt, Human
uuguacucaauuuua

SEQ ID NO: 1636242 - RNA, 14 nt, Human
uuguauuacaaauc

SEQ ID NO: 1636243 - RNA, 21 nt, Human
uuguauucagaguugaugguu

SEQ ID NO: 1636244 - RNA, 15 nt, Human
uuguauucucuccug

SEQ ID NO: 1636245 - RNA, 16 nt, Human
uuguauucucuccugu

SEQ ID NO: 1636246 - RNA, 19 nt, Human
uuguauucucuccuguacc

SEQ ID NO: 1636247 - RNA, 19 nt, Human
uugucuacaccauuaugug

SEQ ID NO: 1636248 - RNA, 15 nt, Human
uugucuagugaaacu

SEQ ID NO: 1636249 - RNA, 20 nt, Human
uugucuacaccauuaugugc

SEQ ID NO: 1636250 - RNA, 13 nt, Human
uugucucagauuu

SEQ ID NO: 1636251 - RNA, 20 nt, Human
uugucucagauuuuauuaug

SEQ ID NO: 1636252 - RNA, 16 nt, Human
uugucucagauuuuau

SEQ ID NO: 1636253 - RNA, 15 nt, Human
uugucuuaaaaagug

SEQ ID NO: 1636254 - RNA, 21 nt, Human
uugucugaagucacugcacag

SEQ ID NO: 1636255 - RNA, 22 nt, Human
uugucucagauuuuauuaugua

SEQ ID NO: 1636256 - RNA, 22 nt, Human
uugucuuaaaaaguggaaaaau

SEQ ID NO: 1636257 - RNA, 20 nt, Human
uugugaaaggaaagaggcuc

SEQ ID NO: 1636258 - RNA, 16 nt, Human
uugugauuuuuguaau

SEQ ID NO: 1636259 - RNA, 17 nt, Human
uugugauuuuuguaauu

SEQ ID NO: 1636260 - RNA, 12 nt, Human
uugugauuuuug

SEQ ID NO: 1636261 - RNA, 13 nt, Human
uugugaaauuauu

SEQ ID NO: 1636262 - RNA, 14 nt, Human
uugugaaaugaugg

SEQ ID NO: 1636263 - RNA, 17 nt, Human
uuguaaauagcucaggu

SEQ ID NO: 1636264 - RNA, 21 nt, Human
uuguaaaugugguaaagaguu

SEQ ID NO: 1636265 - RNA, 16 nt, Human
uuguaaaugugguaaa

SEQ ID NO: 1636266 - RNA, 15 nt, Human
uuguaaauuaacuuu

SEQ ID NO: 1636267 - RNA, 16 nt, Human
uuguaaauuaacuuuu

SEQ ID NO: 1636268 - RNA, 18 nt, Human
uuguaaauuaacuuuuau

SEQ ID NO: 1636269 - RNA, 23 nt, Human
uuguaaauuaacuuuuauaaacu

SEQ ID NO: 1636270 - RNA, 18 nt, Human
uuguacauaaugcgugca

SEQ ID NO: 1636271 - RNA, 16 nt, Human
uuggucugugagaugc

SEQ ID NO: 1636272 - RNA, 13 nt, Human
uuggucuguguga

SEQ ID NO: 1636273 - RNA, 16 nt, Human
uuggucccccuuccau

SEQ ID NO: 1636274 - RNA, 22 nt, Human
uuggguucaagcgauucuucug

SEQ ID NO: 1636275 - RNA, 16 nt, Human
uuggguguauugugcg

SEQ ID NO: 1636276 - RNA, 15 nt, Human
uuggguguauugugc

SEQ ID NO: 1636277 - RNA, 13 nt, Human
uuggguguauugu

SEQ ID NO: 1636278 - RNA, 13 nt, Human
uuuaauaauguuu

SEQ ID NO: 1636279 - RNA, 20 nt, Human
uuuaagacgaaacauuuguu

SEQ ID NO: 1636280 - RNA, 22 nt, Human
uuuaagaaaaaggaugcacaga

SEQ ID NO: 1636281 - RNA, 19 nt, Human
uuuaagacauuuuuggaag

SEQ ID NO: 1636282 - RNA, 18 nt, Human
uuuaagaaaaaggaugca

SEQ ID NO: 1636283 - RNA, 19 nt, Human
uuuaacucuauaauguguu

SEQ ID NO: 1636284 - RNA, 18 nt, Human
uuuaacagaaauguacag

SEQ ID NO: 1636285 - RNA, 18 nt, Human
uuguuuggagacagaguc

SEQ ID NO: 1636286 - RNA, 21 nt, Human
uuguuuggaccaaaaaccagu

SEQ ID NO: 1636287 - RNA, 23 nt, Human
uuuaacaacuaugauuuggaaaa

SEQ ID NO: 1636288 - RNA, 16 nt, Human
uuuaacaacagcuggu

SEQ ID NO: 1636289 - RNA, 18 nt, Human
uuuaauaauuauaugcua

SEQ ID NO: 1636290 - RNA, 21 nt, Human
uuuaauaauuauaugcuauuu

SEQ ID NO: 1636291 - RNA, 21 nt, Human
uuuaauagguuuggacaaaau

SEQ ID NO: 1636292 - RNA, 13 nt, Human
uuuaccacuugug

SEQ ID NO: 1636293 - RNA, 16 nt, Human
uuuacagcugccugca

SEQ ID NO: 1636294 - RNA, 15 nt, Human
uuuacagcugccugc

SEQ ID NO: 1636295 - RNA, 22 nt, Human
uuuacuucuuauacauuugaua

SEQ ID NO: 1636296 - RNA, 19 nt, Human
uuuacuucuuauacauuug

SEQ ID NO: 1636297 - RNA, 14 nt, Human
uuuagaaauauaau

SEQ ID NO: 1636298 - RNA, 12 nt, Human
uuuagacagagu

SEQ ID NO: 1636299 - RNA, 23 nt, Human
uuuauaaaaauaaaaaacacugg

SEQ ID NO: 1636300 - RNA, 21 nt, Human
uuuauaaaaauaaaaaacacu

SEQ ID NO: 1636301 - RNA, 22 nt, Human
uuuauaauuuugugaagcaaaa

SEQ ID NO: 1636302 - RNA, 14 nt, Human
uuuauggcuuuugu

SEQ ID NO: 1636303 - RNA, 16 nt, Human
uuuauggcuuuugugc

SEQ ID NO: 1636304 - RNA, 20 nt, Human
uuuauggcuuuugugcauua

SEQ ID NO: 1636305 - RNA, 14 nt, Human
uuuauuauguaaau

SEQ ID NO: 1636306 - RNA, 17 nt, Human
uuuauuauguaaauccc

SEQ ID NO: 1636307 - RNA, 16 nt, Human
uuuauuauguaaaucc

SEQ ID NO: 1636308 - RNA, 13 nt, Human
uuuauuaugcaug

SEQ ID NO: 1636309 - RNA, 13 nt, Human
uuuauuauggcac

SEQ ID NO: 1636310 - RNA, 19 nt, Human
uuuauuuaguuccuugagu

SEQ ID NO: 1636311 - RNA, 21 nt, Human
uuucaacgcagcccugcuuug

SEQ ID NO: 1636312 - RNA, 20 nt, Human
uuucaacgcagcccugcuuu

SEQ ID NO: 1636313 - RNA, 16 nt, Human
uuucaacgcagcccug

SEQ ID NO: 1636314 - RNA, 15 nt, Human
uuucaacgcagcccu

SEQ ID NO: 1636315 - RNA, 19 nt, Human
uuucaauaggaaaaacuga

SEQ ID NO: 1636316 - RNA, 17 nt, Human
uuucaauaggaaaaacu

SEQ ID NO: 1636317 - RNA, 14 nt, Human
uuucaauaggaaaa

SEQ ID NO: 1636318 - RNA, 12 nt, Human
uuucaauaggaa

SEQ ID NO: 1636319 - RNA, 16 nt, Human
uuucacaaccuucugu

SEQ ID NO: 1636320 - RNA, 22 nt, Human
uuucacaaccuucuguggcuca

SEQ ID NO: 1636321 - RNA, 21 nt, Human
uuucagauacuggauuguacu

SEQ ID NO: 1636322 - RNA, 13 nt, Human
uuucagauacugg

SEQ ID NO: 1636323 - RNA, 14 nt, Human
uuucaguguacaug

SEQ ID NO: 1636324 - RNA, 13 nt, Human
uuucaguguacau

SEQ ID NO: 1636325 - RNA, 18 nt, Human
uuucauuuaggugaggaa

SEQ ID NO: 1636326 - RNA, 14 nt, Human
uuucauuuagguga

SEQ ID NO: 1636327 - RNA, 19 nt, Human
uucuacccagcgagcccug

SEQ ID NO: 1636328 - RNA, 12 nt, Human
uucuacccagcg

SEQ ID NO: 1636329 - RNA, 15 nt, Human
uucuacauacuaugg

SEQ ID NO: 1636330 - RNA, 23 nt, Human
uucuaaugugugaaucagagcac

SEQ ID NO: 1636331 - RNA, 13 nt, Human
uucuacgccaggg

SEQ ID NO: 1636332 - RNA, 13 nt, Human
uucuacuauuuau

SEQ ID NO: 1636333 - RNA, 21 nt, Human
uucuacccagcgagcccuggu

SEQ ID NO: 1636334 - RNA, 20 nt, Human
uucuacccagcgagcccugg

SEQ ID NO: 1636335 - RNA, 14 nt, Human
uucuacccaggugc

SEQ ID NO: 1636336 - RNA, 22 nt, Human
uucuacucgaguuacagacaaa

SEQ ID NO: 1636337 - RNA, 14 nt, Human
uucuauagcuuuuc

SEQ ID NO: 1636338 - RNA, 17 nt, Human
uuccuuggacucauuuu

SEQ ID NO: 1636339 - RNA, 18 nt, Human
uucggugagcuacaaaug

SEQ ID NO: 1636340 - RNA, 21 nt, Human
uuccuugaguugauucagcuc

SEQ ID NO: 1636341 - RNA, 15 nt, Human
uuccugcauuuguga

SEQ ID NO: 1636342 - RNA, 12 nt, Human
uuccauggccuc

SEQ ID NO: 1636343 - RNA, 16 nt, Human
uuccauggccucuuca

SEQ ID NO: 1636344 - RNA, 16 nt, Human
uuccaugucgccucug

SEQ ID NO: 1636345 - RNA, 15 nt, Human
uuccugaggcugggc

SEQ ID NO: 1636346 - RNA, 20 nt, Human
uuccugaggcugggcucccu

SEQ ID NO: 1636347 - RNA, 21 nt, Human
uucugagaaagacuauucaaa

SEQ ID NO: 1636348 - RNA, 16 nt, Human
uucugagaaagacuau

SEQ ID NO: 1636349 - RNA, 21 nt, Human
uucugacccugcuucaaauau

SEQ ID NO: 1636350 - RNA, 18 nt, Human
uucugacccugcuucaaa

SEQ ID NO: 1636351 - RNA, 22 nt, Human
uucugacccaugcugcccugug

SEQ ID NO: 1636352 - RNA, 23 nt, Human
uucugacccaugcugcccuguga

SEQ ID NO: 1636353 - RNA, 17 nt, Human
uucucugcccuccaaga

SEQ ID NO: 1636354 - RNA, 16 nt, Human
uucucugcccuccaag

SEQ ID NO: 1636355 - RNA, 21 nt, Human
uucugauagaggaagccugau

SEQ ID NO: 1636356 - RNA, 13 nt, Human
uucugauagagga

SEQ ID NO: 1636357 - RNA, 19 nt, Human
uucugauccuaguuccacc

SEQ ID NO: 1636358 - RNA, 19 nt, Human
uucugcucacauaucuguc

SEQ ID NO: 1636359 - RNA, 21 nt, Human
uucuaugaaauauuauguuaa

SEQ ID NO: 1636360 - RNA, 14 nt, Human
uucuaugaaauauu

SEQ ID NO: 1636361 - RNA, 20 nt, Human
uucucauuugccaauaauaa

SEQ ID NO: 1636362 - RNA, 15 nt, Human
uucuccaccugccag

SEQ ID NO: 1636363 - RNA, 14 nt, Human
uucuccaccugcca

SEQ ID NO: 1636364 - RNA, 12 nt, Human
uucuccaccugc

SEQ ID NO: 1636365 - RNA, 21 nt, Human
uucuccaccucccacaaagga

SEQ ID NO: 1636366 - RNA, 18 nt, Human
uucuccaccugccaggga

SEQ ID NO: 1636367 - RNA, 16 nt, Human
uucuccaccugccagg

SEQ ID NO: 1636368 - RNA, 20 nt, Human
uucuccaccugccagggaca

SEQ ID NO: 1636369 - RNA, 12 nt, Human
uucuccacugga

SEQ ID NO: 1636370 - RNA, 12 nt, Human
uucucugcccuc

SEQ ID NO: 1636371 - RNA, 11 nt, Human
uucucugcccu

SEQ ID NO: 1636372 - RNA, 20 nt, Human
uucucugaggacacuaacca

SEQ ID NO: 1636373 - RNA, 14 nt, Human
uucucugaggacac

SEQ ID NO: 1636374 - RNA, 22 nt, Human
uucucuccuguaccucuugagc

SEQ ID NO: 1636375 - RNA, 19 nt, Human
uucucuccuguaccucuug

SEQ ID NO: 1636376 - RNA, 16 nt, Human
uucucuccagccccug

SEQ ID NO: 1636377 - RNA, 15 nt, Human
uucucuccagccccu

SEQ ID NO: 1636378 - RNA, 14 nt, Human
uucucuccuguacc

SEQ ID NO: 1636379 - RNA, 18 nt, Human
uucucuccuguaccucuu

SEQ ID NO: 1636380 - RNA, 14 nt, Human
uucucuccagcccc

SEQ ID NO: 1636381 - RNA, 13 nt, Human
uucucuccagccc

SEQ ID NO: 1636382 - RNA, 21 nt, Human
uucuuauacauuugauaaagu

SEQ ID NO: 1636383 - RNA, 21 nt, Human
uucuuccacaagagcccaggc

SEQ ID NO: 1636384 - RNA, 21 nt, Human
uucuuguguguuuauugucaa

SEQ ID NO: 1636385 - RNA, 13 nt, Human
uucuuccucccuc

SEQ ID NO: 1636386 - RNA, 23 nt, Human
uucuuccucccucccucuuuccc

SEQ ID NO: 1636387 - RNA, 12 nt, Human
uucuuucagcca

SEQ ID NO: 1636388 - RNA, 14 nt, Human
uucuuuccaaagua

SEQ ID NO: 1636389 - RNA, 16 nt, Human
uugaaaagacuccaaa

SEQ ID NO: 1636390 - RNA, 16 nt, Human
uugaacuccuggccuc

SEQ ID NO: 1636391 - RNA, 15 nt, Human
uugaacuccuggccu

SEQ ID NO: 1636392 - RNA, 20 nt, Human
uugaaaaaccauuuugcugu

SEQ ID NO: 1636393 - RNA, 21 nt, Human
uucuuuccaaaguacacuguu

SEQ ID NO: 1636394 - RNA, 23 nt, Human
uugaaaacacuguucucugcccu

SEQ ID NO: 1636395 - RNA, 15 nt, Human
uugaaaaaugcaugu

SEQ ID NO: 1636396 - RNA, 19 nt, Human
uucugcuucagccucccga

SEQ ID NO: 1636397 - RNA, 16 nt, Human
uucugcuucagccucc

SEQ ID NO: 1636398 - RNA, 15 nt, Human
uucugcuucagccuc

SEQ ID NO: 1636399 - RNA, 14 nt, Human
uucugcuucagccu

SEQ ID NO: 1636400 - RNA, 18 nt, Human
uucugcuuuccucuuccu

SEQ ID NO: 1636401 - RNA, 17 nt, Human
uucugucuucacaacag

SEQ ID NO: 1636402 - RNA, 18 nt, Human
uucuguauuuuguuuuug

SEQ ID NO: 1636403 - RNA, 15 nt, Human
uucuggcagaggagg

SEQ ID NO: 1636404 - RNA, 23 nt, Human
uugaugaagaaguugauaugccu

SEQ ID NO: 1636405 - RNA, 14 nt, Human
uugaugaagaaguu

SEQ ID NO: 1636406 - RNA, 13 nt, Human
uugaugaagaagu

SEQ ID NO: 1636407 - RNA, 23 nt, Human
uugauauccucuuugagugaagc

SEQ ID NO: 1636408 - RNA, 15 nt, Human
uugaggucuguucuu

SEQ ID NO: 1636409 - RNA, 11 nt, Human
uugagccuggg

SEQ ID NO: 1636410 - RNA, 13 nt, Human
uugaggguugggc

SEQ ID NO: 1636411 - RNA, 14 nt, Human
uugagccugggagg

SEQ ID NO: 1636412 - RNA, 16 nt, Human
uugaggguugggcugg

SEQ ID NO: 1636413 - RNA, 16 nt, Human
uugaugaucuuugcag

SEQ ID NO: 1636414 - RNA, 17 nt, Human
uugaugacccccaacca

SEQ ID NO: 1636415 - RNA, 21 nt, Human
uugcaaaguaucccuacugua

SEQ ID NO: 1636416 - RNA, 17 nt, Human
uugacccacaagaaaug

SEQ ID NO: 1636417 - RNA, 17 nt, Human
uugaccgugaggccaga

SEQ ID NO: 1636418 - RNA, 14 nt, Human
uugaccucugcagc

SEQ ID NO: 1636419 - RNA, 15 nt, Human
uugaccucugcagca

SEQ ID NO: 1636420 - RNA, 20 nt, Human
uugacgccaucccagcccca

SEQ ID NO: 1636421 - RNA, 19 nt, Human
uugacgccaucccagcccc

SEQ ID NO: 1636422 - RNA, 18 nt, Human
uugacgccaucccagccc

SEQ ID NO: 1636423 - RNA, 17 nt, Human
uugacgccaucccagcc

SEQ ID NO: 1636424 - RNA, 16 nt, Human
uugaccucugcagcaa

SEQ ID NO: 1636425 - RNA, 18 nt, Human
uugaacuggguacuugug

SEQ ID NO: 1636426 - RNA, 17 nt, Human
uugaacuccugaccuca

SEQ ID NO: 1636427 - RNA, 13 nt, Human
uugaacuuugacc

SEQ ID NO: 1636428 - RNA, 22 nt, Human
uugaauuuauuggcuuuucuga

SEQ ID NO: 1636429 - RNA, 18 nt, Human
uugaauuuauuggcuuuu

SEQ ID NO: 1636430 - RNA, 15 nt, Human
uugaauuuauuggcu

SEQ ID NO: 1636431 - RNA, 12 nt, Human
uugaauuuuaca

SEQ ID NO: 1636432 - RNA, 21 nt, Human
uugaauuuuguguuagagauu

SEQ ID NO: 1636433 - RNA, 17 nt, Human
uugaauuuuguguuaga

SEQ ID NO: 1636434 - RNA, 15 nt, Human
uucaaccauucccca

SEQ ID NO: 1636435 - RNA, 18 nt, Human
uucaaauguauuacagug

SEQ ID NO: 1636436 - RNA, 18 nt, Human
uucaaaugcuguaacuuu

SEQ ID NO: 1636437 - RNA, 22 nt, Human
uuauuuuggaaaauaaauuauu

SEQ ID NO: 1636438 - RNA, 20 nt, Human
uuauuuuauuaugaaacuug

SEQ ID NO: 1636439 - RNA, 20 nt, Human
uuauuuuaauaauguuucaa

SEQ ID NO: 1636440 - RNA, 17 nt, Human
uuauuuuaauucaguug

SEQ ID NO: 1636441 - RNA, 18 nt, Human
uuauuuuauuaugcauga

SEQ ID NO: 1636442 - RNA, 16 nt, Human
uuauuuuauuaugaaa

SEQ ID NO: 1636443 - RNA, 15 nt, Human
uuauuuuauuaugaa

SEQ ID NO: 1636444 - RNA, 19 nt, Human
uuauuuuaauaauguuuca

SEQ ID NO: 1636445 - RNA, 15 nt, Human
uucagagcugcccuc

SEQ ID NO: 1636446 - RNA, 17 nt, Human
uucagagcugcccucuc

SEQ ID NO: 1636447 - RNA, 17 nt, Human
uucagacagcugccugg

SEQ ID NO: 1636448 - RNA, 18 nt, Human
uucagagcugcccucucc

SEQ ID NO: 1636449 - RNA, 19 nt, Human
uucagagcugcccucuccu

SEQ ID NO: 1636450 - RNA, 20 nt, Human
uucagagcugcccucuccug

SEQ ID NO: 1636451 - RNA, 20 nt, Human
uucagauacuggauuguacu

SEQ ID NO: 1636452 - RNA, 16 nt, Human
uucagauacuggauug

SEQ ID NO: 1636453 - RNA, 14 nt, Human
uucagcucacugca

SEQ ID NO: 1636454 - RNA, 16 nt, Human
uucagacagcugccug

SEQ ID NO: 1636455 - RNA, 15 nt, Human
uucagacagcugccu

SEQ ID NO: 1636456 - RNA, 17 nt, Human
uucacggaagagccuug

SEQ ID NO: 1636457 - RNA, 22 nt, Human
uucaccuuuguccccaccgcag

SEQ ID NO: 1636458 - RNA, 13 nt, Human
uucacggaagagc

SEQ ID NO: 1636459 - RNA, 22 nt, Human
uucacaagacccaaaaggcaga

SEQ ID NO: 1636460 - RNA, 21 nt, Human
uucacaaccuucuguggcuca

SEQ ID NO: 1636461 - RNA, 13 nt, Human
uucacccuuuucu

SEQ ID NO: 1636462 - RNA, 20 nt, Human
uucaccuuuguccccaccgc

SEQ ID NO: 1636463 - RNA, 19 nt, Human
uucaccuuuguccccaccg

SEQ ID NO: 1636464 - RNA, 14 nt, Human
uucaccuuuguccc

SEQ ID NO: 1636465 - RNA, 22 nt, Human
uucaauaggaaaaacugauuuu

SEQ ID NO: 1636466 - RNA, 21 nt, Human
uucaauaggaaaaacugauuu

SEQ ID NO: 1636467 - RNA, 13 nt, Human
uuccaaaguacac

SEQ ID NO: 1636468 - RNA, 16 nt, Human
uuccaaaguacacugu

SEQ ID NO: 1636469 - RNA, 20 nt, Human
uucaugcuguucaugaaaga

SEQ ID NO: 1636470 - RNA, 18 nt, Human
uuccagauccuggaaauc

SEQ ID NO: 1636471 - RNA, 19 nt, Human
uuccaacccucaucaccaa

SEQ ID NO: 1636472 - RNA, 15 nt, Human
uuccauggacuuugu

SEQ ID NO: 1636473 - RNA, 14 nt, Human
uuccauggacuuug

SEQ ID NO: 1636474 - RNA, 23 nt, Human
uucaguuauuauauuuacaaaug

SEQ ID NO: 1636475 - RNA, 20 nt, Human
uucauaaauaaaguuuguug

SEQ ID NO: 1636476 - RNA, 19 nt, Human
uucauccuccucagaucuu

SEQ ID NO: 1636477 - RNA, 15 nt, Human
uucauccuccucaga

SEQ ID NO: 1636478 - RNA, 15 nt, Human
uucauaaccuagccu

SEQ ID NO: 1636479 - RNA, 16 nt, Human
uucaguggcagcugcu

SEQ ID NO: 1636480 - RNA, 15 nt, Human
uucaguggcagcugc

SEQ ID NO: 1636481 - RNA, 17 nt, Human
uucaguggcagcugcuu

SEQ ID NO: 1636482 - RNA, 12 nt, Human
uucaguguacau

SEQ ID NO: 1636483 - RNA, 13 nt, Human
uucaguguacaug

SEQ ID NO: 1636484 - RNA, 15 nt, Human
uucagcuccagcuca

SEQ ID NO: 1636485 - RNA, 12 nt, Human
uucagcuccagc

SEQ ID NO: 1636486 - RNA, 22 nt, Human
uucagcuccagcucaccagccc

SEQ ID NO: 1636487 - RNA, 14 nt, Human
uucaguggcagcug

SEQ ID NO: 1636488 - RNA, 22 nt, Human
uucagcuuguaaauagcucagg

SEQ ID NO: 1636489 - RNA, 18 nt, Human
uuauaauuuugugaagca

SEQ ID NO: 1636490 - RNA, 17 nt, Human
uuauaauuuugugaagc

SEQ ID NO: 1636491 - RNA, 16 nt, Human
uuauaauuuugugaag

SEQ ID NO: 1636492 - RNA, 11 nt, Human
uuauacauaaa

SEQ ID NO: 1636493 - RNA, 13 nt, Human
uuauacauaaaca

SEQ ID NO: 1636494 - RNA, 23 nt, Human
uuauaucuauauuuuacauaaau

SEQ ID NO: 1636495 - RNA, 19 nt, Human
uuauaucuauauuuuacau

SEQ ID NO: 1636496 - RNA, 16 nt, Human
uuauaugcuauuucua

SEQ ID NO: 1636497 - RNA, 18 nt, Human
uuauaugcuauuucuaua

SEQ ID NO: 1636498 - RNA, 23 nt, Human
uuauaucugaggaauucuguaua

SEQ ID NO: 1636499 - RNA, 22 nt, Human
uuauaucugaggaauucuguau

SEQ ID NO: 1636500 - RNA, 14 nt, Human
uuauaucugaggaa

SEQ ID NO: 1636501 - RNA, 21 nt, Human
uuauaucugaggaauucugua

SEQ ID NO: 1636502 - RNA, 20 nt, Human
uuauaucugaggaauucugu

SEQ ID NO: 1636503 - RNA, 16 nt, Human
uuauauuaugaagcuu

SEQ ID NO: 1636504 - RNA, 11 nt, Human
uuauaaucuuu

SEQ ID NO: 1636505 - RNA, 15 nt, Human
uuauaaugaaugaaa

SEQ ID NO: 1636506 - RNA, 15 nt, Human
uuauaauaauguuaa

SEQ ID NO: 1636507 - RNA, 18 nt, Human
uuauaauaauguuaacau

SEQ ID NO: 1636508 - RNA, 15 nt, Human
uuauaauuuugugaa

SEQ ID NO: 1636509 - RNA, 14 nt, Human
uuauaauuuuguga

SEQ ID NO: 1636510 - RNA, 21 nt, Human
uuauaauuuuaaauguuuuuu

SEQ ID NO: 1636511 - RNA, 17 nt, Human
uuauaauuuuaaauguu

SEQ ID NO: 1636512 - RNA, 12 nt, Human
uuauaauuuaaa

SEQ ID NO: 1636513 - RNA, 12 nt, Human
uuauaauuuuaa

SEQ ID NO: 1636514 - RNA, 15 nt, Human
ugugaaaagaaaaau

SEQ ID NO: 1636515 - RNA, 13 nt, Human
ugugaaaagaaaa

SEQ ID NO: 1636516 - RNA, 17 nt, Human
ugugaaaagaaaaauga

SEQ ID NO: 1636517 - RNA, 21 nt, Human
ugugaaaagaaaaaugagccu

SEQ ID NO: 1636518 - RNA, 19 nt, Human
uuagugaccucagcuuuga

SEQ ID NO: 1636519 - RNA, 18 nt, Human
uuauggcuauaggugcua

SEQ ID NO: 1636520 - RNA, 16 nt, Human
uuauggcuuuugugca

SEQ ID NO: 1636521 - RNA, 14 nt, Human
uuauggcacaucag

SEQ ID NO: 1636522 - RNA, 17 nt, Human
uuauguugcauagaaua

SEQ ID NO: 1636523 - RNA, 18 nt, Human
uuauggcuuuugugcauu

SEQ ID NO: 1636524 - RNA, 17 nt, Human
uuauggcuuuugugcau

SEQ ID NO: 1636525 - RNA, 20 nt, Human
uuauggaacacucugagacu

SEQ ID NO: 1636526 - RNA, 18 nt, Human
uuauggaacacucugaga

SEQ ID NO: 1636527 - RNA, 21 nt, Human
uuauggacaaugacccagugg

SEQ ID NO: 1636528 - RNA, 17 nt, Human
uuauggaacacucugag

SEQ ID NO: 1636529 - RNA, 16 nt, Human
uuauuacaguauaauu

SEQ ID NO: 1636530 - RNA, 21 nt, Human
uuauuaaaugcccagccccuu

SEQ ID NO: 1636531 - RNA, 19 nt, Human
uuauuaaaugcccagcccc

SEQ ID NO: 1636532 - RNA, 23 nt, Human
uuauuaaaaaucucaaauuucua

SEQ ID NO: 1636533 - RNA, 11 nt, Human
uuaucucaaaa

SEQ ID NO: 1636534 - RNA, 14 nt, Human
uuaucuugaauaau

SEQ ID NO: 1636535 - RNA, 16 nt, Human
uuaucuugaauaaugu

SEQ ID NO: 1636536 - RNA, 14 nt, Human
uuaucuagauacug

SEQ ID NO: 1636537 - RNA, 15 nt, Human
uuauauuugaaauau

SEQ ID NO: 1636538 - RNA, 13 nt, Human
uuauauuugaaau

SEQ ID NO: 1636539 - RNA, 12 nt, Human
uuauauuugaaa

SEQ ID NO: 1636540 - RNA, 20 nt, Human
uuauauuuauuacuguaaga

SEQ ID NO: 1636541 - RNA, 16 nt, Human
uuauauuuacaaaugg

SEQ ID NO: 1636542 - RNA, 15 nt, Human
aaaaaauauuuuccu

SEQ ID NO: 1636543 - RNA, 18 nt, Human
aaaaacacagcaagggug

SEQ ID NO: 1636544 - RNA, 23 nt, Human
aaaaaauuggggauucuuaaagu

SEQ ID NO: 1636545 - RNA, 13 nt, Human
aaaaacacagcaa

SEQ ID NO: 1636546 - RNA, 18 nt, Human
aaaaaauuggggauucuu

SEQ ID NO: 1636547 - RNA, 21 nt, Human
acuauucaaacagucucagga

SEQ ID NO: 1636548 - RNA, 20 nt, Human
acuaguauuucuaugaaaua

SEQ ID NO: 1636549 - RNA, 18 nt, Human
acucaaaagcugggcagg

SEQ ID NO: 1636550 - RNA, 13 nt, Human
acucaaaagcugg

SEQ ID NO: 1636551 - RNA, 19 nt, Human
acucaguccauagcagaga

SEQ ID NO: 1636552 - RNA, 17 nt, Human
acucuauguucuaagaa

SEQ ID NO: 1636553 - RNA, 23 nt, Human
acucuaucaaguauuauaccuuu

SEQ ID NO: 1636554 - RNA, 19 nt, Human
acucugucgcccagucugg

SEQ ID NO: 1636555 - RNA, 17 nt, Human
acucuagggaaaaacca

SEQ ID NO: 1636556 - RNA, 15 nt, Human
acucuagggaaaaac

SEQ ID NO: 1636557 - RNA, 15 nt, Human
acucauauuuucaug

SEQ ID NO: 1636558 - RNA, 15 nt, Human
acuaagagagaauga

SEQ ID NO: 1636559 - RNA, 13 nt, Human
acuaagagagaau

SEQ ID NO: 1636560 - RNA, 11 nt, Human
acgugaguccu

SEQ ID NO: 1636561 - RNA, 22 nt, Human
acgcaggcccccaggugccagu

SEQ ID NO: 1636562 - RNA, 14 nt, Human
acgcugugcugccc

SEQ ID NO: 1636563 - RNA, 12 nt, Human
acgcugugcugc

SEQ ID NO: 1636564 - RNA, 11 nt, Human
acgcugugcug

SEQ ID NO: 1636565 - RNA, 15 nt, Human
acgcugugcugcccu

SEQ ID NO: 1636566 - RNA, 15 nt, Human
acgucugacaggcaa

SEQ ID NO: 1636567 - RNA, 14 nt, Human
acgucugacaggca

SEQ ID NO: 1636568 - RNA, 13 nt, Human
acgucugacaggc

SEQ ID NO: 1636569 - RNA, 14 nt, Human
acggaacucaaaua

SEQ ID NO: 1636570 - RNA, 21 nt, Human
accucugcagcaauaaagcag

SEQ ID NO: 1636571 - RNA, 18 nt, Human
accucugcagcaauaaag

SEQ ID NO: 1636572 - RNA, 20 nt, Human
accucugcagcaauaaagca

SEQ ID NO: 1636573 - RNA, 15 nt, Human
accuuuaagagaaau

SEQ ID NO: 1636574 - RNA, 18 nt, Human
accuuucccaucuuccaa

SEQ ID NO: 1636575 - RNA, 13 nt, Human
accuuucccaucu

SEQ ID NO: 1636576 - RNA, 18 nt, Human
accuuggcugcagggagu

SEQ ID NO: 1636577 - RNA, 17 nt, Human
accuuggcugcagggag

SEQ ID NO: 1636578 - RNA, 15 nt, Human
accugucccccugac

SEQ ID NO: 1636579 - RNA, 12 nt, Human
accugucccccu

SEQ ID NO: 1636580 - RNA, 16 nt, Human
accugucccccugaca

SEQ ID NO: 1636581 - RNA, 20 nt, Human
accugcccugcugaguccca

SEQ ID NO: 1636582 - RNA, 23 nt, Human
acugucucaagagggcacuggug

SEQ ID NO: 1636583 - RNA, 21 nt, Human
acugucucaagagggcacugg

SEQ ID NO: 1636584 - RNA, 20 nt, Human
acugucucaagagggcacug

SEQ ID NO: 1636585 - RNA, 22 nt, Human
acuguaagaaaauaucacuugu

SEQ ID NO: 1636586 - RNA, 13 nt, Human
acuguaagaaaau

SEQ ID NO: 1636587 - RNA, 19 nt, Human
acuguaagaaaauaucacu

SEQ ID NO: 1636588 - RNA, 18 nt, Human
acugguuccauggccucu

SEQ ID NO: 1636589 - RNA, 16 nt, Human
acuggugacugauucu

SEQ ID NO: 1636590 - RNA, 14 nt, Human
acuggugacugauu

SEQ ID NO: 1636591 - RNA, 17 nt, Human
acuggaagcacagcuuc

SEQ ID NO: 1636592 - RNA, 17 nt, Human
acugcccccucugcccu

SEQ ID NO: 1636593 - RNA, 16 nt, Human
acugcccccucugccc

SEQ ID NO: 1636594 - RNA, 19 nt, Human
acuggaagcacagcuucau

SEQ ID NO: 1636595 - RNA, 15 nt, Human
acugcccccucugcc

SEQ ID NO: 1636596 - RNA, 14 nt, Human
acugcccccucugc

SEQ ID NO: 1636597 - RNA, 15 nt, Human
acuggagaaaaugga

SEQ ID NO: 1636598 - RNA, 18 nt, Human
acugguaggaaacuaggu

SEQ ID NO: 1636599 - RNA, 18 nt, Human
acucugucucaguccaug

SEQ ID NO: 1636600 - RNA, 20 nt, Human
acucugucucaguccaugaa

SEQ ID NO: 1636601 - RNA, 13 nt, Human
acugccagcaacg

SEQ ID NO: 1636602 - RNA, 21 nt, Human
acuucugucuucacaacagau

SEQ ID NO: 1636603 - RNA, 12 nt, Human
acuucagacaua

SEQ ID NO: 1636604 - RNA, 22 nt, Human
acuucugucuucacaacagauu

SEQ ID NO: 1636605 - RNA, 15 nt, Human
acuugggccacugug

SEQ ID NO: 1636606 - RNA, 14 nt, Human
acuugggccacugu

SEQ ID NO: 1636607 - RNA, 18 nt, Human
acuuguaaaggaauuuaa

SEQ ID NO: 1636608 - RNA, 16 nt, Human
acuugguuuuuaaaaa

SEQ ID NO: 1636609 - RNA, 20 nt, Human
acugugcugagucugaaggc

SEQ ID NO: 1636610 - RNA, 22 nt, Human
acugugcugagucugaaggcug

SEQ ID NO: 1636611 - RNA, 22 nt, Human
acuuuauuuucuauaauuuaaa

SEQ ID NO: 1636612 - RNA, 17 nt, Human
acuuuguucuggcucuu

SEQ ID NO: 1636613 - RNA, 16 nt, Human
acuuuguucuggcucu

SEQ ID NO: 1636614 - RNA, 22 nt, Human
acuuuaucuugaauaauguaag

SEQ ID NO: 1636615 - RNA, 19 nt, Human
acuuuguucuggcucuucc

SEQ ID NO: 1636616 - RNA, 20 nt, Human
acuuuguucuggcucuucca

SEQ ID NO: 1636617 - RNA, 13 nt, Human
acuuuuauaaacu

SEQ ID NO: 1636618 - RNA, 16 nt, Human
acuuuuaugauacuug

SEQ ID NO: 1636619 - RNA, 12 nt, Human
acuuuuaugaua

SEQ ID NO: 1636620 - RNA, 16 nt, Human
agaaaaucaggcuggc

SEQ ID NO: 1636621 - RNA, 15 nt, Human
agaaaauaccaagga

SEQ ID NO: 1636622 - RNA, 19 nt, Human
agaaaauaguggugugauu

SEQ ID NO: 1636623 - RNA, 14 nt, Human
acuuuucuuugugg

SEQ ID NO: 1636624 - RNA, 14 nt, Human
acuuuuggaaggua

SEQ ID NO: 1636625 - RNA, 16 nt, Human
acuuuucuuucagcca

SEQ ID NO: 1636626 - RNA, 20 nt, Human
acuuuucauaaccuagccuu

SEQ ID NO: 1636627 - RNA, 15 nt, Human
acuuuuauaaacuuu

SEQ ID NO: 1636628 - RNA, 23 nt, Human
acuuuuauuuccagugaaaucag

SEQ ID NO: 1636629 - RNA, 23 nt, Human
acuuuuaugauacuugaaaauua

SEQ ID NO: 1636630 - RNA, 14 nt, Human
agaaaguucaugcu

SEQ ID NO: 1636631 - RNA, 22 nt, Human
agaaaguacuucuccacccugc

SEQ ID NO: 1636632 - RNA, 23 nt, Human
agaaaguacuucuccacccugcu

SEQ ID NO: 1636633 - RNA, 21 nt, Human
acacgagcaggcuacugucag

SEQ ID NO: 1636634 - RNA, 17 nt, Human
acacgcgugcacacacc

SEQ ID NO: 1636635 - RNA, 15 nt, Human
acacgcgugcacaca

SEQ ID NO: 1636636 - RNA, 19 nt, Human
acacgagcaggcuacuguc

SEQ ID NO: 1636637 - RNA, 14 nt, Human
acacgagcaggcua

SEQ ID NO: 1636638 - RNA, 14 nt, Human
acacgcuccuuccu

SEQ ID NO: 1636639 - RNA, 16 nt, Human
acacgcuccuuccucu

SEQ ID NO: 1636640 - RNA, 13 nt, Human
acacagcucuucu

SEQ ID NO: 1636641 - RNA, 11 nt, Human
acacagcucuu

SEQ ID NO: 1636642 - RNA, 22 nt, Human
acacauuuuauuuuauuaugca

SEQ ID NO: 1636643 - RNA, 12 nt, Human
acacauuuuucu

SEQ ID NO: 1636644 - RNA, 20 nt, Human
acacauuuuuuaaaugcacc

SEQ ID NO: 1636645 - RNA, 22 nt, Human
acacauuuuuuaaaugcaccug

SEQ ID NO: 1636646 - RNA, 19 nt, Human
acacagaggcugccucucc

SEQ ID NO: 1636647 - RNA, 20 nt, Human
acacagcucuguccugggag

SEQ ID NO: 1636648 - RNA, 17 nt, Human
acacagauuugagcuca

SEQ ID NO: 1636649 - RNA, 13 nt, Human
acaagaaaugaaa

SEQ ID NO: 1636650 - RNA, 17 nt, Human
acaaggauugcuacugu

SEQ ID NO: 1636651 - RNA, 14 nt, Human
acaaggcaaggcug

SEQ ID NO: 1636652 - RNA, 12 nt, Human
acaaggcaaggc

SEQ ID NO: 1636653 - RNA, 22 nt, Human
acaaaauguaggguuauaauaa

SEQ ID NO: 1636654 - RNA, 15 nt, Human
aauuuuguuucugua

SEQ ID NO: 1636655 - RNA, 14 nt, Human
aauuuuguuucugu

SEQ ID NO: 1636656 - RNA, 15 nt, Human
acaaggcaaggcugu

SEQ ID NO: 1636657 - RNA, 13 nt, Human
aauuuugugaagc

SEQ ID NO: 1636658 - RNA, 13 nt, Human
aauuuuguuucug

SEQ ID NO: 1636659 - RNA, 23 nt, Human
acagcaguugaaaagacuccaaa

SEQ ID NO: 1636660 - RNA, 22 nt, Human
acagcaguugaaaagacuccaa

SEQ ID NO: 1636661 - RNA, 21 nt, Human
acagcaguugaaaagacucca

SEQ ID NO: 1636662 - RNA, 19 nt, Human
acagagugagacucugucu

SEQ ID NO: 1636663 - RNA, 15 nt, Human
acagagugagacucu

SEQ ID NO: 1636664 - RNA, 14 nt, Human
acagaggggguggc

SEQ ID NO: 1636665 - RNA, 17 nt, Human
acagccaacuauggccu

SEQ ID NO: 1636666 - RNA, 19 nt, Human
acagccaacuauggccugu

SEQ ID NO: 1636667 - RNA, 15 nt, Human
acagaggcagcccca

SEQ ID NO: 1636668 - RNA, 14 nt, Human
acagacacaggccc

SEQ ID NO: 1636669 - RNA, 13 nt, Human
acagacacaggcc

SEQ ID NO: 1636670 - RNA, 23 nt, Human
acagaggcagccccauucugccu

SEQ ID NO: 1636671 - RNA, 19 nt, Human
acagaggcagccccauucu

SEQ ID NO: 1636672 - RNA, 15 nt, Human
acagacacaggcccg

SEQ ID NO: 1636673 - RNA, 15 nt, Human
acacuguacugcaau

SEQ ID NO: 1636674 - RNA, 13 nt, Human
acagacaaagcgu

SEQ ID NO: 1636675 - RNA, 11 nt, Human
acagacacagg

SEQ ID NO: 1636676 - RNA, 14 nt, Human
acacugcauguuug

SEQ ID NO: 1636677 - RNA, 15 nt, Human
acacugcauguuugu

SEQ ID NO: 1636678 - RNA, 17 nt, Human
acagccacggccaggcc

SEQ ID NO: 1636679 - RNA, 16 nt, Human
acagccacggccaggc

SEQ ID NO: 1636680 - RNA, 15 nt, Human
acagccacggccagg

SEQ ID NO: 1636681 - RNA, 18 nt, Human
acagccacggccaggcca

SEQ ID NO: 1636682 - RNA, 19 nt, Human
acagccacggccaggccag

SEQ ID NO: 1636683 - RNA, 18 nt, Human
acagcucuucuccaggcu

SEQ ID NO: 1636684 - RNA, 17 nt, Human
acagcucuucuccaggc

SEQ ID NO: 1636685 - RNA, 16 nt, Human
acagcucuucuccagg

SEQ ID NO: 1636686 - RNA, 12 nt, Human
acaggcaagcac

SEQ ID NO: 1636687 - RNA, 21 nt, Human
acaggaugaugacuauggaaa

SEQ ID NO: 1636688 - RNA, 17 nt, Human
acccacaagaaaugaaa

SEQ ID NO: 1636689 - RNA, 23 nt, Human
acccaagggccuggccugagcug

SEQ ID NO: 1636690 - RNA, 21 nt, Human
acccacaagaaaugaaagcag

SEQ ID NO: 1636691 - RNA, 15 nt, Human
acccaccucagccuc

SEQ ID NO: 1636692 - RNA, 14 nt, Human
acccaccucagccu

SEQ ID NO: 1636693 - RNA, 13 nt, Human
acccaccucagcc

SEQ ID NO: 1636694 - RNA, 20 nt, Human
accauauuaccacagacaua

SEQ ID NO: 1636695 - RNA, 22 nt, Human
acccaagggccuggccugagcu

SEQ ID NO: 1636696 - RNA, 19 nt, Human
acccaagggccuggccuga

SEQ ID NO: 1636697 - RNA, 18 nt, Human
acccaagggccuggccug

SEQ ID NO: 1636698 - RNA, 11 nt, Human
acccccugaau

SEQ ID NO: 1636699 - RNA, 17 nt, Human
acccccugcaaagccca

SEQ ID NO: 1636700 - RNA, 14 nt, Human
acccccugcaaagc

SEQ ID NO: 1636701 - RNA, 22 nt, Human
acccccugcaaagcccagcuug

SEQ ID NO: 1636702 - RNA, 20 nt, Human
acccccugcaaagcccagcu

SEQ ID NO: 1636703 - RNA, 18 nt, Human
acccccugcaaagcccag

SEQ ID NO: 1636704 - RNA, 16 nt, Human
acccaccucagccucc

SEQ ID NO: 1636705 - RNA, 14 nt, Human
accauauuaccaca

SEQ ID NO: 1636706 - RNA, 16 nt, Human
accauauuaccacaga

SEQ ID NO: 1636707 - RNA, 19 nt, Human
accccuccaugugggcuag

SEQ ID NO: 1636708 - RNA, 16 nt, Human
accccuccaugugggc

SEQ ID NO: 1636709 - RNA, 17 nt, Human
accccucauagcccuca

SEQ ID NO: 1636710 - RNA, 18 nt, Human
acaugugcacaugcacgu

SEQ ID NO: 1636711 - RNA, 16 nt, Human
acaugugcacaugcac

SEQ ID NO: 1636712 - RNA, 15 nt, Human
acaucagcacgauuu

SEQ ID NO: 1636713 - RNA, 17 nt, Human
acaucagcacgauuucu

SEQ ID NO: 1636714 - RNA, 18 nt, Human
acaucagcacgauuucug

SEQ ID NO: 1636715 - RNA, 19 nt, Human
acaucagcacgauuucugu

SEQ ID NO: 1636716 - RNA, 22 nt, Human
acauguuucuuuguaaugaaaa

SEQ ID NO: 1636717 - RNA, 19 nt, Human
acauguuucuuuguaauga

SEQ ID NO: 1636718 - RNA, 23 nt, Human
acauguuucuuuguaaugaaaac

SEQ ID NO: 1636719 - RNA, 23 nt, Human
acauaaugcgugcauaccacuuu

SEQ ID NO: 1636720 - RNA, 22 nt, Human
acauaaugcgugcauaccacuu

SEQ ID NO: 1636721 - RNA, 19 nt, Human
acaggguuuugccauguug

SEQ ID NO: 1636722 - RNA, 23 nt, Human
acaggcaaugcuggcuguuggcu

SEQ ID NO: 1636723 - RNA, 19 nt, Human
acaggcaaugcuggcuguu

SEQ ID NO: 1636724 - RNA, 15 nt, Human
acauuuauucugcuc

SEQ ID NO: 1636725 - RNA, 19 nt, Human
acauuuguucuauagcuuu

SEQ ID NO: 1636726 - RNA, 12 nt, Human
accaagcccagu

SEQ ID NO: 1636727 - RNA, 17 nt, Human
accagccaguaaauggg

SEQ ID NO: 1636728 - RNA, 13 nt, Human
accagcagaaaug

SEQ ID NO: 1636729 - RNA, 13 nt, Human
accagaucauugu

SEQ ID NO: 1636730 - RNA, 21 nt, Human
aaaaucuacacuccagugaga

SEQ ID NO: 1636731 - RNA, 18 nt, Human
aaaaguucugcagauaaa

SEQ ID NO: 1636732 - RNA, 17 nt, Human
aaaauaaaacuuuuuaa

SEQ ID NO: 1636733 - RNA, 13 nt, Human
aaaaguugaauuu

SEQ ID NO: 1636734 - RNA, 19 nt, Human
aaaauaaaauuaaagcuga

SEQ ID NO: 1636735 - RNA, 16 nt, Human
aaaaagaaacauuugg

SEQ ID NO: 1636736 - RNA, 15 nt, Human
aaaaagaaaggaggg

SEQ ID NO: 1636737 - RNA, 21 nt, Human
aaacacugggagaaaugaaaa

SEQ ID NO: 1636738 - RNA, 16 nt, Human
aaacacuguucucugc

SEQ ID NO: 1636739 - RNA, 22 nt, Human
aaacacugggagaaaugaaaaa

SEQ ID NO: 1636740 - RNA, 21 nt, Human
aaaauugaugggauuugguca

SEQ ID NO: 1636741 - RNA, 17 nt, Human
aaaaucucaauauuuca

SEQ ID NO: 1636742 - RNA, 16 nt, Human
aaaaucucaauauuuc

SEQ ID NO: 1636743 - RNA, 19 nt, Human
aaaaucucaaauuucuaaa

SEQ ID NO: 1636744 - RNA, 22 nt, Human
aaaaucucaaauuucuaaaucu

SEQ ID NO: 1636745 - RNA, 15 nt, Human
aaagaaauguaaggg

SEQ ID NO: 1636746 - RNA, 14 nt, Human
aaagaguaggaaga

SEQ ID NO: 1636747 - RNA, 20 nt, Human
aaagaagguuucagaaagaa

SEQ ID NO: 1636748 - RNA, 19 nt, Human
aaagaguguggcaaaauaa

SEQ ID NO: 1636749 - RNA, 23 nt, Human
aaacugagaugugaacacaucag

SEQ ID NO: 1636750 - RNA, 21 nt, Human
aaacugagaugugaacacauc

SEQ ID NO: 1636751 - RNA, 17 nt, Human
aaagaaauauaccuaaa

SEQ ID NO: 1636752 - RNA, 15 nt, Human
aaagaaauauaccua

SEQ ID NO: 1636753 - RNA, 17 nt, Human
aaagauauuuugcuuug

SEQ ID NO: 1636754 - RNA, 20 nt, Human
aaagauauuuugcuuuguga

SEQ ID NO: 1636755 - RNA, 12 nt, Human
aaagauauuuug

SEQ ID NO: 1636756 - RNA, 16 nt, Human
aaagauauuuugcuuu

SEQ ID NO: 1636757 - RNA, 18 nt, Human
aaaccaucauugaaaucu

SEQ ID NO: 1636758 - RNA, 15 nt, Human
aaaccaugggauaaa

SEQ ID NO: 1636759 - RNA, 18 nt, Human
aaacucuccucugcugcu

SEQ ID NO: 1636760 - RNA, 20 nt, Human
aaaccaugggauaaaugcca

SEQ ID NO: 1636761 - RNA, 16 nt, Human
aaacccuauugguaaa

SEQ ID NO: 1636762 - RNA, 14 nt, Human
aaaggcagaagcaa

SEQ ID NO: 1636763 - RNA, 16 nt, Human
aaaggcuccaggagca

SEQ ID NO: 1636764 - RNA, 15 nt, Human
aaaggcuccaggagc

SEQ ID NO: 1636765 - RNA, 16 nt, Human
aaagccuccuccagcc

SEQ ID NO: 1636766 - RNA, 23 nt, Human
aaagcccuuccaugucgccucug

SEQ ID NO: 1636767 - RNA, 22 nt, Human
aaagcccuuccaugucgccucu

SEQ ID NO: 1636768 - RNA, 14 nt, Human
aaagcccugugcuc

SEQ ID NO: 1636769 - RNA, 13 nt, Human
aaagcccugugcu

SEQ ID NO: 1636770 - RNA, 13 nt, Human
aaaguggaaaaau

SEQ ID NO: 1636771 - RNA, 20 nt, Human
aaaggcuccaggagcagcca

SEQ ID NO: 1636772 - RNA, 19 nt, Human
aaaggcuccaggagcagcc

SEQ ID NO: 1636773 - RNA, 13 nt, Human
aaauaaaacuuuu

SEQ ID NO: 1636774 - RNA, 16 nt, Human
aaauaaaacuuuuuaa

SEQ ID NO: 1636775 - RNA, 19 nt, Human
aaauaaaacuuuuuaaaau

SEQ ID NO: 1636776 - RNA, 10 nt, Human
aaauaaauaa

SEQ ID NO: 1636777 - RNA, 16 nt, Human
aaaucaaauaugcaaa

SEQ ID NO: 1636778 - RNA, 15 nt, Human
aaaucaaauaugcaa

SEQ ID NO: 1636779 - RNA, 14 nt, Human
aaaucaaauaugca

SEQ ID NO: 1636780 - RNA, 12 nt, Human
aaaucaaauaug

SEQ ID NO: 1636781 - RNA, 20 nt, Human
aaauauuuauuuuaauaaug

SEQ ID NO: 1636782 - RNA, 13 nt, Human
aaauauuuauuuu

SEQ ID NO: 1636783 - RNA, 15 nt, Human
aaauauuuauuuuaa

SEQ ID NO: 1636784 - RNA, 19 nt, Human
aaaucaaugcuauaacuau

SEQ ID NO: 1636785 - RNA, 19 nt, Human
aaaucugugaacuugaaau

SEQ ID NO: 1636786 - RNA, 18 nt, Human
aaaucugugaacuugaaa

SEQ ID NO: 1636787 - RNA, 16 nt, Human
aaaucugugaacuuga

SEQ ID NO: 1636788 - RNA, 15 nt, Human
aaaucugugaacuug

SEQ ID NO: 1636789 - RNA, 24 nt, Human
aaauagcucaggugucccugcacu

SEQ ID NO: 1636790 - RNA, 18 nt, Human
aaauagcuagacugguga

SEQ ID NO: 1636791 - RNA, 20 nt, Human
aaauagcuuuuuucucugau

SEQ ID NO: 1636792 - RNA, 17 nt, Human
aaauagcuuuuuucucu

SEQ ID NO: 1636793 - RNA, 19 nt, Human
aaauaguggugugauuugg

SEQ ID NO: 1636794 - RNA, 20 nt, Human
aacuuuaugcuaagugaaau

SEQ ID NO: 1636795 - RNA, 21 nt, Human
aacuuuaugcuaagugaaaua

SEQ ID NO: 1636796 - RNA, 20 nt, Human
aacugagaugugaacacauc

SEQ ID NO: 1636797 - RNA, 20 nt, Human
aacugacucuuaagaagacu

SEQ ID NO: 1636798 - RNA, 19 nt, Human
aacugacucuuaagaagac

SEQ ID NO: 1636799 - RNA, 18 nt, Human
aacugacucuuaagaaga

SEQ ID NO: 1636800 - RNA, 15 nt, Human
aacugacucuuaaga

SEQ ID NO: 1636801 - RNA, 16 nt, Human
aacugagugccuuuug

SEQ ID NO: 1636802 - RNA, 14 nt, Human
aacugauaaagaug

SEQ ID NO: 1636803 - RNA, 18 nt, Human
aacuuaaucuaaauggaa

SEQ ID NO: 1636804 - RNA, 15 nt, Human
aacuuaaucuaaaug

SEQ ID NO: 1636805 - RNA, 16 nt, Human
aacuuaaucuaaaugg

SEQ ID NO: 1636806 - RNA, 17 nt, Human
aacggaugauuucuaug

SEQ ID NO: 1636807 - RNA, 16 nt, Human
aacggaugauuucuau

SEQ ID NO: 1636808 - RNA, 15 nt, Human
aacggaugauuucua

SEQ ID NO: 1636809 - RNA, 14 nt, Human
aacggaugauuucu

SEQ ID NO: 1636810 - RNA, 11 nt, Human
aacgcagcccu

SEQ ID NO: 1636811 - RNA, 19 nt, Human
aaauugacacuuaaaaaug

SEQ ID NO: 1636812 - RNA, 22 nt, Human
aaauugacacuuaaaaaugguu

SEQ ID NO: 1636813 - RNA, 14 nt, Human
aaauugcuccuuga

SEQ ID NO: 1636814 - RNA, 13 nt, Human
aaauugcuccuug

SEQ ID NO: 1636815 - RNA, 21 nt, Human
aaauucuugcaaaguaucccu

SEQ ID NO: 1636816 - RNA, 13 nt, Human
aaauucuuucauu

SEQ ID NO: 1636817 - RNA, 17 nt, Human
aaauuaaagcugaaaac

SEQ ID NO: 1636818 - RNA, 13 nt, Human
aaauuaaagcuga

SEQ ID NO: 1636819 - RNA, 22 nt, Human
aaauguuguucucuucuuuaaa

SEQ ID NO: 1636820 - RNA, 17 nt, Human
aaaucuuauaauuuaaa

SEQ ID NO: 1636821 - RNA, 15 nt, Human
aaaugccuuuguacu

SEQ ID NO: 1636822 - RNA, 18 nt, Human
aacaaauuuacagagaca

SEQ ID NO: 1636823 - RNA, 16 nt, Human
aacacaucagcuugcc

SEQ ID NO: 1636824 - RNA, 17 nt, Human
aaccuagggugauauua

SEQ ID NO: 1636825 - RNA, 21 nt, Human
aaccgaacugauguaaguaaa

SEQ ID NO: 1636826 - RNA, 21 nt, Human
aacccuuggagccaauggaga

SEQ ID NO: 1636827 - RNA, 12 nt, Human
aacccucagagc

SEQ ID NO: 1636828 - RNA, 15 nt, Human
aacccuauugguaaa

SEQ ID NO: 1636829 - RNA, 12 nt, Human
aaccagaucauu

SEQ ID NO: 1636830 - RNA, 15 nt, Human
aaccacuucagcuga

SEQ ID NO: 1636831 - RNA, 13 nt, Human
aaccacgcuggac

SEQ ID NO: 1636832 - RNA, 15 nt, Human
aacaucccuccuggg

SEQ ID NO: 1636833 - RNA, 21 nt, Human
aacagcuggugcccugcuuuc

SEQ ID NO: 1636834 - RNA, 20 nt, Human
aacagcuggugcccugcuuu

SEQ ID NO: 1636835 - RNA, 19 nt, Human
aacagcuggugcccugcuu

SEQ ID NO: 1636836 - RNA, 14 nt, Human
aagcagcguuucua

SEQ ID NO: 1636837 - RNA, 17 nt, Human
aagcagcguuucuauga

SEQ ID NO: 1636838 - RNA, 20 nt, Human
aagcagcguuucuaugacac

SEQ ID NO: 1636839 - RNA, 21 nt, Human
aagcagcguuucuaugacaca

SEQ ID NO: 1636840 - RNA, 22 nt, Human
aagcagcguuucuaugacacau

SEQ ID NO: 1636841 - RNA, 23 nt, Human
aagccagcaggcucucaggccag

SEQ ID NO: 1636842 - RNA, 20 nt, Human
aagccagcaggcucucaggc

SEQ ID NO: 1636843 - RNA, 14 nt, Human
aagauaaaugugcu

SEQ ID NO: 1636844 - RNA, 13 nt, Human
aagauaaaugugc

SEQ ID NO: 1636845 - RNA, 12 nt, Human
aagauaaaugug

SEQ ID NO: 1636846 - RNA, 13 nt, Human
aagauacugaaau

SEQ ID NO: 1636847 - RNA, 20 nt, Human
aaggcagcucuaaaugucaa

SEQ ID NO: 1636848 - RNA, 12 nt, Human
aaggcagggagg

SEQ ID NO: 1636849 - RNA, 15 nt, Human
aaggauugcuacugu

SEQ ID NO: 1636850 - RNA, 15 nt, Human
aaggauguucuagca

SEQ ID NO: 1636851 - RNA, 23 nt, Human
aaggacuucuuuaauuuuggaau

SEQ ID NO: 1636852 - RNA, 21 nt, Human
aagcuggucccacucagucca

SEQ ID NO: 1636853 - RNA, 18 nt, Human
aagcuggucccacucagu

SEQ ID NO: 1636854 - RNA, 18 nt, Human
aagcuguguggcagucug

SEQ ID NO: 1636855 - RNA, 21 nt, Human
aaggacuucuuuaauuuugga

SEQ ID NO: 1636856 - RNA, 20 nt, Human
aaggacuucuuuaauuuugg

SEQ ID NO: 1636857 - RNA, 15 nt, Human
aaggacuucuuuaau

SEQ ID NO: 1636858 - RNA, 14 nt, Human
aaggacuucuuuaa

SEQ ID NO: 1636859 - RNA, 19 nt, Human
aaggacagccccuccucca

SEQ ID NO: 1636860 - RNA, 13 nt, Human
aaggacagccccu

SEQ ID NO: 1636861 - RNA, 21 nt, Human
aagcgauucuucugcuucagc

SEQ ID NO: 1636862 - RNA, 17 nt, Human
aagggaaacugccagca

SEQ ID NO: 1636863 - RNA, 16 nt, Human
aagggaaacugccagc

SEQ ID NO: 1636864 - RNA, 23 nt, Human
aagggaaacugccagcaacgcag

SEQ ID NO: 1636865 - RNA, 18 nt, Human
aagggacgcuacccggga

SEQ ID NO: 1636866 - RNA, 18 nt, Human
aaggucauuuuuuuuaag

SEQ ID NO: 1636867 - RNA, 19 nt, Human
aaggucauuuuuuuuaaga

SEQ ID NO: 1636868 - RNA, 17 nt, Human
aaguccaagcauaccaa

SEQ ID NO: 1636869 - RNA, 18 nt, Human
aaguccaagcauuuagau

SEQ ID NO: 1636870 - RNA, 18 nt, Human
aaguccucuuuucugaga

SEQ ID NO: 1636871 - RNA, 22 nt, Human
aaguccucuuuucugagaggac

SEQ ID NO: 1636872 - RNA, 14 nt, Human
aagucuccaaaguc

SEQ ID NO: 1636873 - RNA, 21 nt, Human
aaguagggacuucugucuuca

SEQ ID NO: 1636874 - RNA, 21 nt, Human
aaguagaagucuuagauguau

SEQ ID NO: 1636875 - RNA, 18 nt, Human
aaguaucccuacuguaau

SEQ ID NO: 1636876 - RNA, 23 nt, Human
aaguaucccuacuguaauuugug

SEQ ID NO: 1636877 - RNA, 17 nt, Human
aaguaucccuacuguaa

SEQ ID NO: 1636878 - RNA, 20 nt, Human
aaguagaagucuuagaugua

SEQ ID NO: 1636879 - RNA, 19 nt, Human
aaguagaagucuuagaugu

SEQ ID NO: 1636880 - RNA, 20 nt, Human
aaggugaggagcuugaaacc

SEQ ID NO: 1636881 - RNA, 19 nt, Human
aaguggaaaaauagccugc

SEQ ID NO: 1636882 - RNA, 21 nt, Human
aaguggaaaaauagccugccu

SEQ ID NO: 1636883 - RNA, 12 nt, Human
aaguugaauuuu

SEQ ID NO: 1636884 - RNA, 12 nt, Human
aaguugccuaaa

SEQ ID NO: 1636885 - RNA, 15 nt, Human
aagucuccaaagucu

SEQ ID NO: 1636886 - RNA, 23 nt, Human
aaugcuauaacuauguugauaaa

SEQ ID NO: 1636887 - RNA, 23 nt, Human
aauguuucaaacauauauaacaa

SEQ ID NO: 1636888 - RNA, 22 nt, Human
aauguuuacagauccccaagcc

SEQ ID NO: 1636889 - RNA, 16 nt, Human
aauguuugccucugcc

SEQ ID NO: 1636890 - RNA, 15 nt, Human
aauguuugccucugc

SEQ ID NO: 1636891 - RNA, 15 nt, Human
aaugugaaaagaaaa

SEQ ID NO: 1636892 - RNA, 17 nt, Human
aaugugaaaagaaaaau

SEQ ID NO: 1636893 - RNA, 19 nt, Human
aaugcgugcauaccacuuu

SEQ ID NO: 1636894 - RNA, 18 nt, Human
aaugcgugcauaccacuu

SEQ ID NO: 1636895 - RNA, 22 nt, Human
aaugcgcaggcuggcccugccc

SEQ ID NO: 1636896 - RNA, 23 nt, Human
aaugccuuacccucauguucuua

SEQ ID NO: 1636897 - RNA, 20 nt, Human
aauguuuuuuuuuaaagacu

SEQ ID NO: 1636898 - RNA, 15 nt, Human
aauguuuuuuuuuaa

SEQ ID NO: 1636899 - RNA, 22 nt, Human
aauguuuuuuuuuaaagacuuu

SEQ ID NO: 1636900 - RNA, 13 nt, Human
aauagacaauuua

SEQ ID NO: 1636901 - RNA, 14 nt, Human
aaucaccgaaaacg

SEQ ID NO: 1636902 - RNA, 23 nt, Human
aaucaaguuggcuucuaaucaaa

SEQ ID NO: 1636903 - RNA, 19 nt, Human
aaucacauucgaguguuuc

SEQ ID NO: 1636904 - RNA, 15 nt, Human
aaucaccgaaaacgu

SEQ ID NO: 1636905 - RNA, 12 nt, Human
aauauuaaagcc

SEQ ID NO: 1636906 - RNA, 21 nt, Human
aauauuagugaccucagcuuu

SEQ ID NO: 1636907 - RNA, 22 nt, Human
aauacucuacccucuuagaaaa

SEQ ID NO: 1636908 - RNA, 20 nt, Human
aauacucuacccucuuagaa

SEQ ID NO: 1636909 - RNA, 13 nt, Human
aauacucuuauau

SEQ ID NO: 1636910 - RNA, 19 nt, Human
aaguugccuaaauccauuu

SEQ ID NO: 1636911 - RNA, 18 nt, Human
aaguugccuaaauccauu

SEQ ID NO: 1636912 - RNA, 17 nt, Human
aaguugccuaaauccau

SEQ ID NO: 1636913 - RNA, 16 nt, Human
aaguugccuaaaucca

SEQ ID NO: 1636914 - RNA, 15 nt, Human
aaguugccuaaaucc

SEQ ID NO: 1636915 - RNA, 15 nt, Human
aauccaaugaaauga

SEQ ID NO: 1636916 - RNA, 19 nt, Human
aauccagacccggcugcgu

SEQ ID NO: 1636917 - RNA, 16 nt, Human
aaucucaaauuucuaa

SEQ ID NO: 1636918 - RNA, 13 nt, Human
aauccagccugcu

SEQ ID NO: 1636919 - RNA, 17 nt, Human
aaucucaaauuucuaaa

SEQ ID NO: 1636920 - RNA, 18 nt, Human
aaucucaaauuucuaaau

SEQ ID NO: 1636921 - RNA, 15 nt, Human
aaugauuaugaauua

SEQ ID NO: 1636922 - RNA, 23 nt, Human
aaugauuaugaauuacauuugua

SEQ ID NO: 1636923 - RNA, 21 nt, Human
aaugauuaugaauuacauuug

SEQ ID NO: 1636924 - RNA, 18 nt, Human
aauccaagcaaaugugaa

SEQ ID NO: 1636925 - RNA, 17 nt, Human
aauccaagcaaauguga

SEQ ID NO: 1636926 - RNA, 16 nt, Human
agcacugacuucuaag

SEQ ID NO: 1636927 - RNA, 19 nt, Human
agcacagacccugcccugu

SEQ ID NO: 1636928 - RNA, 18 nt, Human
agcacagacccugcccug

SEQ ID NO: 1636929 - RNA, 20 nt, Human
agcacagacccugcccugug

SEQ ID NO: 1636930 - RNA, 12 nt, Human
agcacagacccu

SEQ ID NO: 1636931 - RNA, 17 nt, Human
agcacagacccugcccu

SEQ ID NO: 1636932 - RNA, 23 nt, Human
agcacacuugacaucaacugcau

SEQ ID NO: 1636933 - RNA, 20 nt, Human
agcagugcaugcugucccuu

SEQ ID NO: 1636934 - RNA, 19 nt, Human
agcagugcaugcugucccu

SEQ ID NO: 1636935 - RNA, 13 nt, Human
agcagcguuucua

SEQ ID NO: 1636936 - RNA, 18 nt, Human
agcagcguuucuaugaca

SEQ ID NO: 1636937 - RNA, 13 nt, Human
agcaguugaaaag

SEQ ID NO: 1636938 - RNA, 23 nt, Human
agcaguucagagcugcccucucc

SEQ ID NO: 1636939 - RNA, 16 nt, Human
agcaguugaaaagacu

SEQ ID NO: 1636940 - RNA, 23 nt, Human
agcauccuggcacccggccccug

SEQ ID NO: 1636941 - RNA, 22 nt, Human
agcauccuggcacccggccccu

SEQ ID NO: 1636942 - RNA, 23 nt, Human
agcaugccuggauggggcugcac

SEQ ID NO: 1636943 - RNA, 23 nt, Human
agccaagugugguagagugugcc

SEQ ID NO: 1636944 - RNA, 21 nt, Human
agccgggcgugguggugagug

SEQ ID NO: 1636945 - RNA, 16 nt, Human
agccgugccuucagcu

SEQ ID NO: 1636946 - RNA, 15 nt, Human
agccgugccuucagc

SEQ ID NO: 1636947 - RNA, 21 nt, Human
agccucccaaagugcugggau

SEQ ID NO: 1636948 - RNA, 13 nt, Human
agccguggcuucc

SEQ ID NO: 1636949 - RNA, 17 nt, Human
agccgugccuucagcuc

SEQ ID NO: 1636950 - RNA, 22 nt, Human
agccucccacgacugcccggca

SEQ ID NO: 1636951 - RNA, 14 nt, Human
agccuccuccagcc

SEQ ID NO: 1636952 - RNA, 19 nt, Human
agccucccgaguagcuggg

SEQ ID NO: 1636953 - RNA, 18 nt, Human
agccucccgaguagcugg

SEQ ID NO: 1636954 - RNA, 20 nt, Human
agccucccgaguagcuggga

SEQ ID NO: 1636955 - RNA, 22 nt, Human
agccucccgaguagcugggacu

SEQ ID NO: 1636956 - RNA, 21 nt, Human
agccgccaugcuccuggccca

SEQ ID NO: 1636957 - RNA, 13 nt, Human
agccgcuggggcc

SEQ ID NO: 1636958 - RNA, 20 nt, Human
agccagcaggcucucaggcc

SEQ ID NO: 1636959 - RNA, 19 nt, Human
agccagcaggcucucaggc

SEQ ID NO: 1636960 - RNA, 18 nt, Human
agccagcaggcucucagg

SEQ ID NO: 1636961 - RNA, 16 nt, Human
agccccauucugccug

SEQ ID NO: 1636962 - RNA, 13 nt, Human
agccccauucugc

SEQ ID NO: 1636963 - RNA, 17 nt, Human
agcccucacccuggggc

SEQ ID NO: 1636964 - RNA, 15 nt, Human
agccccagugcccac

SEQ ID NO: 1636965 - RNA, 14 nt, Human
agccccagugccca

SEQ ID NO: 1636966 - RNA, 13 nt, Human
agccccagugccc

SEQ ID NO: 1636967 - RNA, 21 nt, Human
agacugcauuauauuuauuac

SEQ ID NO: 1636968 - RNA, 17 nt, Human
agacuggaagcacagcu

SEQ ID NO: 1636969 - RNA, 19 nt, Human
agacuggaagcacagcuuc

SEQ ID NO: 1636970 - RNA, 17 nt, Human
agagaacuuccagaucc

SEQ ID NO: 1636971 - RNA, 21 nt, Human
agagaggguggugaccucugc

SEQ ID NO: 1636972 - RNA, 20 nt, Human
agagaggguggugaccucug

SEQ ID NO: 1636973 - RNA, 22 nt, Human
agagaggguggugaccucugcc

SEQ ID NO: 1636974 - RNA, 23 nt, Human
agagaggguggugaccucugccu

SEQ ID NO: 1636975 - RNA, 13 nt, Human
agagcccacgccc

SEQ ID NO: 1636976 - RNA, 19 nt, Human
agagcccaccuuggcucaa

SEQ ID NO: 1636977 - RNA, 16 nt, Human
agagcccacgccccca

SEQ ID NO: 1636978 - RNA, 17 nt, Human
agagcccacgcccccac

SEQ ID NO: 1636979 - RNA, 21 nt, Human
agacgcugugcugcccugccc

SEQ ID NO: 1636980 - RNA, 12 nt, Human
agacagcucuua

SEQ ID NO: 1636981 - RNA, 11 nt, Human
agacagcucuu

SEQ ID NO: 1636982 - RNA, 12 nt, Human
agacagcugccu

SEQ ID NO: 1636983 - RNA, 18 nt, Human
agacggagucccaccuug

SEQ ID NO: 1636984 - RNA, 22 nt, Human
agacgcugugcugcccugccca

SEQ ID NO: 1636985 - RNA, 15 nt, Human
agacagcccgggcuc

SEQ ID NO: 1636986 - RNA, 14 nt, Human
agacagcccgggcu

SEQ ID NO: 1636987 - RNA, 16 nt, Human
agacagcccgggcucu

SEQ ID NO: 1636988 - RNA, 21 nt, Human
agacagauacuccuccaaggu

SEQ ID NO: 1636989 - RNA, 22 nt, Human
agacagauacuccuccaagguu

SEQ ID NO: 1636990 - RNA, 15 nt, Human
agacagauacuccuc

SEQ ID NO: 1636991 - RNA, 14 nt, Human
agagcccaggccuc

SEQ ID NO: 1636992 - RNA, 13 nt, Human
agagcccaggccu

SEQ ID NO: 1636993 - RNA, 15 nt, Human
agagcccaggccucc

SEQ ID NO: 1636994 - RNA, 16 nt, Human
agaggaaggagaggag

SEQ ID NO: 1636995 - RNA, 16 nt, Human
agaggagagaggaccc

SEQ ID NO: 1636996 - RNA, 15 nt, Human
agaggagagaggacc

SEQ ID NO: 1636997 - RNA, 14 nt, Human
agaggacuuuucuu

SEQ ID NO: 1636998 - RNA, 22 nt, Human
agaggguggugaccucugccug

SEQ ID NO: 1636999 - RNA, 20 nt, Human
agaggguggugaccucugcc

SEQ ID NO: 1637000 - RNA, 12 nt, Human
agagggcacaga

SEQ ID NO: 1637001 - RNA, 14 nt, Human
agagugugccugaa

SEQ ID NO: 1637002 - RNA, 17 nt, Human
agaguguggcaaaauaa

SEQ ID NO: 1637003 - RNA, 13 nt, Human
agaguguugaaac

SEQ ID NO: 1637004 - RNA, 11 nt, Human
agagugggagc

SEQ ID NO: 1637005 - RNA, 23 nt, Human
agaggguggugaccucugccuga

SEQ ID NO: 1637006 - RNA, 19 nt, Human
agaguggcuccucccggug

SEQ ID NO: 1637007 - RNA, 19 nt, Human
agaguggggauaugauuua

SEQ ID NO: 1637008 - RNA, 23 nt, Human
agaguggcuccucccggugccca

SEQ ID NO: 1637009 - RNA, 19 nt, Human
agauauaugcucugcaugu

SEQ ID NO: 1637010 - RNA, 14 nt, Human
agauggcugugccu

SEQ ID NO: 1637011 - RNA, 17 nt, Human
aggcuagauguauguac

SEQ ID NO: 1637012 - RNA, 16 nt, Human
aggcuagauguaugua

SEQ ID NO: 1637013 - RNA, 15 nt, Human
aggcuagauguaugu

SEQ ID NO: 1637014 - RNA, 18 nt, Human
aggcuguaucccaugagc

SEQ ID NO: 1637015 - RNA, 13 nt, Human
aggcuguauccca

SEQ ID NO: 1637016 - RNA, 20 nt, Human
aggcugucaauuacaggaag

SEQ ID NO: 1637017 - RNA, 23 nt, Human
agggacagaggggguggccuccc

SEQ ID NO: 1637018 - RNA, 22 nt, Human
agggacagaggggguggccucc

SEQ ID NO: 1637019 - RNA, 21 nt, Human
aggcugucaauuacaggaagu

SEQ ID NO: 1637020 - RNA, 17 nt, Human
agggacgcuacccggga

SEQ ID NO: 1637021 - RNA, 21 nt, Human
aggcuagaaccaccugccuau

SEQ ID NO: 1637022 - RNA, 17 nt, Human
aggcuacugucagcucc

SEQ ID NO: 1637023 - RNA, 23 nt, Human
aggcuacuguaaggcaaucaugg

SEQ ID NO: 1637024 - RNA, 21 nt, Human
aggcgugagccaccgugccug

SEQ ID NO: 1637025 - RNA, 23 nt, Human
aggcccuucucuccagccccugg

SEQ ID NO: 1637026 - RNA, 22 nt, Human
aggcccuucucuccagccccug

SEQ ID NO: 1637027 - RNA, 19 nt, Human
aggcccuuccucuccacug

SEQ ID NO: 1637028 - RNA, 21 nt, Human
aggcccuucucuccagccccu

SEQ ID NO: 1637029 - RNA, 20 nt, Human
aggcccuucucuccagcccc

SEQ ID NO: 1637030 - RNA, 18 nt, Human
aggcccuuccucuccacu

SEQ ID NO: 1637031 - RNA, 17 nt, Human
aggcccuuccucuccac

SEQ ID NO: 1637032 - RNA, 15 nt, Human
aggcccuuccucucc

SEQ ID NO: 1637033 - RNA, 13 nt, Human
aggcccuuccucu

SEQ ID NO: 1637034 - RNA, 24 nt, Human
aggugcuacaaaaacacagcaagg

SEQ ID NO: 1637035 - RNA, 23 nt, Human
aggugcuacaaaaacacagcaag

SEQ ID NO: 1637036 - RNA, 22 nt, Human
aggugcuaggaacacuccuuca

SEQ ID NO: 1637037 - RNA, 19 nt, Human
aggugcuaggaacacuccu

SEQ ID NO: 1637038 - RNA, 23 nt, Human
aggugcuaggaacacuccuucac

SEQ ID NO: 1637039 - RNA, 15 nt, Human
agguuaauaaaguaa

SEQ ID NO: 1637040 - RNA, 23 nt, Human
agguucccuuugacgccauccca

SEQ ID NO: 1637041 - RNA, 22 nt, Human
agguucccuuugacgccauccc

SEQ ID NO: 1637042 - RNA, 14 nt, Human
agguucaaagauau

SEQ ID NO: 1637043 - RNA, 15 nt, Human
agguucaaagauauu

SEQ ID NO: 1637044 - RNA, 22 nt, Human
aggugcuacaaaaacacagcaa

SEQ ID NO: 1637045 - RNA, 21 nt, Human
aggugcuacaaaaacacagca

SEQ ID NO: 1637046 - RNA, 20 nt, Human
aggugcuacaaaaacacagc

SEQ ID NO: 1637047 - RNA, 19 nt, Human
aggugcuacaaaaacacag

SEQ ID NO: 1637048 - RNA, 18 nt, Human
aggugcuacaaaaacaca

SEQ ID NO: 1637049 - RNA, 22 nt, Human
aggucuguucuuuccaaaguac

SEQ ID NO: 1637050 - RNA, 23 nt, Human
aggucuguucuuuccaaaguaca

SEQ ID NO: 1637051 - RNA, 18 nt, Human
aggucuguucuuuccaaa

SEQ ID NO: 1637052 - RNA, 16 nt, Human
aggucccuaauaaagc

SEQ ID NO: 1637053 - RNA, 15 nt, Human
aggucccuaauaaag

SEQ ID NO: 1637054 - RNA, 13 nt, Human
aggucccuaauaa

SEQ ID NO: 1637055 - RNA, 20 nt, Human
agguaaaagcaucacaugaa

SEQ ID NO: 1637056 - RNA, 18 nt, Human
agguaaaucagacuauga

SEQ ID NO: 1637057 - RNA, 11 nt, Human
aggucccuaau

SEQ ID NO: 1637058 - RNA, 12 nt, Human
aggucccuaaua

SEQ ID NO: 1637059 - RNA, 17 nt, Human
agguacaaccuguucug

SEQ ID NO: 1637060 - RNA, 23 nt, Human
agguaaaucagacuaugaaguuu

SEQ ID NO: 1637061 - RNA, 21 nt, Human
agguaaucgaccugccucggc

SEQ ID NO: 1637062 - RNA, 11 nt, Human
agggucccugg

SEQ ID NO: 1637063 - RNA, 23 nt, Human
aggguccuggggaaccugacccc

SEQ ID NO: 1637064 - RNA, 21 nt, Human
aggguccuggggaaccugacc

SEQ ID NO: 1637065 - RNA, 15 nt, Human
aggguccuggggaac

SEQ ID NO: 1637066 - RNA, 12 nt, Human
aggguccugggg

SEQ ID NO: 1637067 - RNA, 21 nt, Human
aggggccucuuaugggcuggg

SEQ ID NO: 1637068 - RNA, 20 nt, Human
aggggccucuuaugggcugg

SEQ ID NO: 1637069 - RNA, 19 nt, Human
aggggccucuuaugggcug

SEQ ID NO: 1637070 - RNA, 15 nt, Human
aggguaucuggugac

SEQ ID NO: 1637071 - RNA, 21 nt, Human
aggguaucaggugcugccauc

SEQ ID NO: 1637072 - RNA, 19 nt, Human
aggguaucaggugcugcca

SEQ ID NO: 1637073 - RNA, 22 nt, Human
agcuccccucggagaagagcug

SEQ ID NO: 1637074 - RNA, 23 nt, Human
agcuccgcuuucuacccagcgag

SEQ ID NO: 1637075 - RNA, 21 nt, Human
agcuccgcuuucuacccagcg

SEQ ID NO: 1637076 - RNA, 20 nt, Human
agcuccgcuuucuacccagc

SEQ ID NO: 1637077 - RNA, 13 nt, Human
agcuccuucuguc

SEQ ID NO: 1637078 - RNA, 12 nt, Human
agcuccuucugu

SEQ ID NO: 1637079 - RNA, 23 nt, Human
agcugagauuauaggcaccuacc

SEQ ID NO: 1637080 - RNA, 23 nt, Human
agcugcgguccacccaggagccc

SEQ ID NO: 1637081 - RNA, 19 nt, Human
agcuucuguugcugccuca

SEQ ID NO: 1637082 - RNA, 23 nt, Human
aggaugguucccuugaugaagaa

SEQ ID NO: 1637083 - RNA, 16 nt, Human
aggauguucugggaca

SEQ ID NO: 1637084 - RNA, 15 nt, Human
aggauguucugggac

SEQ ID NO: 1637085 - RNA, 22 nt, Human
aggauguacaaggacagccccu

SEQ ID NO: 1637086 - RNA, 18 nt, Human
aggauguucugggacaca

SEQ ID NO: 1637087 - RNA, 14 nt, Human
aggauuaaauaaug

SEQ ID NO: 1637088 - RNA, 14 nt, Human
aggauuauuggaaa

SEQ ID NO: 1637089 - RNA, 20 nt, Human
aggauuaaauaauguaaaua

SEQ ID NO: 1637090 - RNA, 13 nt, Human
aggaccucaggug

SEQ ID NO: 1637091 - RNA, 21 nt, Human
aggaugcuuguacauaaugcg

SEQ ID NO: 1637092 - RNA, 23 nt, Human
aggaugcuuguacauaaugcgug

SEQ ID NO: 1637093 - RNA, 17 nt, Human
aggaauccagacccggc

SEQ ID NO: 1637094 - RNA, 21 nt, Human
aggaaucaugugccaagcaga

SEQ ID NO: 1637095 - RNA, 20 nt, Human
aggaauccagacccggcugc

SEQ ID NO: 1637096 - RNA, 21 nt, Human
agcuuuucccuuuuuuuaagu

SEQ ID NO: 1637097 - RNA, 20 nt, Human
agcuucuguugcugccucau

SEQ ID NO: 1637098 - RNA, 23 nt, Human
auguaauuaaguacuauguauca

SEQ ID NO: 1637099 - RNA, 19 nt, Human
auguaagggaaacugccag

SEQ ID NO: 1637100 - RNA, 17 nt, Human
auguaauuaaguacuau

SEQ ID NO: 1637101 - RNA, 15 nt, Human
auguaauuaaguacu

SEQ ID NO: 1637102 - RNA, 16 nt, Human
auguaagggaaacugc

SEQ ID NO: 1637103 - RNA, 14 nt, Human
auguaagggaaacu

SEQ ID NO: 1637104 - RNA, 15 nt, Human
auggucggaaaacau

SEQ ID NO: 1637105 - RNA, 19 nt, Human
auggucaccaaaucagcug

SEQ ID NO: 1637106 - RNA, 21 nt, Human
augguccgugcuaaggacuug

SEQ ID NO: 1637107 - RNA, 20 nt, Human
augguccgugcuaaggacuu

SEQ ID NO: 1637108 - RNA, 14 nt, Human
augucuuuucuugc

SEQ ID NO: 1637109 - RNA, 13 nt, Human
augucuuccugga

SEQ ID NO: 1637110 - RNA, 22 nt, Human
augugaaacuggauuaaacuua

SEQ ID NO: 1637111 - RNA, 14 nt, Human
augugaaaucauuc

SEQ ID NO: 1637112 - RNA, 15 nt, Human
augugaaacauguuu

SEQ ID NO: 1637113 - RNA, 23 nt, Human
augugaacaguuguguuugaagc

SEQ ID NO: 1637114 - RNA, 21 nt, Human
augugaacaguuguguuugaa

SEQ ID NO: 1637115 - RNA, 11 nt, Human
augugaacagu

SEQ ID NO: 1637116 - RNA, 13 nt, Human
auguucugggaca

SEQ ID NO: 1637117 - RNA, 19 nt, Human
auguuugccucugccucug

SEQ ID NO: 1637118 - RNA, 22 nt, Human
auguuugccucugccucugaca

SEQ ID NO: 1637119 - RNA, 17 nt, Human
auguucuaagaagugaa

SEQ ID NO: 1637120 - RNA, 18 nt, Human
augugggcagugauguca

SEQ ID NO: 1637121 - RNA, 20 nt, Human
augugggcuaguugggcuuc

SEQ ID NO: 1637122 - RNA, 13 nt, Human
augugugaaguga

SEQ ID NO: 1637123 - RNA, 12 nt, Human
auguucugggac

SEQ ID NO: 1637124 - RNA, 11 nt, Human
auguucuggga

SEQ ID NO: 1637125 - RNA, 16 nt, Human
auguucucucuucucc

SEQ ID NO: 1637126 - RNA, 17 nt, Human
augcacagaguuguuac

SEQ ID NO: 1637127 - RNA, 18 nt, Human
augcacagaguuguuaca

SEQ ID NO: 1637128 - RNA, 17 nt, Human
augcacaaacagaggcc

SEQ ID NO: 1637129 - RNA, 16 nt, Human
augcacaaacagaggc

SEQ ID NO: 1637130 - RNA, 16 nt, Human
augcacagaguuguua

SEQ ID NO: 1637131 - RNA, 19 nt, Human
augccucucucaggccaaa

SEQ ID NO: 1637132 - RNA, 16 nt, Human
augcaugaaguaauau

SEQ ID NO: 1637133 - RNA, 20 nt, Human
augcaugaaguaauaugcac

SEQ ID NO: 1637134 - RNA, 20 nt, Human
augcauauuauuuuauguug

SEQ ID NO: 1637135 - RNA, 16 nt, Human
augcauauuauuuuau

SEQ ID NO: 1637136 - RNA, 17 nt, Human
augaugccaugaggaac

SEQ ID NO: 1637137 - RNA, 16 nt, Human
augaugccaugaggaa

SEQ ID NO: 1637138 - RNA, 24 nt, Human
augauguuuuccaugaguccccug

SEQ ID NO: 1637139 - RNA, 15 nt, Human
augcacaaacagagg

SEQ ID NO: 1637140 - RNA, 11 nt, Human
augcugcccug

SEQ ID NO: 1637141 - RNA, 16 nt, Human
augcucuuuacuucau

SEQ ID NO: 1637142 - RNA, 15 nt, Human
auggauuuccagcca

SEQ ID NO: 1637143 - RNA, 22 nt, Human
auggaggaaaaccaagccgugg

SEQ ID NO: 1637144 - RNA, 12 nt, Human
augcugcccugu

SEQ ID NO: 1637145 - RNA, 12 nt, Human
augcuuguacau

SEQ ID NO: 1637146 - RNA, 13 nt, Human
augcuuguacaua

SEQ ID NO: 1637147 - RNA, 14 nt, Human
augcuuguacauaa

SEQ ID NO: 1637148 - RNA, 20 nt, Human
auggcugugccucugccugu

SEQ ID NO: 1637149 - RNA, 19 nt, Human
auggcugugccucugccug

SEQ ID NO: 1637150 - RNA, 23 nt, Human
aucagcugcugaaacaacaaaua

SEQ ID NO: 1637151 - RNA, 22 nt, Human
aucagcugcugaaacaacaaau

SEQ ID NO: 1637152 - RNA, 15 nt, Human
aucaugugaaaucau

SEQ ID NO: 1637153 - RNA, 16 nt, Human
aucaugugaaaucauu

SEQ ID NO: 1637154 - RNA, 21 nt, Human
aucagcugcugaaacaacaaa

SEQ ID NO: 1637155 - RNA, 18 nt, Human
aucagccugcuccagcug

SEQ ID NO: 1637156 - RNA, 17 nt, Human
aucagccugcuccagcu

SEQ ID NO: 1637157 - RNA, 19 nt, Human
aucagccugcuccagcugu

SEQ ID NO: 1637158 - RNA, 20 nt, Human
aucagccugcuccagcuguu

SEQ ID NO: 1637159 - RNA, 21 nt, Human
aucaccgaaaacguggcugcu

SEQ ID NO: 1637160 - RNA, 19 nt, Human
aucaccgaaaacguggcug

SEQ ID NO: 1637161 - RNA, 14 nt, Human
aucaccgaaaacgu

SEQ ID NO: 1637162 - RNA, 19 nt, Human
aucagcacgauuucuguuu

SEQ ID NO: 1637163 - RNA, 20 nt, Human
aucagcacgauuucuguuua

SEQ ID NO: 1637164 - RNA, 23 nt, Human
aucagcacgauuucuguuuagau

SEQ ID NO: 1637165 - RNA, 15 nt, Human
auauuuauuuuaaua

SEQ ID NO: 1637166 - RNA, 14 nt, Human
auauuuauuuuaau

SEQ ID NO: 1637167 - RNA, 17 nt, Human
auauuuauuuuaauaau

SEQ ID NO: 1637168 - RNA, 20 nt, Human
aucaccaacgucugugccau

SEQ ID NO: 1637169 - RNA, 19 nt, Human
aucaccaacgucugugcca

SEQ ID NO: 1637170 - RNA, 18 nt, Human
aucaccaacgucugugcc

SEQ ID NO: 1637171 - RNA, 15 nt, Human
aucacauguggacuu

SEQ ID NO: 1637172 - RNA, 21 nt, Human
aucacagccucugaaaaccaa

SEQ ID NO: 1637173 - RNA, 19 nt, Human
auccucccaccucagccuc

SEQ ID NO: 1637174 - RNA, 18 nt, Human
auccucccaccucagccu

SEQ ID NO: 1637175 - RNA, 20 nt, Human
auccucccaccucagccucc

SEQ ID NO: 1637176 - RNA, 12 nt, Human
auccucccaggc

SEQ ID NO: 1637177 - RNA, 15 nt, Human
auccucccaccucag

SEQ ID NO: 1637178 - RNA, 13 nt, Human
auccuccaggugc

SEQ ID NO: 1637179 - RNA, 23 nt, Human
auccuccaggugcacaagcucca

SEQ ID NO: 1637180 - RNA, 11 nt, Human
auccuccaggu

SEQ ID NO: 1637181 - RNA, 15 nt, Human
auccccuguagagug

SEQ ID NO: 1637182 - RNA, 16 nt, Human
auccccaagccuggca

SEQ ID NO: 1637183 - RNA, 15 nt, Human
aucccauuuaaaaaa

SEQ ID NO: 1637184 - RNA, 13 nt, Human
auccccaagccug

SEQ ID NO: 1637185 - RNA, 14 nt, Human
aucccauuuaaaaa

SEQ ID NO: 1637186 - RNA, 15 nt, Human
auccagacccggcug

SEQ ID NO: 1637187 - RNA, 18 nt, Human
auccagaaagaaaacuug

SEQ ID NO: 1637188 - RNA, 16 nt, Human
auccagaaagaaaacu

SEQ ID NO: 1637189 - RNA, 14 nt, Human
aucuucuuuauaau

SEQ ID NO: 1637190 - RNA, 18 nt, Human
aucuugaagacuuuucuu

SEQ ID NO: 1637191 - RNA, 17 nt, Human
aucuugaauuguaagga

SEQ ID NO: 1637192 - RNA, 18 nt, Human
aucuugaauaauguaaga

SEQ ID NO: 1637193 - RNA, 22 nt, Human
aucugcuuuuuaaagaaugcuc

SEQ ID NO: 1637194 - RNA, 22 nt, Human
aucuggacuccucuguccaggc

SEQ ID NO: 1637195 - RNA, 19 nt, Human
aucuggacuccucugucca

SEQ ID NO: 1637196 - RNA, 18 nt, Human
aucuggacuccucugucc

SEQ ID NO: 1637197 - RNA, 17 nt, Human
aucuggacuccucuguc

SEQ ID NO: 1637198 - RNA, 16 nt, Human
aucuggacuccucugu

SEQ ID NO: 1637199 - RNA, 15 nt, Human
aucuggacuccucug

SEQ ID NO: 1637200 - RNA, 17 nt, Human
aucucugcuuuggaaau

SEQ ID NO: 1637201 - RNA, 16 nt, Human
aucucggcucacugca

SEQ ID NO: 1637202 - RNA, 15 nt, Human
aucucggcucacugc

SEQ ID NO: 1637203 - RNA, 14 nt, Human
aucucggcucacug

SEQ ID NO: 1637204 - RNA, 21 nt, Human
aucuauauuuuacauaaauuu

SEQ ID NO: 1637205 - RNA, 17 nt, Human
aucuauauuuuacauaa

SEQ ID NO: 1637206 - RNA, 14 nt, Human
aucuauauuuuaca

SEQ ID NO: 1637207 - RNA, 19 nt, Human
augaaagacuguacaaagu

SEQ ID NO: 1637208 - RNA, 17 nt, Human
augaaagacuguacaaa

SEQ ID NO: 1637209 - RNA, 16 nt, Human
augaaagacuguacaa

SEQ ID NO: 1637210 - RNA, 13 nt, Human
augaaagacugua

SEQ ID NO: 1637211 - RNA, 22 nt, Human
augaagcuuuuaugugaaacau

SEQ ID NO: 1637212 - RNA, 19 nt, Human
augaaguuuuuuuuauaca

SEQ ID NO: 1637213 - RNA, 23 nt, Human
augaccuuucaauaggaaaaacu

SEQ ID NO: 1637214 - RNA, 22 nt, Human
augaccuuucaauaggaaaaac

SEQ ID NO: 1637215 - RNA, 21 nt, Human
augaccuuucaauaggaaaaa

SEQ ID NO: 1637216 - RNA, 23 nt, Human
augaaguuuuuuuuauacaggau

SEQ ID NO: 1637217 - RNA, 14 nt, Human
auagucaaauugug

SEQ ID NO: 1637218 - RNA, 18 nt, Human
auaguaugguggcugggu

SEQ ID NO: 1637219 - RNA, 17 nt, Human
auaguaugguggcuggg

SEQ ID NO: 1637220 - RNA, 15 nt, Human
auagguuuaauaauu

SEQ ID NO: 1637221 - RNA, 18 nt, Human
auagguuuggacaaaaug

SEQ ID NO: 1637222 - RNA, 14 nt, Human
auagguuuggacaa

SEQ ID NO: 1637223 - RNA, 21 nt, Human
auaggugcuacaaaaacacag

SEQ ID NO: 1637224 - RNA, 15 nt, Human
auaggugcuacaaaa

SEQ ID NO: 1637225 - RNA, 23 nt, Human
auaggugcuacaaaaacacagca

SEQ ID NO: 1637226 - RNA, 14 nt, Human
auaggugcuacaaa

SEQ ID NO: 1637227 - RNA, 21 nt, Human
auagguauaaguggugugugu

SEQ ID NO: 1637228 - RNA, 21 nt, Human
auagccaaggccaaaggaagc

SEQ ID NO: 1637229 - RNA, 15 nt, Human
auagccaaggccaaa

SEQ ID NO: 1637230 - RNA, 23 nt, Human
auauuaugaagcuuuuaugugaa

SEQ ID NO: 1637231 - RNA, 13 nt, Human
auauuuauuuuaa

SEQ ID NO: 1637232 - RNA, 19 nt, Human
auauuuacuucuuauacau

SEQ ID NO: 1637233 - RNA, 20 nt, Human
auauuuacuaaaauggacug

SEQ ID NO: 1637234 - RNA, 18 nt, Human
auauuuacuaaaauggac

SEQ ID NO: 1637235 - RNA, 14 nt, Human
auauuauuuuaugu

SEQ ID NO: 1637236 - RNA, 22 nt, Human
auaugcuucuguuuuauaauuu

SEQ ID NO: 1637237 - RNA, 20 nt, Human
auaugcuucuguuuuauaau

SEQ ID NO: 1637238 - RNA, 23 nt, Human
auaugcuauuucuauauuuucau

SEQ ID NO: 1637239 - RNA, 22 nt, Human
auaugcuauuucuauauuuuca

SEQ ID NO: 1637240 - RNA, 22 nt, Human
auauuaccacagacauacuaac

SEQ ID NO: 1637241 - RNA, 15 nt, Human
auaugcuauuucuau

SEQ ID NO: 1637242 - RNA, 21 nt, Human
auaugcuauuucuauauuuuc

SEQ ID NO: 1637243 - RNA, 19 nt, Human
auaugcuauuucuauauuu

SEQ ID NO: 1637244 - RNA, 18 nt, Human
auaugcuauuucuauauu

SEQ ID NO: 1637245 - RNA, 16 nt, Human
auaugcuauuucuaua

SEQ ID NO: 1637246 - RNA, 15 nt, Human
auaucaauuuaaaaa

SEQ ID NO: 1637247 - RNA, 19 nt, Human
auauauuuuuuucugaaau

SEQ ID NO: 1637248 - RNA, 16 nt, Human
auaucaaauauauuca

SEQ ID NO: 1637249 - RNA, 17 nt, Human
auaauuaacauguuaaa

SEQ ID NO: 1637250 - RNA, 15 nt, Human
auaauuaacauguua

SEQ ID NO: 1637251 - RNA, 23 nt, Human
auaauguuucaaacauauauaac

SEQ ID NO: 1637252 - RNA, 15 nt, Human
auaauguaagcucua

SEQ ID NO: 1637253 - RNA, 20 nt, Human
auacacacucaaaucaagaa

SEQ ID NO: 1637254 - RNA, 18 nt, Human
auacacacucaaaucaag

SEQ ID NO: 1637255 - RNA, 17 nt, Human
auacacacucaaaucaa

SEQ ID NO: 1637256 - RNA, 21 nt, Human
auacaccacuacauucuguua

SEQ ID NO: 1637257 - RNA, 19 nt, Human
auacaccacuacauucugu

SEQ ID NO: 1637258 - RNA, 20 nt, Human
auacaccacuacauucuguu

SEQ ID NO: 1637259 - RNA, 21 nt, Human
auaaugcgugcauaccacuuu

SEQ ID NO: 1637260 - RNA, 15 nt, Human
auaaggaaaaguuua

SEQ ID NO: 1637261 - RNA, 16 nt, Human
auaaggaaaaguuuaa

SEQ ID NO: 1637262 - RNA, 18 nt, Human
auaccugucccccugaca

SEQ ID NO: 1637263 - RNA, 11 nt, Human
auacccacccc

SEQ ID NO: 1637264 - RNA, 12 nt, Human
auacccaccccc

SEQ ID NO: 1637265 - RNA, 17 nt, Human
auaaaacuuuuuaaaau

SEQ ID NO: 1637266 - RNA, 21 nt, Human
auaaacuuuaccuuuuuuaua

SEQ ID NO: 1637267 - RNA, 24 nt, Human
auaaacuuuaccuuuuuuauacau

SEQ ID NO: 1637268 - RNA, 20 nt, Human
auaaacuuuuuucuuacugu

SEQ ID NO: 1637269 - RNA, 15 nt, Human
auaaaacuuuuuaaa

SEQ ID NO: 1637270 - RNA, 11 nt, Human
auaaaacuuuu

SEQ ID NO: 1637271 - RNA, 14 nt, Human
auaaagcagcguuu

SEQ ID NO: 1637272 - RNA, 18 nt, Human
auaaagcagcguuucuau

SEQ ID NO: 1637273 - RNA, 19 nt, Human
auaaagcagcguuucuaug

SEQ ID NO: 1637274 - RNA, 20 nt, Human
auaaagcagcguuucuauga

SEQ ID NO: 1637275 - RNA, 13 nt, Human
auaaagcagcguu

SEQ ID NO: 1637276 - RNA, 12 nt, Human
auaaagacaccu

SEQ ID NO: 1637277 - RNA, 18 nt, Human
auaaagcuguguggcagu

SEQ ID NO: 1637278 - RNA, 15 nt, Human
auaaagcaggcagaa

SEQ ID NO: 1637279 - RNA, 18 nt, Human
auaaaggauuaaugucaa

SEQ ID NO: 1637280 - RNA, 15 nt, Human
auaacauaaaucugu

SEQ ID NO: 1637281 - RNA, 14 nt, Human
auaacauaaaucug

SEQ ID NO: 1637282 - RNA, 19 nt, Human
auaacauaaaucugugaac

SEQ ID NO: 1637283 - RNA, 18 nt, Human
auaacauaaaucugugaa

SEQ ID NO: 1637284 - RNA, 17 nt, Human
auaacauaaaucuguga

SEQ ID NO: 1637285 - RNA, 16 nt, Human
aguaucuuuuuauuca

SEQ ID NO: 1637286 - RNA, 16 nt, Human
aguaugaauaaagaca

SEQ ID NO: 1637287 - RNA, 15 nt, Human
aguaugaggcauuug

SEQ ID NO: 1637288 - RNA, 16 nt, Human
aguaugaggcauuugu

SEQ ID NO: 1637289 - RNA, 17 nt, Human
aguaugaggcauuuguu

SEQ ID NO: 1637290 - RNA, 15 nt, Human
aguaucuugaagacu

SEQ ID NO: 1637291 - RNA, 12 nt, Human
aguaucuugaag

SEQ ID NO: 1637292 - RNA, 11 nt, Human
aguaucuugaa

SEQ ID NO: 1637293 - RNA, 19 nt, Human
agucaaauugugugaaagg

SEQ ID NO: 1637294 - RNA, 23 nt, Human
agucaaauugugugaaagguacu

SEQ ID NO: 1637295 - RNA, 14 nt, Human
aguaugguggcugg

SEQ ID NO: 1637296 - RNA, 20 nt, Human
aguaugggacuggccucugc

SEQ ID NO: 1637297 - RNA, 17 nt, Human
aguaugggacuggccuc

SEQ ID NO: 1637298 - RNA, 12 nt, Human
aguccuguaaug

SEQ ID NO: 1637299 - RNA, 15 nt, Human
agucugaaggcuggg

SEQ ID NO: 1637300 - RNA, 13 nt, Human
agucugaaggcug

SEQ ID NO: 1637301 - RNA, 16 nt, Human
agucugaaggcugggu

SEQ ID NO: 1637302 - RNA, 17 nt, Human
agucugaaggcuggguu

SEQ ID NO: 1637303 - RNA, 21 nt, Human
aguccuggcaugggaaugaau

SEQ ID NO: 1637304 - RNA, 20 nt, Human
aguccuggcaugggaaugaa

SEQ ID NO: 1637305 - RNA, 22 nt, Human
aguccuggcaugggaaugaaug

SEQ ID NO: 1637306 - RNA, 18 nt, Human
agucuggaaugcaguggu

SEQ ID NO: 1637307 - RNA, 17 nt, Human
agucuggaaugcagugg

SEQ ID NO: 1637308 - RNA, 18 nt, Human
agucugauucccaagcuc

SEQ ID NO: 1637309 - RNA, 16 nt, Human
agucugauucccaagc

SEQ ID NO: 1637310 - RNA, 20 nt, Human
agucugauucccaagcucug

SEQ ID NO: 1637311 - RNA, 14 nt, Human
agugaagacaauga

SEQ ID NO: 1637312 - RNA, 16 nt, Human
agugaagacaaugacu

SEQ ID NO: 1637313 - RNA, 18 nt, Human
agugaccauacuaauuau

SEQ ID NO: 1637314 - RNA, 22 nt, Human
aguugaaaaucuuauaauuuaa

SEQ ID NO: 1637315 - RNA, 19 nt, Human
aguucagguaacaggcaga

SEQ ID NO: 1637316 - RNA, 17 nt, Human
aguuacagacaaagcgu

SEQ ID NO: 1637317 - RNA, 20 nt, Human
aguucagguaacaggcagau

SEQ ID NO: 1637318 - RNA, 12 nt, Human
aguuaaauaaau

SEQ ID NO: 1637319 - RNA, 13 nt, Human
aguuaagccuuug

SEQ ID NO: 1637320 - RNA, 14 nt, Human
aguuaagccuuugg

SEQ ID NO: 1637321 - RNA, 16 nt, Human
aguuacagacaaagcg

SEQ ID NO: 1637322 - RNA, 14 nt, Human
aguuacagacaaag

SEQ ID NO: 1637323 - RNA, 22 nt, Human
aguugaaaagacuccaaagaaa

SEQ ID NO: 1637324 - RNA, 23 nt, Human
aguugaaaaucuuauaauuuaaa

SEQ ID NO: 1637325 - RNA, 14 nt, Human
aguugaagacagag

SEQ ID NO: 1637326 - RNA, 16 nt, Human
aguuguguuugaagca

SEQ ID NO: 1637327 - RNA, 20 nt, Human
aguuguuugauucagacagc

SEQ ID NO: 1637328 - RNA, 15 nt, Human
agugucuuaauuaaa

SEQ ID NO: 1637329 - RNA, 17 nt, Human
aguguauuuuuuuacua

SEQ ID NO: 1637330 - RNA, 18 nt, Human
aguguauuuuuuuacuaa

SEQ ID NO: 1637331 - RNA, 14 nt, Human
agugggagcugccu

SEQ ID NO: 1637332 - RNA, 15 nt, Human
agugggagcugccug

SEQ ID NO: 1637333 - RNA, 16 nt, Human
agugggagcugccugu

SEQ ID NO: 1637334 - RNA, 23 nt, Human
aguggcuuaaaacaacacucaca

SEQ ID NO: 1637335 - RNA, 21 nt, Human
aguggcuccucccggugccca

SEQ ID NO: 1637336 - RNA, 17 nt, Human
aguggcuccucccggug

SEQ ID NO: 1637337 - RNA, 13 nt, Human
aguggcuccuccc

SEQ ID NO: 1637338 - RNA, 18 nt, Human
agugucuuaauuaaaaga

SEQ ID NO: 1637339 - RNA, 17 nt, Human
agugucuuaauuaaaag

SEQ ID NO: 1637340 - RNA, 21 nt, Human
agugucuuaauuaaaagaaua

SEQ ID NO: 1637341 - RNA, 22 nt, Human
gcuuccucauaguaugguggcu

SEQ ID NO: 1637342 - RNA, 20 nt, Human
gcuuguaaauagcucaggug

SEQ ID NO: 1637343 - RNA, 14 nt, Human
gcuugagcucagga

SEQ ID NO: 1637344 - RNA, 12 nt, Human
gcuuguacauaa

SEQ ID NO: 1637345 - RNA, 17 nt, Human
gcuucacggaagagccu

SEQ ID NO: 1637346 - RNA, 21 nt, Human
gcuucaaggauccugagccag

SEQ ID NO: 1637347 - RNA, 20 nt, Human
gcuucaaggauccugagcca

SEQ ID NO: 1637348 - RNA, 19 nt, Human
gcuucaaggauccugagcc

SEQ ID NO: 1637349 - RNA, 12 nt, Human
gcuucagccucc

SEQ ID NO: 1637350 - RNA, 18 nt, Human
gcuucacggaagagccuu

SEQ ID NO: 1637351 - RNA, 19 nt, Human
gcuucacggaagagccuug

SEQ ID NO: 1637352 - RNA, 23 nt, Human
gcuggguggcaccagcagccugg

SEQ ID NO: 1637353 - RNA, 22 nt, Human
gcuggguggcaccagcagccug

SEQ ID NO: 1637354 - RNA, 21 nt, Human
gcuggguggcaccagcagccu

SEQ ID NO: 1637355 - RNA, 17 nt, Human
gcuggcuguuggcuggg

SEQ ID NO: 1637356 - RNA, 16 nt, Human
gcuggcuguuggcugg

SEQ ID NO: 1637357 - RNA, 15 nt, Human
gcuggcuguuggcug

SEQ ID NO: 1637358 - RNA, 12 nt, Human
gcugggcucccu

SEQ ID NO: 1637359 - RNA, 14 nt, Human
gcugggguuaucug

SEQ ID NO: 1637360 - RNA, 23 nt, Human
gcugggguuaucugaagucagau

SEQ ID NO: 1637361 - RNA, 22 nt, Human
gcugggguuaucugaagucaga

SEQ ID NO: 1637362 - RNA, 12 nt, Human
gcugggucgccc

SEQ ID NO: 1637363 - RNA, 23 nt, Human
gcugggccccugccucucugcag

SEQ ID NO: 1637364 - RNA, 22 nt, Human
gcugggccccugccucucugca

SEQ ID NO: 1637365 - RNA, 21 nt, Human
gcugggccccugccucucugc

SEQ ID NO: 1637366 - RNA, 20 nt, Human
gcuggccuggccccucaggg

SEQ ID NO: 1637367 - RNA, 22 nt, Human
gcuggagugcagugagccgaga

SEQ ID NO: 1637368 - RNA, 17 nt, Human
gcuggagugcagugagc

SEQ ID NO: 1637369 - RNA, 18 nt, Human
gcuggagugcagugagcc

SEQ ID NO: 1637370 - RNA, 13 nt, Human
gcugcuggcuggu

SEQ ID NO: 1637371 - RNA, 18 nt, Human
gcugcugaaggcucgagc

SEQ ID NO: 1637372 - RNA, 15 nt, Human
gcugcugaaggcucg

SEQ ID NO: 1637373 - RNA, 14 nt, Human
gcugcugaaggcuc

SEQ ID NO: 1637374 - RNA, 13 nt, Human
gcugcugaaggcu

SEQ ID NO: 1637375 - RNA, 23 nt, Human
gcucugguccauagagagcaaga

SEQ ID NO: 1637376 - RNA, 16 nt, Human
gcucugguccauagag

SEQ ID NO: 1637377 - RNA, 15 nt, Human
gcucugguccauaga

SEQ ID NO: 1637378 - RNA, 13 nt, Human
gcucugcccuugg

SEQ ID NO: 1637379 - RNA, 14 nt, Human
ggaacacucugaga

SEQ ID NO: 1637380 - RNA, 12 nt, Human
ggaacacucuga

SEQ ID NO: 1637381 - RNA, 16 nt, Human
ggaacacucugagacu

SEQ ID NO: 1637382 - RNA, 15 nt, Human
ggaacacucugagac

SEQ ID NO: 1637383 - RNA, 17 nt, Human
ggaacagacuggaagca

SEQ ID NO: 1637384 - RNA, 13 nt, Human
ggaagagaaaaaa

SEQ ID NO: 1637385 - RNA, 18 nt, Human
ggaagacuuuggaaagag

SEQ ID NO: 1637386 - RNA, 15 nt, Human
ggaagagaaaaaaua

SEQ ID NO: 1637387 - RNA, 14 nt, Human
ggaagacagcucuu

SEQ ID NO: 1637388 - RNA, 13 nt, Human
ggaagacagcucu

SEQ ID NO: 1637389 - RNA, 17 nt, Human
ggaagacuuuggaaaga

SEQ ID NO: 1637390 - RNA, 13 nt, Human
ggaagacuuugga

SEQ ID NO: 1637391 - RNA, 15 nt, Human
ggaagccgcuggggc

SEQ ID NO: 1637392 - RNA, 23 nt, Human
ggaagcucagggccuggcucagg

SEQ ID NO: 1637393 - RNA, 15 nt, Human
ggaagcucagggccu

SEQ ID NO: 1637394 - RNA, 11 nt, Human
ggaagcuccgc

SEQ ID NO: 1637395 - RNA, 16 nt, Human
ggaaggaaacccagcu

SEQ ID NO: 1637396 - RNA, 20 nt, Human
ggaaggaaacccagcucugg

SEQ ID NO: 1637397 - RNA, 19 nt, Human
ggaaggaaacccagcucug

SEQ ID NO: 1637398 - RNA, 20 nt, Human
ggacagcuccuucuguccua

SEQ ID NO: 1637399 - RNA, 19 nt, Human
ggacagcuccuucuguccu

SEQ ID NO: 1637400 - RNA, 22 nt, Human
ggacacuaaccacgcuggaccu

SEQ ID NO: 1637401 - RNA, 17 nt, Human
ggacacuaaccacgcug

SEQ ID NO: 1637402 - RNA, 18 nt, Human
ggacacagcucuucucca

SEQ ID NO: 1637403 - RNA, 15 nt, Human
ggacacagcucuucu

SEQ ID NO: 1637404 - RNA, 21 nt, Human
ggacacagcucuucuccaggc

SEQ ID NO: 1637405 - RNA, 19 nt, Human
ggacaaggacuaggguccu

SEQ ID NO: 1637406 - RNA, 18 nt, Human
ggaauaacauguaauuaa

SEQ ID NO: 1637407 - RNA, 16 nt, Human
ggaauccagacccggc

SEQ ID NO: 1637408 - RNA, 23 nt, Human
ggacaaggaugaucuaggaagac

SEQ ID NO: 1637409 - RNA, 22 nt, Human
ggacaaggaugaucuaggaaga

SEQ ID NO: 1637410 - RNA, 13 nt, Human
ggacaagagcagg

SEQ ID NO: 1637411 - RNA, 19 nt, Human
ggaaugaagauacugaaau

SEQ ID NO: 1637412 - RNA, 18 nt, Human
ggaaugaagcaaugcuuc

SEQ ID NO: 1637413 - RNA, 23 nt, Human
ggacaggcauguucucugaggac

SEQ ID NO: 1637414 - RNA, 22 nt, Human
ggacucauuuuaaaaaauggaa

SEQ ID NO: 1637415 - RNA, 18 nt, Human
ggacucaaugcacugaca

SEQ ID NO: 1637416 - RNA, 16 nt, Human
ggacucaaugcacuga

SEQ ID NO: 1637417 - RNA, 20 nt, Human
ggacuaacuugucuuuggac

SEQ ID NO: 1637418 - RNA, 14 nt, Human
ggacuacaggugug

SEQ ID NO: 1637419 - RNA, 24 nt, Human
ggacuaacuugucuuuggacccug

SEQ ID NO: 1637420 - RNA, 15 nt, Human
ggacucaaugcacug

SEQ ID NO: 1637421 - RNA, 13 nt, Human
ggagaaacuggaa

SEQ ID NO: 1637422 - RNA, 16 nt, Human
ggagaaaggaagggcu

SEQ ID NO: 1637423 - RNA, 9 nt, Human
ggacuuugu

SEQ ID NO: 1637424 - RNA, 18 nt, Human
ggagaaaugaaaaaauau

SEQ ID NO: 1637425 - RNA, 14 nt, Human
ggacuuggaagcuc

SEQ ID NO: 1637426 - RNA, 15 nt, Human
ggacuuguuagaucu

SEQ ID NO: 1637427 - RNA, 21 nt, Human
ggacuucuuuaauuuuggaau

SEQ ID NO: 1637428 - RNA, 22 nt, Human
ggacuucuuuaauuuuggaauu

SEQ ID NO: 1637429 - RNA, 12 nt, Human
ggacccccugaa

SEQ ID NO: 1637430 - RNA, 11 nt, Human
ggacccugagg

SEQ ID NO: 1637431 - RNA, 20 nt, Human
ggacguguuaugacuccaga

SEQ ID NO: 1637432 - RNA, 15 nt, Human
ggaccucaggccugg

SEQ ID NO: 1637433 - RNA, 14 nt, Human
ggaccucaggccug

SEQ ID NO: 1637434 - RNA, 20 nt, Human
ggaccucaggccugggggcu

SEQ ID NO: 1637435 - RNA, 13 nt, Human
ggaccucaggccu

SEQ ID NO: 1637436 - RNA, 13 nt, Human
ggacccugaggcc

SEQ ID NO: 1637437 - RNA, 12 nt, Human
ggacccugaggc

SEQ ID NO: 1637438 - RNA, 12 nt, Human
gcccccacuggu

SEQ ID NO: 1637439 - RNA, 16 nt, Human
gccccugccacccugg

SEQ ID NO: 1637440 - RNA, 17 nt, Human
gccccugccacccuggg

SEQ ID NO: 1637441 - RNA, 15 nt, Human
gcccucacccugggg

SEQ ID NO: 1637442 - RNA, 23 nt, Human
gcccuaaugcgcaggcuggcccu

SEQ ID NO: 1637443 - RNA, 20 nt, Human
gcccuaaugcgcaggcuggc

SEQ ID NO: 1637444 - RNA, 19 nt, Human
gcccuaaugcgcaggcugg

SEQ ID NO: 1637445 - RNA, 17 nt, Human
gcccuaaugcgcaggcu

SEQ ID NO: 1637446 - RNA, 16 nt, Human
gcccuaaugcgcaggc

SEQ ID NO: 1637447 - RNA, 23 nt, Human
gcccgggcucugccucccaucac

SEQ ID NO: 1637448 - RNA, 23 nt, Human
gccccugccucucugcagguccc

SEQ ID NO: 1637449 - RNA, 20 nt, Human
gccccugccucucugcaggu

SEQ ID NO: 1637450 - RNA, 20 nt, Human
gccuaggugacagagugaga

SEQ ID NO: 1637451 - RNA, 15 nt, Human
gccuaggugacagag

SEQ ID NO: 1637452 - RNA, 14 nt, Human
gccuaggugacaga

SEQ ID NO: 1637453 - RNA, 13 nt, Human
gccuaggugacag

SEQ ID NO: 1637454 - RNA, 20 nt, Human
gccuagcauacguacacauu

SEQ ID NO: 1637455 - RNA, 21 nt, Human
gccuagcauacguacacauuu

SEQ ID NO: 1637456 - RNA, 22 nt, Human
gccuagcauacguacacauuuu

SEQ ID NO: 1637457 - RNA, 23 nt, Human
gccuagcauacguacacauuuua

SEQ ID NO: 1637458 - RNA, 18 nt, Human
gcccugcagagggcacag

SEQ ID NO: 1637459 - RNA, 22 nt, Human
gcccugcccaccuggccucugc

SEQ ID NO: 1637460 - RNA, 21 nt, Human
gcccugcccaccuggccucug

SEQ ID NO: 1637461 - RNA, 20 nt, Human
gcccugcccaccuggccucu

SEQ ID NO: 1637462 - RNA, 17 nt, Human
gcccugcccaccuggcc

SEQ ID NO: 1637463 - RNA, 11 nt, Human
gcccugccucc

SEQ ID NO: 1637464 - RNA, 16 nt, Human
gcccugcccugguuuc

SEQ ID NO: 1637465 - RNA, 12 nt, Human
gcccugcccugg

SEQ ID NO: 1637466 - RNA, 11 nt, Human
gcccugcccug

SEQ ID NO: 1637467 - RNA, 13 nt, Human
gcccugccuccuu

SEQ ID NO: 1637468 - RNA, 12 nt, Human
gcccugccuccu

SEQ ID NO: 1637469 - RNA, 14 nt, Human
gcccugccuccuuu

SEQ ID NO: 1637470 - RNA, 18 nt, Human
gcccugcccugguuuccu

SEQ ID NO: 1637471 - RNA, 20 nt, Human
gcccuuagcagggaaacagc

SEQ ID NO: 1637472 - RNA, 22 nt, Human
gcccuguccugccuaaggcuga

SEQ ID NO: 1637473 - RNA, 20 nt, Human
gccgcagcccugcagagggc

SEQ ID NO: 1637474 - RNA, 22 nt, Human
gcccuuagcagggaaacagcua

SEQ ID NO: 1637475 - RNA, 17 nt, Human
gccugcccaggccccug

SEQ ID NO: 1637476 - RNA, 15 nt, Human
gccugcccaggcccc

SEQ ID NO: 1637477 - RNA, 22 nt, Human
gccugcccaggccccugccacc

SEQ ID NO: 1637478 - RNA, 12 nt, Human
gccuccauccug

SEQ ID NO: 1637479 - RNA, 17 nt, Human
gccucccaaagugcugg

SEQ ID NO: 1637480 - RNA, 16 nt, Human
gccucccaaagugcug

SEQ ID NO: 1637481 - RNA, 23 nt, Human
gccuccugugugugcgccuacag

SEQ ID NO: 1637482 - RNA, 19 nt, Human
gccuccugugugugcgccu

SEQ ID NO: 1637483 - RNA, 17 nt, Human
gccucgaacuggcugca

SEQ ID NO: 1637484 - RNA, 15 nt, Human
gccucuuagaugcag

SEQ ID NO: 1637485 - RNA, 16 nt, Human
gccucuuaugggcugg

SEQ ID NO: 1637486 - RNA, 18 nt, Human
gccucuuaugggcugggu

SEQ ID NO: 1637487 - RNA, 17 nt, Human
gccucuuaugggcuggg

SEQ ID NO: 1637488 - RNA, 22 nt, Human
gccucgaacuggcugcaaaggg

SEQ ID NO: 1637489 - RNA, 20 nt, Human
gccucgaacuggcugcaaag

SEQ ID NO: 1637490 - RNA, 14 nt, Human
gccugcccaggccc

SEQ ID NO: 1637491 - RNA, 13 nt, Human
gccugcccaggcc

SEQ ID NO: 1637492 - RNA, 21 nt, Human
gccucuuaugggcuggguucu

SEQ ID NO: 1637493 - RNA, 14 nt, Human
gccucuuggguuca

SEQ ID NO: 1637494 - RNA, 13 nt, Human
gccuggccugagc

SEQ ID NO: 1637495 - RNA, 18 nt, Human
gccuggccugagcuggga

SEQ ID NO: 1637496 - RNA, 14 nt, Human
gccuggccugagcu

SEQ ID NO: 1637497 - RNA, 20 nt, Human
gccuggccugagcugggaug

SEQ ID NO: 1637498 - RNA, 20 nt, Human
gccuguugggccaggagccu

SEQ ID NO: 1637499 - RNA, 18 nt, Human
gccuguugggccaggagc

SEQ ID NO: 1637500 - RNA, 16 nt, Human
gccuguugggccagga

SEQ ID NO: 1637501 - RNA, 15 nt, Human
gccuguugggccagg

SEQ ID NO: 1637502 - RNA, 14 nt, Human
gccuguugggccag

SEQ ID NO: 1637503 - RNA, 23 nt, Human
gccuguucccauucuugcauggc

SEQ ID NO: 1637504 - RNA, 19 nt, Human
gccuguucccauucuugca

SEQ ID NO: 1637505 - RNA, 17 nt, Human
gccugugccucugggac

SEQ ID NO: 1637506 - RNA, 16 nt, Human
gccugugccucuggga

SEQ ID NO: 1637507 - RNA, 13 nt, Human
gccuggcucaggu

SEQ ID NO: 1637508 - RNA, 18 nt, Human
gccugugccucugggacu

SEQ ID NO: 1637509 - RNA, 20 nt, Human
gccuucggccuccauccuga

SEQ ID NO: 1637510 - RNA, 21 nt, Human
gccuguugggccaggagccuc

SEQ ID NO: 1637511 - RNA, 23 nt, Human
gccuucggccuccauccugaggc

SEQ ID NO: 1637512 - RNA, 21 nt, Human
gccuucggccuccauccugag

SEQ ID NO: 1637513 - RNA, 21 nt, Human
gccuugaccauucuccaccug

SEQ ID NO: 1637514 - RNA, 20 nt, Human
gccuugaccauucuccaccu

SEQ ID NO: 1637515 - RNA, 19 nt, Human
gccuugaccauucuccacc

SEQ ID NO: 1637516 - RNA, 17 nt, Human
gccuugaccauucucca

SEQ ID NO: 1637517 - RNA, 17 nt, Human
gcgagcccugguggcag

SEQ ID NO: 1637518 - RNA, 20 nt, Human
gcgcagcauauucaggaagc

SEQ ID NO: 1637519 - RNA, 22 nt, Human
gcgaucuggguucacugcaacc

SEQ ID NO: 1637520 - RNA, 11 nt, Human
gcucugcccuu

SEQ ID NO: 1637521 - RNA, 17 nt, Human
gcucugaucauccacug

SEQ ID NO: 1637522 - RNA, 23 nt, Human
gcucugcaagaauugaagcagga

SEQ ID NO: 1637523 - RNA, 15 nt, Human
gcuccacuuggucug

SEQ ID NO: 1637524 - RNA, 21 nt, Human
gcuccccucggagaagagcug

SEQ ID NO: 1637525 - RNA, 18 nt, Human
gcuccugccaccacgccc

SEQ ID NO: 1637526 - RNA, 12 nt, Human
gcuccugccacc

SEQ ID NO: 1637527 - RNA, 19 nt, Human
gcuccuggcccacugcauc

SEQ ID NO: 1637528 - RNA, 18 nt, Human
gcuccuggcccacugcau

SEQ ID NO: 1637529 - RNA, 20 nt, Human
gcuccuggcccacugcaucg

SEQ ID NO: 1637530 - RNA, 15 nt, Human
gcuccuggcccacug

SEQ ID NO: 1637531 - RNA, 14 nt, Human
gcuccuggcccacu

SEQ ID NO: 1637532 - RNA, 21 nt, Human
gcuccugccaccacgcccggc

SEQ ID NO: 1637533 - RNA, 19 nt, Human
gcuccacuuggucugugag

SEQ ID NO: 1637534 - RNA, 18 nt, Human
gcuccacuuggucuguga

SEQ ID NO: 1637535 - RNA, 18 nt, Human
gcuccagcucaccagccc

SEQ ID NO: 1637536 - RNA, 21 nt, Human
gcuccagcucaccagccccag

SEQ ID NO: 1637537 - RNA, 20 nt, Human
gcuccagcucaccagcccca

SEQ ID NO: 1637538 - RNA, 21 nt, Human
gcucccacaggcccuuccucu

SEQ ID NO: 1637539 - RNA, 20 nt, Human
gcucccacaggcccuuccuc

SEQ ID NO: 1637540 - RNA, 17 nt, Human
gcucccacaggcccuuc

SEQ ID NO: 1637541 - RNA, 16 nt, Human
gcucccacaggcccuu

SEQ ID NO: 1637542 - RNA, 17 nt, Human
gcucccaggcauucccc

SEQ ID NO: 1637543 - RNA, 22 nt, Human
gcucccacaggcccuuccucuc

SEQ ID NO: 1637544 - RNA, 16 nt, Human
gcuaggccuggccaga

SEQ ID NO: 1637545 - RNA, 23 nt, Human
gcuaggccuggccagaugcacca

SEQ ID NO: 1637546 - RNA, 17 nt, Human
gcuaggccuggccagau

SEQ ID NO: 1637547 - RNA, 22 nt, Human
gcuagugugguguuuccuggca

SEQ ID NO: 1637548 - RNA, 21 nt, Human
gcuagugugguguuuccuggc

SEQ ID NO: 1637549 - RNA, 12 nt, Human
gcuaugcauuug

SEQ ID NO: 1637550 - RNA, 19 nt, Human
gcuauucaguaauaacucu

SEQ ID NO: 1637551 - RNA, 13 nt, Human
gcuaugcauuuga

SEQ ID NO: 1637552 - RNA, 17 nt, Human
gcucaggugucccugca

SEQ ID NO: 1637553 - RNA, 16 nt, Human
gcucaggugucccugc

SEQ ID NO: 1637554 - RNA, 14 nt, Human
gcucaggugucccu

SEQ ID NO: 1637555 - RNA, 23 nt, Human
gcucagguggggucacucuggca

SEQ ID NO: 1637556 - RNA, 13 nt, Human
gcucagagagggu

SEQ ID NO: 1637557 - RNA, 20 nt, Human
gcucacugcauccuccgccu

SEQ ID NO: 1637558 - RNA, 14 nt, Human
gcucagagagggug

SEQ ID NO: 1637559 - RNA, 20 nt, Human
gcuauucaguaauaacucua

SEQ ID NO: 1637560 - RNA, 14 nt, Human
gcucacugcagccu

SEQ ID NO: 1637561 - RNA, 13 nt, Human
gcucacugcagcc

SEQ ID NO: 1637562 - RNA, 12 nt, Human
gcucacugcagc

SEQ ID NO: 1637563 - RNA, 11 nt, Human
gcucacugcag

SEQ ID NO: 1637564 - RNA, 16 nt, Human
gcucacugcagccuca

SEQ ID NO: 1637565 - RNA, 15 nt, Human
gcucacugcagccuc

SEQ ID NO: 1637566 - RNA, 17 nt, Human
gcucacugcagccucaa

SEQ ID NO: 1637567 - RNA, 16 nt, Human
gcucacugcauccucc

SEQ ID NO: 1637568 - RNA, 15 nt, Human
gcuagaacucccuuu

SEQ ID NO: 1637569 - RNA, 14 nt, Human
gcuagaacucccuu

SEQ ID NO: 1637570 - RNA, 13 nt, Human
gcuagaacucccu

SEQ ID NO: 1637571 - RNA, 12 nt, Human
gcuagaacuccc

SEQ ID NO: 1637572 - RNA, 18 nt, Human
gcuagaacucccuuucaa

SEQ ID NO: 1637573 - RNA, 16 nt, Human
gcuagaacucccuuuc

SEQ ID NO: 1637574 - RNA, 20 nt, Human
gcgugcacacaccagagccc

SEQ ID NO: 1637575 - RNA, 22 nt, Human
gcgggaggauguucugggacac

SEQ ID NO: 1637576 - RNA, 21 nt, Human
gcgggaggauguucugggaca

SEQ ID NO: 1637577 - RNA, 23 nt, Human
gcgugcacacaccagagcccacc

SEQ ID NO: 1637578 - RNA, 18 nt, Human
gcguuucuaugacacaug

SEQ ID NO: 1637579 - RNA, 13 nt, Human
gcuaaugggacac

SEQ ID NO: 1637580 - RNA, 15 nt, Human
gcuaaugggacacua

SEQ ID NO: 1637581 - RNA, 23 nt, Human
gcuaagugauccucccaccucag

SEQ ID NO: 1637582 - RNA, 14 nt, Human
gcuaaucagcauuc

SEQ ID NO: 1637583 - RNA, 22 nt, Human
gcuaaucagcauucucacuccu

SEQ ID NO: 1637584 - RNA, 17 nt, Human
gcuaaucagcauucuca

SEQ ID NO: 1637585 - RNA, 16 nt, Human
gcuaaucagcauucuc

SEQ ID NO: 1637586 - RNA, 20 nt, Human
ggcaguggugguuuucuguu

SEQ ID NO: 1637587 - RNA, 21 nt, Human
ggcaguggugguuuucuguuc

SEQ ID NO: 1637588 - RNA, 22 nt, Human
ggcagccccuguucuggcagag

SEQ ID NO: 1637589 - RNA, 16 nt, Human
ggagagaagagaaugc

SEQ ID NO: 1637590 - RNA, 22 nt, Human
ggagacugcugagucaacccaa

SEQ ID NO: 1637591 - RNA, 21 nt, Human
ggcacaguuuucugagaaaga

SEQ ID NO: 1637592 - RNA, 23 nt, Human
ggcacagaaaauggaagacagcu

SEQ ID NO: 1637593 - RNA, 23 nt, Human
ggcacucagaagacacugauggg

SEQ ID NO: 1637594 - RNA, 13 nt, Human
ggcacaucagcac

SEQ ID NO: 1637595 - RNA, 19 nt, Human
ggcacagaaaauggaagac

SEQ ID NO: 1637596 - RNA, 21 nt, Human
ggcacagaaaauggaagacag

SEQ ID NO: 1637597 - RNA, 20 nt, Human
ggcacagaaaauggaagaca

SEQ ID NO: 1637598 - RNA, 11 nt, Human
ggcagccccug

SEQ ID NO: 1637599 - RNA, 15 nt, Human
ggcacugguggcccg

SEQ ID NO: 1637600 - RNA, 16 nt, Human
ggccuccauccugagg

SEQ ID NO: 1637601 - RNA, 15 nt, Human
ggccuccauccugag

SEQ ID NO: 1637602 - RNA, 14 nt, Human
ggccuccauccuga

SEQ ID NO: 1637603 - RNA, 23 nt, Human
ggcccuucucuccagccccugga

SEQ ID NO: 1637604 - RNA, 22 nt, Human
ggcccuucucuccagccccugg

SEQ ID NO: 1637605 - RNA, 19 nt, Human
ggccucacuaggcuucugg

SEQ ID NO: 1637606 - RNA, 23 nt, Human
ggccccugcugguucaggguugg

SEQ ID NO: 1637607 - RNA, 13 nt, Human
ggcccggcuccag

SEQ ID NO: 1637608 - RNA, 14 nt, Human
ggccccugcugguu

SEQ ID NO: 1637609 - RNA, 13 nt, Human
ggccccugcuggu

SEQ ID NO: 1637610 - RNA, 21 nt, Human
ggcccuucucuccagccccug

SEQ ID NO: 1637611 - RNA, 20 nt, Human
ggcccuucucuccagccccu

SEQ ID NO: 1637612 - RNA, 15 nt, Human
ggcccggcuccaggc

SEQ ID NO: 1637613 - RNA, 17 nt, Human
ggccaguuggucccccu

SEQ ID NO: 1637614 - RNA, 14 nt, Human
ggccaguugguccc

SEQ ID NO: 1637615 - RNA, 20 nt, Human
ggccagugugacaaggauug

SEQ ID NO: 1637616 - RNA, 17 nt, Human
ggcauaacauaaaucug

SEQ ID NO: 1637617 - RNA, 16 nt, Human
ggcauaacauaaaucu

SEQ ID NO: 1637618 - RNA, 18 nt, Human
ggcugggagagccuucca

SEQ ID NO: 1637619 - RNA, 16 nt, Human
ggcugggagagccuuc

SEQ ID NO: 1637620 - RNA, 15 nt, Human
ggcugggagagccuu

SEQ ID NO: 1637621 - RNA, 14 nt, Human
ggcugggagagccu

SEQ ID NO: 1637622 - RNA, 13 nt, Human
ggcugcugaaggc

SEQ ID NO: 1637623 - RNA, 11 nt, Human
ggcucucaggc

SEQ ID NO: 1637624 - RNA, 13 nt, Human
ggcucucaggcca

SEQ ID NO: 1637625 - RNA, 14 nt, Human
ggcucucaggccag

SEQ ID NO: 1637626 - RNA, 12 nt, Human
ggcucuuccagg

SEQ ID NO: 1637627 - RNA, 14 nt, Human
ggcucuuccaggcu

SEQ ID NO: 1637628 - RNA, 13 nt, Human
ggcucuucuccuu

SEQ ID NO: 1637629 - RNA, 12 nt, Human
ggcucuucuccu

SEQ ID NO: 1637630 - RNA, 20 nt, Human
ggcugccaaugggagcucau

SEQ ID NO: 1637631 - RNA, 19 nt, Human
ggcugccaaugggagcuca

SEQ ID NO: 1637632 - RNA, 16 nt, Human
ggcucuucuccuuuca

SEQ ID NO: 1637633 - RNA, 22 nt, Human
ggcugacagacagcccuccauc

SEQ ID NO: 1637634 - RNA, 23 nt, Human
ggcucuucuccuuucacaaccuu

SEQ ID NO: 1637635 - RNA, 15 nt, Human
ggcucuucuccuuuc

SEQ ID NO: 1637636 - RNA, 14 nt, Human
ggcucuucuccuuu

SEQ ID NO: 1637637 - RNA, 21 nt, Human
ggcugccaaugggagcucaug

SEQ ID NO: 1637638 - RNA, 13 nt, Human
ggcugcccuggug

SEQ ID NO: 1637639 - RNA, 19 nt, Human
ggcugcccuggugcugcca

SEQ ID NO: 1637640 - RNA, 16 nt, Human
ggcugcccuggugcug

SEQ ID NO: 1637641 - RNA, 15 nt, Human
ggcugcccuggugcu

SEQ ID NO: 1637642 - RNA, 14 nt, Human
ggcugcccuggugc

SEQ ID NO: 1637643 - RNA, 22 nt, Human
ggcugcggaaugaaccacaucu

SEQ ID NO: 1637644 - RNA, 16 nt, Human
ggcugccuuagaaccu

SEQ ID NO: 1637645 - RNA, 22 nt, Human
ggcugcccuggugcugccacac

SEQ ID NO: 1637646 - RNA, 14 nt, Human
ggcuccacuugguc

SEQ ID NO: 1637647 - RNA, 18 nt, Human
ggcucagcggggacagcu

SEQ ID NO: 1637648 - RNA, 19 nt, Human
ggcucagcaaaagaugcuu

SEQ ID NO: 1637649 - RNA, 20 nt, Human
ggcucagguggggucacucu

SEQ ID NO: 1637650 - RNA, 19 nt, Human
ggcucagguggggucacuc

SEQ ID NO: 1637651 - RNA, 20 nt, Human
ggcucagcggggacagcucc

SEQ ID NO: 1637652 - RNA, 19 nt, Human
ggcucagcggggacagcuc

SEQ ID NO: 1637653 - RNA, 15 nt, Human
aaaacuucagacaua

SEQ ID NO: 1637654 - RNA, 22 nt, Human
aaaacuugauguguuaucucuu

SEQ ID NO: 1637655 - RNA, 18 nt, Human
aaaacucuccucugcugc

SEQ ID NO: 1637656 - RNA, 17 nt, Human
aaaaaugguuuaaaugg

SEQ ID NO: 1637657 - RNA, 19 nt, Human
gggacauuugcucauggaa

SEQ ID NO: 1637658 - RNA, 20 nt, Human
gggaccagagcugccaccug

SEQ ID NO: 1637659 - RNA, 14 nt, Human
gggaccagagcugc

SEQ ID NO: 1637660 - RNA, 12 nt, Human
aaaacccaagug

SEQ ID NO: 1637661 - RNA, 17 nt, Human
aaaaccaguauuguaca

SEQ ID NO: 1637662 - RNA, 13 nt, Human
aaaacaugcuaca

SEQ ID NO: 1637663 - RNA, 14 nt, Human
aaaacaugcuacac

SEQ ID NO: 1637664 - RNA, 19 nt, Human
gggagagccuuccaggggu

SEQ ID NO: 1637665 - RNA, 15 nt, Human
gggagagccuuccag

SEQ ID NO: 1637666 - RNA, 23 nt, Human
gggagcaggcucgggcuccccag

SEQ ID NO: 1637667 - RNA, 16 nt, Human
gggagggagggcucca

SEQ ID NO: 1637668 - RNA, 15 nt, Human
gggagggagggcucc

SEQ ID NO: 1637669 - RNA, 18 nt, Human
gggaggucaaggcugcag

SEQ ID NO: 1637670 - RNA, 15 nt, Human
gggaggucgaggcag

SEQ ID NO: 1637671 - RNA, 23 nt, Human
gggacuuggaagcuccgcuuucu

SEQ ID NO: 1637672 - RNA, 18 nt, Human
gggacuuggaagcuccgc

SEQ ID NO: 1637673 - RNA, 17 nt, Human
gggacuuggaagcuccg

SEQ ID NO: 1637674 - RNA, 15 nt, Human
gggacuuggaagcuc

SEQ ID NO: 1637675 - RNA, 21 nt, Human
gggagaaccaaaaagaggcua

SEQ ID NO: 1637676 - RNA, 14 nt, Human
aaaaauaacaauga

SEQ ID NO: 1637677 - RNA, 19 nt, Human
ggcugggggccucagugcc

SEQ ID NO: 1637678 - RNA, 17 nt, Human
ggcugggggccucagug

SEQ ID NO: 1637679 - RNA, 16 nt, Human
ggcugggggccucagu

SEQ ID NO: 1637680 - RNA, 15 nt, Human
ggcugggggccucag

SEQ ID NO: 1637681 - RNA, 21 nt, Human
ggcuggguucuacccaggugc

SEQ ID NO: 1637682 - RNA, 19 nt, Human
ggcuggguucuacccaggu

SEQ ID NO: 1637683 - RNA, 19 nt, Human
ggcuggguggcaccagcag

SEQ ID NO: 1637684 - RNA, 20 nt, Human
ggcugggucgcccuggacug

SEQ ID NO: 1637685 - RNA, 17 nt, Human
ggcugggucgcccugga

SEQ ID NO: 1637686 - RNA, 14 nt, Human
ggcugggucgcccu

SEQ ID NO: 1637687 - RNA, 16 nt, Human
ggcuuccucauaguau

SEQ ID NO: 1637688 - RNA, 21 nt, Human
ggcuucccgcucagcccuccc

SEQ ID NO: 1637689 - RNA, 19 nt, Human
ggcuucccgcucagcccuc

SEQ ID NO: 1637690 - RNA, 18 nt, Human
ggcuucccgcucagcccu

SEQ ID NO: 1637691 - RNA, 17 nt, Human
ggcuucccgcucagccc

SEQ ID NO: 1637692 - RNA, 16 nt, Human
ggcuucccgcucagcc

SEQ ID NO: 1637693 - RNA, 15 nt, Human
ggcuucccgcucagc

SEQ ID NO: 1637694 - RNA, 18 nt, Human
ggcuucauccuccucaga

SEQ ID NO: 1637695 - RNA, 22 nt, Human
ggcuucauccuccucagaucuu

SEQ ID NO: 1637696 - RNA, 14 nt, Human
ggcuucccgcucag

SEQ ID NO: 1637697 - RNA, 20 nt, Human
ggcuucaguggcagcugcuu

SEQ ID NO: 1637698 - RNA, 19 nt, Human
ggcuucaguggcagcugcu

SEQ ID NO: 1637699 - RNA, 18 nt, Human
ggcuucaguggcagcugc

SEQ ID NO: 1637700 - RNA, 22 nt, Human
ggcuggguucuacccaggugcu

SEQ ID NO: 1637701 - RNA, 18 nt, Human
ggcuguaucccaugagcc

SEQ ID NO: 1637702 - RNA, 15 nt, Human
ggcuguacccaggaa

SEQ ID NO: 1637703 - RNA, 20 nt, Human
gggaacccaaguccaagcau

SEQ ID NO: 1637704 - RNA, 13 nt, Human
gggaaccugaccc

SEQ ID NO: 1637705 - RNA, 18 nt, Human
gggaagaagcucucuccu

SEQ ID NO: 1637706 - RNA, 21 nt, Human
ggcuuccuccugguguggaag

SEQ ID NO: 1637707 - RNA, 22 nt, Human
ggcuucccgcucagcccucccu

SEQ ID NO: 1637708 - RNA, 22 nt, Human
gggacagucaccucauggaauu

SEQ ID NO: 1637709 - RNA, 21 nt, Human
gggacagucaccucauggaau

SEQ ID NO: 1637710 - RNA, 20 nt, Human
gggacagucaccucauggaa

SEQ ID NO: 1637711 - RNA, 16 nt, Human
gggacagcuccuucug

SEQ ID NO: 1637712 - RNA, 15 nt, Human
gggacagcuccuucu

SEQ ID NO: 1637713 - RNA, 13 nt, Human
gggacagcuccuu

SEQ ID NO: 1637714 - RNA, 12 nt, Human
gggacagcuccu

SEQ ID NO: 1637715 - RNA, 13 nt, Human
gggacagagcaga

SEQ ID NO: 1637716 - RNA, 13 nt, Human
gggaagagacuug

SEQ ID NO: 1637717 - RNA, 20 nt, Human
ggucgcccuggacugugugc

SEQ ID NO: 1637718 - RNA, 13 nt, Human
ggugaacagaaca

SEQ ID NO: 1637719 - RNA, 13 nt, Human
ggucgaggcagga

SEQ ID NO: 1637720 - RNA, 14 nt, Human
ggucgcccuggacu

SEQ ID NO: 1637721 - RNA, 16 nt, Human
ggugcaaugaccuuuc

SEQ ID NO: 1637722 - RNA, 13 nt, Human
ggugcaaugaccu

SEQ ID NO: 1637723 - RNA, 12 nt, Human
ggugcaaugacc

SEQ ID NO: 1637724 - RNA, 24 nt, Human
ggugauccacccaccucagccucc

SEQ ID NO: 1637725 - RNA, 23 nt, Human
ggugauccacccaccucagccuc

SEQ ID NO: 1637726 - RNA, 18 nt, Human
ggugauccacccaccuca

SEQ ID NO: 1637727 - RNA, 21 nt, Human
ggugcauuugaggucuguucu

SEQ ID NO: 1637728 - RNA, 21 nt, Human
ggugcauauuuauaaaaauaa

SEQ ID NO: 1637729 - RNA, 16 nt, Human
ggugcugggccccugc

SEQ ID NO: 1637730 - RNA, 15 nt, Human
ggugcugggccccug

SEQ ID NO: 1637731 - RNA, 13 nt, Human
ggugcugggcccc

SEQ ID NO: 1637732 - RNA, 11 nt, Human
ggugcugggcc

SEQ ID NO: 1637733 - RNA, 13 nt, Human
gguggaugccugg

SEQ ID NO: 1637734 - RNA, 19 nt, Human
ggugcugggccccugccuc

SEQ ID NO: 1637735 - RNA, 14 nt, Human
aaagguacuucaaa

SEQ ID NO: 1637736 - RNA, 14 nt, Human
aaagguaaaucaga

SEQ ID NO: 1637737 - RNA, 20 nt, Human
aaagggauggcaagaugugg

SEQ ID NO: 1637738 - RNA, 22 nt, Human
aaagggacuuggaagcuccgcu

SEQ ID NO: 1637739 - RNA, 22 nt, Human
aaaggaaagagggagguaagga

SEQ ID NO: 1637740 - RNA, 21 nt, Human
aaaggagagcuagcagcaggg

SEQ ID NO: 1637741 - RNA, 17 nt, Human
aaaggagauuggaagga

SEQ ID NO: 1637742 - RNA, 21 nt, Human
aaagcacugacuucuaaguaa

SEQ ID NO: 1637743 - RNA, 17 nt, Human
aaagcacugacuucuaa

SEQ ID NO: 1637744 - RNA, 15 nt, Human
aaagcucacuuuacu

SEQ ID NO: 1637745 - RNA, 15 nt, Human
aaagcugaaaacugc

SEQ ID NO: 1637746 - RNA, 15 nt, Human
aaagcuuguuaagau

SEQ ID NO: 1637747 - RNA, 13 nt, Human
aaagcugcugaca

SEQ ID NO: 1637748 - RNA, 12 nt, Human
aaagcugaaaac

SEQ ID NO: 1637749 - RNA, 19 nt, Human
aaagacuauucaaacaguc

SEQ ID NO: 1637750 - RNA, 18 nt, Human
aaagacuauucaaacagu

SEQ ID NO: 1637751 - RNA, 21 nt, Human
aaagacuccaaagaaauguaa

SEQ ID NO: 1637752 - RNA, 15 nt, Human
aaagacuccaaagaa

SEQ ID NO: 1637753 - RNA, 21 nt, Human
aaagacuauucaaacagucuc

SEQ ID NO: 1637754 - RNA, 13 nt, Human
aaagacagugaaa

SEQ ID NO: 1637755 - RNA, 12 nt, Human
aaacuuuucuga

SEQ ID NO: 1637756 - RNA, 11 nt, Human
aaacuuuucug

SEQ ID NO: 1637757 - RNA, 23 nt, Human
aaacuucagcgguuuauauaagc

SEQ ID NO: 1637758 - RNA, 15 nt, Human
ggguggggggggugc

SEQ ID NO: 1637759 - RNA, 14 nt, Human
ggguggccucccaa

SEQ ID NO: 1637760 - RNA, 16 nt, Human
aaacuuguauuaugug

SEQ ID NO: 1637761 - RNA, 15 nt, Human
aaacuuguguaaaua

SEQ ID NO: 1637762 - RNA, 15 nt, Human
aaagaggcagcuuga

SEQ ID NO: 1637763 - RNA, 15 nt, Human
aaagaggaaugaagu

SEQ ID NO: 1637764 - RNA, 14 nt, Human
aaagaugcuucuca

SEQ ID NO: 1637765 - RNA, 17 nt, Human
aaagaugcuucucacug

SEQ ID NO: 1637766 - RNA, 19 nt, Human
aaagaugcuucucacugcc

SEQ ID NO: 1637767 - RNA, 13 nt, Human
aaagacuguacaa

SEQ ID NO: 1637768 - RNA, 23 nt, Human
aaagacugaguacguugugcauu

SEQ ID NO: 1637769 - RNA, 14 nt, Human
aaagacuguacaaa

SEQ ID NO: 1637770 - RNA, 14 nt, Human
gguccugcugcagu

SEQ ID NO: 1637771 - RNA, 12 nt, Human
gguccugcugca

SEQ ID NO: 1637772 - RNA, 11 nt, Human
gguccugcugc

SEQ ID NO: 1637773 - RNA, 23 nt, Human
aaagauggcugugccucugccug

SEQ ID NO: 1637774 - RNA, 22 nt, Human
aaagauggcugugccucugccu

SEQ ID NO: 1637775 - RNA, 21 nt, Human
aaagauggcugugccucugcc

SEQ ID NO: 1637776 - RNA, 15 nt, Human
aaacagucucaggaa

SEQ ID NO: 1637777 - RNA, 16 nt, Human
aaacauggccuuugcu

SEQ ID NO: 1637778 - RNA, 14 nt, Human
aaacaguagugaua

SEQ ID NO: 1637779 - RNA, 17 nt, Human
aaacauggccuuugcuu

SEQ ID NO: 1637780 - RNA, 19 nt, Human
ggggaauugaggacacuga

SEQ ID NO: 1637781 - RNA, 16 nt, Human
ggggaccagagcugcc

SEQ ID NO: 1637782 - RNA, 22 nt, Human
ggggaauguuugccucugccuc

SEQ ID NO: 1637783 - RNA, 18 nt, Human
ggggaauguuugccucug

SEQ ID NO: 1637784 - RNA, 13 nt, Human
ggggaaggcaggg

SEQ ID NO: 1637785 - RNA, 11 nt, Human
ggggagaaagu

SEQ ID NO: 1637786 - RNA, 18 nt, Human
gggggccucagugccacu

SEQ ID NO: 1637787 - RNA, 17 nt, Human
gggggccucagugccac

SEQ ID NO: 1637788 - RNA, 15 nt, Human
gggggccucagugcc

SEQ ID NO: 1637789 - RNA, 12 nt, Human
gggggccucagu

SEQ ID NO: 1637790 - RNA, 15 nt, Human
ggggccucagugcca

SEQ ID NO: 1637791 - RNA, 14 nt, Human
aaacacagcaaggg

SEQ ID NO: 1637792 - RNA, 12 nt, Human
aaacacagcaag

SEQ ID NO: 1637793 - RNA, 11 nt, Human
aaacacauuuu

SEQ ID NO: 1637794 - RNA, 12 nt, Human
aaacacauuuuu

SEQ ID NO: 1637795 - RNA, 11 nt, Human
aaacacagcaa

SEQ ID NO: 1637796 - RNA, 19 nt, Human
aaacacaaacgggcucagc

SEQ ID NO: 1637797 - RNA, 13 nt, Human
gggaugagaaagg

SEQ ID NO: 1637798 - RNA, 19 nt, Human
aaaauuuagaaauauaauu

SEQ ID NO: 1637799 - RNA, 20 nt, Human
aaaauuuugauguuuuaagg

SEQ ID NO: 1637800 - RNA, 15 nt, Human
aaaauuuuuaaucuu

SEQ ID NO: 1637801 - RNA, 15 nt, Human
aaacucguuaauuug

SEQ ID NO: 1637802 - RNA, 14 nt, Human
aaacgucuuaaaua

SEQ ID NO: 1637803 - RNA, 18 nt, Human
aaacuaggugcauauuua

SEQ ID NO: 1637804 - RNA, 13 nt, Human
aaacgucuuaaau

SEQ ID NO: 1637805 - RNA, 22 nt, Human
aaacuaggugcauauuuauaaa

SEQ ID NO: 1637806 - RNA, 13 nt, Human
aaacucuccucug

SEQ ID NO: 1637807 - RNA, 22 nt, Human
aaacugcccccucugcccugcg

SEQ ID NO: 1637808 - RNA, 19 nt, Human
aaacuguuaauaguucagg

SEQ ID NO: 1637809 - RNA, 16 nt, Human
aaacuuaaucuaaaug

SEQ ID NO: 1637810 - RNA, 17 nt, Human
aaacuuaaucuaaaugg

SEQ ID NO: 1637811 - RNA, 18 nt, Human
aaacuuaaucuaaaugga

SEQ ID NO: 1637812 - RNA, 19 nt, Human
aaacuuaaucuaaauggaa

SEQ ID NO: 1637813 - RNA, 12 nt, Human
aaaccacagcag

SEQ ID NO: 1637814 - RNA, 23 nt, Human
aaaccaagucaagugaaaaagga

SEQ ID NO: 1637815 - RNA, 15 nt, Human
aaacauuaugaugug

SEQ ID NO: 1637816 - RNA, 15 nt, Human
aaacgggcucagcaa

SEQ ID NO: 1637817 - RNA, 18 nt, Human
aaaccuuuuauauuuagu

SEQ ID NO: 1637818 - RNA, 18 nt, Human
aaaccuuuguuugcaucu

SEQ ID NO: 1637819 - RNA, 15 nt, Human
gggucgcccuggacu

SEQ ID NO: 1637820 - RNA, 13 nt, Human
gggucgcccugga

SEQ ID NO: 1637821 - RNA, 19 nt, Human
gggggugcugggccccugc

SEQ ID NO: 1637822 - RNA, 20 nt, Human
guaauaggcguaacuaauuu

SEQ ID NO: 1637823 - RNA, 14 nt, Human
guaauaugcacaca

SEQ ID NO: 1637824 - RNA, 16 nt, Human
guaauaugcacacauu

SEQ ID NO: 1637825 - RNA, 17 nt, Human
guaauaugcacacauuu

SEQ ID NO: 1637826 - RNA, 18 nt, Human
guaauaugcacacauuuu

SEQ ID NO: 1637827 - RNA, 21 nt, Human
guaauccaagcaaaugugaau

SEQ ID NO: 1637828 - RNA, 21 nt, Human
aaauaauuuuuauauuugaaa

SEQ ID NO: 1637829 - RNA, 23 nt, Human
guacacugccuucucaacuccaa

SEQ ID NO: 1637830 - RNA, 21 nt, Human
guaauuuuuuuaucgucacug

SEQ ID NO: 1637831 - RNA, 15 nt, Human
aaauacacacucaaa

SEQ ID NO: 1637832 - RNA, 22 nt, Human
aaauacaauuuuguuucuguac

SEQ ID NO: 1637833 - RNA, 21 nt, Human
aaauacaauuuuguuucugua

SEQ ID NO: 1637834 - RNA, 20 nt, Human
aaauacaauuuuguuucugu

SEQ ID NO: 1637835 - RNA, 18 nt, Human
aaauacaauuuuguuucu

SEQ ID NO: 1637836 - RNA, 17 nt, Human
aaauacaauuuuguuuc

SEQ ID NO: 1637837 - RNA, 14 nt, Human
aaauacaauuuugu

SEQ ID NO: 1637838 - RNA, 23 nt, Human
aaauaauuuuuauauuugaaaua

SEQ ID NO: 1637839 - RNA, 22 nt, Human
aaauaauuuuuauauuugaaau

SEQ ID NO: 1637840 - RNA, 13 nt, Human
aaauacaauuuug

SEQ ID NO: 1637841 - RNA, 19 nt, Human
aaauacacacucaaaucaa

SEQ ID NO: 1637842 - RNA, 17 nt, Human
aaauacagauagauaua

SEQ ID NO: 1637843 - RNA, 18 nt, Human
aaauaccagccaguaaau

SEQ ID NO: 1637844 - RNA, 22 nt, Human
aaauacgugggcauucaaaugu

SEQ ID NO: 1637845 - RNA, 17 nt, Human
aaaguugguaaaccuuu

SEQ ID NO: 1637846 - RNA, 23 nt, Human
aaaguugccuaaauccauuugga

SEQ ID NO: 1637847 - RNA, 16 nt, Human
aaaguugguaaaccuu

SEQ ID NO: 1637848 - RNA, 17 nt, Human
aaaguugccuaaaucca

SEQ ID NO: 1637849 - RNA, 16 nt, Human
aaaguugccuaaaucc

SEQ ID NO: 1637850 - RNA, 14 nt, Human
aaaguuuaauauua

SEQ ID NO: 1637851 - RNA, 12 nt, Human
aaaguuuaauau

SEQ ID NO: 1637852 - RNA, 23 nt, Human
aaaguucugcagauaaacaguag

SEQ ID NO: 1637853 - RNA, 12 nt, Human
aaaguugaauuu

SEQ ID NO: 1637854 - RNA, 14 nt, Human
aaaguugccuaaau

SEQ ID NO: 1637855 - RNA, 13 nt, Human
aaaguugccuaaa

SEQ ID NO: 1637856 - RNA, 20 nt, Human
aaaguauuaagcauauauuu

SEQ ID NO: 1637857 - RNA, 19 nt, Human
aaaguauuaagcauauauu

SEQ ID NO: 1637858 - RNA, 18 nt, Human
aaaguauuaagcauauau

SEQ ID NO: 1637859 - RNA, 13 nt, Human
aaaguauuaagca

SEQ ID NO: 1637860 - RNA, 20 nt, Human
aaagguauuuuaaucaccaa

SEQ ID NO: 1637861 - RNA, 20 nt, Human
aaaguacacuguuucaaacu

SEQ ID NO: 1637862 - RNA, 19 nt, Human
aaaguacuucuccacccug

SEQ ID NO: 1637863 - RNA, 18 nt, Human
aaaguauguuagugcaaa

SEQ ID NO: 1637864 - RNA, 18 nt, Human
aaaguaucccuacuguaa

SEQ ID NO: 1637865 - RNA, 21 nt, Human
aaaguacuucuccacccugcu

SEQ ID NO: 1637866 - RNA, 20 nt, Human
aaaguacuucuccacccugc

SEQ ID NO: 1637867 - RNA, 23 nt, Human
aaaguacuucuccacccugcucu

SEQ ID NO: 1637868 - RNA, 15 nt, Human
guacuucaugcuguc

SEQ ID NO: 1637869 - RNA, 22 nt, Human
guacuucaaauccuugaagauu

SEQ ID NO: 1637870 - RNA, 21 nt, Human
guacuucaaauccuugaagau

SEQ ID NO: 1637871 - RNA, 16 nt, Human
guacuggagaaaaugg

SEQ ID NO: 1637872 - RNA, 19 nt, Human
guacuacaguccucccauc

SEQ ID NO: 1637873 - RNA, 18 nt, Human
guacuacaguccucccau

SEQ ID NO: 1637874 - RNA, 14 nt, Human
guacccacugcucu

SEQ ID NO: 1637875 - RNA, 13 nt, Human
guacccacugcuc

SEQ ID NO: 1637876 - RNA, 13 nt, Human
guacuauguauca

SEQ ID NO: 1637877 - RNA, 17 nt, Human
guacuauguaucaauga

SEQ ID NO: 1637878 - RNA, 15 nt, Human
guacuauguaucaau

SEQ ID NO: 1637879 - RNA, 14 nt, Human
guacuccucccagg

SEQ ID NO: 1637880 - RNA, 23 nt, Human
guagaaauaucugaaaauguaug

SEQ ID NO: 1637881 - RNA, 21 nt, Human
guagaaauaucugaaaaugua

SEQ ID NO: 1637882 - RNA, 20 nt, Human
guagaaauaucugaaaaugu

SEQ ID NO: 1637883 - RNA, 18 nt, Human
guagaagcccuucuaccu

SEQ ID NO: 1637884 - RNA, 21 nt, Human
guagaagucuuagauguauau

SEQ ID NO: 1637885 - RNA, 11 nt, Human
guagagccagg

SEQ ID NO: 1637886 - RNA, 10 nt, Human
guagagccag

SEQ ID NO: 1637887 - RNA, 13 nt, Human
guagagacagggu

SEQ ID NO: 1637888 - RNA, 18 nt, Human
guagagccagggucucac

SEQ ID NO: 1637889 - RNA, 15 nt, Human
guagagccagggucu

SEQ ID NO: 1637890 - RNA, 12 nt, Human
guagagacaggg

SEQ ID NO: 1637891 - RNA, 11 nt, Human
guagagacagg

SEQ ID NO: 1637892 - RNA, 23 nt, Human
guaccaagacuacuagggaaaug

SEQ ID NO: 1637893 - RNA, 20 nt, Human
guaccaagacuacuagggaa

SEQ ID NO: 1637894 - RNA, 12 nt, Human
guacccacugcu

SEQ ID NO: 1637895 - RNA, 18 nt, Human
aaauccauacauuugugu

SEQ ID NO: 1637896 - RNA, 15 nt, Human
aaauccauacauuug

SEQ ID NO: 1637897 - RNA, 14 nt, Human
guacaugaaaacac

SEQ ID NO: 1637898 - RNA, 15 nt, Human
guacaugaaaacaca

SEQ ID NO: 1637899 - RNA, 16 nt, Human
guacaugaaaacacau

SEQ ID NO: 1637900 - RNA, 19 nt, Human
guacauggaauaacaugua

SEQ ID NO: 1637901 - RNA, 17 nt, Human
guacaugaaaacacauu

SEQ ID NO: 1637902 - RNA, 18 nt, Human
guacaugaaaacacauuu

SEQ ID NO: 1637903 - RNA, 19 nt, Human
guacaugaaaacacauuuu

SEQ ID NO: 1637904 - RNA, 20 nt, Human
guacaugaaaacacauuuuu

SEQ ID NO: 1637905 - RNA, 15 nt, Human
aaauauuccugcauu

SEQ ID NO: 1637906 - RNA, 21 nt, Human
aaaucagacuaugaaguuuuu

SEQ ID NO: 1637907 - RNA, 14 nt, Human
aaaucagacuauga

SEQ ID NO: 1637908 - RNA, 17 nt, Human
aaauauuauguuaaaac

SEQ ID NO: 1637909 - RNA, 12 nt, Human
aaaucauuucug

SEQ ID NO: 1637910 - RNA, 18 nt, Human
aaaucagccugcuccagc

SEQ ID NO: 1637911 - RNA, 16 nt, Human
aaaucagcugcuacua

SEQ ID NO: 1637912 - RNA, 12 nt, Human
aaaucagccugc

SEQ ID NO: 1637913 - RNA, 19 nt, Human
aaaucagccguguaaccau

SEQ ID NO: 1637914 - RNA, 23 nt, Human
aaaucauuucugcaucagcugcu

SEQ ID NO: 1637915 - RNA, 22 nt, Human
aaaucauuucugcaucagcugc

SEQ ID NO: 1637916 - RNA, 21 nt, Human
aaaucauuucugcaucagcug

SEQ ID NO: 1637917 - RNA, 19 nt, Human
aaaucauuucugcaucagc

SEQ ID NO: 1637918 - RNA, 15 nt, Human
aaauccacuuuaucu

SEQ ID NO: 1637919 - RNA, 17 nt, Human
gagaagcggcuggcagc

SEQ ID NO: 1637920 - RNA, 23 nt, Human
gacuuuucuguccgagcuuugaa

SEQ ID NO: 1637921 - RNA, 21 nt, Human
gacuuuucuguccgagcuuug

SEQ ID NO: 1637922 - RNA, 22 nt, Human
gacuuuguuaguuucuccaagc

SEQ ID NO: 1637923 - RNA, 19 nt, Human
gacuuuggauaauaaggaa

SEQ ID NO: 1637924 - RNA, 14 nt, Human
gacuuuggaaagag

SEQ ID NO: 1637925 - RNA, 14 nt, Human
gacuuuggaaagac

SEQ ID NO: 1637926 - RNA, 18 nt, Human
gacuguuuucucuugaga

SEQ ID NO: 1637927 - RNA, 16 nt, Human
gacuguuuucucuuga

SEQ ID NO: 1637928 - RNA, 22 nt, Human
gacuguacaaaguagaagucuu

SEQ ID NO: 1637929 - RNA, 17 nt, Human
gacuguacuccucccag

SEQ ID NO: 1637930 - RNA, 16 nt, Human
gacuguacuccuccca

SEQ ID NO: 1637931 - RNA, 17 nt, Human
gacucaaugcacugaca

SEQ ID NO: 1637932 - RNA, 14 nt, Human
gacucaaugcacug

SEQ ID NO: 1637933 - RNA, 20 nt, Human
gacugugugcucaggagccc

SEQ ID NO: 1637934 - RNA, 17 nt, Human
gacugugugcucaggag

SEQ ID NO: 1637935 - RNA, 16 nt, Human
gacugugugcucagga

SEQ ID NO: 1637936 - RNA, 14 nt, Human
gacugugugcucag

SEQ ID NO: 1637937 - RNA, 21 nt, Human
gacugucucaagagggcacug

SEQ ID NO: 1637938 - RNA, 23 nt, Human
gacugucucaagagggcacuggu

SEQ ID NO: 1637939 - RNA, 22 nt, Human
gacugucucaagagggcacugg

SEQ ID NO: 1637940 - RNA, 15 nt, Human
gacgcugugcugccc

SEQ ID NO: 1637941 - RNA, 13 nt, Human
gacgcugugcugc

SEQ ID NO: 1637942 - RNA, 12 nt, Human
gacgcugugcug

SEQ ID NO: 1637943 - RNA, 16 nt, Human
gacuauucaaacaguc

SEQ ID NO: 1637944 - RNA, 15 nt, Human
gacuauucaaacagu

SEQ ID NO: 1637945 - RNA, 22 nt, Human
gacuauucaaacagucucagga

SEQ ID NO: 1637946 - RNA, 14 nt, Human
gacagaaagcagaa

SEQ ID NO: 1637947 - RNA, 20 nt, Human
gacagaaagcagaacaguga

SEQ ID NO: 1637948 - RNA, 21 nt, Human
gacagcccuucuuuccacaga

SEQ ID NO: 1637949 - RNA, 15 nt, Human
gacagcuccuucugu

SEQ ID NO: 1637950 - RNA, 14 nt, Human
gacagcuccuucug

SEQ ID NO: 1637951 - RNA, 13 nt, Human
gacagcuccuucu

SEQ ID NO: 1637952 - RNA, 12 nt, Human
gacagccuggca

SEQ ID NO: 1637953 - RNA, 11 nt, Human
gacagccuggc

SEQ ID NO: 1637954 - RNA, 16 nt, Human
gacagcuccuucuguc

SEQ ID NO: 1637955 - RNA, 15 nt, Human
gaccaucccugaagg

SEQ ID NO: 1637956 - RNA, 13 nt, Human
gacccggcugcgu

SEQ ID NO: 1637957 - RNA, 12 nt, Human
gacccggcugcg

SEQ ID NO: 1637958 - RNA, 22 nt, Human
gaccccuggcuuuucacugcug

SEQ ID NO: 1637959 - RNA, 21 nt, Human
gaccccuggcuuuucacugcu

SEQ ID NO: 1637960 - RNA, 16 nt, Human
gacccuauugcugcuu

SEQ ID NO: 1637961 - RNA, 17 nt, Human
gaccauucuccaccugc

SEQ ID NO: 1637962 - RNA, 13 nt, Human
gaccccuggcuuu

SEQ ID NO: 1637963 - RNA, 16 nt, Human
gaccauucuccaccug

SEQ ID NO: 1637964 - RNA, 17 nt, Human
gaccaucccugaaggcc

SEQ ID NO: 1637965 - RNA, 16 nt, Human
gaccaucccugaaggc

SEQ ID NO: 1637966 - RNA, 20 nt, Human
gacaguauggcagcuuuccu

SEQ ID NO: 1637967 - RNA, 17 nt, Human
gacaggguuucaccaug

SEQ ID NO: 1637968 - RNA, 16 nt, Human
gaggugggauccucca

SEQ ID NO: 1637969 - RNA, 15 nt, Human
gaggugggauccucc

SEQ ID NO: 1637970 - RNA, 21 nt, Human
gagucacuggaacacuaauga

SEQ ID NO: 1637971 - RNA, 14 nt, Human
gagucacuggaaca

SEQ ID NO: 1637972 - RNA, 17 nt, Human
gaggugggauccuccag

SEQ ID NO: 1637973 - RNA, 18 nt, Human
gagugccuuacacaaugg

SEQ ID NO: 1637974 - RNA, 19 nt, Human
gaguugauacuacaguuug

SEQ ID NO: 1637975 - RNA, 21 nt, Human
gaguugauagcacagacccug

SEQ ID NO: 1637976 - RNA, 22 nt, Human
gaguugauacuacaguuuguua

SEQ ID NO: 1637977 - RNA, 18 nt, Human
gagugcagugagccgaga

SEQ ID NO: 1637978 - RNA, 24 nt, Human
gagugagcacuaaggugugcucug

SEQ ID NO: 1637979 - RNA, 18 nt, Human
gagugagacucugucuca

SEQ ID NO: 1637980 - RNA, 14 nt, Human
gagugagacucugu

SEQ ID NO: 1637981 - RNA, 18 nt, Human
gagucagaaguuucugcc

SEQ ID NO: 1637982 - RNA, 20 nt, Human
gaggccagagacacaagccu

SEQ ID NO: 1637983 - RNA, 14 nt, Human
gaggcucugcccuu

SEQ ID NO: 1637984 - RNA, 13 nt, Human
gaggcucugcccu

SEQ ID NO: 1637985 - RNA, 12 nt, Human
gaggcucugccc

SEQ ID NO: 1637986 - RNA, 17 nt, Human
gaggcucugcccuuggu

SEQ ID NO: 1637987 - RNA, 15 nt, Human
gaggcucugcccuug

SEQ ID NO: 1637988 - RNA, 19 nt, Human
gaggcucuggagcccacug

SEQ ID NO: 1637989 - RNA, 14 nt, Human
gaggcucuggagcc

SEQ ID NO: 1637990 - RNA, 14 nt, Human
gaggcugccucucc

SEQ ID NO: 1637991 - RNA, 15 nt, Human
gagggcuccagacac

SEQ ID NO: 1637992 - RNA, 14 nt, Human
gagggcuccagaca

SEQ ID NO: 1637993 - RNA, 13 nt, Human
gagggcuccagac

SEQ ID NO: 1637994 - RNA, 12 nt, Human
gagggcuccaga

SEQ ID NO: 1637995 - RNA, 12 nt, Human
gaggggaacaga

SEQ ID NO: 1637996 - RNA, 22 nt, Human
gagcaucaggccaggcccucug

SEQ ID NO: 1637997 - RNA, 20 nt, Human
gagcaucaggccaggcccuc

SEQ ID NO: 1637998 - RNA, 15 nt, Human
gagcgacagugagac

SEQ ID NO: 1637999 - RNA, 13 nt, Human
gagcgacagugag

SEQ ID NO: 1638000 - RNA, 13 nt, Human
gagccuuccaggg

SEQ ID NO: 1638001 - RNA, 12 nt, Human
gagccuuccagg

SEQ ID NO: 1638002 - RNA, 17 nt, Human
gagcuguucacagccag

SEQ ID NO: 1638003 - RNA, 19 nt, Human
gagcugccuguucagcucc

SEQ ID NO: 1638004 - RNA, 16 nt, Human
gagcugccuguucagc

SEQ ID NO: 1638005 - RNA, 15 nt, Human
gagcugccuguucag

SEQ ID NO: 1638006 - RNA, 17 nt, Human
gagcggagaaaggaagg

SEQ ID NO: 1638007 - RNA, 20 nt, Human
gagcugccuguucagcucca

SEQ ID NO: 1638008 - RNA, 12 nt, Human
gcaccuccugcc

SEQ ID NO: 1638009 - RNA, 16 nt, Human
gcaccggcuggccugg

SEQ ID NO: 1638010 - RNA, 15 nt, Human
gcaccggcuggccug

SEQ ID NO: 1638011 - RNA, 17 nt, Human
gcaccggcuggccuggc

SEQ ID NO: 1638012 - RNA, 18 nt, Human
gcaccggcuggccuggcc

SEQ ID NO: 1638013 - RNA, 18 nt, Human
gcaccuaccaccacgccc

SEQ ID NO: 1638014 - RNA, 17 nt, Human
gcaccuaccaccacgcc

SEQ ID NO: 1638015 - RNA, 14 nt, Human
gcacacauuuuuua

SEQ ID NO: 1638016 - RNA, 12 nt, Human
gcacacauuuuu

SEQ ID NO: 1638017 - RNA, 11 nt, Human
gcacacauuuu

SEQ ID NO: 1638018 - RNA, 20 nt, Human
gcacacaccagagcccaccu

SEQ ID NO: 1638019 - RNA, 23 nt, Human
gcacacagcacgggggccaagga

SEQ ID NO: 1638020 - RNA, 11 nt, Human
gcacacagcac

SEQ ID NO: 1638021 - RNA, 22 nt, Human
gcacuauagccuaggugacaga

SEQ ID NO: 1638022 - RNA, 12 nt, Human
gcacuccccugc

SEQ ID NO: 1638023 - RNA, 17 nt, Human
gcacuccagccugggug

SEQ ID NO: 1638024 - RNA, 16 nt, Human
gcaauaaaauggguuu

SEQ ID NO: 1638025 - RNA, 11 nt, Human
gcaauaaagca

SEQ ID NO: 1638026 - RNA, 18 nt, Human
gcaauagucaaauugugu

SEQ ID NO: 1638027 - RNA, 21 nt, Human
gcaauaaagcagcguuucuau

SEQ ID NO: 1638028 - RNA, 19 nt, Human
gcacacaccagagcccacc

SEQ ID NO: 1638029 - RNA, 18 nt, Human
gcacacaccagagcccac

SEQ ID NO: 1638030 - RNA, 17 nt, Human
gcacacaccagagccca

SEQ ID NO: 1638031 - RNA, 16 nt, Human
gcacacaccagagccc

SEQ ID NO: 1638032 - RNA, 15 nt, Human
gcacacaccagagcc

SEQ ID NO: 1638033 - RNA, 14 nt, Human
gcacacaccagagc

SEQ ID NO: 1638034 - RNA, 12 nt, Human
gcacacaccaga

SEQ ID NO: 1638035 - RNA, 19 nt, Human
gcaaccuccgccucuuggg

SEQ ID NO: 1638036 - RNA, 18 nt, Human
gcaaccuccgccucuugg

SEQ ID NO: 1638037 - RNA, 22 nt, Human
gcaacccuggugaccagcacca

SEQ ID NO: 1638038 - RNA, 16 nt, Human
gcaaaagaugcuucuc

SEQ ID NO: 1638039 - RNA, 18 nt, Human
gcaacccccagccugcua

SEQ ID NO: 1638040 - RNA, 15 nt, Human
gcaaaagaugcuucu

SEQ ID NO: 1638041 - RNA, 19 nt, Human
gauucuccugccucagccu

SEQ ID NO: 1638042 - RNA, 15 nt, Human
gauucuuaaaguuga

SEQ ID NO: 1638043 - RNA, 21 nt, Human
gauucuccugccucagccucc

SEQ ID NO: 1638044 - RNA, 20 nt, Human
gauucuccugccucagccuc

SEQ ID NO: 1638045 - RNA, 20 nt, Human
gauuuaacagaaauguacag

SEQ ID NO: 1638046 - RNA, 23 nt, Human
gauuuaacagaaauguacagcaa

SEQ ID NO: 1638047 - RNA, 23 nt, Human
gauucuuauggacaaugacccag

SEQ ID NO: 1638048 - RNA, 17 nt, Human
gauucuuaaaguugaau

SEQ ID NO: 1638049 - RNA, 16 nt, Human
gauucuuaaaguugaa

SEQ ID NO: 1638050 - RNA, 21 nt, Human
gauucuucugcuucagccucc

SEQ ID NO: 1638051 - RNA, 21 nt, Human
gauucuuaaaguugaauuuau

SEQ ID NO: 1638052 - RNA, 18 nt, Human
gauuucacucuccuuggu

SEQ ID NO: 1638053 - RNA, 17 nt, Human
gauuucacucuccuugg

SEQ ID NO: 1638054 - RNA, 20 nt, Human
gauuucagcucacugcaacc

SEQ ID NO: 1638055 - RNA, 17 nt, Human
gauuucagcucacugca

SEQ ID NO: 1638056 - RNA, 15 nt, Human
gauuucagcucacug

SEQ ID NO: 1638057 - RNA, 16 nt, Human
gauuucacucuccuug

SEQ ID NO: 1638058 - RNA, 13 nt, Human
gauuucacucucc

SEQ ID NO: 1638059 - RNA, 12 nt, Human
gauucuuuccug

SEQ ID NO: 1638060 - RNA, 23 nt, Human
gauuuuuuuuuccuucagugccu

SEQ ID NO: 1638061 - RNA, 22 nt, Human
gauuuuuuuuuccuucagugcc

SEQ ID NO: 1638062 - RNA, 16 nt, Human
gcaaaaauauuuuaug

SEQ ID NO: 1638063 - RNA, 23 nt, Human
gcaaaaauauuuuaugauccagc

SEQ ID NO: 1638064 - RNA, 22 nt, Human
gcaaaaauauuuuaugauccag

SEQ ID NO: 1638065 - RNA, 17 nt, Human
gcaaaaauauuuuauga

SEQ ID NO: 1638066 - RNA, 18 nt, Human
gaucuggguucacugcaa

SEQ ID NO: 1638067 - RNA, 22 nt, Human
gaguugauagcacagacccugc

SEQ ID NO: 1638068 - RNA, 20 nt, Human
gaucuggguucacugcaacc

SEQ ID NO: 1638069 - RNA, 17 nt, Human
gauguagaggagaaacu

SEQ ID NO: 1638070 - RNA, 17 nt, Human
gaugucccaacuuguaa

SEQ ID NO: 1638071 - RNA, 18 nt, Human
gaugucccaacuuguaaa

SEQ ID NO: 1638072 - RNA, 14 nt, Human
gaugcuuguacaua

SEQ ID NO: 1638073 - RNA, 16 nt, Human
gaugcuuguacauaau

SEQ ID NO: 1638074 - RNA, 23 nt, Human
gauggaggaaaaccaagccgugg

SEQ ID NO: 1638075 - RNA, 23 nt, Human
gaugcuucucacugccaugccag

SEQ ID NO: 1638076 - RNA, 14 nt, Human
gaugaugacuaugg

SEQ ID NO: 1638077 - RNA, 15 nt, Human
gcauaccacuuuugu

SEQ ID NO: 1638078 - RNA, 16 nt, Human
gcauaccacuuuuguu

SEQ ID NO: 1638079 - RNA, 23 nt, Human
gcaguugccagucaccccggcca

SEQ ID NO: 1638080 - RNA, 14 nt, Human
gcaguugccaguca

SEQ ID NO: 1638081 - RNA, 15 nt, Human
gcauaaaaauuagcc

SEQ ID NO: 1638082 - RNA, 15 nt, Human
gcauaacauaaaucu

SEQ ID NO: 1638083 - RNA, 13 nt, Human
gcauaacauaaau

SEQ ID NO: 1638084 - RNA, 22 nt, Human
gcaguugaaaagacuccaaaga

SEQ ID NO: 1638085 - RNA, 16 nt, Human
gcacuuuguucuggcu

SEQ ID NO: 1638086 - RNA, 15 nt, Human
gcagcuuauucacaa

SEQ ID NO: 1638087 - RNA, 16 nt, Human
gcagcuugaggguugg

SEQ ID NO: 1638088 - RNA, 20 nt, Human
gcagcugcuuuugucuaugg

SEQ ID NO: 1638089 - RNA, 13 nt, Human
gcagcugcuuuug

SEQ ID NO: 1638090 - RNA, 23 nt, Human
gcagcugcgguccacccaggagc

SEQ ID NO: 1638091 - RNA, 22 nt, Human
gcagcugcgguccacccaggag

SEQ ID NO: 1638092 - RNA, 16 nt, Human
gcaggcucucaggcca

SEQ ID NO: 1638093 - RNA, 15 nt, Human
gcaggcucucaggcc

SEQ ID NO: 1638094 - RNA, 14 nt, Human
gcaggcucucaggc

SEQ ID NO: 1638095 - RNA, 13 nt, Human
gcaggcucucagg

SEQ ID NO: 1638096 - RNA, 12 nt, Human
gcaggcucucag

SEQ ID NO: 1638097 - RNA, 22 nt, Human
gcaggcucgggcuccccagccc

SEQ ID NO: 1638098 - RNA, 21 nt, Human
gcagcuugaggguugggcugg

SEQ ID NO: 1638099 - RNA, 19 nt, Human
gcagcuugaggguugggcu

SEQ ID NO: 1638100 - RNA, 22 nt, Human
gcagggaaacagcuaaugggac

SEQ ID NO: 1638101 - RNA, 13 nt, Human
gcaggcuggcccu

SEQ ID NO: 1638102 - RNA, 17 nt, Human
gcaggcucucaggccag

SEQ ID NO: 1638103 - RNA, 18 nt, Human
gcaggcucucaggccagc

SEQ ID NO: 1638104 - RNA, 11 nt, Human
gccaaggccaa

SEQ ID NO: 1638105 - RNA, 17 nt, Human
gccaaggccaaaggaag

SEQ ID NO: 1638106 - RNA, 19 nt, Human
gccaaggccaaaggaagca

SEQ ID NO: 1638107 - RNA, 22 nt, Human
gccaagcaccuagccucgcucu

SEQ ID NO: 1638108 - RNA, 13 nt, Human
gcauggccaggug

SEQ ID NO: 1638109 - RNA, 17 nt, Human
gcauggccagguggcca

SEQ ID NO: 1638110 - RNA, 14 nt, Human
gcauggccaggugg

SEQ ID NO: 1638111 - RNA, 23 nt, Human
gcauccuggcacccggccccugc

SEQ ID NO: 1638112 - RNA, 22 nt, Human
gcauccuggcacccggccccug

SEQ ID NO: 1638113 - RNA, 13 nt, Human
gcaucgcaaugua

SEQ ID NO: 1638114 - RNA, 21 nt, Human
gcauccuggcacccggccccu

SEQ ID NO: 1638115 - RNA, 17 nt, Human
gcauccuggcacccggc

SEQ ID NO: 1638116 - RNA, 16 nt, Human
gcauuguaaaugugcu

SEQ ID NO: 1638117 - RNA, 18 nt, Human
gcaugugaugagaggaaa

SEQ ID NO: 1638118 - RNA, 17 nt, Human
gcaugugaugagaggaa

SEQ ID NO: 1638119 - RNA, 23 nt, Human
gcaugucccuaccgagucucuuc

SEQ ID NO: 1638120 - RNA, 16 nt, Human
gcaugggaaugaaugu

SEQ ID NO: 1638121 - RNA, 19 nt, Human
gcaugggaaugaaugucag

SEQ ID NO: 1638122 - RNA, 14 nt, Human
gcauuugaaaauuu

SEQ ID NO: 1638123 - RNA, 16 nt, Human
gcauuugaaaauuuug

SEQ ID NO: 1638124 - RNA, 12 nt, Human
gcauuuaaaaga

SEQ ID NO: 1638125 - RNA, 15 nt, Human
gcauuuaaaagauac

SEQ ID NO: 1638126 - RNA, 18 nt, Human
gccaagaauucuuaaaua

SEQ ID NO: 1638127 - RNA, 14 nt, Human
gccaagaauucuua

SEQ ID NO: 1638128 - RNA, 19 nt, Human
gccaacuauggccugugga

SEQ ID NO: 1638129 - RNA, 15 nt, Human
gccaacuauggccug

SEQ ID NO: 1638130 - RNA, 14 nt, Human
gccaacuauggccu

SEQ ID NO: 1638131 - RNA, 24 nt, Human
cuuggauuguccccgacccuugcc

SEQ ID NO: 1638132 - RNA, 23 nt, Human
cuuggauuguccccgacccuugc

SEQ ID NO: 1638133 - RNA, 12 nt, Human
cuugcaaaguau

SEQ ID NO: 1638134 - RNA, 12 nt, Human
cuugauucauaa

SEQ ID NO: 1638135 - RNA, 18 nt, Human
cuugauguguuaucucuu

SEQ ID NO: 1638136 - RNA, 17 nt, Human
cuugauauccucuuuga

SEQ ID NO: 1638137 - RNA, 22 nt, Human
cuugauauccucuuugagugaa

SEQ ID NO: 1638138 - RNA, 16 nt, Human
cuugacaucaacugca

SEQ ID NO: 1638139 - RNA, 18 nt, Human
cuugaauuguaaggaaug

SEQ ID NO: 1638140 - RNA, 13 nt, Human
cuuccuccuggug

SEQ ID NO: 1638141 - RNA, 22 nt, Human
cuuccucuuuccaucuacccuc

SEQ ID NO: 1638142 - RNA, 22 nt, Human
cuuccucugaggcugaaauuca

SEQ ID NO: 1638143 - RNA, 16 nt, Human
cuuccucugaggcuga

SEQ ID NO: 1638144 - RNA, 15 nt, Human
cuuccucugagccuu

SEQ ID NO: 1638145 - RNA, 14 nt, Human
cuuccucugagccu

SEQ ID NO: 1638146 - RNA, 15 nt, Human
cuuccucuccacugc

SEQ ID NO: 1638147 - RNA, 14 nt, Human
cuuccucuccacug

SEQ ID NO: 1638148 - RNA, 13 nt, Human
cuuccucuccacu

SEQ ID NO: 1638149 - RNA, 21 nt, Human
cuucuaaguaaaaccacagca

SEQ ID NO: 1638150 - RNA, 17 nt, Human
cuucuaaguaaaaccac

SEQ ID NO: 1638151 - RNA, 13 nt, Human
cuucuaaguaaaa

SEQ ID NO: 1638152 - RNA, 13 nt, Human
cuucucacauuua

SEQ ID NO: 1638153 - RNA, 20 nt, Human
cuucucacauuuauauuuuu

SEQ ID NO: 1638154 - RNA, 18 nt, Human
cuucuucagagacuccug

SEQ ID NO: 1638155 - RNA, 14 nt, Human
cuucuucagagacu

SEQ ID NO: 1638156 - RNA, 13 nt, Human
cuucuucagagac

SEQ ID NO: 1638157 - RNA, 15 nt, Human
cuucugacccaugcu

SEQ ID NO: 1638158 - RNA, 20 nt, Human
cuuuuauaaacuuuaccuuu

SEQ ID NO: 1638159 - RNA, 21 nt, Human
cuuuuauaaacuuuaccuuuu

SEQ ID NO: 1638160 - RNA, 22 nt, Human
cuuuguauucucuccuguaccu

SEQ ID NO: 1638161 - RNA, 17 nt, Human
cuuuguauucucuccug

SEQ ID NO: 1638162 - RNA, 12 nt, Human
cuuuguaugcac

SEQ ID NO: 1638163 - RNA, 16 nt, Human
cuuuguaaugaaaacc

SEQ ID NO: 1638164 - RNA, 15 nt, Human
cuuuguaaugaaaac

SEQ ID NO: 1638165 - RNA, 14 nt, Human
cuuuguaaugaaaa

SEQ ID NO: 1638166 - RNA, 16 nt, Human
cuuucuacccagcgag

SEQ ID NO: 1638167 - RNA, 15 nt, Human
cuuucuacccagcga

SEQ ID NO: 1638168 - RNA, 17 nt, Human
cuuucuacccagcgagc

SEQ ID NO: 1638169 - RNA, 17 nt, Human
cuuugacgccaucccag

SEQ ID NO: 1638170 - RNA, 16 nt, Human
cuuugacgccauccca

SEQ ID NO: 1638171 - RNA, 18 nt, Human
cuuugacgccaucccagc

SEQ ID NO: 1638172 - RNA, 22 nt, Human
cuuucagauacuggauuguacu

SEQ ID NO: 1638173 - RNA, 17 nt, Human
cuuucagauacuggauu

SEQ ID NO: 1638174 - RNA, 15 nt, Human
cuuucagauacugga

SEQ ID NO: 1638175 - RNA, 15 nt, Human
cuuucacccuuuucu

SEQ ID NO: 1638176 - RNA, 14 nt, Human
cuuucacccuuuuc

SEQ ID NO: 1638177 - RNA, 20 nt, Human
cuuucacccuuuucuguuug

SEQ ID NO: 1638178 - RNA, 14 nt, Human
cuuucagauacugg

SEQ ID NO: 1638179 - RNA, 23 nt, Human
cuuuaaugucacaggcaggucca

SEQ ID NO: 1638180 - RNA, 16 nt, Human
cuuggucugugagaug

SEQ ID NO: 1638181 - RNA, 14 nt, Human
cuugguccugcugc

SEQ ID NO: 1638182 - RNA, 19 nt, Human
cuuggucugugagaugcua

SEQ ID NO: 1638183 - RNA, 22 nt, Human
cuugguagaagcccuucuaccu

SEQ ID NO: 1638184 - RNA, 15 nt, Human
cuugucuuuggaccc

SEQ ID NO: 1638185 - RNA, 13 nt, Human
cuugucuuuggac

SEQ ID NO: 1638186 - RNA, 18 nt, Human
cuugucuuuggacccuga

SEQ ID NO: 1638187 - RNA, 19 nt, Human
cuugucuuuggacccugag

SEQ ID NO: 1638188 - RNA, 18 nt, Human
cuugucucagauuuuauu

SEQ ID NO: 1638189 - RNA, 20 nt, Human
cuuggugucgggcaugacac

SEQ ID NO: 1638190 - RNA, 19 nt, Human
cuuggugucgggcaugaca

SEQ ID NO: 1638191 - RNA, 13 nt, Human
cuugucucagauu

SEQ ID NO: 1638192 - RNA, 17 nt, Human
cuugucucagauuuuau

SEQ ID NO: 1638193 - RNA, 14 nt, Human
cuugucucagauuu

SEQ ID NO: 1638194 - RNA, 22 nt, Human
gaaccaccacacccagcccacu

SEQ ID NO: 1638195 - RNA, 21 nt, Human
gaaccaccacacccagcccac

SEQ ID NO: 1638196 - RNA, 20 nt, Human
gaaccaccacacccagccca

SEQ ID NO: 1638197 - RNA, 18 nt, Human
gaaccaccacacccagcc

SEQ ID NO: 1638198 - RNA, 23 nt, Human
gaaccaccacacccagcccacuu

SEQ ID NO: 1638199 - RNA, 22 nt, Human
gaaccauggucggaaaacaugc

SEQ ID NO: 1638200 - RNA, 17 nt, Human
gaacccaaguccaagca

SEQ ID NO: 1638201 - RNA, 16 nt, Human
gaacccaaguccaagc

SEQ ID NO: 1638202 - RNA, 19 nt, Human
gaacccgggaggcagaggu

SEQ ID NO: 1638203 - RNA, 17 nt, Human
gaacccgggaggcagag

SEQ ID NO: 1638204 - RNA, 13 nt, Human
gaacuccuggccu

SEQ ID NO: 1638205 - RNA, 14 nt, Human
gaacuccugaccuc

SEQ ID NO: 1638206 - RNA, 14 nt, Human
gaacuccuggccuc

SEQ ID NO: 1638207 - RNA, 15 nt, Human
gaacuccuggccuca

SEQ ID NO: 1638208 - RNA, 13 nt, Human
gaacugaaaucau

SEQ ID NO: 1638209 - RNA, 17 nt, Human
gaacugauguaaguaaa

SEQ ID NO: 1638210 - RNA, 15 nt, Human
gaagacagcucuuau

SEQ ID NO: 1638211 - RNA, 14 nt, Human
gaagacagcucuua

SEQ ID NO: 1638212 - RNA, 13 nt, Human
gaagacagcucuu

SEQ ID NO: 1638213 - RNA, 12 nt, Human
gaagacagcucu

SEQ ID NO: 1638214 - RNA, 15 nt, Human
gaagacagagcuaca

SEQ ID NO: 1638215 - RNA, 13 nt, Human
gaagacagagcua

SEQ ID NO: 1638216 - RNA, 16 nt, Human
gaagacacugaugggc

SEQ ID NO: 1638217 - RNA, 21 nt, Human
gaagacacugaugggcaaccc

SEQ ID NO: 1638218 - RNA, 16 nt, Human
gaagcaccauaacuuu

SEQ ID NO: 1638219 - RNA, 18 nt, Human
gaagacucauucuucugu

SEQ ID NO: 1638220 - RNA, 17 nt, Human
gaagacucauucuucug

SEQ ID NO: 1638221 - RNA, 16 nt, Human
gaagacucauucuucu

SEQ ID NO: 1638222 - RNA, 14 nt, Human
gaagcacagcuuca

SEQ ID NO: 1638223 - RNA, 13 nt, Human
gaagcacagcuuc

SEQ ID NO: 1638224 - RNA, 22 nt, Human
gaagcacaugccucucucaggc

SEQ ID NO: 1638225 - RNA, 14 nt, Human
gaagcacaugccuc

SEQ ID NO: 1638226 - RNA, 17 nt, Human
gaagcacagugaucaag

SEQ ID NO: 1638227 - RNA, 21 nt, Human
gaaacaagucagucauucaga

SEQ ID NO: 1638228 - RNA, 15 nt, Human
gaaaaugugugugug

SEQ ID NO: 1638229 - RNA, 12 nt, Human
gaaaaugugugu

SEQ ID NO: 1638230 - RNA, 17 nt, Human
gaaaagacuccaaagaa

SEQ ID NO: 1638231 - RNA, 16 nt, Human
gaaaagacuccaaaga

SEQ ID NO: 1638232 - RNA, 18 nt, Human
gaaaagacuccaaagaaa

SEQ ID NO: 1638233 - RNA, 14 nt, Human
gaaaagacuccaaa

SEQ ID NO: 1638234 - RNA, 21 nt, Human
gaaaacuuuaugcuaagugaa

SEQ ID NO: 1638235 - RNA, 23 nt, Human
gaaaagaaaaaugagccuggcaa

SEQ ID NO: 1638236 - RNA, 22 nt, Human
gaaaacuuguauuauguguguu

SEQ ID NO: 1638237 - RNA, 19 nt, Human
gaaaacuuguauuaugugu

SEQ ID NO: 1638238 - RNA, 18 nt, Human
gaaagaaaaucaggcugg

SEQ ID NO: 1638239 - RNA, 13 nt, Human
gaaacuggauuaa

SEQ ID NO: 1638240 - RNA, 17 nt, Human
gaaacuggauuaaacuu

SEQ ID NO: 1638241 - RNA, 15 nt, Human
gaaaggcuccaggag

SEQ ID NO: 1638242 - RNA, 14 nt, Human
gaaaggcuccagga

SEQ ID NO: 1638243 - RNA, 13 nt, Human
gaaaggcuccagg

SEQ ID NO: 1638244 - RNA, 16 nt, Human
gaaaggcuccaggagc

SEQ ID NO: 1638245 - RNA, 13 nt, Human
gaaagggcccaga

SEQ ID NO: 1638246 - RNA, 17 nt, Human
gaaaugaaagcagggac

SEQ ID NO: 1638247 - RNA, 11 nt, Human
gaaaugaaaaa

SEQ ID NO: 1638248 - RNA, 15 nt, Human
gaaaucuuuaaaaaa

SEQ ID NO: 1638249 - RNA, 12 nt, Human
gaaaucuuuaaa

SEQ ID NO: 1638250 - RNA, 16 nt, Human
gaaagggcccagagag

SEQ ID NO: 1638251 - RNA, 15 nt, Human
gaaagggcccagaga

SEQ ID NO: 1638252 - RNA, 20 nt, Human
gaacacauaauucaggaagc

SEQ ID NO: 1638253 - RNA, 17 nt, Human
gaacacauaauucagga

SEQ ID NO: 1638254 - RNA, 11 nt, Human
cugggacacag

SEQ ID NO: 1638255 - RNA, 22 nt, Human
cuggccccucagggucccuggu

SEQ ID NO: 1638256 - RNA, 14 nt, Human
cuggcccugcccug

SEQ ID NO: 1638257 - RNA, 13 nt, Human
cuggcccugcccu

SEQ ID NO: 1638258 - RNA, 11 nt, Human
cuggcccugcc

SEQ ID NO: 1638259 - RNA, 14 nt, Human
cuggccuagcauac

SEQ ID NO: 1638260 - RNA, 16 nt, Human
cuggccgggagccuga

SEQ ID NO: 1638261 - RNA, 15 nt, Human
cuggcccugcccugg

SEQ ID NO: 1638262 - RNA, 18 nt, Human
cuggcagaguugaagaca

SEQ ID NO: 1638263 - RNA, 17 nt, Human
cuggcagaguugaagac

SEQ ID NO: 1638264 - RNA, 13 nt, Human
cuggcagccccug

SEQ ID NO: 1638265 - RNA, 20 nt, Human
cuggcagccgugccuucagc

SEQ ID NO: 1638266 - RNA, 22 nt, Human
cuggcagccgugccuucagcuc

SEQ ID NO: 1638267 - RNA, 21 nt, Human
cuggcagccgugccuucagcu

SEQ ID NO: 1638268 - RNA, 12 nt, Human
cuggcagccccu

SEQ ID NO: 1638269 - RNA, 11 nt, Human
cuggcagccca

SEQ ID NO: 1638270 - RNA, 19 nt, Human
cuggcagaguugaagacag

SEQ ID NO: 1638271 - RNA, 14 nt, Human
cuggcagaggaggg

SEQ ID NO: 1638272 - RNA, 16 nt, Human
cugggcagaaggaaga

SEQ ID NO: 1638273 - RNA, 15 nt, Human
cugggcagaaggaag

SEQ ID NO: 1638274 - RNA, 12 nt, Human
cugggcagaagg

SEQ ID NO: 1638275 - RNA, 14 nt, Human
cugggccagaauuu

SEQ ID NO: 1638276 - RNA, 12 nt, Human
cugggccagaau

SEQ ID NO: 1638277 - RNA, 20 nt, Human
cuggguucacugcaaccucc

SEQ ID NO: 1638278 - RNA, 18 nt, Human
cuggguucacugcaaccu

SEQ ID NO: 1638279 - RNA, 15 nt, Human
cuggggccaggcugg

SEQ ID NO: 1638280 - RNA, 19 nt, Human
cugcuuuuuaaagaaugcu

SEQ ID NO: 1638281 - RNA, 21 nt, Human
cugcuuuugucuaugggacuc

SEQ ID NO: 1638282 - RNA, 14 nt, Human
cuggaagcacagcu

SEQ ID NO: 1638283 - RNA, 14 nt, Human
cuggagaaaaugga

SEQ ID NO: 1638284 - RNA, 14 nt, Human
cugcuucaaauauu

SEQ ID NO: 1638285 - RNA, 20 nt, Human
cugcuuuugucuaugggacu

SEQ ID NO: 1638286 - RNA, 23 nt, Human
cugcuucaaggauccugagccag

SEQ ID NO: 1638287 - RNA, 22 nt, Human
cugcuucaaggauccugagcca

SEQ ID NO: 1638288 - RNA, 21 nt, Human
cugcuucaaggauccugagcc

SEQ ID NO: 1638289 - RNA, 13 nt, Human
cugcuucaaggau

SEQ ID NO: 1638290 - RNA, 12 nt, Human
cugcuucaagga

SEQ ID NO: 1638291 - RNA, 19 nt, Human
cugcuucaaauauuucccu

SEQ ID NO: 1638292 - RNA, 20 nt, Human
cugaucugaugcaagcaaga

SEQ ID NO: 1638293 - RNA, 19 nt, Human
cugccuguucagcuccagc

SEQ ID NO: 1638294 - RNA, 20 nt, Human
cugccuguugggccaggagc

SEQ ID NO: 1638295 - RNA, 18 nt, Human
cugccuguucagcuccag

SEQ ID NO: 1638296 - RNA, 17 nt, Human
cugccuguucagcucca

SEQ ID NO: 1638297 - RNA, 22 nt, Human
cugccucucccaucacuucccu

SEQ ID NO: 1638298 - RNA, 15 nt, Human
cugccucucccauca

SEQ ID NO: 1638299 - RNA, 23 nt, Human
cugccucucccaucacuucccua

SEQ ID NO: 1638300 - RNA, 24 nt, Human
cugccuccucuucaacugaccagc

SEQ ID NO: 1638301 - RNA, 15 nt, Human
cugccuccucuucaa

SEQ ID NO: 1638302 - RNA, 14 nt, Human
cugccuccucuuca

SEQ ID NO: 1638303 - RNA, 13 nt, Human
cugccuccucuuc

SEQ ID NO: 1638304 - RNA, 21 nt, Human
cugcugacuguuuucucuuga

SEQ ID NO: 1638305 - RNA, 18 nt, Human
cugcugacuguuuucucu

SEQ ID NO: 1638306 - RNA, 17 nt, Human
cugcuaucaaagagguu

SEQ ID NO: 1638307 - RNA, 22 nt, Human
cugccuguugggccaggagccu

SEQ ID NO: 1638308 - RNA, 21 nt, Human
cugccuguugggccaggagcc

SEQ ID NO: 1638309 - RNA, 23 nt, Human
cugccuguugggccaggagccuc

SEQ ID NO: 1638310 - RNA, 12 nt, Human
cuguucacagcc

SEQ ID NO: 1638311 - RNA, 22 nt, Human
cuguuggcugggggccucagug

SEQ ID NO: 1638312 - RNA, 19 nt, Human
cuguuggcugggggccuca

SEQ ID NO: 1638313 - RNA, 14 nt, Human
cuguuggcuggggg

SEQ ID NO: 1638314 - RNA, 14 nt, Human
cuguuuaagagaca

SEQ ID NO: 1638315 - RNA, 12 nt, Human
cuguuuaagaga

SEQ ID NO: 1638316 - RNA, 15 nt, Human
cuuaccagcagagca

SEQ ID NO: 1638317 - RNA, 22 nt, Human
cuuacauuagcaguuugcuuug

SEQ ID NO: 1638318 - RNA, 21 nt, Human
cuuacauuagcaguuugcuuu

SEQ ID NO: 1638319 - RNA, 14 nt, Human
cuuaaaacaacacu

SEQ ID NO: 1638320 - RNA, 18 nt, Human
cuuaaaguugaauuuauu

SEQ ID NO: 1638321 - RNA, 15 nt, Human
cuuaaaguugaauuu

SEQ ID NO: 1638322 - RNA, 13 nt, Human
cuuaaauaaugug

SEQ ID NO: 1638323 - RNA, 22 nt, Human
cuuaaaguugaauuuauuggcu

SEQ ID NO: 1638324 - RNA, 21 nt, Human
cuuagggaaggauacaaaagc

SEQ ID NO: 1638325 - RNA, 19 nt, Human
cuuagggaaggauacaaaa

SEQ ID NO: 1638326 - RNA, 23 nt, Human
cuuagcucauucuccuuguguua

SEQ ID NO: 1638327 - RNA, 13 nt, Human
cuuagcugggaga

SEQ ID NO: 1638328 - RNA, 22 nt, Human
cuuagcucauucuccuuguguu

SEQ ID NO: 1638329 - RNA, 16 nt, Human
cuuaccagcagagcac

SEQ ID NO: 1638330 - RNA, 22 nt, Human
cuggugacaugucuuuucuugc

SEQ ID NO: 1638331 - RNA, 16 nt, Human
cugguuuccugcccug

SEQ ID NO: 1638332 - RNA, 14 nt, Human
cugguuuccugccc

SEQ ID NO: 1638333 - RNA, 13 nt, Human
cugguuuccugcc

SEQ ID NO: 1638334 - RNA, 13 nt, Human
cuguagaguggga

SEQ ID NO: 1638335 - RNA, 16 nt, Human
cugucgcccagucugg

SEQ ID NO: 1638336 - RNA, 23 nt, Human
cugucaauuacaggaaguacugg

SEQ ID NO: 1638337 - RNA, 20 nt, Human
cugucaauuacaggaaguac

SEQ ID NO: 1638338 - RNA, 14 nt, Human
cugugcugcccugc

SEQ ID NO: 1638339 - RNA, 13 nt, Human
cugugcugcccug

SEQ ID NO: 1638340 - RNA, 12 nt, Human
cugugcugcccu

SEQ ID NO: 1638341 - RNA, 19 nt, Human
cuguuauaaucuuucacag

SEQ ID NO: 1638342 - RNA, 13 nt, Human
cuguuauaaucuu

SEQ ID NO: 1638343 - RNA, 19 nt, Human
cugugcugcccugcccacc

SEQ ID NO: 1638344 - RNA, 18 nt, Human
cugugcugcccugcccac

SEQ ID NO: 1638345 - RNA, 17 nt, Human
cugugcugcccugccca

SEQ ID NO: 1638346 - RNA, 15 nt, Human
cugugcugcccugcc

SEQ ID NO: 1638347 - RNA, 19 nt, Human
cugugucagcauagaagua

SEQ ID NO: 1638348 - RNA, 17 nt, Human
cugugucagcauagaag

SEQ ID NO: 1638349 - RNA, 21 nt, Human
cugugcugcccugcccaccug

SEQ ID NO: 1638350 - RNA, 15 nt, Human
cauuuggauuggaug

SEQ ID NO: 1638351 - RNA, 17 nt, Human
cauuugucacacacuuu

SEQ ID NO: 1638352 - RNA, 16 nt, Human
cauuugugaaaugaug

SEQ ID NO: 1638353 - RNA, 14 nt, Human
cauuugugaaauga

SEQ ID NO: 1638354 - RNA, 15 nt, Human
cauuuauucugcuca

SEQ ID NO: 1638355 - RNA, 14 nt, Human
cauuuauucugcuc

SEQ ID NO: 1638356 - RNA, 19 nt, Human
cauuuuuuaaaugcaccug

SEQ ID NO: 1638357 - RNA, 15 nt, Human
cauuuuuuaaaugca

SEQ ID NO: 1638358 - RNA, 16 nt, Human
cauuuuuuaaaugcac

SEQ ID NO: 1638359 - RNA, 16 nt, Human
ccaaggccaaaggaag

SEQ ID NO: 1638360 - RNA, 18 nt, Human
ccaaaugcagcuuuaaaa

SEQ ID NO: 1638361 - RNA, 15 nt, Human
ccaaaugcagcuuua

SEQ ID NO: 1638362 - RNA, 13 nt, Human
ccaaaugcagcuu

SEQ ID NO: 1638363 - RNA, 13 nt, Human
ccaagaagcccag

SEQ ID NO: 1638364 - RNA, 16 nt, Human
ccaacgucugugccau

SEQ ID NO: 1638365 - RNA, 15 nt, Human
ccaacgucugugcca

SEQ ID NO: 1638366 - RNA, 13 nt, Human
ccaacgucugugc

SEQ ID NO: 1638367 - RNA, 22 nt, Human
ccaaauggaaaugggcagagca

SEQ ID NO: 1638368 - RNA, 19 nt, Human
ccaagcuggucccacucag

SEQ ID NO: 1638369 - RNA, 12 nt, Human
ccaagcuggucc

SEQ ID NO: 1638370 - RNA, 14 nt, Human
ccaagaagcccagg

SEQ ID NO: 1638371 - RNA, 20 nt, Human
ccaagcuggucccacucagu

SEQ ID NO: 1638372 - RNA, 18 nt, Human
ccaaggaugccccguccc

SEQ ID NO: 1638373 - RNA, 15 nt, Human
ccaaggccaaaggaa

SEQ ID NO: 1638374 - RNA, 18 nt, Human
ccacagaagcuccaggua

SEQ ID NO: 1638375 - RNA, 22 nt, Human
ccacagagaaaguacuucucca

SEQ ID NO: 1638376 - RNA, 18 nt, Human
ccaccagucugacuguuu

SEQ ID NO: 1638377 - RNA, 15 nt, Human
ccaccacgcccggcu

SEQ ID NO: 1638378 - RNA, 16 nt, Human
ccacagaagcuccagg

SEQ ID NO: 1638379 - RNA, 21 nt, Human
ccacacuucaggcucuucucc

SEQ ID NO: 1638380 - RNA, 20 nt, Human
ccacacuucaggcucuucuc

SEQ ID NO: 1638381 - RNA, 16 nt, Human
ccacacuucaggcucu

SEQ ID NO: 1638382 - RNA, 13 nt, Human
ccacgcccccacu

SEQ ID NO: 1638383 - RNA, 19 nt, Human
ccaccuuggcugcagggag

SEQ ID NO: 1638384 - RNA, 18 nt, Human
ccaccuuggcugcaggga

SEQ ID NO: 1638385 - RNA, 18 nt, Human
ccacgcuggaccuugaac

SEQ ID NO: 1638386 - RNA, 13 nt, Human
ccacgcuggagug

SEQ ID NO: 1638387 - RNA, 16 nt, Human
ccaccuuggcugcagg

SEQ ID NO: 1638388 - RNA, 15 nt, Human
ccaccuuggcugcag

SEQ ID NO: 1638389 - RNA, 14 nt, Human
ccaccuuggcugca

SEQ ID NO: 1638390 - RNA, 12 nt, Human
ccaccuuggcug

SEQ ID NO: 1638391 - RNA, 22 nt, Human
ccaccgggcugggagcucugca

SEQ ID NO: 1638392 - RNA, 19 nt, Human
ccaccaucaugucuggcua

SEQ ID NO: 1638393 - RNA, 18 nt, Human
ccaccaucaugucuggcu

SEQ ID NO: 1638394 - RNA, 19 nt, Human
ccaccgggcugggagcucu

SEQ ID NO: 1638395 - RNA, 15 nt, Human
cagugggagcugccu

SEQ ID NO: 1638396 - RNA, 22 nt, Human
cauagcagagaaugaaagggcc

SEQ ID NO: 1638397 - RNA, 19 nt, Human
cauagcagagaaugaaagg

SEQ ID NO: 1638398 - RNA, 15 nt, Human
cauauucaggaagcu

SEQ ID NO: 1638399 - RNA, 14 nt, Human
cauauucaggaagc

SEQ ID NO: 1638400 - RNA, 20 nt, Human
cauauucaggaagcucaggg

SEQ ID NO: 1638401 - RNA, 22 nt, Human
cauauucaggaagcucagggcc

SEQ ID NO: 1638402 - RNA, 20 nt, Human
cauaugccugggcagaagga

SEQ ID NO: 1638403 - RNA, 15 nt, Human
cauaugccugggcag

SEQ ID NO: 1638404 - RNA, 22 nt, Human
cauaugccugggcagaaggaag

SEQ ID NO: 1638405 - RNA, 15 nt, Human
caucaggccaggccc

SEQ ID NO: 1638406 - RNA, 19 nt, Human
caucaggccaggcccucug

SEQ ID NO: 1638407 - RNA, 16 nt, Human
caucaggccaggcccu

SEQ ID NO: 1638408 - RNA, 20 nt, Human
caucaggccaggcccucugc

SEQ ID NO: 1638409 - RNA, 19 nt, Human
caucccauaugccugggca

SEQ ID NO: 1638410 - RNA, 14 nt, Human
cauccccuguagag

SEQ ID NO: 1638411 - RNA, 21 nt, Human
cauccccuguagagugggagc

SEQ ID NO: 1638412 - RNA, 13 nt, Human
cauuaucucaaaa

SEQ ID NO: 1638413 - RNA, 12 nt, Human
cauuaucucaaa

SEQ ID NO: 1638414 - RNA, 23 nt, Human
cauuaucuagauacuguaucaug

SEQ ID NO: 1638415 - RNA, 22 nt, Human
cauuaggugugacugaauuucu

SEQ ID NO: 1638416 - RNA, 13 nt, Human
cauguuggccagg

SEQ ID NO: 1638417 - RNA, 12 nt, Human
cauguuggccag

SEQ ID NO: 1638418 - RNA, 20 nt, Human
cauguccaagaagcccagga

SEQ ID NO: 1638419 - RNA, 19 nt, Human
cauguccaagaagcccagg

SEQ ID NO: 1638420 - RNA, 18 nt, Human
cauguccaagaagcccag

SEQ ID NO: 1638421 - RNA, 12 nt, Human
cauuccuguucc

SEQ ID NO: 1638422 - RNA, 18 nt, Human
cauucuagguuugcaaga

SEQ ID NO: 1638423 - RNA, 13 nt, Human
cauucucacuccu

SEQ ID NO: 1638424 - RNA, 14 nt, Human
cauucucacuccua

SEQ ID NO: 1638425 - RNA, 16 nt, Human
caugcacgugugugca

SEQ ID NO: 1638426 - RNA, 13 nt, Human
caugcugcccugu

SEQ ID NO: 1638427 - RNA, 12 nt, Human
caugcugcccug

SEQ ID NO: 1638428 - RNA, 13 nt, Human
caugcuccuggcc

SEQ ID NO: 1638429 - RNA, 23 nt, Human
caugauuaaccacuucagcugac

SEQ ID NO: 1638430 - RNA, 22 nt, Human
caugauuaaccacuucagcuga

SEQ ID NO: 1638431 - RNA, 24 nt, Human
caugauuaaccacuucagcugacu

SEQ ID NO: 1638432 - RNA, 12 nt, Human
caugcacaaauu

SEQ ID NO: 1638433 - RNA, 15 nt, Human
caugaaguaauaugc

SEQ ID NO: 1638434 - RNA, 19 nt, Human
caugaaguaauaugcacac

SEQ ID NO: 1638435 - RNA, 22 nt, Human
caugaaguaauaugcacacauu

SEQ ID NO: 1638436 - RNA, 23 nt, Human
caugaaguaauaugcacacauuu

SEQ ID NO: 1638437 - RNA, 23 nt, Human
caugacacgaauauugcugaugg

SEQ ID NO: 1638438 - RNA, 21 nt, Human
caugacacgaauauugcugau

SEQ ID NO: 1638439 - RNA, 15 nt, Human
caugcugcccuguga

SEQ ID NO: 1638440 - RNA, 14 nt, Human
caugcugcccugug

SEQ ID NO: 1638441 - RNA, 13 nt, Human
cauggccaggugg

SEQ ID NO: 1638442 - RNA, 14 nt, Human
cauggccagguggc

SEQ ID NO: 1638443 - RNA, 15 nt, Human
cagucaccucaugga

SEQ ID NO: 1638444 - RNA, 22 nt, Human
cagucaccccggccaccugcgg

SEQ ID NO: 1638445 - RNA, 19 nt, Human
cagucaccccggccaccug

SEQ ID NO: 1638446 - RNA, 20 nt, Human
cagucaccccggccaccugc

SEQ ID NO: 1638447 - RNA, 21 nt, Human
caguauuguacaaaguauuaa

SEQ ID NO: 1638448 - RNA, 16 nt, Human
cagguuuaagcuguua

SEQ ID NO: 1638449 - RNA, 21 nt, Human
cagguuggugggggccucggu

SEQ ID NO: 1638450 - RNA, 18 nt, Human
cagguuuaagcuguuacu

SEQ ID NO: 1638451 - RNA, 13 nt, Human
caguauuguacaa

SEQ ID NO: 1638452 - RNA, 12 nt, Human
caguauuguaca

SEQ ID NO: 1638453 - RNA, 19 nt, Human
caguauuguacaaaguauu

SEQ ID NO: 1638454 - RNA, 18 nt, Human
caguauuguacaaaguau

SEQ ID NO: 1638455 - RNA, 17 nt, Human
caguauuguacaaagua

SEQ ID NO: 1638456 - RNA, 16 nt, Human
caguauuguacaaagu

SEQ ID NO: 1638457 - RNA, 18 nt, Human
cagggucucacucugucg

SEQ ID NO: 1638458 - RNA, 21 nt, Human
cagggucucacucugucgccc

SEQ ID NO: 1638459 - RNA, 22 nt, Human
cagggucucacucugucgccca

SEQ ID NO: 1638460 - RNA, 17 nt, Human
caggugauccacccacc

SEQ ID NO: 1638461 - RNA, 16 nt, Human
caggugauccacccac

SEQ ID NO: 1638462 - RNA, 12 nt, Human
caggguuggccc

SEQ ID NO: 1638463 - RNA, 14 nt, Human
caggguuggccccu

SEQ ID NO: 1638464 - RNA, 20 nt, Human
caggugauccacccaccuca

SEQ ID NO: 1638465 - RNA, 14 nt, Human
cagguugguggggg

SEQ ID NO: 1638466 - RNA, 20 nt, Human
caggugcuaggaacacuccu

SEQ ID NO: 1638467 - RNA, 18 nt, Human
caggugcuaggaacacuc

SEQ ID NO: 1638468 - RNA, 14 nt, Human
caggugcgaaagga

SEQ ID NO: 1638469 - RNA, 15 nt, Human
cagucucaggaaauc

SEQ ID NO: 1638470 - RNA, 14 nt, Human
cagucucccucccu

SEQ ID NO: 1638471 - RNA, 15 nt, Human
cagugccaaaaacaa

SEQ ID NO: 1638472 - RNA, 12 nt, Human
cagugcccacag

SEQ ID NO: 1638473 - RNA, 19 nt, Human
cagugggacagggcauggc

SEQ ID NO: 1638474 - RNA, 11 nt, Human
cagugggagcu

SEQ ID NO: 1638475 - RNA, 23 nt, Human
cagugcaugcugucccuuacgug

SEQ ID NO: 1638476 - RNA, 22 nt, Human
cagugcaugcugucccuuacgu

SEQ ID NO: 1638477 - RNA, 19 nt, Human
cagugcaugcugucccuua

SEQ ID NO: 1638478 - RNA, 20 nt, Human
cagucugauucccaagcucu

SEQ ID NO: 1638479 - RNA, 19 nt, Human
cagucugauucccaagcuc

SEQ ID NO: 1638480 - RNA, 22 nt, Human
cagugcacuaauguguaagaca

SEQ ID NO: 1638481 - RNA, 18 nt, Human
cagggaggacgcucucug

SEQ ID NO: 1638482 - RNA, 17 nt, Human
cagggaggacgcucucu

SEQ ID NO: 1638483 - RNA, 19 nt, Human
caggcugggcuucaguggc

SEQ ID NO: 1638484 - RNA, 17 nt, Human
caggcugggcuucagug

SEQ ID NO: 1638485 - RNA, 19 nt, Human
cagggaggacgcucucugg

SEQ ID NO: 1638486 - RNA, 13 nt, Human
cagggagggccug

SEQ ID NO: 1638487 - RNA, 12 nt, Human
cagggagggccu

SEQ ID NO: 1638488 - RNA, 16 nt, Human
caggcugggcuucagu

SEQ ID NO: 1638489 - RNA, 15 nt, Human
caggcuggcgugcag

SEQ ID NO: 1638490 - RNA, 20 nt, Human
caggcuggcccugcccuggu

SEQ ID NO: 1638491 - RNA, 17 nt, Human
caggcgccccuuccccc

SEQ ID NO: 1638492 - RNA, 19 nt, Human
caggcuggcccugcccugg

SEQ ID NO: 1638493 - RNA, 18 nt, Human
caggcuggcccugcccug

SEQ ID NO: 1638494 - RNA, 15 nt, Human
caggcgccccuuccc

SEQ ID NO: 1638495 - RNA, 20 nt, Human
caggccugccuguucccauu

SEQ ID NO: 1638496 - RNA, 18 nt, Human
cagggaggugaccccagg

SEQ ID NO: 1638497 - RNA, 16 nt, Human
cagggagggccugggc

SEQ ID NO: 1638498 - RNA, 14 nt, Human
cagggagggccugg

SEQ ID NO: 1638499 - RNA, 22 nt, Human
cagggaguccgaaagggacuug

SEQ ID NO: 1638500 - RNA, 17 nt, Human
cagggagggccugggcc

SEQ ID NO: 1638501 - RNA, 15 nt, Human
caggagggaggggga

SEQ ID NO: 1638502 - RNA, 17 nt, Human
caggaggccagccuuga

SEQ ID NO: 1638503 - RNA, 23 nt, Human
caggagggagggggaaggcaggg

SEQ ID NO: 1638504 - RNA, 23 nt, Human
caggcacccaccaucaugucugg

SEQ ID NO: 1638505 - RNA, 22 nt, Human
caggcacccaccaucaugucug

SEQ ID NO: 1638506 - RNA, 18 nt, Human
caggcacccaccaucaug

SEQ ID NO: 1638507 - RNA, 16 nt, Human
caggaggccagccuug

SEQ ID NO: 1638508 - RNA, 15 nt, Human
caggaggccagccuu

SEQ ID NO: 1638509 - RNA, 21 nt, Human
caggccagagggagugacaga

SEQ ID NO: 1638510 - RNA, 19 nt, Human
caggccagagggagugaca

SEQ ID NO: 1638511 - RNA, 23 nt, Human
caggccagagggagugacagagg

SEQ ID NO: 1638512 - RNA, 17 nt, Human
cagagcugcccucuccu

SEQ ID NO: 1638513 - RNA, 13 nt, Human
cagagcugcccuc

SEQ ID NO: 1638514 - RNA, 15 nt, Human
cagagcugcccucuc

SEQ ID NO: 1638515 - RNA, 18 nt, Human
cagagcugccaccugccu

SEQ ID NO: 1638516 - RNA, 23 nt, Human
cagaaguuugagaucagccuggg

SEQ ID NO: 1638517 - RNA, 22 nt, Human
cagaaguuugagaucagccugg

SEQ ID NO: 1638518 - RNA, 20 nt, Human
cagaaguuugagaucagccu

SEQ ID NO: 1638519 - RNA, 19 nt, Human
cagaaguuucugccgcagc

SEQ ID NO: 1638520 - RNA, 22 nt, Human
cagagggccugcaagggaguga

SEQ ID NO: 1638521 - RNA, 20 nt, Human
cagaggggguggccucccaa

SEQ ID NO: 1638522 - RNA, 19 nt, Human
cagaggggguggccuccca

SEQ ID NO: 1638523 - RNA, 18 nt, Human
cagaggggguggccuccc

SEQ ID NO: 1638524 - RNA, 20 nt, Human
cagagucagaaguuucugcc

SEQ ID NO: 1638525 - RNA, 19 nt, Human
cagauaugauucaaauguc

SEQ ID NO: 1638526 - RNA, 17 nt, Human
cagauaugauucaaaug

SEQ ID NO: 1638527 - RNA, 16 nt, Human
cagauaugauucaaau

SEQ ID NO: 1638528 - RNA, 15 nt, Human
cagauaugauucaaa

SEQ ID NO: 1638529 - RNA, 21 nt, Human
cagcaguugaaaagacuccaa

SEQ ID NO: 1638530 - RNA, 20 nt, Human
cagcaguugaaaagacucca

SEQ ID NO: 1638531 - RNA, 17 nt, Human
cagcaguugaaaagacu

SEQ ID NO: 1638532 - RNA, 22 nt, Human
cagcaguugaaaagacuccaaa

SEQ ID NO: 1638533 - RNA, 23 nt, Human
cagcauauucaggaagcucaggg

SEQ ID NO: 1638534 - RNA, 22 nt, Human
cagcauauucaggaagcucagg

SEQ ID NO: 1638535 - RNA, 19 nt, Human
cagcauauucaggaagcuc

SEQ ID NO: 1638536 - RNA, 22 nt, Human
cagccagcaguucagagcugcc

SEQ ID NO: 1638537 - RNA, 15 nt, Human
cagccagcaguucag

SEQ ID NO: 1638538 - RNA, 21 nt, Human
cagccagcaguucagagcugc

SEQ ID NO: 1638539 - RNA, 14 nt, Human
cagccagcaguuca

SEQ ID NO: 1638540 - RNA, 13 nt, Human
cagccaggccaca

SEQ ID NO: 1638541 - RNA, 12 nt, Human
cagccaggccac

SEQ ID NO: 1638542 - RNA, 22 nt, Human
cagccaggccacaagacccuug

SEQ ID NO: 1638543 - RNA, 22 nt, Human
cagcacagccucuuagaugcag

SEQ ID NO: 1638544 - RNA, 22 nt, Human
cagccugagcgacagugagacu

SEQ ID NO: 1638545 - RNA, 19 nt, Human
cagccugagcgacagugag

SEQ ID NO: 1638546 - RNA, 18 nt, Human
cagccugagcgacaguga

SEQ ID NO: 1638547 - RNA, 17 nt, Human
cagcggggacagcuccu

SEQ ID NO: 1638548 - RNA, 16 nt, Human
cagcggggacagcucc

SEQ ID NO: 1638549 - RNA, 15 nt, Human
cagcggggacagcuc

SEQ ID NO: 1638550 - RNA, 20 nt, Human
cagcccuucuuuccacagaa

SEQ ID NO: 1638551 - RNA, 19 nt, Human
cagcccuucuuuccacaga

SEQ ID NO: 1638552 - RNA, 15 nt, Human
cagcccuucuuucca

SEQ ID NO: 1638553 - RNA, 21 nt, Human
cagccgagauagccaaggcca

SEQ ID NO: 1638554 - RNA, 21 nt, Human
cagccccuggaugcagccuca

SEQ ID NO: 1638555 - RNA, 19 nt, Human
cagccccuggaugcagccu

SEQ ID NO: 1638556 - RNA, 18 nt, Human
cagccccuggaugcagcc

SEQ ID NO: 1638557 - RNA, 17 nt, Human
cagccccuggaugcagc

SEQ ID NO: 1638558 - RNA, 21 nt, Human
cagcccuuagcagggaaacag

SEQ ID NO: 1638559 - RNA, 16 nt, Human
cagcccuuagcaggga

SEQ ID NO: 1638560 - RNA, 22 nt, Human
cagccccuggaugcagccucac

SEQ ID NO: 1638561 - RNA, 14 nt, Human
cagccccuggaugc

SEQ ID NO: 1638562 - RNA, 13 nt, Human
cagccccuggaug

SEQ ID NO: 1638563 - RNA, 12 nt, Human
cagccccuggau

SEQ ID NO: 1638564 - RNA, 23 nt, Human
caggaaaucaaauaugcaaagca

SEQ ID NO: 1638565 - RNA, 15 nt, Human
caggaaaggcuccag

SEQ ID NO: 1638566 - RNA, 14 nt, Human
caggaaaggcucca

SEQ ID NO: 1638567 - RNA, 19 nt, Human
cagcuucauuuccuguguc

SEQ ID NO: 1638568 - RNA, 18 nt, Human
cagcuucauuuccugugu

SEQ ID NO: 1638569 - RNA, 15 nt, Human
cagcuucauuuccug

SEQ ID NO: 1638570 - RNA, 18 nt, Human
cagcugugcucuggacag

SEQ ID NO: 1638571 - RNA, 19 nt, Human
cagcugugcucuggacagg

SEQ ID NO: 1638572 - RNA, 12 nt, Human
cagcugccugca

SEQ ID NO: 1638573 - RNA, 20 nt, Human
cagcuccccucggagaagag

SEQ ID NO: 1638574 - RNA, 18 nt, Human
cagcuccccucggagaag

SEQ ID NO: 1638575 - RNA, 17 nt, Human
cagcuccccucggagaa

SEQ ID NO: 1638576 - RNA, 16 nt, Human
cagcuccccucggaga

SEQ ID NO: 1638577 - RNA, 23 nt, Human
cagcugccuccccuccucugcuu

SEQ ID NO: 1638578 - RNA, 24 nt, Human
cagcugccuccccuccucugcuug

SEQ ID NO: 1638579 - RNA, 21 nt, Human
cagcugccuccccuccucugc

SEQ ID NO: 1638580 - RNA, 22 nt, Human
cagcugccuccccuccucugcu

SEQ ID NO: 1638581 - RNA, 20 nt, Human
cagcuccagcucaccagccc

SEQ ID NO: 1638582 - RNA, 18 nt, Human
cagcuccagcucaccagc

SEQ ID NO: 1638583 - RNA, 17 nt, Human
cagcuccagcucaccag

SEQ ID NO: 1638584 - RNA, 16 nt, Human
cagcuccagcucacca

SEQ ID NO: 1638585 - RNA, 22 nt, Human
cagcuccagcucaccagcccca

SEQ ID NO: 1638586 - RNA, 21 nt, Human
cagcucccaaggcucugagca

SEQ ID NO: 1638587 - RNA, 15 nt, Human
cagcuccagcucacc

SEQ ID NO: 1638588 - RNA, 14 nt, Human
cagcuccagcucac

SEQ ID NO: 1638589 - RNA, 13 nt, Human
cagcuccagcuca

SEQ ID NO: 1638590 - RNA, 19 nt, Human
cagcuccaagaauuucuag

SEQ ID NO: 1638591 - RNA, 16 nt, Human
cagcuccaagaauuuc

SEQ ID NO: 1638592 - RNA, 20 nt, Human
auuguacaaaguauuaagca

SEQ ID NO: 1638593 - RNA, 19 nt, Human
auuguacaaaguauuaagc

SEQ ID NO: 1638594 - RNA, 17 nt, Human
auuguacaaaguauuaa

SEQ ID NO: 1638595 - RNA, 16 nt, Human
auuguacaaaguauua

SEQ ID NO: 1638596 - RNA, 21 nt, Human
auuguaauuauaucugaggaa

SEQ ID NO: 1638597 - RNA, 18 nt, Human
auuguaagcaugcacaaa

SEQ ID NO: 1638598 - RNA, 15 nt, Human
auuguaauuauaucu

SEQ ID NO: 1638599 - RNA, 17 nt, Human
auuguaauuauaucuga

SEQ ID NO: 1638600 - RNA, 16 nt, Human
auuguaauuauaucug

SEQ ID NO: 1638601 - RNA, 16 nt, Human
auuguugucugcaacu

SEQ ID NO: 1638602 - RNA, 15 nt, Human
auuguuuaaaaucau

SEQ ID NO: 1638603 - RNA, 16 nt, Human
auuucuauauuuucau

SEQ ID NO: 1638604 - RNA, 15 nt, Human
auuucuauauuuuca

SEQ ID NO: 1638605 - RNA, 14 nt, Human
auuucuaugaaaua

SEQ ID NO: 1638606 - RNA, 18 nt, Human
auuucuauauuuucauuc

SEQ ID NO: 1638607 - RNA, 17 nt, Human
auuucuauauuuucauu

SEQ ID NO: 1638608 - RNA, 20 nt, Human
auuucauaccuaucaucuua

SEQ ID NO: 1638609 - RNA, 22 nt, Human
auuucuaugcugaguuugugcu

SEQ ID NO: 1638610 - RNA, 21 nt, Human
auuucuaugcugaguuugugc

SEQ ID NO: 1638611 - RNA, 19 nt, Human
auuucuaugcugaguuugu

SEQ ID NO: 1638612 - RNA, 19 nt, Human
auuucuauauuuucauucu

SEQ ID NO: 1638613 - RNA, 16 nt, Human
auuuaauaaaugugcc

SEQ ID NO: 1638614 - RNA, 21 nt, Human
auuuaaugaaagacuguacaa

SEQ ID NO: 1638615 - RNA, 20 nt, Human
auuuaaugaaagacuguaca

SEQ ID NO: 1638616 - RNA, 16 nt, Human
auuuaaugaaagacug

SEQ ID NO: 1638617 - RNA, 13 nt, Human
auuuaauaauuau

SEQ ID NO: 1638618 - RNA, 22 nt, Human
auuuaugcauauuauuuuaugu

SEQ ID NO: 1638619 - RNA, 16 nt, Human
auuuaugcauauuauu

SEQ ID NO: 1638620 - RNA, 22 nt, Human
auuaugaauuacauuuguauaa

SEQ ID NO: 1638621 - RNA, 20 nt, Human
auuaugaauuacauuuguau

SEQ ID NO: 1638622 - RNA, 19 nt, Human
auuaugaauuacauuugua

SEQ ID NO: 1638623 - RNA, 20 nt, Human
auuaguacuccccuccuuga

SEQ ID NO: 1638624 - RNA, 19 nt, Human
auuaaaugcccagccccuu

SEQ ID NO: 1638625 - RNA, 17 nt, Human
auuaaaugcccagcccc

SEQ ID NO: 1638626 - RNA, 11 nt, Human
auuaaauuaug

SEQ ID NO: 1638627 - RNA, 16 nt, Human
auuaggauuucaugau

SEQ ID NO: 1638628 - RNA, 14 nt, Human
auuaggauuucaug

SEQ ID NO: 1638629 - RNA, 18 nt, Human
auucaacagguuuuccug

SEQ ID NO: 1638630 - RNA, 16 nt, Human
auucaaaugucuauaa

SEQ ID NO: 1638631 - RNA, 12 nt, Human
auuauguaaauc

SEQ ID NO: 1638632 - RNA, 15 nt, Human
auucuugcaaaguau

SEQ ID NO: 1638633 - RNA, 16 nt, Human
auucuugcaaaguauc

SEQ ID NO: 1638634 - RNA, 14 nt, Human
auucuugcaaagua

SEQ ID NO: 1638635 - RNA, 22 nt, Human
auucuucuguacgucugacagg

SEQ ID NO: 1638636 - RNA, 20 nt, Human
auucuucugcuucagccucc

SEQ ID NO: 1638637 - RNA, 19 nt, Human
auucuucugcuucagccuc

SEQ ID NO: 1638638 - RNA, 19 nt, Human
auucucuaguuugauuaaa

SEQ ID NO: 1638639 - RNA, 18 nt, Human
auucuccuuguguuacua

SEQ ID NO: 1638640 - RNA, 19 nt, Human
auucuccuuguguuacuaa

SEQ ID NO: 1638641 - RNA, 21 nt, Human
auucuccuuguguuacuaagu

SEQ ID NO: 1638642 - RNA, 22 nt, Human
auucuccuuguguuacuaaguu

SEQ ID NO: 1638643 - RNA, 17 nt, Human
auucucuaguuugauua

SEQ ID NO: 1638644 - RNA, 18 nt, Human
auucucuaguuugauuaa

SEQ ID NO: 1638645 - RNA, 15 nt, Human
auuccugcauuugug

SEQ ID NO: 1638646 - RNA, 18 nt, Human
auuccugcauuugugaaa

SEQ ID NO: 1638647 - RNA, 19 nt, Human
caagacccaaaaggcagaa

SEQ ID NO: 1638648 - RNA, 20 nt, Human
caagaauuucuaggacugaa

SEQ ID NO: 1638649 - RNA, 17 nt, Human
caagaccacguuucuaa

SEQ ID NO: 1638650 - RNA, 18 nt, Human
caagaccacguuucuaaa

SEQ ID NO: 1638651 - RNA, 14 nt, Human
caacucuccuccag

SEQ ID NO: 1638652 - RNA, 22 nt, Human
caagaauugaagcaggacuaaa

SEQ ID NO: 1638653 - RNA, 18 nt, Human
caacucaccccagcccca

SEQ ID NO: 1638654 - RNA, 17 nt, Human
caacucauauuuucaug

SEQ ID NO: 1638655 - RNA, 18 nt, Human
caacuaauuuuuguauuu

SEQ ID NO: 1638656 - RNA, 22 nt, Human
caaagcagugcaugcugucccu

SEQ ID NO: 1638657 - RNA, 18 nt, Human
caaagauauuuugcuuug

SEQ ID NO: 1638658 - RNA, 21 nt, Human
caaagcagugcaugcuguccc

SEQ ID NO: 1638659 - RNA, 18 nt, Human
caaagcagugcaugcugu

SEQ ID NO: 1638660 - RNA, 14 nt, Human
caaagauauuuugc

SEQ ID NO: 1638661 - RNA, 16 nt, Human
caaagauauuuugcuu

SEQ ID NO: 1638662 - RNA, 19 nt, Human
caaaguaucccuacuguaa

SEQ ID NO: 1638663 - RNA, 21 nt, Human
caaaguaucccuacuguaauu

SEQ ID NO: 1638664 - RNA, 22 nt, Human
caaaguagaagucuuagaugua

SEQ ID NO: 1638665 - RNA, 22 nt, Human
caaagguaaaucagacuaugaa

SEQ ID NO: 1638666 - RNA, 14 nt, Human
caaagguaaaucag

SEQ ID NO: 1638667 - RNA, 21 nt, Human
caaaucuuaacuugaaggagu

SEQ ID NO: 1638668 - RNA, 23 nt, Human
caaaugcuguaacuuucugaaau

SEQ ID NO: 1638669 - RNA, 22 nt, Human
caacacacagauuugagcucag

SEQ ID NO: 1638670 - RNA, 21 nt, Human
caacacacagauuugagcuca

SEQ ID NO: 1638671 - RNA, 14 nt, Human
auuuuauguugcau

SEQ ID NO: 1638672 - RNA, 21 nt, Human
auuuuauaucaauuuaaaaaa

SEQ ID NO: 1638673 - RNA, 19 nt, Human
auuuuagggguagcauuug

SEQ ID NO: 1638674 - RNA, 16 nt, Human
auuuuuaagugcugca

SEQ ID NO: 1638675 - RNA, 18 nt, Human
auuuuuaagugcugcauu

SEQ ID NO: 1638676 - RNA, 19 nt, Human
auuuuuaagugcugcauuu

SEQ ID NO: 1638677 - RNA, 14 nt, Human
auuuuuagacagag

SEQ ID NO: 1638678 - RNA, 14 nt, Human
caaacccuucagug

SEQ ID NO: 1638679 - RNA, 21 nt, Human
caaaccccgaccaccugccca

SEQ ID NO: 1638680 - RNA, 18 nt, Human
caaaccccgaccaccugc

SEQ ID NO: 1638681 - RNA, 17 nt, Human
caaacagucucaggaaa

SEQ ID NO: 1638682 - RNA, 16 nt, Human
caaacagucucaggaa

SEQ ID NO: 1638683 - RNA, 17 nt, Human
caaacauauauaacaau

SEQ ID NO: 1638684 - RNA, 21 nt, Human
caaaaggauaaugaauacuuu

SEQ ID NO: 1638685 - RNA, 16 nt, Human
auuuuuauauuugaaa

SEQ ID NO: 1638686 - RNA, 15 nt, Human
auuuuuauauuugaa

SEQ ID NO: 1638687 - RNA, 16 nt, Human
auuuuuauauuuacua

SEQ ID NO: 1638688 - RNA, 15 nt, Human
auuuuuauauuuacu

SEQ ID NO: 1638689 - RNA, 16 nt, Human
auuuuuuugagacaga

SEQ ID NO: 1638690 - RNA, 18 nt, Human
auuuuuuuuuccuucagu

SEQ ID NO: 1638691 - RNA, 13 nt, Human
auuuuuuuguugu

SEQ ID NO: 1638692 - RNA, 22 nt, Human
auuuuuuuuuccuucagugccu

SEQ ID NO: 1638693 - RNA, 20 nt, Human
auuuuuuuuuccuucagugc

SEQ ID NO: 1638694 - RNA, 23 nt, Human
auuuuuuuuuccuucagugccuu

SEQ ID NO: 1638695 - RNA, 18 nt, Human
auuuuuuuguuguuuguu

SEQ ID NO: 1638696 - RNA, 15 nt, Human
cacuuaaaaaugguu

SEQ ID NO: 1638697 - RNA, 23 nt, Human
cacuguugcccaggcuggcgugc

SEQ ID NO: 1638698 - RNA, 19 nt, Human
cacuguugcccaggcuggc

SEQ ID NO: 1638699 - RNA, 18 nt, Human
cacuguugcccaggcugg

SEQ ID NO: 1638700 - RNA, 20 nt, Human
cacugggcuuggggaccaga

SEQ ID NO: 1638701 - RNA, 13 nt, Human
cacugggcuucua

SEQ ID NO: 1638702 - RNA, 19 nt, Human
cacugggagaaaugaaaaa

SEQ ID NO: 1638703 - RNA, 14 nt, Human
cacugcagccucaa

SEQ ID NO: 1638704 - RNA, 19 nt, Human
cacugcagccucaaccucc

SEQ ID NO: 1638705 - RNA, 23 nt, Human
cacugcagccucaaccuccuggg

SEQ ID NO: 1638706 - RNA, 22 nt, Human
cacugcagccucaaccuccugg

SEQ ID NO: 1638707 - RNA, 21 nt, Human
cacugcagccucaaccuccug

SEQ ID NO: 1638708 - RNA, 20 nt, Human
cacugcagccucaaccuccu

SEQ ID NO: 1638709 - RNA, 17 nt, Human
cacugccaugccagcuu

SEQ ID NO: 1638710 - RNA, 17 nt, Human
cacuuguguuuugcaag

SEQ ID NO: 1638711 - RNA, 18 nt, Human
cacuuguguuaugaagca

SEQ ID NO: 1638712 - RNA, 19 nt, Human
cacuuguugauuaauggaa

SEQ ID NO: 1638713 - RNA, 17 nt, Human
cacuuucuagccagagg

SEQ ID NO: 1638714 - RNA, 16 nt, Human
cacuuucuagccagag

SEQ ID NO: 1638715 - RNA, 18 nt, Human
cacuuucuagccagagga

SEQ ID NO: 1638716 - RNA, 13 nt, Human
cacuuucuagcca

SEQ ID NO: 1638717 - RNA, 18 nt, Human
cagaacagugauuaccag

SEQ ID NO: 1638718 - RNA, 19 nt, Human
cagaaguuucucagcuccc

SEQ ID NO: 1638719 - RNA, 15 nt, Human
cagaaguuucucagc

SEQ ID NO: 1638720 - RNA, 16 nt, Human
cagaaguuucugccgc

SEQ ID NO: 1638721 - RNA, 14 nt, Human
cagaaguuucugcc

SEQ ID NO: 1638722 - RNA, 17 nt, Human
cagaacagugauuacca

SEQ ID NO: 1638723 - RNA, 12 nt, Human
cagaacagugau

SEQ ID NO: 1638724 - RNA, 11 nt, Human
cagaacaguga

SEQ ID NO: 1638725 - RNA, 16 nt, Human
cagaaauguacagcaa

SEQ ID NO: 1638726 - RNA, 17 nt, Human
cagaaauguguuaucac

SEQ ID NO: 1638727 - RNA, 12 nt, Human
cacuccagccug

SEQ ID NO: 1638728 - RNA, 13 nt, Human
cacuccagccuga

SEQ ID NO: 1638729 - RNA, 21 nt, Human
cacuacauucuguuaaucauu

SEQ ID NO: 1638730 - RNA, 21 nt, Human
cacuacauuauaaaugucucu

SEQ ID NO: 1638731 - RNA, 16 nt, Human
cacuacauucuguuaa

SEQ ID NO: 1638732 - RNA, 17 nt, Human
cacuacauucuguuaau

SEQ ID NO: 1638733 - RNA, 23 nt, Human
cacuccagccugagcgacaguga

SEQ ID NO: 1638734 - RNA, 14 nt, Human
cacuccagccuggg

SEQ ID NO: 1638735 - RNA, 13 nt, Human
cacuccagccugg

SEQ ID NO: 1638736 - RNA, 13 nt, Human
cacggccaggcca

SEQ ID NO: 1638737 - RNA, 12 nt, Human
cacggccaggcc

SEQ ID NO: 1638738 - RNA, 14 nt, Human
cacggcucacugca

SEQ ID NO: 1638739 - RNA, 15 nt, Human
cacggcucacugcag

SEQ ID NO: 1638740 - RNA, 22 nt, Human
cacucuuauugcccacgcugga

SEQ ID NO: 1638741 - RNA, 21 nt, Human
cacucuuauugcccacgcugg

SEQ ID NO: 1638742 - RNA, 20 nt, Human
cacucuuauugcccacgcug

SEQ ID NO: 1638743 - RNA, 16 nt, Human
caccuuggcugcaggg

SEQ ID NO: 1638744 - RNA, 15 nt, Human
caccuuggcugcagg

SEQ ID NO: 1638745 - RNA, 18 nt, Human
caccuuggcugcagggag

SEQ ID NO: 1638746 - RNA, 23 nt, Human
caccuuuauucuggcagaggagg

SEQ ID NO: 1638747 - RNA, 13 nt, Human
caccugcccaacc

SEQ ID NO: 1638748 - RNA, 19 nt, Human
caccugcccaaccugcucu

SEQ ID NO: 1638749 - RNA, 18 nt, Human
caccugcccaaccugcuc

SEQ ID NO: 1638750 - RNA, 14 nt, Human
caccuuucccaucu

SEQ ID NO: 1638751 - RNA, 14 nt, Human
caccuuugaagaag

SEQ ID NO: 1638752 - RNA, 12 nt, Human
caccucagccuc

SEQ ID NO: 1638753 - RNA, 12 nt, Human
caccuacugagu

SEQ ID NO: 1638754 - RNA, 23 nt, Human
caauaaaauccauacauuugugu

SEQ ID NO: 1638755 - RNA, 20 nt, Human
caauaaaauccauacauuug

SEQ ID NO: 1638756 - RNA, 21 nt, Human
caagucagucauucagauaug

SEQ ID NO: 1638757 - RNA, 15 nt, Human
caaggcucugagcaa

SEQ ID NO: 1638758 - RNA, 20 nt, Human
caaggccaaaggaagcacau

SEQ ID NO: 1638759 - RNA, 19 nt, Human
caaggccaaaggaagcaca

SEQ ID NO: 1638760 - RNA, 21 nt, Human
caaggccaaaggaagcacaug

SEQ ID NO: 1638761 - RNA, 18 nt, Human
caaggcaaggcugucaau

SEQ ID NO: 1638762 - RNA, 17 nt, Human
caaggcaaggcugucaa

SEQ ID NO: 1638763 - RNA, 15 nt, Human
caauaaaauggguuu

SEQ ID NO: 1638764 - RNA, 20 nt, Human
caauaaaaucuugaaaaugc

SEQ ID NO: 1638765 - RNA, 21 nt, Human
cacaagcuccaagcucccagg

SEQ ID NO: 1638766 - RNA, 20 nt, Human
cacaagcuccaagcucccag

SEQ ID NO: 1638767 - RNA, 21 nt, Human
caaugcuggcuguuggcuggg

SEQ ID NO: 1638768 - RNA, 20 nt, Human
caaugcuggcuguuggcugg

SEQ ID NO: 1638769 - RNA, 13 nt, Human
caaugcuggcugu

SEQ ID NO: 1638770 - RNA, 23 nt, Human
caaucccaccaacccucagagcc

SEQ ID NO: 1638771 - RNA, 22 nt, Human
caaucccaccaacccucagagc

SEQ ID NO: 1638772 - RNA, 17 nt, Human
caaucccaccaacccuc

SEQ ID NO: 1638773 - RNA, 16 nt, Human
caaucccaccaacccu

SEQ ID NO: 1638774 - RNA, 19 nt, Human
cacaagcuccaagcuccca

SEQ ID NO: 1638775 - RNA, 18 nt, Human
cacaagcuccaagcuccc

SEQ ID NO: 1638776 - RNA, 20 nt, Human
cacaagagcccaggccuccu

SEQ ID NO: 1638777 - RNA, 19 nt, Human
cacaagagcccaggccucc

SEQ ID NO: 1638778 - RNA, 18 nt, Human
cacaagagcccaggccuc

SEQ ID NO: 1638779 - RNA, 15 nt, Human
caaugggagcucaug

SEQ ID NO: 1638780 - RNA, 17 nt, Human
cacagacccugcccugu

SEQ ID NO: 1638781 - RNA, 16 nt, Human
cacagacccugcccug

SEQ ID NO: 1638782 - RNA, 14 nt, Human
cacagacccugccc

SEQ ID NO: 1638783 - RNA, 14 nt, Human
cacagcucuguccu

SEQ ID NO: 1638784 - RNA, 11 nt, Human
cacagcucugu

SEQ ID NO: 1638785 - RNA, 18 nt, Human
cacagacccugcccugug

SEQ ID NO: 1638786 - RNA, 19 nt, Human
cacagcucuguccugggag

SEQ ID NO: 1638787 - RNA, 18 nt, Human
cacagcucuguccuggga

SEQ ID NO: 1638788 - RNA, 16 nt, Human
cacagcucuguccugg

SEQ ID NO: 1638789 - RNA, 15 nt, Human
cacagcucuguccug

SEQ ID NO: 1638790 - RNA, 15 nt, Human
cacagcucuucucca

SEQ ID NO: 1638791 - RNA, 14 nt, Human
cacagcucuucucc

SEQ ID NO: 1638792 - RNA, 17 nt, Human
cacagcucuucuccagg

SEQ ID NO: 1638793 - RNA, 18 nt, Human
cacagcucuucuccaggc

SEQ ID NO: 1638794 - RNA, 12 nt, Human
cacacauuuuuu

SEQ ID NO: 1638795 - RNA, 16 nt, Human
cacacauuuuuuaaau

SEQ ID NO: 1638796 - RNA, 19 nt, Human
cacacauuuuuuaaaugca

SEQ ID NO: 1638797 - RNA, 20 nt, Human
cacacauuuuuuaaaugcac

SEQ ID NO: 1638798 - RNA, 10 nt, Human
cacacauuuu

SEQ ID NO: 1638799 - RNA, 11 nt, Human
cacacauuuuu

SEQ ID NO: 1638800 - RNA, 13 nt, Human
cacagaacccuug

SEQ ID NO: 1638801 - RNA, 23 nt, Human
cacagaaaagaaaguucaugcuu

SEQ ID NO: 1638802 - RNA, 16 nt, Human
cacccaggagccccga

SEQ ID NO: 1638803 - RNA, 18 nt, Human
cacccaccucagccuccc

SEQ ID NO: 1638804 - RNA, 16 nt, Human
caccagccccagugcc

SEQ ID NO: 1638805 - RNA, 13 nt, Human
caccagccccagu

SEQ ID NO: 1638806 - RNA, 17 nt, Human
cacccaccucagccucc

SEQ ID NO: 1638807 - RNA, 13 nt, Human
caccagggaaggg

SEQ ID NO: 1638808 - RNA, 21 nt, Human
caccagggaaggggacaagga

SEQ ID NO: 1638809 - RNA, 18 nt, Human
caccagggaaggggacaa

SEQ ID NO: 1638810 - RNA, 14 nt, Human
caccaacgucugug

SEQ ID NO: 1638811 - RNA, 13 nt, Human
caccaacccucag

SEQ ID NO: 1638812 - RNA, 16 nt, Human
caccaacgucugugcc

SEQ ID NO: 1638813 - RNA, 17 nt, Human
caccaacauacucccau

SEQ ID NO: 1638814 - RNA, 17 nt, Human
cacauuuuauuuuauua

SEQ ID NO: 1638815 - RNA, 19 nt, Human
cacauuuuauuuuauuaug

SEQ ID NO: 1638816 - RNA, 20 nt, Human
cacauuuuauuuuauuaugc

SEQ ID NO: 1638817 - RNA, 21 nt, Human
cacauuuuauuuuauuaugca

SEQ ID NO: 1638818 - RNA, 17 nt, Human
ccugucucuacuaaaaa

SEQ ID NO: 1638819 - RNA, 22 nt, Human
ccugguuuccugcccugggagg

SEQ ID NO: 1638820 - RNA, 15 nt, Human
ccuggauggggcugc

SEQ ID NO: 1638821 - RNA, 18 nt, Human
ccuggauggggcugcacc

SEQ ID NO: 1638822 - RNA, 17 nt, Human
ccuggauggggcugcac

SEQ ID NO: 1638823 - RNA, 18 nt, Human
ccuggccccucagggucc

SEQ ID NO: 1638824 - RNA, 21 nt, Human
ccuggccccucagggucccug

SEQ ID NO: 1638825 - RNA, 20 nt, Human
ccuggccccucagggucccu

SEQ ID NO: 1638826 - RNA, 15 nt, Human
ccuggggagaaagua

SEQ ID NO: 1638827 - RNA, 18 nt, Human
ccuggggaaccugacccc

SEQ ID NO: 1638828 - RNA, 13 nt, Human
ccugguguggaag

SEQ ID NO: 1638829 - RNA, 21 nt, Human
ccugguuuccugcccugggag

SEQ ID NO: 1638830 - RNA, 20 nt, Human
ccugguuuccugcccuggga

SEQ ID NO: 1638831 - RNA, 19 nt, Human
ccugguuuccugcccuggg

SEQ ID NO: 1638832 - RNA, 18 nt, Human
ccugguuuccugcccugg

SEQ ID NO: 1638833 - RNA, 19 nt, Human
ccugguggcagugggagcu

SEQ ID NO: 1638834 - RNA, 18 nt, Human
ccugguggcagugggagc

SEQ ID NO: 1638835 - RNA, 20 nt, Human
ccugguggcagugggagcug

SEQ ID NO: 1638836 - RNA, 13 nt, Human
ccugcaggcagcc

SEQ ID NO: 1638837 - RNA, 12 nt, Human
ccugcaggcagc

SEQ ID NO: 1638838 - RNA, 14 nt, Human
ccugcaggcagcca

SEQ ID NO: 1638839 - RNA, 15 nt, Human
ccugcaggcagccag

SEQ ID NO: 1638840 - RNA, 18 nt, Human
ccugaccccucauagccc

SEQ ID NO: 1638841 - RNA, 19 nt, Human
ccucuuucccucccuuccu

SEQ ID NO: 1638842 - RNA, 15 nt, Human
ccucuuugagugaag

SEQ ID NO: 1638843 - RNA, 22 nt, Human
ccucuugccacugccucuuccu

SEQ ID NO: 1638844 - RNA, 23 nt, Human
ccucuugccacugccucuuccuc

SEQ ID NO: 1638845 - RNA, 17 nt, Human
ccugcccaccuggccuc

SEQ ID NO: 1638846 - RNA, 15 nt, Human
ccugcccaccuggcc

SEQ ID NO: 1638847 - RNA, 19 nt, Human
ccugcccaggccccugcca

SEQ ID NO: 1638848 - RNA, 19 nt, Human
ccugcccaccuggccucug

SEQ ID NO: 1638849 - RNA, 18 nt, Human
ccugcccaccuggccucu

SEQ ID NO: 1638850 - RNA, 22 nt, Human
ccugcccaggccccugccaccc

SEQ ID NO: 1638851 - RNA, 21 nt, Human
ccugcccaggccccugccacc

SEQ ID NO: 1638852 - RNA, 15 nt, Human
ccugccucagccucc

SEQ ID NO: 1638853 - RNA, 16 nt, Human
ccugccucagccuccc

SEQ ID NO: 1638854 - RNA, 15 nt, Human
ccugccucucugcag

SEQ ID NO: 1638855 - RNA, 14 nt, Human
ccugccucucugca

SEQ ID NO: 1638856 - RNA, 20 nt, Human
ccugcugagucccaggcuga

SEQ ID NO: 1638857 - RNA, 19 nt, Human
ccugcugagucccaggcug

SEQ ID NO: 1638858 - RNA, 18 nt, Human
ccugcugagucccaggcu

SEQ ID NO: 1638859 - RNA, 13 nt, Human
ccugccucucugc

SEQ ID NO: 1638860 - RNA, 17 nt, Human
ccugccucagccucccg

SEQ ID NO: 1638861 - RNA, 16 nt, Human
ccucccuucucuucac

SEQ ID NO: 1638862 - RNA, 20 nt, Human
ccucccuuggggccuaugca

SEQ ID NO: 1638863 - RNA, 14 nt, Human
ccuccgccucuugg

SEQ ID NO: 1638864 - RNA, 14 nt, Human
ccucggagaagagc

SEQ ID NO: 1638865 - RNA, 12 nt, Human
ccucggagaaga

SEQ ID NO: 1638866 - RNA, 20 nt, Human
ccucggacuuagcugggaga

SEQ ID NO: 1638867 - RNA, 19 nt, Human
ccucggacuuagcugggag

SEQ ID NO: 1638868 - RNA, 18 nt, Human
ccuccuuuucacaguucu

SEQ ID NO: 1638869 - RNA, 23 nt, Human
ccuccuuugugaggaagccgcug

SEQ ID NO: 1638870 - RNA, 19 nt, Human
ccuccuaucagaaguuucu

SEQ ID NO: 1638871 - RNA, 19 nt, Human
ccuccaagaccuucuccuu

SEQ ID NO: 1638872 - RNA, 17 nt, Human
ccuccaagaccuucucc

SEQ ID NO: 1638873 - RNA, 16 nt, Human
ccuccaagaccuucuc

SEQ ID NO: 1638874 - RNA, 12 nt, Human
ccucccaucacc

SEQ ID NO: 1638875 - RNA, 20 nt, Human
ccuccaagaccuucuccuuc

SEQ ID NO: 1638876 - RNA, 17 nt, Human
ccucccaucacccgcua

SEQ ID NO: 1638877 - RNA, 18 nt, Human
ccucaggcaggugggaug

SEQ ID NO: 1638878 - RNA, 12 nt, Human
ccucaggcaggu

SEQ ID NO: 1638879 - RNA, 10 nt, Human
ccucaggccu

SEQ ID NO: 1638880 - RNA, 21 nt, Human
ccucauuccaccuucccaugc

SEQ ID NO: 1638881 - RNA, 20 nt, Human
ccucaagugauucuccugcc

SEQ ID NO: 1638882 - RNA, 16 nt, Human
ccucaaccuccugggc

SEQ ID NO: 1638883 - RNA, 23 nt, Human
ccucaagugauucuccugccuca

SEQ ID NO: 1638884 - RNA, 23 nt, Human
ccucaacucuccuccagagucag

SEQ ID NO: 1638885 - RNA, 21 nt, Human
ccucaacucuccuccagaguc

SEQ ID NO: 1638886 - RNA, 15 nt, Human
ccucaaccuccuggg

SEQ ID NO: 1638887 - RNA, 19 nt, Human
ccucaacucuccuccagag

SEQ ID NO: 1638888 - RNA, 16 nt, Human
ccucaacaccucugca

SEQ ID NO: 1638889 - RNA, 12 nt, Human
ccgacagccugg

SEQ ID NO: 1638890 - RNA, 14 nt, Human
ccgacagccuggca

SEQ ID NO: 1638891 - RNA, 13 nt, Human
ccgacagccuggc

SEQ ID NO: 1638892 - RNA, 22 nt, Human
ccgacagccuggcacagggcag

SEQ ID NO: 1638893 - RNA, 15 nt, Human
ccgacagccuggcac

SEQ ID NO: 1638894 - RNA, 23 nt, Human
cccuuuuuuggcugcugaaggcu

SEQ ID NO: 1638895 - RNA, 22 nt, Human
cccuuuuuuggcugcugaaggc

SEQ ID NO: 1638896 - RNA, 21 nt, Human
cccuuuuuuggcugcugaagg

SEQ ID NO: 1638897 - RNA, 19 nt, Human
cccuucucuccagccccug

SEQ ID NO: 1638898 - RNA, 14 nt, Human
cccuucucuccagc

SEQ ID NO: 1638899 - RNA, 15 nt, Human
cccugugauggggcc

SEQ ID NO: 1638900 - RNA, 23 nt, Human
cccugugaguacuacaguccucc

SEQ ID NO: 1638901 - RNA, 21 nt, Human
cccugugaguacuacaguccu

SEQ ID NO: 1638902 - RNA, 14 nt, Human
cccuccuuucacca

SEQ ID NO: 1638903 - RNA, 15 nt, Human
cccugugggccccca

SEQ ID NO: 1638904 - RNA, 23 nt, Human
ccgcagcccugcagagggcacag

SEQ ID NO: 1638905 - RNA, 18 nt, Human
ccgcagcccugcagaggg

SEQ ID NO: 1638906 - RNA, 14 nt, Human
ccgcagcccugcag

SEQ ID NO: 1638907 - RNA, 18 nt, Human
ccggccaccugcggugcu

SEQ ID NO: 1638908 - RNA, 18 nt, Human
ccggcaggguccuagaaa

SEQ ID NO: 1638909 - RNA, 17 nt, Human
ccggccaccugcggugc

SEQ ID NO: 1638910 - RNA, 14 nt, Human
ccgucccccucugg

SEQ ID NO: 1638911 - RNA, 19 nt, Human
ccuagccuuagaagucaca

SEQ ID NO: 1638912 - RNA, 23 nt, Human
ccuagccugugccucugggacug

SEQ ID NO: 1638913 - RNA, 22 nt, Human
ccuagccuuagaagucacacag

SEQ ID NO: 1638914 - RNA, 13 nt, Human
ccuaauaaagcug

SEQ ID NO: 1638915 - RNA, 12 nt, Human
ccuaauaaagcu

SEQ ID NO: 1638916 - RNA, 13 nt, Human
ccuaauuccacag

SEQ ID NO: 1638917 - RNA, 21 nt, Human
ccuaaugcgcaggcuggcccu

SEQ ID NO: 1638918 - RNA, 13 nt, Human
ccccugcacucca

SEQ ID NO: 1638919 - RNA, 21 nt, Human
ccccugcaaagcccagcuuga

SEQ ID NO: 1638920 - RNA, 17 nt, Human
ccccugaauuuaaauag

SEQ ID NO: 1638921 - RNA, 20 nt, Human
ccccugcaaagcccagcuug

SEQ ID NO: 1638922 - RNA, 18 nt, Human
ccccugcaaagcccagcu

SEQ ID NO: 1638923 - RNA, 15 nt, Human
ccccugacaacacuc

SEQ ID NO: 1638924 - RNA, 13 nt, Human
ccccugaauuuaa

SEQ ID NO: 1638925 - RNA, 18 nt, Human
ccccucuggcuccagcug

SEQ ID NO: 1638926 - RNA, 16 nt, Human
ccccucuggcuccagc

SEQ ID NO: 1638927 - RNA, 16 nt, Human
ccccugccacccuggg

SEQ ID NO: 1638928 - RNA, 14 nt, Human
ccccugccacccug

SEQ ID NO: 1638929 - RNA, 23 nt, Human
ccccucugcccugcgggucacag

SEQ ID NO: 1638930 - RNA, 20 nt, Human
ccccucugcccugcggguca

SEQ ID NO: 1638931 - RNA, 15 nt, Human
ccccucugcccugcg

SEQ ID NO: 1638932 - RNA, 16 nt, Human
cccggccccugcuggu

SEQ ID NO: 1638933 - RNA, 15 nt, Human
cccggccccugcugg

SEQ ID NO: 1638934 - RNA, 15 nt, Human
cccgggaagggggcu

SEQ ID NO: 1638935 - RNA, 11 nt, Human
cccggcuccag

SEQ ID NO: 1638936 - RNA, 20 nt, Human
cccggcuaauuuuuguauuu

SEQ ID NO: 1638937 - RNA, 22 nt, Human
cccgaauagcugggacuacagg

SEQ ID NO: 1638938 - RNA, 18 nt, Human
cccgaauagcugggacua

SEQ ID NO: 1638939 - RNA, 17 nt, Human
cccgaauagcugggacu

SEQ ID NO: 1638940 - RNA, 16 nt, Human
cccgaauagcugggac

SEQ ID NO: 1638941 - RNA, 16 nt, Human
ccccuucugacccaug

SEQ ID NO: 1638942 - RNA, 14 nt, Human
ccccuucugaccca

SEQ ID NO: 1638943 - RNA, 13 nt, Human
ccccuucugaccc

SEQ ID NO: 1638944 - RNA, 21 nt, Human
cccgggaagggggcugggaca

SEQ ID NO: 1638945 - RNA, 18 nt, Human
cccgggaagggggcuggg

SEQ ID NO: 1638946 - RNA, 16 nt, Human
cccucaacaccucugc

SEQ ID NO: 1638947 - RNA, 22 nt, Human
cccgggaagggggcugggacau

SEQ ID NO: 1638948 - RNA, 20 nt, Human
cccucaacucuccuccagag

SEQ ID NO: 1638949 - RNA, 16 nt, Human
cccucacccuggggcu

SEQ ID NO: 1638950 - RNA, 16 nt, Human
cccucaacucuccucc

SEQ ID NO: 1638951 - RNA, 13 nt, Human
cccuccucugcuu

SEQ ID NO: 1638952 - RNA, 22 nt, Human
cccuccucugcuugccaucccu

SEQ ID NO: 1638953 - RNA, 15 nt, Human
cccuccucucugccc

SEQ ID NO: 1638954 - RNA, 16 nt, Human
cccuccucucugcccu

SEQ ID NO: 1638955 - RNA, 14 nt, Human
ccccgcacugggcu

SEQ ID NO: 1638956 - RNA, 15 nt, Human
cccauucugccugcc

SEQ ID NO: 1638957 - RNA, 14 nt, Human
cccauucugccugc

SEQ ID NO: 1638958 - RNA, 19 nt, Human
cccauucugccugcccagg

SEQ ID NO: 1638959 - RNA, 20 nt, Human
cccauucugccugcccaggc

SEQ ID NO: 1638960 - RNA, 15 nt, Human
cccauuugcuccuuu

SEQ ID NO: 1638961 - RNA, 10 nt, Human
ccccagcccc

SEQ ID NO: 1638962 - RNA, 20 nt, Human
ccccagauugcaacaggcug

SEQ ID NO: 1638963 - RNA, 15 nt, Human
ccccagauugcaaca

SEQ ID NO: 1638964 - RNA, 17 nt, Human
ccccagaggcuggguga

SEQ ID NO: 1638965 - RNA, 22 nt, Human
cccauccucuguacagagccca

SEQ ID NO: 1638966 - RNA, 21 nt, Human
cccauccucuguacagagccc

SEQ ID NO: 1638967 - RNA, 18 nt, Human
cccaggaaaggcuccagg

SEQ ID NO: 1638968 - RNA, 17 nt, Human
cccaggaaaggcuccag

SEQ ID NO: 1638969 - RNA, 17 nt, Human
cccaggcugagccucag

SEQ ID NO: 1638970 - RNA, 16 nt, Human
cccaggcugagccuca

SEQ ID NO: 1638971 - RNA, 22 nt, Human
cccaggcuuagucacugagaca

SEQ ID NO: 1638972 - RNA, 18 nt, Human
cccaggcugagccucagu

SEQ ID NO: 1638973 - RNA, 13 nt, Human
cccaggcuggagu

SEQ ID NO: 1638974 - RNA, 16 nt, Human
cccacuggacucaccu

SEQ ID NO: 1638975 - RNA, 16 nt, Human
cccaggaaaggcucca

SEQ ID NO: 1638976 - RNA, 20 nt, Human
cccagcuggggccaggcugg

SEQ ID NO: 1638977 - RNA, 14 nt, Human
ccaucccucccucc

SEQ ID NO: 1638978 - RNA, 15 nt, Human
ccaucccucccucca

SEQ ID NO: 1638979 - RNA, 20 nt, Human
ccaugaggaacaaggcaagg

SEQ ID NO: 1638980 - RNA, 23 nt, Human
ccaugaggaacaaggcaaggcug

SEQ ID NO: 1638981 - RNA, 18 nt, Human
ccaugaguccccuguuug

SEQ ID NO: 1638982 - RNA, 13 nt, Human
ccaugaguccccu

SEQ ID NO: 1638983 - RNA, 12 nt, Human
ccaugucgccuc

SEQ ID NO: 1638984 - RNA, 19 nt, Human
ccaugucgccucugcauuc

SEQ ID NO: 1638985 - RNA, 17 nt, Human
ccaugucgccucugcau

SEQ ID NO: 1638986 - RNA, 16 nt, Human
ccaugucgccucugca

SEQ ID NO: 1638987 - RNA, 15 nt, Human
ccaugucgccucugc

SEQ ID NO: 1638988 - RNA, 13 nt, Human
ccaucccucccuc

SEQ ID NO: 1638989 - RNA, 21 nt, Human
ccaucccauaugccugggcag

SEQ ID NO: 1638990 - RNA, 20 nt, Human
ccaucccauaugccugggca

SEQ ID NO: 1638991 - RNA, 19 nt, Human
ccaucccauaugccugggc

SEQ ID NO: 1638992 - RNA, 20 nt, Human
ccaucccaaacccuucagug

SEQ ID NO: 1638993 - RNA, 19 nt, Human
ccauccagguucagcuugu

SEQ ID NO: 1638994 - RNA, 18 nt, Human
ccauccagguucagcuug

SEQ ID NO: 1638995 - RNA, 21 nt, Human
ccauaaucuggacuccucugu

SEQ ID NO: 1638996 - RNA, 14 nt, Human
ccauaaucuggacu

SEQ ID NO: 1638997 - RNA, 20 nt, Human
ccaguuggucccccuuccau

SEQ ID NO: 1638998 - RNA, 18 nt, Human
ccaguuggucccccuucc

SEQ ID NO: 1638999 - RNA, 13 nt, Human
ccaguuggucccc

SEQ ID NO: 1639000 - RNA, 13 nt, Human
cccaacuccagaa

SEQ ID NO: 1639001 - RNA, 20 nt, Human
cccaacuaauuuuuguauuu

SEQ ID NO: 1639002 - RNA, 20 nt, Human
cccaacucaccccagcccca

SEQ ID NO: 1639003 - RNA, 17 nt, Human
cccaacucaccccagcc

SEQ ID NO: 1639004 - RNA, 15 nt, Human
cccaagcucugcucc

SEQ ID NO: 1639005 - RNA, 14 nt, Human
cccaagcucugcuc

SEQ ID NO: 1639006 - RNA, 13 nt, Human
cccaagcucugcu

SEQ ID NO: 1639007 - RNA, 23 nt, Human
cccacugcuuuuggucuguguga

SEQ ID NO: 1639008 - RNA, 13 nt, Human
cccacucccugca

SEQ ID NO: 1639009 - RNA, 12 nt, Human
cccacccccacc

SEQ ID NO: 1639010 - RNA, 16 nt, Human
cccaacucaccccagc

SEQ ID NO: 1639011 - RNA, 15 nt, Human
cccaacucaccccag

SEQ ID NO: 1639012 - RNA, 22 nt, Human
ccauuucauuugugccagaaug

SEQ ID NO: 1639013 - RNA, 21 nt, Human
ccauuucauuugugccagaau

SEQ ID NO: 1639014 - RNA, 17 nt, Human
ccagccccagugcccac

SEQ ID NO: 1639015 - RNA, 14 nt, Human
ccagcagagcaccu

SEQ ID NO: 1639016 - RNA, 13 nt, Human
ccagcagagcacc

SEQ ID NO: 1639017 - RNA, 12 nt, Human
ccagcagagcac

SEQ ID NO: 1639018 - RNA, 17 nt, Human
ccagccccauccucugu

SEQ ID NO: 1639019 - RNA, 15 nt, Human
ccagccccauccucu

SEQ ID NO: 1639020 - RNA, 18 nt, Human
ccagccccauccucugua

SEQ ID NO: 1639021 - RNA, 12 nt, Human
ccagcagaaaug

SEQ ID NO: 1639022 - RNA, 24 nt, Human
ccagccccuucugacccaugcugc

SEQ ID NO: 1639023 - RNA, 23 nt, Human
ccagccccuucugacccaugcug

SEQ ID NO: 1639024 - RNA, 16 nt, Human
ccaggcuggcgugcag

SEQ ID NO: 1639025 - RNA, 12 nt, Human
ccaggcuggcgu

SEQ ID NO: 1639026 - RNA, 21 nt, Human
ccaggggaaaaucagccugcu

SEQ ID NO: 1639027 - RNA, 14 nt, Human
ccaggcaggucuug

SEQ ID NO: 1639028 - RNA, 12 nt, Human
ccaggcaggucu

SEQ ID NO: 1639029 - RNA, 23 nt, Human
ccaggcaggucuugaacuccugg

SEQ ID NO: 1639030 - RNA, 21 nt, Human
ccaggcugcucuugaacuccu

SEQ ID NO: 1639031 - RNA, 18 nt, Human
ccagucccccugccccag

SEQ ID NO: 1639032 - RNA, 23 nt, Human
cucagaaaacaaggaugaauuaa

SEQ ID NO: 1639033 - RNA, 19 nt, Human
cucagaaaacaaggaugaa

SEQ ID NO: 1639034 - RNA, 18 nt, Human
cucacuuguuuuauuuaa

SEQ ID NO: 1639035 - RNA, 17 nt, Human
cucaccucucccuugga

SEQ ID NO: 1639036 - RNA, 16 nt, Human
cucaccucucccuugg

SEQ ID NO: 1639037 - RNA, 15 nt, Human
cucaccucucccuug

SEQ ID NO: 1639038 - RNA, 14 nt, Human
cucaccucucccuu

SEQ ID NO: 1639039 - RNA, 13 nt, Human
cucaccucucccu

SEQ ID NO: 1639040 - RNA, 16 nt, Human
cucaccucccccaucu

SEQ ID NO: 1639041 - RNA, 13 nt, Human
cucaccuccugcu

SEQ ID NO: 1639042 - RNA, 16 nt, Human
cucaccugccccucaa

SEQ ID NO: 1639043 - RNA, 14 nt, Human
cucaccugccccuc

SEQ ID NO: 1639044 - RNA, 18 nt, Human
cucaccugccccucaacu

SEQ ID NO: 1639045 - RNA, 13 nt, Human
cucaccugccccu

SEQ ID NO: 1639046 - RNA, 14 nt, Human
cucaccuccugcug

SEQ ID NO: 1639047 - RNA, 14 nt, Human
cucacccuggggcu

SEQ ID NO: 1639048 - RNA, 23 nt, Human
cuaugucauuugcuggagcucug

SEQ ID NO: 1639049 - RNA, 15 nt, Human
cuauguugcccaggc

SEQ ID NO: 1639050 - RNA, 22 nt, Human
cuauguguagggcgggaggaug

SEQ ID NO: 1639051 - RNA, 20 nt, Human
cuaucucccccagccccauc

SEQ ID NO: 1639052 - RNA, 19 nt, Human
cuauguaucaaugaguaac

SEQ ID NO: 1639053 - RNA, 13 nt, Human
cucaaaacugcac

SEQ ID NO: 1639054 - RNA, 17 nt, Human
cucaaaacugcacuguc

SEQ ID NO: 1639055 - RNA, 17 nt, Human
cuauguugcccaggcag

SEQ ID NO: 1639056 - RNA, 16 nt, Human
cuauguugcccaggca

SEQ ID NO: 1639057 - RNA, 18 nt, Human
cucaaaaaaagaaaaaga

SEQ ID NO: 1639058 - RNA, 21 nt, Human
cucacacaugagcaucaggcc

SEQ ID NO: 1639059 - RNA, 14 nt, Human
cucacacaugagca

SEQ ID NO: 1639060 - RNA, 12 nt, Human
cucaaauaacua

SEQ ID NO: 1639061 - RNA, 14 nt, Human
cucacaaaggaugc

SEQ ID NO: 1639062 - RNA, 16 nt, Human
cuagcauacguacaca

SEQ ID NO: 1639063 - RNA, 18 nt, Human
cuagcauacguacacauu

SEQ ID NO: 1639064 - RNA, 19 nt, Human
cuagcauacguacacauuu

SEQ ID NO: 1639065 - RNA, 20 nt, Human
cuagcauacguacacauuuu

SEQ ID NO: 1639066 - RNA, 21 nt, Human
cuagacccacuggacucaccu

SEQ ID NO: 1639067 - RNA, 13 nt, Human
cuaggccuggcca

SEQ ID NO: 1639068 - RNA, 17 nt, Human
cuagccagaggagagag

SEQ ID NO: 1639069 - RNA, 19 nt, Human
cuagccagaggagagagga

SEQ ID NO: 1639070 - RNA, 19 nt, Human
cuaggccuggccagaugca

SEQ ID NO: 1639071 - RNA, 18 nt, Human
cuaggccuggccagaugc

SEQ ID NO: 1639072 - RNA, 15 nt, Human
cuaggccuggccaga

SEQ ID NO: 1639073 - RNA, 14 nt, Human
cuaggccuggccag

SEQ ID NO: 1639074 - RNA, 13 nt, Human
cuaggccugggga

SEQ ID NO: 1639075 - RNA, 12 nt, Human
cuaggccugggg

SEQ ID NO: 1639076 - RNA, 20 nt, Human
cuaguuugauuaaauucuug

SEQ ID NO: 1639077 - RNA, 21 nt, Human
cuaguuugauuaaauucuugc

SEQ ID NO: 1639078 - RNA, 17 nt, Human
cuaguuugauuaaauuc

SEQ ID NO: 1639079 - RNA, 19 nt, Human
cuaguuugauuaaauucuu

SEQ ID NO: 1639080 - RNA, 15 nt, Human
cuaggguccugggga

SEQ ID NO: 1639081 - RNA, 14 nt, Human
cuaggguccugggg

SEQ ID NO: 1639082 - RNA, 13 nt, Human
cuaggguccuggg

SEQ ID NO: 1639083 - RNA, 14 nt, Human
cuagggaagauaau

SEQ ID NO: 1639084 - RNA, 23 nt, Human
cuaccugaggggccucuuauggg

SEQ ID NO: 1639085 - RNA, 19 nt, Human
cuaccugaggggccucuua

SEQ ID NO: 1639086 - RNA, 16 nt, Human
cuaccugaggggccuc

SEQ ID NO: 1639087 - RNA, 18 nt, Human
cuaccuuccaguuccuca

SEQ ID NO: 1639088 - RNA, 20 nt, Human
cuacuagggaaaugccuuug

SEQ ID NO: 1639089 - RNA, 14 nt, Human
cuaacuggacuggu

SEQ ID NO: 1639090 - RNA, 22 nt, Human
cguguccccuauccuacuuccc

SEQ ID NO: 1639091 - RNA, 13 nt, Human
cguuaaaauacca

SEQ ID NO: 1639092 - RNA, 16 nt, Human
cuaaacuuuucugaua

SEQ ID NO: 1639093 - RNA, 14 nt, Human
cguuaccaggcagg

SEQ ID NO: 1639094 - RNA, 22 nt, Human
cuaaaguguauuuuuuuacuaa

SEQ ID NO: 1639095 - RNA, 17 nt, Human
cuaaaggcuaccuuugu

SEQ ID NO: 1639096 - RNA, 19 nt, Human
cuaaaggcuaccuuuguau

SEQ ID NO: 1639097 - RNA, 14 nt, Human
cuaaagcugccagc

SEQ ID NO: 1639098 - RNA, 21 nt, Human
cuaaagaagguuucagaaaga

SEQ ID NO: 1639099 - RNA, 15 nt, Human
cuaaaggcuaccuuu

SEQ ID NO: 1639100 - RNA, 16 nt, Human
cuaaaggcuaccuuug

SEQ ID NO: 1639101 - RNA, 15 nt, Human
cuaaagcugccagcc

SEQ ID NO: 1639102 - RNA, 24 nt, Human
cggagaagagcuguucacagccag

SEQ ID NO: 1639103 - RNA, 23 nt, Human
cggagaagagcuguucacagcca

SEQ ID NO: 1639104 - RNA, 15 nt, Human
cggagacggaguccc

SEQ ID NO: 1639105 - RNA, 15 nt, Human
cgguuuauauaagcu

SEQ ID NO: 1639106 - RNA, 13 nt, Human
cgguguggagaag

SEQ ID NO: 1639107 - RNA, 13 nt, Human
cguacacauuuua

SEQ ID NO: 1639108 - RNA, 16 nt, Human
cguacacauuuuauuu

SEQ ID NO: 1639109 - RNA, 17 nt, Human
cgcugccccuggcagcc

SEQ ID NO: 1639110 - RNA, 16 nt, Human
cgcugccccuggcagc

SEQ ID NO: 1639111 - RNA, 23 nt, Human
cgcuggaccuugaacuggguacu

SEQ ID NO: 1639112 - RNA, 19 nt, Human
cgcuggaccuugaacuggg

SEQ ID NO: 1639113 - RNA, 18 nt, Human
cgcugccccuggcagccc

SEQ ID NO: 1639114 - RNA, 16 nt, Human
cgccuuaaggauguuc

SEQ ID NO: 1639115 - RNA, 20 nt, Human
cgcuggggccaguugguccc

SEQ ID NO: 1639116 - RNA, 17 nt, Human
cgcuggggccaguuggu

SEQ ID NO: 1639117 - RNA, 13 nt, Human
cgaguagcuggga

SEQ ID NO: 1639118 - RNA, 19 nt, Human
cgaguagcugagauuauag

SEQ ID NO: 1639119 - RNA, 21 nt, Human
cgauacaccgggccuggagaa

SEQ ID NO: 1639120 - RNA, 20 nt, Human
cgauacaccgggccuggaga

SEQ ID NO: 1639121 - RNA, 18 nt, Human
cgauacaccgggccugga

SEQ ID NO: 1639122 - RNA, 17 nt, Human
cugaaagaggaaugaag

SEQ ID NO: 1639123 - RNA, 13 nt, Human
cugaaagaggaau

SEQ ID NO: 1639124 - RNA, 24 nt, Human
cucuugauucauaaugacuuaagc

SEQ ID NO: 1639125 - RNA, 14 nt, Human
cucuugagccuggg

SEQ ID NO: 1639126 - RNA, 16 nt, Human
cucuugagccugggag

SEQ ID NO: 1639127 - RNA, 15 nt, Human
cucuugagccuggga

SEQ ID NO: 1639128 - RNA, 22 nt, Human
cucuugauucauaaugacuuaa

SEQ ID NO: 1639129 - RNA, 19 nt, Human
cucugcacaagcugcaccc

SEQ ID NO: 1639130 - RNA, 18 nt, Human
cucugcacaagcugcacc

SEQ ID NO: 1639131 - RNA, 17 nt, Human
cucugcacaagcugcac

SEQ ID NO: 1639132 - RNA, 17 nt, Human
cugaccccucauagccc

SEQ ID NO: 1639133 - RNA, 21 nt, Human
cugaccccucauagcccucac

SEQ ID NO: 1639134 - RNA, 20 nt, Human
cugaccccucauagcccuca

SEQ ID NO: 1639135 - RNA, 23 nt, Human
cugacacacagcucuguccuggg

SEQ ID NO: 1639136 - RNA, 22 nt, Human
cugacacacagcucuguccugg

SEQ ID NO: 1639137 - RNA, 21 nt, Human
cugacacacagcucuguccug

SEQ ID NO: 1639138 - RNA, 20 nt, Human
cugacacacagcucuguccu

SEQ ID NO: 1639139 - RNA, 19 nt, Human
cugacacacagcucugucc

SEQ ID NO: 1639140 - RNA, 18 nt, Human
cugacacacagcucuguc

SEQ ID NO: 1639141 - RNA, 17 nt, Human
cugacacacagcucugu

SEQ ID NO: 1639142 - RNA, 16 nt, Human
cugacacacagcucug

SEQ ID NO: 1639143 - RNA, 15 nt, Human
cugacacacagcucu

SEQ ID NO: 1639144 - RNA, 13 nt, Human
cugacacacagcu

SEQ ID NO: 1639145 - RNA, 14 nt, Human
cugaaaauguaugu

SEQ ID NO: 1639146 - RNA, 23 nt, Human
cugaggaauccagacccggcugc

SEQ ID NO: 1639147 - RNA, 16 nt, Human
cugaggaauucuguau

SEQ ID NO: 1639148 - RNA, 15 nt, Human
cugaggaauucugua

SEQ ID NO: 1639149 - RNA, 19 nt, Human
cugaggaauucuguauaga

SEQ ID NO: 1639150 - RNA, 18 nt, Human
cugaggaauucuguauag

SEQ ID NO: 1639151 - RNA, 14 nt, Human
cugaggggccucuu

SEQ ID NO: 1639152 - RNA, 22 nt, Human
cugaggugggaggaucucuuga

SEQ ID NO: 1639153 - RNA, 13 nt, Human
cugaggugggagg

SEQ ID NO: 1639154 - RNA, 14 nt, Human
cugaggaauccaga

SEQ ID NO: 1639155 - RNA, 22 nt, Human
cugagcuugcagagaugaggcc

SEQ ID NO: 1639156 - RNA, 22 nt, Human
cugagcugggaugauuggaggg

SEQ ID NO: 1639157 - RNA, 12 nt, Human
cugagcugggau

SEQ ID NO: 1639158 - RNA, 23 nt, Human
cugacccugcuucaaauauuucc

SEQ ID NO: 1639159 - RNA, 19 nt, Human
cugacccugcuucaaauau

SEQ ID NO: 1639160 - RNA, 18 nt, Human
cugaucucucgugauuga

SEQ ID NO: 1639161 - RNA, 17 nt, Human
cugaucucucgugauug

SEQ ID NO: 1639162 - RNA, 19 nt, Human
cuccccaugauguuuagaa

SEQ ID NO: 1639163 - RNA, 16 nt, Human
cucccucccucuuucc

SEQ ID NO: 1639164 - RNA, 15 nt, Human
cucccucuuucccuc

SEQ ID NO: 1639165 - RNA, 19 nt, Human
cucccucuuucccucccuu

SEQ ID NO: 1639166 - RNA, 21 nt, Human
cuccgcuuucuacccagcgag

SEQ ID NO: 1639167 - RNA, 22 nt, Human
cuccgcuuucuacccagcgagc

SEQ ID NO: 1639168 - RNA, 23 nt, Human
cuccgcuuucuacccagcgagcc

SEQ ID NO: 1639169 - RNA, 14 nt, Human
cuccgucaacucau

SEQ ID NO: 1639170 - RNA, 17 nt, Human
cucagaaucucaaauaa

SEQ ID NO: 1639171 - RNA, 16 nt, Human
cucagaaucucaaaua

SEQ ID NO: 1639172 - RNA, 11 nt, Human
cuccagacaca

SEQ ID NO: 1639173 - RNA, 22 nt, Human
cuccagaauuucccaaagcagu

SEQ ID NO: 1639174 - RNA, 16 nt, Human
cuccagacacaugucc

SEQ ID NO: 1639175 - RNA, 23 nt, Human
cuccaggcuguaucccaugagcc

SEQ ID NO: 1639176 - RNA, 22 nt, Human
cuccaggugcacaagcuccaag

SEQ ID NO: 1639177 - RNA, 20 nt, Human
cuccaggugcacaagcucca

SEQ ID NO: 1639178 - RNA, 19 nt, Human
cuccaggugcacaagcucc

SEQ ID NO: 1639179 - RNA, 18 nt, Human
cuccaggugcacaagcuc

SEQ ID NO: 1639180 - RNA, 17 nt, Human
cucccaccucagccucc

SEQ ID NO: 1639181 - RNA, 16 nt, Human
cucccaccucagccuc

SEQ ID NO: 1639182 - RNA, 14 nt, Human
cucccaccucagcc

SEQ ID NO: 1639183 - RNA, 17 nt, Human
cucucuggccuucggcc

SEQ ID NO: 1639184 - RNA, 10 nt, Human
cucuccucug

SEQ ID NO: 1639185 - RNA, 22 nt, Human
cucucuggccuucggccuccau

SEQ ID NO: 1639186 - RNA, 19 nt, Human
cucucuggccuucggccuc

SEQ ID NO: 1639187 - RNA, 20 nt, Human
cucuccuccuuuucacaguu

SEQ ID NO: 1639188 - RNA, 13 nt, Human
cucuccuccuuuu

SEQ ID NO: 1639189 - RNA, 16 nt, Human
cucuccgaccagacac

SEQ ID NO: 1639190 - RNA, 21 nt, Human
cucuccgaccagacaccuuga

SEQ ID NO: 1639191 - RNA, 13 nt, Human
cucucccuuggau

SEQ ID NO: 1639192 - RNA, 16 nt, Human
cucugcacaagcugca

SEQ ID NO: 1639193 - RNA, 11 nt, Human
cucggugccuu

SEQ ID NO: 1639194 - RNA, 18 nt, Human
cucguauaugucucaggu

SEQ ID NO: 1639195 - RNA, 20 nt, Human
cucguauaugucucaggucc

SEQ ID NO: 1639196 - RNA, 17 nt, Human
cucgaacuccugaccuu

SEQ ID NO: 1639197 - RNA, 16 nt, Human
cucgaacuccugaccu

SEQ ID NO: 1639198 - RNA, 24 nt, Human
cuccuuuucacaguucucuccuuc

SEQ ID NO: 1639199 - RNA, 13 nt, Human
cucgaacuccuga

SEQ ID NO: 1639200 - RNA, 17 nt, Human
cuccuuuagcgcccagu

SEQ ID NO: 1639201 - RNA, 16 nt, Human
cuccuuuagcgcccag

SEQ ID NO: 1639202 - RNA, 22 nt, Human
cuccuagccugugccucuggga

SEQ ID NO: 1639203 - RNA, 22 nt, Human
cuccuuuagcgcccaguugggu

SEQ ID NO: 1639204 - RNA, 13 nt, Human
cuccuuucucuuu

SEQ ID NO: 1639205 - RNA, 14 nt, Human
gugaagugaagaca

SEQ ID NO: 1639206 - RNA, 23 nt, Human
aacuaucucauuuccaagcaagu

SEQ ID NO: 1639207 - RNA, 20 nt, Human
aacuaucucauuuccaagca

SEQ ID NO: 1639208 - RNA, 13 nt, Human
aacuauauuguuu

SEQ ID NO: 1639209 - RNA, 23 nt, Human
gugaagacaaugacuuacuguac

SEQ ID NO: 1639210 - RNA, 19 nt, Human
gugacagaggcagccccau

SEQ ID NO: 1639211 - RNA, 18 nt, Human
gugacagaggcagcccca

SEQ ID NO: 1639212 - RNA, 16 nt, Human
gugacagaggcagccc

SEQ ID NO: 1639213 - RNA, 14 nt, Human
gugacaugucuuuu

SEQ ID NO: 1639214 - RNA, 23 nt, Human
gugacagaggcagccccauucug

SEQ ID NO: 1639215 - RNA, 21 nt, Human
gugaccagcaccaucucuccu

SEQ ID NO: 1639216 - RNA, 18 nt, Human
gugaccagcaccaucucu

SEQ ID NO: 1639217 - RNA, 18 nt, Human
gugaccauguuuuguuua

SEQ ID NO: 1639218 - RNA, 17 nt, Human
gugaccaaugaugguca

SEQ ID NO: 1639219 - RNA, 20 nt, Human
aacugaaaucauacuucuua

SEQ ID NO: 1639220 - RNA, 14 nt, Human
aacugaacucugac

SEQ ID NO: 1639221 - RNA, 21 nt, Human
gugaguacuacaguccuccca

SEQ ID NO: 1639222 - RNA, 19 nt, Human
gugaguacuacaguccucc

SEQ ID NO: 1639223 - RNA, 17 nt, Human
gugaguccuggcauggg

SEQ ID NO: 1639224 - RNA, 15 nt, Human
gugagucgaggacag

SEQ ID NO: 1639225 - RNA, 20 nt, Human
gugaguccuggcaugggaau

SEQ ID NO: 1639226 - RNA, 16 nt, Human
gugagaggggaacaga

SEQ ID NO: 1639227 - RNA, 13 nt, Human
gugagagcugggu

SEQ ID NO: 1639228 - RNA, 17 nt, Human
gugaguacuacaguccu

SEQ ID NO: 1639229 - RNA, 15 nt, Human
gugagcaggcuguga

SEQ ID NO: 1639230 - RNA, 21 nt, Human
gugagcacuaaggugugcucu

SEQ ID NO: 1639231 - RNA, 12 nt, Human
gugaccccaggu

SEQ ID NO: 1639232 - RNA, 12 nt, Human
gugagagcuggg

SEQ ID NO: 1639233 - RNA, 23 nt, Human
gucugacaggcaaugcuggcugu

SEQ ID NO: 1639234 - RNA, 22 nt, Human
gucugacaggcaaugcuggcug

SEQ ID NO: 1639235 - RNA, 21 nt, Human
gucugacaggcaaugcuggcu

SEQ ID NO: 1639236 - RNA, 19 nt, Human
gucugaagucacugcacag

SEQ ID NO: 1639237 - RNA, 17 nt, Human
gucugaagucacugcac

SEQ ID NO: 1639238 - RNA, 19 nt, Human
gucucuugguccugcugca

SEQ ID NO: 1639239 - RNA, 18 nt, Human
gucucuugguccugcugc

SEQ ID NO: 1639240 - RNA, 20 nt, Human
gucucuugguccugcugcag

SEQ ID NO: 1639241 - RNA, 17 nt, Human
gucucuugguccugcug

SEQ ID NO: 1639242 - RNA, 23 nt, Human
gucucuuuaaugucacaggcagg

SEQ ID NO: 1639243 - RNA, 22 nt, Human
gucucuuuaaugucacaggcag

SEQ ID NO: 1639244 - RNA, 19 nt, Human
gucugaaggcuggguucug

SEQ ID NO: 1639245 - RNA, 16 nt, Human
gucugaagucacugca

SEQ ID NO: 1639246 - RNA, 20 nt, Human
gucucuuuaaugucacaggc

SEQ ID NO: 1639247 - RNA, 19 nt, Human
gucucuuuaaugucacagg

SEQ ID NO: 1639248 - RNA, 18 nt, Human
gucucuuuaaugucacag

SEQ ID NO: 1639249 - RNA, 16 nt, Human
gucuucaguaagccgu

SEQ ID NO: 1639250 - RNA, 16 nt, Human
gucuuuguacagacaa

SEQ ID NO: 1639251 - RNA, 15 nt, Human
gucuuuguacagaca

SEQ ID NO: 1639252 - RNA, 18 nt, Human
aaccugauugugucucuu

SEQ ID NO: 1639253 - RNA, 19 nt, Human
aaccugauugugucucuug

SEQ ID NO: 1639254 - RNA, 17 nt, Human
aaccuguucugcuuucc

SEQ ID NO: 1639255 - RNA, 13 nt, Human
aaccuguucugcu

SEQ ID NO: 1639256 - RNA, 23 nt, Human
aacguggcugcuucaaggauccu

SEQ ID NO: 1639257 - RNA, 20 nt, Human
aacauacucccaucugugaa

SEQ ID NO: 1639258 - RNA, 18 nt, Human
aacauacucccaucugug

SEQ ID NO: 1639259 - RNA, 14 nt, Human
aacauaaaucugug

SEQ ID NO: 1639260 - RNA, 12 nt, Human
aacauaaaucug

SEQ ID NO: 1639261 - RNA, 15 nt, Human
aacauaaaucuguga

SEQ ID NO: 1639262 - RNA, 16 nt, Human
aacauauauaacaaug

SEQ ID NO: 1639263 - RNA, 14 nt, Human
aacaucaacaucuu

SEQ ID NO: 1639264 - RNA, 22 nt, Human
aacauguuuuucuucucccuca

SEQ ID NO: 1639265 - RNA, 23 nt, Human
aacauguuaaaccaugggauaaa

SEQ ID NO: 1639266 - RNA, 19 nt, Human
aacagauuauuaccuuaca

SEQ ID NO: 1639267 - RNA, 16 nt, Human
aacagauaaauaguuu

SEQ ID NO: 1639268 - RNA, 15 nt, Human
guccuacccacccuc

SEQ ID NO: 1639269 - RNA, 13 nt, Human
guccuacccaccc

SEQ ID NO: 1639270 - RNA, 17 nt, Human
aacagucucaggaaauc

SEQ ID NO: 1639271 - RNA, 19 nt, Human
aacagguuuuccugaagaa

SEQ ID NO: 1639272 - RNA, 19 nt, Human
aacagucucaggaaaucaa

SEQ ID NO: 1639273 - RNA, 23 nt, Human
guccccuguuuguuucugaaagg

SEQ ID NO: 1639274 - RNA, 16 nt, Human
guccccgcacugggcu

SEQ ID NO: 1639275 - RNA, 15 nt, Human
guccccgcacugggc

SEQ ID NO: 1639276 - RNA, 13 nt, Human
gucccccugacaa

SEQ ID NO: 1639277 - RNA, 18 nt, Human
gucccccugacaacacuc

SEQ ID NO: 1639278 - RNA, 21 nt, Human
guccgaaagggacuuggaagc

SEQ ID NO: 1639279 - RNA, 13 nt, Human
gucccuuuuccuu

SEQ ID NO: 1639280 - RNA, 22 nt, Human
guccgaaagggacuuggaagcu

SEQ ID NO: 1639281 - RNA, 13 nt, Human
guccgagcuuuga

SEQ ID NO: 1639282 - RNA, 18 nt, Human
gucccaccuuggcugcag

SEQ ID NO: 1639283 - RNA, 17 nt, Human
gucccaccuuggcugca

SEQ ID NO: 1639284 - RNA, 20 nt, Human
gucccaccuuggcugcaggg

SEQ ID NO: 1639285 - RNA, 19 nt, Human
gucccaccuuggcugcagg

SEQ ID NO: 1639286 - RNA, 14 nt, Human
gucccccucuggcu

SEQ ID NO: 1639287 - RNA, 12 nt, Human
gucccccucugg

SEQ ID NO: 1639288 - RNA, 22 nt, Human
guagcucuaggagggcuggcaa

SEQ ID NO: 1639289 - RNA, 23 nt, Human
gucucaguccaugaagauguaga

SEQ ID NO: 1639290 - RNA, 16 nt, Human
gucucaggucccugca

SEQ ID NO: 1639291 - RNA, 15 nt, Human
gucucaggucccugc

SEQ ID NO: 1639292 - RNA, 15 nt, Human
gucuaugggacucaa

SEQ ID NO: 1639293 - RNA, 14 nt, Human
gucuaugggacuca

SEQ ID NO: 1639294 - RNA, 22 nt, Human
gucucaaacucuugaccucagg

SEQ ID NO: 1639295 - RNA, 17 nt, Human
gucucaagagggcacug

SEQ ID NO: 1639296 - RNA, 15 nt, Human
gucucaagagggcac

SEQ ID NO: 1639297 - RNA, 22 nt, Human
gucucaagagggcacugguggc

SEQ ID NO: 1639298 - RNA, 20 nt, Human
gucucaagagggcacuggug

SEQ ID NO: 1639299 - RNA, 16 nt, Human
aacauuuugucauaua

SEQ ID NO: 1639300 - RNA, 13 nt, Human
gucuccauguuug

SEQ ID NO: 1639301 - RNA, 18 nt, Human
aaccacaucuugcucugc

SEQ ID NO: 1639302 - RNA, 13 nt, Human
aaccacaucuugc

SEQ ID NO: 1639303 - RNA, 16 nt, Human
aaccaagccguggcuu

SEQ ID NO: 1639304 - RNA, 16 nt, Human
guccugcugcaguugc

SEQ ID NO: 1639305 - RNA, 13 nt, Human
guccugcugcagu

SEQ ID NO: 1639306 - RNA, 17 nt, Human
guccugcugcaguugcc

SEQ ID NO: 1639307 - RNA, 14 nt, Human
gucgaggacaggga

SEQ ID NO: 1639308 - RNA, 14 nt, Human
gucgcccagucugg

SEQ ID NO: 1639309 - RNA, 13 nt, Human
gucgcccagucug

SEQ ID NO: 1639310 - RNA, 14 nt, Human
gucgcccaggcugg

SEQ ID NO: 1639311 - RNA, 20 nt, Human
gucgcccaggcuggagugca

SEQ ID NO: 1639312 - RNA, 15 nt, Human
gucgcccaggcugga

SEQ ID NO: 1639313 - RNA, 23 nt, Human
gucgcccagucuggaaugcagug

SEQ ID NO: 1639314 - RNA, 14 nt, Human
gucgcccuggacug

SEQ ID NO: 1639315 - RNA, 20 nt, Human
gucuaccugaggggccucuu

SEQ ID NO: 1639316 - RNA, 18 nt, Human
gucgcccuggacugugug

SEQ ID NO: 1639317 - RNA, 16 nt, Human
aagcaaguauuagaau

SEQ ID NO: 1639318 - RNA, 20 nt, Human
gugucccaaaaagaaaggag

SEQ ID NO: 1639319 - RNA, 19 nt, Human
gugucuugcaauggcagcc

SEQ ID NO: 1639320 - RNA, 19 nt, Human
gugucuuuaaaugcugcuu

SEQ ID NO: 1639321 - RNA, 18 nt, Human
gugucuuuaaaugcugcu

SEQ ID NO: 1639322 - RNA, 21 nt, Human
gugucuugcaauggcagccuu

SEQ ID NO: 1639323 - RNA, 18 nt, Human
gugugagucaccaagccc

SEQ ID NO: 1639324 - RNA, 13 nt, Human
gugugagucacca

SEQ ID NO: 1639325 - RNA, 15 nt, Human
gugugguguuuccug

SEQ ID NO: 1639326 - RNA, 20 nt, Human
gugugagucaccaagcccag

SEQ ID NO: 1639327 - RNA, 19 nt, Human
gugugguguuuccuggcac

SEQ ID NO: 1639328 - RNA, 19 nt, Human
guguguguaugcgugugug

SEQ ID NO: 1639329 - RNA, 14 nt, Human
guguuuaagacauu

SEQ ID NO: 1639330 - RNA, 13 nt, Human
guguuuaagacau

SEQ ID NO: 1639331 - RNA, 23 nt, Human
guguugaaacggaugauuucuau

SEQ ID NO: 1639332 - RNA, 21 nt, Human
guguugaaacggaugauuucu

SEQ ID NO: 1639333 - RNA, 19 nt, Human
aagcaaaauuuuuucucua

SEQ ID NO: 1639334 - RNA, 20 nt, Human
aagcaaaugugaaucauuuu

SEQ ID NO: 1639335 - RNA, 14 nt, Human
aagcaaaugugaau

SEQ ID NO: 1639336 - RNA, 13 nt, Human
aagcaaaugugaa

SEQ ID NO: 1639337 - RNA, 12 nt, Human
aagcaaaugucu

SEQ ID NO: 1639338 - RNA, 22 nt, Human
aagauguagaggagaaacugga

SEQ ID NO: 1639339 - RNA, 18 nt, Human
gugguuauggagagggug

SEQ ID NO: 1639340 - RNA, 19 nt, Human
gugguguuuccuggcacug

SEQ ID NO: 1639341 - RNA, 15 nt, Human
aagauauuuugcuuu

SEQ ID NO: 1639342 - RNA, 19 nt, Human
aagaguaggaagacuuugg

SEQ ID NO: 1639343 - RNA, 18 nt, Human
aagaguaggaagacuuug

SEQ ID NO: 1639344 - RNA, 16 nt, Human
aagaguaggaagacuu

SEQ ID NO: 1639345 - RNA, 17 nt, Human
aagauauuuugcuuugu

SEQ ID NO: 1639346 - RNA, 20 nt, Human
aagauauuuugcuuugugau

SEQ ID NO: 1639347 - RNA, 20 nt, Human
aagaguaggaagacuuugga

SEQ ID NO: 1639348 - RNA, 22 nt, Human
aagauauuuugcuuugugauuu

SEQ ID NO: 1639349 - RNA, 14 nt, Human
aagacuauucaaac

SEQ ID NO: 1639350 - RNA, 23 nt, Human
aagacgcugugcugcccugccca

SEQ ID NO: 1639351 - RNA, 22 nt, Human
aagacgcugugcugcccugccc

SEQ ID NO: 1639352 - RNA, 21 nt, Human
aagacgcugugcugcccugcc

SEQ ID NO: 1639353 - RNA, 12 nt, Human
aagaccagucca

SEQ ID NO: 1639354 - RNA, 23 nt, Human
aagaccccuuaccacugcucuga

SEQ ID NO: 1639355 - RNA, 17 nt, Human
aagacuccaaagaaaug

SEQ ID NO: 1639356 - RNA, 16 nt, Human
aagacuccaaagaaau

SEQ ID NO: 1639357 - RNA, 14 nt, Human
aagacuccaaagaa

SEQ ID NO: 1639358 - RNA, 17 nt, Human
aagacucauucuucugu

SEQ ID NO: 1639359 - RNA, 19 nt, Human
aagagcuguucacagccag

SEQ ID NO: 1639360 - RNA, 16 nt, Human
guggcccgacagccug

SEQ ID NO: 1639361 - RNA, 18 nt, Human
aagagcuguucacagcca

SEQ ID NO: 1639362 - RNA, 19 nt, Human
aagagauugugguuucauu

SEQ ID NO: 1639363 - RNA, 16 nt, Human
aagagauugugguuuc

SEQ ID NO: 1639364 - RNA, 16 nt, Human
aagacuguacaaagua

SEQ ID NO: 1639365 - RNA, 14 nt, Human
aagagcccaggccu

SEQ ID NO: 1639366 - RNA, 12 nt, Human
aagagcccaggc

SEQ ID NO: 1639367 - RNA, 16 nt, Human
aagagcccaggccucc

SEQ ID NO: 1639368 - RNA, 14 nt, Human
guggccucccaacu

SEQ ID NO: 1639369 - RNA, 13 nt, Human
guggccucccaac

SEQ ID NO: 1639370 - RNA, 17 nt, Human
guggcccgacagccugg

SEQ ID NO: 1639371 - RNA, 15 nt, Human
guggccucccaacuc

SEQ ID NO: 1639372 - RNA, 21 nt, Human
guggcuucccgcucagcccuc

SEQ ID NO: 1639373 - RNA, 18 nt, Human
gugggauccuccaggugc

SEQ ID NO: 1639374 - RNA, 15 nt, Human
gugggauccuccagg

SEQ ID NO: 1639375 - RNA, 12 nt, Human
gugggagcugag

SEQ ID NO: 1639376 - RNA, 16 nt, Human
gugguguuuccuggca

SEQ ID NO: 1639377 - RNA, 15 nt, Human
gugguguuuccuggc

SEQ ID NO: 1639378 - RNA, 18 nt, Human
guggggggggugcugggc

SEQ ID NO: 1639379 - RNA, 22 nt, Human
aagaagcaccaaucaugaauua

SEQ ID NO: 1639380 - RNA, 17 nt, Human
aagaagcccaggaaagg

SEQ ID NO: 1639381 - RNA, 16 nt, Human
aagaagcccaggaaag

SEQ ID NO: 1639382 - RNA, 14 nt, Human
aagaagcucucucc

SEQ ID NO: 1639383 - RNA, 15 nt, Human
aagaagcucucuccu

SEQ ID NO: 1639384 - RNA, 13 nt, Human
aagaaaauaucac

SEQ ID NO: 1639385 - RNA, 16 nt, Human
aagaaaauaccaagga

SEQ ID NO: 1639386 - RNA, 22 nt, Human
aagaaaaaggaugcacagaguu

SEQ ID NO: 1639387 - RNA, 19 nt, Human
aagaaaaaggaugcacaga

SEQ ID NO: 1639388 - RNA, 20 nt, Human
aagaaaaaggaugcacagag

SEQ ID NO: 1639389 - RNA, 13 nt, Human
aacuuguuuucug

SEQ ID NO: 1639390 - RNA, 20 nt, Human
aacuuguguaaauacaauuu

SEQ ID NO: 1639391 - RNA, 15 nt, Human
aacuuguguaaauac

SEQ ID NO: 1639392 - RNA, 14 nt, Human
aacuuguguaaaua

SEQ ID NO: 1639393 - RNA, 15 nt, Human
gugccucugggacug

SEQ ID NO: 1639394 - RNA, 16 nt, Human
gugccuggccacgccc

SEQ ID NO: 1639395 - RNA, 23 nt, Human
aacuugguucccauuugcuccuu

SEQ ID NO: 1639396 - RNA, 17 nt, Human
aacuuggcgcugccccu

SEQ ID NO: 1639397 - RNA, 15 nt, Human
aacuuguaaaugugg

SEQ ID NO: 1639398 - RNA, 14 nt, Human
aacuuggcgcugcc

SEQ ID NO: 1639399 - RNA, 17 nt, Human
gugcacacaccagagcc

SEQ ID NO: 1639400 - RNA, 18 nt, Human
gugcacguacacacacau

SEQ ID NO: 1639401 - RNA, 14 nt, Human
gugcacacaccaga

SEQ ID NO: 1639402 - RNA, 12 nt, Human
gugcacacacca

SEQ ID NO: 1639403 - RNA, 14 nt, Human
gugccaagcagagg

SEQ ID NO: 1639404 - RNA, 15 nt, Human
gugcauuuggugguu

SEQ ID NO: 1639405 - RNA, 21 nt, Human
gugcauuugaggucuguucuu

SEQ ID NO: 1639406 - RNA, 22 nt, Human
gugcauuugaggucuguucuuu

SEQ ID NO: 1639407 - RNA, 20 nt, Human
gugcacuaauguguaagaca

SEQ ID NO: 1639408 - RNA, 13 nt, Human
aagaauauuuuaa

SEQ ID NO: 1639409 - RNA, 17 nt, Human
guggcagcugcggucca

SEQ ID NO: 1639410 - RNA, 19 nt, Human
guggcagcugcgguccacc

SEQ ID NO: 1639411 - RNA, 13 nt, Human
aagacccaaaagg

SEQ ID NO: 1639412 - RNA, 16 nt, Human
aagacaaaaagcuacu

SEQ ID NO: 1639413 - RNA, 24 nt, Human
aagaauuucuaggacugaauuaug

SEQ ID NO: 1639414 - RNA, 21 nt, Human
guggauuuaacagaaauguac

SEQ ID NO: 1639415 - RNA, 23 nt, Human
guggauuuaacagaaauguacag

SEQ ID NO: 1639416 - RNA, 14 nt, Human
guggcagcugcggu

SEQ ID NO: 1639417 - RNA, 22 nt, Human
guggcagcucaccucucccuug

SEQ ID NO: 1639418 - RNA, 14 nt, Human
guggcaccagcagc

SEQ ID NO: 1639419 - RNA, 13 nt, Human
guggcaccagcag

SEQ ID NO: 1639420 - RNA, 18 nt, Human
guggcaccagcagccugg

SEQ ID NO: 1639421 - RNA, 20 nt, Human
gugcugcccugcccaccugg

SEQ ID NO: 1639422 - RNA, 19 nt, Human
gugcugcccugcccaccug

SEQ ID NO: 1639423 - RNA, 21 nt, Human
gugcugcccugcccaccuggc

SEQ ID NO: 1639424 - RNA, 23 nt, Human
aagaagguuucagaaagaagugg

SEQ ID NO: 1639425 - RNA, 19 nt, Human
gugcugggccccugccucu

SEQ ID NO: 1639426 - RNA, 22 nt, Human
gugcugggguuaucugaaguca

SEQ ID NO: 1639427 - RNA, 19 nt, Human
gugcugguguaugugugaa

SEQ ID NO: 1639428 - RNA, 16 nt, Human
gugcugggccccugcc

SEQ ID NO: 1639429 - RNA, 24 nt, Human
guggacacagcucuucuccaggcu

SEQ ID NO: 1639430 - RNA, 17 nt, Human
guggacacagcucuucu

SEQ ID NO: 1639431 - RNA, 15 nt, Human
guggacacagcucuu

SEQ ID NO: 1639432 - RNA, 14 nt, Human
guggacacagcucu

SEQ ID NO: 1639433 - RNA, 12 nt, Human
aauaaaaauaau

SEQ ID NO: 1639434 - RNA, 22 nt, Human
aauaaaauccauacauuugugu

SEQ ID NO: 1639435 - RNA, 16 nt, Human
aauaaaaucuugaaaa

SEQ ID NO: 1639436 - RNA, 14 nt, Human
aauaaaguaauuau

SEQ ID NO: 1639437 - RNA, 16 nt, Human
aauaaaguacaagagc

SEQ ID NO: 1639438 - RNA, 14 nt, Human
uaaaguguauuuuu

SEQ ID NO: 1639439 - RNA, 15 nt, Human
uaaaguguauuuuuu

SEQ ID NO: 1639440 - RNA, 19 nt, Human
uaaaguguauuuuuuuacu

SEQ ID NO: 1639441 - RNA, 20 nt, Human
uaaaguguauuuuuuuacua

SEQ ID NO: 1639442 - RNA, 14 nt, Human
aauaaaaaauuaug

SEQ ID NO: 1639443 - RNA, 16 nt, Human
aauaaaaaauuaugac

SEQ ID NO: 1639444 - RNA, 15 nt, Human
aauaaaaaauuauga

SEQ ID NO: 1639445 - RNA, 13 nt, Human
uaaagucaggggu

SEQ ID NO: 1639446 - RNA, 21 nt, Human
aauaaaugugccuucauuuuu

SEQ ID NO: 1639447 - RNA, 12 nt, Human
aauaaaugugcc

SEQ ID NO: 1639448 - RNA, 12 nt, Human
aauaaauuauuu

SEQ ID NO: 1639449 - RNA, 21 nt, Human
aauaaauagcuagacugguga

SEQ ID NO: 1639450 - RNA, 15 nt, Human
aauaacaauaaaaga

SEQ ID NO: 1639451 - RNA, 22 nt, Human
aauaacauguaauuaaguacua

SEQ ID NO: 1639452 - RNA, 19 nt, Human
aauaacauguaauuaagua

SEQ ID NO: 1639453 - RNA, 12 nt, Human
aauaacauguaa

SEQ ID NO: 1639454 - RNA, 15 nt, Human
aauaacuaaaaggua

SEQ ID NO: 1639455 - RNA, 15 nt, Human
aauaaggaaaaguuu

SEQ ID NO: 1639456 - RNA, 13 nt, Human
aauaaggaaaagu

SEQ ID NO: 1639457 - RNA, 22 nt, Human
aauaaggaaaaguuuaauauua

SEQ ID NO: 1639458 - RNA, 19 nt, Human
aauaaggaaaaguuuaaua

SEQ ID NO: 1639459 - RNA, 16 nt, Human
aauaaggaaaaguuua

SEQ ID NO: 1639460 - RNA, 23 nt, Human
aauaauuauaugcuauuucuaua

SEQ ID NO: 1639461 - RNA, 22 nt, Human
aauaauuauaugcuauuucuau

SEQ ID NO: 1639462 - RNA, 21 nt, Human
aauaauuauaugcuauuucua

SEQ ID NO: 1639463 - RNA, 20 nt, Human
aauaauuauaugcuauuucu

SEQ ID NO: 1639464 - RNA, 15 nt, Human
aauaauuauaugcua

SEQ ID NO: 1639465 - RNA, 14 nt, Human
aauaauuauaugcu

SEQ ID NO: 1639466 - RNA, 23 nt, Human
uaaaucccauuauucaaaguugc

SEQ ID NO: 1639467 - RNA, 19 nt, Human
uaaaucuccaaaauaaaac

SEQ ID NO: 1639468 - RNA, 12 nt, Human
uaaauagcuuuu

SEQ ID NO: 1639469 - RNA, 23 nt, Human
uaaauagcuagacuggugacuga

SEQ ID NO: 1639470 - RNA, 20 nt, Human
uaaauaguaaaaauaaaauu

SEQ ID NO: 1639471 - RNA, 19 nt, Human
uaaauaguaaaaauaaaau

SEQ ID NO: 1639472 - RNA, 23 nt, Human
uaaauacaauuuuguuucuguac

SEQ ID NO: 1639473 - RNA, 22 nt, Human
uaaauacaauuuuguuucugua

SEQ ID NO: 1639474 - RNA, 15 nt, Human
uaaauacaauuuugu

SEQ ID NO: 1639475 - RNA, 13 nt, Human
uaaauacaauuuu

SEQ ID NO: 1639476 - RNA, 14 nt, Human
aauacacacucaaa

SEQ ID NO: 1639477 - RNA, 23 nt, Human
aauacaauuuuguuucuguacuu

SEQ ID NO: 1639478 - RNA, 22 nt, Human
aauacaauuuuguuucuguacu

SEQ ID NO: 1639479 - RNA, 15 nt, Human
aauacaccacuacau

SEQ ID NO: 1639480 - RNA, 13 nt, Human
aauacaauuuugu

SEQ ID NO: 1639481 - RNA, 12 nt, Human
aauacaauuuug

SEQ ID NO: 1639482 - RNA, 20 nt, Human
aauacaauuuuguuucugua

SEQ ID NO: 1639483 - RNA, 18 nt, Human
aauacaauuuuguuucug

SEQ ID NO: 1639484 - RNA, 17 nt, Human
aauacaauuuuguuucu

SEQ ID NO: 1639485 - RNA, 15 nt, Human
aauacaauuuuguuu

SEQ ID NO: 1639486 - RNA, 16 nt, Human
aauacaccacuacauu

SEQ ID NO: 1639487 - RNA, 18 nt, Human
aauacaccacuacauucu

SEQ ID NO: 1639488 - RNA, 20 nt, Human
aauacaccacuacauucugu

SEQ ID NO: 1639489 - RNA, 21 nt, Human
aauacaccacuacauucuguu

SEQ ID NO: 1639490 - RNA, 16 nt, Human
uaacaacagcuggugc

SEQ ID NO: 1639491 - RNA, 17 nt, Human
uaacaaugcuguauuuu

SEQ ID NO: 1639492 - RNA, 15 nt, Human
uaacaaugcuguauu

SEQ ID NO: 1639493 - RNA, 13 nt, Human
uaacaagccaccc

SEQ ID NO: 1639494 - RNA, 22 nt, Human
uaacaacuaugauuuggaaaau

SEQ ID NO: 1639495 - RNA, 21 nt, Human
uaacaacuaugauuuggaaaa

SEQ ID NO: 1639496 - RNA, 16 nt, Human
uaacaacuaugauuug

SEQ ID NO: 1639497 - RNA, 17 nt, Human
uaaaugauuucauucaa

SEQ ID NO: 1639498 - RNA, 22 nt, Human
uaaaucuccaaaauaaaacuuu

SEQ ID NO: 1639499 - RNA, 20 nt, Human
uaaaucuccaaaauaaaacu

SEQ ID NO: 1639500 - RNA, 21 nt, Human
uaaaucuccaaaauaaaacuu

SEQ ID NO: 1639501 - RNA, 23 nt, Human
uaaauguuuuuuuuuaaagacuu

SEQ ID NO: 1639502 - RNA, 20 nt, Human
uaaauguuuuuuuuuaaaga

SEQ ID NO: 1639503 - RNA, 18 nt, Human
uaaaccgccaaggcuggg

SEQ ID NO: 1639504 - RNA, 16 nt, Human
uaaaccgccaaggcug

SEQ ID NO: 1639505 - RNA, 22 nt, Human
uaaaccaugggauaaaugccau

SEQ ID NO: 1639506 - RNA, 21 nt, Human
uaaaccaugggauaaaugcca

SEQ ID NO: 1639507 - RNA, 20 nt, Human
uaaaccaugggauaaaugcc

SEQ ID NO: 1639508 - RNA, 18 nt, Human
uaaaccaugggauaaaug

SEQ ID NO: 1639509 - RNA, 17 nt, Human
uaaacgucuuaaauauu

SEQ ID NO: 1639510 - RNA, 13 nt, Human
uaaacgucuuaaa

SEQ ID NO: 1639511 - RNA, 12 nt, Human
uaaacugccccc

SEQ ID NO: 1639512 - RNA, 21 nt, Human
uaaaggcuaccuuuguauucu

SEQ ID NO: 1639513 - RNA, 19 nt, Human
uaaaggcuaccuuuguauu

SEQ ID NO: 1639514 - RNA, 14 nt, Human
uaaagaguguggca

SEQ ID NO: 1639515 - RNA, 18 nt, Human
uaaagaguuaguuugagu

SEQ ID NO: 1639516 - RNA, 16 nt, Human
uaaagacuuuuaugau

SEQ ID NO: 1639517 - RNA, 15 nt, Human
uaaagacaccuacug

SEQ ID NO: 1639518 - RNA, 14 nt, Human
uaaagaagguuuca

SEQ ID NO: 1639519 - RNA, 17 nt, Human
aaguucaugcuuuguuc

SEQ ID NO: 1639520 - RNA, 17 nt, Human
aaguucugcagauaaac

SEQ ID NO: 1639521 - RNA, 21 nt, Human
aaguuuaauauuaaagccaug

SEQ ID NO: 1639522 - RNA, 20 nt, Human
aaguuuaauauuaaagccau

SEQ ID NO: 1639523 - RNA, 19 nt, Human
aaguuuaauauuaaagcca

SEQ ID NO: 1639524 - RNA, 14 nt, Human
aaguuaaauaaauc

SEQ ID NO: 1639525 - RNA, 12 nt, Human
aaguuaaauaaa

SEQ ID NO: 1639526 - RNA, 17 nt, Human
guuuuuuuuuaaagacu

SEQ ID NO: 1639527 - RNA, 19 nt, Human
uaaaauuuuuaaucuuuaa

SEQ ID NO: 1639528 - RNA, 19 nt, Human
uaaaccaaggcuagaacca

SEQ ID NO: 1639529 - RNA, 17 nt, Human
uaaaauuuuuaaucuuu

SEQ ID NO: 1639530 - RNA, 19 nt, Human
uaaaauuaaagcugaaaac

SEQ ID NO: 1639531 - RNA, 18 nt, Human
uaaaauuaaagcugaaaa

SEQ ID NO: 1639532 - RNA, 16 nt, Human
uaaaauuaaagcugaa

SEQ ID NO: 1639533 - RNA, 18 nt, Human
aaguaaaaccacagcagu

SEQ ID NO: 1639534 - RNA, 17 nt, Human
aaguaaaaccacagcag

SEQ ID NO: 1639535 - RNA, 21 nt, Human
aagggugaugggaaagcauug

SEQ ID NO: 1639536 - RNA, 16 nt, Human
aaguaaaaccacagca

SEQ ID NO: 1639537 - RNA, 15 nt, Human
aaguaaaaccacagc

SEQ ID NO: 1639538 - RNA, 14 nt, Human
aaguaaaaccacag

SEQ ID NO: 1639539 - RNA, 13 nt, Human
aagggccuggccu

SEQ ID NO: 1639540 - RNA, 14 nt, Human
aaggcugggggaag

SEQ ID NO: 1639541 - RNA, 16 nt, Human
aaggguaucuggugac

SEQ ID NO: 1639542 - RNA, 19 nt, Human
aaggguaucaggugcugcc

SEQ ID NO: 1639543 - RNA, 14 nt, Human
aaggggcaguggug

SEQ ID NO: 1639544 - RNA, 17 nt, Human
aaggggcaguggugguu

SEQ ID NO: 1639545 - RNA, 13 nt, Human
aagggcccagaga

SEQ ID NO: 1639546 - RNA, 15 nt, Human
aagggcccagagagg

SEQ ID NO: 1639547 - RNA, 19 nt, Human
aaggcugagaggagagaga

SEQ ID NO: 1639548 - RNA, 22 nt, Human
guuuuauaauuuugugaagcaa

SEQ ID NO: 1639549 - RNA, 15 nt, Human
guuuuauaauuuugu

SEQ ID NO: 1639550 - RNA, 18 nt, Human
guuuuacugcagcuuugu

SEQ ID NO: 1639551 - RNA, 16 nt, Human
guuuuacugcagcuuu

SEQ ID NO: 1639552 - RNA, 16 nt, Human
guuuuaagaggcaggg

SEQ ID NO: 1639553 - RNA, 18 nt, Human
guuuuaaggaugcuugua

SEQ ID NO: 1639554 - RNA, 14 nt, Human
guuuuaagaggcag

SEQ ID NO: 1639555 - RNA, 22 nt, Human
guuucuaugacacaugcaaggu

SEQ ID NO: 1639556 - RNA, 14 nt, Human
guuucucagcuccc

SEQ ID NO: 1639557 - RNA, 22 nt, Human
guuucugccgcagcccugcaga

SEQ ID NO: 1639558 - RNA, 10 nt, Human
guuucuguac

SEQ ID NO: 1639559 - RNA, 13 nt, Human
guuugcuaaguga

SEQ ID NO: 1639560 - RNA, 17 nt, Human
guuugccucugccucug

SEQ ID NO: 1639561 - RNA, 19 nt, Human
guuugcaucugaaaauuga

SEQ ID NO: 1639562 - RNA, 15 nt, Human
guuucuguacuuuuu

SEQ ID NO: 1639563 - RNA, 14 nt, Human
aaguauuaagcaua

SEQ ID NO: 1639564 - RNA, 13 nt, Human
aaguauuaagcau

SEQ ID NO: 1639565 - RNA, 21 nt, Human
aaguauguuagugcaaauugu

SEQ ID NO: 1639566 - RNA, 23 nt, Human
aaguauguuagugcaaauuguca

SEQ ID NO: 1639567 - RNA, 23 nt, Human
aaguacuucuccacccugcucuc

SEQ ID NO: 1639568 - RNA, 22 nt, Human
aaguacuucuccacccugcucu

SEQ ID NO: 1639569 - RNA, 22 nt, Human
guuuucugagaaagacuauuca

SEQ ID NO: 1639570 - RNA, 17 nt, Human
guuuucugagaaagacu

SEQ ID NO: 1639571 - RNA, 16 nt, Human
guuuucugagaaagac

SEQ ID NO: 1639572 - RNA, 21 nt, Human
aaguacuucuccacccugcuc

SEQ ID NO: 1639573 - RNA, 15 nt, Human
aaguacuggagaaaa

SEQ ID NO: 1639574 - RNA, 16 nt, Human
aaguacuauguaucaa

SEQ ID NO: 1639575 - RNA, 19 nt, Human
aaguauucuuauuuaauga

SEQ ID NO: 1639576 - RNA, 18 nt, Human
aaguauucuuauuuaaug

SEQ ID NO: 1639577 - RNA, 21 nt, Human
aagucaagugaaaaaggagga

SEQ ID NO: 1639578 - RNA, 24 nt, Human
aagucacacaguauuacuucugcu

SEQ ID NO: 1639579 - RNA, 19 nt, Human
aagucaaggguaggguggg

SEQ ID NO: 1639580 - RNA, 13 nt, Human
aagucacacagug

SEQ ID NO: 1639581 - RNA, 20 nt, Human
aagucacauuccugaacagg

SEQ ID NO: 1639582 - RNA, 12 nt, Human
aagucacugcac

SEQ ID NO: 1639583 - RNA, 14 nt, Human
aagucacugcacag

SEQ ID NO: 1639584 - RNA, 23 nt, Human
guuuuuuuuuaaaaaagaaacau

SEQ ID NO: 1639585 - RNA, 15 nt, Human
guuuuuuuuuaaaga

SEQ ID NO: 1639586 - RNA, 16 nt, Human
guuuuugucuuaaaaa

SEQ ID NO: 1639587 - RNA, 22 nt, Human
aagucuuauauauuguagauaa

SEQ ID NO: 1639588 - RNA, 19 nt, Human
aagucuuagauguauauau

SEQ ID NO: 1639589 - RNA, 18 nt, Human
aagucuuagauguauaua

SEQ ID NO: 1639590 - RNA, 18 nt, Human
guuuuucuaggccugggg

SEQ ID NO: 1639591 - RNA, 13 nt, Human
guguuuauuguca

SEQ ID NO: 1639592 - RNA, 11 nt, Human
aagcucccagg

SEQ ID NO: 1639593 - RNA, 22 nt, Human
guguuuaagacauuuuuggaag

SEQ ID NO: 1639594 - RNA, 22 nt, Human
aagcucccaggcauuccccagg

SEQ ID NO: 1639595 - RNA, 12 nt, Human
aagcucccaggc

SEQ ID NO: 1639596 - RNA, 23 nt, Human
aagcucccaggcauuccccagga

SEQ ID NO: 1639597 - RNA, 16 nt, Human
aaggaaaaaauaacaa

SEQ ID NO: 1639598 - RNA, 19 nt, Human
aaggaaaaaauaacaauga

SEQ ID NO: 1639599 - RNA, 17 nt, Human
guuccccuguucacucu

SEQ ID NO: 1639600 - RNA, 15 nt, Human
guuccccuguucacu

SEQ ID NO: 1639601 - RNA, 16 nt, Human
aagcuuuuaugugaaa

SEQ ID NO: 1639602 - RNA, 18 nt, Human
aagcuguuacugucuuca

SEQ ID NO: 1639603 - RNA, 13 nt, Human
aagcucugcuccu

SEQ ID NO: 1639604 - RNA, 17 nt, Human
aagcucugcuccucucc

SEQ ID NO: 1639605 - RNA, 23 nt, Human
guugauagcacagacccugcccu

SEQ ID NO: 1639606 - RNA, 13 nt, Human
guugaauuuuaca

SEQ ID NO: 1639607 - RNA, 18 nt, Human
guuccccuguucacucua

SEQ ID NO: 1639608 - RNA, 12 nt, Human
guucucugcccu

SEQ ID NO: 1639609 - RNA, 13 nt, Human
guucucugcccuc

SEQ ID NO: 1639610 - RNA, 11 nt, Human
guucucugccc

SEQ ID NO: 1639611 - RNA, 16 nt, Human
guucucugaggacacu

SEQ ID NO: 1639612 - RNA, 15 nt, Human
aaggaaacccagcuc

SEQ ID NO: 1639613 - RNA, 16 nt, Human
aaggaaacccagcucu

SEQ ID NO: 1639614 - RNA, 18 nt, Human
aaggagauuuacaacugg

SEQ ID NO: 1639615 - RNA, 22 nt, Human
aaggagcaagucagaauagaaa

SEQ ID NO: 1639616 - RNA, 22 nt, Human
aaggauccugagccagauuuca

SEQ ID NO: 1639617 - RNA, 13 nt, Human
aaggauccugagc

SEQ ID NO: 1639618 - RNA, 12 nt, Human
aaggauccugag

SEQ ID NO: 1639619 - RNA, 11 nt, Human
aaggauccuga

SEQ ID NO: 1639620 - RNA, 13 nt, Human
aaggauaaugaau

SEQ ID NO: 1639621 - RNA, 23 nt, Human
aaggauaaaguugguaaaccuuu

SEQ ID NO: 1639622 - RNA, 21 nt, Human
aaggauaaaguugguaaaccu

SEQ ID NO: 1639623 - RNA, 20 nt, Human
aaggaggaagagaaaaaaua

SEQ ID NO: 1639624 - RNA, 17 nt, Human
guugggcuggugucacc

SEQ ID NO: 1639625 - RNA, 17 nt, Human
guugcccaggcuggcgu

SEQ ID NO: 1639626 - RNA, 16 nt, Human
guugcccaggcuggcg

SEQ ID NO: 1639627 - RNA, 15 nt, Human
guugcccaggcuggc

SEQ ID NO: 1639628 - RNA, 12 nt, Human
guugcugccuca

SEQ ID NO: 1639629 - RNA, 19 nt, Human
aaggaugcccaaagaugca

SEQ ID NO: 1639630 - RNA, 14 nt, Human
aaggaugcccaaag

SEQ ID NO: 1639631 - RNA, 24 nt, Human
aaggaugcacagaguuguuacauu

SEQ ID NO: 1639632 - RNA, 16 nt, Human
aaggccccgcccaggc

SEQ ID NO: 1639633 - RNA, 14 nt, Human
aaggccccgcccag

SEQ ID NO: 1639634 - RNA, 19 nt, Human
aaggccccgcccaggcuua

SEQ ID NO: 1639635 - RNA, 13 nt, Human
aaggcuaccuuug

SEQ ID NO: 1639636 - RNA, 15 nt, Human
aaggcuaccuuugua

SEQ ID NO: 1639637 - RNA, 20 nt, Human
uacauuagcaguuugcuuug

SEQ ID NO: 1639638 - RNA, 19 nt, Human
uacauuagcaguuugcuuu

SEQ ID NO: 1639639 - RNA, 13 nt, Human
aauuaaguacuau

SEQ ID NO: 1639640 - RNA, 18 nt, Human
aauuaacauguuaaacca

SEQ ID NO: 1639641 - RNA, 23 nt, Human
uacauggcuggagcuagaauuug

SEQ ID NO: 1639642 - RNA, 17 nt, Human
uacauguacugauuacu

SEQ ID NO: 1639643 - RNA, 18 nt, Human
aauguugacaugggacau

SEQ ID NO: 1639644 - RNA, 15 nt, Human
aaugucacaggcagg

SEQ ID NO: 1639645 - RNA, 18 nt, Human
aauuaacuuuuauaaacu

SEQ ID NO: 1639646 - RNA, 20 nt, Human
aauuaacuuuuauaaacuuu

SEQ ID NO: 1639647 - RNA, 22 nt, Human
aauuaacuuuuauaaacuuuac

SEQ ID NO: 1639648 - RNA, 20 nt, Human
aauuaagaaaggauaaaguu

SEQ ID NO: 1639649 - RNA, 19 nt, Human
aauuaacaugaauauuuag

SEQ ID NO: 1639650 - RNA, 14 nt, Human
aauuaacauguuaa

SEQ ID NO: 1639651 - RNA, 13 nt, Human
aauuaacauguua

SEQ ID NO: 1639652 - RNA, 16 nt, Human
uaccaugccauuuaaa

SEQ ID NO: 1639653 - RNA, 17 nt, Human
uaccauccccuguagag

SEQ ID NO: 1639654 - RNA, 17 nt, Human
uaccacuuuuguucuug

SEQ ID NO: 1639655 - RNA, 22 nt, Human
uacccuggcacuauaauguaag

SEQ ID NO: 1639656 - RNA, 20 nt, Human
uacccuggcacuauaaugua

SEQ ID NO: 1639657 - RNA, 16 nt, Human
uacccucauguucuua

SEQ ID NO: 1639658 - RNA, 20 nt, Human
uacccgggaagggggcuggg

SEQ ID NO: 1639659 - RNA, 20 nt, Human
uacaguggggaaugaagaua

SEQ ID NO: 1639660 - RNA, 15 nt, Human
uacauaaugcgugca

SEQ ID NO: 1639661 - RNA, 18 nt, Human
uacaguccucccaucuca

SEQ ID NO: 1639662 - RNA, 17 nt, Human
uacaguccucccaucuc

SEQ ID NO: 1639663 - RNA, 15 nt, Human
uacaguccucccauc

SEQ ID NO: 1639664 - RNA, 12 nt, Human
uacaguccuccc

SEQ ID NO: 1639665 - RNA, 18 nt, Human
uacaguaucucagggccu

SEQ ID NO: 1639666 - RNA, 13 nt, Human
aaugucacaggca

SEQ ID NO: 1639667 - RNA, 14 nt, Human
aaugucacaggcag

SEQ ID NO: 1639668 - RNA, 22 nt, Human
aaugugaaacuggauuaaacuu

SEQ ID NO: 1639669 - RNA, 16 nt, Human
aaugguuuaaaugguc

SEQ ID NO: 1639670 - RNA, 22 nt, Human
aaugguuuucuuguguguuuau

SEQ ID NO: 1639671 - RNA, 18 nt, Human
aaugguuuucuugugugu

SEQ ID NO: 1639672 - RNA, 17 nt, Human
aaugguuuucuugugug

SEQ ID NO: 1639673 - RNA, 15 nt, Human
aauguaagcucuacu

SEQ ID NO: 1639674 - RNA, 13 nt, Human
aauguaagcucua

SEQ ID NO: 1639675 - RNA, 13 nt, Human
aauguaagacaaa

SEQ ID NO: 1639676 - RNA, 22 nt, Human
uacagcaaggagauuuacaacu

SEQ ID NO: 1639677 - RNA, 21 nt, Human
aauguacagcaaggagauuua

SEQ ID NO: 1639678 - RNA, 23 nt, Human
aauguacagcaaggagauuuaca

SEQ ID NO: 1639679 - RNA, 15 nt, Human
uaaugucacaggcag

SEQ ID NO: 1639680 - RNA, 17 nt, Human
uaaugucacaggcaggu

SEQ ID NO: 1639681 - RNA, 16 nt, Human
uaaugucacaggcagg

SEQ ID NO: 1639682 - RNA, 12 nt, Human
uaaugugaaacu

SEQ ID NO: 1639683 - RNA, 20 nt, Human
uaaugugaaacuggauuaaa

SEQ ID NO: 1639684 - RNA, 22 nt, Human
uaaugugaaacuggauuaaacu

SEQ ID NO: 1639685 - RNA, 23 nt, Human
uaaugugaaacuggauuaaacuu

SEQ ID NO: 1639686 - RNA, 17 nt, Human
uaauguaagcucuacug

SEQ ID NO: 1639687 - RNA, 16 nt, Human
uaauguaagcucuacu

SEQ ID NO: 1639688 - RNA, 15 nt, Human
uaauguaagacaaau

SEQ ID NO: 1639689 - RNA, 15 nt, Human
aaugaaugaaugaau

SEQ ID NO: 1639690 - RNA, 14 nt, Human
aaugaaugaaacau

SEQ ID NO: 1639691 - RNA, 15 nt, Human
aaugaaugucagugu

SEQ ID NO: 1639692 - RNA, 23 nt, Human
aaucuucugaacuuggcgcugcc

SEQ ID NO: 1639693 - RNA, 13 nt, Human
aaucuugaaaaug

SEQ ID NO: 1639694 - RNA, 13 nt, Human
uaaucuuucacag

SEQ ID NO: 1639695 - RNA, 17 nt, Human
uaaucuuuaauuuuaca

SEQ ID NO: 1639696 - RNA, 22 nt, Human
uaauccaagcaaaugugaauca

SEQ ID NO: 1639697 - RNA, 14 nt, Human
uaauagacaauuua

SEQ ID NO: 1639698 - RNA, 21 nt, Human
uaauauugauaugcuuauaca

SEQ ID NO: 1639699 - RNA, 19 nt, Human
uaacaaugcuguauuuuaa

SEQ ID NO: 1639700 - RNA, 20 nt, Human
aauacaguaucucagggccu

SEQ ID NO: 1639701 - RNA, 22 nt, Human
uaauacaccacuacauucuguu

SEQ ID NO: 1639702 - RNA, 23 nt, Human
uaauacaccacuacauucuguua

SEQ ID NO: 1639703 - RNA, 18 nt, Human
uaauacuugcuuuggaaa

SEQ ID NO: 1639704 - RNA, 13 nt, Human
uaauaccucccuu

SEQ ID NO: 1639705 - RNA, 18 nt, Human
uacaaaaacacagcaagg

SEQ ID NO: 1639706 - RNA, 17 nt, Human
uacaaaaacacagcaag

SEQ ID NO: 1639707 - RNA, 16 nt, Human
uacaaaaacauggccu

SEQ ID NO: 1639708 - RNA, 15 nt, Human
uacaaaaagcauaaa

SEQ ID NO: 1639709 - RNA, 20 nt, Human
uacaagcgugagccacugca

SEQ ID NO: 1639710 - RNA, 19 nt, Human
uacaagcgugagccacugc

SEQ ID NO: 1639711 - RNA, 18 nt, Human
uacaagcgugagccacug

SEQ ID NO: 1639712 - RNA, 16 nt, Human
uacaagcgugagccac

SEQ ID NO: 1639713 - RNA, 21 nt, Human
uacaagcgugagccacugcac

SEQ ID NO: 1639714 - RNA, 20 nt, Human
uacaauaaaaucuugaaaau

SEQ ID NO: 1639715 - RNA, 21 nt, Human
uaauuuuuguauuuuuaguag

SEQ ID NO: 1639716 - RNA, 18 nt, Human
uaauuuaccugaagucuu

SEQ ID NO: 1639717 - RNA, 17 nt, Human
uaauuuaccugaagucu

SEQ ID NO: 1639718 - RNA, 13 nt, Human
uaauucauguugc

SEQ ID NO: 1639719 - RNA, 16 nt, Human
aaugcaaaccaucauu

SEQ ID NO: 1639720 - RNA, 15 nt, Human
aaugaccuuucaaua

SEQ ID NO: 1639721 - RNA, 14 nt, Human
aaugaccuuucaau

SEQ ID NO: 1639722 - RNA, 13 nt, Human
aaugaccuuucaa

SEQ ID NO: 1639723 - RNA, 21 nt, Human
aaugaaugucagugugacuga

SEQ ID NO: 1639724 - RNA, 20 nt, Human
aaugaaugucagugugacug

SEQ ID NO: 1639725 - RNA, 18 nt, Human
aaugcacaaacagaggcc

SEQ ID NO: 1639726 - RNA, 23 nt, Human
aaugcaaaccaucauugaaaucu

SEQ ID NO: 1639727 - RNA, 22 nt, Human
aaugcaaaccaucauugaaauc

SEQ ID NO: 1639728 - RNA, 16 nt, Human
aaugcacuuuguucug

SEQ ID NO: 1639729 - RNA, 13 nt, Human
aaugcacuuuguu

SEQ ID NO: 1639730 - RNA, 20 nt, Human
aaugcacaaacagaggccgc

SEQ ID NO: 1639731 - RNA, 19 nt, Human
aaugcacaaacagaggccg

SEQ ID NO: 1639732 - RNA, 20 nt, Human
aaugcacuuuguucuggcuc

SEQ ID NO: 1639733 - RNA, 19 nt, Human
aaugcacuuuguucuggcu

SEQ ID NO: 1639734 - RNA, 23 nt, Human
uaauuaguuccucauuagcauuu

SEQ ID NO: 1639735 - RNA, 20 nt, Human
uaauuauacccccugcaaag

SEQ ID NO: 1639736 - RNA, 17 nt, Human
uaauuauaucugaggaa

SEQ ID NO: 1639737 - RNA, 13 nt, Human
uaauuauaucuga

SEQ ID NO: 1639738 - RNA, 21 nt, Human
uaauuauaugcuauuucuaua

SEQ ID NO: 1639739 - RNA, 17 nt, Human
aauuuuuuugagacaga

SEQ ID NO: 1639740 - RNA, 13 nt, Human
acaaaaacauggc

SEQ ID NO: 1639741 - RNA, 19 nt, Human
aauuuuuucucuaggaaau

SEQ ID NO: 1639742 - RNA, 14 nt, Human
aauuuuuguauuuu

SEQ ID NO: 1639743 - RNA, 19 nt, Human
aauuuuuauauuugaaaua

SEQ ID NO: 1639744 - RNA, 18 nt, Human
aauuuuuauuaaauuaug

SEQ ID NO: 1639745 - RNA, 17 nt, Human
aauuuuuauuaaauuau

SEQ ID NO: 1639746 - RNA, 14 nt, Human
uagacagucccugc

SEQ ID NO: 1639747 - RNA, 12 nt, Human
uagacagucccu

SEQ ID NO: 1639748 - RNA, 15 nt, Human
uagaacucccuuuca

SEQ ID NO: 1639749 - RNA, 14 nt, Human
uagaaccucuuugu

SEQ ID NO: 1639750 - RNA, 16 nt, Human
uacuucaugcugucua

SEQ ID NO: 1639751 - RNA, 21 nt, Human
uacuucaaauccuugaagauu

SEQ ID NO: 1639752 - RNA, 15 nt, Human
uagaagucacacagu

SEQ ID NO: 1639753 - RNA, 16 nt, Human
uagacaauuuauuaug

SEQ ID NO: 1639754 - RNA, 19 nt, Human
uagaauuugauaugugaac

SEQ ID NO: 1639755 - RNA, 19 nt, Human
uagaagucuuagauguaua

SEQ ID NO: 1639756 - RNA, 18 nt, Human
uagaagucuuagauguau

SEQ ID NO: 1639757 - RNA, 20 nt, Human
uagaagucuuagauguauau

SEQ ID NO: 1639758 - RNA, 17 nt, Human
uagaagucuuagaugua

SEQ ID NO: 1639759 - RNA, 16 nt, Human
uagaagucuuagaugu

SEQ ID NO: 1639760 - RNA, 16 nt, Human
uagaagucacacagua

SEQ ID NO: 1639761 - RNA, 23 nt, Human
uagaagucacauuccugaacagg

SEQ ID NO: 1639762 - RNA, 19 nt, Human
uagaggagaaacuggaacu

SEQ ID NO: 1639763 - RNA, 21 nt, Human
uagaggaagccugauuaaaga

SEQ ID NO: 1639764 - RNA, 16 nt, Human
uagaugcaguucugaa

SEQ ID NO: 1639765 - RNA, 19 nt, Human
uagaugcaguucugaagaa

SEQ ID NO: 1639766 - RNA, 17 nt, Human
uagaugcaguucugaag

SEQ ID NO: 1639767 - RNA, 16 nt, Human
acaaaaagcauaaaaa

SEQ ID NO: 1639768 - RNA, 15 nt, Human
uagagcuucuggcac

SEQ ID NO: 1639769 - RNA, 21 nt, Human
uagcaugucgucaaagcugaa

SEQ ID NO: 1639770 - RNA, 16 nt, Human
uagcaccagggaaggg

SEQ ID NO: 1639771 - RNA, 14 nt, Human
uagcaccagggaag

SEQ ID NO: 1639772 - RNA, 13 nt, Human
uagcaccagggaa

SEQ ID NO: 1639773 - RNA, 19 nt, Human
uagcacagacccugcccug

SEQ ID NO: 1639774 - RNA, 18 nt, Human
uagcacagacccugcccu

SEQ ID NO: 1639775 - RNA, 17 nt, Human
uagcacagacccugccc

SEQ ID NO: 1639776 - RNA, 16 nt, Human
uagcacagacccugcc

SEQ ID NO: 1639777 - RNA, 22 nt, Human
uagauuuuagacccuauugcug

SEQ ID NO: 1639778 - RNA, 18 nt, Human
acaagcacuaaacaaaga

SEQ ID NO: 1639779 - RNA, 18 nt, Human
acaagagcccaggccucc

SEQ ID NO: 1639780 - RNA, 17 nt, Human
acaagagcccaggccuc

SEQ ID NO: 1639781 - RNA, 21 nt, Human
acaagcgugagccacugcacc

SEQ ID NO: 1639782 - RNA, 20 nt, Human
acaagcgugagccacugcac

SEQ ID NO: 1639783 - RNA, 13 nt, Human
acaagcugcaccc

SEQ ID NO: 1639784 - RNA, 12 nt, Human
acaagccacccc

SEQ ID NO: 1639785 - RNA, 12 nt, Human
acaacacucaca

SEQ ID NO: 1639786 - RNA, 15 nt, Human
acaacaacaaaauga

SEQ ID NO: 1639787 - RNA, 18 nt, Human
acaaauucugucucugga

SEQ ID NO: 1639788 - RNA, 15 nt, Human
acaacaaccugguca

SEQ ID NO: 1639789 - RNA, 19 nt, Human
uagcauuuguguugaagag

SEQ ID NO: 1639790 - RNA, 22 nt, Human
aauucuucuccacuuucuagcc

SEQ ID NO: 1639791 - RNA, 21 nt, Human
aauucuugccaaauauaaaua

SEQ ID NO: 1639792 - RNA, 14 nt, Human
aauucuugcaaagu

SEQ ID NO: 1639793 - RNA, 20 nt, Human
aauucuugcaaaguaucccu

SEQ ID NO: 1639794 - RNA, 19 nt, Human
aauugacccacaagaaaug

SEQ ID NO: 1639795 - RNA, 16 nt, Human
aauugacccacaagaa

SEQ ID NO: 1639796 - RNA, 15 nt, Human
uacguacacauuuua

SEQ ID NO: 1639797 - RNA, 14 nt, Human
aauucuuucauuuu

SEQ ID NO: 1639798 - RNA, 14 nt, Human
uacgucugacaggc

SEQ ID NO: 1639799 - RNA, 14 nt, Human
uacguuaccaggca

SEQ ID NO: 1639800 - RNA, 13 nt, Human
uacguugugcauu

SEQ ID NO: 1639801 - RNA, 14 nt, Human
uacguugugcauuu

SEQ ID NO: 1639802 - RNA, 16 nt, Human
uacuauguaucaauga

SEQ ID NO: 1639803 - RNA, 16 nt, Human
uacuauaauuuaccug

SEQ ID NO: 1639804 - RNA, 22 nt, Human
uacucuuauaucuauauuuuac

SEQ ID NO: 1639805 - RNA, 22 nt, Human
uacucuucaguuaagccuuugg

SEQ ID NO: 1639806 - RNA, 20 nt, Human
uacucuuauaucuauauuuu

SEQ ID NO: 1639807 - RNA, 18 nt, Human
uacucuuauagacaacau

SEQ ID NO: 1639808 - RNA, 14 nt, Human
uacucaauuuuaac

SEQ ID NO: 1639809 - RNA, 13 nt, Human
uacucaauuuuaa

SEQ ID NO: 1639810 - RNA, 12 nt, Human
uacucaauuuua

SEQ ID NO: 1639811 - RNA, 20 nt, Human
aauuucucccagucauuuaa

SEQ ID NO: 1639812 - RNA, 13 nt, Human
aauuucuaaaucu

SEQ ID NO: 1639813 - RNA, 21 nt, Human
aauuucuaaaucuccaaaaua

SEQ ID NO: 1639814 - RNA, 15 nt, Human
aauuuaccugaaguc

SEQ ID NO: 1639815 - RNA, 17 nt, Human
aauuuagaaauauaauu

SEQ ID NO: 1639816 - RNA, 19 nt, Human
uacuucaaauccuugaaga

SEQ ID NO: 1639817 - RNA, 14 nt, Human
uacuucaaauccuu

SEQ ID NO: 1639818 - RNA, 19 nt, Human
aauuugauaugugaacagu

SEQ ID NO: 1639819 - RNA, 18 nt, Human
aauuugauaugugaacag

SEQ ID NO: 1639820 - RNA, 16 nt, Human
aauuugauaugugaac

SEQ ID NO: 1639821 - RNA, 15 nt, Human
aauuugauaugugaa

SEQ ID NO: 1639822 - RNA, 18 nt, Human
aauuugaauuuuguguua

SEQ ID NO: 1639823 - RNA, 16 nt, Human
aauuugaauuuugugu

SEQ ID NO: 1639824 - RNA, 13 nt, Human
aauuugaauuuug

SEQ ID NO: 1639825 - RNA, 20 nt, Human
aauuugaaacacuuugcaua

SEQ ID NO: 1639826 - RNA, 13 nt, Human
uacuguaagaaaa

SEQ ID NO: 1639827 - RNA, 12 nt, Human
aauugcuccuug

SEQ ID NO: 1639828 - RNA, 23 nt, Human
aauugugugaaagguacuucaaa

SEQ ID NO: 1639829 - RNA, 22 nt, Human
aauuguuuggggaugagaaagg

SEQ ID NO: 1639830 - RNA, 20 nt, Human
aauuguguuuauaauuuuaa

SEQ ID NO: 1639831 - RNA, 19 nt, Human
aauuuacauacucugcuua

SEQ ID NO: 1639832 - RNA, 16 nt, Human
aauuuaaauagcuuuu

SEQ ID NO: 1639833 - RNA, 15 nt, Human
aauuuaaauagcuuu

SEQ ID NO: 1639834 - RNA, 13 nt, Human
aauuuaaaagucu

SEQ ID NO: 1639835 - RNA, 22 nt, Human
uauucaggaagcucagggccug

SEQ ID NO: 1639836 - RNA, 18 nt, Human
uauucaggaagcucaggg

SEQ ID NO: 1639837 - RNA, 23 nt, Human
uauucauagcagcuuauucacaa

SEQ ID NO: 1639838 - RNA, 15 nt, Human
uauucagcucaugga

SEQ ID NO: 1639839 - RNA, 22 nt, Human
uauucacugauuugacauaguc

SEQ ID NO: 1639840 - RNA, 19 nt, Human
uauucacugauuugacaua

SEQ ID NO: 1639841 - RNA, 13 nt, Human
uauucacugauuu

SEQ ID NO: 1639842 - RNA, 23 nt, Human
uauucaaaguugccuaaauccau

SEQ ID NO: 1639843 - RNA, 22 nt, Human
uauucaaaguugccuaaaucca

SEQ ID NO: 1639844 - RNA, 21 nt, Human
uauucaaaguugccuaaaucc

SEQ ID NO: 1639845 - RNA, 18 nt, Human
uauucaaaguugccuaaa

SEQ ID NO: 1639846 - RNA, 12 nt, Human
uauuagagaaga

SEQ ID NO: 1639847 - RNA, 16 nt, Human
uauuaccacagacaua

SEQ ID NO: 1639848 - RNA, 16 nt, Human
uauuaaaacucauuuu

SEQ ID NO: 1639849 - RNA, 12 nt, Human
uauuaaaacuca

SEQ ID NO: 1639850 - RNA, 23 nt, Human
uauuaaaaaucucaaauuucuaa

SEQ ID NO: 1639851 - RNA, 12 nt, Human
uauuaaagccau

SEQ ID NO: 1639852 - RNA, 14 nt, Human
uauuaaagccaugu

SEQ ID NO: 1639853 - RNA, 13 nt, Human
uauuaaagccaug

SEQ ID NO: 1639854 - RNA, 23 nt, Human
uauuacaguggggaaugaagaua

SEQ ID NO: 1639855 - RNA, 21 nt, Human
uauuacaguauaauuaacaug

SEQ ID NO: 1639856 - RNA, 20 nt, Human
uauuacaguauaauuaacau

SEQ ID NO: 1639857 - RNA, 18 nt, Human
uauuacaguauaauuaac

SEQ ID NO: 1639858 - RNA, 16 nt, Human
uauuacaguauaauua

SEQ ID NO: 1639859 - RNA, 20 nt, Human
uauuaaagccauguuuauua

SEQ ID NO: 1639860 - RNA, 18 nt, Human
uauuaaagccauguuuau

SEQ ID NO: 1639861 - RNA, 17 nt, Human
uauuaaagccauguuua

SEQ ID NO: 1639862 - RNA, 21 nt, Human
uauguuuucaggcuagaugua

SEQ ID NO: 1639863 - RNA, 19 nt, Human
uauguuuuaagaggcaggg

SEQ ID NO: 1639864 - RNA, 17 nt, Human
uauguuuuaagaggcag

SEQ ID NO: 1639865 - RNA, 16 nt, Human
uauuaaaaaucucaaa

SEQ ID NO: 1639866 - RNA, 18 nt, Human
uauuaaaaaucucaaauu

SEQ ID NO: 1639867 - RNA, 20 nt, Human
uauuaaaaaucucaaauuuc

SEQ ID NO: 1639868 - RNA, 22 nt, Human
uauuaaaaaucucaaauuucua

SEQ ID NO: 1639869 - RNA, 20 nt, Human
acagcuggugcccugcuuuc

SEQ ID NO: 1639870 - RNA, 17 nt, Human
acagcuggugcccugcu

SEQ ID NO: 1639871 - RNA, 21 nt, Human
acaguauggcagcuuuccuca

SEQ ID NO: 1639872 - RNA, 23 nt, Human
acaguauaauuaacauguuaaac

SEQ ID NO: 1639873 - RNA, 21 nt, Human
acaguauaauuaacauguuaa

SEQ ID NO: 1639874 - RNA, 22 nt, Human
acagggcacaccgggcacucag

SEQ ID NO: 1639875 - RNA, 22 nt, Human
acagguuuuccugaagaauuga

SEQ ID NO: 1639876 - RNA, 17 nt, Human
acaggcugggcuucagu

SEQ ID NO: 1639877 - RNA, 14 nt, Human
acaggcugggcuuc

SEQ ID NO: 1639878 - RNA, 21 nt, Human
acaggcugggcuucaguggca

SEQ ID NO: 1639879 - RNA, 19 nt, Human
acaguauuacuucugcuac

SEQ ID NO: 1639880 - RNA, 17 nt, Human
acaguauuacuucugcu

SEQ ID NO: 1639881 - RNA, 16 nt, Human
acaguauuacuucugc

SEQ ID NO: 1639882 - RNA, 15 nt, Human
acaguauuacuucug

SEQ ID NO: 1639883 - RNA, 13 nt, Human
acagucccugcca

SEQ ID NO: 1639884 - RNA, 15 nt, Human
acaguccucccaucu

SEQ ID NO: 1639885 - RNA, 14 nt, Human
acaguccucccauc

SEQ ID NO: 1639886 - RNA, 13 nt, Human
acaguccucccau

SEQ ID NO: 1639887 - RNA, 15 nt, Human
acagucccugccaau

SEQ ID NO: 1639888 - RNA, 20 nt, Human
acaguccuuaccagcagagc

SEQ ID NO: 1639889 - RNA, 18 nt, Human
acaguccuuaccagcaga

SEQ ID NO: 1639890 - RNA, 17 nt, Human
acaguccucccaucuca

SEQ ID NO: 1639891 - RNA, 16 nt, Human
acagucucaggaaauc

SEQ ID NO: 1639892 - RNA, 15 nt, Human
acagucucaggaaau

SEQ ID NO: 1639893 - RNA, 14 nt, Human
acagucucaggaaa

SEQ ID NO: 1639894 - RNA, 13 nt, Human
acagucucaggaa

SEQ ID NO: 1639895 - RNA, 22 nt, Human
acaguccuuaccagcagagcac

SEQ ID NO: 1639896 - RNA, 21 nt, Human
acaguccuuaccagcagagca

SEQ ID NO: 1639897 - RNA, 17 nt, Human
acagucucaggaaauca

SEQ ID NO: 1639898 - RNA, 20 nt, Human
acagugaaagaaaauaacaa

SEQ ID NO: 1639899 - RNA, 18 nt, Human
acagugagacucugucuc

SEQ ID NO: 1639900 - RNA, 14 nt, Human
acagugagacucug

SEQ ID NO: 1639901 - RNA, 21 nt, Human
acaguuaccucugccucagaa

SEQ ID NO: 1639902 - RNA, 15 nt, Human
acaguuaagagaaau

SEQ ID NO: 1639903 - RNA, 23 nt, Human
uauuuaauuuuuuugagacagag

SEQ ID NO: 1639904 - RNA, 14 nt, Human
uauuuaauucaugu

SEQ ID NO: 1639905 - RNA, 18 nt, Human
uauuuacuucuuauacau

SEQ ID NO: 1639906 - RNA, 20 nt, Human
uauuuagcaccagggaaggg

SEQ ID NO: 1639907 - RNA, 18 nt, Human
uauuuacuaaaauggacu

SEQ ID NO: 1639908 - RNA, 18 nt, Human
uauuuauuuuaauaaugu

SEQ ID NO: 1639909 - RNA, 16 nt, Human
uauuuauuuuaauaau

SEQ ID NO: 1639910 - RNA, 14 nt, Human
uauuuauuuuaaua

SEQ ID NO: 1639911 - RNA, 14 nt, Human
uauuuauuuaaauu

SEQ ID NO: 1639912 - RNA, 14 nt, Human
uauuuauuuaguau

SEQ ID NO: 1639913 - RNA, 13 nt, Human
uauuuauuuaaau

SEQ ID NO: 1639914 - RNA, 19 nt, Human
uauuuaguguucauaaaua

SEQ ID NO: 1639915 - RNA, 17 nt, Human
uauugucuagugaaacu

SEQ ID NO: 1639916 - RNA, 18 nt, Human
uauuuaaccucuaaauuc

SEQ ID NO: 1639917 - RNA, 17 nt, Human
uauuuaaccucuaaauu

SEQ ID NO: 1639918 - RNA, 21 nt, Human
uauuuaaugaaagacuguaca

SEQ ID NO: 1639919 - RNA, 15 nt, Human
uauuuaaugaaagac

SEQ ID NO: 1639920 - RNA, 14 nt, Human
uauuuaauagguuu

SEQ ID NO: 1639921 - RNA, 17 nt, Human
uauugucaaagugguga

SEQ ID NO: 1639922 - RNA, 13 nt, Human
uauugucaaagug

SEQ ID NO: 1639923 - RNA, 21 nt, Human
uauuguagcauccuggaauau

SEQ ID NO: 1639924 - RNA, 20 nt, Human
uauuguagcauccuggaaua

SEQ ID NO: 1639925 - RNA, 18 nt, Human
uauuguagcauccuggaa

SEQ ID NO: 1639926 - RNA, 17 nt, Human
uauuguagcauccugga

SEQ ID NO: 1639927 - RNA, 23 nt, Human
uauuguacaaaguauuaagcaua

SEQ ID NO: 1639928 - RNA, 22 nt, Human
uauuguacaaaguauuaagcau

SEQ ID NO: 1639929 - RNA, 21 nt, Human
uauuguacaaaguauuaagca

SEQ ID NO: 1639930 - RNA, 16 nt, Human
uauuguacaaaguauu

SEQ ID NO: 1639931 - RNA, 15 nt, Human
uauuguacaaaguau

SEQ ID NO: 1639932 - RNA, 23 nt, Human
acaguucggugagcuacaaaugc

SEQ ID NO: 1639933 - RNA, 16 nt, Human
acaguucucuccuucu

SEQ ID NO: 1639934 - RNA, 19 nt, Human
acaguucggugagcuacaa

SEQ ID NO: 1639935 - RNA, 22 nt, Human
acaguucggugagcuacaaaug

SEQ ID NO: 1639936 - RNA, 13 nt, Human
acaguuacucaga

SEQ ID NO: 1639937 - RNA, 20 nt, Human
acaguuacucagaauucucu

SEQ ID NO: 1639938 - RNA, 20 nt, Human
acaguucaauucucauuugu

SEQ ID NO: 1639939 - RNA, 16 nt, Human
uauucuguuggccagu

SEQ ID NO: 1639940 - RNA, 15 nt, Human
uauucuuauuuaaug

SEQ ID NO: 1639941 - RNA, 20 nt, Human
uauucucuccuguaccucuu

SEQ ID NO: 1639942 - RNA, 24 nt, Human
uauucucuccuguaccucuugagc

SEQ ID NO: 1639943 - RNA, 17 nt, Human
acaguucucuccuucuu

SEQ ID NO: 1639944 - RNA, 22 nt, Human
uauuggcuuuucugauccaguu

SEQ ID NO: 1639945 - RNA, 21 nt, Human
uauuggcuuuucugauccagu

SEQ ID NO: 1639946 - RNA, 14 nt, Human
uauuggcuuuucug

SEQ ID NO: 1639947 - RNA, 18 nt, Human
uauuggcuuuucugaucc

SEQ ID NO: 1639948 - RNA, 17 nt, Human
uauuggcuuuucugauc

SEQ ID NO: 1639949 - RNA, 16 nt, Human
uauuggcuuuucugau

SEQ ID NO: 1639950 - RNA, 15 nt, Human
uauuggcuuuucuga

SEQ ID NO: 1639951 - RNA, 23 nt, Human
acacucauugaccugaggcccuu

SEQ ID NO: 1639952 - RNA, 21 nt, Human
acacucauugaccugaggccc

SEQ ID NO: 1639953 - RNA, 23 nt, Human
uauauauuuuuuucugaaauuuc

SEQ ID NO: 1639954 - RNA, 20 nt, Human
uauauauuuuuuucugaaau

SEQ ID NO: 1639955 - RNA, 22 nt, Human
uauauauuuuuuucugaaauuu

SEQ ID NO: 1639956 - RNA, 21 nt, Human
uauauauuuuuuucugaaauu

SEQ ID NO: 1639957 - RNA, 13 nt, Human
uauauaucaaaua

SEQ ID NO: 1639958 - RNA, 19 nt, Human
uauaggaauugacccacaa

SEQ ID NO: 1639959 - RNA, 14 nt, Human
uauaggaauugacc

SEQ ID NO: 1639960 - RNA, 13 nt, Human
uauaggaauugac

SEQ ID NO: 1639961 - RNA, 20 nt, Human
uauagccuaggugacagagu

SEQ ID NO: 1639962 - RNA, 20 nt, Human
uauaggugcuacaaaaacac

SEQ ID NO: 1639963 - RNA, 21 nt, Human
uauaggugcuacaaaaacaca

SEQ ID NO: 1639964 - RNA, 23 nt, Human
uauaggugcuacaaaaacacagc

SEQ ID NO: 1639965 - RNA, 19 nt, Human
uauaauuuugugaagcaaa

SEQ ID NO: 1639966 - RNA, 21 nt, Human
uauacacuuacacuuuaugca

SEQ ID NO: 1639967 - RNA, 13 nt, Human
uauacauaaacaa

SEQ ID NO: 1639968 - RNA, 14 nt, Human
uauacauaaacaag

SEQ ID NO: 1639969 - RNA, 14 nt, Human
uauacauuugauaa

SEQ ID NO: 1639970 - RNA, 20 nt, Human
uauagauuagaauucuguau

SEQ ID NO: 1639971 - RNA, 22 nt, Human
uauagauuagagaguguugaaa

SEQ ID NO: 1639972 - RNA, 19 nt, Human
uauagauuagagaguguug

SEQ ID NO: 1639973 - RNA, 14 nt, Human
uauaauuuugugaa

SEQ ID NO: 1639974 - RNA, 20 nt, Human
uauaaccaguguuguggauu

SEQ ID NO: 1639975 - RNA, 23 nt, Human
uauaaaauaauuuuuauauuuga

SEQ ID NO: 1639976 - RNA, 22 nt, Human
acacaucagcuugcccuguuaa

SEQ ID NO: 1639977 - RNA, 19 nt, Human
uauaaaagccuguuuaaga

SEQ ID NO: 1639978 - RNA, 19 nt, Human
acacaugcaaggucauuuu

SEQ ID NO: 1639979 - RNA, 20 nt, Human
acacaugcaaggucauuuuu

SEQ ID NO: 1639980 - RNA, 22 nt, Human
uauaaaauaauuuuuauauuug

SEQ ID NO: 1639981 - RNA, 21 nt, Human
uauaaaauaauuuuuauauuu

SEQ ID NO: 1639982 - RNA, 17 nt, Human
uauaaaagccuguuuaa

SEQ ID NO: 1639983 - RNA, 14 nt, Human
uauaaaagccuguu

SEQ ID NO: 1639984 - RNA, 12 nt, Human
uauaaaagccug

SEQ ID NO: 1639985 - RNA, 21 nt, Human
acacaugcaaggucauuuuuu

SEQ ID NO: 1639986 - RNA, 21 nt, Human
acacccagcccacuucugcca

SEQ ID NO: 1639987 - RNA, 20 nt, Human
acacccagcccacuucugcc

SEQ ID NO: 1639988 - RNA, 19 nt, Human
acacccagcccacuucugc

SEQ ID NO: 1639989 - RNA, 18 nt, Human
acacccugugauggggcc

SEQ ID NO: 1639990 - RNA, 12 nt, Human
acacccugugau

SEQ ID NO: 1639991 - RNA, 11 nt, Human
acacccuguga

SEQ ID NO: 1639992 - RNA, 19 nt, Human
acacccugugauggggccc

SEQ ID NO: 1639993 - RNA, 22 nt, Human
uagugagcagucaggaaagaga

SEQ ID NO: 1639994 - RNA, 23 nt, Human
acaagcugcacccucaggcaggu

SEQ ID NO: 1639995 - RNA, 22 nt, Human
acaagcugcacccucaggcagg

SEQ ID NO: 1639996 - RNA, 21 nt, Human
acaagcugcacccucaggcag

SEQ ID NO: 1639997 - RNA, 19 nt, Human
acaagcugcacccucaggc

SEQ ID NO: 1639998 - RNA, 21 nt, Human
uagucaggugccucaagagaa

SEQ ID NO: 1639999 - RNA, 16 nt, Human
uaguuuuauaugcuuc

SEQ ID NO: 1640000 - RNA, 20 nt, Human
uaguuccucauuagcauuuu

SEQ ID NO: 1640001 - RNA, 13 nt, Human
uagugaugguucc

SEQ ID NO: 1640002 - RNA, 19 nt, Human
uaucuagauacuguaucau

SEQ ID NO: 1640003 - RNA, 17 nt, Human
uaucucccccagcccca

SEQ ID NO: 1640004 - RNA, 18 nt, Human
uaucucccccagccccau

SEQ ID NO: 1640005 - RNA, 10 nt, Human
uaucagaauu

SEQ ID NO: 1640006 - RNA, 15 nt, Human
uaucuagauacugua

SEQ ID NO: 1640007 - RNA, 16 nt, Human
uaucuagauacuguau

SEQ ID NO: 1640008 - RNA, 16 nt, Human
acagagcuacacaggg

SEQ ID NO: 1640009 - RNA, 18 nt, Human
acagagcuacacagggga

SEQ ID NO: 1640010 - RNA, 21 nt, Human
acagagugagacucugucuca

SEQ ID NO: 1640011 - RNA, 14 nt, Human
acagacuucugaaa

SEQ ID NO: 1640012 - RNA, 13 nt, Human
acagacuucugaa

SEQ ID NO: 1640013 - RNA, 15 nt, Human
uauauuuacaaaugg

SEQ ID NO: 1640014 - RNA, 21 nt, Human
uaucaaguauuauaccuuuuu

SEQ ID NO: 1640015 - RNA, 19 nt, Human
uauauuuacuaaaauggac

SEQ ID NO: 1640016 - RNA, 14 nt, Human
uauauuuacaaaug

SEQ ID NO: 1640017 - RNA, 18 nt, Human
uaucacccagaagaaaau

SEQ ID NO: 1640018 - RNA, 20 nt, Human
uaucaccugucuugccuuuu

SEQ ID NO: 1640019 - RNA, 23 nt, Human
acagacacaggcccggcuccagg

SEQ ID NO: 1640020 - RNA, 13 nt, Human
acacuccuucaca

SEQ ID NO: 1640021 - RNA, 11 nt, Human
acacuccuuca

SEQ ID NO: 1640022 - RNA, 16 nt, Human
acagacccugcccugu

SEQ ID NO: 1640023 - RNA, 17 nt, Human
acagacccugcccugug

SEQ ID NO: 1640024 - RNA, 15 nt, Human
acagacagcccucca

SEQ ID NO: 1640025 - RNA, 13 nt, Human
acagacagcccuc

SEQ ID NO: 1640026 - RNA, 20 nt, Human
acagacccugcccugugggc

SEQ ID NO: 1640027 - RNA, 18 nt, Human
acagacccugcccugugg

SEQ ID NO: 1640028 - RNA, 14 nt, Human
acagacuggaagca

SEQ ID NO: 1640029 - RNA, 17 nt, Human
acagacuggaagcacag

SEQ ID NO: 1640030 - RNA, 16 nt, Human
uauauugauccagaaa

SEQ ID NO: 1640031 - RNA, 15 nt, Human
uaucuugaagacuuu

SEQ ID NO: 1640032 - RNA, 15 nt, Human
uaucuugaauaaugu

SEQ ID NO: 1640033 - RNA, 13 nt, Human
uaugaggcauuug

SEQ ID NO: 1640034 - RNA, 23 nt, Human
uaugaucacggcucacugcagcc

SEQ ID NO: 1640035 - RNA, 21 nt, Human
uaugaucacggcucacugcag

SEQ ID NO: 1640036 - RNA, 10 nt, Human
uaugauccag

SEQ ID NO: 1640037 - RNA, 19 nt, Human
uaugauccagcagauuauu

SEQ ID NO: 1640038 - RNA, 11 nt, Human
uaugauccagc

SEQ ID NO: 1640039 - RNA, 18 nt, Human
acagaguuuucacucuua

SEQ ID NO: 1640040 - RNA, 15 nt, Human
acagaguuguuacau

SEQ ID NO: 1640041 - RNA, 20 nt, Human
acagaguuuucacucuuauu

SEQ ID NO: 1640042 - RNA, 18 nt, Human
acagcagccccugcacaa

SEQ ID NO: 1640043 - RNA, 16 nt, Human
uauggcuauaggugcu

SEQ ID NO: 1640044 - RNA, 14 nt, Human
uauggccuguggau

SEQ ID NO: 1640045 - RNA, 22 nt, Human
uauggccugugagcuaggaauu

SEQ ID NO: 1640046 - RNA, 15 nt, Human
uaugcugaguuugug

SEQ ID NO: 1640047 - RNA, 19 nt, Human
uaugcucugcauguuacau

SEQ ID NO: 1640048 - RNA, 18 nt, Human
uaugcucugcauguuaca

SEQ ID NO: 1640049 - RNA, 22 nt, Human
uaugauccagcagauuauucac

SEQ ID NO: 1640050 - RNA, 21 nt, Human
uaugauccagcagauuauuca

SEQ ID NO: 1640051 - RNA, 20 nt, Human
uaugauccagcagauuauuc

SEQ ID NO: 1640052 - RNA, 17 nt, Human
uauggcuauaggugcua

SEQ ID NO: 1640053 - RNA, 16 nt, Human
uauggcuuuugugcau

SEQ ID NO: 1640054 - RNA, 15 nt, Human
acagccuggcacagg

SEQ ID NO: 1640055 - RNA, 14 nt, Human
acagccuggcacag

SEQ ID NO: 1640056 - RNA, 15 nt, Human
acagcuaacauggaa

SEQ ID NO: 1640057 - RNA, 14 nt, Human
acagcuaacaugga

SEQ ID NO: 1640058 - RNA, 23 nt, Human
acagccugugucuuuaaaugcug

SEQ ID NO: 1640059 - RNA, 18 nt, Human
acagccugugucuuuaaa

SEQ ID NO: 1640060 - RNA, 14 nt, Human
acagccugugucuu

SEQ ID NO: 1640061 - RNA, 17 nt, Human
acagcuaacauggaagu

SEQ ID NO: 1640062 - RNA, 22 nt, Human
acagcuaaucagcauucucacu

SEQ ID NO: 1640063 - RNA, 20 nt, Human
acagcuaaucagcauucuca

SEQ ID NO: 1640064 - RNA, 15 nt, Human
acagcuccaagaauu

SEQ ID NO: 1640065 - RNA, 12 nt, Human
uccccuccucug

SEQ ID NO: 1640066 - RNA, 16 nt, Human
ucccgaauagcuggga

SEQ ID NO: 1640067 - RNA, 15 nt, Human
ucccgaauagcuggg

SEQ ID NO: 1640068 - RNA, 18 nt, Human
ucccgaauagcugggacu

SEQ ID NO: 1640069 - RNA, 20 nt, Human
ucccgcucagcccucccugc

SEQ ID NO: 1640070 - RNA, 16 nt, Human
ucccgcucagcccucc

SEQ ID NO: 1640071 - RNA, 15 nt, Human
ucccgcucagcccuc

SEQ ID NO: 1640072 - RNA, 14 nt, Human
ucccgcucagcccu

SEQ ID NO: 1640073 - RNA, 13 nt, Human
ucccgcucagccc

SEQ ID NO: 1640074 - RNA, 18 nt, Human
ucccuauuagagaagaga

SEQ ID NO: 1640075 - RNA, 18 nt, Human
acuauguugcccaggcag

SEQ ID NO: 1640076 - RNA, 22 nt, Human
acuaugaaguuuuuuuuauaca

SEQ ID NO: 1640077 - RNA, 18 nt, Human
acuaucccggcugcccuu

SEQ ID NO: 1640078 - RNA, 17 nt, Human
acuaucccggcugcccu

SEQ ID NO: 1640079 - RNA, 16 nt, Human
acuaucccggcugccc

SEQ ID NO: 1640080 - RNA, 22 nt, Human
acuaucaugucaaacgugaaaa

SEQ ID NO: 1640081 - RNA, 23 nt, Human
acuauguugcccaggcaggucuu

SEQ ID NO: 1640082 - RNA, 20 nt, Human
acuauguugcccaggcaggu

SEQ ID NO: 1640083 - RNA, 19 nt, Human
acuauguugcccaggcagg

SEQ ID NO: 1640084 - RNA, 18 nt, Human
acuauagccuaggugaca

SEQ ID NO: 1640085 - RNA, 17 nt, Human
acuauagccuaggugac

SEQ ID NO: 1640086 - RNA, 23 nt, Human
acuauaauuuaccugaagucuuu

SEQ ID NO: 1640087 - RNA, 24 nt, Human
uccccaccgcagacaggaccaggg

SEQ ID NO: 1640088 - RNA, 22 nt, Human
ucccagugccgagaaggaagcc

SEQ ID NO: 1640089 - RNA, 19 nt, Human
ucccagugccgagaaggaa

SEQ ID NO: 1640090 - RNA, 16 nt, Human
acuacaguccucccau

SEQ ID NO: 1640091 - RNA, 17 nt, Human
acuacaguccucccauc

SEQ ID NO: 1640092 - RNA, 19 nt, Human
ucccaucucacacaugagc

SEQ ID NO: 1640093 - RNA, 14 nt, Human
ucccaucucacaca

SEQ ID NO: 1640094 - RNA, 13 nt, Human
ucccaucucacac

SEQ ID NO: 1640095 - RNA, 16 nt, Human
ucccauaugccugggc

SEQ ID NO: 1640096 - RNA, 15 nt, Human
ucccauaugccuggg

SEQ ID NO: 1640097 - RNA, 15 nt, Human
uccccaagccuggca

SEQ ID NO: 1640098 - RNA, 13 nt, Human
acuaaaaauacaa

SEQ ID NO: 1640099 - RNA, 15 nt, Human
acguuucuaaaggcu

SEQ ID NO: 1640100 - RNA, 14 nt, Human
acguuucuaaaggc

SEQ ID NO: 1640101 - RNA, 12 nt, Human
acguuucuaaag

SEQ ID NO: 1640102 - RNA, 14 nt, Human
uccagcucaccagc

SEQ ID NO: 1640103 - RNA, 15 nt, Human
uccagcucaccagcc

SEQ ID NO: 1640104 - RNA, 24 nt, Human
uccagccugggugacagagcaagu

SEQ ID NO: 1640105 - RNA, 13 nt, Human
uccagccugggug

SEQ ID NO: 1640106 - RNA, 15 nt, Human
acuacaguccuccca

SEQ ID NO: 1640107 - RNA, 17 nt, Human
acuaaccagcagaaaug

SEQ ID NO: 1640108 - RNA, 23 nt, Human
acuacaggugugagucaccaagc

SEQ ID NO: 1640109 - RNA, 13 nt, Human
acuaaccacgcug

SEQ ID NO: 1640110 - RNA, 16 nt, Human
acuaaccagcagaaau

SEQ ID NO: 1640111 - RNA, 20 nt, Human
acucauuuuaaaaaauggaa

SEQ ID NO: 1640112 - RNA, 20 nt, Human
acuccagcuggguuggaaaa

SEQ ID NO: 1640113 - RNA, 19 nt, Human
acuccagugagacagcucu

SEQ ID NO: 1640114 - RNA, 14 nt, Human
acuccuaccuggua

SEQ ID NO: 1640115 - RNA, 21 nt, Human
ucccucagucuggcccuuccu

SEQ ID NO: 1640116 - RNA, 22 nt, Human
ucccucauccucauacccaccc

SEQ ID NO: 1640117 - RNA, 18 nt, Human
acucaucuagguaaauua

SEQ ID NO: 1640118 - RNA, 16 nt, Human
acucaucuagguaaau

SEQ ID NO: 1640119 - RNA, 23 nt, Human
ucccucauuccaccuucccaugc

SEQ ID NO: 1640120 - RNA, 21 nt, Human
acucaucuagguaaauuacag

SEQ ID NO: 1640121 - RNA, 23 nt, Human
ucccuuugacgccaucccagccc

SEQ ID NO: 1640122 - RNA, 22 nt, Human
ucccuuugacgccaucccagcc

SEQ ID NO: 1640123 - RNA, 18 nt, Human
ucccuuuuaauccuggcu

SEQ ID NO: 1640124 - RNA, 19 nt, Human
ucccuuuuaauccuggcug

SEQ ID NO: 1640125 - RNA, 16 nt, Human
uccgugcuaaggacuu

SEQ ID NO: 1640126 - RNA, 15 nt, Human
uccgugcuaaggacu

SEQ ID NO: 1640127 - RNA, 14 nt, Human
uccgugcuaaggac

SEQ ID NO: 1640128 - RNA, 14 nt, Human
uccuaggcauuugc

SEQ ID NO: 1640129 - RNA, 20 nt, Human
uccuagcacuuugggaggcc

SEQ ID NO: 1640130 - RNA, 22 nt, Human
ucccuuacgugaguccuggcau

SEQ ID NO: 1640131 - RNA, 18 nt, Human
ucccuuacgugaguccug

SEQ ID NO: 1640132 - RNA, 22 nt, Human
ucccuucaaccauuccccaugg

SEQ ID NO: 1640133 - RNA, 21 nt, Human
ucccuucaaccauuccccaug

SEQ ID NO: 1640134 - RNA, 11 nt, Human
ucccuucaacc

SEQ ID NO: 1640135 - RNA, 22 nt, Human
ucccuuuccaaaugcccagcuu

SEQ ID NO: 1640136 - RNA, 12 nt, Human
acuccugcaggc

SEQ ID NO: 1640137 - RNA, 23 nt, Human
acuccugcacacgcuccuuccuc

SEQ ID NO: 1640138 - RNA, 19 nt, Human
uccucccucccucuuuccc

SEQ ID NO: 1640139 - RNA, 15 nt, Human
uccucccucccucuu

SEQ ID NO: 1640140 - RNA, 17 nt, Human
uccucccucccucuuuc

SEQ ID NO: 1640141 - RNA, 12 nt, Human
uccucuccccag

SEQ ID NO: 1640142 - RNA, 16 nt, Human
uccucuccacugccuu

SEQ ID NO: 1640143 - RNA, 15 nt, Human
uccucuccacugccu

SEQ ID NO: 1640144 - RNA, 14 nt, Human
uccucuccacugcc

SEQ ID NO: 1640145 - RNA, 13 nt, Human
uccucuccacugc

SEQ ID NO: 1640146 - RNA, 12 nt, Human
uccucuccacug

SEQ ID NO: 1640147 - RNA, 18 nt, Human
uccucauacccaccccca

SEQ ID NO: 1640148 - RNA, 14 nt, Human
uccucauacccacc

SEQ ID NO: 1640149 - RNA, 22 nt, Human
uccucauacccacccccaccca

SEQ ID NO: 1640150 - RNA, 16 nt, Human
uccuccccuccuccug

SEQ ID NO: 1640151 - RNA, 20 nt, Human
uccuccccuccuccuggacu

SEQ ID NO: 1640152 - RNA, 18 nt, Human
uccuccccuccuccugga

SEQ ID NO: 1640153 - RNA, 22 nt, Human
uccuccccuccuccuggacucc

SEQ ID NO: 1640154 - RNA, 19 nt, Human
acucuuauugcccacgcug

SEQ ID NO: 1640155 - RNA, 16 nt, Human
acucuuauugcccacg

SEQ ID NO: 1640156 - RNA, 20 nt, Human
uccucagaucuucugugggu

SEQ ID NO: 1640157 - RNA, 17 nt, Human
acucuccucugcugcug

SEQ ID NO: 1640158 - RNA, 22 nt, Human
acucuccauuuaauaauuauau

SEQ ID NO: 1640159 - RNA, 23 nt, Human
acucgcgacaaugcaaaccauca

SEQ ID NO: 1640160 - RNA, 20 nt, Human
acucgcgacaaugcaaacca

SEQ ID NO: 1640161 - RNA, 19 nt, Human
uccuaggcauuugcugaau

SEQ ID NO: 1640162 - RNA, 18 nt, Human
acucgcgacaaugcaaac

SEQ ID NO: 1640163 - RNA, 19 nt, Human
acucuccucugcugcuggc

SEQ ID NO: 1640164 - RNA, 18 nt, Human
acucuccucugcugcugg

SEQ ID NO: 1640165 - RNA, 21 nt, Human
acucuccucugcugcuggcug

SEQ ID NO: 1640166 - RNA, 13 nt, Human
acucugacaacag

SEQ ID NO: 1640167 - RNA, 23 nt, Human
acucuuauaucuauauuuuacau

SEQ ID NO: 1640168 - RNA, 15 nt, Human
ucgaacuggcugcaa

SEQ ID NO: 1640169 - RNA, 14 nt, Human
ucgaacuggcugca

SEQ ID NO: 1640170 - RNA, 15 nt, Human
uccuuucaccacaug

SEQ ID NO: 1640171 - RNA, 20 nt, Human
uccuuucacaaccuucugug

SEQ ID NO: 1640172 - RNA, 19 nt, Human
uccuuucacaaccuucugu

SEQ ID NO: 1640173 - RNA, 18 nt, Human
uccuuucacaaccuucug

SEQ ID NO: 1640174 - RNA, 16 nt, Human
uccuuucacaaccuuc

SEQ ID NO: 1640175 - RNA, 13 nt, Human
ucgcgacaaugca

SEQ ID NO: 1640176 - RNA, 14 nt, Human
ucgcgacaaugcaa

SEQ ID NO: 1640177 - RNA, 17 nt, Human
ucgaggacagggaggug

SEQ ID NO: 1640178 - RNA, 14 nt, Human
ucgaggacagggag

SEQ ID NO: 1640179 - RNA, 15 nt, Human
ucgagcaugccugga

SEQ ID NO: 1640180 - RNA, 14 nt, Human
ucgagcaugccugg

SEQ ID NO: 1640181 - RNA, 13 nt, Human
ucgaccugccucg

SEQ ID NO: 1640182 - RNA, 23 nt, Human
acuguacaugaaaacacauuuuu

SEQ ID NO: 1640183 - RNA, 13 nt, Human
acuguacaugaaa

SEQ ID NO: 1640184 - RNA, 14 nt, Human
acuguacaugaaaa

SEQ ID NO: 1640185 - RNA, 15 nt, Human
acuguacuccuccca

SEQ ID NO: 1640186 - RNA, 14 nt, Human
acuguacuccuccc

SEQ ID NO: 1640187 - RNA, 13 nt, Human
acuguacuccucc

SEQ ID NO: 1640188 - RNA, 15 nt, Human
acuguacaaaguaga

SEQ ID NO: 1640189 - RNA, 14 nt, Human
acuguacaaaguag

SEQ ID NO: 1640190 - RNA, 20 nt, Human
acuguacagacagaaaaaac

SEQ ID NO: 1640191 - RNA, 13 nt, Human
acuguacaaagua

SEQ ID NO: 1640192 - RNA, 19 nt, Human
acuguaauuugugauacaa

SEQ ID NO: 1640193 - RNA, 14 nt, Human
ucgcuccugugucu

SEQ ID NO: 1640194 - RNA, 13 nt, Human
ucgcuccuguguc

SEQ ID NO: 1640195 - RNA, 12 nt, Human
ucgcuccugugu

SEQ ID NO: 1640196 - RNA, 19 nt, Human
acuggguacuuguggacac

SEQ ID NO: 1640197 - RNA, 23 nt, Human
acuggguacuuguggacacagcu

SEQ ID NO: 1640198 - RNA, 20 nt, Human
acuggguacuuguggacaca

SEQ ID NO: 1640199 - RNA, 16 nt, Human
acuguaaggcaaucau

SEQ ID NO: 1640200 - RNA, 22 nt, Human
acugccuucucaacuccaaacu

SEQ ID NO: 1640201 - RNA, 12 nt, Human
acugcucugaug

SEQ ID NO: 1640202 - RNA, 23 nt, Human
acugcuuccagugaggcucugcc

SEQ ID NO: 1640203 - RNA, 22 nt, Human
acugcuuccagugaggcucugc

SEQ ID NO: 1640204 - RNA, 21 nt, Human
acugcuuccagugaggcucug

SEQ ID NO: 1640205 - RNA, 18 nt, Human
acugcuuccagugaggcu

SEQ ID NO: 1640206 - RNA, 21 nt, Human
acugcugcccagccuccaagc

SEQ ID NO: 1640207 - RNA, 18 nt, Human
acugcugcccagccucca

SEQ ID NO: 1640208 - RNA, 16 nt, Human
acugcugcccagccuc

SEQ ID NO: 1640209 - RNA, 12 nt, Human
acugcuggcugc

SEQ ID NO: 1640210 - RNA, 21 nt, Human
acugcuugugaaaggaaagag

SEQ ID NO: 1640211 - RNA, 13 nt, Human
acuggauuguacu

SEQ ID NO: 1640212 - RNA, 16 nt, Human
acuggauuguacuuug

SEQ ID NO: 1640213 - RNA, 13 nt, Human
acugcuggcugcc

SEQ ID NO: 1640214 - RNA, 22 nt, Human
acuggcacaguuuucugagaaa

SEQ ID NO: 1640215 - RNA, 23 nt, Human
acuggccucugcugauccuccca

SEQ ID NO: 1640216 - RNA, 22 nt, Human
acuggcugcaaaggguaucagg

SEQ ID NO: 1640217 - RNA, 13 nt, Human
uccuucagccuga

SEQ ID NO: 1640218 - RNA, 11 nt, Human
uccuucagugc

SEQ ID NO: 1640219 - RNA, 12 nt, Human
uccuucagugcc

SEQ ID NO: 1640220 - RNA, 13 nt, Human
uccuucagugccu

SEQ ID NO: 1640221 - RNA, 22 nt, Human
uccuucagugccuuauggaaca

SEQ ID NO: 1640222 - RNA, 14 nt, Human
uccuucagugccuu

SEQ ID NO: 1640223 - RNA, 16 nt, Human
uccuuccucugaggcu

SEQ ID NO: 1640224 - RNA, 17 nt, Human
uccuuccucugagccuu

SEQ ID NO: 1640225 - RNA, 16 nt, Human
uccuuccucugagccu

SEQ ID NO: 1640226 - RNA, 22 nt, Human
acugaggggaggggagcauggg

SEQ ID NO: 1640227 - RNA, 17 nt, Human
acugaggggaggggagc

SEQ ID NO: 1640228 - RNA, 14 nt, Human
acugaggaucagag

SEQ ID NO: 1640229 - RNA, 15 nt, Human
acugaggaccagcca

SEQ ID NO: 1640230 - RNA, 15 nt, Human
uccucuccccagcaa

SEQ ID NO: 1640231 - RNA, 18 nt, Human
acugaguacguugugcau

SEQ ID NO: 1640232 - RNA, 19 nt, Human
acugaguacguugugcauu

SEQ ID NO: 1640233 - RNA, 21 nt, Human
acugaguacguugugcauuug

SEQ ID NO: 1640234 - RNA, 22 nt, Human
acugaguacguugugcauuugg

SEQ ID NO: 1640235 - RNA, 23 nt, Human
acugaguacguugugcauuuggu

SEQ ID NO: 1640236 - RNA, 16 nt, Human
acugagugccuuuugg

SEQ ID NO: 1640237 - RNA, 14 nt, Human
acugcaaccuccgc

SEQ ID NO: 1640238 - RNA, 13 nt, Human
acugcaaccuccg

SEQ ID NO: 1640239 - RNA, 22 nt, Human
acugcaaccuccgccucuuggg

SEQ ID NO: 1640240 - RNA, 16 nt, Human
acugcaaccuccgccu

SEQ ID NO: 1640241 - RNA, 23 nt, Human
acugcaaccuucgccaccugggu

SEQ ID NO: 1640242 - RNA, 20 nt, Human
acugcaaccuucgccaccug

SEQ ID NO: 1640243 - RNA, 22 nt, Human
acugcacagugcaucucagccc

SEQ ID NO: 1640244 - RNA, 18 nt, Human
acugcacagugcaucuca

SEQ ID NO: 1640245 - RNA, 16 nt, Human
acugcacagugcaucu

SEQ ID NO: 1640246 - RNA, 20 nt, Human
uccugaguagcugggauuac

SEQ ID NO: 1640247 - RNA, 20 nt, Human
uccugccucgaacuggcugc

SEQ ID NO: 1640248 - RNA, 21 nt, Human
uccugccucgaacuggcugca

SEQ ID NO: 1640249 - RNA, 20 nt, Human
uccugcaggcagccaggcca

SEQ ID NO: 1640250 - RNA, 19 nt, Human
uccugcaggcagccaggcc

SEQ ID NO: 1640251 - RNA, 17 nt, Human
uccugcaggcagccagg

SEQ ID NO: 1640252 - RNA, 16 nt, Human
uccugcaggcagccag

SEQ ID NO: 1640253 - RNA, 19 nt, Human
uccugccucagccucccaa

SEQ ID NO: 1640254 - RNA, 22 nt, Human
uccugcaggcagccaggccaca

SEQ ID NO: 1640255 - RNA, 15 nt, Human
uccugggcagcugcc

SEQ ID NO: 1640256 - RNA, 21 nt, Human
uccugcugcaguugccaguca

SEQ ID NO: 1640257 - RNA, 16 nt, Human
uccugggcagcugccu

SEQ ID NO: 1640258 - RNA, 17 nt, Human
uccugggcagcugccuc

SEQ ID NO: 1640259 - RNA, 13 nt, Human
uccugcugcaguu

SEQ ID NO: 1640260 - RNA, 18 nt, Human
uccugggcagcugccucc

SEQ ID NO: 1640261 - RNA, 19 nt, Human
uccugggcagcugccuccc

SEQ ID NO: 1640262 - RNA, 22 nt, Human
uccugggcagcugccuccccuc

SEQ ID NO: 1640263 - RNA, 23 nt, Human
uccugggcagcugccuccccucc

SEQ ID NO: 1640264 - RNA, 19 nt, Human
uccuggggaaccugacccc

SEQ ID NO: 1640265 - RNA, 18 nt, Human
uccuggggaaccugaccc

SEQ ID NO: 1640266 - RNA, 23 nt, Human
uccuggggguucuuucuuccucu

SEQ ID NO: 1640267 - RNA, 22 nt, Human
uccuggggguucuuucuuccuc

SEQ ID NO: 1640268 - RNA, 21 nt, Human
uccuggggguucuuucuuccu

SEQ ID NO: 1640269 - RNA, 18 nt, Human
uccugugacuucagcucu

SEQ ID NO: 1640270 - RNA, 22 nt, Human
acugcagccucaaccuccuggg

SEQ ID NO: 1640271 - RNA, 21 nt, Human
acugcagccucaaccuccugg

SEQ ID NO: 1640272 - RNA, 19 nt, Human
acugcagccucaaccuccu

SEQ ID NO: 1640273 - RNA, 17 nt, Human
uccuuaaagaguguggc

SEQ ID NO: 1640274 - RNA, 18 nt, Human
uccuuaaagaguguggca

SEQ ID NO: 1640275 - RNA, 23 nt, Human
uccuuaaagaguguggcaaaaua

SEQ ID NO: 1640276 - RNA, 23 nt, Human
acugcagccucaaccuccugggc

SEQ ID NO: 1640277 - RNA, 16 nt, Human
acugcagggacugcca

SEQ ID NO: 1640278 - RNA, 18 nt, Human
acugcagggacugccagu

SEQ ID NO: 1640279 - RNA, 17 nt, Human
acugcagggacugccag

SEQ ID NO: 1640280 - RNA, 24 nt, Human
uccugugucuugcaauggcagccu

SEQ ID NO: 1640281 - RNA, 23 nt, Human
uccugugucuugcaauggcagcc

SEQ ID NO: 1640282 - RNA, 14 nt, Human
uccugugugugcgc

SEQ ID NO: 1640283 - RNA, 13 nt, Human
uccugugugugcg

SEQ ID NO: 1640284 - RNA, 18 nt, Human
uccugugugugcgccuac

SEQ ID NO: 1640285 - RNA, 19 nt, Human
uccuguucccaugagauga

SEQ ID NO: 1640286 - RNA, 10 nt, Human
acccuuuucu

SEQ ID NO: 1640287 - RNA, 18 nt, Human
accgagucucuucuccac

SEQ ID NO: 1640288 - RNA, 22 nt, Human
ucauauuuacuucuuauacauu

SEQ ID NO: 1640289 - RNA, 21 nt, Human
ucauauuuacuucuuauacau

SEQ ID NO: 1640290 - RNA, 20 nt, Human
ucauauuuacuucuuauaca

SEQ ID NO: 1640291 - RNA, 20 nt, Human
accgcagacaggaccaggga

SEQ ID NO: 1640292 - RNA, 24 nt, Human
accgagucucuucuccacuggaug

SEQ ID NO: 1640293 - RNA, 21 nt, Human
accgagucucuucuccacugg

SEQ ID NO: 1640294 - RNA, 20 nt, Human
accgagucucuucuccacug

SEQ ID NO: 1640295 - RNA, 17 nt, Human
accgccaaggcuggggg

SEQ ID NO: 1640296 - RNA, 20 nt, Human
accuccgccucuuggguuca

SEQ ID NO: 1640297 - RNA, 11 nt, Human
accucagccuc

SEQ ID NO: 1640298 - RNA, 13 nt, Human
accuagccuuaga

SEQ ID NO: 1640299 - RNA, 22 nt, Human
ucaugaauuaguuuuauaugcu

SEQ ID NO: 1640300 - RNA, 23 nt, Human
ucauccacugugccaugugccag

SEQ ID NO: 1640301 - RNA, 21 nt, Human
ucauccacugugccaugugcc

SEQ ID NO: 1640302 - RNA, 19 nt, Human
ucauccacugugccaugug

SEQ ID NO: 1640303 - RNA, 19 nt, Human
ucaugacaaagacugagua

SEQ ID NO: 1640304 - RNA, 11 nt, Human
ucauguucuua

SEQ ID NO: 1640305 - RNA, 17 nt, Human
ucauguucuuaauucuu

SEQ ID NO: 1640306 - RNA, 13 nt, Human
ucaugucuggcua

SEQ ID NO: 1640307 - RNA, 14 nt, Human
ucaugugaaaucau

SEQ ID NO: 1640308 - RNA, 22 nt, Human
ucauugaccugaggcccuucuc

SEQ ID NO: 1640309 - RNA, 21 nt, Human
ucauucuccuuguguuacuaa

SEQ ID NO: 1640310 - RNA, 17 nt, Human
accucggugccuuccuc

SEQ ID NO: 1640311 - RNA, 18 nt, Human
accucuaaauucuuucau

SEQ ID NO: 1640312 - RNA, 19 nt, Human
accucucucacuccuugaa

SEQ ID NO: 1640313 - RNA, 14 nt, Human
accucucucacucc

SEQ ID NO: 1640314 - RNA, 23 nt, Human
accucucccuuggauuguccccg

SEQ ID NO: 1640315 - RNA, 12 nt, Human
accucugcacaa

SEQ ID NO: 1640316 - RNA, 15 nt, Human
accucucccuuggau

SEQ ID NO: 1640317 - RNA, 14 nt, Human
accucucccuugga

SEQ ID NO: 1640318 - RNA, 13 nt, Human
accucucccuugg

SEQ ID NO: 1640319 - RNA, 21 nt, Human
accucuaaauucuuucauuuu

SEQ ID NO: 1640320 - RNA, 21 nt, Human
uccaacuaucucauuuccaag

SEQ ID NO: 1640321 - RNA, 13 nt, Human
uccaagcucccag

SEQ ID NO: 1640322 - RNA, 12 nt, Human
uccaagcuccca

SEQ ID NO: 1640323 - RNA, 15 nt, Human
uccaagcucccaggc

SEQ ID NO: 1640324 - RNA, 14 nt, Human
uccaagcucccagg

SEQ ID NO: 1640325 - RNA, 16 nt, Human
uccaagcucccaggca

SEQ ID NO: 1640326 - RNA, 18 nt, Human
uccaagcuccaucuccac

SEQ ID NO: 1640327 - RNA, 15 nt, Human
uccaaaugcagcuuu

SEQ ID NO: 1640328 - RNA, 14 nt, Human
uccaaaugcagcuu

SEQ ID NO: 1640329 - RNA, 11 nt, Human
uccaagcuggu

SEQ ID NO: 1640330 - RNA, 16 nt, Human
uccaagcuggucccac

SEQ ID NO: 1640331 - RNA, 21 nt, Human
ucauuugagcagggcucagcg

SEQ ID NO: 1640332 - RNA, 18 nt, Human
ucauuugugccagaaugc

SEQ ID NO: 1640333 - RNA, 20 nt, Human
ucauuuuagggguagcauuu

SEQ ID NO: 1640334 - RNA, 13 nt, Human
ucauuuuuuuuaa

SEQ ID NO: 1640335 - RNA, 17 nt, Human
ucauuuuuuuuaagaaa

SEQ ID NO: 1640336 - RNA, 23 nt, Human
uccaaagucucuggaauuugaaa

SEQ ID NO: 1640337 - RNA, 14 nt, Human
accuggaauauaua

SEQ ID NO: 1640338 - RNA, 17 nt, Human
accuggaauauauaacc

SEQ ID NO: 1640339 - RNA, 19 nt, Human
ucauuugagcagggcucag

SEQ ID NO: 1640340 - RNA, 19 nt, Human
accugcucuccucuugcca

SEQ ID NO: 1640341 - RNA, 22 nt, Human
accugcggugcuaucuccccca

SEQ ID NO: 1640342 - RNA, 19 nt, Human
accugcggugcuaucuccc

SEQ ID NO: 1640343 - RNA, 23 nt, Human
accugcggugcuaucucccccag

SEQ ID NO: 1640344 - RNA, 17 nt, Human
accugcucuccucuugc

SEQ ID NO: 1640345 - RNA, 18 nt, Human
accugcucuccucuugcc

SEQ ID NO: 1640346 - RNA, 22 nt, Human
accugaagucuuuguacagaca

SEQ ID NO: 1640347 - RNA, 15 nt, Human
accugaagucuuugu

SEQ ID NO: 1640348 - RNA, 20 nt, Human
uccagccugagcgacaguga

SEQ ID NO: 1640349 - RNA, 22 nt, Human
uccagccccuggaugcagccuc

SEQ ID NO: 1640350 - RNA, 23 nt, Human
uccagaccccuggcuuuucacug

SEQ ID NO: 1640351 - RNA, 21 nt, Human
uccagccugagcgacagugag

SEQ ID NO: 1640352 - RNA, 21 nt, Human
uccagccccuggaugcagccu

SEQ ID NO: 1640353 - RNA, 19 nt, Human
uccagccccuggaugcagc

SEQ ID NO: 1640354 - RNA, 17 nt, Human
uccagccccuggaugca

SEQ ID NO: 1640355 - RNA, 16 nt, Human
uccagccccuggaugc

SEQ ID NO: 1640356 - RNA, 15 nt, Human
uccagccccuggaug

SEQ ID NO: 1640357 - RNA, 14 nt, Human
uccagacccggcug

SEQ ID NO: 1640358 - RNA, 18 nt, Human
uccagaccccuggcuuuu

SEQ ID NO: 1640359 - RNA, 17 nt, Human
uccagaccccuggcuuu

SEQ ID NO: 1640360 - RNA, 16 nt, Human
uccagaccccuggcuu

SEQ ID NO: 1640361 - RNA, 15 nt, Human
uccagaccccuggcu

SEQ ID NO: 1640362 - RNA, 23 nt, Human
accuuuguauucucuccuguacc

SEQ ID NO: 1640363 - RNA, 15 nt, Human
accuuuguauucucu

SEQ ID NO: 1640364 - RNA, 19 nt, Human
accuuuguauucucuccug

SEQ ID NO: 1640365 - RNA, 22 nt, Human
uccagaaguuugagaucagccu

SEQ ID NO: 1640366 - RNA, 18 nt, Human
uccaccaucaagccacca

SEQ ID NO: 1640367 - RNA, 15 nt, Human
uccaccaucaagcca

SEQ ID NO: 1640368 - RNA, 23 nt, Human
accuggucacaggacucugccuc

SEQ ID NO: 1640369 - RNA, 22 nt, Human
accuggucacaggacucugccu

SEQ ID NO: 1640370 - RNA, 17 nt, Human
accuuagacagucccug

SEQ ID NO: 1640371 - RNA, 14 nt, Human
accuuagccugccc

SEQ ID NO: 1640372 - RNA, 13 nt, Human
accuucuccuuca

SEQ ID NO: 1640373 - RNA, 14 nt, Human
accuucuccuucac

SEQ ID NO: 1640374 - RNA, 12 nt, Human
accuucuguggc

SEQ ID NO: 1640375 - RNA, 16 nt, Human
accuucuguggcucac

SEQ ID NO: 1640376 - RNA, 15 nt, Human
accuucuguggcuca

SEQ ID NO: 1640377 - RNA, 13 nt, Human
accuucuguggcu

SEQ ID NO: 1640378 - RNA, 14 nt, Human
accuugacagggca

SEQ ID NO: 1640379 - RNA, 15 nt, Human
accuugaaugaugcc

SEQ ID NO: 1640380 - RNA, 15 nt, Human
accuugacagggcac

SEQ ID NO: 1640381 - RNA, 16 nt, Human
accuugacagggcaca

SEQ ID NO: 1640382 - RNA, 12 nt, Human
accuucuccuuc

SEQ ID NO: 1640383 - RNA, 12 nt, Human
uauuucauuucu

SEQ ID NO: 1640384 - RNA, 11 nt, Human
accacagcagu

SEQ ID NO: 1640385 - RNA, 14 nt, Human
accacaucuugcuc

SEQ ID NO: 1640386 - RNA, 21 nt, Human
accacagacauacuaaccagc

SEQ ID NO: 1640387 - RNA, 22 nt, Human
accacagacauacuaaccagca

SEQ ID NO: 1640388 - RNA, 19 nt, Human
accacugcagaagacagua

SEQ ID NO: 1640389 - RNA, 14 nt, Human
accacugcagaaga

SEQ ID NO: 1640390 - RNA, 14 nt, Human
accacuucagcuga

SEQ ID NO: 1640391 - RNA, 13 nt, Human
accacuucagcug

SEQ ID NO: 1640392 - RNA, 15 nt, Human
accacuucagcugac

SEQ ID NO: 1640393 - RNA, 24 nt, Human
accacaucuugcucugcugacaga

SEQ ID NO: 1640394 - RNA, 21 nt, Human
accacaucuugcucugcugac

SEQ ID NO: 1640395 - RNA, 20 nt, Human
accacaucuugcucugcuga

SEQ ID NO: 1640396 - RNA, 16 nt, Human
accacaucuugcucug

SEQ ID NO: 1640397 - RNA, 20 nt, Human
accacucuaucaaguauuau

SEQ ID NO: 1640398 - RNA, 23 nt, Human
accacuuguguuuugcaagccag

SEQ ID NO: 1640399 - RNA, 19 nt, Human
accacuuguguuuugcaag

SEQ ID NO: 1640400 - RNA, 12 nt, Human
accacuuuuguu

SEQ ID NO: 1640401 - RNA, 23 nt, Human
accagacaccuugacagggcaca

SEQ ID NO: 1640402 - RNA, 22 nt, Human
accagacaccuugacagggcac

SEQ ID NO: 1640403 - RNA, 11 nt, Human
accagacaggu

SEQ ID NO: 1640404 - RNA, 22 nt, Human
accagagcccaccuuggcucaa

SEQ ID NO: 1640405 - RNA, 19 nt, Human
accagagcccaccuuggcu

SEQ ID NO: 1640406 - RNA, 12 nt, Human
accagagcugcc

SEQ ID NO: 1640407 - RNA, 23 nt, Human
ucaccugaagacucauucuucug

SEQ ID NO: 1640408 - RNA, 19 nt, Human
ucaccugaagacucauucu

SEQ ID NO: 1640409 - RNA, 17 nt, Human
ucaccuccugcugggca

SEQ ID NO: 1640410 - RNA, 15 nt, Human
ucaccuccugcuggg

SEQ ID NO: 1640411 - RNA, 14 nt, Human
ucaccuccugcugg

SEQ ID NO: 1640412 - RNA, 13 nt, Human
ucaccuccugcug

SEQ ID NO: 1640413 - RNA, 12 nt, Human
ucaccuccugcu

SEQ ID NO: 1640414 - RNA, 15 nt, Human
ucaccucccccaucu

SEQ ID NO: 1640415 - RNA, 13 nt, Human
ucaccucccccau

SEQ ID NO: 1640416 - RNA, 19 nt, Human
accaggcaacuugggaacu

SEQ ID NO: 1640417 - RNA, 15 nt, Human
acccaaaaggcagaa

SEQ ID NO: 1640418 - RNA, 13 nt, Human
acccaaaaggcag

SEQ ID NO: 1640419 - RNA, 23 nt, Human
accauuuugggguacccacugcu

SEQ ID NO: 1640420 - RNA, 16 nt, Human
accauucuccaccugc

SEQ ID NO: 1640421 - RNA, 13 nt, Human
accauucuccacc

SEQ ID NO: 1640422 - RNA, 18 nt, Human
accauucuccaccugcca

SEQ ID NO: 1640423 - RNA, 22 nt, Human
accaugauuaaccacuucagcu

SEQ ID NO: 1640424 - RNA, 23 nt, Human
accaugauuaaccacuucagcug

SEQ ID NO: 1640425 - RNA, 15 nt, Human
accauuccccauggg

SEQ ID NO: 1640426 - RNA, 18 nt, Human
acccaaaaggcagaagca

SEQ ID NO: 1640427 - RNA, 21 nt, Human
acccaaauguucaucaaugaa

SEQ ID NO: 1640428 - RNA, 16 nt, Human
acccagaagaaaauag

SEQ ID NO: 1640429 - RNA, 19 nt, Human
acccacuugcuuuuaaaau

SEQ ID NO: 1640430 - RNA, 18 nt, Human
acccagcccacuucugcc

SEQ ID NO: 1640431 - RNA, 17 nt, Human
acccagcccacuucugc

SEQ ID NO: 1640432 - RNA, 16 nt, Human
acccagcccacuucug

SEQ ID NO: 1640433 - RNA, 12 nt, Human
ucacugcagccu

SEQ ID NO: 1640434 - RNA, 13 nt, Human
ucacugcagccuc

SEQ ID NO: 1640435 - RNA, 16 nt, Human
ucacugagacagcccg

SEQ ID NO: 1640436 - RNA, 24 nt, Human
ucacugcacagugcaucucagccc

SEQ ID NO: 1640437 - RNA, 22 nt, Human
ucacugcacagugcaucucagc

SEQ ID NO: 1640438 - RNA, 20 nt, Human
ucacugcacagugcaucuca

SEQ ID NO: 1640439 - RNA, 15 nt, Human
ucacugagacagccc

SEQ ID NO: 1640440 - RNA, 14 nt, Human
ucacugagacagcc

SEQ ID NO: 1640441 - RNA, 13 nt, Human
ucacugagacagc

SEQ ID NO: 1640442 - RNA, 21 nt, Human
accaguguuguggauuuaaca

SEQ ID NO: 1640443 - RNA, 18 nt, Human
ucacuguugcccaggcug

SEQ ID NO: 1640444 - RNA, 17 nt, Human
ucacuguugcccaggcu

SEQ ID NO: 1640445 - RNA, 19 nt, Human
ucacuguugcccaggcugg

SEQ ID NO: 1640446 - RNA, 15 nt, Human
acccccagccugcua

SEQ ID NO: 1640447 - RNA, 12 nt, Human
accccuggcuuu

SEQ ID NO: 1640448 - RNA, 12 nt, Human
ucagccugggca

SEQ ID NO: 1640449 - RNA, 10 nt, Human
ucagccuggg

SEQ ID NO: 1640450 - RNA, 19 nt, Human
ucagccuggcuucaaauug

SEQ ID NO: 1640451 - RNA, 17 nt, Human
accccuggcuuuucacu

SEQ ID NO: 1640452 - RNA, 15 nt, Human
accccuggcuuuuca

SEQ ID NO: 1640453 - RNA, 13 nt, Human
ucagaagacacug

SEQ ID NO: 1640454 - RNA, 13 nt, Human
ucagaucuucugu

SEQ ID NO: 1640455 - RNA, 13 nt, Human
ucagauuuuauua

SEQ ID NO: 1640456 - RNA, 15 nt, Human
ucagauuuuauuaug

SEQ ID NO: 1640457 - RNA, 14 nt, Human
ucagauuuuauuau

SEQ ID NO: 1640458 - RNA, 15 nt, Human
acccagcucuggucc

SEQ ID NO: 1640459 - RNA, 13 nt, Human
acccagcucuggu

SEQ ID NO: 1640460 - RNA, 19 nt, Human
ucagcccucccugccccuc

SEQ ID NO: 1640461 - RNA, 18 nt, Human
ucagcccucccugccccu

SEQ ID NO: 1640462 - RNA, 22 nt, Human
ucagauuuuauuauguaaaucc

SEQ ID NO: 1640463 - RNA, 20 nt, Human
ucagauuuuauuauguaaau

SEQ ID NO: 1640464 - RNA, 19 nt, Human
ucagauuuuauuauguaaa

SEQ ID NO: 1640465 - RNA, 16 nt, Human
ucagauuuuauuaugu

SEQ ID NO: 1640466 - RNA, 14 nt, Human
acccucuuagaaaa

SEQ ID NO: 1640467 - RNA, 12 nt, Human
acccugcccugu

SEQ ID NO: 1640468 - RNA, 11 nt, Human
acccugcccug

SEQ ID NO: 1640469 - RNA, 13 nt, Human
acccugcccugug

SEQ ID NO: 1640470 - RNA, 14 nt, Human
acccugcccugugg

SEQ ID NO: 1640471 - RNA, 20 nt, Human
acccuuguggucccacccca

SEQ ID NO: 1640472 - RNA, 19 nt, Human
acccuuguggucccacccc

SEQ ID NO: 1640473 - RNA, 17 nt, Human
acccuuguggucccacc

SEQ ID NO: 1640474 - RNA, 16 nt, Human
acccuuguggucccac

SEQ ID NO: 1640475 - RNA, 20 nt, Human
accccuucgcuccugugucu

SEQ ID NO: 1640476 - RNA, 19 nt, Human
accccuucgcuccuguguc

SEQ ID NO: 1640477 - RNA, 16 nt, Human
ucagguaacaggcaga

SEQ ID NO: 1640478 - RNA, 15 nt, Human
ucagguaacaggcag

SEQ ID NO: 1640479 - RNA, 13 nt, Human
ucagguaacaggc

SEQ ID NO: 1640480 - RNA, 18 nt, Human
ucagggucccugguggca

SEQ ID NO: 1640481 - RNA, 14 nt, Human
ucagggucccuggu

SEQ ID NO: 1640482 - RNA, 13 nt, Human
ucagggucccugg

SEQ ID NO: 1640483 - RNA, 12 nt, Human
ucaggccaggcc

SEQ ID NO: 1640484 - RNA, 11 nt, Human
ucaggccaggc

SEQ ID NO: 1640485 - RNA, 20 nt, Human
ucaggccagcugcuugggcu

SEQ ID NO: 1640486 - RNA, 15 nt, Human
ucaggccagcugcuu

SEQ ID NO: 1640487 - RNA, 20 nt, Human
ucaggaagcucagggccugg

SEQ ID NO: 1640488 - RNA, 19 nt, Human
ucaggaagcucagggccug

SEQ ID NO: 1640489 - RNA, 17 nt, Human
ucaggaagcucagggcc

SEQ ID NO: 1640490 - RNA, 12 nt, Human
ucaggaagcuca

SEQ ID NO: 1640491 - RNA, 23 nt, Human
ucaggccaaacucaccugccccu

SEQ ID NO: 1640492 - RNA, 20 nt, Human
ucaggccaaacucaccugcc

SEQ ID NO: 1640493 - RNA, 17 nt, Human
ucagcggggacagcucc

SEQ ID NO: 1640494 - RNA, 16 nt, Human
ucagcggggacagcuc

SEQ ID NO: 1640495 - RNA, 15 nt, Human
ucagcggggacagcu

SEQ ID NO: 1640496 - RNA, 18 nt, Human
ucagcggggacagcuccu

SEQ ID NO: 1640497 - RNA, 14 nt, Human
agcagauuauucac

SEQ ID NO: 1640498 - RNA, 16 nt, Human
agcagauuauucacug

SEQ ID NO: 1640499 - RNA, 15 nt, Human
agcagauuauucacu

SEQ ID NO: 1640500 - RNA, 19 nt, Human
agcagauggagaccccuug

SEQ ID NO: 1640501 - RNA, 20 nt, Human
agcagauuauucacugauuu

SEQ ID NO: 1640502 - RNA, 19 nt, Human
agcagauuauucacugauu

SEQ ID NO: 1640503 - RNA, 17 nt, Human
agcagaggaaggagagg

SEQ ID NO: 1640504 - RNA, 22 nt, Human
ugagguacugagagugaacaaa

SEQ ID NO: 1640505 - RNA, 13 nt, Human
ugaggucagagcc

SEQ ID NO: 1640506 - RNA, 16 nt, Human
ugaggucagagccugc

SEQ ID NO: 1640507 - RNA, 14 nt, Human
ugaggucagagccu

SEQ ID NO: 1640508 - RNA, 17 nt, Human
ugagguacugagaguga

SEQ ID NO: 1640509 - RNA, 20 nt, Human
ugaggguugggcugguguca

SEQ ID NO: 1640510 - RNA, 19 nt, Human
agcagagaccaucccugaa

SEQ ID NO: 1640511 - RNA, 18 nt, Human
agcagagaccaucccuga

SEQ ID NO: 1640512 - RNA, 17 nt, Human
ugaggucagagccugca

SEQ ID NO: 1640513 - RNA, 20 nt, Human
agcagagcaccuuagacagu

SEQ ID NO: 1640514 - RNA, 20 nt, Human
agcagagaccaucccugaag

SEQ ID NO: 1640515 - RNA, 19 nt, Human
ugagguacaaccuguucug

SEQ ID NO: 1640516 - RNA, 13 nt, Human
ugaggggccucuu

SEQ ID NO: 1640517 - RNA, 12 nt, Human
ugaggggccucu

SEQ ID NO: 1640518 - RNA, 24 nt, Human
ugaggcccuucucuccagccccug

SEQ ID NO: 1640519 - RNA, 23 nt, Human
ugaggcccuucucuccagccccu

SEQ ID NO: 1640520 - RNA, 22 nt, Human
ugaggcccuucucuccagcccc

SEQ ID NO: 1640521 - RNA, 20 nt, Human
ugaggcccuucucuccagcc

SEQ ID NO: 1640522 - RNA, 19 nt, Human
ugaggcccuucucuccagc

SEQ ID NO: 1640523 - RNA, 18 nt, Human
ugaggcccuucucuccag

SEQ ID NO: 1640524 - RNA, 16 nt, Human
ugaggcccuucucucc

SEQ ID NO: 1640525 - RNA, 19 nt, Human
ugagggauacccaucccau

SEQ ID NO: 1640526 - RNA, 15 nt, Human
ugagggauuaucuuu

SEQ ID NO: 1640527 - RNA, 15 nt, Human
ugaggacacugauau

SEQ ID NO: 1640528 - RNA, 21 nt, Human
ugaggacacuaaccacgcugg

SEQ ID NO: 1640529 - RNA, 12 nt, Human
ugaggccagaga

SEQ ID NO: 1640530 - RNA, 22 nt, Human
ugaggaauccagacccggcugc

SEQ ID NO: 1640531 - RNA, 21 nt, Human
ugaggaauccagacccggcug

SEQ ID NO: 1640532 - RNA, 16 nt, Human
ugaggaauucuguaua

SEQ ID NO: 1640533 - RNA, 15 nt, Human
ugaggaauucuguau

SEQ ID NO: 1640534 - RNA, 14 nt, Human
ugaggaauucugua

SEQ ID NO: 1640535 - RNA, 19 nt, Human
ugaggaauucuguauagau

SEQ ID NO: 1640536 - RNA, 18 nt, Human
ugaggaauucuguauaga

SEQ ID NO: 1640537 - RNA, 20 nt, Human
ugaggcccagagggccugca

SEQ ID NO: 1640538 - RNA, 18 nt, Human
ugaggcccagagggccug

SEQ ID NO: 1640539 - RNA, 17 nt, Human
ugaggcccagagggccu

SEQ ID NO: 1640540 - RNA, 15 nt, Human
ugaggcccagagggc

SEQ ID NO: 1640541 - RNA, 22 nt, Human
ugaggcccagagggccugcaag

SEQ ID NO: 1640542 - RNA, 21 nt, Human
ugaggcccagagggccugcaa

SEQ ID NO: 1640543 - RNA, 23 nt, Human
ugaggcccagagggccugcaagg

SEQ ID NO: 1640544 - RNA, 13 nt, Human
ugaggcccagagg

SEQ ID NO: 1640545 - RNA, 12 nt, Human
ugaggcccagag

SEQ ID NO: 1640546 - RNA, 16 nt, Human
ugaggccagagacaca

SEQ ID NO: 1640547 - RNA, 14 nt, Human
ugaggccagagaca

SEQ ID NO: 1640548 - RNA, 20 nt, Human
ugaggccagagacacaagcc

SEQ ID NO: 1640549 - RNA, 13 nt, Human
ugagcuacaaaug

SEQ ID NO: 1640550 - RNA, 14 nt, Human
ugagcuacaaaugc

SEQ ID NO: 1640551 - RNA, 16 nt, Human
ugagcuacaaaugcau

SEQ ID NO: 1640552 - RNA, 14 nt, Human
ugagcuaggaauug

SEQ ID NO: 1640553 - RNA, 21 nt, Human
ugaggaagccgcuggggccag

SEQ ID NO: 1640554 - RNA, 19 nt, Human
ugaggaagccgcuggggcc

SEQ ID NO: 1640555 - RNA, 18 nt, Human
ugaggaagccgcuggggc

SEQ ID NO: 1640556 - RNA, 17 nt, Human
ugaggaagccgcugggg

SEQ ID NO: 1640557 - RNA, 14 nt, Human
ugaggaagccgcug

SEQ ID NO: 1640558 - RNA, 22 nt, Human
ugaggaagcaaaagcaucuaug

SEQ ID NO: 1640559 - RNA, 15 nt, Human
ugaggaagcaaaagc

SEQ ID NO: 1640560 - RNA, 20 nt, Human
ugagcgacagugagacucug

SEQ ID NO: 1640561 - RNA, 16 nt, Human
ugagcgacagugagac

SEQ ID NO: 1640562 - RNA, 14 nt, Human
ugagcgacagugag

SEQ ID NO: 1640563 - RNA, 13 nt, Human
ugagcgacaguga

SEQ ID NO: 1640564 - RNA, 15 nt, Human
ugagccuugaacuuu

SEQ ID NO: 1640565 - RNA, 17 nt, Human
ugagccuugaacuuuga

SEQ ID NO: 1640566 - RNA, 18 nt, Human
ugagccuugaacuuugac

SEQ ID NO: 1640567 - RNA, 19 nt, Human
ugagccuugaacuuugacc

SEQ ID NO: 1640568 - RNA, 14 nt, Human
ugagccuugaacuu

SEQ ID NO: 1640569 - RNA, 22 nt, Human
ugagccugggaggucaaggcug

SEQ ID NO: 1640570 - RNA, 19 nt, Human
ugagccugggaggucaagg

SEQ ID NO: 1640571 - RNA, 14 nt, Human
ugagccugggaggu

SEQ ID NO: 1640572 - RNA, 16 nt, Human
ugagccuggcaagaau

SEQ ID NO: 1640573 - RNA, 11 nt, Human
ugagccuggca

SEQ ID NO: 1640574 - RNA, 10 nt, Human
ugagccuggc

SEQ ID NO: 1640575 - RNA, 17 nt, Human
agcagagaccaucccug

SEQ ID NO: 1640576 - RNA, 16 nt, Human
agcagagaccaucccu

SEQ ID NO: 1640577 - RNA, 15 nt, Human
agcagagaccauccc

SEQ ID NO: 1640578 - RNA, 21 nt, Human
agcagagaauucucuuaucca

SEQ ID NO: 1640579 - RNA, 14 nt, Human
agcagagaauucuc

SEQ ID NO: 1640580 - RNA, 23 nt, Human
agcagagaaugaaagggcccaga

SEQ ID NO: 1640581 - RNA, 22 nt, Human
agcagagaaugaaagggcccag

SEQ ID NO: 1640582 - RNA, 21 nt, Human
agcagagaaugaaagggccca

SEQ ID NO: 1640583 - RNA, 14 nt, Human
agcagaacagugau

SEQ ID NO: 1640584 - RNA, 19 nt, Human
agcagaaaugccuuacccu

SEQ ID NO: 1640585 - RNA, 12 nt, Human
agcagaaaugcc

SEQ ID NO: 1640586 - RNA, 13 nt, Human
agcagaaaugccu

SEQ ID NO: 1640587 - RNA, 23 nt, Human
agcacuuugggaggccaaggugg

SEQ ID NO: 1640588 - RNA, 22 nt, Human
agcacuuugggaggccaaggug

SEQ ID NO: 1640589 - RNA, 16 nt, Human
agcacgauuucuguuu

SEQ ID NO: 1640590 - RNA, 14 nt, Human
agcacgauuucugu

SEQ ID NO: 1640591 - RNA, 15 nt, Human
agcacgauuucuguu

SEQ ID NO: 1640592 - RNA, 13 nt, Human
agcacgauuucug

SEQ ID NO: 1640593 - RNA, 23 nt, Human
agcaccuuagacagucccugcca

SEQ ID NO: 1640594 - RNA, 22 nt, Human
agcaccuuagacagucccugcc

SEQ ID NO: 1640595 - RNA, 21 nt, Human
agcaccuuagacagucccugc

SEQ ID NO: 1640596 - RNA, 20 nt, Human
agcaccuuagacagucccug

SEQ ID NO: 1640597 - RNA, 19 nt, Human
agcaccuuagacagucccu

SEQ ID NO: 1640598 - RNA, 13 nt, Human
agcaccagggaag

SEQ ID NO: 1640599 - RNA, 12 nt, Human
agcaccagggaa

SEQ ID NO: 1640600 - RNA, 10 nt, Human
agcaccaggg

SEQ ID NO: 1640601 - RNA, 14 nt, Human
agcaacgcaggccc

SEQ ID NO: 1640602 - RNA, 15 nt, Human
ugagcaauccugcaa

SEQ ID NO: 1640603 - RNA, 19 nt, Human
ugagcaaauguggcuccug

SEQ ID NO: 1640604 - RNA, 18 nt, Human
ugagcaaauguggcuccu

SEQ ID NO: 1640605 - RNA, 16 nt, Human
ugagcaaauguggcuc

SEQ ID NO: 1640606 - RNA, 23 nt, Human
ugagcacuaaggugugcucugau

SEQ ID NO: 1640607 - RNA, 22 nt, Human
ugagcacuaaggugugcucuga

SEQ ID NO: 1640608 - RNA, 21 nt, Human
ugagcacuaaggugugcucug

SEQ ID NO: 1640609 - RNA, 20 nt, Human
ugagcacuaaggugugcucu

SEQ ID NO: 1640610 - RNA, 16 nt, Human
ugagccagauuucacu

SEQ ID NO: 1640611 - RNA, 14 nt, Human
ugagccagauuuca

SEQ ID NO: 1640612 - RNA, 13 nt, Human
ugagccagauuuc

SEQ ID NO: 1640613 - RNA, 23 nt, Human
ugagccacugcaccgggccacag

SEQ ID NO: 1640614 - RNA, 21 nt, Human
ugagccacugcaccgggccac

SEQ ID NO: 1640615 - RNA, 21 nt, Human
ugagccaccgugccuggccac

SEQ ID NO: 1640616 - RNA, 20 nt, Human
ugagccaccgugccuggcca

SEQ ID NO: 1640617 - RNA, 19 nt, Human
ugagccaccgugccuggcc

SEQ ID NO: 1640618 - RNA, 18 nt, Human
ugagccaccgugccuggc

SEQ ID NO: 1640619 - RNA, 24 nt, Human
ugagcaucaggccaggcccucugc

SEQ ID NO: 1640620 - RNA, 22 nt, Human
ugagcaucaggccaggcccucu

SEQ ID NO: 1640621 - RNA, 14 nt, Human
ugagccaccgugcc

SEQ ID NO: 1640622 - RNA, 15 nt, Human
ugagccaccacgccc

SEQ ID NO: 1640623 - RNA, 21 nt, Human
ugagcaucaggccaggcccuc

SEQ ID NO: 1640624 - RNA, 16 nt, Human
agcaccaaucaugaau

SEQ ID NO: 1640625 - RNA, 16 nt, Human
agcacaugccucucuc

SEQ ID NO: 1640626 - RNA, 14 nt, Human
agcacaugccucuc

SEQ ID NO: 1640627 - RNA, 13 nt, Human
agcacaugccucu

SEQ ID NO: 1640628 - RNA, 22 nt, Human
agcacagccucuuagaugcagu

SEQ ID NO: 1640629 - RNA, 16 nt, Human
agcacagcuucauuuc

SEQ ID NO: 1640630 - RNA, 15 nt, Human
agcacagugaucaag

SEQ ID NO: 1640631 - RNA, 13 nt, Human
agcaagugagagc

SEQ ID NO: 1640632 - RNA, 20 nt, Human
agcaagugagacccugucuc

SEQ ID NO: 1640633 - RNA, 22 nt, Human
ugagccagauuucacucuccuu

SEQ ID NO: 1640634 - RNA, 17 nt, Human
ugagccagauuucacuc

SEQ ID NO: 1640635 - RNA, 14 nt, Human
agcaagugagagcu

SEQ ID NO: 1640636 - RNA, 22 nt, Human
agcaagugagagcuggguguca

SEQ ID NO: 1640637 - RNA, 21 nt, Human
agcacagcagccccugcacaa

SEQ ID NO: 1640638 - RNA, 14 nt, Human
agauuuuccugaaa

SEQ ID NO: 1640639 - RNA, 22 nt, Human
agauuuuauuauguaaauccca

SEQ ID NO: 1640640 - RNA, 21 nt, Human
agauuuuauuauguaaauccc

SEQ ID NO: 1640641 - RNA, 23 nt, Human
agcaaaaauauuuuaugauccag

SEQ ID NO: 1640642 - RNA, 19 nt, Human
agcaaaaauauuuuaugau

SEQ ID NO: 1640643 - RNA, 18 nt, Human
agcaaaaauauuuuauga

SEQ ID NO: 1640644 - RNA, 17 nt, Human
agcaaaaauauuuuaug

SEQ ID NO: 1640645 - RNA, 15 nt, Human
agcaaaaauauuuua

SEQ ID NO: 1640646 - RNA, 21 nt, Human
agauugugccccugcacucca

SEQ ID NO: 1640647 - RNA, 16 nt, Human
agauugugccccugca

SEQ ID NO: 1640648 - RNA, 16 nt, Human
agauuuaccacuugug

SEQ ID NO: 1640649 - RNA, 14 nt, Human
agauuuaugcauau

SEQ ID NO: 1640650 - RNA, 17 nt, Human
agauuucacucuccuug

SEQ ID NO: 1640651 - RNA, 14 nt, Human
agauuucacucucc

SEQ ID NO: 1640652 - RNA, 13 nt, Human
agauuucacucuc

SEQ ID NO: 1640653 - RNA, 15 nt, Human
ugacuguuuccauca

SEQ ID NO: 1640654 - RNA, 21 nt, Human
ugacuguuuucucuugagagg

SEQ ID NO: 1640655 - RNA, 23 nt, Human
ugacuccagaauuucccaaagca

SEQ ID NO: 1640656 - RNA, 20 nt, Human
ugacuccagaauuucccaaa

SEQ ID NO: 1640657 - RNA, 19 nt, Human
ugacuccagaauuucccaa

SEQ ID NO: 1640658 - RNA, 17 nt, Human
ugacuccagaauuuccc

SEQ ID NO: 1640659 - RNA, 15 nt, Human
ugaccugaggcccuu

SEQ ID NO: 1640660 - RNA, 14 nt, Human
ugaccugaggcccu

SEQ ID NO: 1640661 - RNA, 17 nt, Human
ugaccugaggcccuucu

SEQ ID NO: 1640662 - RNA, 22 nt, Human
agauucaaugccccugaauuua

SEQ ID NO: 1640663 - RNA, 21 nt, Human
agauucaaugccccugaauuu

SEQ ID NO: 1640664 - RNA, 16 nt, Human
agauucaaucccagga

SEQ ID NO: 1640665 - RNA, 16 nt, Human
agauuauucacugauu

SEQ ID NO: 1640666 - RNA, 23 nt, Human
agauuauauauauuuuuuucuga

SEQ ID NO: 1640667 - RNA, 20 nt, Human
agauuauaggcaccuaccac

SEQ ID NO: 1640668 - RNA, 23 nt, Human
agaugcuagaacucccuuucaac

SEQ ID NO: 1640669 - RNA, 18 nt, Human
agaugcuucucacugcca

SEQ ID NO: 1640670 - RNA, 12 nt, Human
ugaccugaggcc

SEQ ID NO: 1640671 - RNA, 14 nt, Human
ugaccucugccuga

SEQ ID NO: 1640672 - RNA, 23 nt, Human
ugaccccucauagcccucacccu

SEQ ID NO: 1640673 - RNA, 13 nt, Human
ugaccucugccug

SEQ ID NO: 1640674 - RNA, 20 nt, Human
ugaccccucauagcccucac

SEQ ID NO: 1640675 - RNA, 19 nt, Human
ugaccccucauagcccuca

SEQ ID NO: 1640676 - RNA, 22 nt, Human
ugacccccaaccaaguggcucc

SEQ ID NO: 1640677 - RNA, 17 nt, Human
ugaccccucauagcccu

SEQ ID NO: 1640678 - RNA, 12 nt, Human
ugacccaugcug

SEQ ID NO: 1640679 - RNA, 18 nt, Human
agauguguucacaaugga

SEQ ID NO: 1640680 - RNA, 15 nt, Human
agauguguucacaau

SEQ ID NO: 1640681 - RNA, 21 nt, Human
agaucauugugaaauuauuca

SEQ ID NO: 1640682 - RNA, 20 nt, Human
ugaccacacuccagcuggga

SEQ ID NO: 1640683 - RNA, 19 nt, Human
ugaccacacuccagcuggg

SEQ ID NO: 1640684 - RNA, 17 nt, Human
ugaccacacuccagcug

SEQ ID NO: 1640685 - RNA, 12 nt, Human
ugaccacacucc

SEQ ID NO: 1640686 - RNA, 22 nt, Human
ugacauuguagagcuucuggca

SEQ ID NO: 1640687 - RNA, 18 nt, Human
ugacauuguagagcuucu

SEQ ID NO: 1640688 - RNA, 17 nt, Human
ugaauuuauuggcuuuu

SEQ ID NO: 1640689 - RNA, 16 nt, Human
ugaauuuauuggcuuu

SEQ ID NO: 1640690 - RNA, 15 nt, Human
ugaauuuauuggcuu

SEQ ID NO: 1640691 - RNA, 12 nt, Human
ugaauuuauugg

SEQ ID NO: 1640692 - RNA, 18 nt, Human
agauaauacaccacuaca

SEQ ID NO: 1640693 - RNA, 18 nt, Human
agauaauucuagcuuuga

SEQ ID NO: 1640694 - RNA, 19 nt, Human
agauaaggguaucugguga

SEQ ID NO: 1640695 - RNA, 19 nt, Human
agagugagacucugucuca

SEQ ID NO: 1640696 - RNA, 19 nt, Human
agauacaggaaaagcugcu

SEQ ID NO: 1640697 - RNA, 22 nt, Human
agauauuuugcuuugugauuuu

SEQ ID NO: 1640698 - RNA, 19 nt, Human
agaucaaccccuucgcucc

SEQ ID NO: 1640699 - RNA, 14 nt, Human
agaucaaccccuuc

SEQ ID NO: 1640700 - RNA, 21 nt, Human
agaucaaccccuucgcuccug

SEQ ID NO: 1640701 - RNA, 22 nt, Human
agagugaacaaauuuacagaga

SEQ ID NO: 1640702 - RNA, 18 nt, Human
agagucuauuuacggaac

SEQ ID NO: 1640703 - RNA, 16 nt, Human
agagugagacucuguc

SEQ ID NO: 1640704 - RNA, 15 nt, Human
agagugagacucugu

SEQ ID NO: 1640705 - RNA, 22 nt, Human
agagucucacuguugcccaggc

SEQ ID NO: 1640706 - RNA, 20 nt, Human
agagucucacuguugcccag

SEQ ID NO: 1640707 - RNA, 18 nt, Human
ugaaugucagugugacug

SEQ ID NO: 1640708 - RNA, 15 nt, Human
ugaaugucaguguga

SEQ ID NO: 1640709 - RNA, 14 nt, Human
ugaaugucagugug

SEQ ID NO: 1640710 - RNA, 11 nt, Human
ugaauggcuuu

SEQ ID NO: 1640711 - RNA, 18 nt, Human
ugaagguggaaauaaacu

SEQ ID NO: 1640712 - RNA, 16 nt, Human
ugaaugcauaaaaugu

SEQ ID NO: 1640713 - RNA, 15 nt, Human
ugaaugcauaaaaug

SEQ ID NO: 1640714 - RNA, 20 nt, Human
ugaagaagcaccaaucauga

SEQ ID NO: 1640715 - RNA, 14 nt, Human
ugaagaagauggua

SEQ ID NO: 1640716 - RNA, 16 nt, Human
ugaacuuugaccucug

SEQ ID NO: 1640717 - RNA, 17 nt, Human
ugaacuuugaccucugc

SEQ ID NO: 1640718 - RNA, 22 nt, Human
ugaagaagcaccaaucaugaau

SEQ ID NO: 1640719 - RNA, 11 nt, Human
ugaagacaaug

SEQ ID NO: 1640720 - RNA, 13 nt, Human
ugaagacaaugac

SEQ ID NO: 1640721 - RNA, 17 nt, Human
ugaagacaaugacuuac

SEQ ID NO: 1640722 - RNA, 21 nt, Human
ucuuuggucuacacugugcug

SEQ ID NO: 1640723 - RNA, 14 nt, Human
ucuuuggucuacac

SEQ ID NO: 1640724 - RNA, 12 nt, Human
ucuuuguaauga

SEQ ID NO: 1640725 - RNA, 11 nt, Human
ugaacuuugac

SEQ ID NO: 1640726 - RNA, 15 nt, Human
ucuuuguaaugaaaa

SEQ ID NO: 1640727 - RNA, 13 nt, Human
ucuuuguaaugaa

SEQ ID NO: 1640728 - RNA, 18 nt, Human
agaggcaacugcauuggc

SEQ ID NO: 1640729 - RNA, 21 nt, Human
agaggaaaucaccgaaaacgu

SEQ ID NO: 1640730 - RNA, 12 nt, Human
agaggaaaucac

SEQ ID NO: 1640731 - RNA, 11 nt, Human
agaggaaauca

SEQ ID NO: 1640732 - RNA, 19 nt, Human
agaggaaagcaaaggagau

SEQ ID NO: 1640733 - RNA, 18 nt, Human
agaggaaagcaaaggaga

SEQ ID NO: 1640734 - RNA, 16 nt, Human
agaggaaagcaaagga

SEQ ID NO: 1640735 - RNA, 12 nt, Human
agaggaaagcaa

SEQ ID NO: 1640736 - RNA, 19 nt, Human
agagcugggugucaagagg

SEQ ID NO: 1640737 - RNA, 21 nt, Human
ugaagacaaugacuuacugua

SEQ ID NO: 1640738 - RNA, 15 nt, Human
agagcuucuggcacu

SEQ ID NO: 1640739 - RNA, 22 nt, Human
agagcuucuguugcugccucau

SEQ ID NO: 1640740 - RNA, 21 nt, Human
agagcuucuguugcugccuca

SEQ ID NO: 1640741 - RNA, 20 nt, Human
agagcuucuguugcugccuc

SEQ ID NO: 1640742 - RNA, 19 nt, Human
agagcuucuguugcugccu

SEQ ID NO: 1640743 - RNA, 18 nt, Human
ugaagauguagaggagaa

SEQ ID NO: 1640744 - RNA, 22 nt, Human
agagggagggagggcuccagac

SEQ ID NO: 1640745 - RNA, 15 nt, Human
agagggagguaagga

SEQ ID NO: 1640746 - RNA, 21 nt, Human
agagggagggagggcuccaga

SEQ ID NO: 1640747 - RNA, 17 nt, Human
agaggcuaugugagcac

SEQ ID NO: 1640748 - RNA, 21 nt, Human
agaggcgcaugaauuugugaa

SEQ ID NO: 1640749 - RNA, 18 nt, Human
ucuguuuuauaauuuugu

SEQ ID NO: 1640750 - RNA, 20 nt, Human
ucuguuuuauaauuuuguga

SEQ ID NO: 1640751 - RNA, 18 nt, Human
agaauuucccaaagcagu

SEQ ID NO: 1640752 - RNA, 17 nt, Human
agaauuucccaaagcag

SEQ ID NO: 1640753 - RNA, 23 nt, Human
agaauuucccaaagcagugcaug

SEQ ID NO: 1640754 - RNA, 21 nt, Human
agaauuucuaggacugaauua

SEQ ID NO: 1640755 - RNA, 13 nt, Human
agaauuucuagga

SEQ ID NO: 1640756 - RNA, 21 nt, Human
ucugugaaaggaaagagggag

SEQ ID NO: 1640757 - RNA, 15 nt, Human
ucugugaaaggaaag

SEQ ID NO: 1640758 - RNA, 24 nt, Human
ucuguccaggcacugcugcccagc

SEQ ID NO: 1640759 - RNA, 22 nt, Human
ucugugaaaggaaagagggagg

SEQ ID NO: 1640760 - RNA, 20 nt, Human
ucuguuggccagugugacaa

SEQ ID NO: 1640761 - RNA, 19 nt, Human
ucuguuggccagugugaca

SEQ ID NO: 1640762 - RNA, 18 nt, Human
ucuguuggccagugugac

SEQ ID NO: 1640763 - RNA, 17 nt, Human
ucuguauagauuagaau

SEQ ID NO: 1640764 - RNA, 23 nt, Human
ucugucauuugagcagggcucag

SEQ ID NO: 1640765 - RNA, 20 nt, Human
ucugucauuugagcagggcu

SEQ ID NO: 1640766 - RNA, 15 nt, Human
ucugucauuugagca

SEQ ID NO: 1640767 - RNA, 16 nt, Human
ucuguauagauuagag

SEQ ID NO: 1640768 - RNA, 16 nt, Human
ucuggguucacugcaa

SEQ ID NO: 1640769 - RNA, 14 nt, Human
ucuggguucacugc

SEQ ID NO: 1640770 - RNA, 11 nt, Human
ucuggggcugu

SEQ ID NO: 1640771 - RNA, 18 nt, Human
ucugguccauagagagca

SEQ ID NO: 1640772 - RNA, 16 nt, Human
ucuggguuccuuccuc

SEQ ID NO: 1640773 - RNA, 21 nt, Human
ucuuaauuaaaagaauauuuu

SEQ ID NO: 1640774 - RNA, 18 nt, Human
ucuuaauuaaaagaauau

SEQ ID NO: 1640775 - RNA, 22 nt, Human
ucuuagaugcaguucugaagaa

SEQ ID NO: 1640776 - RNA, 14 nt, Human
ucuuaugggcuggg

SEQ ID NO: 1640777 - RNA, 16 nt, Human
ucuuaugggcuggguu

SEQ ID NO: 1640778 - RNA, 15 nt, Human
ucuuaugggcugggu

SEQ ID NO: 1640779 - RNA, 22 nt, Human
ucuuauugcccacgcuggagug

SEQ ID NO: 1640780 - RNA, 18 nt, Human
ucuuauugcccacgcugg

SEQ ID NO: 1640781 - RNA, 18 nt, Human
ucuuaugggcuggguucu

SEQ ID NO: 1640782 - RNA, 14 nt, Human
ucuuauugcccacg

SEQ ID NO: 1640783 - RNA, 17 nt, Human
ucuuauuuaaugaaaga

SEQ ID NO: 1640784 - RNA, 17 nt, Human
ucuucaaaaugagcccu

SEQ ID NO: 1640785 - RNA, 22 nt, Human
ucuuccaggcugggagagccuu

SEQ ID NO: 1640786 - RNA, 23 nt, Human
agacaggcaagcaccuccugccu

SEQ ID NO: 1640787 - RNA, 16 nt, Human
agacaggaccagggau

SEQ ID NO: 1640788 - RNA, 15 nt, Human
agacaggaccaggga

SEQ ID NO: 1640789 - RNA, 21 nt, Human
agacaggguuuugccauguug

SEQ ID NO: 1640790 - RNA, 17 nt, Human
agacagucccugccaau

SEQ ID NO: 1640791 - RNA, 16 nt, Human
agacagucccugccaa

SEQ ID NO: 1640792 - RNA, 15 nt, Human
agacagucccugcca

SEQ ID NO: 1640793 - RNA, 19 nt, Human
agacagucccugccaaugg

SEQ ID NO: 1640794 - RNA, 20 nt, Human
agaauuugauaugugaacag

SEQ ID NO: 1640795 - RNA, 19 nt, Human
agaauuugauaugugaaca

SEQ ID NO: 1640796 - RNA, 18 nt, Human
agaauuugauaugugaac

SEQ ID NO: 1640797 - RNA, 17 nt, Human
agaauuugauaugugaa

SEQ ID NO: 1640798 - RNA, 22 nt, Human
agacagaaucucgcucugucgc

SEQ ID NO: 1640799 - RNA, 18 nt, Human
agacagaaucucgcucug

SEQ ID NO: 1640800 - RNA, 15 nt, Human
agacuggcacaguuu

SEQ ID NO: 1640801 - RNA, 14 nt, Human
agacuggcacaguu

SEQ ID NO: 1640802 - RNA, 18 nt, Human
agacuggcacaguuuucu

SEQ ID NO: 1640803 - RNA, 17 nt, Human
agacuucaucccucugg

SEQ ID NO: 1640804 - RNA, 14 nt, Human
agacuucaucccuc

SEQ ID NO: 1640805 - RNA, 15 nt, Human
agagaaugagagaca

SEQ ID NO: 1640806 - RNA, 15 nt, Human
agacuuuggaaagac

SEQ ID NO: 1640807 - RNA, 17 nt, Human
agagacacacugaagaa

SEQ ID NO: 1640808 - RNA, 18 nt, Human
agagaaugaaagggccca

SEQ ID NO: 1640809 - RNA, 14 nt, Human
agacuuuggaaaga

SEQ ID NO: 1640810 - RNA, 12 nt, Human
agacuuuggaaa

SEQ ID NO: 1640811 - RNA, 20 nt, Human
agagacacacugaagaagca

SEQ ID NO: 1640812 - RNA, 18 nt, Human
agagacacacugaagaag

SEQ ID NO: 1640813 - RNA, 14 nt, Human
agagaccaucccug

SEQ ID NO: 1640814 - RNA, 13 nt, Human
agagaccaucccu

SEQ ID NO: 1640815 - RNA, 15 nt, Human
agagaccaucccuga

SEQ ID NO: 1640816 - RNA, 18 nt, Human
agagaccaucccugaagg

SEQ ID NO: 1640817 - RNA, 21 nt, Human
ucuuuaaagggauggcaagau

SEQ ID NO: 1640818 - RNA, 13 nt, Human
ucuuuaauuuugg

SEQ ID NO: 1640819 - RNA, 17 nt, Human
ucuuuaaaauacacacu

SEQ ID NO: 1640820 - RNA, 15 nt, Human
ucuuuacuucaugga

SEQ ID NO: 1640821 - RNA, 18 nt, Human
ucuuuaauuuuggaauuu

SEQ ID NO: 1640822 - RNA, 17 nt, Human
ucuuuaauuuuggaauu

SEQ ID NO: 1640823 - RNA, 16 nt, Human
ucuuuaauuuuggaau

SEQ ID NO: 1640824 - RNA, 15 nt, Human
ucuuuaauuuuggaa

SEQ ID NO: 1640825 - RNA, 14 nt, Human
ucuuuaauuuugga

SEQ ID NO: 1640826 - RNA, 17 nt, Human
agacuccugcaggcagc

SEQ ID NO: 1640827 - RNA, 16 nt, Human
agacuccugcaggcag

SEQ ID NO: 1640828 - RNA, 15 nt, Human
agacuccugcaggca

SEQ ID NO: 1640829 - RNA, 14 nt, Human
agacuccugcaggc

SEQ ID NO: 1640830 - RNA, 16 nt, Human
ucuuuccugaggcugg

SEQ ID NO: 1640831 - RNA, 15 nt, Human
ucuuuccugaggcug

SEQ ID NO: 1640832 - RNA, 14 nt, Human
ucuuuccugaggcu

SEQ ID NO: 1640833 - RNA, 13 nt, Human
ucuuuccugaggc

SEQ ID NO: 1640834 - RNA, 23 nt, Human
agacuccugcaggcagccaggcc

SEQ ID NO: 1640835 - RNA, 20 nt, Human
agacuccugcaggcagccag

SEQ ID NO: 1640836 - RNA, 19 nt, Human
agacuccugcaggcagcca

SEQ ID NO: 1640837 - RNA, 18 nt, Human
agacuccugcaggcagcc

SEQ ID NO: 1640838 - RNA, 17 nt, Human
agacucuacagaggcca

SEQ ID NO: 1640839 - RNA, 21 nt, Human
agacucgcgacaaugcaaacc

SEQ ID NO: 1640840 - RNA, 19 nt, Human
agacucuacagaggccaug

SEQ ID NO: 1640841 - RNA, 14 nt, Human
agacuccaaagaaa

SEQ ID NO: 1640842 - RNA, 13 nt, Human
agacuccaaagaa

SEQ ID NO: 1640843 - RNA, 12 nt, Human
agacuccaaaga

SEQ ID NO: 1640844 - RNA, 18 nt, Human
agacucauucuucuguac

SEQ ID NO: 1640845 - RNA, 20 nt, Human
agacuauucaaacagucuca

SEQ ID NO: 1640846 - RNA, 18 nt, Human
agacuauucaaacagucu

SEQ ID NO: 1640847 - RNA, 21 nt, Human
agacuauucaaacagucucag

SEQ ID NO: 1640848 - RNA, 17 nt, Human
agacucauucuucugua

SEQ ID NO: 1640849 - RNA, 18 nt, Human
agacuaucuaaauguuga

SEQ ID NO: 1640850 - RNA, 17 nt, Human
agacuaucuaaauguug

SEQ ID NO: 1640851 - RNA, 19 nt, Human
agacuaucuaaauguugaa

SEQ ID NO: 1640852 - RNA, 12 nt, Human
agaccugccccu

SEQ ID NO: 1640853 - RNA, 13 nt, Human
agaccugccccuc

SEQ ID NO: 1640854 - RNA, 19 nt, Human
agacuccaaagaaauguaa

SEQ ID NO: 1640855 - RNA, 16 nt, Human
agacuccaaagaaaug

SEQ ID NO: 1640856 - RNA, 23 nt, Human
agacuauucaaacagucucagga

SEQ ID NO: 1640857 - RNA, 20 nt, Human
ucuugaugccuggcggggug

SEQ ID NO: 1640858 - RNA, 14 nt, Human
ucuugaugccuggc

SEQ ID NO: 1640859 - RNA, 16 nt, Human
ucuugcaauggcagcc

SEQ ID NO: 1640860 - RNA, 13 nt, Human
ucuugcaauggca

SEQ ID NO: 1640861 - RNA, 17 nt, Human
ucuugcaauggcagccu

SEQ ID NO: 1640862 - RNA, 14 nt, Human
agacccugcccugu

SEQ ID NO: 1640863 - RNA, 13 nt, Human
agacccugcccug

SEQ ID NO: 1640864 - RNA, 12 nt, Human
agacccugcccu

SEQ ID NO: 1640865 - RNA, 23 nt, Human
agacccugcccugugggccccca

SEQ ID NO: 1640866 - RNA, 21 nt, Human
agacccugcccugugggcccc

SEQ ID NO: 1640867 - RNA, 19 nt, Human
agacccugcccugugggcc

SEQ ID NO: 1640868 - RNA, 16 nt, Human
agacccugcccugugg

SEQ ID NO: 1640869 - RNA, 15 nt, Human
agacccuuguggucc

SEQ ID NO: 1640870 - RNA, 13 nt, Human
agacccuuguggu

SEQ ID NO: 1640871 - RNA, 23 nt, Human
agacccuuguggucccaccccac

SEQ ID NO: 1640872 - RNA, 22 nt, Human
agacccuuguggucccacccca

SEQ ID NO: 1640873 - RNA, 20 nt, Human
agacccuuguggucccaccc

SEQ ID NO: 1640874 - RNA, 19 nt, Human
agacccuuguggucccacc

SEQ ID NO: 1640875 - RNA, 17 nt, Human
ucucuggccuucggccu

SEQ ID NO: 1640876 - RNA, 16 nt, Human
ucucuggccuucggcc

SEQ ID NO: 1640877 - RNA, 13 nt, Human
ucucuggccuucg

SEQ ID NO: 1640878 - RNA, 22 nt, Human
ucucugcccuaaugcgcaggcu

SEQ ID NO: 1640879 - RNA, 11 nt, Human
ucucugcccua

SEQ ID NO: 1640880 - RNA, 13 nt, Human
ucucuucuuuaaa

SEQ ID NO: 1640881 - RNA, 14 nt, Human
ucucuugagagggu

SEQ ID NO: 1640882 - RNA, 12 nt, Human
ucucuucuuuaa

SEQ ID NO: 1640883 - RNA, 21 nt, Human
ucucuucuggguuccuuccuc

SEQ ID NO: 1640884 - RNA, 20 nt, Human
ucucuucuggguuccuuccu

SEQ ID NO: 1640885 - RNA, 19 nt, Human
ucucuucuggguuccuucc

SEQ ID NO: 1640886 - RNA, 18 nt, Human
ucucuucuggguuccuuc

SEQ ID NO: 1640887 - RNA, 20 nt, Human
ucuccuucaccuuugucccc

SEQ ID NO: 1640888 - RNA, 14 nt, Human
ucucuccagccccu

SEQ ID NO: 1640889 - RNA, 13 nt, Human
ucucuccagcccc

SEQ ID NO: 1640890 - RNA, 15 nt, Human
ucucuccagccccug

SEQ ID NO: 1640891 - RNA, 16 nt, Human
ucucuccagccccugg

SEQ ID NO: 1640892 - RNA, 20 nt, Human
ucucuccuguaccucuugag

SEQ ID NO: 1640893 - RNA, 22 nt, Human
ucucuccuguaccucuugagcc

SEQ ID NO: 1640894 - RNA, 19 nt, Human
agaaaacaaggaugaauua

SEQ ID NO: 1640895 - RNA, 17 nt, Human
agaaaaaugagccuggc

SEQ ID NO: 1640896 - RNA, 19 nt, Human
agaaaaauaugaccacacu

SEQ ID NO: 1640897 - RNA, 14 nt, Human
ucucuugagccugg

SEQ ID NO: 1640898 - RNA, 13 nt, Human
ucucuugagccug

SEQ ID NO: 1640899 - RNA, 15 nt, Human
ucucuugagccuggg

SEQ ID NO: 1640900 - RNA, 17 nt, Human
ucucuugagccugggag

SEQ ID NO: 1640901 - RNA, 22 nt, Human
ucucuuuaaugucacaggcagg

SEQ ID NO: 1640902 - RNA, 15 nt, Human
agaaacuggaacucu

SEQ ID NO: 1640903 - RNA, 13 nt, Human
agaaacuggaacu

SEQ ID NO: 1640904 - RNA, 19 nt, Human
agaaaacuuguauuaugug

SEQ ID NO: 1640905 - RNA, 15 nt, Human
ucucccagucauuua

SEQ ID NO: 1640906 - RNA, 18 nt, Human
ucucccuuggauuguccc

SEQ ID NO: 1640907 - RNA, 11 nt, Human
ucucccuugga

SEQ ID NO: 1640908 - RNA, 18 nt, Human
ucucccaaagugcuggga

SEQ ID NO: 1640909 - RNA, 19 nt, Human
ucuccauuuaauaauuaua

SEQ ID NO: 1640910 - RNA, 16 nt, Human
ucuccauuuaauaauu

SEQ ID NO: 1640911 - RNA, 12 nt, Human
ucuccauuuaau

SEQ ID NO: 1640912 - RNA, 21 nt, Human
ucucccuuggauuguccccga

SEQ ID NO: 1640913 - RNA, 19 nt, Human
ucucccuuggauugucccc

SEQ ID NO: 1640914 - RNA, 12 nt, Human
ucuccucugcug

SEQ ID NO: 1640915 - RNA, 14 nt, Human
ucuccucugcugcu

SEQ ID NO: 1640916 - RNA, 13 nt, Human
ucuccucugcugc

SEQ ID NO: 1640917 - RNA, 15 nt, Human
ucuccucugcugcug

SEQ ID NO: 1640918 - RNA, 23 nt, Human
acuuguguaaauacaauuuuguu

SEQ ID NO: 1640919 - RNA, 22 nt, Human
acuuguguaaauacaauuuugu

SEQ ID NO: 1640920 - RNA, 21 nt, Human
acuuguguaaauacaauuuug

SEQ ID NO: 1640921 - RNA, 21 nt, Human
acuuguugauuaauggaaaug

SEQ ID NO: 1640922 - RNA, 19 nt, Human
acuuguugauuaauggaaa

SEQ ID NO: 1640923 - RNA, 18 nt, Human
acuuuaccuuuuuuauac

SEQ ID NO: 1640924 - RNA, 19 nt, Human
acuuuaccuuuuuuauaca

SEQ ID NO: 1640925 - RNA, 22 nt, Human
acuuuaccuuuuuuauacauaa

SEQ ID NO: 1640926 - RNA, 23 nt, Human
acuuuaccuuuuuuauacauaaa

SEQ ID NO: 1640927 - RNA, 19 nt, Human
acuuugaccucugcagcaa

SEQ ID NO: 1640928 - RNA, 23 nt, Human
acuuugaccucugcagcaauaaa

SEQ ID NO: 1640929 - RNA, 14 nt, Human
acuuuggaaagacu

SEQ ID NO: 1640930 - RNA, 13 nt, Human
acuuuggaaagac

SEQ ID NO: 1640931 - RNA, 17 nt, Human
acuuuggaaagacuuuu

SEQ ID NO: 1640932 - RNA, 23 nt, Human
acuuuggaaagacuuuuccaacc

SEQ ID NO: 1640933 - RNA, 22 nt, Human
acuuuuuuuuuuuaagaguaaa

SEQ ID NO: 1640934 - RNA, 14 nt, Human
acuuuuggcauuuu

SEQ ID NO: 1640935 - RNA, 22 nt, Human
acuuuuuauggcacuaguauuu

SEQ ID NO: 1640936 - RNA, 15 nt, Human
agaacucccuuucaa

SEQ ID NO: 1640937 - RNA, 14 nt, Human
agaacucccuuuca

SEQ ID NO: 1640938 - RNA, 22 nt, Human
agaaccucuuugucuacaccau

SEQ ID NO: 1640939 - RNA, 15 nt, Human
ucugcagauaaacag

SEQ ID NO: 1640940 - RNA, 12 nt, Human
ucugcagagcag

SEQ ID NO: 1640941 - RNA, 11 nt, Human
agaaauguguu

SEQ ID NO: 1640942 - RNA, 17 nt, Human
agaaauguacagcaagg

SEQ ID NO: 1640943 - RNA, 16 nt, Human
agaaauguacagcaag

SEQ ID NO: 1640944 - RNA, 23 nt, Human
agaaagacuauucaaacagucuc

SEQ ID NO: 1640945 - RNA, 20 nt, Human
agaaagacuauucaaacagu

SEQ ID NO: 1640946 - RNA, 19 nt, Human
agaaagacuauucaaacag

SEQ ID NO: 1640947 - RNA, 19 nt, Human
ucugacccugcuucaaaua

SEQ ID NO: 1640948 - RNA, 20 nt, Human
ucugagaaagacuauucaaa

SEQ ID NO: 1640949 - RNA, 19 nt, Human
ucugagaaagacuauucaa

SEQ ID NO: 1640950 - RNA, 15 nt, Human
ucugagaaagacuau

SEQ ID NO: 1640951 - RNA, 14 nt, Human
ucugagaaagacua

SEQ ID NO: 1640952 - RNA, 21 nt, Human
ucugacuguuuccaucaaggg

SEQ ID NO: 1640953 - RNA, 22 nt, Human
ucugagaaagacuauucaaaca

SEQ ID NO: 1640954 - RNA, 21 nt, Human
ucugagaaagacuauucaaac

SEQ ID NO: 1640955 - RNA, 23 nt, Human
ucugagaaagacuauucaaacag

SEQ ID NO: 1640956 - RNA, 21 nt, Human
ucugauucccaagcucugcuc

SEQ ID NO: 1640957 - RNA, 20 nt, Human
ucugauucccaagcucugcu

SEQ ID NO: 1640958 - RNA, 19 nt, Human
ucugauucccaagcucugc

SEQ ID NO: 1640959 - RNA, 17 nt, Human
ucugauacagaaaaguu

SEQ ID NO: 1640960 - RNA, 16 nt, Human
ucugauacagaaaagu

SEQ ID NO: 1640961 - RNA, 11 nt, Human
ucugcuugcca

SEQ ID NO: 1640962 - RNA, 13 nt, Human
ucugcuucagccu

SEQ ID NO: 1640963 - RNA, 16 nt, Human
ucugcucacauaucug

SEQ ID NO: 1640964 - RNA, 17 nt, Human
ucugcucacauaucugu

SEQ ID NO: 1640965 - RNA, 21 nt, Human
agaagaacugaaaucauacuu

SEQ ID NO: 1640966 - RNA, 18 nt, Human
ucugcccuccaagaccuu

SEQ ID NO: 1640967 - RNA, 14 nt, Human
ucugcccuccaaga

SEQ ID NO: 1640968 - RNA, 13 nt, Human
ucugccuaaggac

SEQ ID NO: 1640969 - RNA, 16 nt, Human
ucugccuaaggacuuc

SEQ ID NO: 1640970 - RNA, 15 nt, Human
ucugccuaaggacuu

SEQ ID NO: 1640971 - RNA, 14 nt, Human
ucugccuaaggacu

SEQ ID NO: 1640972 - RNA, 12 nt, Human
ucugcuugccau

SEQ ID NO: 1640973 - RNA, 14 nt, Human
ucugcuugccaucc

SEQ ID NO: 1640974 - RNA, 15 nt, Human
ucuggcagcucagag

SEQ ID NO: 1640975 - RNA, 14 nt, Human
ucuggcagcucaga

SEQ ID NO: 1640976 - RNA, 18 nt, Human
ucuggauuauauuaugaa

SEQ ID NO: 1640977 - RNA, 12 nt, Human
ucuggauuauau

SEQ ID NO: 1640978 - RNA, 14 nt, Human
agaagcuccaggua

SEQ ID NO: 1640979 - RNA, 16 nt, Human
agaagcggcuggcagc

SEQ ID NO: 1640980 - RNA, 15 nt, Human
agaagcggcuggcag

SEQ ID NO: 1640981 - RNA, 16 nt, Human
ucuggcagcucagaga

SEQ ID NO: 1640982 - RNA, 19 nt, Human
agccugaucaccugcccug

SEQ ID NO: 1640983 - RNA, 14 nt, Human
agccugauuaaaga

SEQ ID NO: 1640984 - RNA, 16 nt, Human
ugcaugcugucccuua

SEQ ID NO: 1640985 - RNA, 18 nt, Human
agccugaucaccugcccu

SEQ ID NO: 1640986 - RNA, 16 nt, Human
agccugcacggugaau

SEQ ID NO: 1640987 - RNA, 18 nt, Human
agccugcacggugaaugg

SEQ ID NO: 1640988 - RNA, 23 nt, Human
agccugcaguuauuaacacuaac

SEQ ID NO: 1640989 - RNA, 19 nt, Human
agccugccucuucucuacu

SEQ ID NO: 1640990 - RNA, 16 nt, Human
agccugccucuucucu

SEQ ID NO: 1640991 - RNA, 12 nt, Human
agccugcccucc

SEQ ID NO: 1640992 - RNA, 22 nt, Human
ugcauaccacuuuuguucuugg

SEQ ID NO: 1640993 - RNA, 15 nt, Human
ugcaugcugucccuu

SEQ ID NO: 1640994 - RNA, 14 nt, Human
ugcaugcugucccu

SEQ ID NO: 1640995 - RNA, 13 nt, Human
ugcaugcuguccc

SEQ ID NO: 1640996 - RNA, 21 nt, Human
ugcaugaggcuaguguggugu

SEQ ID NO: 1640997 - RNA, 22 nt, Human
ugcaugaaguaauaugcacaca

SEQ ID NO: 1640998 - RNA, 20 nt, Human
ugcaugaaguaauaugcaca

SEQ ID NO: 1640999 - RNA, 19 nt, Human
ugcagugagccgagauugu

SEQ ID NO: 1641000 - RNA, 11 nt, Human
ugcauaaaaug

SEQ ID NO: 1641001 - RNA, 15 nt, Human
ugcauaauggucaga

SEQ ID NO: 1641002 - RNA, 22 nt, Human
ugcauaacguauaaaagccugu

SEQ ID NO: 1641003 - RNA, 14 nt, Human
ugcagugagccgag

SEQ ID NO: 1641004 - RNA, 21 nt, Human
ugcaggucccuaauaaagcug

SEQ ID NO: 1641005 - RNA, 20 nt, Human
ugcaggucccuaauaaagcu

SEQ ID NO: 1641006 - RNA, 19 nt, Human
ugcaggucccuaauaaagc

SEQ ID NO: 1641007 - RNA, 18 nt, Human
ugcaggucccuaauaaag

SEQ ID NO: 1641008 - RNA, 18 nt, Human
agccugagcgacagugag

SEQ ID NO: 1641009 - RNA, 19 nt, Human
agccucaaccuccugggcu

SEQ ID NO: 1641010 - RNA, 15 nt, Human
agccucagcauccug

SEQ ID NO: 1641011 - RNA, 16 nt, Human
agccucagcauccugg

SEQ ID NO: 1641012 - RNA, 14 nt, Human
agccucagcauccu

SEQ ID NO: 1641013 - RNA, 13 nt, Human
agccucagcaucc

SEQ ID NO: 1641014 - RNA, 18 nt, Human
agccucaaccuccugggc

SEQ ID NO: 1641015 - RNA, 17 nt, Human
agccucaaccuccuggg

SEQ ID NO: 1641016 - RNA, 19 nt, Human
agccugagcgacagugaga

SEQ ID NO: 1641017 - RNA, 19 nt, Human
ugcagccucaaccuccugg

SEQ ID NO: 1641018 - RNA, 18 nt, Human
ugcagccucaaccuccug

SEQ ID NO: 1641019 - RNA, 20 nt, Human
ugcagccucaaccuccuggg

SEQ ID NO: 1641020 - RNA, 19 nt, Human
agcccuucuuuccacagaa

SEQ ID NO: 1641021 - RNA, 18 nt, Human
agcccuucuuuccacaga

SEQ ID NO: 1641022 - RNA, 23 nt, Human
agccguuuguuccccaagacauu

SEQ ID NO: 1641023 - RNA, 15 nt, Human
agccucaaccuccug

SEQ ID NO: 1641024 - RNA, 17 nt, Human
agccuaggugacagagu

SEQ ID NO: 1641025 - RNA, 15 nt, Human
agccuaggugacaga

SEQ ID NO: 1641026 - RNA, 22 nt, Human
ugcagacucuacagaggccaug

SEQ ID NO: 1641027 - RNA, 14 nt, Human
agcccuucauuugg

SEQ ID NO: 1641028 - RNA, 13 nt, Human
agcccuucauuug

SEQ ID NO: 1641029 - RNA, 23 nt, Human
agcccuuccaugucgccucugca

SEQ ID NO: 1641030 - RNA, 22 nt, Human
agcccuuccaugucgccucugc

SEQ ID NO: 1641031 - RNA, 19 nt, Human
agcccuuccaugucgccuc

SEQ ID NO: 1641032 - RNA, 15 nt, Human
ugcacuccccugcug

SEQ ID NO: 1641033 - RNA, 20 nt, Human
ugcagacucuacagaggcca

SEQ ID NO: 1641034 - RNA, 19 nt, Human
ugcagacucuacagaggcc

SEQ ID NO: 1641035 - RNA, 13 nt, Human
ugcacuccccugc

SEQ ID NO: 1641036 - RNA, 12 nt, Human
ugcacuccccug

SEQ ID NO: 1641037 - RNA, 22 nt, Human
ugcacuauagccuaggugacag

SEQ ID NO: 1641038 - RNA, 15 nt, Human
ugcaccacugcacuc

SEQ ID NO: 1641039 - RNA, 14 nt, Human
ugcaccacugcacu

SEQ ID NO: 1641040 - RNA, 23 nt, Human
ugcacaagcuccaagcucccagg

SEQ ID NO: 1641041 - RNA, 22 nt, Human
ugcacaagcuccaagcucccag

SEQ ID NO: 1641042 - RNA, 20 nt, Human
ugcacaagcuccaagcuccc

SEQ ID NO: 1641043 - RNA, 18 nt, Human
ugcacaagcuccaagcuc

SEQ ID NO: 1641044 - RNA, 16 nt, Human
ugcacaagcuccaagc

SEQ ID NO: 1641045 - RNA, 15 nt, Human
ugcacaagcuccaag

SEQ ID NO: 1641046 - RNA, 15 nt, Human
ugcacacaccagagc

SEQ ID NO: 1641047 - RNA, 14 nt, Human
ugcacaagcugcac

SEQ ID NO: 1641048 - RNA, 19 nt, Human
agcuauggugucauaggcu

SEQ ID NO: 1641049 - RNA, 19 nt, Human
ugccauguuggccaggcug

SEQ ID NO: 1641050 - RNA, 18 nt, Human
ugccauguuggccaggcu

SEQ ID NO: 1641051 - RNA, 17 nt, Human
ugccauguuggccaggc

SEQ ID NO: 1641052 - RNA, 17 nt, Human
agcucagggccuggcuc

SEQ ID NO: 1641053 - RNA, 16 nt, Human
agcucagggccuggcu

SEQ ID NO: 1641054 - RNA, 15 nt, Human
agcucagggccuggc

SEQ ID NO: 1641055 - RNA, 21 nt, Human
ugccauguuggccaggcuggu

SEQ ID NO: 1641056 - RNA, 20 nt, Human
ugccauguuggccaggcugg

SEQ ID NO: 1641057 - RNA, 18 nt, Human
agcucagggccuggcuca

SEQ ID NO: 1641058 - RNA, 22 nt, Human
ugcccaaccugcucuccucuug

SEQ ID NO: 1641059 - RNA, 18 nt, Human
ugcccaaccugcucuccu

SEQ ID NO: 1641060 - RNA, 24 nt, Human
ugcccaaccugcucuccucuugcc

SEQ ID NO: 1641061 - RNA, 23 nt, Human
ugcccaaccugcucuccucuugc

SEQ ID NO: 1641062 - RNA, 11 nt, Human
ugcccaggccc

SEQ ID NO: 1641063 - RNA, 20 nt, Human
ugcccaggcaggucuugaac

SEQ ID NO: 1641064 - RNA, 17 nt, Human
ugcccaggcaggucuug

SEQ ID NO: 1641065 - RNA, 16 nt, Human
ugcccaggcaggucuu

SEQ ID NO: 1641066 - RNA, 15 nt, Human
ugcccaggcaggucu

SEQ ID NO: 1641067 - RNA, 14 nt, Human
ugcccacaggauca

SEQ ID NO: 1641068 - RNA, 22 nt, Human
ugcccaggccccugccacccug

SEQ ID NO: 1641069 - RNA, 20 nt, Human
ugcccaggccccugccaccc

SEQ ID NO: 1641070 - RNA, 14 nt, Human
ugcccaggccccug

SEQ ID NO: 1641071 - RNA, 16 nt, Human
ugcccacaggaucagu

SEQ ID NO: 1641072 - RNA, 12 nt, Human
ugcccaggcccc

SEQ ID NO: 1641073 - RNA, 17 nt, Human
ugcccaggccugccugu

SEQ ID NO: 1641074 - RNA, 15 nt, Human
ugcccaggccugccu

SEQ ID NO: 1641075 - RNA, 12 nt, Human
ugccccccagcc

SEQ ID NO: 1641076 - RNA, 19 nt, Human
ugccccucaacucuccucc

SEQ ID NO: 1641077 - RNA, 18 nt, Human
ugccccgucccccucugg

SEQ ID NO: 1641078 - RNA, 16 nt, Human
ugccccgucccccucu

SEQ ID NO: 1641079 - RNA, 23 nt, Human
agcgugguggacaugcacagcua

SEQ ID NO: 1641080 - RNA, 17 nt, Human
agcgugagccacugcac

SEQ ID NO: 1641081 - RNA, 16 nt, Human
agcgugagccacugca

SEQ ID NO: 1641082 - RNA, 20 nt, Human
agcgugguggacaugcacag

SEQ ID NO: 1641083 - RNA, 21 nt, Human
ugccauauucuguuggccagu

SEQ ID NO: 1641084 - RNA, 20 nt, Human
ugccauauucuguuggccag

SEQ ID NO: 1641085 - RNA, 15 nt, Human
agcggggacagcucc

SEQ ID NO: 1641086 - RNA, 17 nt, Human
agcggggacagcuccuu

SEQ ID NO: 1641087 - RNA, 16 nt, Human
agcggggacagcuccu

SEQ ID NO: 1641088 - RNA, 15 nt, Human
agcgugagccacugc

SEQ ID NO: 1641089 - RNA, 17 nt, Human
ugccauauucuguuggc

SEQ ID NO: 1641090 - RNA, 16 nt, Human
ugccauauucuguugg

SEQ ID NO: 1641091 - RNA, 15 nt, Human
ugccauauucuguug

SEQ ID NO: 1641092 - RNA, 23 nt, Human
ugccagucaccccggccaccugc

SEQ ID NO: 1641093 - RNA, 22 nt, Human
ugccagucaccccggccaccug

SEQ ID NO: 1641094 - RNA, 17 nt, Human
ugccagucccccugccc

SEQ ID NO: 1641095 - RNA, 20 nt, Human
ugccagucccccugccccag

SEQ ID NO: 1641096 - RNA, 19 nt, Human
ugccagucccccugcccca

SEQ ID NO: 1641097 - RNA, 20 nt, Human
ugccagucaccccggccacc

SEQ ID NO: 1641098 - RNA, 18 nt, Human
ugccagucaccccggcca

SEQ ID NO: 1641099 - RNA, 16 nt, Human
ugccagucaccccggc

SEQ ID NO: 1641100 - RNA, 15 nt, Human
ugccagucaccccgg

SEQ ID NO: 1641101 - RNA, 12 nt, Human
ugccacacuuca

SEQ ID NO: 1641102 - RNA, 23 nt, Human
ugccacugccucuuccucccuca

SEQ ID NO: 1641103 - RNA, 22 nt, Human
agcgcccaguuggguggaugcc

SEQ ID NO: 1641104 - RNA, 14 nt, Human
agcgcccaguuggg

SEQ ID NO: 1641105 - RNA, 14 nt, Human
agccugcuccagcu

SEQ ID NO: 1641106 - RNA, 20 nt, Human
agcgcccacuagacccacug

SEQ ID NO: 1641107 - RNA, 19 nt, Human
ugcauuugaaaauuuugau

SEQ ID NO: 1641108 - RNA, 23 nt, Human
ugcauuugaaaauuuugauguuu

SEQ ID NO: 1641109 - RNA, 14 nt, Human
ugcauuuccugaca

SEQ ID NO: 1641110 - RNA, 18 nt, Human
ugcauuugaggucuguuc

SEQ ID NO: 1641111 - RNA, 13 nt, Human
agcuggaaaagua

SEQ ID NO: 1641112 - RNA, 10 nt, Human
agcugccugu

SEQ ID NO: 1641113 - RNA, 19 nt, Human
agcugccugggaucccuca

SEQ ID NO: 1641114 - RNA, 13 nt, Human
agcugccugggau

SEQ ID NO: 1641115 - RNA, 21 nt, Human
agcugccugggaucccucauc

SEQ ID NO: 1641116 - RNA, 18 nt, Human
agcugccuccccuccucu

SEQ ID NO: 1641117 - RNA, 19 nt, Human
agcugccuccccuccucug

SEQ ID NO: 1641118 - RNA, 20 nt, Human
agcugccuccccuccucugc

SEQ ID NO: 1641119 - RNA, 22 nt, Human
ugccucugacacacagcucugu

SEQ ID NO: 1641120 - RNA, 21 nt, Human
ugccucucugcaggucccuaa

SEQ ID NO: 1641121 - RNA, 23 nt, Human
agcugccuccccuccucugcuug

SEQ ID NO: 1641122 - RNA, 21 nt, Human
agcugccuccccuccucugcu

SEQ ID NO: 1641123 - RNA, 22 nt, Human
agcugccuccccuccucugcuu

SEQ ID NO: 1641124 - RNA, 23 nt, Human
agcugggaugauuggagggggga

SEQ ID NO: 1641125 - RNA, 21 nt, Human
agcugggauuacaggcuccug

SEQ ID NO: 1641126 - RNA, 18 nt, Human
agcugggauuacaggcuc

SEQ ID NO: 1641127 - RNA, 22 nt, Human
agcugggaucacauguggacuu

SEQ ID NO: 1641128 - RNA, 19 nt, Human
agcugggacuacaggugug

SEQ ID NO: 1641129 - RNA, 17 nt, Human
agcugggacuacaggug

SEQ ID NO: 1641130 - RNA, 14 nt, Human
agcugggcagguug

SEQ ID NO: 1641131 - RNA, 23 nt, Human
agcugggauuacaggcuccugcc

SEQ ID NO: 1641132 - RNA, 22 nt, Human
agcugggauuacaggcuccugc

SEQ ID NO: 1641133 - RNA, 17 nt, Human
agcuggggccaggcugg

SEQ ID NO: 1641134 - RNA, 18 nt, Human
ugcggacagccacggcca

SEQ ID NO: 1641135 - RNA, 19 nt, Human
ugcgaaaggaugaaaguga

SEQ ID NO: 1641136 - RNA, 13 nt, Human
ugcgaaaggauga

SEQ ID NO: 1641137 - RNA, 21 nt, Human
ugccuuuuucauuauuuuauu

SEQ ID NO: 1641138 - RNA, 17 nt, Human
ugccuuuuucauuauuu

SEQ ID NO: 1641139 - RNA, 16 nt, Human
ugccuuuuucauuauu

SEQ ID NO: 1641140 - RNA, 15 nt, Human
ugccuuuuucauuau

SEQ ID NO: 1641141 - RNA, 14 nt, Human
ugccuuuuucauua

SEQ ID NO: 1641142 - RNA, 13 nt, Human
ugccuuuuucauu

SEQ ID NO: 1641143 - RNA, 17 nt, Human
ugccuguucagcuccag

SEQ ID NO: 1641144 - RNA, 16 nt, Human
ugccuguucagcucca

SEQ ID NO: 1641145 - RNA, 15 nt, Human
ugccuguucagcucc

SEQ ID NO: 1641146 - RNA, 17 nt, Human
ugccuuagaaccuuucu

SEQ ID NO: 1641147 - RNA, 14 nt, Human
ugccuuagaaccuu

SEQ ID NO: 1641148 - RNA, 21 nt, Human
ugccuuagaaccuuucuuaca

SEQ ID NO: 1641149 - RNA, 20 nt, Human
agcuggggccaggcuggguc

SEQ ID NO: 1641150 - RNA, 14 nt, Human
agcucuguccuggg

SEQ ID NO: 1641151 - RNA, 12 nt, Human
agcucuguccug

SEQ ID NO: 1641152 - RNA, 18 nt, Human
agcucuucuccaggcugu

SEQ ID NO: 1641153 - RNA, 22 nt, Human
agcugcacccucaggcaggugg

SEQ ID NO: 1641154 - RNA, 20 nt, Human
agcugcacccucaggcaggu

SEQ ID NO: 1641155 - RNA, 19 nt, Human
agcugcacccucaggcagg

SEQ ID NO: 1641156 - RNA, 18 nt, Human
agcugcacccucaggcag

SEQ ID NO: 1641157 - RNA, 17 nt, Human
agcugcacccucaggca

SEQ ID NO: 1641158 - RNA, 13 nt, Human
agcugcacccuca

SEQ ID NO: 1641159 - RNA, 12 nt, Human
agcucugcuccu

SEQ ID NO: 1641160 - RNA, 22 nt, Human
agcucugcuccucuccccagca

SEQ ID NO: 1641161 - RNA, 16 nt, Human
agcucucuccucccuu

SEQ ID NO: 1641162 - RNA, 20 nt, Human
ugcccuccaagaccuucucc

SEQ ID NO: 1641163 - RNA, 19 nt, Human
ugcccuccaagaccuucuc

SEQ ID NO: 1641164 - RNA, 22 nt, Human
ugcccuccaagaccuucuccuu

SEQ ID NO: 1641165 - RNA, 22 nt, Human
agcucuaucaccaaggagccaa

SEQ ID NO: 1641166 - RNA, 13 nt, Human
agcugccaccugc

SEQ ID NO: 1641167 - RNA, 14 nt, Human
agcugccagccgag

SEQ ID NO: 1641168 - RNA, 18 nt, Human
agcugcauacaguuugca

SEQ ID NO: 1641169 - RNA, 15 nt, Human
ugcccuuucugggca

SEQ ID NO: 1641170 - RNA, 14 nt, Human
ugccucucucaggc

SEQ ID NO: 1641171 - RNA, 13 nt, Human
ugccucucucagg

SEQ ID NO: 1641172 - RNA, 19 nt, Human
ugccucccaucacccgcua

SEQ ID NO: 1641173 - RNA, 14 nt, Human
ugccucccaucacc

SEQ ID NO: 1641174 - RNA, 13 nt, Human
ugccucccaucac

SEQ ID NO: 1641175 - RNA, 15 nt, Human
ugccucucucaggcc

SEQ ID NO: 1641176 - RNA, 16 nt, Human
ugccucucucaggcca

SEQ ID NO: 1641177 - RNA, 18 nt, Human
ugccucucugcagguccc

SEQ ID NO: 1641178 - RNA, 16 nt, Human
ugccucucugcagguc

SEQ ID NO: 1641179 - RNA, 21 nt, Human
ugccucugacacacagcucug

SEQ ID NO: 1641180 - RNA, 20 nt, Human
ugccucugacacacagcucu

SEQ ID NO: 1641181 - RNA, 20 nt, Human
ugccucucugcaggucccua

SEQ ID NO: 1641182 - RNA, 19 nt, Human
ugccucucugcaggucccu

SEQ ID NO: 1641183 - RNA, 14 nt, Human
ugcuaguaauugga

SEQ ID NO: 1641184 - RNA, 19 nt, Human
aggaaagcaaaggagauug

SEQ ID NO: 1641185 - RNA, 17 nt, Human
aggaaagcaaaggagau

SEQ ID NO: 1641186 - RNA, 16 nt, Human
aggaaagaggcucugg

SEQ ID NO: 1641187 - RNA, 16 nt, Human
ugcuaguaauuggaaa

SEQ ID NO: 1641188 - RNA, 21 nt, Human
ugcuauaacuauguugauaaa

SEQ ID NO: 1641189 - RNA, 19 nt, Human
aggaaagagaacuuccaga

SEQ ID NO: 1641190 - RNA, 13 nt, Human
aggaaagagaacu

SEQ ID NO: 1641191 - RNA, 13 nt, Human
aggaaagaggcuc

SEQ ID NO: 1641192 - RNA, 12 nt, Human
aggaaagaggcu

SEQ ID NO: 1641193 - RNA, 17 nt, Human
aggaaacccagcucugg

SEQ ID NO: 1641194 - RNA, 16 nt, Human
aggaaacccagcucug

SEQ ID NO: 1641195 - RNA, 15 nt, Human
aggaaacccagcucu

SEQ ID NO: 1641196 - RNA, 20 nt, Human
aggaaacccagcucuggucc

SEQ ID NO: 1641197 - RNA, 18 nt, Human
aggaaacccagcucuggu

SEQ ID NO: 1641198 - RNA, 21 nt, Human
aggaaacccagcucuggucca

SEQ ID NO: 1641199 - RNA, 19 nt, Human
agcuuugaaaauucagugg

SEQ ID NO: 1641200 - RNA, 18 nt, Human
agcuuugaaaauucagug

SEQ ID NO: 1641201 - RNA, 16 nt, Human
agcuuugaaaauucag

SEQ ID NO: 1641202 - RNA, 12 nt, Human
agcuuugaaaau

SEQ ID NO: 1641203 - RNA, 21 nt, Human
aggaaaaguuuaauauuaaag

SEQ ID NO: 1641204 - RNA, 24 nt, Human
aggaaaaguuuaauauuaaagcca

SEQ ID NO: 1641205 - RNA, 23 nt, Human
aggaaaaguuuaauauuaaagcc

SEQ ID NO: 1641206 - RNA, 20 nt, Human
agcuuauuaaaacucauuuu

SEQ ID NO: 1641207 - RNA, 15 nt, Human
agcuuauuaaaacuc

SEQ ID NO: 1641208 - RNA, 21 nt, Human
agcuuauugucuagugaaacu

SEQ ID NO: 1641209 - RNA, 21 nt, Human
agcuuguaaauagcucaggug

SEQ ID NO: 1641210 - RNA, 20 nt, Human
agcuuguaaauagcucaggu

SEQ ID NO: 1641211 - RNA, 19 nt, Human
agcuuguaaauagcucagg

SEQ ID NO: 1641212 - RNA, 21 nt, Human
ugcggacagccacggccaggc

SEQ ID NO: 1641213 - RNA, 20 nt, Human
ugcggacagccacggccagg

SEQ ID NO: 1641214 - RNA, 15 nt, Human
agcuuaucucagggg

SEQ ID NO: 1641215 - RNA, 14 nt, Human
agcuuaucucaggg

SEQ ID NO: 1641216 - RNA, 12 nt, Human
agcuuaucucag

SEQ ID NO: 1641217 - RNA, 20 nt, Human
agcuuaaaggggcuagagug

SEQ ID NO: 1641218 - RNA, 23 nt, Human
aggaauucuguauagauuagaau

SEQ ID NO: 1641219 - RNA, 19 nt, Human
aggaauugacccacaagaa

SEQ ID NO: 1641220 - RNA, 16 nt, Human
aggaauucuguauaga

SEQ ID NO: 1641221 - RNA, 22 nt, Human
aggaauucuguauagauuagaa

SEQ ID NO: 1641222 - RNA, 17 nt, Human
aggaauucuguauagau

SEQ ID NO: 1641223 - RNA, 23 nt, Human
aggaauccagacccggcugcgug

SEQ ID NO: 1641224 - RNA, 19 nt, Human
aggaaaucaaauaugcaaa

SEQ ID NO: 1641225 - RNA, 15 nt, Human
aggaagacuuuggaa

SEQ ID NO: 1641226 - RNA, 14 nt, Human
aggaagagaaaaaa

SEQ ID NO: 1641227 - RNA, 22 nt, Human
aggaagcucagggccuggcuca

SEQ ID NO: 1641228 - RNA, 18 nt, Human
aggaagcucagggccugg

SEQ ID NO: 1641229 - RNA, 17 nt, Human
aggaagcucagggccug

SEQ ID NO: 1641230 - RNA, 15 nt, Human
ugcugccauccaggu

SEQ ID NO: 1641231 - RNA, 14 nt, Human
ugcugccauccagg

SEQ ID NO: 1641232 - RNA, 13 nt, Human
ugcugccauccag

SEQ ID NO: 1641233 - RNA, 12 nt, Human
ugcugccaucca

SEQ ID NO: 1641234 - RNA, 22 nt, Human
ugcugccauccagguucagcuu

SEQ ID NO: 1641235 - RNA, 21 nt, Human
ugcugccauccagguucagcu

SEQ ID NO: 1641236 - RNA, 16 nt, Human
ugcugcccagccucca

SEQ ID NO: 1641237 - RNA, 14 nt, Human
ugcugcccagccuc

SEQ ID NO: 1641238 - RNA, 11 nt, Human
ugcugccaucc

SEQ ID NO: 1641239 - RNA, 22 nt, Human
ugcugccacacuucaggcucuu

SEQ ID NO: 1641240 - RNA, 19 nt, Human
ugcugccacacuucaggcu

SEQ ID NO: 1641241 - RNA, 16 nt, Human
ugcugccacacuucag

SEQ ID NO: 1641242 - RNA, 15 nt, Human
ugcugccacacuuca

SEQ ID NO: 1641243 - RNA, 22 nt, Human
aggaauuuuauuuuuuucugaa

SEQ ID NO: 1641244 - RNA, 18 nt, Human
aggaaauauuuauuuuaa

SEQ ID NO: 1641245 - RNA, 14 nt, Human
aggaaauauuuauu

SEQ ID NO: 1641246 - RNA, 23 nt, Human
aggaaaggcuccaggagcagcca

SEQ ID NO: 1641247 - RNA, 22 nt, Human
aggaaaggcuccaggagcagcc

SEQ ID NO: 1641248 - RNA, 20 nt, Human
aggaaaggcuccaggagcag

SEQ ID NO: 1641249 - RNA, 18 nt, Human
aggaaaggcuccaggagc

SEQ ID NO: 1641250 - RNA, 14 nt, Human
ugcugagucugaag

SEQ ID NO: 1641251 - RNA, 22 nt, Human
ugcugagucccaggcugagccu

SEQ ID NO: 1641252 - RNA, 18 nt, Human
ugcugagucccaggcuga

SEQ ID NO: 1641253 - RNA, 15 nt, Human
ugcugagucccaggc

SEQ ID NO: 1641254 - RNA, 24 nt, Human
ugcugacuguuuucucuugagagg

SEQ ID NO: 1641255 - RNA, 21 nt, Human
ugcugacuguuuucucuugag

SEQ ID NO: 1641256 - RNA, 18 nt, Human
ugcucugcauguuacaua

SEQ ID NO: 1641257 - RNA, 15 nt, Human
ugcucugcauguuac

SEQ ID NO: 1641258 - RNA, 17 nt, Human
ugcugacuguuuucucu

SEQ ID NO: 1641259 - RNA, 22 nt, Human
ugcucugaucauccacugugcc

SEQ ID NO: 1641260 - RNA, 19 nt, Human
ugcucugaugaagaggagu

SEQ ID NO: 1641261 - RNA, 18 nt, Human
ugcucugaugaagaggag

SEQ ID NO: 1641262 - RNA, 23 nt, Human
agggacuucugucuucacaacag

SEQ ID NO: 1641263 - RNA, 15 nt, Human
agggacuuggaagcu

SEQ ID NO: 1641264 - RNA, 19 nt, Human
agggacuuggaagcuccgc

SEQ ID NO: 1641265 - RNA, 18 nt, Human
agggacuuggaagcuccg

SEQ ID NO: 1641266 - RNA, 13 nt, Human
agggaaauuucag

SEQ ID NO: 1641267 - RNA, 14 nt, Human
agggagagaagaua

SEQ ID NO: 1641268 - RNA, 13 nt, Human
agggagagaagau

SEQ ID NO: 1641269 - RNA, 20 nt, Human
agggacuuggaagcuccgcu

SEQ ID NO: 1641270 - RNA, 16 nt, Human
ugggacuacaggugug

SEQ ID NO: 1641271 - RNA, 18 nt, Human
ugggacucaaugcacuga

SEQ ID NO: 1641272 - RNA, 13 nt, Human
ugggacuggccuc

SEQ ID NO: 1641273 - RNA, 15 nt, Human
ugggagaaaugaaaa

SEQ ID NO: 1641274 - RNA, 16 nt, Human
ugggacuggccucugc

SEQ ID NO: 1641275 - RNA, 14 nt, Human
ugggacuggccucu

SEQ ID NO: 1641276 - RNA, 18 nt, Human
ugggacuacaggcaccca

SEQ ID NO: 1641277 - RNA, 18 nt, Human
agggagcaucagugcccu

SEQ ID NO: 1641278 - RNA, 19 nt, Human
ugggaggcugagaugggag

SEQ ID NO: 1641279 - RNA, 23 nt, Human
ugggaggcucuggagcccacugu

SEQ ID NO: 1641280 - RNA, 17 nt, Human
ugggaggcucuggagcc

SEQ ID NO: 1641281 - RNA, 14 nt, Human
ugggaggcucugga

SEQ ID NO: 1641282 - RNA, 21 nt, Human
ugggaggauugcuugagcuca

SEQ ID NO: 1641283 - RNA, 18 nt, Human
ugggaggauugcuugagc

SEQ ID NO: 1641284 - RNA, 22 nt, Human
ugggaggauugcuugagcucag

SEQ ID NO: 1641285 - RNA, 22 nt, Human
ugggagaaccaaaaagaggcua

SEQ ID NO: 1641286 - RNA, 21 nt, Human
ugggagaaccaaaaagaggcu

SEQ ID NO: 1641287 - RNA, 16 nt, Human
ugggagaaaugaaaaa

SEQ ID NO: 1641288 - RNA, 17 nt, Human
ugggaggucaaggcugc

SEQ ID NO: 1641289 - RNA, 13 nt, Human
ugggcagaaggaa

SEQ ID NO: 1641290 - RNA, 20 nt, Human
ugggcagaaggaagacuuca

SEQ ID NO: 1641291 - RNA, 16 nt, Human
ugggcagaaggaagac

SEQ ID NO: 1641292 - RNA, 23 nt, Human
ugggcagaaggaagacuucaucc

SEQ ID NO: 1641293 - RNA, 13 nt, Human
ugggcauucaaau

SEQ ID NO: 1641294 - RNA, 14 nt, Human
ugggcauucaaaug

SEQ ID NO: 1641295 - RNA, 22 nt, Human
agggcuguuauaaucuuucaca

SEQ ID NO: 1641296 - RNA, 15 nt, Human
ugggcucccuuccca

SEQ ID NO: 1641297 - RNA, 14 nt, Human
ugggcucccuuccc

SEQ ID NO: 1641298 - RNA, 18 nt, Human
agggcccagagagggugg

SEQ ID NO: 1641299 - RNA, 14 nt, Human
agggcccagagagg

SEQ ID NO: 1641300 - RNA, 20 nt, Human
agggcuccagacacaugucc

SEQ ID NO: 1641301 - RNA, 16 nt, Human
agggauacccauccca

SEQ ID NO: 1641302 - RNA, 17 nt, Human
agggcacugguggcccg

SEQ ID NO: 1641303 - RNA, 13 nt, Human
agggcccagagag

SEQ ID NO: 1641304 - RNA, 12 nt, Human
agggcccagaga

SEQ ID NO: 1641305 - RNA, 20 nt, Human
agggagugaguugauagcac

SEQ ID NO: 1641306 - RNA, 23 nt, Human
agggaguccgaaagggacuugga

SEQ ID NO: 1641307 - RNA, 20 nt, Human
agggaguccgaaagggacuu

SEQ ID NO: 1641308 - RNA, 22 nt, Human
agggagggcuccagacacaugu

SEQ ID NO: 1641309 - RNA, 19 nt, Human
agggagggcuccagacaca

SEQ ID NO: 1641310 - RNA, 13 nt, Human
agggagggcucca

SEQ ID NO: 1641311 - RNA, 12 nt, Human
agggagggcucc

SEQ ID NO: 1641312 - RNA, 15 nt, Human
agggagggccugggc

SEQ ID NO: 1641313 - RNA, 13 nt, Human
agggagggccugg

SEQ ID NO: 1641314 - RNA, 23 nt, Human
agggaaacugccagcaacgcagg

SEQ ID NO: 1641315 - RNA, 21 nt, Human
agggaaacugccagcaacgca

SEQ ID NO: 1641316 - RNA, 19 nt, Human
agggaaacugccagcaacg

SEQ ID NO: 1641317 - RNA, 16 nt, Human
agggaaacugccagca

SEQ ID NO: 1641318 - RNA, 15 nt, Human
agggaaacugccagc

SEQ ID NO: 1641319 - RNA, 14 nt, Human
agggaaacugccag

SEQ ID NO: 1641320 - RNA, 21 nt, Human
aggcuuuuuuaucaugugaaa

SEQ ID NO: 1641321 - RNA, 18 nt, Human
aggcuuuuuuaucaugug

SEQ ID NO: 1641322 - RNA, 15 nt, Human
aggcuuuuuuaucau

SEQ ID NO: 1641323 - RNA, 22 nt, Human
aggcuuagucacugagacagcc

SEQ ID NO: 1641324 - RNA, 23 nt, Human
aggcuuagucacugagacagccc

SEQ ID NO: 1641325 - RNA, 23 nt, Human
aggcuucugguugaugccuguga

SEQ ID NO: 1641326 - RNA, 20 nt, Human
ugggaacccaaguccaagca

SEQ ID NO: 1641327 - RNA, 16 nt, Human
aggcugggagagccuu

SEQ ID NO: 1641328 - RNA, 19 nt, Human
aggcugggagagccuucca

SEQ ID NO: 1641329 - RNA, 21 nt, Human
aggcugggagagccuuccagg

SEQ ID NO: 1641330 - RNA, 20 nt, Human
aggcugggagagccuuccag

SEQ ID NO: 1641331 - RNA, 22 nt, Human
aggcugggagagccuuccaggg

SEQ ID NO: 1641332 - RNA, 23 nt, Human
aggcugggcucccuucccaccuc

SEQ ID NO: 1641333 - RNA, 21 nt, Human
aggcugggcucccuucccacc

SEQ ID NO: 1641334 - RNA, 14 nt, Human
aggcugggcuucag

SEQ ID NO: 1641335 - RNA, 18 nt, Human
aggcugggcucccuuccc

SEQ ID NO: 1641336 - RNA, 14 nt, Human
aggcugggcucccu

SEQ ID NO: 1641337 - RNA, 13 nt, Human
aggcugggcuccc

SEQ ID NO: 1641338 - RNA, 17 nt, Human
aggcugggggaagaagc

SEQ ID NO: 1641339 - RNA, 23 nt, Human
aggcugggcuucaguggcagcug

SEQ ID NO: 1641340 - RNA, 22 nt, Human
aggcugggcuucaguggcagcu

SEQ ID NO: 1641341 - RNA, 21 nt, Human
aggcugggcuucaguggcagc

SEQ ID NO: 1641342 - RNA, 20 nt, Human
aggcugggcuucaguggcag

SEQ ID NO: 1641343 - RNA, 19 nt, Human
aggcugggcuucaguggca

SEQ ID NO: 1641344 - RNA, 18 nt, Human
aggcugggcuucaguggc

SEQ ID NO: 1641345 - RNA, 22 nt, Human
aggcugggggaagaagcucucu

SEQ ID NO: 1641346 - RNA, 10 nt, Human
aggcuggguc

SEQ ID NO: 1641347 - RNA, 18 nt, Human
aggcugggucgcccugga

SEQ ID NO: 1641348 - RNA, 15 nt, Human
aggcugggucgcccu

SEQ ID NO: 1641349 - RNA, 17 nt, Human
aggcuggguucugaucc

SEQ ID NO: 1641350 - RNA, 14 nt, Human
aggcuggguucuga

SEQ ID NO: 1641351 - RNA, 21 nt, Human
aggcugggucgcccuggacug

SEQ ID NO: 1641352 - RNA, 20 nt, Human
aggcugggucgcccuggacu

SEQ ID NO: 1641353 - RNA, 19 nt, Human
uggcuauaggugcuacaaa

SEQ ID NO: 1641354 - RNA, 15 nt, Human
uggcuauaggugcua

SEQ ID NO: 1641355 - RNA, 19 nt, Human
uggcuaauguacugcauau

SEQ ID NO: 1641356 - RNA, 17 nt, Human
uggcuaauguacugcau

SEQ ID NO: 1641357 - RNA, 18 nt, Human
uggcuaagcaaaauguga

SEQ ID NO: 1641358 - RNA, 13 nt, Human
aggcuccugccac

SEQ ID NO: 1641359 - RNA, 23 nt, Human
aggcuccaggagcagccacauuc

SEQ ID NO: 1641360 - RNA, 19 nt, Human
aggcuccaggagcagccac

SEQ ID NO: 1641361 - RNA, 18 nt, Human
aggcuccaggagcagcca

SEQ ID NO: 1641362 - RNA, 17 nt, Human
aggcuccaggagcagcc

SEQ ID NO: 1641363 - RNA, 23 nt, Human
uggcuauaggugcuacaaaaaca

SEQ ID NO: 1641364 - RNA, 13 nt, Human
uggcucacgccug

SEQ ID NO: 1641365 - RNA, 18 nt, Human
ugggaaagcauuguaaau

SEQ ID NO: 1641366 - RNA, 17 nt, Human
ugggaaagcauuguaaa

SEQ ID NO: 1641367 - RNA, 21 nt, Human
ugggaaagcauuguaaaugug

SEQ ID NO: 1641368 - RNA, 20 nt, Human
ugggaacaccauaggucacc

SEQ ID NO: 1641369 - RNA, 16 nt, Human
ugggaaagcauuguaa

SEQ ID NO: 1641370 - RNA, 14 nt, Human
ugggaaagcauugu

SEQ ID NO: 1641371 - RNA, 18 nt, Human
ugggaaacaaaaggauaa

SEQ ID NO: 1641372 - RNA, 21 nt, Human
uggcuuuugugcauuaucuag

SEQ ID NO: 1641373 - RNA, 20 nt, Human
uggcuucacggaagagccuu

SEQ ID NO: 1641374 - RNA, 17 nt, Human
uggcuucacggaagagc

SEQ ID NO: 1641375 - RNA, 22 nt, Human
uggcuucacggaagagccuugc

SEQ ID NO: 1641376 - RNA, 16 nt, Human
uggcuuuugugcauua

SEQ ID NO: 1641377 - RNA, 23 nt, Human
uggcugcaaaggguaucaggugc

SEQ ID NO: 1641378 - RNA, 17 nt, Human
uggcugugccucugccu

SEQ ID NO: 1641379 - RNA, 16 nt, Human
uggcugugccucugcc

SEQ ID NO: 1641380 - RNA, 15 nt, Human
uggcugugccucugc

SEQ ID NO: 1641381 - RNA, 14 nt, Human
uggcugugccucug

SEQ ID NO: 1641382 - RNA, 14 nt, Human
uggcuucacggaag

SEQ ID NO: 1641383 - RNA, 23 nt, Human
uggcuguuggcugggggccucag

SEQ ID NO: 1641384 - RNA, 18 nt, Human
uggcuguuggcugggggc

SEQ ID NO: 1641385 - RNA, 16 nt, Human
uggcuguuggcugggg

SEQ ID NO: 1641386 - RNA, 19 nt, Human
uggcugugccucugccugu

SEQ ID NO: 1641387 - RNA, 18 nt, Human
uggcugugccucugccug

SEQ ID NO: 1641388 - RNA, 22 nt, Human
uggcugugccucugccugucuc

SEQ ID NO: 1641389 - RNA, 22 nt, Human
aggcuccacuuggucugugaga

SEQ ID NO: 1641390 - RNA, 21 nt, Human
aggcuccacuuggucugugag

SEQ ID NO: 1641391 - RNA, 17 nt, Human
aggcuccacuuggucug

SEQ ID NO: 1641392 - RNA, 11 nt, Human
aggcuccacuu

SEQ ID NO: 1641393 - RNA, 16 nt, Human
aggcuccaggagcagc

SEQ ID NO: 1641394 - RNA, 14 nt, Human
aggcuccaggagca

SEQ ID NO: 1641395 - RNA, 13 nt, Human
aggcuccaggagc

SEQ ID NO: 1641396 - RNA, 18 nt, Human
aggccuucucugaaggac

SEQ ID NO: 1641397 - RNA, 17 nt, Human
aggccuucucugaagga

SEQ ID NO: 1641398 - RNA, 14 nt, Human
aggcgccccuuccc

SEQ ID NO: 1641399 - RNA, 14 nt, Human
uggcccacugcauc

SEQ ID NO: 1641400 - RNA, 13 nt, Human
uggcccacugcau

SEQ ID NO: 1641401 - RNA, 19 nt, Human
uggcccacgcacuucggga

SEQ ID NO: 1641402 - RNA, 12 nt, Human
uggcccugcccu

SEQ ID NO: 1641403 - RNA, 19 nt, Human
uggccucugcacuccccug

SEQ ID NO: 1641404 - RNA, 20 nt, Human
uggccucugcacuccccugc

SEQ ID NO: 1641405 - RNA, 21 nt, Human
uggccucugcugauccuccca

SEQ ID NO: 1641406 - RNA, 13 nt, Human
uggcccugcccug

SEQ ID NO: 1641407 - RNA, 18 nt, Human
aggccagagacacaagcc

SEQ ID NO: 1641408 - RNA, 13 nt, Human
aggccagagacac

SEQ ID NO: 1641409 - RNA, 18 nt, Human
uggcagcucagagagggu

SEQ ID NO: 1641410 - RNA, 16 nt, Human
uggcagcucagagagg

SEQ ID NO: 1641411 - RNA, 15 nt, Human
uggcagcucagagag

SEQ ID NO: 1641412 - RNA, 14 nt, Human
uggcagcucagaga

SEQ ID NO: 1641413 - RNA, 21 nt, Human
uggcagccgugccuucagcuc

SEQ ID NO: 1641414 - RNA, 20 nt, Human
uggcagccgugccuucagcu

SEQ ID NO: 1641415 - RNA, 19 nt, Human
uggcagccgugccuucagc

SEQ ID NO: 1641416 - RNA, 18 nt, Human
uggcagccgugccuucag

SEQ ID NO: 1641417 - RNA, 18 nt, Human
aggccaugggccuccugu

SEQ ID NO: 1641418 - RNA, 23 nt, Human
aggccagagacacaagccuucgg

SEQ ID NO: 1641419 - RNA, 22 nt, Human
uggcagccgugccuucagcucu

SEQ ID NO: 1641420 - RNA, 16 nt, Human
aggcccagagggccug

SEQ ID NO: 1641421 - RNA, 15 nt, Human
aggcccagagggccu

SEQ ID NO: 1641422 - RNA, 20 nt, Human
aggccauuccccgucucugg

SEQ ID NO: 1641423 - RNA, 15 nt, Human
uggcacagggcagug

SEQ ID NO: 1641424 - RNA, 16 nt, Human
uggcacagggcagugg

SEQ ID NO: 1641425 - RNA, 17 nt, Human
uggcaccagcagccugg

SEQ ID NO: 1641426 - RNA, 16 nt, Human
uggcaccagcagccug

SEQ ID NO: 1641427 - RNA, 18 nt, Human
uggcaccagcagccugga

SEQ ID NO: 1641428 - RNA, 17 nt, Human
uggcagccgugccuuca

SEQ ID NO: 1641429 - RNA, 21 nt, Human
aggccccugccacccugggga

SEQ ID NO: 1641430 - RNA, 18 nt, Human
aggccccugccacccugg

SEQ ID NO: 1641431 - RNA, 17 nt, Human
aggccccugccacccug

SEQ ID NO: 1641432 - RNA, 15 nt, Human
aggccccugccaccc

SEQ ID NO: 1641433 - RNA, 13 nt, Human
aggccccugccac

SEQ ID NO: 1641434 - RNA, 20 nt, Human
aggcccagagggccugcaag

SEQ ID NO: 1641435 - RNA, 19 nt, Human
aggcccagagggccugcaa

SEQ ID NO: 1641436 - RNA, 16 nt, Human
aggcccggcuccaggc

SEQ ID NO: 1641437 - RNA, 15 nt, Human
aggcccggcuccagg

SEQ ID NO: 1641438 - RNA, 14 nt, Human
aggcccggcuccag

SEQ ID NO: 1641439 - RNA, 17 nt, Human
aggcccggcuccaggcu

SEQ ID NO: 1641440 - RNA, 12 nt, Human
aggccuggccag

SEQ ID NO: 1641441 - RNA, 13 nt, Human
aggccuggccaga

SEQ ID NO: 1641442 - RNA, 12 nt, Human
ugcugcccugcc

SEQ ID NO: 1641443 - RNA, 10 nt, Human
ugcugcccug

SEQ ID NO: 1641444 - RNA, 12 nt, Human
uggaacacucug

SEQ ID NO: 1641445 - RNA, 14 nt, Human
uggaacacucugag

SEQ ID NO: 1641446 - RNA, 13 nt, Human
uggaagcuccgcu

SEQ ID NO: 1641447 - RNA, 20 nt, Human
uggaaguacuauaauuuacc

SEQ ID NO: 1641448 - RNA, 21 nt, Human
aggaguuugagaccaaccugg

SEQ ID NO: 1641449 - RNA, 19 nt, Human
aggaguuucguuuucaaaa

SEQ ID NO: 1641450 - RNA, 15 nt, Human
aggaggccagccuug

SEQ ID NO: 1641451 - RNA, 14 nt, Human
uggaagugcuaauu

SEQ ID NO: 1641452 - RNA, 12 nt, Human
aggaucucuuga

SEQ ID NO: 1641453 - RNA, 15 nt, Human
aggaugcuuguacau

SEQ ID NO: 1641454 - RNA, 16 nt, Human
aggaugcuuguacaua

SEQ ID NO: 1641455 - RNA, 21 nt, Human
aggauccugagccagauuuca

SEQ ID NO: 1641456 - RNA, 12 nt, Human
aggaucagucug

SEQ ID NO: 1641457 - RNA, 18 nt, Human
aggaugcuuguacauaau

SEQ ID NO: 1641458 - RNA, 14 nt, Human
aggcaagcaccucc

SEQ ID NO: 1641459 - RNA, 16 nt, Human
aggcaacuugggaacu

SEQ ID NO: 1641460 - RNA, 17 nt, Human
aggcaagcaccuccugc

SEQ ID NO: 1641461 - RNA, 14 nt, Human
uggaauuugaaaca

SEQ ID NO: 1641462 - RNA, 21 nt, Human
uggaauuuuccuccuuucucu

SEQ ID NO: 1641463 - RNA, 17 nt, Human
uggaauuuuccuccuuu

SEQ ID NO: 1641464 - RNA, 15 nt, Human
uggacaccggaaaca

SEQ ID NO: 1641465 - RNA, 14 nt, Human
uggacaaaauggaa

SEQ ID NO: 1641466 - RNA, 17 nt, Human
uggacaaaauggaauac

SEQ ID NO: 1641467 - RNA, 20 nt, Human
aggcagcucuaaaugucaau

SEQ ID NO: 1641468 - RNA, 22 nt, Human
aggcagccccauucugccugcc

SEQ ID NO: 1641469 - RNA, 21 nt, Human
aggcagccccauucugccugc

SEQ ID NO: 1641470 - RNA, 20 nt, Human
aggcagccccauucugccug

SEQ ID NO: 1641471 - RNA, 19 nt, Human
aggcagccccauucugccu

SEQ ID NO: 1641472 - RNA, 15 nt, Human
aggcacccaccauca

SEQ ID NO: 1641473 - RNA, 12 nt, Human
aggcaggauggc

SEQ ID NO: 1641474 - RNA, 20 nt, Human
aggcaggaguuucguuuuca

SEQ ID NO: 1641475 - RNA, 16 nt, Human
aggcagggagggccug

SEQ ID NO: 1641476 - RNA, 21 nt, Human
aggcagggucucacucugucg

SEQ ID NO: 1641477 - RNA, 20 nt, Human
aggcagggucucacucuguc

SEQ ID NO: 1641478 - RNA, 19 nt, Human
aggcagggucucacucugu

SEQ ID NO: 1641479 - RNA, 14 nt, Human
aggcagguccaggg

SEQ ID NO: 1641480 - RNA, 22 nt, Human
aggcagggucucacucugucgc

SEQ ID NO: 1641481 - RNA, 21 nt, Human
aggcaggucuugaacuccugg

SEQ ID NO: 1641482 - RNA, 16 nt, Human
uggagaagaacugaaa

SEQ ID NO: 1641483 - RNA, 14 nt, Human
uggagaaaauggac

SEQ ID NO: 1641484 - RNA, 24 nt, Human
uggacuuuguuaguuucuccaagc

SEQ ID NO: 1641485 - RNA, 16 nt, Human
uggagcccacuguacu

SEQ ID NO: 1641486 - RNA, 23 nt, Human
uggagcccacuguacuugcucuu

SEQ ID NO: 1641487 - RNA, 19 nt, Human
uggagcccacuguacuugc

SEQ ID NO: 1641488 - RNA, 11 nt, Human
uggacuuuguu

SEQ ID NO: 1641489 - RNA, 22 nt, Human
uggacuuuguuaguuucuccaa

SEQ ID NO: 1641490 - RNA, 23 nt, Human
uggagccugcacggugaauggcu

SEQ ID NO: 1641491 - RNA, 16 nt, Human
aggcaaugcuggcugu

SEQ ID NO: 1641492 - RNA, 15 nt, Human
aggcaaugcuggcug

SEQ ID NO: 1641493 - RNA, 23 nt, Human
uggaggaaaaccaagccguggcu

SEQ ID NO: 1641494 - RNA, 21 nt, Human
uggaggaaaaccaagccgugg

SEQ ID NO: 1641495 - RNA, 16 nt, Human
uguaguguuggagaag

SEQ ID NO: 1641496 - RNA, 17 nt, Human
uguaggguuauaauaau

SEQ ID NO: 1641497 - RNA, 16 nt, Human
uguaggguuauaauaa

SEQ ID NO: 1641498 - RNA, 22 nt, Human
uguauauauuuccuauauuguu

SEQ ID NO: 1641499 - RNA, 18 nt, Human
uguauauauuuccuauau

SEQ ID NO: 1641500 - RNA, 18 nt, Human
uguaguguuggagaagaa

SEQ ID NO: 1641501 - RNA, 17 nt, Human
uguaguguuggagaaga

SEQ ID NO: 1641502 - RNA, 20 nt, Human
aguaaaaccacagcaguuga

SEQ ID NO: 1641503 - RNA, 19 nt, Human
aguaaaaccacagcaguug

SEQ ID NO: 1641504 - RNA, 17 nt, Human
aguaaaaccacagcagu

SEQ ID NO: 1641505 - RNA, 16 nt, Human
aguaaaaccacagcag

SEQ ID NO: 1641506 - RNA, 21 nt, Human
uguacauggaauaacauguaa

SEQ ID NO: 1641507 - RNA, 23 nt, Human
aguaaaaacaaagaaauuaugug

SEQ ID NO: 1641508 - RNA, 16 nt, Human
aguaaaaacaaagaaa

SEQ ID NO: 1641509 - RNA, 13 nt, Human
aguaauuggaaag

SEQ ID NO: 1641510 - RNA, 12 nt, Human
aguaauuggaaa

SEQ ID NO: 1641511 - RNA, 13 nt, Human
aguaaugauaacu

SEQ ID NO: 1641512 - RNA, 23 nt, Human
aguacacuguuucaaacuuuacu

SEQ ID NO: 1641513 - RNA, 21 nt, Human
aguacacuguuucaaacuuua

SEQ ID NO: 1641514 - RNA, 19 nt, Human
uguaagggaaacugccagc

SEQ ID NO: 1641515 - RNA, 18 nt, Human
uguaauuaaguacuaugu

SEQ ID NO: 1641516 - RNA, 21 nt, Human
uguaauuaaguacuauguauc

SEQ ID NO: 1641517 - RNA, 19 nt, Human
uguaauuaaguacuaugua

SEQ ID NO: 1641518 - RNA, 23 nt, Human
uguaauuaaguacuauguaucaa

SEQ ID NO: 1641519 - RNA, 18 nt, Human
uguaagggaaacugccag

SEQ ID NO: 1641520 - RNA, 13 nt, Human
uguaagggaaacu

SEQ ID NO: 1641521 - RNA, 20 nt, Human
agguuggcaaaaaggcagga

SEQ ID NO: 1641522 - RNA, 20 nt, Human
uguaauuuuuuuaucgucac

SEQ ID NO: 1641523 - RNA, 19 nt, Human
uguacauaaugcgugcaua

SEQ ID NO: 1641524 - RNA, 20 nt, Human
uguacauaaugcgugcauac

SEQ ID NO: 1641525 - RNA, 16 nt, Human
uguacaugaaaacaca

SEQ ID NO: 1641526 - RNA, 14 nt, Human
uguacaugaaaaca

SEQ ID NO: 1641527 - RNA, 14 nt, Human
uguacauauaagug

SEQ ID NO: 1641528 - RNA, 16 nt, Human
aggugcuacaaaaaca

SEQ ID NO: 1641529 - RNA, 12 nt, Human
aggugggaggau

SEQ ID NO: 1641530 - RNA, 16 nt, Human
ugggcugcccuggugc

SEQ ID NO: 1641531 - RNA, 15 nt, Human
ugggcugcccuggug

SEQ ID NO: 1641532 - RNA, 14 nt, Human
ugggcugcccuggu

SEQ ID NO: 1641533 - RNA, 13 nt, Human
ugggcugcccugg

SEQ ID NO: 1641534 - RNA, 22 nt, Human
aggugugagucaccaagcccag

SEQ ID NO: 1641535 - RNA, 21 nt, Human
aggugugagucaccaagccca

SEQ ID NO: 1641536 - RNA, 20 nt, Human
aggugucccugcacuugcag

SEQ ID NO: 1641537 - RNA, 16 nt, Human
aggugucccugcacuu

SEQ ID NO: 1641538 - RNA, 14 nt, Human
agguugaagcacca

SEQ ID NO: 1641539 - RNA, 12 nt, Human
aggugugcucug

SEQ ID NO: 1641540 - RNA, 16 nt, Human
agucucaggaaaucaa

SEQ ID NO: 1641541 - RNA, 13 nt, Human
agucucaggaaau

SEQ ID NO: 1641542 - RNA, 23 nt, Human
agucucacuguugcccaggcugg

SEQ ID NO: 1641543 - RNA, 20 nt, Human
agucuauuuacggaacucaa

SEQ ID NO: 1641544 - RNA, 15 nt, Human
agucuauuuacggaa

SEQ ID NO: 1641545 - RNA, 16 nt, Human
aguccucccaucucac

SEQ ID NO: 1641546 - RNA, 14 nt, Human
aguccucccaucuc

SEQ ID NO: 1641547 - RNA, 16 nt, Human
agucccccugccccag

SEQ ID NO: 1641548 - RNA, 14 nt, Human
agucaggaaagaga

SEQ ID NO: 1641549 - RNA, 22 nt, Human
agucagaaguuucugccgcagc

SEQ ID NO: 1641550 - RNA, 23 nt, Human
ugucccuuacgugaguccuggca

SEQ ID NO: 1641551 - RNA, 19 nt, Human
ugucccuuacgugaguccu

SEQ ID NO: 1641552 - RNA, 14 nt, Human
ugucgccucugcau

SEQ ID NO: 1641553 - RNA, 16 nt, Human
agucccaccuuggcug

SEQ ID NO: 1641554 - RNA, 15 nt, Human
agucccaccuuggcu

SEQ ID NO: 1641555 - RNA, 20 nt, Human
agucccaccuuggcugcagg

SEQ ID NO: 1641556 - RNA, 19 nt, Human
agucccaccuuggcugcag

SEQ ID NO: 1641557 - RNA, 18 nt, Human
agucccaccuuggcugca

SEQ ID NO: 1641558 - RNA, 20 nt, Human
agucccaggcugagccucag

SEQ ID NO: 1641559 - RNA, 19 nt, Human
agucccaggcugagccuca

SEQ ID NO: 1641560 - RNA, 18 nt, Human
agucccaggcugagccuc

SEQ ID NO: 1641561 - RNA, 17 nt, Human
agucccaggcugagccu

SEQ ID NO: 1641562 - RNA, 23 nt, Human
ugucccugcacuugcagacucua

SEQ ID NO: 1641563 - RNA, 22 nt, Human
ugucccugcacuugcagacucu

SEQ ID NO: 1641564 - RNA, 20 nt, Human
ugucccugcacuugcagacu

SEQ ID NO: 1641565 - RNA, 22 nt, Human
uguccaagaagcccaggaaagg

SEQ ID NO: 1641566 - RNA, 18 nt, Human
uguccaagaagcccagga

SEQ ID NO: 1641567 - RNA, 17 nt, Human
uguccaagaagcccagg

SEQ ID NO: 1641568 - RNA, 16 nt, Human
uguccaagaagcccag

SEQ ID NO: 1641569 - RNA, 22 nt, Human
ugucauuugagcagggcucagc

SEQ ID NO: 1641570 - RNA, 21 nt, Human
ugucauuugagcagggcucag

SEQ ID NO: 1641571 - RNA, 20 nt, Human
ugucauuugagcagggcuca

SEQ ID NO: 1641572 - RNA, 20 nt, Human
ugucagguggggcagcuuga

SEQ ID NO: 1641573 - RNA, 18 nt, Human
ugucagguggggcagcuu

SEQ ID NO: 1641574 - RNA, 17 nt, Human
ugucagguggggcagcu

SEQ ID NO: 1641575 - RNA, 15 nt, Human
uguccaagaagccca

SEQ ID NO: 1641576 - RNA, 14 nt, Human
uguccaagaagccc

SEQ ID NO: 1641577 - RNA, 14 nt, Human
aguauuaagcauau

SEQ ID NO: 1641578 - RNA, 12 nt, Human
aguauuaagcau

SEQ ID NO: 1641579 - RNA, 23 nt, Human
aguauaauuaacauguuaaacca

SEQ ID NO: 1641580 - RNA, 16 nt, Human
aguauaauuaacaugu

SEQ ID NO: 1641581 - RNA, 14 nt, Human
aguauaauuaacau

SEQ ID NO: 1641582 - RNA, 13 nt, Human
aguauaauuaaca

SEQ ID NO: 1641583 - RNA, 19 nt, Human
aguauucuuauuuaaugaa

SEQ ID NO: 1641584 - RNA, 15 nt, Human
agucaccaagcccag

SEQ ID NO: 1641585 - RNA, 17 nt, Human
agucaccccggccaccu

SEQ ID NO: 1641586 - RNA, 22 nt, Human
uguuaacugagugccuuuuggu

SEQ ID NO: 1641587 - RNA, 16 nt, Human
uguuaacugagugccu

SEQ ID NO: 1641588 - RNA, 23 nt, Human
uguguuaucacccagaagaaaau

SEQ ID NO: 1641589 - RNA, 16 nt, Human
uguguuagagauuuuu

SEQ ID NO: 1641590 - RNA, 22 nt, Human
uguguuaucacccagaagaaaa

SEQ ID NO: 1641591 - RNA, 19 nt, Human
uguuacauaagauaaaugu

SEQ ID NO: 1641592 - RNA, 18 nt, Human
uguuacaaauuguagaag

SEQ ID NO: 1641593 - RNA, 17 nt, Human
uguuacaaauuguagaa

SEQ ID NO: 1641594 - RNA, 22 nt, Human
uguuaaguugauggugaugaaa

SEQ ID NO: 1641595 - RNA, 11 nt, Human
aguggcagcug

SEQ ID NO: 1641596 - RNA, 16 nt, Human
aguggggaaugaagau

SEQ ID NO: 1641597 - RNA, 14 nt, Human
aguggggaggggcu

SEQ ID NO: 1641598 - RNA, 15 nt, Human
aguggggacagagca

SEQ ID NO: 1641599 - RNA, 17 nt, Human
aguggauggaaggggcu

SEQ ID NO: 1641600 - RNA, 16 nt, Human
agugcccuccaggaua

SEQ ID NO: 1641601 - RNA, 11 nt, Human
uguguguuuau

SEQ ID NO: 1641602 - RNA, 20 nt, Human
ugugucuugcaauggcagcc

SEQ ID NO: 1641603 - RNA, 22 nt, Human
uguugcccacagcuguaugauu

SEQ ID NO: 1641604 - RNA, 20 nt, Human
uguugcccaggcuggcgugc

SEQ ID NO: 1641605 - RNA, 23 nt, Human
uguugcccaggcuggcgugcagu

SEQ ID NO: 1641606 - RNA, 12 nt, Human
uguugcccaggc

SEQ ID NO: 1641607 - RNA, 15 nt, Human
uguucuaagaaguga

SEQ ID NO: 1641608 - RNA, 15 nt, Human
uguugcauagaauaa

SEQ ID NO: 1641609 - RNA, 19 nt, Human
aguguuguggauuuaacag

SEQ ID NO: 1641610 - RNA, 20 nt, Human
aguguuguggauuuaacaga

SEQ ID NO: 1641611 - RNA, 13 nt, Human
aguuacucagaau

SEQ ID NO: 1641612 - RNA, 23 nt, Human
aguuacuaucaugucaaacguga

SEQ ID NO: 1641613 - RNA, 16 nt, Human
aguguuguggauuuaa

SEQ ID NO: 1641614 - RNA, 19 nt, Human
aguguguguuuuucauaaa

SEQ ID NO: 1641615 - RNA, 18 nt, Human
aguguguguuuuucauaa

SEQ ID NO: 1641616 - RNA, 20 nt, Human
agugugacugaucucucgug

SEQ ID NO: 1641617 - RNA, 21 nt, Human
agugugccugaagucccagau

SEQ ID NO: 1641618 - RNA, 15 nt, Human
aguguggcaaaauaa

SEQ ID NO: 1641619 - RNA, 19 nt, Human
uguuccacaaguuaaauaa

SEQ ID NO: 1641620 - RNA, 22 nt, Human
agugugguguuuccuggcacug

SEQ ID NO: 1641621 - RNA, 17 nt, Human
uguuaugacuccagaau

SEQ ID NO: 1641622 - RNA, 13 nt, Human
uguuaugacucca

SEQ ID NO: 1641623 - RNA, 23 nt, Human
agugaacaaauuuacagagacag

SEQ ID NO: 1641624 - RNA, 22 nt, Human
agugaacaaauuuacagagaca

SEQ ID NO: 1641625 - RNA, 16 nt, Human
agugaacuugggccac

SEQ ID NO: 1641626 - RNA, 21 nt, Human
agugacugauggcuaauguac

SEQ ID NO: 1641627 - RNA, 20 nt, Human
agugaacuugggccacugug

SEQ ID NO: 1641628 - RNA, 16 nt, Human
agucuuucacauuuaa

SEQ ID NO: 1641629 - RNA, 21 nt, Human
agucuugucucagauuuuauu

SEQ ID NO: 1641630 - RNA, 20 nt, Human
agucuugucucagauuuuau

SEQ ID NO: 1641631 - RNA, 21 nt, Human
agugaacaaauuuacagagac

SEQ ID NO: 1641632 - RNA, 18 nt, Human
agucuuucacauuuaaau

SEQ ID NO: 1641633 - RNA, 12 nt, Human
agugagcugguu

SEQ ID NO: 1641634 - RNA, 19 nt, Human
ugugaugagaggaaaucac

SEQ ID NO: 1641635 - RNA, 22 nt, Human
ugugaugaugaaaugaggucag

SEQ ID NO: 1641636 - RNA, 22 nt, Human
agugagcacuaaggugugcucu

SEQ ID NO: 1641637 - RNA, 14 nt, Human
agugagcacuaagg

SEQ ID NO: 1641638 - RNA, 12 nt, Human
ugugaggaagcc

SEQ ID NO: 1641639 - RNA, 11 nt, Human
ugugaggaagc

SEQ ID NO: 1641640 - RNA, 19 nt, Human
ugugacuucagcucuguuu

SEQ ID NO: 1641641 - RNA, 18 nt, Human
ugugacuucagcucuguu

SEQ ID NO: 1641642 - RNA, 17 nt, Human
agucucuugauucauaa

SEQ ID NO: 1641643 - RNA, 16 nt, Human
agucucuugauucaua

SEQ ID NO: 1641644 - RNA, 21 nt, Human
agucucuucuccacuggaugg

SEQ ID NO: 1641645 - RNA, 19 nt, Human
agucucuucuccacuggau

SEQ ID NO: 1641646 - RNA, 16 nt, Human
agucuuagauguauau

SEQ ID NO: 1641647 - RNA, 14 nt, Human
agucuuagauguau

SEQ ID NO: 1641648 - RNA, 23 nt, Human
agucuuagauguauauauuuccu

SEQ ID NO: 1641649 - RNA, 16 nt, Human
agucuugucucagauu

SEQ ID NO: 1641650 - RNA, 19 nt, Human
agucuugucucagauuuua

SEQ ID NO: 1641651 - RNA, 17 nt, Human
agucuugucucagauuu

SEQ ID NO: 1641652 - RNA, 13 nt, Human
agucuuagaugua

SEQ ID NO: 1641653 - RNA, 12 nt, Human
agucugaaggcu

SEQ ID NO: 1641654 - RNA, 14 nt, Human
agugcaaauuguca

SEQ ID NO: 1641655 - RNA, 12 nt, Human
agugaggcucug

SEQ ID NO: 1641656 - RNA, 13 nt, Human
agugaggcucugc

SEQ ID NO: 1641657 - RNA, 14 nt, Human
agugaggcucugcc

SEQ ID NO: 1641658 - RNA, 21 nt, Human
agugaguuggguguauugugc

SEQ ID NO: 1641659 - RNA, 16 nt, Human
agugaggaugaaaaaa

SEQ ID NO: 1641660 - RNA, 17 nt, Human
agugcagugagccgaga

SEQ ID NO: 1641661 - RNA, 21 nt, Human
agugcacuaauguguaagaca

SEQ ID NO: 1641662 - RNA, 17 nt, Human
agugcacuaauguguaa

SEQ ID NO: 1641663 - RNA, 16 nt, Human
agugcaugcugucccu

SEQ ID NO: 1641664 - RNA, 14 nt, Human
agugccaaaaacaa

SEQ ID NO: 1641665 - RNA, 21 nt, Human
ugugcugcccugcccaccugg

SEQ ID NO: 1641666 - RNA, 20 nt, Human
ugugcugcccugcccaccug

SEQ ID NO: 1641667 - RNA, 19 nt, Human
ugugcugcccugcccaccu

SEQ ID NO: 1641668 - RNA, 18 nt, Human
ugugcugcccugcccacc

SEQ ID NO: 1641669 - RNA, 20 nt, Human
ugugcugguguaugugugaa

SEQ ID NO: 1641670 - RNA, 19 nt, Human
ugugcugggguuaucugaa

SEQ ID NO: 1641671 - RNA, 19 nt, Human
uguggauuuaacagaaaug

SEQ ID NO: 1641672 - RNA, 20 nt, Human
uguggauuuaacagaaaugu

SEQ ID NO: 1641673 - RNA, 23 nt, Human
agugagcugguuuuuagcggaga

SEQ ID NO: 1641674 - RNA, 22 nt, Human
uguggauuuaacagaaauguac

SEQ ID NO: 1641675 - RNA, 14 nt, Human
uguggaugauaaaa

SEQ ID NO: 1641676 - RNA, 21 nt, Human
uguggaucaaauccagccugc

SEQ ID NO: 1641677 - RNA, 12 nt, Human
ugugcugcccug

SEQ ID NO: 1641678 - RNA, 19 nt, Human
ugugcugagucugaaggcu

SEQ ID NO: 1641679 - RNA, 18 nt, Human
ugugcugagucugaaggc

SEQ ID NO: 1641680 - RNA, 12 nt, Human
ugugcucugauc

SEQ ID NO: 1641681 - RNA, 21 nt, Human
ugugcucaggagcccugggag

SEQ ID NO: 1641682 - RNA, 18 nt, Human
auagauaggucagugcaa

SEQ ID NO: 1641683 - RNA, 22 nt, Human
auagaggaagccugauuaaaga

SEQ ID NO: 1641684 - RNA, 21 nt, Human
auagaggaagccugauuaaag

SEQ ID NO: 1641685 - RNA, 14 nt, Human
auagagagagacca

SEQ ID NO: 1641686 - RNA, 18 nt, Human
auagacccacaagaggca

SEQ ID NO: 1641687 - RNA, 21 nt, Human
auagauuagagaguguugaaa

SEQ ID NO: 1641688 - RNA, 16 nt, Human
auagauuagaauucug

SEQ ID NO: 1641689 - RNA, 15 nt, Human
auagauuagaauucu

SEQ ID NO: 1641690 - RNA, 13 nt, Human
auagauuagaauu

SEQ ID NO: 1641691 - RNA, 22 nt, Human
auagauuagagaguguugaaac

SEQ ID NO: 1641692 - RNA, 17 nt, Human
auagaauuaacacauga

SEQ ID NO: 1641693 - RNA, 22 nt, Human
auagaauaaaauuuuuaaucuu

SEQ ID NO: 1641694 - RNA, 19 nt, Human
auagaauaaaauuuuuaau

SEQ ID NO: 1641695 - RNA, 14 nt, Human
auagaauaaaauuu

SEQ ID NO: 1641696 - RNA, 16 nt, Human
auagacaauuuauuau

SEQ ID NO: 1641697 - RNA, 22 nt, Human
auagacaauuuauuauggcaca

SEQ ID NO: 1641698 - RNA, 23 nt, Human
auagacaauuuauuauggcacau

SEQ ID NO: 1641699 - RNA, 13 nt, Human
auagaaguaaaaa

SEQ ID NO: 1641700 - RNA, 20 nt, Human
auagaaccucuuugucuaca

SEQ ID NO: 1641701 - RNA, 14 nt, Human
auagaaccucuuug

SEQ ID NO: 1641702 - RNA, 15 nt, Human
uuauuauauuuacaa

SEQ ID NO: 1641703 - RNA, 11 nt, Human
uuauuaugaaa

SEQ ID NO: 1641704 - RNA, 12 nt, Human
uuauuaugcaug

SEQ ID NO: 1641705 - RNA, 23 nt, Human
uuauuaugaaacuuguguaaaua

SEQ ID NO: 1641706 - RNA, 22 nt, Human
uuauuaugaaacuuguguaaau

SEQ ID NO: 1641707 - RNA, 21 nt, Human
uuauuaugaaacuuguguaaa

SEQ ID NO: 1641708 - RNA, 20 nt, Human
uuauuaugaaacuuguguaa

SEQ ID NO: 1641709 - RNA, 17 nt, Human
uuauuaugaaacuugug

SEQ ID NO: 1641710 - RNA, 19 nt, Human
uuauguuaaaacugggaca

SEQ ID NO: 1641711 - RNA, 14 nt, Human
uuauuauauuuaca

SEQ ID NO: 1641712 - RNA, 13 nt, Human
uuauuaugcauga

SEQ ID NO: 1641713 - RNA, 14 nt, Human
uuauuauguaaauc

SEQ ID NO: 1641714 - RNA, 13 nt, Human
uuauuauguaaau

SEQ ID NO: 1641715 - RNA, 22 nt, Human
uuauuauguaaaucccauuauu

SEQ ID NO: 1641716 - RNA, 16 nt, Human
uuauuauguaaauccc

SEQ ID NO: 1641717 - RNA, 19 nt, Human
uuauucaaaguugccuaaa

SEQ ID NO: 1641718 - RNA, 15 nt, Human
uuauucaaaguugcc

SEQ ID NO: 1641719 - RNA, 13 nt, Human
uuauucaaaguug

SEQ ID NO: 1641720 - RNA, 12 nt, Human
uuauucauaauu

SEQ ID NO: 1641721 - RNA, 14 nt, Human
uuauucacugauuu

SEQ ID NO: 1641722 - RNA, 20 nt, Human
uuauucacuuuuauuuagca

SEQ ID NO: 1641723 - RNA, 16 nt, Human
auacucauuaggaugg

SEQ ID NO: 1641724 - RNA, 11 nt, Human
auacucccauc

SEQ ID NO: 1641725 - RNA, 14 nt, Human
auacucccaucugu

SEQ ID NO: 1641726 - RNA, 17 nt, Human
auacuccuccaagguua

SEQ ID NO: 1641727 - RNA, 16 nt, Human
auacucugcuuagaau

SEQ ID NO: 1641728 - RNA, 18 nt, Human
auacucuuauaucuauau

SEQ ID NO: 1641729 - RNA, 14 nt, Human
auacucuuauaucu

SEQ ID NO: 1641730 - RNA, 18 nt, Human
auacucuuauagacaaca

SEQ ID NO: 1641731 - RNA, 15 nt, Human
auacuggauuguacu

SEQ ID NO: 1641732 - RNA, 13 nt, Human
auacguacacauu

SEQ ID NO: 1641733 - RNA, 14 nt, Human
auacguacacauuu

SEQ ID NO: 1641734 - RNA, 15 nt, Human
auacguacacauuuu

SEQ ID NO: 1641735 - RNA, 16 nt, Human
auacguacacauuuua

SEQ ID NO: 1641736 - RNA, 19 nt, Human
auacgugggcauucaaaug

SEQ ID NO: 1641737 - RNA, 18 nt, Human
auacgugggcauucaaau

SEQ ID NO: 1641738 - RNA, 17 nt, Human
auaccacuuuuguucuu

SEQ ID NO: 1641739 - RNA, 18 nt, Human
auaccacuuuuguucuug

SEQ ID NO: 1641740 - RNA, 17 nt, Human
auaccagccaguaaaug

SEQ ID NO: 1641741 - RNA, 14 nt, Human
auaccuuuuuuaga

SEQ ID NO: 1641742 - RNA, 17 nt, Human
auacuauggaauuucuc

SEQ ID NO: 1641743 - RNA, 13 nt, Human
auacuaaccagca

SEQ ID NO: 1641744 - RNA, 19 nt, Human
auacuaaccagcagaaaug

SEQ ID NO: 1641745 - RNA, 20 nt, Human
auacuaaccagcagaaaugc

SEQ ID NO: 1641746 - RNA, 19 nt, Human
uuauauuugaaauauugac

SEQ ID NO: 1641747 - RNA, 17 nt, Human
auacagaggcaacugca

SEQ ID NO: 1641748 - RNA, 16 nt, Human
auacagaggcaacugc

SEQ ID NO: 1641749 - RNA, 17 nt, Human
uuauaaacuuuaccuuu

SEQ ID NO: 1641750 - RNA, 18 nt, Human
uuauaaacuuuaccuuuu

SEQ ID NO: 1641751 - RNA, 16 nt, Human
uuauaaacuuuuuucu

SEQ ID NO: 1641752 - RNA, 12 nt, Human
uuauaaacuuuu

SEQ ID NO: 1641753 - RNA, 22 nt, Human
uuauaaacuuuuuucuuacugu

SEQ ID NO: 1641754 - RNA, 20 nt, Human
auacaguuacucagaauucu

SEQ ID NO: 1641755 - RNA, 23 nt, Human
auacaggaaaagcugcugacagu

SEQ ID NO: 1641756 - RNA, 23 nt, Human
auacagauagauauaugcucugc

SEQ ID NO: 1641757 - RNA, 18 nt, Human
auacaguuacucagaauu

SEQ ID NO: 1641758 - RNA, 21 nt, Human
auacaggaugaugacuaugga

SEQ ID NO: 1641759 - RNA, 21 nt, Human
uuaugaauuacauuuguauaa

SEQ ID NO: 1641760 - RNA, 11 nt, Human
uuaugacucca

SEQ ID NO: 1641761 - RNA, 17 nt, Human
uuaugaauuacauuugu

SEQ ID NO: 1641762 - RNA, 16 nt, Human
uuaugaauuacauuug

SEQ ID NO: 1641763 - RNA, 14 nt, Human
uuaugaauuacauu

SEQ ID NO: 1641764 - RNA, 20 nt, Human
uuaugauacuugaaaauuaa

SEQ ID NO: 1641765 - RNA, 18 nt, Human
uuaugauccagcagauua

SEQ ID NO: 1641766 - RNA, 13 nt, Human
uuaugauccagca

SEQ ID NO: 1641767 - RNA, 17 nt, Human
uuaucacccagaagaaa

SEQ ID NO: 1641768 - RNA, 18 nt, Human
uuaucacccagaagaaaa

SEQ ID NO: 1641769 - RNA, 19 nt, Human
uuaucacccagaagaaaau

SEQ ID NO: 1641770 - RNA, 21 nt, Human
uuaucacccagaagaaaauag

SEQ ID NO: 1641771 - RNA, 19 nt, Human
uuaugaaacuuuuggaagg

SEQ ID NO: 1641772 - RNA, 20 nt, Human
uuaugaagcuuuuaugugaa

SEQ ID NO: 1641773 - RNA, 18 nt, Human
uuaugaaacuuuuggaag

SEQ ID NO: 1641774 - RNA, 17 nt, Human
uuaugaaacuuuuggaa

SEQ ID NO: 1641775 - RNA, 14 nt, Human
uuaugaaacuuuug

SEQ ID NO: 1641776 - RNA, 19 nt, Human
uuaugaaacuuguguaaau

SEQ ID NO: 1641777 - RNA, 13 nt, Human
uuaugaaacuugu

SEQ ID NO: 1641778 - RNA, 18 nt, Human
uuaugaaacuuguguaaa

SEQ ID NO: 1641779 - RNA, 16 nt, Human
uuaugaaacuugugua

SEQ ID NO: 1641780 - RNA, 22 nt, Human
uuaugauuaaguaaugauaacu

SEQ ID NO: 1641781 - RNA, 19 nt, Human
uuauggcuuuugugcauua

SEQ ID NO: 1641782 - RNA, 13 nt, Human
uuaugggcugggu

SEQ ID NO: 1641783 - RNA, 19 nt, Human
uuaugauuaaguaaugaua

SEQ ID NO: 1641784 - RNA, 23 nt, Human
uuaugauccagcagauuauucac

SEQ ID NO: 1641785 - RNA, 22 nt, Human
uuaugauccagcagauuauuca

SEQ ID NO: 1641786 - RNA, 22 nt, Human
uuaugggcuggguucuacccag

SEQ ID NO: 1641787 - RNA, 23 nt, Human
uuauguaaaucccauuauucaaa

SEQ ID NO: 1641788 - RNA, 22 nt, Human
uuauguaaaucccauuauucaa

SEQ ID NO: 1641789 - RNA, 21 nt, Human
uuauguaaaucccauuauuca

SEQ ID NO: 1641790 - RNA, 19 nt, Human
uuauguaaaucccauuauu

SEQ ID NO: 1641791 - RNA, 13 nt, Human
uuauguaaauccc

SEQ ID NO: 1641792 - RNA, 12 nt, Human
uuauguaaaucc

SEQ ID NO: 1641793 - RNA, 11 nt, Human
uuauguaaauc

SEQ ID NO: 1641794 - RNA, 13 nt, Human
uuaugugaaacau

SEQ ID NO: 1641795 - RNA, 16 nt, Human
uuaugugcgcugauaa

SEQ ID NO: 1641796 - RNA, 22 nt, Human
uuaugugccagauuuaugcaua

SEQ ID NO: 1641797 - RNA, 15 nt, Human
uuaugugaaacaugu

SEQ ID NO: 1641798 - RNA, 23 nt, Human
uuaaaccaugggauaaaugccau

SEQ ID NO: 1641799 - RNA, 22 nt, Human
uuaaaccaugggauaaaugcca

SEQ ID NO: 1641800 - RNA, 21 nt, Human
uuaaaccaugggauaaaugcc

SEQ ID NO: 1641801 - RNA, 22 nt, Human
uuaaaguugaauuuauuggcuu

SEQ ID NO: 1641802 - RNA, 17 nt, Human
uuaaaguugaauuuauu

SEQ ID NO: 1641803 - RNA, 16 nt, Human
uuaaaguugaauuuau

SEQ ID NO: 1641804 - RNA, 13 nt, Human
uuaaaguugaauu

SEQ ID NO: 1641805 - RNA, 12 nt, Human
uuaacagaaaug

SEQ ID NO: 1641806 - RNA, 13 nt, Human
uuaacagaaaugu

SEQ ID NO: 1641807 - RNA, 14 nt, Human
uuaacagaaaugua

SEQ ID NO: 1641808 - RNA, 16 nt, Human
uuaacagaaauguaca

SEQ ID NO: 1641809 - RNA, 14 nt, Human
aguuucucuuuuca

SEQ ID NO: 1641810 - RNA, 15 nt, Human
aguuucucagcuccc

SEQ ID NO: 1641811 - RNA, 13 nt, Human
aguuucucagcuc

SEQ ID NO: 1641812 - RNA, 15 nt, Human
aguuucugccgcagc

SEQ ID NO: 1641813 - RNA, 22 nt, Human
aguuuguuaguaugaggcauuu

SEQ ID NO: 1641814 - RNA, 19 nt, Human
aguuucugccgcagcccug

SEQ ID NO: 1641815 - RNA, 15 nt, Human
aguuuguugaaacac

SEQ ID NO: 1641816 - RNA, 17 nt, Human
aguuuaaauuguaauag

SEQ ID NO: 1641817 - RNA, 20 nt, Human
aguuuaaauuguaauaggcg

SEQ ID NO: 1641818 - RNA, 15 nt, Human
aguuuagcuggaaaa

SEQ ID NO: 1641819 - RNA, 16 nt, Human
aguuuagcuggaaaag

SEQ ID NO: 1641820 - RNA, 19 nt, Human
uuaaaaaagaaacauuugg

SEQ ID NO: 1641821 - RNA, 22 nt, Human
uuaaaaucauuucugcaucagc

SEQ ID NO: 1641822 - RNA, 20 nt, Human
uuaaaaaugguuuaaauggu

SEQ ID NO: 1641823 - RNA, 16 nt, Human
uuaaaaaauggaacau

SEQ ID NO: 1641824 - RNA, 19 nt, Human
uuaaaaaucucaaauuucu

SEQ ID NO: 1641825 - RNA, 20 nt, Human
uuaaaaaucucaaauuucua

SEQ ID NO: 1641826 - RNA, 19 nt, Human
uuaaaaugagaaaucuaaa

SEQ ID NO: 1641827 - RNA, 12 nt, Human
uuaaaaugagaa

SEQ ID NO: 1641828 - RNA, 17 nt, Human
uuaaaccaugggauaaa

SEQ ID NO: 1641829 - RNA, 16 nt, Human
aguuuuauaugcuucu

SEQ ID NO: 1641830 - RNA, 12 nt, Human
aguuuuguuugg

SEQ ID NO: 1641831 - RNA, 16 nt, Human
aguuuuguuuggacca

SEQ ID NO: 1641832 - RNA, 14 nt, Human
aguuuuguuuggac

SEQ ID NO: 1641833 - RNA, 15 nt, Human
aguuuuuuuuauaca

SEQ ID NO: 1641834 - RNA, 18 nt, Human
aguuuuguuuggaccaaa

SEQ ID NO: 1641835 - RNA, 19 nt, Human
uuaagaaaaaggaugcaca

SEQ ID NO: 1641836 - RNA, 19 nt, Human
uuaagacgaaacauuuguu

SEQ ID NO: 1641837 - RNA, 18 nt, Human
uuaagacauuuuuggaag

SEQ ID NO: 1641838 - RNA, 23 nt, Human
uuaagacauuuuuggaaggggac

SEQ ID NO: 1641839 - RNA, 23 nt, Human
uuaacuuuuauaaacuuuaccuu

SEQ ID NO: 1641840 - RNA, 22 nt, Human
uuaacuuuuauaaacuuuaccu

SEQ ID NO: 1641841 - RNA, 22 nt, Human
auaaaagggacugagaaauuua

SEQ ID NO: 1641842 - RNA, 20 nt, Human
auaaaagccuguuuaagaga

SEQ ID NO: 1641843 - RNA, 19 nt, Human
auaaaagccuguuuaagag

SEQ ID NO: 1641844 - RNA, 15 nt, Human
uuaaucuaaauggaa

SEQ ID NO: 1641845 - RNA, 22 nt, Human
uuaagagagucuauuuacggaa

SEQ ID NO: 1641846 - RNA, 22 nt, Human
uuaagacgaaacauuuguucua

SEQ ID NO: 1641847 - RNA, 16 nt, Human
uuaauuugguuuucac

SEQ ID NO: 1641848 - RNA, 13 nt, Human
uuaauuuuggaau

SEQ ID NO: 1641849 - RNA, 15 nt, Human
uuaauuuuggaauuu

SEQ ID NO: 1641850 - RNA, 14 nt, Human
uuaauuuuggaauu

SEQ ID NO: 1641851 - RNA, 17 nt, Human
uuaaucuuuaauuuuac

SEQ ID NO: 1641852 - RNA, 13 nt, Human
uuaaucuuuaauu

SEQ ID NO: 1641853 - RNA, 14 nt, Human
auaauuuuaaaugu

SEQ ID NO: 1641854 - RNA, 13 nt, Human
auaauuuuaaaug

SEQ ID NO: 1641855 - RNA, 12 nt, Human
auaauuuuaaau

SEQ ID NO: 1641856 - RNA, 20 nt, Human
auaauucaggaagcagcuuu

SEQ ID NO: 1641857 - RNA, 14 nt, Human
auaaucuuucacag

SEQ ID NO: 1641858 - RNA, 23 nt, Human
auaauucacauuguauucagagu

SEQ ID NO: 1641859 - RNA, 14 nt, Human
auaagccagacauc

SEQ ID NO: 1641860 - RNA, 22 nt, Human
auaagccaaaaaaugcuugcuu

SEQ ID NO: 1641861 - RNA, 21 nt, Human
auaagauucauauuuacuucu

SEQ ID NO: 1641862 - RNA, 15 nt, Human
uuagggagagaagau

SEQ ID NO: 1641863 - RNA, 16 nt, Human
uuaggguuaugauuaa

SEQ ID NO: 1641864 - RNA, 14 nt, Human
uuaggguuaugauu

SEQ ID NO: 1641865 - RNA, 15 nt, Human
uuaggugaggaagca

SEQ ID NO: 1641866 - RNA, 19 nt, Human
uuaggugugggggaagcac

SEQ ID NO: 1641867 - RNA, 18 nt, Human
uuagguuggcaaaaaggc

SEQ ID NO: 1641868 - RNA, 13 nt, Human
uuaguaaucauau

SEQ ID NO: 1641869 - RNA, 14 nt, Human
uuaguaaucauauu

SEQ ID NO: 1641870 - RNA, 14 nt, Human
uuaguagagacagg

SEQ ID NO: 1641871 - RNA, 17 nt, Human
uuaguagagacaggguu

SEQ ID NO: 1641872 - RNA, 15 nt, Human
uuauaaaaauaaaaa

SEQ ID NO: 1641873 - RNA, 13 nt, Human
uuaguagagacag

SEQ ID NO: 1641874 - RNA, 19 nt, Human
uuaguacuccccuccuuga

SEQ ID NO: 1641875 - RNA, 13 nt, Human
uuauaaacuuuac

SEQ ID NO: 1641876 - RNA, 22 nt, Human
uuauaaaaauaaaaaacacugg

SEQ ID NO: 1641877 - RNA, 21 nt, Human
uuauaaaaauaaaaaacacug

SEQ ID NO: 1641878 - RNA, 18 nt, Human
auaaauugcuccuugaca

SEQ ID NO: 1641879 - RNA, 15 nt, Human
auaacuauguugaua

SEQ ID NO: 1641880 - RNA, 14 nt, Human
uuacaggugugaac

SEQ ID NO: 1641881 - RNA, 20 nt, Human
uuacauaagauaaaugugcu

SEQ ID NO: 1641882 - RNA, 19 nt, Human
uuaccagcagagcaccuua

SEQ ID NO: 1641883 - RNA, 17 nt, Human
uuacaguggggaaugaa

SEQ ID NO: 1641884 - RNA, 18 nt, Human
auaaaugccaucaauaaa

SEQ ID NO: 1641885 - RNA, 17 nt, Human
auaaaugccaucaauaa

SEQ ID NO: 1641886 - RNA, 19 nt, Human
auaaaucugugaacuugaa

SEQ ID NO: 1641887 - RNA, 16 nt, Human
auaaaucugugaacuu

SEQ ID NO: 1641888 - RNA, 15 nt, Human
auaaaucugugaacu

SEQ ID NO: 1641889 - RNA, 16 nt, Human
auaaauugcuccuuga

SEQ ID NO: 1641890 - RNA, 13 nt, Human
auaaauugcuccu

SEQ ID NO: 1641891 - RNA, 14 nt, Human
auaagauucauauu

SEQ ID NO: 1641892 - RNA, 17 nt, Human
uuagaauucuguauaga

SEQ ID NO: 1641893 - RNA, 15 nt, Human
uuagaauucuguaua

SEQ ID NO: 1641894 - RNA, 14 nt, Human
uuagaauucuguau

SEQ ID NO: 1641895 - RNA, 16 nt, Human
uuagaagucacacagu

SEQ ID NO: 1641896 - RNA, 15 nt, Human
uuacugcagcuuugu

SEQ ID NO: 1641897 - RNA, 13 nt, Human
uuacuguacauga

SEQ ID NO: 1641898 - RNA, 14 nt, Human
uuacuguacaugaa

SEQ ID NO: 1641899 - RNA, 22 nt, Human
uuacuguacaugaaaacacauu

SEQ ID NO: 1641900 - RNA, 23 nt, Human
uuacuguacaugaaaacacauuu

SEQ ID NO: 1641901 - RNA, 12 nt, Human
uuacuguacaug

SEQ ID NO: 1641902 - RNA, 23 nt, Human
uuacuguacagacagaaaaaacu

SEQ ID NO: 1641903 - RNA, 20 nt, Human
aucuuggucagauuugaacu

SEQ ID NO: 1641904 - RNA, 13 nt, Human
aucuugcucugcu

SEQ ID NO: 1641905 - RNA, 14 nt, Human
aucuuauaauuuaa

SEQ ID NO: 1641906 - RNA, 18 nt, Human
aucugugaaaggaaagag

SEQ ID NO: 1641907 - RNA, 23 nt, Human
aucugugaaaggaaagagggagg

SEQ ID NO: 1641908 - RNA, 12 nt, Human
uugcuccuugac

SEQ ID NO: 1641909 - RNA, 17 nt, Human
aucugugaaaggaaaga

SEQ ID NO: 1641910 - RNA, 17 nt, Human
aucuggugacuuuccuc

SEQ ID NO: 1641911 - RNA, 16 nt, Human
aucuggugacuuuccu

SEQ ID NO: 1641912 - RNA, 10 nt, Human
aucuggugac

SEQ ID NO: 1641913 - RNA, 23 nt, Human
aucugccuaaggacuucuuuaau

SEQ ID NO: 1641914 - RNA, 22 nt, Human
aucugccuaaggacuucuuuaa

SEQ ID NO: 1641915 - RNA, 21 nt, Human
aucugccuaaggacuucuuua

SEQ ID NO: 1641916 - RNA, 11 nt, Human
aucugccuaag

SEQ ID NO: 1641917 - RNA, 19 nt, Human
augaaagggcccagagagg

SEQ ID NO: 1641918 - RNA, 18 nt, Human
augaacuuguaaaggaau

SEQ ID NO: 1641919 - RNA, 16 nt, Human
augaauauuuaguguu

SEQ ID NO: 1641920 - RNA, 11 nt, Human
augaagaggag

SEQ ID NO: 1641921 - RNA, 17 nt, Human
augaauuacauuuguau

SEQ ID NO: 1641922 - RNA, 16 nt, Human
augaauuacauuugua

SEQ ID NO: 1641923 - RNA, 18 nt, Human
uuggggaccagagcugcc

SEQ ID NO: 1641924 - RNA, 23 nt, Human
augaauggcuaagcaaaauguga

SEQ ID NO: 1641925 - RNA, 21 nt, Human
augaauauuuaguguucauaa

SEQ ID NO: 1641926 - RNA, 15 nt, Human
augaauuacauuugu

SEQ ID NO: 1641927 - RNA, 11 nt, Human
uuggagacaga

SEQ ID NO: 1641928 - RNA, 14 nt, Human
uugcuugaaagaaa

SEQ ID NO: 1641929 - RNA, 18 nt, Human
uuggccccugcccggcug

SEQ ID NO: 1641930 - RNA, 16 nt, Human
uuggagggugucccaa

SEQ ID NO: 1641931 - RNA, 18 nt, Human
augaaagggcccagagag

SEQ ID NO: 1641932 - RNA, 17 nt, Human
aucuuugcagacaggca

SEQ ID NO: 1641933 - RNA, 22 nt, Human
aucuuuucauuuaggugaggaa

SEQ ID NO: 1641934 - RNA, 18 nt, Human
aucuuugcagacaggcaa

SEQ ID NO: 1641935 - RNA, 16 nt, Human
uugagaucagccuggg

SEQ ID NO: 1641936 - RNA, 16 nt, Human
uugagauguguucaca

SEQ ID NO: 1641937 - RNA, 19 nt, Human
aucuacacuccagugagac

SEQ ID NO: 1641938 - RNA, 18 nt, Human
aucuacacuccagugaga

SEQ ID NO: 1641939 - RNA, 20 nt, Human
aucuaauauguaacaagcca

SEQ ID NO: 1641940 - RNA, 18 nt, Human
aucuaauauguaacaagc

SEQ ID NO: 1641941 - RNA, 15 nt, Human
uugauacuacaguuu

SEQ ID NO: 1641942 - RNA, 11 nt, Human
uugagugccuu

SEQ ID NO: 1641943 - RNA, 20 nt, Human
uugagugaagcugggagaac

SEQ ID NO: 1641944 - RNA, 20 nt, Human
uugaguugauucagcucugc

SEQ ID NO: 1641945 - RNA, 13 nt, Human
uugaaucacagua

SEQ ID NO: 1641946 - RNA, 17 nt, Human
uugaagggaaauuucag

SEQ ID NO: 1641947 - RNA, 13 nt, Human
uugaagccuuugu

SEQ ID NO: 1641948 - RNA, 13 nt, Human
aucuaaauggaac

SEQ ID NO: 1641949 - RNA, 17 nt, Human
aucuaaauggaaccacu

SEQ ID NO: 1641950 - RNA, 18 nt, Human
aucuaaauggaaccacuc

SEQ ID NO: 1641951 - RNA, 19 nt, Human
aucuaaauggaaccacucu

SEQ ID NO: 1641952 - RNA, 17 nt, Human
auccucuguacagagcc

SEQ ID NO: 1641953 - RNA, 16 nt, Human
auccucuguacagagc

SEQ ID NO: 1641954 - RNA, 13 nt, Human
uugcaucaauuuu

SEQ ID NO: 1641955 - RNA, 18 nt, Human
uugcaccacugcacucca

SEQ ID NO: 1641956 - RNA, 16 nt, Human
uugcaccacugcacuc

SEQ ID NO: 1641957 - RNA, 15 nt, Human
uugcaccacugcacu

SEQ ID NO: 1641958 - RNA, 19 nt, Human
uugcaauggcagccuuggc

SEQ ID NO: 1641959 - RNA, 17 nt, Human
uugcaauggcagccuug

SEQ ID NO: 1641960 - RNA, 16 nt, Human
uugcaauggcagccuu

SEQ ID NO: 1641961 - RNA, 14 nt, Human
uugauuaaauucuu

SEQ ID NO: 1641962 - RNA, 13 nt, Human
uugauuaaauucu

SEQ ID NO: 1641963 - RNA, 23 nt, Human
uugauguuuuaaggaugcuugua

SEQ ID NO: 1641964 - RNA, 23 nt, Human
aucugaaaauguauguguaagua

SEQ ID NO: 1641965 - RNA, 14 nt, Human
aucucauuuccaag

SEQ ID NO: 1641966 - RNA, 14 nt, Human
aucuccaaaauaaa

SEQ ID NO: 1641967 - RNA, 17 nt, Human
aucuccaaaauaaaacu

SEQ ID NO: 1641968 - RNA, 20 nt, Human
aucuccaaaauaaaacuuuu

SEQ ID NO: 1641969 - RNA, 21 nt, Human
aucuccaaaauaaaacuuuuu

SEQ ID NO: 1641970 - RNA, 16 nt, Human
aucucagggccugguc

SEQ ID NO: 1641971 - RNA, 17 nt, Human
aucucccccagccccau

SEQ ID NO: 1641972 - RNA, 16 nt, Human
aucucccccagcccca

SEQ ID NO: 1641973 - RNA, 21 nt, Human
aucucccccagccccauccuc

SEQ ID NO: 1641974 - RNA, 15 nt, Human
aucuccacuccagau

SEQ ID NO: 1641975 - RNA, 21 nt, Human
aucucuucuggguuccuuccu

SEQ ID NO: 1641976 - RNA, 15 nt, Human
aucucccccagcccc

SEQ ID NO: 1641977 - RNA, 22 nt, Human
aucugaaaauguauguguaagu

SEQ ID NO: 1641978 - RNA, 20 nt, Human
aucugaaaauguauguguaa

SEQ ID NO: 1641979 - RNA, 19 nt, Human
aucugaaaauguaugugua

SEQ ID NO: 1641980 - RNA, 16 nt, Human
aucugaaaauguaugu

SEQ ID NO: 1641981 - RNA, 14 nt, Human
aucugaaaauguau

SEQ ID NO: 1641982 - RNA, 18 nt, Human
aucucuugagccugggag

SEQ ID NO: 1641983 - RNA, 15 nt, Human
aucucuugagccugg

SEQ ID NO: 1641984 - RNA, 16 nt, Human
uucuagcauggcugcc

SEQ ID NO: 1641985 - RNA, 23 nt, Human
uucuaagaagugaaaaucuacac

SEQ ID NO: 1641986 - RNA, 16 nt, Human
uucuaaguaaaaccac

SEQ ID NO: 1641987 - RNA, 15 nt, Human
uucuaaguaaaacca

SEQ ID NO: 1641988 - RNA, 14 nt, Human
uucggccuccaucc

SEQ ID NO: 1641989 - RNA, 19 nt, Human
uucgcuccugugucuugca

SEQ ID NO: 1641990 - RNA, 15 nt, Human
uucgcuccugugucu

SEQ ID NO: 1641991 - RNA, 15 nt, Human
uucggccuccauccu

SEQ ID NO: 1641992 - RNA, 20 nt, Human
uucuaaaggcuaccuuugua

SEQ ID NO: 1641993 - RNA, 21 nt, Human
uucuaaaggcuaccuuuguau

SEQ ID NO: 1641994 - RNA, 21 nt, Human
uucuaaaucuccaaaauaaaa

SEQ ID NO: 1641995 - RNA, 13 nt, Human
uucuaaaguaaaa

SEQ ID NO: 1641996 - RNA, 22 nt, Human
aucacuugucaauaaaauccau

SEQ ID NO: 1641997 - RNA, 11 nt, Human
aucagaauucu

SEQ ID NO: 1641998 - RNA, 18 nt, Human
aucagaaguuucucagcu

SEQ ID NO: 1641999 - RNA, 23 nt, Human
uucuaggacugaauuaugaaacu

SEQ ID NO: 1642000 - RNA, 16 nt, Human
uucuaggacugaauua

SEQ ID NO: 1642001 - RNA, 14 nt, Human
uucuaggacugaau

SEQ ID NO: 1642002 - RNA, 13 nt, Human
uucuaggacugaa

SEQ ID NO: 1642003 - RNA, 16 nt, Human
uucucacuccuaccug

SEQ ID NO: 1642004 - RNA, 18 nt, Human
uucucacuccuaccuggu

SEQ ID NO: 1642005 - RNA, 17 nt, Human
aucaggguuaguauugu

SEQ ID NO: 1642006 - RNA, 20 nt, Human
aucaggccaggcccucugcc

SEQ ID NO: 1642007 - RNA, 12 nt, Human
aucagaauucuc

SEQ ID NO: 1642008 - RNA, 18 nt, Human
aucaggccaggcccucug

SEQ ID NO: 1642009 - RNA, 16 nt, Human
aucaggccaggcccuc

SEQ ID NO: 1642010 - RNA, 15 nt, Human
aucaggccaggcccu

SEQ ID NO: 1642011 - RNA, 13 nt, Human
aucagcacgauuu

SEQ ID NO: 1642012 - RNA, 11 nt, Human
uuccugugucu

SEQ ID NO: 1642013 - RNA, 18 nt, Human
auauuuuuuguuaaauga

SEQ ID NO: 1642014 - RNA, 20 nt, Human
auauuuuuuguuaaaugauu

SEQ ID NO: 1642015 - RNA, 14 nt, Human
aucaacagauaaau

SEQ ID NO: 1642016 - RNA, 15 nt, Human
aucacggcucacugc

SEQ ID NO: 1642017 - RNA, 14 nt, Human
aucacgccacugca

SEQ ID NO: 1642018 - RNA, 13 nt, Human
aucacgccacugc

SEQ ID NO: 1642019 - RNA, 19 nt, Human
aucacggcucacugcagcc

SEQ ID NO: 1642020 - RNA, 18 nt, Human
aucacggcucacugcagc

SEQ ID NO: 1642021 - RNA, 14 nt, Human
aucaaugaguaaca

SEQ ID NO: 1642022 - RNA, 23 nt, Human
aucaccugucuugccuuuuucau

SEQ ID NO: 1642023 - RNA, 19 nt, Human
uuccguagguuauuuucag

SEQ ID NO: 1642024 - RNA, 14 nt, Human
uuccguuaaaauac

SEQ ID NO: 1642025 - RNA, 16 nt, Human
uuccguuaaaauacca

SEQ ID NO: 1642026 - RNA, 20 nt, Human
uucccucaccuuucccaucu

SEQ ID NO: 1642027 - RNA, 22 nt, Human
uucccgcucagcccucccugcc

SEQ ID NO: 1642028 - RNA, 21 nt, Human
uucccgcucagcccucccugc

SEQ ID NO: 1642029 - RNA, 18 nt, Human
uucccgcucagcccuccc

SEQ ID NO: 1642030 - RNA, 16 nt, Human
uucccgcucagcccuc

SEQ ID NO: 1642031 - RNA, 22 nt, Human
uuccucuuuccaucuacccucc

SEQ ID NO: 1642032 - RNA, 17 nt, Human
uuccucuuuccaucuac

SEQ ID NO: 1642033 - RNA, 13 nt, Human
uuccucuuuccau

SEQ ID NO: 1642034 - RNA, 18 nt, Human
uuccugaagaauugaaaa

SEQ ID NO: 1642035 - RNA, 15 nt, Human
uuccugaacaggaua

SEQ ID NO: 1642036 - RNA, 14 nt, Human
uuccugaaccgaug

SEQ ID NO: 1642037 - RNA, 14 nt, Human
uuccugaacaggau

SEQ ID NO: 1642038 - RNA, 20 nt, Human
uuccuaaauauauuuuaaga

SEQ ID NO: 1642039 - RNA, 18 nt, Human
uuccuaauuccacagcug

SEQ ID NO: 1642040 - RNA, 17 nt, Human
uuccuaauuccacagcu

SEQ ID NO: 1642041 - RNA, 16 nt, Human
uuccuaauuccacagc

SEQ ID NO: 1642042 - RNA, 21 nt, Human
uuccucugaggcugaaauuca

SEQ ID NO: 1642043 - RNA, 17 nt, Human
uuccucugagccuuggg

SEQ ID NO: 1642044 - RNA, 14 nt, Human
uuccucugagccuu

SEQ ID NO: 1642045 - RNA, 19 nt, Human
uugaacccgggaggcagag

SEQ ID NO: 1642046 - RNA, 17 nt, Human
uugaaauuguauuacaa

SEQ ID NO: 1642047 - RNA, 17 nt, Human
uugaaauuguaauuaua

SEQ ID NO: 1642048 - RNA, 15 nt, Human
uugaaauuguaauua

SEQ ID NO: 1642049 - RNA, 14 nt, Human
uugaaauuguaauu

SEQ ID NO: 1642050 - RNA, 13 nt, Human
uugaaauuguaau

SEQ ID NO: 1642051 - RNA, 12 nt, Human
auccuaagcuau

SEQ ID NO: 1642052 - RNA, 21 nt, Human
auccuaagcuauucaguaaua

SEQ ID NO: 1642053 - RNA, 19 nt, Human
auccuacaagacacaguga

SEQ ID NO: 1642054 - RNA, 18 nt, Human
auccuacaagacacagug

SEQ ID NO: 1642055 - RNA, 16 nt, Human
auccuaggcauuugcu

SEQ ID NO: 1642056 - RNA, 16 nt, Human
auccuccucagaucuu

SEQ ID NO: 1642057 - RNA, 23 nt, Human
aucccucauccucauacccaccc

SEQ ID NO: 1642058 - RNA, 21 nt, Human
aucccucauccucauacccac

SEQ ID NO: 1642059 - RNA, 14 nt, Human
aucccucauccuca

SEQ ID NO: 1642060 - RNA, 13 nt, Human
aucccaugagccu

SEQ ID NO: 1642061 - RNA, 24 nt, Human
aucccauaugccugggcagaagga

SEQ ID NO: 1642062 - RNA, 13 nt, Human
uucuucucccuca

SEQ ID NO: 1642063 - RNA, 15 nt, Human
uucuucugcuucagc

SEQ ID NO: 1642064 - RNA, 13 nt, Human
uucuucugcuuca

SEQ ID NO: 1642065 - RNA, 14 nt, Human
uucuucucccucag

SEQ ID NO: 1642066 - RNA, 20 nt, Human
uucuucugcuucagccuccc

SEQ ID NO: 1642067 - RNA, 16 nt, Human
uucuuuguaaugaaaa

SEQ ID NO: 1642068 - RNA, 15 nt, Human
uucuuuguaaugaaa

SEQ ID NO: 1642069 - RNA, 14 nt, Human
uucuuuuuuuguga

SEQ ID NO: 1642070 - RNA, 12 nt, Human
uucucuaggaaa

SEQ ID NO: 1642071 - RNA, 17 nt, Human
uucuccuuucacaaccu

SEQ ID NO: 1642072 - RNA, 15 nt, Human
uucucuaguuugauu

SEQ ID NO: 1642073 - RNA, 17 nt, Human
uucucuaguuugauuaa

SEQ ID NO: 1642074 - RNA, 20 nt, Human
uucucuaguuugauuaaauu

SEQ ID NO: 1642075 - RNA, 21 nt, Human
uucuccuuguguuacuaaguu

SEQ ID NO: 1642076 - RNA, 14 nt, Human
aucaggugcugcca

SEQ ID NO: 1642077 - RNA, 17 nt, Human
uucuggcucuuccaggc

SEQ ID NO: 1642078 - RNA, 16 nt, Human
uucuggcucuuccagg

SEQ ID NO: 1642079 - RNA, 18 nt, Human
uucugccugcccaggccc

SEQ ID NO: 1642080 - RNA, 17 nt, Human
uucugccugcccaggcc

SEQ ID NO: 1642081 - RNA, 21 nt, Human
uucugccugcccaggccccug

SEQ ID NO: 1642082 - RNA, 22 nt, Human
uucugaacuuggcgcugccccu

SEQ ID NO: 1642083 - RNA, 19 nt, Human
uucugaacuuggcgcugcc

SEQ ID NO: 1642084 - RNA, 15 nt, Human
uucugccauauucug

SEQ ID NO: 1642085 - RNA, 23 nt, Human
uucugaacuuggcgcugccccug

SEQ ID NO: 1642086 - RNA, 20 nt, Human
aucccaaacccuucagugcc

SEQ ID NO: 1642087 - RNA, 19 nt, Human
aucccaaacccuucagugc

SEQ ID NO: 1642088 - RNA, 18 nt, Human
aucccauaugccugggca

SEQ ID NO: 1642089 - RNA, 21 nt, Human
auccaguaucuugaagacuuu

SEQ ID NO: 1642090 - RNA, 17 nt, Human
auccaguuuuguuugga

SEQ ID NO: 1642091 - RNA, 13 nt, Human
auccaucaggcca

SEQ ID NO: 1642092 - RNA, 21 nt, Human
auccauuuggaaaucuuuaaa

SEQ ID NO: 1642093 - RNA, 16 nt, Human
auccaguaucuugaag

SEQ ID NO: 1642094 - RNA, 16 nt, Human
auccacccaccucagc

SEQ ID NO: 1642095 - RNA, 15 nt, Human
auccacccaccucag

SEQ ID NO: 1642096 - RNA, 13 nt, Human
auccacccaccuc

SEQ ID NO: 1642097 - RNA, 21 nt, Human
auccaagcuggucccacucag

SEQ ID NO: 1642098 - RNA, 18 nt, Human
auccaagcuggucccacu

SEQ ID NO: 1642099 - RNA, 20 nt, Human
aucauuuuaccuuugacaaa

SEQ ID NO: 1642100 - RNA, 18 nt, Human
uuuaucaugugaaaucau

SEQ ID NO: 1642101 - RNA, 17 nt, Human
uuuaucaugugaaauca

SEQ ID NO: 1642102 - RNA, 13 nt, Human
augcuaagugaaa

SEQ ID NO: 1642103 - RNA, 16 nt, Human
augcuaagacucagug

SEQ ID NO: 1642104 - RNA, 13 nt, Human
uuuauauuuacua

SEQ ID NO: 1642105 - RNA, 16 nt, Human
uuuauauuuacuaaaa

SEQ ID NO: 1642106 - RNA, 11 nt, Human
augcuauuucu

SEQ ID NO: 1642107 - RNA, 20 nt, Human
augcuauuucuauauuuuca

SEQ ID NO: 1642108 - RNA, 15 nt, Human
augcuauuucuauau

SEQ ID NO: 1642109 - RNA, 14 nt, Human
augcuauuucuaua

SEQ ID NO: 1642110 - RNA, 13 nt, Human
augcuauuucuau

SEQ ID NO: 1642111 - RNA, 23 nt, Human
augcuauuucuauauuuucauuc

SEQ ID NO: 1642112 - RNA, 22 nt, Human
augcuauuucuauauuuucauu

SEQ ID NO: 1642113 - RNA, 21 nt, Human
augcuauuucuauauuuucau

SEQ ID NO: 1642114 - RNA, 22 nt, Human
augcuagaacucccuuucaaca

SEQ ID NO: 1642115 - RNA, 21 nt, Human
augcuagaacucccuuucaac

SEQ ID NO: 1642116 - RNA, 20 nt, Human
augcuagaacucccuuucaa

SEQ ID NO: 1642117 - RNA, 18 nt, Human
uuuauuacaguauaauua

SEQ ID NO: 1642118 - RNA, 14 nt, Human
uuuauuacaguaua

SEQ ID NO: 1642119 - RNA, 17 nt, Human
uuucaaacauauauaac

SEQ ID NO: 1642120 - RNA, 16 nt, Human
uuucaaacuuuacuau

SEQ ID NO: 1642121 - RNA, 22 nt, Human
uuucaaacuuuacuauggcccu

SEQ ID NO: 1642122 - RNA, 16 nt, Human
uuucaaacauauauaa

SEQ ID NO: 1642123 - RNA, 22 nt, Human
uuucaaaauuguuacaaauugu

SEQ ID NO: 1642124 - RNA, 16 nt, Human
uuuauuuuguguuuag

SEQ ID NO: 1642125 - RNA, 23 nt, Human
auggaacgcguugaaauuguaau

SEQ ID NO: 1642126 - RNA, 20 nt, Human
uuuauuuuguguuuaggaac

SEQ ID NO: 1642127 - RNA, 19 nt, Human
auggaacgcguugaaauug

SEQ ID NO: 1642128 - RNA, 18 nt, Human
auggaacgcguugaaauu

SEQ ID NO: 1642129 - RNA, 13 nt, Human
augcuucucacug

SEQ ID NO: 1642130 - RNA, 17 nt, Human
auggaacgcguugaaau

SEQ ID NO: 1642131 - RNA, 16 nt, Human
auggaacgcguugaaa

SEQ ID NO: 1642132 - RNA, 15 nt, Human
auggaacgcguugaa

SEQ ID NO: 1642133 - RNA, 19 nt, Human
augcuguucaugaaagauu

SEQ ID NO: 1642134 - RNA, 23 nt, Human
augcuguucaugaaagauucaau

SEQ ID NO: 1642135 - RNA, 22 nt, Human
augcugugcccuaaaguguauu

SEQ ID NO: 1642136 - RNA, 17 nt, Human
augcuguucaugaaaga

SEQ ID NO: 1642137 - RNA, 13 nt, Human
augcugcuuuuuc

SEQ ID NO: 1642138 - RNA, 15 nt, Human
uuucauuauuuuauu

SEQ ID NO: 1642139 - RNA, 13 nt, Human
uuucauuauuuua

SEQ ID NO: 1642140 - RNA, 18 nt, Human
uuuccaugaguccccugu

SEQ ID NO: 1642141 - RNA, 17 nt, Human
uuuccaugaguccccug

SEQ ID NO: 1642142 - RNA, 20 nt, Human
uuucauuauuuuauuaugaa

SEQ ID NO: 1642143 - RNA, 19 nt, Human
uuucauuauuuuauuauga

SEQ ID NO: 1642144 - RNA, 12 nt, Human
auggacuuuguu

SEQ ID NO: 1642145 - RNA, 11 nt, Human
auggacuuugu

SEQ ID NO: 1642146 - RNA, 22 nt, Human
auggacuguggugacuuuggau

SEQ ID NO: 1642147 - RNA, 17 nt, Human
auggacuguggugacuu

SEQ ID NO: 1642148 - RNA, 16 nt, Human
auggacuguggugacu

SEQ ID NO: 1642149 - RNA, 16 nt, Human
auggcacuaguauuuc

SEQ ID NO: 1642150 - RNA, 14 nt, Human
auggcacuaguauu

SEQ ID NO: 1642151 - RNA, 18 nt, Human
auggagacugucucaaga

SEQ ID NO: 1642152 - RNA, 19 nt, Human
auggcuaagcaaaauguga

SEQ ID NO: 1642153 - RNA, 18 nt, Human
auggcuaauguacugcau

SEQ ID NO: 1642154 - RNA, 15 nt, Human
augggagagaagaga

SEQ ID NO: 1642155 - RNA, 19 nt, Human
augggagagaagagaaugc

SEQ ID NO: 1642156 - RNA, 14 nt, Human
augggauaaaugcc

SEQ ID NO: 1642157 - RNA, 15 nt, Human
augauaacuggaaac

SEQ ID NO: 1642158 - RNA, 21 nt, Human
uuguuccacaaguuaaauaaa

SEQ ID NO: 1642159 - RNA, 13 nt, Human
uuguguucaccuu

SEQ ID NO: 1642160 - RNA, 13 nt, Human
uuguguuacuaag

SEQ ID NO: 1642161 - RNA, 15 nt, Human
uuguguuacuaaguu

SEQ ID NO: 1642162 - RNA, 20 nt, Human
uuguguuacuaaguuuuuau

SEQ ID NO: 1642163 - RNA, 18 nt, Human
augauuaaguaaugauaa

SEQ ID NO: 1642164 - RNA, 14 nt, Human
augauuaaguaaug

SEQ ID NO: 1642165 - RNA, 20 nt, Human
augaucuaggaagacuuugg

SEQ ID NO: 1642166 - RNA, 17 nt, Human
augaucuaggaagacuu

SEQ ID NO: 1642167 - RNA, 22 nt, Human
augauccagcagauuauucacu

SEQ ID NO: 1642168 - RNA, 21 nt, Human
augauacuugaaaauuaacau

SEQ ID NO: 1642169 - RNA, 17 nt, Human
augauacuugaaaauua

SEQ ID NO: 1642170 - RNA, 20 nt, Human
augauccagcagauuauuca

SEQ ID NO: 1642171 - RNA, 19 nt, Human
augauccagcagauuauuc

SEQ ID NO: 1642172 - RNA, 10 nt, Human
augauccagc

SEQ ID NO: 1642173 - RNA, 21 nt, Human
augcacuuuguucuggcucuu

SEQ ID NO: 1642174 - RNA, 13 nt, Human
uuuaaagaaugcu

SEQ ID NO: 1642175 - RNA, 22 nt, Human
augcaccagcccuuagcaggga

SEQ ID NO: 1642176 - RNA, 13 nt, Human
augcaccuggaau

SEQ ID NO: 1642177 - RNA, 20 nt, Human
augcacuuuguucuggcucu

SEQ ID NO: 1642178 - RNA, 19 nt, Human
augcacuuuguucuggcuc

SEQ ID NO: 1642179 - RNA, 17 nt, Human
augcacuuuguucuggc

SEQ ID NO: 1642180 - RNA, 21 nt, Human
augccauuuaaagcuuauuaa

SEQ ID NO: 1642181 - RNA, 17 nt, Human
augccauuuaaagcuua

SEQ ID NO: 1642182 - RNA, 13 nt, Human
augcaguucugaa

SEQ ID NO: 1642183 - RNA, 23 nt, Human
augcagugguaugaucacggcuc

SEQ ID NO: 1642184 - RNA, 13 nt, Human
augcagugcuucc

SEQ ID NO: 1642185 - RNA, 21 nt, Human
augcgggccagugcuccagcc

SEQ ID NO: 1642186 - RNA, 20 nt, Human
augcgugcauaccacuuuug

SEQ ID NO: 1642187 - RNA, 15 nt, Human
augcccagccccuuc

SEQ ID NO: 1642188 - RNA, 14 nt, Human
augcccagccccuu

SEQ ID NO: 1642189 - RNA, 13 nt, Human
augcccagccccu

SEQ ID NO: 1642190 - RNA, 12 nt, Human
augcccagcccc

SEQ ID NO: 1642191 - RNA, 16 nt, Human
augccucagccuccug

SEQ ID NO: 1642192 - RNA, 14 nt, Human
augcccuggaucca

SEQ ID NO: 1642193 - RNA, 18 nt, Human
uuuaaauauaugcuaagu

SEQ ID NO: 1642194 - RNA, 21 nt, Human
uuuaaauaaauaaauagcuag

SEQ ID NO: 1642195 - RNA, 12 nt, Human
uuuaauucaguu

SEQ ID NO: 1642196 - RNA, 18 nt, Human
augcagccucacaguccu

SEQ ID NO: 1642197 - RNA, 17 nt, Human
augcagcaucuaaguaa

SEQ ID NO: 1642198 - RNA, 18 nt, Human
uuugaccucugcagcaau

SEQ ID NO: 1642199 - RNA, 12 nt, Human
uuugaccucugc

SEQ ID NO: 1642200 - RNA, 19 nt, Human
auguagccccucuccugga

SEQ ID NO: 1642201 - RNA, 13 nt, Human
auguagaggagaa

SEQ ID NO: 1642202 - RNA, 12 nt, Human
auguagaggaga

SEQ ID NO: 1642203 - RNA, 19 nt, Human
auguagaggagaaacugga

SEQ ID NO: 1642204 - RNA, 17 nt, Human
auguagaggagaaacug

SEQ ID NO: 1642205 - RNA, 16 nt, Human
auguacuucaugcugu

SEQ ID NO: 1642206 - RNA, 14 nt, Human
uuugcaagccagau

SEQ ID NO: 1642207 - RNA, 15 nt, Human
uuugccguuauuaaa

SEQ ID NO: 1642208 - RNA, 22 nt, Human
uuugauucagacagcugccugg

SEQ ID NO: 1642209 - RNA, 13 nt, Human
uuugccucugccu

SEQ ID NO: 1642210 - RNA, 22 nt, Human
uuugauguucuuucacccuuuu

SEQ ID NO: 1642211 - RNA, 13 nt, Human
uuugauuaaauuc

SEQ ID NO: 1642212 - RNA, 18 nt, Human
uuugauuaaauucuugca

SEQ ID NO: 1642213 - RNA, 21 nt, Human
uuugauuaaauucuugcaaag

SEQ ID NO: 1642214 - RNA, 21 nt, Human
uuugauucagacagcugccug

SEQ ID NO: 1642215 - RNA, 23 nt, Human
uuugauuaaauucuugcaaagua

SEQ ID NO: 1642216 - RNA, 19 nt, Human
uuugacgccaucccagccc

SEQ ID NO: 1642217 - RNA, 16 nt, Human
uuugacgccaucccag

SEQ ID NO: 1642218 - RNA, 14 nt, Human
uuugacgccauccc

SEQ ID NO: 1642219 - RNA, 13 nt, Human
uuugacgccaucc

SEQ ID NO: 1642220 - RNA, 20 nt, Human
uuugacgccaucccagcccc

SEQ ID NO: 1642221 - RNA, 17 nt, Human
uuugugaagcaaaauuu

SEQ ID NO: 1642222 - RNA, 22 nt, Human
uuugugaaaugauggugaaagu

SEQ ID NO: 1642223 - RNA, 20 nt, Human
uuugugaagguggaaauaaa

SEQ ID NO: 1642224 - RNA, 19 nt, Human
uuugugcugguguaugugu

SEQ ID NO: 1642225 - RNA, 21 nt, Human
uuuguaguguuggagaagaac

SEQ ID NO: 1642226 - RNA, 19 nt, Human
uuuguaguguuggagaaga

SEQ ID NO: 1642227 - RNA, 12 nt, Human
uuuguauaaaag

SEQ ID NO: 1642228 - RNA, 14 nt, Human
uuuguaaugaaaac

SEQ ID NO: 1642229 - RNA, 13 nt, Human
uuuguaaugaaaa

SEQ ID NO: 1642230 - RNA, 23 nt, Human
augugcacaugcacgugugugca

SEQ ID NO: 1642231 - RNA, 19 nt, Human
augugaugagaggaaauca

SEQ ID NO: 1642232 - RNA, 17 nt, Human
augugaugagaggaaau

SEQ ID NO: 1642233 - RNA, 16 nt, Human
augugaugagaggaaa

SEQ ID NO: 1642234 - RNA, 23 nt, Human
augucucuuuaaugucacaggca

SEQ ID NO: 1642235 - RNA, 17 nt, Human
auguccacugguucuuc

SEQ ID NO: 1642236 - RNA, 13 nt, Human
augucagugugac

SEQ ID NO: 1642237 - RNA, 12 nt, Human
augucaguguga

SEQ ID NO: 1642238 - RNA, 17 nt, Human
augucucugagcauuag

SEQ ID NO: 1642239 - RNA, 14 nt, Human
augucgccucugca

SEQ ID NO: 1642240 - RNA, 13 nt, Human
augucgccucugc

SEQ ID NO: 1642241 - RNA, 15 nt, Human
augucgccucugcau

SEQ ID NO: 1642242 - RNA, 22 nt, Human
augucucaggucccugcagggc

SEQ ID NO: 1642243 - RNA, 17 nt, Human
augucucaggucccugc

SEQ ID NO: 1642244 - RNA, 16 nt, Human
auguauguguaaguau

SEQ ID NO: 1642245 - RNA, 22 nt, Human
auguauuacaguggggaaugaa

SEQ ID NO: 1642246 - RNA, 20 nt, Human
uuuggcauaacauaaaucug

SEQ ID NO: 1642247 - RNA, 21 nt, Human
uuuggcauaacauaaaucugu

SEQ ID NO: 1642248 - RNA, 18 nt, Human
auguaugagguacaaccu

SEQ ID NO: 1642249 - RNA, 21 nt, Human
augguucccuugaugaagaag

SEQ ID NO: 1642250 - RNA, 20 nt, Human
augguuccccuguucacucu

SEQ ID NO: 1642251 - RNA, 19 nt, Human
augguuccccuguucacuc

SEQ ID NO: 1642252 - RNA, 13 nt, Human
augguuguacaua

SEQ ID NO: 1642253 - RNA, 15 nt, Human
augguuuucaaaaua

SEQ ID NO: 1642254 - RNA, 14 nt, Human
augguuuucaaaau

SEQ ID NO: 1642255 - RNA, 14 nt, Human
augguuuucuugug

SEQ ID NO: 1642256 - RNA, 16 nt, Human
augguuuucaaaauaa

SEQ ID NO: 1642257 - RNA, 23 nt, Human
auguaaaucccauuauucaaagu

SEQ ID NO: 1642258 - RNA, 22 nt, Human
auguaaaucccauuauucaaag

SEQ ID NO: 1642259 - RNA, 20 nt, Human
auguaaaucccauuauucaa

SEQ ID NO: 1642260 - RNA, 14 nt, Human
auguaaaucccauu

SEQ ID NO: 1642261 - RNA, 17 nt, Human
augguggcuggguugga

SEQ ID NO: 1642262 - RNA, 15 nt, Human
augguggcuggguug

SEQ ID NO: 1642263 - RNA, 13 nt, Human
augguggcugggu

SEQ ID NO: 1642264 - RNA, 12 nt, Human
augguggcuggg

SEQ ID NO: 1642265 - RNA, 15 nt, Human
auggugcaaugaccu

SEQ ID NO: 1642266 - RNA, 13 nt, Human
auggugcaaugac

SEQ ID NO: 1642267 - RNA, 12 nt, Human
auggugcaauga

SEQ ID NO: 1642268 - RNA, 20 nt, Human
augggugcuuggaggaagga

SEQ ID NO: 1642269 - RNA, 20 nt, Human
auggugagggauacccaucc

SEQ ID NO: 1642270 - RNA, 15 nt, Human
augggugcuuggagg

SEQ ID NO: 1642271 - RNA, 14 nt, Human
auggugaugaaaug

SEQ ID NO: 1642272 - RNA, 17 nt, Human
auggugaugaaauguaa

SEQ ID NO: 1642273 - RNA, 16 nt, Human
auggugaugaaaugua

SEQ ID NO: 1642274 - RNA, 17 nt, Human
auggugcaaugaccuuu

SEQ ID NO: 1642275 - RNA, 16 nt, Human
auggugcaaugaccuu

SEQ ID NO: 1642276 - RNA, 19 nt, Human
auggugcaaugaccuuuca

SEQ ID NO: 1642277 - RNA, 18 nt, Human
uuucucccagucauuuaa

SEQ ID NO: 1642278 - RNA, 17 nt, Human
uuucucccagucauuua

SEQ ID NO: 1642279 - RNA, 18 nt, Human
augggcaacccccagccu

SEQ ID NO: 1642280 - RNA, 15 nt, Human
augggauccuggagu

SEQ ID NO: 1642281 - RNA, 20 nt, Human
augggauaaaugccaucaau

SEQ ID NO: 1642282 - RNA, 16 nt, Human
augggauaaaugccau

SEQ ID NO: 1642283 - RNA, 15 nt, Human
augggauaaaugcca

SEQ ID NO: 1642284 - RNA, 19 nt, Human
uuucugcagccacuauugu

SEQ ID NO: 1642285 - RNA, 15 nt, Human
uuucuggcuaugcau

SEQ ID NO: 1642286 - RNA, 16 nt, Human
uuucuggcuaugcauu

SEQ ID NO: 1642287 - RNA, 18 nt, Human
uuucuggcuaugcauuug

SEQ ID NO: 1642288 - RNA, 19 nt, Human
uuucuggcuaugcauuuga

SEQ ID NO: 1642289 - RNA, 21 nt, Human
uuucugcagccacuauuguua

SEQ ID NO: 1642290 - RNA, 23 nt, Human
uuucugggcaccggggccucgga

SEQ ID NO: 1642291 - RNA, 19 nt, Human
uuucuguacuuuuuggcau

SEQ ID NO: 1642292 - RNA, 20 nt, Human
uuucuguacuuuuuggcaua

SEQ ID NO: 1642293 - RNA, 24 nt, Human
auggggcugcaccggcuggccugg

SEQ ID NO: 1642294 - RNA, 14 nt, Human
augggggugcauuu

SEQ ID NO: 1642295 - RNA, 17 nt, Human
augggggcacugaggac

SEQ ID NO: 1642296 - RNA, 15 nt, Human
augggggugcauuug

SEQ ID NO: 1642297 - RNA, 15 nt, Human
uuugaaauauugacu

SEQ ID NO: 1642298 - RNA, 20 nt, Human
augggcuggguucuacccag

SEQ ID NO: 1642299 - RNA, 18 nt, Human
augggccuccugugugug

SEQ ID NO: 1642300 - RNA, 20 nt, Human
auucacauuguauucagagu

SEQ ID NO: 1642301 - RNA, 13 nt, Human
auucacauuguau

SEQ ID NO: 1642302 - RNA, 11 nt, Human
auucagacagc

SEQ ID NO: 1642303 - RNA, 13 nt, Human
auucagacagcug

SEQ ID NO: 1642304 - RNA, 12 nt, Human
auucagacagcu

SEQ ID NO: 1642305 - RNA, 17 nt, Human
auucagacagcugccug

SEQ ID NO: 1642306 - RNA, 16 nt, Human
auucagacagcugccu

SEQ ID NO: 1642307 - RNA, 15 nt, Human
auucagacagcugcc

SEQ ID NO: 1642308 - RNA, 14 nt, Human
auucagacagcugc

SEQ ID NO: 1642309 - RNA, 12 nt, Human
auucaggaagcu

SEQ ID NO: 1642310 - RNA, 22 nt, Human
auucaggaagcagcuuucccca

SEQ ID NO: 1642311 - RNA, 18 nt, Human
auucagacagcugccugg

SEQ ID NO: 1642312 - RNA, 22 nt, Human
auuccccacccugaaagcccug

SEQ ID NO: 1642313 - RNA, 23 nt, Human
auuccccgucucugguuccuccc

SEQ ID NO: 1642314 - RNA, 13 nt, Human
auucaggaagcuc

SEQ ID NO: 1642315 - RNA, 19 nt, Human
auuccagagaguggcuccu

SEQ ID NO: 1642316 - RNA, 21 nt, Human
auuccagagaguggcuccucc

SEQ ID NO: 1642317 - RNA, 18 nt, Human
auucaaacagucucagga

SEQ ID NO: 1642318 - RNA, 16 nt, Human
auucaaacagucucag

SEQ ID NO: 1642319 - RNA, 20 nt, Human
auucaaacagucucaggaaa

SEQ ID NO: 1642320 - RNA, 19 nt, Human
auucaaacagucucaggaa

SEQ ID NO: 1642321 - RNA, 13 nt, Human
auuauucaaaguu

SEQ ID NO: 1642322 - RNA, 15 nt, Human
auuauucaaaguugc

SEQ ID NO: 1642323 - RNA, 14 nt, Human
auuauucaaaguug

SEQ ID NO: 1642324 - RNA, 17 nt, Human
auuauucaaaguugccu

SEQ ID NO: 1642325 - RNA, 21 nt, Human
auuauguuaaaacugggacag

SEQ ID NO: 1642326 - RNA, 14 nt, Human
auuaucuagauacu

SEQ ID NO: 1642327 - RNA, 18 nt, Human
auuaucuagauacuguau

SEQ ID NO: 1642328 - RNA, 18 nt, Human
auuauauuuauuacugua

SEQ ID NO: 1642329 - RNA, 15 nt, Human
auuauauuuauuacu

SEQ ID NO: 1642330 - RNA, 15 nt, Human
auuauuauuuggccc

SEQ ID NO: 1642331 - RNA, 15 nt, Human
auuauauuuacaaau

SEQ ID NO: 1642332 - RNA, 14 nt, Human
auuauauuaugaag

SEQ ID NO: 1642333 - RNA, 19 nt, Human
auuauacccccugcaaagc

SEQ ID NO: 1642334 - RNA, 11 nt, Human
uuuguggaaaa

SEQ ID NO: 1642335 - RNA, 19 nt, Human
auucagacagcugccuggg

SEQ ID NO: 1642336 - RNA, 15 nt, Human
auucuagcuuugagc

SEQ ID NO: 1642337 - RNA, 17 nt, Human
auucucauuugucacac

SEQ ID NO: 1642338 - RNA, 22 nt, Human
auucucaugccucagccuccug

SEQ ID NO: 1642339 - RNA, 19 nt, Human
auucugccugcccaggccc

SEQ ID NO: 1642340 - RNA, 18 nt, Human
auucugccugcccaggcc

SEQ ID NO: 1642341 - RNA, 17 nt, Human
auucugccugcccaggc

SEQ ID NO: 1642342 - RNA, 16 nt, Human
auucugccugcccagg

SEQ ID NO: 1642343 - RNA, 15 nt, Human
auucugccugcccag

SEQ ID NO: 1642344 - RNA, 14 nt, Human
auucugccugccca

SEQ ID NO: 1642345 - RNA, 13 nt, Human
auucugccugccc

SEQ ID NO: 1642346 - RNA, 11 nt, Human
auucugccugc

SEQ ID NO: 1642347 - RNA, 22 nt, Human
auucugcucacauaucugucau

SEQ ID NO: 1642348 - RNA, 21 nt, Human
auucugcucacauaucuguca

SEQ ID NO: 1642349 - RNA, 20 nt, Human
auucugcucacauaucuguc

SEQ ID NO: 1642350 - RNA, 19 nt, Human
auucugcucacauaucugu

SEQ ID NO: 1642351 - RNA, 21 nt, Human
auucugccugcccaggccccu

SEQ ID NO: 1642352 - RNA, 20 nt, Human
auucugccugcccaggcccc

SEQ ID NO: 1642353 - RNA, 18 nt, Human
auucugcucacauaucug

SEQ ID NO: 1642354 - RNA, 21 nt, Human
auucuguuggccagugugaca

SEQ ID NO: 1642355 - RNA, 19 nt, Human
auucuguuggccaguguga

SEQ ID NO: 1642356 - RNA, 14 nt, Human
auucuguuggccag

SEQ ID NO: 1642357 - RNA, 13 nt, Human
auucuguauagau

SEQ ID NO: 1642358 - RNA, 12 nt, Human
auucuguauaga

SEQ ID NO: 1642359 - RNA, 11 nt, Human
auucuguauag

SEQ ID NO: 1642360 - RNA, 19 nt, Human
auugacacuuaaaaauggu

SEQ ID NO: 1642361 - RNA, 11 nt, Human
auugacuucuu

SEQ ID NO: 1642362 - RNA, 17 nt, Human
auugacacuuaaaaaug

SEQ ID NO: 1642363 - RNA, 15 nt, Human
auugacacuuaaaaa

SEQ ID NO: 1642364 - RNA, 18 nt, Human
auugaaaucuuuuugcuu

SEQ ID NO: 1642365 - RNA, 17 nt, Human
auugaaaucuuuuugcu

SEQ ID NO: 1642366 - RNA, 20 nt, Human
auugaaaucuuuuugcuuug

SEQ ID NO: 1642367 - RNA, 15 nt, Human
auugaaaaaccauuu

SEQ ID NO: 1642368 - RNA, 14 nt, Human
auucuuaaauaugu

SEQ ID NO: 1642369 - RNA, 20 nt, Human
auucuuaaaguugaauuuau

SEQ ID NO: 1642370 - RNA, 19 nt, Human
auucuuaaaguugaauuua

SEQ ID NO: 1642371 - RNA, 15 nt, Human
auucuguauagauua

SEQ ID NO: 1642372 - RNA, 21 nt, Human
auucuuaaaguugaauuuauu

SEQ ID NO: 1642373 - RNA, 13 nt, Human
auucuuccucccu

SEQ ID NO: 1642374 - RNA, 19 nt, Human
auuuuuguagagccagggu

SEQ ID NO: 1642375 - RNA, 12 nt, Human
auuuuuguaauu

SEQ ID NO: 1642376 - RNA, 22 nt, Human
auuuuugugauuuugugauuga

SEQ ID NO: 1642377 - RNA, 21 nt, Human
auuuuuguuuucauuaucuca

SEQ ID NO: 1642378 - RNA, 13 nt, Human
auuuuuuaaaugc

SEQ ID NO: 1642379 - RNA, 14 nt, Human
auuuuuuaaaugca

SEQ ID NO: 1642380 - RNA, 18 nt, Human
auuuuuuaaauugaauuc

SEQ ID NO: 1642381 - RNA, 18 nt, Human
auuuuuuguuaaaugauu

SEQ ID NO: 1642382 - RNA, 23 nt, Human
auuuuuucucuaggaaauauuua

SEQ ID NO: 1642383 - RNA, 20 nt, Human
auuuuuucucuaggaaauau

SEQ ID NO: 1642384 - RNA, 19 nt, Human
auuuuuuacagcugccugc

SEQ ID NO: 1642385 - RNA, 20 nt, Human
auuuuucuuauuucauuucu

SEQ ID NO: 1642386 - RNA, 19 nt, Human
auuuuucuuauuucauuuc

SEQ ID NO: 1642387 - RNA, 15 nt, Human
auuuuucuuauuuca

SEQ ID NO: 1642388 - RNA, 22 nt, Human
auuuuucuuagggaaggauaca

SEQ ID NO: 1642389 - RNA, 21 nt, Human
auuuuucuuagggaaggauac

SEQ ID NO: 1642390 - RNA, 21 nt, Human
auuuuguuuuugucuuaaaaa

SEQ ID NO: 1642391 - RNA, 15 nt, Human
auuuuguuucuguac

SEQ ID NO: 1642392 - RNA, 14 nt, Human
auuuuguuucugua

SEQ ID NO: 1642393 - RNA, 17 nt, Human
auuuuguguuuaggaac

SEQ ID NO: 1642394 - RNA, 16 nt, Human
auuuuguuucagugca

SEQ ID NO: 1642395 - RNA, 11 nt, Human
auuuuguuucu

SEQ ID NO: 1642396 - RNA, 23 nt, Human
auuuugucauauaagauucauau

SEQ ID NO: 1642397 - RNA, 19 nt, Human
auuuugugcccccauguaa

SEQ ID NO: 1642398 - RNA, 19 nt, Human
auuuuggaaaauaaauuau

SEQ ID NO: 1642399 - RNA, 14 nt, Human
auuuuggaaaauaa

SEQ ID NO: 1642400 - RNA, 20 nt, Human
auuuuggaaaauaaauuauu

SEQ ID NO: 1642401 - RNA, 12 nt, Human
auuuuggaauuu

SEQ ID NO: 1642402 - RNA, 12 nt, Human
auuuugcuuugu

SEQ ID NO: 1642403 - RNA, 18 nt, Human
auuuugcuuugugauuuu

SEQ ID NO: 1642404 - RNA, 20 nt, Human
auuuugcuuugugauuuuug

SEQ ID NO: 1642405 - RNA, 14 nt, Human
auuuuccugaaaac

SEQ ID NO: 1642406 - RNA, 19 nt, Human
auuuucccuauuagagaag

SEQ ID NO: 1642407 - RNA, 16 nt, Human
auuuuccugccaggca

SEQ ID NO: 1642408 - RNA, 14 nt, Human
auuuucuauaauuu

SEQ ID NO: 1642409 - RNA, 15 nt, Human
auuuucuauaauuua

SEQ ID NO: 1642410 - RNA, 12 nt, Human
auuuuaauaaug

SEQ ID NO: 1642411 - RNA, 17 nt, Human
auuuuaauaaacacucu

SEQ ID NO: 1642412 - RNA, 16 nt, Human
auuuuaauaaacacuc

SEQ ID NO: 1642413 - RNA, 15 nt, Human
auuuuaauaaacacu

SEQ ID NO: 1642414 - RNA, 15 nt, Human
auuuugauguuuuaa

SEQ ID NO: 1642415 - RNA, 17 nt, Human
auuuugauguuuuaagg

SEQ ID NO: 1642416 - RNA, 19 nt, Human
auuuugauccaagcugguc

SEQ ID NO: 1642417 - RNA, 20 nt, Human
auuuugcuaaaugugaauga

SEQ ID NO: 1642418 - RNA, 21 nt, Human
auuuugcugucccuuuuccuu

SEQ ID NO: 1642419 - RNA, 18 nt, Human
auuuugccagugggaacu

SEQ ID NO: 1642420 - RNA, 21 nt, Human
auugauuuccguuaaaauacc

SEQ ID NO: 1642421 - RNA, 18 nt, Human
auugacuuuuuauggcac

SEQ ID NO: 1642422 - RNA, 13 nt, Human
auugacuuuuuau

SEQ ID NO: 1642423 - RNA, 19 nt, Human
auuggagcucgugggacag

SEQ ID NO: 1642424 - RNA, 19 nt, Human
auuggacaguaaaauccac

SEQ ID NO: 1642425 - RNA, 18 nt, Human
auugguaaagaauggaag

SEQ ID NO: 1642426 - RNA, 20 nt, Human
auuggcuuuucugauccagu

SEQ ID NO: 1642427 - RNA, 19 nt, Human
auuggcuuuucugauccag

SEQ ID NO: 1642428 - RNA, 16 nt, Human
auuggcuuuucugauc

SEQ ID NO: 1642429 - RNA, 15 nt, Human
auuggcuuuucugau

SEQ ID NO: 1642430 - RNA, 13 nt, Human
auuggcuuuucug

SEQ ID NO: 1642431 - RNA, 16 nt, Human
auugucaaagugguga

SEQ ID NO: 1642432 - RNA, 23 nt, Human
auugucaaaguggugagaggcau

SEQ ID NO: 1642433 - RNA, 13 nt, Human
auugucuagugaa

SEQ ID NO: 1642434 - RNA, 13 nt, Human
auugugggaaggg

SEQ ID NO: 1642435 - RNA, 14 nt, Human
auugugggaagggg

SEQ ID NO: 1642436 - RNA, 14 nt, Human
auuuaaaagauaca

SEQ ID NO: 1642437 - RNA, 16 nt, Human
auuuaaaagauacagu

SEQ ID NO: 1642438 - RNA, 17 nt, Human
auuuaaaagauacaguu

SEQ ID NO: 1642439 - RNA, 21 nt, Human
auuguuuggggaugagaaagg

SEQ ID NO: 1642440 - RNA, 14 nt, Human
auuuauuuuaauaa

SEQ ID NO: 1642441 - RNA, 14 nt, Human
auuuauuuaaauuu

SEQ ID NO: 1642442 - RNA, 12 nt, Human
auuuauuuaaau

SEQ ID NO: 1642443 - RNA, 19 nt, Human
auuucccaaagcagugcau

SEQ ID NO: 1642444 - RNA, 20 nt, Human
auuucuugagguaaaagcau

SEQ ID NO: 1642445 - RNA, 16 nt, Human
auuugaaaauuuugau

SEQ ID NO: 1642446 - RNA, 18 nt, Human
auuugaaacacuuugcau

SEQ ID NO: 1642447 - RNA, 21 nt, Human
auuugacauagucuggcugua

SEQ ID NO: 1642448 - RNA, 17 nt, Human
auuugacauagucuggc

SEQ ID NO: 1642449 - RNA, 16 nt, Human
auuugacauagucugg

SEQ ID NO: 1642450 - RNA, 23 nt, Human
auuucuuccacaagagcccaggc

SEQ ID NO: 1642451 - RNA, 20 nt, Human
auuucuuccacaagagccca

SEQ ID NO: 1642452 - RNA, 23 nt, Human
auuucuaggacugaauuaugaaa

SEQ ID NO: 1642453 - RNA, 20 nt, Human
auuucuaggacugaauuaug

SEQ ID NO: 1642454 - RNA, 18 nt, Human
auuucuaggacugaauua

SEQ ID NO: 1642455 - RNA, 17 nt, Human
auuucuaggacugaauu

SEQ ID NO: 1642456 - RNA, 16 nt, Human
auuuuaaaagaaugau

SEQ ID NO: 1642457 - RNA, 22 nt, Human
auuuuaaaaauacagauagaua

SEQ ID NO: 1642458 - RNA, 23 nt, Human
auuugugaagguggaaauaaacu

SEQ ID NO: 1642459 - RNA, 23 nt, Human
auuugugaaaugauggugaaagu

SEQ ID NO: 1642460 - RNA, 21 nt, Human
auuugugaagguggaaauaaa

SEQ ID NO: 1642461 - RNA, 18 nt, Human
auuugugaagguggaaau

SEQ ID NO: 1642462 - RNA, 23 nt, Human
auuuuaaaagaaugauuaugaau

SEQ ID NO: 1642463 - RNA, 15 nt, Human
auuuguauaaaauaa

SEQ ID NO: 1642464 - RNA, 14 nt, Human
auuuguauaaaaua

SEQ ID NO: 1642465 - RNA, 22 nt, Human
auuuguaguguuggagaagaac

SEQ ID NO: 1642466 - RNA, 22 nt, Human
cacagcaguugaaaagacucca

SEQ ID NO: 1642467 - RNA, 18 nt, Human
cacagaugggugcuugga

SEQ ID NO: 1642468 - RNA, 14 nt, Human
cacagaugggugcu

SEQ ID NO: 1642469 - RNA, 20 nt, Human
cacagaguuguuacauuuuu

SEQ ID NO: 1642470 - RNA, 21 nt, Human
cacagaguuguuacauuuuua

SEQ ID NO: 1642471 - RNA, 20 nt, Human
cacagaugggugcuuggagg

SEQ ID NO: 1642472 - RNA, 20 nt, Human
cacagcacgggggccaagga

SEQ ID NO: 1642473 - RNA, 16 nt, Human
cacagcagccccugca

SEQ ID NO: 1642474 - RNA, 23 nt, Human
cacagaugggugcuuggaggaag

SEQ ID NO: 1642475 - RNA, 17 nt, Human
cacauacacacacacgc

SEQ ID NO: 1642476 - RNA, 14 nt, Human
cacaguuuucugag

SEQ ID NO: 1642477 - RNA, 15 nt, Human
cacaguuuucugaga

SEQ ID NO: 1642478 - RNA, 22 nt, Human
cacauaauucaggaagcagcuu

SEQ ID NO: 1642479 - RNA, 23 nt, Human
cacaggcccggcuccaggcuccu

SEQ ID NO: 1642480 - RNA, 20 nt, Human
cacaggcccggcuccaggcu

SEQ ID NO: 1642481 - RNA, 18 nt, Human
cacagugagucgaggaca

SEQ ID NO: 1642482 - RNA, 15 nt, Human
cacaggcccuuccuc

SEQ ID NO: 1642483 - RNA, 20 nt, Human
cacagugagucgaggacagg

SEQ ID NO: 1642484 - RNA, 19 nt, Human
cacagugagucgaggacag

SEQ ID NO: 1642485 - RNA, 15 nt, Human
cacaggaaguagagg

SEQ ID NO: 1642486 - RNA, 20 nt, Human
cacaggaaccacaagacugc

SEQ ID NO: 1642487 - RNA, 19 nt, Human
cacaggaaccacaagacug

SEQ ID NO: 1642488 - RNA, 16 nt, Human
cacaggaucagucuga

SEQ ID NO: 1642489 - RNA, 15 nt, Human
cacaggaucagucug

SEQ ID NO: 1642490 - RNA, 12 nt, Human
cacaggaucagu

SEQ ID NO: 1642491 - RNA, 19 nt, Human
cacaggcccggcuccaggc

SEQ ID NO: 1642492 - RNA, 18 nt, Human
cacaggcccggcuccagg

SEQ ID NO: 1642493 - RNA, 17 nt, Human
cacaggcccggcuccag

SEQ ID NO: 1642494 - RNA, 16 nt, Human
cacaggcccggcucca

SEQ ID NO: 1642495 - RNA, 10 nt, Human
cacaggcagg

SEQ ID NO: 1642496 - RNA, 17 nt, Human
cacaggaucagucugau

SEQ ID NO: 1642497 - RNA, 21 nt, Human
cacagugagucgaggacaggg

SEQ ID NO: 1642498 - RNA, 19 nt, Human
caccacuacauucuguuaa

SEQ ID NO: 1642499 - RNA, 20 nt, Human
caccacuacauucuguuaau

SEQ ID NO: 1642500 - RNA, 14 nt, Human
caccaccucuuugg

SEQ ID NO: 1642501 - RNA, 16 nt, Human
caccacuacauucugu

SEQ ID NO: 1642502 - RNA, 17 nt, Human
caccacuacauucuguu

SEQ ID NO: 1642503 - RNA, 18 nt, Human
caccacuacauucuguua

SEQ ID NO: 1642504 - RNA, 18 nt, Human
caccacaugugcacaugc

SEQ ID NO: 1642505 - RNA, 15 nt, Human
caccacaugugcaca

SEQ ID NO: 1642506 - RNA, 19 nt, Human
caccacaugugcacaugca

SEQ ID NO: 1642507 - RNA, 17 nt, Human
caccacacccagcccac

SEQ ID NO: 1642508 - RNA, 15 nt, Human
caccacacccagccc

SEQ ID NO: 1642509 - RNA, 13 nt, Human
caccacacccagc

SEQ ID NO: 1642510 - RNA, 17 nt, Human
cacauuggaaacaaguc

SEQ ID NO: 1642511 - RNA, 18 nt, Human
cacauuggagauguuuag

SEQ ID NO: 1642512 - RNA, 20 nt, Human
cacauugguguuguacucaa

SEQ ID NO: 1642513 - RNA, 18 nt, Human
cacaugccucucucaggc

SEQ ID NO: 1642514 - RNA, 17 nt, Human
cacaugccucucucagg

SEQ ID NO: 1642515 - RNA, 13 nt, Human
cacaugccucucu

SEQ ID NO: 1642516 - RNA, 19 nt, Human
cacaucagcacgauuucug

SEQ ID NO: 1642517 - RNA, 14 nt, Human
cacauaucugucau

SEQ ID NO: 1642518 - RNA, 12 nt, Human
cacauaucuguc

SEQ ID NO: 1642519 - RNA, 18 nt, Human
cacaucagcacgauuucu

SEQ ID NO: 1642520 - RNA, 19 nt, Human
cacaugccucucucaggcc

SEQ ID NO: 1642521 - RNA, 15 nt, Human
cacaugugcacaugc

SEQ ID NO: 1642522 - RNA, 14 nt, Human
cacaugugcacaug

SEQ ID NO: 1642523 - RNA, 17 nt, Human
cacaugugcacaugcac

SEQ ID NO: 1642524 - RNA, 13 nt, Human
cacauguggacuu

SEQ ID NO: 1642525 - RNA, 16 nt, Human
cacauuccugaugcuu

SEQ ID NO: 1642526 - RNA, 16 nt, Human
cacauuccugaacagg

SEQ ID NO: 1642527 - RNA, 13 nt, Human
cacaacuauauug

SEQ ID NO: 1642528 - RNA, 14 nt, Human
cacacaccagagcc

SEQ ID NO: 1642529 - RNA, 12 nt, Human
cacacagcucug

SEQ ID NO: 1642530 - RNA, 21 nt, Human
cacacagaggcugccucuccc

SEQ ID NO: 1642531 - RNA, 19 nt, Human
cacacagaggcugccucuc

SEQ ID NO: 1642532 - RNA, 17 nt, Human
cacaccgggcacucaga

SEQ ID NO: 1642533 - RNA, 14 nt, Human
cacacccuguuuua

SEQ ID NO: 1642534 - RNA, 13 nt, Human
cacaccagagccc

SEQ ID NO: 1642535 - RNA, 12 nt, Human
cacaccagagcc

SEQ ID NO: 1642536 - RNA, 15 nt, Human
cacaccagagcccac

SEQ ID NO: 1642537 - RNA, 13 nt, Human
cacacccagccca

SEQ ID NO: 1642538 - RNA, 19 nt, Human
cacacucaaaucaagaaac

SEQ ID NO: 1642539 - RNA, 17 nt, Human
cacacuucaggcucuuc

SEQ ID NO: 1642540 - RNA, 14 nt, Human
cacacuucaggcuc

SEQ ID NO: 1642541 - RNA, 22 nt, Human
cacacuucaggcucuucuccuu

SEQ ID NO: 1642542 - RNA, 21 nt, Human
cacacuucaggcucuucuccu

SEQ ID NO: 1642543 - RNA, 20 nt, Human
cacacuucaggcucuucucc

SEQ ID NO: 1642544 - RNA, 18 nt, Human
cacacuucaggcucuucu

SEQ ID NO: 1642545 - RNA, 16 nt, Human
cacagaguuguuacau

SEQ ID NO: 1642546 - RNA, 17 nt, Human
cacagaguuguuacauu

SEQ ID NO: 1642547 - RNA, 12 nt, Human
cacagagaaagu

SEQ ID NO: 1642548 - RNA, 21 nt, Human
cacacuugacaucaacugcau

SEQ ID NO: 1642549 - RNA, 11 nt, Human
cacaacagauu

SEQ ID NO: 1642550 - RNA, 21 nt, Human
cacaaauucugucucuggauu

SEQ ID NO: 1642551 - RNA, 22 nt, Human
cacaacacacagauuugagcuc

SEQ ID NO: 1642552 - RNA, 23 nt, Human
cacaaccuucuguggcucacaga

SEQ ID NO: 1642553 - RNA, 19 nt, Human
cacaaccuucuguggcuca

SEQ ID NO: 1642554 - RNA, 18 nt, Human
cacaaccuucuguggcuc

SEQ ID NO: 1642555 - RNA, 17 nt, Human
cacaaccuucuguggcu

SEQ ID NO: 1642556 - RNA, 18 nt, Human
cacaaaaguuucucuuuu

SEQ ID NO: 1642557 - RNA, 16 nt, Human
cacaaaaguuucucuu

SEQ ID NO: 1642558 - RNA, 22 nt, Human
caaugaaugaaugaauggcuaa

SEQ ID NO: 1642559 - RNA, 13 nt, Human
caaugaccuuuca

SEQ ID NO: 1642560 - RNA, 18 nt, Human
caaugcaaaccaucauug

SEQ ID NO: 1642561 - RNA, 17 nt, Human
caaugcaaaccaucauu

SEQ ID NO: 1642562 - RNA, 20 nt, Human
caaugcaaaccaucauugaa

SEQ ID NO: 1642563 - RNA, 19 nt, Human
caaugcaaaccaucauuga

SEQ ID NO: 1642564 - RNA, 23 nt, Human
caaugcacuuuguucuggcucuu

SEQ ID NO: 1642565 - RNA, 20 nt, Human
caauaggaaaaacugauuuu

SEQ ID NO: 1642566 - RNA, 21 nt, Human
caauaggaaaaacugauuuuu

SEQ ID NO: 1642567 - RNA, 19 nt, Human
caaugugaaaagaaaaaug

SEQ ID NO: 1642568 - RNA, 12 nt, Human
caacuuuguaua

SEQ ID NO: 1642569 - RNA, 11 nt, Human
caacuuuguau

SEQ ID NO: 1642570 - RNA, 20 nt, Human
caacucuccuccagagucag

SEQ ID NO: 1642571 - RNA, 21 nt, Human
caacucugaaggguaauuaua

SEQ ID NO: 1642572 - RNA, 15 nt, Human
caacccucaucacca

SEQ ID NO: 1642573 - RNA, 12 nt, Human
caacccucauca

SEQ ID NO: 1642574 - RNA, 16 nt, Human
caaccugauugugucu

SEQ ID NO: 1642575 - RNA, 19 nt, Human
caacucuccuccagaguca

SEQ ID NO: 1642576 - RNA, 18 nt, Human
caacgcagcccugcuuug

SEQ ID NO: 1642577 - RNA, 15 nt, Human
caacgcagcccugcu

SEQ ID NO: 1642578 - RNA, 13 nt, Human
caacgcagcccug

SEQ ID NO: 1642579 - RNA, 12 nt, Human
caacgcagcccu

SEQ ID NO: 1642580 - RNA, 15 nt, Human
caaauuuacagagac

SEQ ID NO: 1642581 - RNA, 23 nt, Human
caacaggcugggcuucaguggca

SEQ ID NO: 1642582 - RNA, 16 nt, Human
caaauuuacagagaca

SEQ ID NO: 1642583 - RNA, 24 nt, Human
caacaggcugggcuucaguggcag

SEQ ID NO: 1642584 - RNA, 14 nt, Human
caaauuuacagaga

SEQ ID NO: 1642585 - RNA, 18 nt, Human
caaauucugucucuggau

SEQ ID NO: 1642586 - RNA, 15 nt, Human
caaauucugucucug

SEQ ID NO: 1642587 - RNA, 15 nt, Human
caacagguuuuccug

SEQ ID NO: 1642588 - RNA, 18 nt, Human
caacaggguuuuuuucca

SEQ ID NO: 1642589 - RNA, 19 nt, Human
caacagguuuuccugaaga

SEQ ID NO: 1642590 - RNA, 22 nt, Human
caacaucuuggucagauuugaa

SEQ ID NO: 1642591 - RNA, 19 nt, Human
caaccccuucgcuccugug

SEQ ID NO: 1642592 - RNA, 18 nt, Human
caaccccuucgcuccugu

SEQ ID NO: 1642593 - RNA, 21 nt, Human
caaccccuucgcuccuguguc

SEQ ID NO: 1642594 - RNA, 22 nt, Human
caaccccuucgcuccugugucu

SEQ ID NO: 1642595 - RNA, 21 nt, Human
caacccucagagccaccccua

SEQ ID NO: 1642596 - RNA, 22 nt, Human
caagccaccaacauacucccau

SEQ ID NO: 1642597 - RNA, 17 nt, Human
caagcacuaaacaaaga

SEQ ID NO: 1642598 - RNA, 16 nt, Human
caagcgugagccacug

SEQ ID NO: 1642599 - RNA, 17 nt, Human
caagccguggcuucccg

SEQ ID NO: 1642600 - RNA, 16 nt, Human
caagccguggcuuccc

SEQ ID NO: 1642601 - RNA, 15 nt, Human
caagccguggcuucc

SEQ ID NO: 1642602 - RNA, 14 nt, Human
caagccguggcuuc

SEQ ID NO: 1642603 - RNA, 21 nt, Human
caagccaccaacauacuccca

SEQ ID NO: 1642604 - RNA, 18 nt, Human
caagcgugagccacugca

SEQ ID NO: 1642605 - RNA, 17 nt, Human
caagcgugagccacugc

SEQ ID NO: 1642606 - RNA, 21 nt, Human
caaggaugaucuaggaagacu

SEQ ID NO: 1642607 - RNA, 19 nt, Human
caaggaugccccguccccc

SEQ ID NO: 1642608 - RNA, 13 nt, Human
caaggauccugag

SEQ ID NO: 1642609 - RNA, 14 nt, Human
caaggacuaggguc

SEQ ID NO: 1642610 - RNA, 23 nt, Human
caaggugggaggauugcuugagc

SEQ ID NO: 1642611 - RNA, 12 nt, Human
caaggugggagg

SEQ ID NO: 1642612 - RNA, 19 nt, Human
caagggccuggccugagcu

SEQ ID NO: 1642613 - RNA, 19 nt, Human
caaggauugcuacuguccu

SEQ ID NO: 1642614 - RNA, 15 nt, Human
caaggauugcuacug

SEQ ID NO: 1642615 - RNA, 17 nt, Human
caagugauucuccugcc

SEQ ID NO: 1642616 - RNA, 16 nt, Human
caagugauucuccugc

SEQ ID NO: 1642617 - RNA, 19 nt, Human
caagugaaaaaggaggaag

SEQ ID NO: 1642618 - RNA, 22 nt, Human
caagugauucucaugccucagc

SEQ ID NO: 1642619 - RNA, 22 nt, Human
caagugugguagagugugccug

SEQ ID NO: 1642620 - RNA, 22 nt, Human
caagugauucuccugccucagc

SEQ ID NO: 1642621 - RNA, 18 nt, Human
caagugauucuccugccu

SEQ ID NO: 1642622 - RNA, 18 nt, Human
auuuuuuuacuaauagac

SEQ ID NO: 1642623 - RNA, 18 nt, Human
caaagcuaggccuggcca

SEQ ID NO: 1642624 - RNA, 17 nt, Human
caaagcuaggccuggcc

SEQ ID NO: 1642625 - RNA, 16 nt, Human
caaagcuaggccuggc

SEQ ID NO: 1642626 - RNA, 22 nt, Human
caaagccaaagcuaggccuggc

SEQ ID NO: 1642627 - RNA, 21 nt, Human
caaagccaaagcuaggccugg

SEQ ID NO: 1642628 - RNA, 20 nt, Human
caaagccaaagcuaggccug

SEQ ID NO: 1642629 - RNA, 16 nt, Human
caaagcuuguuaagau

SEQ ID NO: 1642630 - RNA, 21 nt, Human
caaauguucaucaaugaauga

SEQ ID NO: 1642631 - RNA, 14 nt, Human
caaauguggcuccu

SEQ ID NO: 1642632 - RNA, 22 nt, Human
caaauucugcuugcuugcuuuu

SEQ ID NO: 1642633 - RNA, 17 nt, Human
caaauaugcaaagcacu

SEQ ID NO: 1642634 - RNA, 16 nt, Human
caaauaugcaaagcac

SEQ ID NO: 1642635 - RNA, 18 nt, Human
caaauaugcaaagcacug

SEQ ID NO: 1642636 - RNA, 16 nt, Human
caaaucagcugcuacu

SEQ ID NO: 1642637 - RNA, 18 nt, Human
caaaugucuuccuggauu

SEQ ID NO: 1642638 - RNA, 15 nt, Human
caaaugucuuccugg

SEQ ID NO: 1642639 - RNA, 13 nt, Human
caaaucagcugcu

SEQ ID NO: 1642640 - RNA, 21 nt, Human
caaaggaugcccaaagaugca

SEQ ID NO: 1642641 - RNA, 19 nt, Human
caaaguugccuaaauccau

SEQ ID NO: 1642642 - RNA, 12 nt, Human
caaauauauuca

SEQ ID NO: 1642643 - RNA, 22 nt, Human
cacccccacccaagggccuggc

SEQ ID NO: 1642644 - RNA, 17 nt, Human
caccccggccaccugcg

SEQ ID NO: 1642645 - RNA, 16 nt, Human
caccccggccaccugc

SEQ ID NO: 1642646 - RNA, 15 nt, Human
caccccggccaccug

SEQ ID NO: 1642647 - RNA, 14 nt, Human
caccccggccaccu

SEQ ID NO: 1642648 - RNA, 14 nt, Human
caccccuaaagaga

SEQ ID NO: 1642649 - RNA, 13 nt, Human
caccccagcccca

SEQ ID NO: 1642650 - RNA, 16 nt, Human
cacccaccucagccuc

SEQ ID NO: 1642651 - RNA, 14 nt, Human
cacccaccucagcc

SEQ ID NO: 1642652 - RNA, 13 nt, Human
cacccaccucagc

SEQ ID NO: 1642653 - RNA, 12 nt, Human
cacccaccucag

SEQ ID NO: 1642654 - RNA, 22 nt, Human
cacccaccaucaugucuggcua

SEQ ID NO: 1642655 - RNA, 20 nt, Human
cacccaccaucaugucuggc

SEQ ID NO: 1642656 - RNA, 15 nt, Human
cacccacccuuuuuu

SEQ ID NO: 1642657 - RNA, 18 nt, Human
cacccaagggccuggccu

SEQ ID NO: 1642658 - RNA, 17 nt, Human
cacccaagggccuggcc

SEQ ID NO: 1642659 - RNA, 16 nt, Human
cacccaagggccuggc

SEQ ID NO: 1642660 - RNA, 23 nt, Human
cacccaagggccuggccugagcu

SEQ ID NO: 1642661 - RNA, 21 nt, Human
cacccaagggccuggccugag

SEQ ID NO: 1642662 - RNA, 20 nt, Human
cacccaagggccuggccuga

SEQ ID NO: 1642663 - RNA, 19 nt, Human
cacccaagggccuggccug

SEQ ID NO: 1642664 - RNA, 15 nt, Human
caccccuaaagagau

SEQ ID NO: 1642665 - RNA, 23 nt, Human
ccaguaaaugggggugcauuuga

SEQ ID NO: 1642666 - RNA, 13 nt, Human
ccagugaggcucu

SEQ ID NO: 1642667 - RNA, 13 nt, Human
ccaggugccaguu

SEQ ID NO: 1642668 - RNA, 12 nt, Human
ccaggugccagu

SEQ ID NO: 1642669 - RNA, 21 nt, Human
ccagguggccacuccagaccc

SEQ ID NO: 1642670 - RNA, 16 nt, Human
ccagguggccacucca

SEQ ID NO: 1642671 - RNA, 16 nt, Human
ccagguuucuaugugu

SEQ ID NO: 1642672 - RNA, 13 nt, Human
ccagguuuaagcu

SEQ ID NO: 1642673 - RNA, 20 nt, Human
ccaguaaaugggggugcauu

SEQ ID NO: 1642674 - RNA, 21 nt, Human
ccaguaaaugggggugcauuu

SEQ ID NO: 1642675 - RNA, 22 nt, Human
ccaguaaaugggggugcauuug

SEQ ID NO: 1642676 - RNA, 18 nt, Human
ccauccugaggcuccacu

SEQ ID NO: 1642677 - RNA, 17 nt, Human
ccaucauugaaaucuuu

SEQ ID NO: 1642678 - RNA, 16 nt, Human
ccaucauugaaaucuu

SEQ ID NO: 1642679 - RNA, 14 nt, Human
ccaucauugaaauc

SEQ ID NO: 1642680 - RNA, 20 nt, Human
ccauccugaggcuccacuug

SEQ ID NO: 1642681 - RNA, 15 nt, Human
ccaucucuccuccuu

SEQ ID NO: 1642682 - RNA, 17 nt, Human
ccaucucaccuccugcu

SEQ ID NO: 1642683 - RNA, 21 nt, Human
ccaucucacacaugagcauca

SEQ ID NO: 1642684 - RNA, 20 nt, Human
ccaucucacacaugagcauc

SEQ ID NO: 1642685 - RNA, 18 nt, Human
ccaucucacacaugagca

SEQ ID NO: 1642686 - RNA, 17 nt, Human
ccaucucacacaugagc

SEQ ID NO: 1642687 - RNA, 15 nt, Human
ccaucucacacauga

SEQ ID NO: 1642688 - RNA, 14 nt, Human
ccaucucacacaug

SEQ ID NO: 1642689 - RNA, 23 nt, Human
ccagugugacaaggauugcuacu

SEQ ID NO: 1642690 - RNA, 14 nt, Human
ccagugugacaagg

SEQ ID NO: 1642691 - RNA, 13 nt, Human
ccauaugccuggg

SEQ ID NO: 1642692 - RNA, 15 nt, Human
ccauaugccugggca

SEQ ID NO: 1642693 - RNA, 12 nt, Human
ccaucauugaaa

SEQ ID NO: 1642694 - RNA, 13 nt, Human
ccaucaugucugg

SEQ ID NO: 1642695 - RNA, 12 nt, Human
ccaucaugucug

SEQ ID NO: 1642696 - RNA, 14 nt, Human
ccaucaagccacca

SEQ ID NO: 1642697 - RNA, 13 nt, Human
ccaucaagccacc

SEQ ID NO: 1642698 - RNA, 16 nt, Human
ccaucaagccaccaac

SEQ ID NO: 1642699 - RNA, 19 nt, Human
ccauauuaccacagacaua

SEQ ID NO: 1642700 - RNA, 18 nt, Human
ccaucucaccuccugcug

SEQ ID NO: 1642701 - RNA, 20 nt, Human
ccagguagaggguguguaag

SEQ ID NO: 1642702 - RNA, 23 nt, Human
ccagugcccacaggaucagucug

SEQ ID NO: 1642703 - RNA, 20 nt, Human
ccaggaggccagccuugacc

SEQ ID NO: 1642704 - RNA, 18 nt, Human
ccaggaggccagccuuga

SEQ ID NO: 1642705 - RNA, 15 nt, Human
ccaggaggccagccu

SEQ ID NO: 1642706 - RNA, 16 nt, Human
ccaggccccugccacc

SEQ ID NO: 1642707 - RNA, 15 nt, Human
ccaggccccugccac

SEQ ID NO: 1642708 - RNA, 14 nt, Human
ccaggccccugcca

SEQ ID NO: 1642709 - RNA, 12 nt, Human
ccaggccagagg

SEQ ID NO: 1642710 - RNA, 14 nt, Human
ccaggcccucugcc

SEQ ID NO: 1642711 - RNA, 13 nt, Human
ccaggcccucugc

SEQ ID NO: 1642712 - RNA, 19 nt, Human
ccaggccccugccacccug

SEQ ID NO: 1642713 - RNA, 23 nt, Human
ccaggcuuagucacugagacagc

SEQ ID NO: 1642714 - RNA, 22 nt, Human
ccaggcuuagucacugagacag

SEQ ID NO: 1642715 - RNA, 21 nt, Human
ccaggcuuagucacugagaca

SEQ ID NO: 1642716 - RNA, 14 nt, Human
ccaggcuggucuca
